United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 64

SEQ ID NO: 2286784 - RNA, 17 nt, Yersinia pestis
ccuguuacaucagagcu

SEQ ID NO: 2286785 - RNA, 15 nt, Yersinia pestis
ccuguuaauaauuca

SEQ ID NO: 2286786 - RNA, 20 nt, Yersinia pestis
ccuguguuuugagcaucacu

SEQ ID NO: 2286787 - RNA, 22 nt, Yersinia pestis
ccuguguuuugagcaucacuuc

SEQ ID NO: 2286788 - RNA, 19 nt, Yersinia pestis
ccuguggggcuacuuuuuu

SEQ ID NO: 2286789 - RNA, 22 nt, Yersinia pestis
ccuguggggcuacuuuuuucac

SEQ ID NO: 2286790 - RNA, 13 nt, Yersinia pestis
ccuguauaaaaau

SEQ ID NO: 2286791 - RNA, 13 nt, Yersinia pestis
ccuguaaaacaag

SEQ ID NO: 2286792 - RNA, 20 nt, Yersinia pestis
ccugguuuuuuaaaaaagug

SEQ ID NO: 2286793 - RNA, 16 nt, Yersinia pestis
ccugucaccuaccacc

SEQ ID NO: 2286794 - RNA, 13 nt, Yersinia pestis
ccugucaccuguc

SEQ ID NO: 2286795 - RNA, 17 nt, Yersinia pestis
ccugucaccugucaccu

SEQ ID NO: 2286796 - RNA, 15 nt, Yersinia pestis
ccuguauuuccugua

SEQ ID NO: 2286797 - RNA, 17 nt, Yersinia pestis
ccugucccuaucauuca

SEQ ID NO: 2286798 - RNA, 13 nt, Yersinia pestis
ccugcugcaccuc

SEQ ID NO: 2286799 - RNA, 13 nt, Yersinia pestis
ccugcucuucugg

SEQ ID NO: 2286800 - RNA, 19 nt, Yersinia pestis
ccugcugaaaaaugaguca

SEQ ID NO: 2286801 - RNA, 17 nt, Yersinia pestis
ccugcugcaccucugcu

SEQ ID NO: 2286802 - RNA, 18 nt, Yersinia pestis
ccuucaucgacaauggcu

SEQ ID NO: 2286803 - RNA, 18 nt, Yersinia pestis
ccuucauuugacuuuguc

SEQ ID NO: 2286804 - RNA, 21 nt, Yersinia pestis
ccuuauaaauccgcuaguuaa

SEQ ID NO: 2286805 - RNA, 21 nt, Yersinia pestis
ccuuagcgccaucgcuaauca

SEQ ID NO: 2286806 - RNA, 14 nt, Yersinia pestis
ccuuacuauuuuca

SEQ ID NO: 2286807 - RNA, 17 nt, Yersinia pestis
ccuuaacgccccgcccc

SEQ ID NO: 2286808 - RNA, 22 nt, Yersinia pestis
ccuuaacggucagauccacauu

SEQ ID NO: 2286809 - RNA, 16 nt, Yersinia pestis
ccuuaacugcauagcu

SEQ ID NO: 2286810 - RNA, 21 nt, Yersinia pestis
ccuuaaccaacaugagccaca

SEQ ID NO: 2286811 - RNA, 20 nt, Yersinia pestis
ccuucgguauauuucccguu

SEQ ID NO: 2286812 - RNA, 22 nt, Yersinia pestis
ccuucguuaaacauuauuuuuc

SEQ ID NO: 2286813 - RNA, 22 nt, Yersinia pestis
ccuucgggcuugguguugcaaa

SEQ ID NO: 2286814 - RNA, 20 nt, Yersinia pestis
ccuucccuacagaaaaauaa

SEQ ID NO: 2286815 - RNA, 19 nt, Yersinia pestis
ccuugauuaauaacaguaa

SEQ ID NO: 2286816 - RNA, 20 nt, Yersinia pestis
ccuugauggaaauacgcuua

SEQ ID NO: 2286817 - RNA, 22 nt, Yersinia pestis
ccuugaugguucagccaccauu

SEQ ID NO: 2286818 - RNA, 14 nt, Yersinia pestis
ccuugauucacuga

SEQ ID NO: 2286819 - RNA, 14 nt, Yersinia pestis
ccuugauccgccaa

SEQ ID NO: 2286820 - RNA, 14 nt, Yersinia pestis
ccuugaucgccaaa

SEQ ID NO: 2286821 - RNA, 14 nt, Yersinia pestis
ccuugaguauccaa

SEQ ID NO: 2286822 - RNA, 17 nt, Yersinia pestis
ccuucucucuaccgauc

SEQ ID NO: 2286823 - RNA, 15 nt, Yersinia pestis
ccuugcgccaagucc

SEQ ID NO: 2286824 - RNA, 20 nt, Yersinia pestis
ccuuggcugccagugccgcc

SEQ ID NO: 2286825 - RNA, 23 nt, Yersinia pestis
ccuuuuugaaucaagcauucagc

SEQ ID NO: 2286826 - RNA, 12 nt, Yersinia pestis
cgaaaagcagca

SEQ ID NO: 2286827 - RNA, 13 nt, Yersinia pestis
cgaaaagcagcag

SEQ ID NO: 2286828 - RNA, 12 nt, Yersinia pestis
cgaaaacucaaa

SEQ ID NO: 2286829 - RNA, 13 nt, Yersinia pestis
ccuuugacagcau

SEQ ID NO: 2286830 - RNA, 21 nt, Yersinia pestis
ccuuuguuguuaccaaaaccg

SEQ ID NO: 2286831 - RNA, 19 nt, Yersinia pestis
ccuuuuccgucagcccaac

SEQ ID NO: 2286832 - RNA, 20 nt, Yersinia pestis
ccuuuuacaccacuaguuaa

SEQ ID NO: 2286833 - RNA, 15 nt, Yersinia pestis
ccuuggggccucacu

SEQ ID NO: 2286834 - RNA, 11 nt, Yersinia pestis
ccuuucugggc

SEQ ID NO: 2286835 - RNA, 15 nt, Yersinia pestis
cgaaaggaacaaaag

SEQ ID NO: 2286836 - RNA, 16 nt, Yersinia pestis
cgaaaucacccggcca

SEQ ID NO: 2286837 - RNA, 15 nt, Yersinia pestis
cgaaauaaaaccauc

SEQ ID NO: 2286838 - RNA, 18 nt, Yersinia pestis
cgaaauacuuaucuguuu

SEQ ID NO: 2286839 - RNA, 23 nt, Yersinia pestis
cgaaaguuaaacaauguuaaacu

SEQ ID NO: 2286840 - RNA, 19 nt, Yersinia pestis
cgaaaucgauggauguucc

SEQ ID NO: 2286841 - RNA, 15 nt, Yersinia pestis
cgaaauuaaggaaaa

SEQ ID NO: 2286842 - RNA, 14 nt, Yersinia pestis
cgaaagaaauaaaa

SEQ ID NO: 2286843 - RNA, 16 nt, Yersinia pestis
cgaaacugaucacugg

SEQ ID NO: 2286844 - RNA, 18 nt, Yersinia pestis
cgaaagaaauaaaagaaa

SEQ ID NO: 2286845 - RNA, 15 nt, Yersinia pestis
cgaaagauagcaaaa

SEQ ID NO: 2286846 - RNA, 17 nt, Yersinia pestis
cgaaacacauacaaaua

SEQ ID NO: 2286847 - RNA, 14 nt, Yersinia pestis
cgaagagugcauug

SEQ ID NO: 2286848 - RNA, 13 nt, Yersinia pestis
cgaagcgccccug

SEQ ID NO: 2286849 - RNA, 23 nt, Yersinia pestis
cgaacggauagcgcuucagugau

SEQ ID NO: 2286850 - RNA, 23 nt, Yersinia pestis
cgaauaagcucugggacgugcau

SEQ ID NO: 2286851 - RNA, 17 nt, Yersinia pestis
cgaagggcgcagccccc

SEQ ID NO: 2286852 - RNA, 18 nt, Yersinia pestis
cgaaauuuaagaaaucua

SEQ ID NO: 2286853 - RNA, 15 nt, Yersinia pestis
ccucccgcuaacgca

SEQ ID NO: 2286854 - RNA, 19 nt, Yersinia pestis
ccuccgauucauaguccaa

SEQ ID NO: 2286855 - RNA, 17 nt, Yersinia pestis
ccucauucgggcauucc

SEQ ID NO: 2286856 - RNA, 20 nt, Yersinia pestis
ccucauuggucgcugggccu

SEQ ID NO: 2286857 - RNA, 17 nt, Yersinia pestis
ccucauucaugaggcuu

SEQ ID NO: 2286858 - RNA, 18 nt, Yersinia pestis
ccucauucaugaggcuuc

SEQ ID NO: 2286859 - RNA, 19 nt, Yersinia pestis
ccucauuaaucagcauuaa

SEQ ID NO: 2286860 - RNA, 15 nt, Yersinia pestis
aaacgccuccaguga

SEQ ID NO: 2286861 - RNA, 18 nt, Yersinia pestis
aaacgccgcgucaauaac

SEQ ID NO: 2286862 - RNA, 20 nt, Yersinia pestis
aaacgccugauccaacaucg

SEQ ID NO: 2286863 - RNA, 14 nt, Yersinia pestis
aaacgccucguuua

SEQ ID NO: 2286864 - RNA, 22 nt, Yersinia pestis
aaacgccucguuuaacucaaau

SEQ ID NO: 2286865 - RNA, 18 nt, Yersinia pestis
ccucaugauuuguugaug

SEQ ID NO: 2286866 - RNA, 21 nt, Yersinia pestis
aaacgccagauaugaucaaaa

SEQ ID NO: 2286867 - RNA, 22 nt, Yersinia pestis
ccuaucugcucuugcucaguaa

SEQ ID NO: 2286868 - RNA, 13 nt, Yersinia pestis
ccuaucgccgccg

SEQ ID NO: 2286869 - RNA, 22 nt, Yersinia pestis
ccuaucgguaucucccgcaaag

SEQ ID NO: 2286870 - RNA, 22 nt, Yersinia pestis
ccuaucuauuuuuauuucuccu

SEQ ID NO: 2286871 - RNA, 15 nt, Yersinia pestis
ccuaucgucacagca

SEQ ID NO: 2286872 - RNA, 22 nt, Yersinia pestis
ccuaucgucagugcgguaacca

SEQ ID NO: 2286873 - RNA, 16 nt, Yersinia pestis
ccgugcgggaugacuc

SEQ ID NO: 2286874 - RNA, 18 nt, Yersinia pestis
ccuauucagcagcauuuc

SEQ ID NO: 2286875 - RNA, 19 nt, Yersinia pestis
ccuauucagcagcauuucu

SEQ ID NO: 2286876 - RNA, 18 nt, Yersinia pestis
ccgugauaaaucuuauuu

SEQ ID NO: 2286877 - RNA, 20 nt, Yersinia pestis
ccgugauguucaauucacug

SEQ ID NO: 2286878 - RNA, 15 nt, Yersinia pestis
ccgugcggacugccg

SEQ ID NO: 2286879 - RNA, 17 nt, Yersinia pestis
ccucaacucaaaacaau

SEQ ID NO: 2286880 - RNA, 11 nt, Yersinia pestis
ccucaagaccg

SEQ ID NO: 2286881 - RNA, 15 nt, Yersinia pestis
ccucaccguauacgc

SEQ ID NO: 2286882 - RNA, 21 nt, Yersinia pestis
ccucaaaauucgugcucauca

SEQ ID NO: 2286883 - RNA, 16 nt, Yersinia pestis
ccucaacgcaccccac

SEQ ID NO: 2286884 - RNA, 18 nt, Yersinia pestis
ccucaacgcaccccacaa

SEQ ID NO: 2286885 - RNA, 21 nt, Yersinia pestis
ccucaggcccgcuaucacuag

SEQ ID NO: 2286886 - RNA, 20 nt, Yersinia pestis
ccucaggcccgcuaucacua

SEQ ID NO: 2286887 - RNA, 19 nt, Yersinia pestis
ccucaguaaaacgcuccag

SEQ ID NO: 2286888 - RNA, 16 nt, Yersinia pestis
ccucacgggcuuccau

SEQ ID NO: 2286889 - RNA, 22 nt, Yersinia pestis
ccucacguuuagccaugagguu

SEQ ID NO: 2286890 - RNA, 16 nt, Yersinia pestis
ccucuaacacucuuuc

SEQ ID NO: 2286891 - RNA, 17 nt, Yersinia pestis
ccucuaaggggcgagaa

SEQ ID NO: 2286892 - RNA, 20 nt, Yersinia pestis
ccucguuguuguaugacaag

SEQ ID NO: 2286893 - RNA, 18 nt, Yersinia pestis
ccucguuuaacucaaaua

SEQ ID NO: 2286894 - RNA, 23 nt, Yersinia pestis
ccucguaguuggugauagguuaa

SEQ ID NO: 2286895 - RNA, 21 nt, Yersinia pestis
ccucugcgcuggcguuuuugu

SEQ ID NO: 2286896 - RNA, 17 nt, Yersinia pestis
ccucugccgauuuaaac

SEQ ID NO: 2286897 - RNA, 23 nt, Yersinia pestis
ccucuagcuguauugcccgauca

SEQ ID NO: 2286898 - RNA, 19 nt, Yersinia pestis
ccucuagcuguauugcccg

SEQ ID NO: 2286899 - RNA, 18 nt, Yersinia pestis
ccucccugggggcuagcc

SEQ ID NO: 2286900 - RNA, 14 nt, Yersinia pestis
ccuccguaggccaa

SEQ ID NO: 2286901 - RNA, 18 nt, Yersinia pestis
ccuccugacgaugauaaa

SEQ ID NO: 2286902 - RNA, 14 nt, Yersinia pestis
ccucgcagauccag

SEQ ID NO: 2286903 - RNA, 14 nt, Yersinia pestis
ccugauccaacauc

SEQ ID NO: 2286904 - RNA, 15 nt, Yersinia pestis
ccugauccaguuuca

SEQ ID NO: 2286905 - RNA, 14 nt, Yersinia pestis
ccugauaucaaccu

SEQ ID NO: 2286906 - RNA, 19 nt, Yersinia pestis
ccugaucgauaacccccaa

SEQ ID NO: 2286907 - RNA, 21 nt, Yersinia pestis
ccugaugagagggaguuauuc

SEQ ID NO: 2286908 - RNA, 15 nt, Yersinia pestis
ccugauguuuugcug

SEQ ID NO: 2286909 - RNA, 18 nt, Yersinia pestis
ccugaugccccaugguua

SEQ ID NO: 2286910 - RNA, 19 nt, Yersinia pestis
ccugcaacucgaauuauuu

SEQ ID NO: 2286911 - RNA, 14 nt, Yersinia pestis
ccugcaauuuuuag

SEQ ID NO: 2286912 - RNA, 16 nt, Yersinia pestis
ccugcaauuuuuagcc

SEQ ID NO: 2286913 - RNA, 16 nt, Yersinia pestis
ccugcaauaacaccag

SEQ ID NO: 2286914 - RNA, 18 nt, Yersinia pestis
ccugcagcaacaauaacu

SEQ ID NO: 2286915 - RNA, 21 nt, Yersinia pestis
ccugcauccccggcaucccac

SEQ ID NO: 2286916 - RNA, 15 nt, Yersinia pestis
ccugccgccucugcu

SEQ ID NO: 2286917 - RNA, 15 nt, Yersinia pestis
ccugcguauugcugu

SEQ ID NO: 2286918 - RNA, 13 nt, Yersinia pestis
ccucuuuccaaca

SEQ ID NO: 2286919 - RNA, 14 nt, Yersinia pestis
ccucuuuuaucugu

SEQ ID NO: 2286920 - RNA, 20 nt, Yersinia pestis
ccucuugcgcuccacgcccc

SEQ ID NO: 2286921 - RNA, 13 nt, Yersinia pestis
ccucuucuuccgc

SEQ ID NO: 2286922 - RNA, 20 nt, Yersinia pestis
ccucuucagguaagccuuuc

SEQ ID NO: 2286923 - RNA, 18 nt, Yersinia pestis
ccucuucaucuacagacu

SEQ ID NO: 2286924 - RNA, 11 nt, Yersinia pestis
ccucugcugcu

SEQ ID NO: 2286925 - RNA, 15 nt, Yersinia pestis
ccucugcugcugccc

SEQ ID NO: 2286926 - RNA, 23 nt, Yersinia pestis
ccucuguaaaacgauaguaagcu

SEQ ID NO: 2286927 - RNA, 19 nt, Yersinia pestis
ccugaaauacggaacgcag

SEQ ID NO: 2286928 - RNA, 19 nt, Yersinia pestis
ccugaacgccuugcccugc

SEQ ID NO: 2286929 - RNA, 20 nt, Yersinia pestis
ccugaaagucaggauuggag

SEQ ID NO: 2286930 - RNA, 21 nt, Yersinia pestis
ccugaguuaucuguuucaaau

SEQ ID NO: 2286931 - RNA, 21 nt, Yersinia pestis
ccugaguuaccuugugucacc

SEQ ID NO: 2286932 - RNA, 18 nt, Yersinia pestis
ccugagggugaugacaau

SEQ ID NO: 2286933 - RNA, 17 nt, Yersinia pestis
ccugagucaguaauuca

SEQ ID NO: 2286934 - RNA, 19 nt, Yersinia pestis
ccugagucaguaauucacc

SEQ ID NO: 2286935 - RNA, 15 nt, Yersinia pestis
ccugagucaguaauu

SEQ ID NO: 2286936 - RNA, 19 nt, Yersinia pestis
ccugagaaucaaaaaacag

SEQ ID NO: 2286937 - RNA, 22 nt, Yersinia pestis
ccugagcgaucaauacaccaga

SEQ ID NO: 2286938 - RNA, 15 nt, Yersinia pestis
ccugaggauaaaaac

SEQ ID NO: 2286939 - RNA, 19 nt, Yersinia pestis
ccugaauggaaaaauuagc

SEQ ID NO: 2286940 - RNA, 18 nt, Yersinia pestis
ccugaaucucgcgcccug

SEQ ID NO: 2286941 - RNA, 16 nt, Yersinia pestis
ccugaaucgauaaacc

SEQ ID NO: 2286942 - RNA, 11 nt, Yersinia pestis
ccugacauuug

SEQ ID NO: 2286943 - RNA, 20 nt, Yersinia pestis
ccugacaggcucuuuauacu

SEQ ID NO: 2286944 - RNA, 14 nt, Yersinia pestis
ccugacaggcuuua

SEQ ID NO: 2286945 - RNA, 23 nt, Yersinia pestis
ccugacgaaauuuaagaaaucua

SEQ ID NO: 2286946 - RNA, 15 nt, Yersinia pestis
ccugacgcacagcac

SEQ ID NO: 2286947 - RNA, 14 nt, Yersinia pestis
ccugacggccagca

SEQ ID NO: 2286948 - RNA, 15 nt, Yersinia pestis
ccugacucccugacu

SEQ ID NO: 2286949 - RNA, 23 nt, Yersinia pestis
ccgcguugucagccaugccugcg

SEQ ID NO: 2286950 - RNA, 19 nt, Yersinia pestis
ccgcuauaucaucagcaga

SEQ ID NO: 2286951 - RNA, 13 nt, Yersinia pestis
ccgcuaguuugac

SEQ ID NO: 2286952 - RNA, 18 nt, Yersinia pestis
ccgcuagugauagcgggc

SEQ ID NO: 2286953 - RNA, 11 nt, Yersinia pestis
ccgcuaccaua

SEQ ID NO: 2286954 - RNA, 11 nt, Yersinia pestis
ccgcuccagca

SEQ ID NO: 2286955 - RNA, 14 nt, Yersinia pestis
ccgcuaucugcuga

SEQ ID NO: 2286956 - RNA, 12 nt, Yersinia pestis
ccgcuauuuucu

SEQ ID NO: 2286957 - RNA, 17 nt, Yersinia pestis
ccgcgguuaagcuagcc

SEQ ID NO: 2286958 - RNA, 14 nt, Yersinia pestis
ccgcuugggcgaua

SEQ ID NO: 2286959 - RNA, 19 nt, Yersinia pestis
ccgcuugcuuugcuucauc

SEQ ID NO: 2286960 - RNA, 20 nt, Yersinia pestis
ccgcuucguccagaugccaa

SEQ ID NO: 2286961 - RNA, 14 nt, Yersinia pestis
ccgcugggccgucu

SEQ ID NO: 2286962 - RNA, 18 nt, Yersinia pestis
ccgcuggugcggaacagc

SEQ ID NO: 2286963 - RNA, 20 nt, Yersinia pestis
ccggaaucagcguuuuauuc

SEQ ID NO: 2286964 - RNA, 18 nt, Yersinia pestis
ccggaagagaagcagcgg

SEQ ID NO: 2286965 - RNA, 23 nt, Yersinia pestis
ccggaagagaagcagcgggggau

SEQ ID NO: 2286966 - RNA, 23 nt, Yersinia pestis
ccggagcaagggcgcauccccau

SEQ ID NO: 2286967 - RNA, 24 nt, Yersinia pestis
ccgcugcuaccagcagugcagcca

SEQ ID NO: 2286968 - RNA, 12 nt, Yersinia pestis
ccgcugcccggc

SEQ ID NO: 2286969 - RNA, 21 nt, Yersinia pestis
ccgcugacggcgguauacaga

SEQ ID NO: 2286970 - RNA, 16 nt, Yersinia pestis
ccgccuuccugcaacu

SEQ ID NO: 2286971 - RNA, 18 nt, Yersinia pestis
ccgccuguauccagcagc

SEQ ID NO: 2286972 - RNA, 21 nt, Yersinia pestis
ccgccuguauccagcagcgcu

SEQ ID NO: 2286973 - RNA, 14 nt, Yersinia pestis
ccgcgaauaacaga

SEQ ID NO: 2286974 - RNA, 19 nt, Yersinia pestis
ccgcgauaaaaaauaaagu

SEQ ID NO: 2286975 - RNA, 13 nt, Yersinia pestis
ccgcgauaaaaaa

SEQ ID NO: 2286976 - RNA, 17 nt, Yersinia pestis
ccgcgaucaacaagaau

SEQ ID NO: 2286977 - RNA, 21 nt, Yersinia pestis
ccgcgccaaggauggcgcggc

SEQ ID NO: 2286978 - RNA, 19 nt, Yersinia pestis
aaaccgagccugcuuuaau

SEQ ID NO: 2286979 - RNA, 23 nt, Yersinia pestis
aaaccgcagcagacaacugacaa

SEQ ID NO: 2286980 - RNA, 16 nt, Yersinia pestis
ccgcgcuuccaggcug

SEQ ID NO: 2286981 - RNA, 18 nt, Yersinia pestis
aaaccgaaaugaucuuca

SEQ ID NO: 2286982 - RNA, 18 nt, Yersinia pestis
ccgcgccauccuugccuu

SEQ ID NO: 2286983 - RNA, 22 nt, Yersinia pestis
aaaccggcuaacgaggcauaau

SEQ ID NO: 2286984 - RNA, 20 nt, Yersinia pestis
ccggcugacuggacaaauaa

SEQ ID NO: 2286985 - RNA, 16 nt, Yersinia pestis
aaaccugauaggccaa

SEQ ID NO: 2286986 - RNA, 20 nt, Yersinia pestis
aaaccuagcugcugcaagag

SEQ ID NO: 2286987 - RNA, 19 nt, Yersinia pestis
aaaccuccgcgauaccaau

SEQ ID NO: 2286988 - RNA, 13 nt, Yersinia pestis
aaaccugauuuac

SEQ ID NO: 2286989 - RNA, 20 nt, Yersinia pestis
ccggggcgauacaccaacgc

SEQ ID NO: 2286990 - RNA, 23 nt, Yersinia pestis
ccggaggauauuuauuguuucug

SEQ ID NO: 2286991 - RNA, 21 nt, Yersinia pestis
ccggaggauauuuauuuaauu

SEQ ID NO: 2286992 - RNA, 19 nt, Yersinia pestis
ccggagugaugaaaccaaa

SEQ ID NO: 2286993 - RNA, 15 nt, Yersinia pestis
ccggagguuuuucau

SEQ ID NO: 2286994 - RNA, 13 nt, Yersinia pestis
ccggccugauuua

SEQ ID NO: 2286995 - RNA, 23 nt, Yersinia pestis
ccguaagauucgccgcaaggcaa

SEQ ID NO: 2286996 - RNA, 12 nt, Yersinia pestis
ccguaacuucuu

SEQ ID NO: 2286997 - RNA, 12 nt, Yersinia pestis
ccguacaacaau

SEQ ID NO: 2286998 - RNA, 12 nt, Yersinia pestis
ccguacccgcuc

SEQ ID NO: 2286999 - RNA, 21 nt, Yersinia pestis
ccgucaaaccaucgcucuccu

SEQ ID NO: 2287000 - RNA, 16 nt, Yersinia pestis
ccgucaagacaacaaa

SEQ ID NO: 2287001 - RNA, 13 nt, Yersinia pestis
ccgucaauaucau

SEQ ID NO: 2287002 - RNA, 19 nt, Yersinia pestis
ccguauuuuauaucugcgc

SEQ ID NO: 2287003 - RNA, 22 nt, Yersinia pestis
ccgguguauuuggguuaaauag

SEQ ID NO: 2287004 - RNA, 17 nt, Yersinia pestis
ccggugguucaaccacc

SEQ ID NO: 2287005 - RNA, 21 nt, Yersinia pestis
aaaccuucacuuuuaaaacuu

SEQ ID NO: 2287006 - RNA, 20 nt, Yersinia pestis
aaaccuuauuuuugcauaua

SEQ ID NO: 2287007 - RNA, 15 nt, Yersinia pestis
aaaccuuauuuuugc

SEQ ID NO: 2287008 - RNA, 14 nt, Yersinia pestis
aaacgaacgaauaa

SEQ ID NO: 2287009 - RNA, 14 nt, Yersinia pestis
aaaccuugaauauc

SEQ ID NO: 2287010 - RNA, 16 nt, Yersinia pestis
ccgucagacugcugac

SEQ ID NO: 2287011 - RNA, 23 nt, Yersinia pestis
ccgucacucagaaaacagccacc

SEQ ID NO: 2287012 - RNA, 16 nt, Yersinia pestis
ccgucuuugagcucac

SEQ ID NO: 2287013 - RNA, 23 nt, Yersinia pestis
ccgugacauuuucaccgaggcgg

SEQ ID NO: 2287014 - RNA, 14 nt, Yersinia pestis
aaacgauuacccac

SEQ ID NO: 2287015 - RNA, 21 nt, Yersinia pestis
cgccgccucuucugucggagc

SEQ ID NO: 2287016 - RNA, 14 nt, Yersinia pestis
aaacguuaacugca

SEQ ID NO: 2287017 - RNA, 16 nt, Yersinia pestis
aaacguuaacugcagu

SEQ ID NO: 2287018 - RNA, 22 nt, Yersinia pestis
cgccgcgugacuauucugccua

SEQ ID NO: 2287019 - RNA, 20 nt, Yersinia pestis
cgccguauaaacgccuccga

SEQ ID NO: 2287020 - RNA, 15 nt, Yersinia pestis
cgccguagauuuaac

SEQ ID NO: 2287021 - RNA, 23 nt, Yersinia pestis
cgccggaauugcgcuucgcgcag

SEQ ID NO: 2287022 - RNA, 12 nt, Yersinia pestis
cgcccuccugcg

SEQ ID NO: 2287023 - RNA, 16 nt, Yersinia pestis
cgcccuccugcggcgg

SEQ ID NO: 2287024 - RNA, 16 nt, Yersinia pestis
cgccgaguaagucaau

SEQ ID NO: 2287025 - RNA, 12 nt, Yersinia pestis
cgccgcagguau

SEQ ID NO: 2287026 - RNA, 19 nt, Yersinia pestis
cgccauggcaugccaugca

SEQ ID NO: 2287027 - RNA, 17 nt, Yersinia pestis
cgccauggcaugccaug

SEQ ID NO: 2287028 - RNA, 23 nt, Yersinia pestis
cgccaugauaaccacaacgacag

SEQ ID NO: 2287029 - RNA, 15 nt, Yersinia pestis
cgccacggauaaggu

SEQ ID NO: 2287030 - RNA, 18 nt, Yersinia pestis
cgccaucguauauccacc

SEQ ID NO: 2287031 - RNA, 19 nt, Yersinia pestis
cgccaucgucagccccugc

SEQ ID NO: 2287032 - RNA, 12 nt, Yersinia pestis
cgccccgccccu

SEQ ID NO: 2287033 - RNA, 19 nt, Yersinia pestis
cgccccgauaaaugucgcu

SEQ ID NO: 2287034 - RNA, 12 nt, Yersinia pestis
cgccccggccgc

SEQ ID NO: 2287035 - RNA, 17 nt, Yersinia pestis
cgcggguuuugccgggc

SEQ ID NO: 2287036 - RNA, 22 nt, Yersinia pestis
cgcggguuaucacauaaauaag

SEQ ID NO: 2287037 - RNA, 22 nt, Yersinia pestis
cgcgguuggguucaauucccaa

SEQ ID NO: 2287038 - RNA, 16 nt, Yersinia pestis
cgcguuugcuugcugc

SEQ ID NO: 2287039 - RNA, 23 nt, Yersinia pestis
cgcguuugcuugcugccugccug

SEQ ID NO: 2287040 - RNA, 16 nt, Yersinia pestis
cgcguucagagcagca

SEQ ID NO: 2287041 - RNA, 20 nt, Yersinia pestis
cgcgugguuuccuggaacga

SEQ ID NO: 2287042 - RNA, 15 nt, Yersinia pestis
cgcguuaauaccuug

SEQ ID NO: 2287043 - RNA, 16 nt, Yersinia pestis
cgcguuaaucugcugc

SEQ ID NO: 2287044 - RNA, 17 nt, Yersinia pestis
cgcgguuuuuccgccgu

SEQ ID NO: 2287045 - RNA, 13 nt, Yersinia pestis
cgcgcuuccaggc

SEQ ID NO: 2287046 - RNA, 14 nt, Yersinia pestis
cgcgcuuccaggcu

SEQ ID NO: 2287047 - RNA, 17 nt, Yersinia pestis
cgcgcuucgagccccca

SEQ ID NO: 2287048 - RNA, 20 nt, Yersinia pestis
cgcgcuguggcuaauaaugc

SEQ ID NO: 2287049 - RNA, 20 nt, Yersinia pestis
cgcggcuuaccgccgccagc

SEQ ID NO: 2287050 - RNA, 23 nt, Yersinia pestis
cgcgcagugccgucaauuaucaa

SEQ ID NO: 2287051 - RNA, 15 nt, Yersinia pestis
cgcgcccucccuggc

SEQ ID NO: 2287052 - RNA, 12 nt, Yersinia pestis
cgcgccgcggcu

SEQ ID NO: 2287053 - RNA, 16 nt, Yersinia pestis
cgccuguauccagcag

SEQ ID NO: 2287054 - RNA, 19 nt, Yersinia pestis
cgccuguuagggcgcggcu

SEQ ID NO: 2287055 - RNA, 23 nt, Yersinia pestis
cgccugcugaacuuuaacuucca

SEQ ID NO: 2287056 - RNA, 22 nt, Yersinia pestis
cgccuguuucggcaggcagaaa

SEQ ID NO: 2287057 - RNA, 16 nt, Yersinia pestis
cgccuuaucagcgaaa

SEQ ID NO: 2287058 - RNA, 16 nt, Yersinia pestis
cgccuugccgcuguug

SEQ ID NO: 2287059 - RNA, 20 nt, Yersinia pestis
cgccuuuuuuauaauaaugg

SEQ ID NO: 2287060 - RNA, 21 nt, Yersinia pestis
cgcgaauccccccauucacac

SEQ ID NO: 2287061 - RNA, 16 nt, Yersinia pestis
cgcgaucacaauacag

SEQ ID NO: 2287062 - RNA, 14 nt, Yersinia pestis
cgcgagacggcgca

SEQ ID NO: 2287063 - RNA, 23 nt, Yersinia pestis
cgcaucaaacggcaacuucuaca

SEQ ID NO: 2287064 - RNA, 14 nt, Yersinia pestis
cgcauaugaaaaac

SEQ ID NO: 2287065 - RNA, 19 nt, Yersinia pestis
cgcauauuuuggcaacuca

SEQ ID NO: 2287066 - RNA, 21 nt, Yersinia pestis
aaacggcgcggcaucaccaaa

SEQ ID NO: 2287067 - RNA, 15 nt, Yersinia pestis
cgcaucuuccaaagg

SEQ ID NO: 2287068 - RNA, 14 nt, Yersinia pestis
cgcaucuuccaaag

SEQ ID NO: 2287069 - RNA, 16 nt, Yersinia pestis
cgcaucgaccacccgu

SEQ ID NO: 2287070 - RNA, 16 nt, Yersinia pestis
cgcaggauaaagcuga

SEQ ID NO: 2287071 - RNA, 15 nt, Yersinia pestis
cgcaggcacugcaga

SEQ ID NO: 2287072 - RNA, 12 nt, Yersinia pestis
cgcaggcggcca

SEQ ID NO: 2287073 - RNA, 18 nt, Yersinia pestis
cgcagauccagaauuuca

SEQ ID NO: 2287074 - RNA, 15 nt, Yersinia pestis
cgcagcggcuagcag

SEQ ID NO: 2287075 - RNA, 16 nt, Yersinia pestis
cgcagcguccauaaac

SEQ ID NO: 2287076 - RNA, 13 nt, Yersinia pestis
cgcauuuuucucg

SEQ ID NO: 2287077 - RNA, 23 nt, Yersinia pestis
cgccaacaggccuaaugccgcgc

SEQ ID NO: 2287078 - RNA, 16 nt, Yersinia pestis
cgcauuucgucuugcu

SEQ ID NO: 2287079 - RNA, 21 nt, Yersinia pestis
cgcauugugcuuuuuggcaaa

SEQ ID NO: 2287080 - RNA, 15 nt, Yersinia pestis
cgcauugucacccac

SEQ ID NO: 2287081 - RNA, 21 nt, Yersinia pestis
cgcauuggguaauaucaccau

SEQ ID NO: 2287082 - RNA, 17 nt, Yersinia pestis
cgcauugaggucagcgu

SEQ ID NO: 2287083 - RNA, 17 nt, Yersinia pestis
cgcauugauaaucucca

SEQ ID NO: 2287084 - RNA, 21 nt, Yersinia pestis
cgcauugaccgcuguuugauu

SEQ ID NO: 2287085 - RNA, 14 nt, Yersinia pestis
cgcauugaggucag

SEQ ID NO: 2287086 - RNA, 17 nt, Yersinia pestis
cgcauuaauccgccuga

SEQ ID NO: 2287087 - RNA, 19 nt, Yersinia pestis
cgcauuaauccgccugaga

SEQ ID NO: 2287088 - RNA, 20 nt, Yersinia pestis
cgcauucauaucguccaaag

SEQ ID NO: 2287089 - RNA, 21 nt, Yersinia pestis
cgccaauaaccgcagcaggca

SEQ ID NO: 2287090 - RNA, 18 nt, Yersinia pestis
cgccaaucauagccaucc

SEQ ID NO: 2287091 - RNA, 21 nt, Yersinia pestis
cgccaaucauagccaucccaa

SEQ ID NO: 2287092 - RNA, 20 nt, Yersinia pestis
cgccaaggaaggcuauuuuu

SEQ ID NO: 2287093 - RNA, 15 nt, Yersinia pestis
cgccaaguccuccuu

SEQ ID NO: 2287094 - RNA, 19 nt, Yersinia pestis
cgccacaauauuccggcau

SEQ ID NO: 2287095 - RNA, 21 nt, Yersinia pestis
cgccaccaaugcauccaagcc

SEQ ID NO: 2287096 - RNA, 22 nt, Yersinia pestis
cgauuugcgggcuaaaacuggc

SEQ ID NO: 2287097 - RNA, 18 nt, Yersinia pestis
cgauuggacccgucacca

SEQ ID NO: 2287098 - RNA, 10 nt, Yersinia pestis
cgcaaaacuu

SEQ ID NO: 2287099 - RNA, 14 nt, Yersinia pestis
cgauuuuugaguuu

SEQ ID NO: 2287100 - RNA, 23 nt, Yersinia pestis
cgcaaaaagggcaaacggcccuc

SEQ ID NO: 2287101 - RNA, 11 nt, Yersinia pestis
cgauuuuauau

SEQ ID NO: 2287102 - RNA, 20 nt, Yersinia pestis
cgauuuuuacgugucagacu

SEQ ID NO: 2287103 - RNA, 14 nt, Yersinia pestis
cgaugauuugucaa

SEQ ID NO: 2287104 - RNA, 15 nt, Yersinia pestis
cgaugaugauuauuu

SEQ ID NO: 2287105 - RNA, 20 nt, Yersinia pestis
cgaugauauacccaccagag

SEQ ID NO: 2287106 - RNA, 13 nt, Yersinia pestis
cgaugcucaggcc

SEQ ID NO: 2287107 - RNA, 17 nt, Yersinia pestis
cgauggggggguaugau

SEQ ID NO: 2287108 - RNA, 23 nt, Yersinia pestis
cgcacgaauaucuagcaacacau

SEQ ID NO: 2287109 - RNA, 18 nt, Yersinia pestis
cgcacgaaaggcuggagc

SEQ ID NO: 2287110 - RNA, 21 nt, Yersinia pestis
cgcaccaaugccgguccagac

SEQ ID NO: 2287111 - RNA, 17 nt, Yersinia pestis
cgcacguucccaggcca

SEQ ID NO: 2287112 - RNA, 14 nt, Yersinia pestis
cgcagaacccaggg

SEQ ID NO: 2287113 - RNA, 17 nt, Yersinia pestis
cgcaaagggcaacaaua

SEQ ID NO: 2287114 - RNA, 21 nt, Yersinia pestis
cgcaacacagucgcacugaua

SEQ ID NO: 2287115 - RNA, 17 nt, Yersinia pestis
cgcaaccaaucauucaa

SEQ ID NO: 2287116 - RNA, 13 nt, Yersinia pestis
cgcacacugcaga

SEQ ID NO: 2287117 - RNA, 21 nt, Yersinia pestis
cgcacaacaaauggguuauaa

SEQ ID NO: 2287118 - RNA, 13 nt, Yersinia pestis
cgcacaacugcga

SEQ ID NO: 2287119 - RNA, 14 nt, Yersinia pestis
cgcacacagcccug

SEQ ID NO: 2287120 - RNA, 21 nt, Yersinia pestis
cgcacaaacauggcugucccg

SEQ ID NO: 2287121 - RNA, 15 nt, Yersinia pestis
cgcacaaacauggcu

SEQ ID NO: 2287122 - RNA, 15 nt, Yersinia pestis
cgacucaagccucua

SEQ ID NO: 2287123 - RNA, 13 nt, Yersinia pestis
cgacugcaccuug

SEQ ID NO: 2287124 - RNA, 16 nt, Yersinia pestis
cgaauagagacggaaa

SEQ ID NO: 2287125 - RNA, 22 nt, Yersinia pestis
cgaauagagacggaaagagcca

SEQ ID NO: 2287126 - RNA, 20 nt, Yersinia pestis
cgacgugaugccaguaauuc

SEQ ID NO: 2287127 - RNA, 16 nt, Yersinia pestis
cgagaaauaguuacug

SEQ ID NO: 2287128 - RNA, 17 nt, Yersinia pestis
cgacuugaugaaguuau

SEQ ID NO: 2287129 - RNA, 22 nt, Yersinia pestis
cgacuuaauggucuucuuuauu

SEQ ID NO: 2287130 - RNA, 20 nt, Yersinia pestis
cgagagcgucccugaugggg

SEQ ID NO: 2287131 - RNA, 22 nt, Yersinia pestis
cgagacuaccggaaccgccgcc

SEQ ID NO: 2287132 - RNA, 18 nt, Yersinia pestis
cgagaaggauugaccaau

SEQ ID NO: 2287133 - RNA, 15 nt, Yersinia pestis
cgagaugcugacccu

SEQ ID NO: 2287134 - RNA, 17 nt, Yersinia pestis
cgagauguauccaaggc

SEQ ID NO: 2287135 - RNA, 23 nt, Yersinia pestis
cgagcacugccccgaagcucaag

SEQ ID NO: 2287136 - RNA, 13 nt, Yersinia pestis
cgagcacugcccc

SEQ ID NO: 2287137 - RNA, 18 nt, Yersinia pestis
aaacgcucaguuaaacgg

SEQ ID NO: 2287138 - RNA, 17 nt, Yersinia pestis
aaacgccugggauccau

SEQ ID NO: 2287139 - RNA, 20 nt, Yersinia pestis
aaacgccugggauccauagg

SEQ ID NO: 2287140 - RNA, 14 nt, Yersinia pestis
cgagccuacaugga

SEQ ID NO: 2287141 - RNA, 13 nt, Yersinia pestis
cgagcccaggcga

SEQ ID NO: 2287142 - RNA, 21 nt, Yersinia pestis
cgauacaccauuuccaggcua

SEQ ID NO: 2287143 - RNA, 20 nt, Yersinia pestis
cgauaaaaggcuauuuaaau

SEQ ID NO: 2287144 - RNA, 11 nt, Yersinia pestis
cgauaaaagau

SEQ ID NO: 2287145 - RNA, 20 nt, Yersinia pestis
cgaguuuauauugccacggc

SEQ ID NO: 2287146 - RNA, 13 nt, Yersinia pestis
cgaguuucucugc

SEQ ID NO: 2287147 - RNA, 19 nt, Yersinia pestis
cgaguugacuuuuuuuaac

SEQ ID NO: 2287148 - RNA, 17 nt, Yersinia pestis
cgauaaaauucagccac

SEQ ID NO: 2287149 - RNA, 14 nt, Yersinia pestis
cgauaaacuucaca

SEQ ID NO: 2287150 - RNA, 14 nt, Yersinia pestis
cgauaaagucaucc

SEQ ID NO: 2287151 - RNA, 21 nt, Yersinia pestis
cgauaacagauauuacgcagc

SEQ ID NO: 2287152 - RNA, 13 nt, Yersinia pestis
cgauaacauuuuu

SEQ ID NO: 2287153 - RNA, 23 nt, Yersinia pestis
cgaguuaacacgggcaugaacgu

SEQ ID NO: 2287154 - RNA, 17 nt, Yersinia pestis
cgagugugaugauggcg

SEQ ID NO: 2287155 - RNA, 18 nt, Yersinia pestis
cgagugaacguagccuca

SEQ ID NO: 2287156 - RNA, 22 nt, Yersinia pestis
cgagucgaucacggaaaucugc

SEQ ID NO: 2287157 - RNA, 16 nt, Yersinia pestis
cgagucacauuuuuaa

SEQ ID NO: 2287158 - RNA, 17 nt, Yersinia pestis
cgaguccguuaaaaaau

SEQ ID NO: 2287159 - RNA, 16 nt, Yersinia pestis
cgaguaaauacaaaua

SEQ ID NO: 2287160 - RNA, 14 nt, Yersinia pestis
cgaguaaugaaauc

SEQ ID NO: 2287161 - RNA, 13 nt, Yersinia pestis
cgaguaaugaaau

SEQ ID NO: 2287162 - RNA, 15 nt, Yersinia pestis
cgaguaucgugacca

SEQ ID NO: 2287163 - RNA, 19 nt, Yersinia pestis
cgaggguucgaaucccucc

SEQ ID NO: 2287164 - RNA, 13 nt, Yersinia pestis
cgaggaucaccac

SEQ ID NO: 2287165 - RNA, 15 nt, Yersinia pestis
cgaggcuucucagca

SEQ ID NO: 2287166 - RNA, 17 nt, Yersinia pestis
cgaggccgcuacaagca

SEQ ID NO: 2287167 - RNA, 13 nt, Yersinia pestis
cgagcuaaugcua

SEQ ID NO: 2287168 - RNA, 18 nt, Yersinia pestis
cgagcuaacgcuuuuucg

SEQ ID NO: 2287169 - RNA, 22 nt, Yersinia pestis
cgagcgugcgguagaccaccaa

SEQ ID NO: 2287170 - RNA, 20 nt, Yersinia pestis
cgagcuguuugcuguaaaca

SEQ ID NO: 2287171 - RNA, 19 nt, Yersinia pestis
aaacggaugagucgcuggu

SEQ ID NO: 2287172 - RNA, 13 nt, Yersinia pestis
cgagcguaauucc

SEQ ID NO: 2287173 - RNA, 19 nt, Yersinia pestis
cgagcgucaagccaacccc

SEQ ID NO: 2287174 - RNA, 22 nt, Yersinia pestis
cgagcggggcaaaaauuacagu

SEQ ID NO: 2287175 - RNA, 15 nt, Yersinia pestis
cggagugaugaaacc

SEQ ID NO: 2287176 - RNA, 16 nt, Yersinia pestis
cggagugaugaaacca

SEQ ID NO: 2287177 - RNA, 13 nt, Yersinia pestis
cggauaaaacaau

SEQ ID NO: 2287178 - RNA, 16 nt, Yersinia pestis
cggaggagauuucaga

SEQ ID NO: 2287179 - RNA, 22 nt, Yersinia pestis
cggaggauauuuauuugauaau

SEQ ID NO: 2287180 - RNA, 14 nt, Yersinia pestis
cggauacugaccca

SEQ ID NO: 2287181 - RNA, 14 nt, Yersinia pestis
cggauauucucaac

SEQ ID NO: 2287182 - RNA, 13 nt, Yersinia pestis
cggaucagcgccu

SEQ ID NO: 2287183 - RNA, 23 nt, Yersinia pestis
cggauucacccauuaauagacga

SEQ ID NO: 2287184 - RNA, 17 nt, Yersinia pestis
cggaugccgcuccagca

SEQ ID NO: 2287185 - RNA, 14 nt, Yersinia pestis
cggaucgcgacgaa

SEQ ID NO: 2287186 - RNA, 22 nt, Yersinia pestis
cggcacguuuccccuucauuug

SEQ ID NO: 2287187 - RNA, 12 nt, Yersinia pestis
cggcacagccag

SEQ ID NO: 2287188 - RNA, 23 nt, Yersinia pestis
cggcaaauuaaugucgccauaac

SEQ ID NO: 2287189 - RNA, 15 nt, Yersinia pestis
cggcaaugaccauca

SEQ ID NO: 2287190 - RNA, 14 nt, Yersinia pestis
cggcaacuucuaca

SEQ ID NO: 2287191 - RNA, 14 nt, Yersinia pestis
cggcaacugccgcu

SEQ ID NO: 2287192 - RNA, 22 nt, Yersinia pestis
cgcuuuaauggggagugcgcgc

SEQ ID NO: 2287193 - RNA, 13 nt, Yersinia pestis
cgcuaccaugagu

SEQ ID NO: 2287194 - RNA, 21 nt, Yersinia pestis
cgcuaaccaacgcggcccccg

SEQ ID NO: 2287195 - RNA, 17 nt, Yersinia pestis
cgcuaaucaagccuuca

SEQ ID NO: 2287196 - RNA, 14 nt, Yersinia pestis
cgcuaaugggugau

SEQ ID NO: 2287197 - RNA, 14 nt, Yersinia pestis
cgcuaacguuuauu

SEQ ID NO: 2287198 - RNA, 18 nt, Yersinia pestis
cgcuaauacggcuugcaa

SEQ ID NO: 2287199 - RNA, 16 nt, Yersinia pestis
cgcuaaccaccgucac

SEQ ID NO: 2287200 - RNA, 20 nt, Yersinia pestis
cgcuuucagcacgcuuucca

SEQ ID NO: 2287201 - RNA, 12 nt, Yersinia pestis
cgcuuugugaug

SEQ ID NO: 2287202 - RNA, 11 nt, Yersinia pestis
cggaaaauaaa

SEQ ID NO: 2287203 - RNA, 16 nt, Yersinia pestis
cgcuuuuucgacaaaa

SEQ ID NO: 2287204 - RNA, 15 nt, Yersinia pestis
cggaaauuaaaaauu

SEQ ID NO: 2287205 - RNA, 20 nt, Yersinia pestis
cggaaaugccgauaaaaacu

SEQ ID NO: 2287206 - RNA, 13 nt, Yersinia pestis
cggaacagcagcg

SEQ ID NO: 2287207 - RNA, 19 nt, Yersinia pestis
cggaaccuuucgaguugaa

SEQ ID NO: 2287208 - RNA, 15 nt, Yersinia pestis
cggaaaucagcuuca

SEQ ID NO: 2287209 - RNA, 16 nt, Yersinia pestis
cggaagcacguaaauc

SEQ ID NO: 2287210 - RNA, 22 nt, Yersinia pestis
cggaagcgccgacacccagcca

SEQ ID NO: 2287211 - RNA, 21 nt, Yersinia pestis
cggacauuuuacucccugacu

SEQ ID NO: 2287212 - RNA, 23 nt, Yersinia pestis
cggacauuuuacucccugacucc

SEQ ID NO: 2287213 - RNA, 21 nt, Yersinia pestis
cggacauaagaugaccaccaa

SEQ ID NO: 2287214 - RNA, 22 nt, Yersinia pestis
cggacauaaugcauccacuuuu

SEQ ID NO: 2287215 - RNA, 19 nt, Yersinia pestis
cggaaucaccuuucuccau

SEQ ID NO: 2287216 - RNA, 20 nt, Yersinia pestis
cggaaucaccuuucuccaug

SEQ ID NO: 2287217 - RNA, 22 nt, Yersinia pestis
cggaaucacugacuuggggcaa

SEQ ID NO: 2287218 - RNA, 19 nt, Yersinia pestis
cggacagcgcgcagccaac

SEQ ID NO: 2287219 - RNA, 15 nt, Yersinia pestis
cggacagcgcgcagc

SEQ ID NO: 2287220 - RNA, 16 nt, Yersinia pestis
cggagagaacaggcag

SEQ ID NO: 2287221 - RNA, 13 nt, Yersinia pestis
cggagcaagggcg

SEQ ID NO: 2287222 - RNA, 13 nt, Yersinia pestis
cggagccugauac

SEQ ID NO: 2287223 - RNA, 13 nt, Yersinia pestis
cggagaacuugaa

SEQ ID NO: 2287224 - RNA, 15 nt, Yersinia pestis
cggagaauaaaaaug

SEQ ID NO: 2287225 - RNA, 20 nt, Yersinia pestis
cggccuuucguuucugucug

SEQ ID NO: 2287226 - RNA, 21 nt, Yersinia pestis
cggcgaaggcuucguggugcu

SEQ ID NO: 2287227 - RNA, 20 nt, Yersinia pestis
cggcgaagggcgcagccccc

SEQ ID NO: 2287228 - RNA, 17 nt, Yersinia pestis
cggccuaucaucaccau

SEQ ID NO: 2287229 - RNA, 12 nt, Yersinia pestis
cggccuauuucu

SEQ ID NO: 2287230 - RNA, 14 nt, Yersinia pestis
cggcccggccaggc

SEQ ID NO: 2287231 - RNA, 13 nt, Yersinia pestis
cggcccucuuggc

SEQ ID NO: 2287232 - RNA, 16 nt, Yersinia pestis
cggcacugcaucugac

SEQ ID NO: 2287233 - RNA, 23 nt, Yersinia pestis
cggccagcaaccuggcggcccga

SEQ ID NO: 2287234 - RNA, 20 nt, Yersinia pestis
cggcccacuuuuugaauaau

SEQ ID NO: 2287235 - RNA, 22 nt, Yersinia pestis
cggccauuuacccgucauccuu

SEQ ID NO: 2287236 - RNA, 12 nt, Yersinia pestis
cggccagugaug

SEQ ID NO: 2287237 - RNA, 13 nt, Yersinia pestis
cggcccaacuggc

SEQ ID NO: 2287238 - RNA, 17 nt, Yersinia pestis
cggccauuugcucuggc

SEQ ID NO: 2287239 - RNA, 21 nt, Yersinia pestis
cggcgauggaccaugccauca

SEQ ID NO: 2287240 - RNA, 14 nt, Yersinia pestis
cggcgcaagcgaua

SEQ ID NO: 2287241 - RNA, 23 nt, Human
uuaaaaaugguuuaaauggucaa

SEQ ID NO: 2287242 - RNA, 16 nt, Human
uuaacacaugauccug

SEQ ID NO: 2287243 - RNA, 17 nt, Human
uuaccagggacugaggg

SEQ ID NO: 2287244 - RNA, 20 nt, Human
uuauauuuauuacuguaaga

SEQ ID NO: 2287245 - RNA, 23 nt, Human
ucaaugaaugaaugaauggcuaa

SEQ ID NO: 2287246 - RNA, 23 nt, Human
uauagguugauggugguauguuu

SEQ ID NO: 2287247 - RNA, 12 nt, Human
gcgacagugaga

SEQ ID NO: 2287248 - RNA, 19 nt, Human
gccuucggccuccauccug

SEQ ID NO: 2287249 - RNA, 14 nt, Human
gccuccauccugag

SEQ ID NO: 2287250 - RNA, 15 nt, Human
gcuagaaccaccugc

SEQ ID NO: 2287251 - RNA, 18 nt, Human
gcuccacuuggucuguga

SEQ ID NO: 2287252 - RNA, 17 nt, Human
gcucucuggccuucggc

SEQ ID NO: 2287253 - RNA, 21 nt, Human
ugcuagaacucccuuucaaca

SEQ ID NO: 2287254 - RNA, 19 nt, Human
ugccccugagcccauggca

SEQ ID NO: 2287255 - RNA, 23 nt, Human
ugagcccauggcacucuauguuc

SEQ ID NO: 2287256 - RNA, 17 nt, Human
ucaccugcccugcugag

SEQ ID NO: 2287257 - RNA, 23 nt, Human
uuggacgagaaaacaauaacgau

SEQ ID NO: 2287258 - RNA, 20 nt, Human
uuggagaagaacugaaauca

SEQ ID NO: 2287259 - RNA, 19 nt, Human
cccucuggcuccagcuggc

SEQ ID NO: 2287260 - RNA, 14 nt, Human
uuccucugagccuu

SEQ ID NO: 2287261 - RNA, 11 nt, Human
cgcucucuggc

SEQ ID NO: 2287262 - RNA, 22 nt, Human
cuagacaaguccagccuggcaa

SEQ ID NO: 2287263 - RNA, 12 nt, Human
cugaugcaguug

SEQ ID NO: 2287264 - RNA, 19 nt, Human
cugaugagaacucugagca

SEQ ID NO: 2287265 - RNA, 15 nt, Human
cuccauccugaggcu

SEQ ID NO: 2287266 - RNA, 22 nt, Human
gacgcucucuggccuucggccu

SEQ ID NO: 2287267 - RNA, 17 nt, Human
cugccuaagugcagccc

SEQ ID NO: 2287268 - RNA, 13 nt, Human
cuuccuggcaaua

SEQ ID NO: 2287269 - RNA, 20 nt, Human
cugugagaugcuagaacucc

SEQ ID NO: 2287270 - RNA, 20 nt, Human
gagucagucugaugagaacu

SEQ ID NO: 2287271 - RNA, 14 nt, Human
gcacuccagccuga

SEQ ID NO: 2287272 - RNA, 20 nt, Human
gcagaagacaguauggcagc

SEQ ID NO: 2287273 - RNA, 22 nt, Human
aaaaaguucugcagauaaacag

SEQ ID NO: 2287274 - RNA, 21 nt, Human
aaauauuuauuuuaauaaugu

SEQ ID NO: 2287275 - RNA, 22 nt, Human
aacacaugauccugcaauucca

SEQ ID NO: 2287276 - RNA, 15 nt, Human
aaguccagccuggca

SEQ ID NO: 2287277 - RNA, 23 nt, Human
agauugugccccugcacuccagc

SEQ ID NO: 2287278 - RNA, 19 nt, Human
agaaaaucaggcuggccaa

SEQ ID NO: 2287279 - RNA, 19 nt, Human
acuuggucugugagaugcu

SEQ ID NO: 2287280 - RNA, 14 nt, Human
auauauaacaaugc

SEQ ID NO: 2287281 - RNA, 19 nt, Human
augccacuaaauugacacu

SEQ ID NO: 2287282 - RNA, 16 nt, Human
aagccucauguccacu

SEQ ID NO: 2287283 - RNA, 13 nt, Human
aacaauaacgaua

SEQ ID NO: 2287284 - RNA, 16 nt, Human
aacgauaaaagacagu

SEQ ID NO: 2287285 - RNA, 18 nt, Human
aagaaugauuaugaauua

SEQ ID NO: 2287286 - RNA, 22 nt, Human
acaccaggcuugccugcaggca

SEQ ID NO: 2287287 - RNA, 15 nt, Human
acgagauacagaauu

SEQ ID NO: 2287288 - RNA, 18 nt, Human
acucauuaggauggcuag

SEQ ID NO: 2287289 - RNA, 14 nt, Human
cauuuaggccaugg

SEQ ID NO: 2287290 - RNA, 18 nt, Human
cauggcacucuauguucu

SEQ ID NO: 2287291 - RNA, 16 nt, Human
cauccuacaagacaca

SEQ ID NO: 2287292 - RNA, 15 nt, Human
caucaaugaaugaau

SEQ ID NO: 2287293 - RNA, 14 nt, Human
caucacaugaacuu

SEQ ID NO: 2287294 - RNA, 21 nt, Human
cagcuucucauccugcaggca

SEQ ID NO: 2287295 - RNA, 18 nt, Human
cagcucuaaaugucaauc

SEQ ID NO: 2287296 - RNA, 13 nt, Human
caaucaugaauua

SEQ ID NO: 2287297 - RNA, 13 nt, Human
caaggaugaauua

SEQ ID NO: 2287298 - RNA, 20 nt, Human
caacuccagaaagugacaag

SEQ ID NO: 2287299 - RNA, 14 nt, Human
auggugugaccacu

SEQ ID NO: 2287300 - RNA, 16 nt, Human
ccucuggcuccagcug

SEQ ID NO: 2287301 - RNA, 18 nt, Human
ccugcacuccagccugag

SEQ ID NO: 2287302 - RNA, 20 nt, Human
cgaaguauccuucagccuga

SEQ ID NO: 2287303 - RNA, 16 nt, Human
ccagauccuggaaauc

SEQ ID NO: 2287304 - RNA, 13 nt, Human
ccccaagccuggc

SEQ ID NO: 2287305 - RNA, 14 nt, Human
cuuagaugcaguuc

SEQ ID NO: 2287306 - RNA, 22 nt, Human
cuucacuguaaaauaauaacug

SEQ ID NO: 2287307 - RNA, 15 nt, Human
gaauucauucacuca

SEQ ID NO: 2287308 - RNA, 18 nt, Human
cugcugagucccaggcug

SEQ ID NO: 2287309 - RNA, 16 nt, Human
cuacacuccagugaga

SEQ ID NO: 2287310 - RNA, 15 nt, Human
gauaaaagacaguga

SEQ ID NO: 2287311 - RNA, 13 nt, Human
gagucaaugaacu

SEQ ID NO: 2287312 - RNA, 15 nt, Human
gaggacacugauaug

SEQ ID NO: 2287313 - RNA, 22 nt, Human
gcuggagcucugcccauccugc

SEQ ID NO: 2287314 - RNA, 15 nt, Human
ggauggggcuguggg

SEQ ID NO: 2287315 - RNA, 19 nt, Human
guacuggcugauggaguaa

SEQ ID NO: 2287316 - RNA, 15 nt, Human
ggagaagaacugaaa

SEQ ID NO: 2287317 - RNA, 17 nt, Human
uauggcacuaguauuuc

SEQ ID NO: 2287318 - RNA, 21 nt, Human
uauuacaaauccaaugaaaug

SEQ ID NO: 2287319 - RNA, 19 nt, Human
ugccugcaggcaugaguca

SEQ ID NO: 2287320 - RNA, 17 nt, Human
ucccaggcugagccuca

SEQ ID NO: 2287321 - RNA, 13 nt, Human
uccuuccucugag

SEQ ID NO: 2287322 - RNA, 17 nt, Human
uggaauuggagcucgug

SEQ ID NO: 2287323 - RNA, 12 nt, Human
uuucuaugaaau

SEQ ID NO: 2287324 - RNA, 19 nt, Human
uugccauaauuacuauguc

SEQ ID NO: 2287325 - RNA, 23 nt, Human
uugaaaaaguucugcagauaaac

SEQ ID NO: 2287326 - RNA, 15 nt, Human
uugagcucagcccug

SEQ ID NO: 2287327 - RNA, 15 nt, Human
uugucuagugaaacu

SEQ ID NO: 2287328 - RNA, 21 nt, Human
uucaugcugucuacacuaaga

SEQ ID NO: 2287329 - RNA, 17 nt, Human
uuccaccuacaugaggu

SEQ ID NO: 2287330 - RNA, 15 nt, Human
uucacagucacauuc

SEQ ID NO: 2287331 - RNA, 14 nt, Human
ucucaguucacugu

SEQ ID NO: 2287332 - RNA, 19 nt, Human
uccugaggcuccacuuggu

SEQ ID NO: 2287333 - RNA, 13 nt, Human
ucuccauguacug

SEQ ID NO: 2287334 - RNA, 21 nt, Human
uguaaaauggugugaccacug

SEQ ID NO: 2287335 - RNA, 13 nt, Human
ucaacagauaaau

SEQ ID NO: 2287336 - RNA, 13 nt, Human
uaagcuucacugu

SEQ ID NO: 2287337 - RNA, 19 nt, Human
uacacacuuguugauuaau

SEQ ID NO: 2287338 - RNA, 16 nt, Human
gucucagugucaaugc

SEQ ID NO: 2287339 - RNA, 15 nt, Human
gugagacagcucugc

SEQ ID NO: 2287340 - RNA, 19 nt, Human
ggacugaggggaggggagc

SEQ ID NO: 2287341 - RNA, 19 nt, Human
gggacagggaggacgcucu

SEQ ID NO: 2287342 - RNA, 15 nt, Human
ggcugagaugggaga

SEQ ID NO: 2287343 - RNA, 19 nt, Human
aaagugacaagcucacaga

SEQ ID NO: 2287344 - RNA, 23 nt, Human
aauauugcaaggcaaagacuauu

SEQ ID NO: 2287345 - RNA, 18 nt, Human
aauaauccuaaacauaug

SEQ ID NO: 2287346 - RNA, 13 nt, Human
agaaguugauaug

SEQ ID NO: 2287347 - RNA, 22 nt, Human
acgaaguauccuucagccugaa

SEQ ID NO: 2287348 - RNA, 19 nt, Human
acuauucccuucuaaccug

SEQ ID NO: 2287349 - RNA, 19 nt, Human
acuagacaaguccagccug

SEQ ID NO: 2287350 - RNA, 16 nt, Human
acacagugaccauacu

SEQ ID NO: 2287351 - RNA, 16 nt, Human
acagaaagcagaacag

SEQ ID NO: 2287352 - RNA, 23 nt, Human
acaggaugguucccuugaugaag

SEQ ID NO: 2287353 - RNA, 13 nt, Human
acagcugcucaau

SEQ ID NO: 2287354 - RNA, 17 nt, Human
acagggcucacagaauu

SEQ ID NO: 2287355 - RNA, 22 nt, Human
aauuguauuuuaguaagagauu

SEQ ID NO: 2287356 - RNA, 16 nt, Human
aaagaaaauaacgaua

SEQ ID NO: 2287357 - RNA, 16 nt, Human
aaacauguuuaucgua

SEQ ID NO: 2287358 - RNA, 23 nt, Human
aaucgcuaccuuuugcuguggca

SEQ ID NO: 2287359 - RNA, 19 nt, Human
aauaauuuuuaauuauaug

SEQ ID NO: 2287360 - RNA, 21 nt, Human
caaaauaugccccauucaaca

SEQ ID NO: 2287361 - RNA, 13 nt, Human
caaauugucacag

SEQ ID NO: 2287362 - RNA, 15 nt, Human
caaauugucacagga

SEQ ID NO: 2287363 - RNA, 13 nt, Human
cacuagacccacu

SEQ ID NO: 2287364 - RNA, 12 nt, Human
augaauggcuaa

SEQ ID NO: 2287365 - RNA, 19 nt, Human
agcugcucaauaaaguaca

SEQ ID NO: 2287366 - RNA, 16 nt, Human
auaauuuaaauauaug

SEQ ID NO: 2287367 - RNA, 21 nt, Human
agccuuggggcugaugcaguu

SEQ ID NO: 2287368 - RNA, 19 nt, Human
agcuuuccucaaaacuuca

SEQ ID NO: 2287369 - RNA, 21 nt, Human
agugaaaaucuacacuccagu

SEQ ID NO: 2287370 - RNA, 20 nt, Human
uuucaaacauauauaacaau

SEQ ID NO: 2287371 - RNA, 17 nt, Human
uuucagauaaucacaau

SEQ ID NO: 2287372 - RNA, 17 nt, Human
ugcccauccugccccug

SEQ ID NO: 2287373 - RNA, 22 nt, Human
ugcauacucauuaggauggcua

SEQ ID NO: 2287374 - RNA, 23 nt, Human
augaaaaggcuaagcuucacugu

SEQ ID NO: 2287375 - RNA, 17 nt, Human
augcagagucaaugaac

SEQ ID NO: 2287376 - RNA, 16 nt, Human
augaaugaauggcuaa

SEQ ID NO: 2287377 - RNA, 17 nt, Human
auauauaacaaugcugu

SEQ ID NO: 2287378 - RNA, 16 nt, Human
auaggcguaacuaauu

SEQ ID NO: 2287379 - RNA, 11 nt, Human
auccaaugaaa

SEQ ID NO: 2287380 - RNA, 12 nt, Human
auaacaaugaaa

SEQ ID NO: 2287381 - RNA, 14 nt, Human
cagcuguaugauuc

SEQ ID NO: 2287382 - RNA, 19 nt, Human
cagccucuuagaugcaguu

SEQ ID NO: 2287383 - RNA, 18 nt, Human
caggcuugccugcaggca

SEQ ID NO: 2287384 - RNA, 17 nt, Human
cagugucaaugcagccc

SEQ ID NO: 2287385 - RNA, 13 nt, Human
cauccugcaggca

SEQ ID NO: 2287386 - RNA, 17 nt, Human
ccagaaagugacaagcu

SEQ ID NO: 2287387 - RNA, 11 nt, Human
cacacugaaga

SEQ ID NO: 2287388 - RNA, 22 nt, Human
cacagcugcucaauaaaguaca

SEQ ID NO: 2287389 - RNA, 15 nt, Human
cacaggggacaggau

SEQ ID NO: 2287390 - RNA, 13 nt, Human
auucauucacuca

SEQ ID NO: 2287391 - RNA, 23 nt, Human
caaaaaucucaauauuucagaua

SEQ ID NO: 2287392 - RNA, 13 nt, Human
auuuuaauaaugu

SEQ ID NO: 2287393 - RNA, 21 nt, Human
cagaagcaacccaaauguuca

SEQ ID NO: 2287394 - RNA, 20 nt, Human
cagggaggacgcucucuggc

SEQ ID NO: 2287395 - RNA, 15 nt, Human
caggguuuauguuua

SEQ ID NO: 2287396 - RNA, 20 nt, Human
cagugaaagaaaauaacgau

SEQ ID NO: 2287397 - RNA, 19 nt, Human
cagucaccucauggaauug

SEQ ID NO: 2287398 - RNA, 17 nt, Human
cugaaagaggaaugaag

SEQ ID NO: 2287399 - RNA, 23 nt, Human
agccaaacauccuacaagacaca

SEQ ID NO: 2287400 - RNA, 16 nt, Human
cugccccccagcccuc

SEQ ID NO: 2287401 - RNA, 17 nt, Human
gacgagaaaacaauaac

SEQ ID NO: 2287402 - RNA, 20 nt, Human
gacauuugcucauggaauug

SEQ ID NO: 2287403 - RNA, 14 nt, Human
ucuaaccugaacug

SEQ ID NO: 2287404 - RNA, 16 nt, Human
ucauuaggauggcuag

SEQ ID NO: 2287405 - RNA, 13 nt, Human
ucggccuccaucc

SEQ ID NO: 2287406 - RNA, 19 nt, Human
uagcuggaaaaguauguua

SEQ ID NO: 2287407 - RNA, 11 nt, Human
ucaaugaacuu

SEQ ID NO: 2287408 - RNA, 13 nt, Human
gguugcagugagc

SEQ ID NO: 2287409 - RNA, 17 nt, Human
guaaugauaacuggaaa

SEQ ID NO: 2287410 - RNA, 21 nt, Human
caauuuuguuauguauauuuu

SEQ ID NO: 2287411 - RNA, 10 nt, Human
ccugagcccc

SEQ ID NO: 2287412 - RNA, 20 nt, Human
aaucuuucacaggggacagg

SEQ ID NO: 2287413 - RNA, 16 nt, Human
guuccuuccucugagc

SEQ ID NO: 2287414 - RNA, 22 nt, Human
uacugagagugaacaaauuuac

SEQ ID NO: 2287415 - RNA, 19 nt, Human
ggaauuucuucaacucccu

SEQ ID NO: 2287416 - RNA, 21 nt, Human
aaagcugaaauggacuuuugu

SEQ ID NO: 2287417 - RNA, 19 nt, Human
ugaaauuguauuacaaauc

SEQ ID NO: 2287418 - RNA, 15 nt, Human
acauccuacaagaca

SEQ ID NO: 2287419 - RNA, 14 nt, Human
ccaaauauaaauaa

SEQ ID NO: 2287420 - RNA, 22 nt, Human
aauugacccacaagaaaugaaa

SEQ ID NO: 2287421 - RNA, 22 nt, Human
aguauguuagugcaaauuguca

SEQ ID NO: 2287422 - RNA, 21 nt, Human
cucuucuggguuccuuccucu

SEQ ID NO: 2287423 - RNA, 13 nt, Human
ccaaaagguauuu

SEQ ID NO: 2287424 - RNA, 19 nt, Human
cuagaguuuagcuggaaaa

SEQ ID NO: 2287425 - RNA, 18 nt, Human
acugugugcuaaaacaag

SEQ ID NO: 2287426 - RNA, 16 nt, Human
uuucacauuuaaauaa

SEQ ID NO: 2287427 - RNA, 16 nt, Human
aggcuugccugcaggc

SEQ ID NO: 2287428 - RNA, 15 nt, Human
ccagauccuggaaau

SEQ ID NO: 2287429 - RNA, 15 nt, Human
acgagauacagaauu

SEQ ID NO: 2287430 - RNA, 15 nt, Human
uccaagccucauguc

SEQ ID NO: 2287431 - RNA, 13 nt, Human
auuuuuuaaaaaa

SEQ ID NO: 2287432 - RNA, 15 nt, Human
gaaagaaaauaacga

SEQ ID NO: 2287433 - RNA, 21 nt, Human
aggacagcccuucuuuccaca

SEQ ID NO: 2287434 - RNA, 15 nt, Human
uucggccuccauccu

SEQ ID NO: 2287435 - RNA, 23 nt, Human
caucucuucuggguuccuuccuc

SEQ ID NO: 2287436 - RNA, 16 nt, Human
aaaugggaaacaaaag

SEQ ID NO: 2287437 - RNA, 22 nt, Human
cccccugcaaagcccagcuuga

SEQ ID NO: 2287438 - RNA, 12 nt, Human
agugcagccccg

SEQ ID NO: 2287439 - RNA, 14 nt, Human
cugcaaagcccagc

SEQ ID NO: 2287440 - RNA, 23 nt, Human
aagagccuuuuuuugaaaaaaag

SEQ ID NO: 2287441 - RNA, 21 nt, Human
gaaaaaaagcuuuuuuugaau

SEQ ID NO: 2287442 - RNA, 14 nt, Human
cacuuauaggaauu

SEQ ID NO: 2287443 - RNA, 15 nt, Human
accaaggcugauuaa

SEQ ID NO: 2287444 - RNA, 14 nt, Human
caugaacuuguaaa

SEQ ID NO: 2287445 - RNA, 22 nt, Human
gaugguucccuugaugaagaag

SEQ ID NO: 2287446 - RNA, 22 nt, Human
acaccuuguacuuuauuuucua

SEQ ID NO: 2287447 - RNA, 14 nt, Human
cucccugcccccca

SEQ ID NO: 2287448 - RNA, 19 nt, Human
cagcacgggggccaaggau

SEQ ID NO: 2287449 - RNA, 18 nt, Human
cagugaaagaaaauaaca

SEQ ID NO: 2287450 - RNA, 14 nt, Human
cuuucauaauaagu

SEQ ID NO: 2287451 - RNA, 18 nt, Human
acuggacucaccuccccc

SEQ ID NO: 2287452 - RNA, 12 nt, Human
aauacuuuauaa

SEQ ID NO: 2287453 - RNA, 23 nt, Human
cucagcccuggugggcagagagg

SEQ ID NO: 2287454 - RNA, 16 nt, Human
ucucuaggaaauauuu

SEQ ID NO: 2287455 - RNA, 20 nt, Human
ugauuauaugucacuuugcu

SEQ ID NO: 2287456 - RNA, 21 nt, Human
uuauuuucuauaauuuaaaua

SEQ ID NO: 2287457 - RNA, 18 nt, Human
gaaauggugaaaugcaga

SEQ ID NO: 2287458 - RNA, 18 nt, Human
cuccauuuuuagugaaau

SEQ ID NO: 2287459 - RNA, 16 nt, Human
cccccagcccuccuua

SEQ ID NO: 2287460 - RNA, 16 nt, Human
aaauauuuauuuuaau

SEQ ID NO: 2287461 - RNA, 18 nt, Human
uucaauaucuuuuuuuua

SEQ ID NO: 2287462 - RNA, 20 nt, Human
ccuccugccuaagugcagcc

SEQ ID NO: 2287463 - RNA, 15 nt, Human
ggccuucggccucca

SEQ ID NO: 2287464 - RNA, 13 nt, Human
agcccagcuugaa

SEQ ID NO: 2287465 - RNA, 13 nt, Human
agacacagugacc

SEQ ID NO: 2287466 - RNA, 23 nt, Human
caauaacgauaaaagacagugaa

SEQ ID NO: 2287467 - RNA, 15 nt, Human
cuggguuccuuccuc

SEQ ID NO: 2287468 - RNA, 16 nt, Human
cagucucccucccuug

SEQ ID NO: 2287469 - RNA, 21 nt, Human
ucauucacucaacaaacauaa

SEQ ID NO: 2287470 - RNA, 21 nt, Human
augaauacuuuauaaaggauu

SEQ ID NO: 2287471 - RNA, 14 nt, Human
cucugccucagaaa

SEQ ID NO: 2287472 - RNA, 20 nt, Human
uuaaauggucaauuuuguua

SEQ ID NO: 2287473 - RNA, 23 nt, Human
aaagcccagcuugaaaccuucac

SEQ ID NO: 2287474 - RNA, 15 nt, Human
gauccugcaauucca

SEQ ID NO: 2287475 - RNA, 23 nt, Human
cagagguugcagugagccgagau

SEQ ID NO: 2287476 - RNA, 18 nt, Human
aaagaaaaucaggcuggc

SEQ ID NO: 2287477 - RNA, 20 nt, Human
ccaaauguucaucaaugaau

SEQ ID NO: 2287478 - RNA, 17 nt, Human
ugaacuugguuuuaauu

SEQ ID NO: 2287479 - RNA, 15 nt, Human
cuucucuucacaguc

SEQ ID NO: 2287480 - RNA, 21 nt, Human
ucaccugggcugaggcauccu

SEQ ID NO: 2287481 - RNA, 15 nt, Human
uuacagagacagaaa

SEQ ID NO: 2287482 - RNA, 23 nt, Human
cucuacuaaaaauacaaaaaaaa

SEQ ID NO: 2287483 - RNA, 17 nt, Human
cuaagcuucacuguaaa

SEQ ID NO: 2287484 - RNA, 16 nt, Human
acauccuacaagacac

SEQ ID NO: 2287485 - RNA, 20 nt, Human
uuaaugccacuaaauugaca

SEQ ID NO: 2287486 - RNA, 21 nt, Human
cgacagugagacucugucuca

SEQ ID NO: 2287487 - RNA, 18 nt, Human
gagcgacagugagacucu

SEQ ID NO: 2287488 - RNA, 20 nt, Human
uccagagggaauugcagagu

SEQ ID NO: 2287489 - RNA, 17 nt, Human
acucaccucccccaucu

SEQ ID NO: 2287490 - RNA, 17 nt, Human
uugugaagcaaaauuuu

SEQ ID NO: 2287491 - RNA, 12 nt, Human
uaauuccacagc

SEQ ID NO: 2287492 - RNA, 18 nt, Human
cuuuccacagaagcucca

SEQ ID NO: 2287493 - RNA, 20 nt, Human
caagagccuuuuuuugaaaa

SEQ ID NO: 2287494 - RNA, 21 nt, Human
ucacaugaacuuguaaaggaa

SEQ ID NO: 2287495 - RNA, 13 nt, Human
aacucccugcccc

SEQ ID NO: 2287496 - RNA, 20 nt, Human
cccuuccuaauuccacagcu

SEQ ID NO: 2287497 - RNA, 14 nt, Human
ccuuaucaaaggac

SEQ ID NO: 2287498 - RNA, 12 nt, Human
ccuucagccuga

SEQ ID NO: 2287499 - RNA, 22 nt, Human
uaaaacaagcacuaaacaaaga

SEQ ID NO: 2287500 - RNA, 21 nt, Human
guauacugugugcuaaaacaa

SEQ ID NO: 2287501 - RNA, 19 nt, Human
caauucuugccaaauauaa

SEQ ID NO: 2287502 - RNA, 13 nt, Human
aaacauccuacaa

SEQ ID NO: 2287503 - RNA, 13 nt, Human
auugcaaggcaaa

SEQ ID NO: 2287504 - RNA, 15 nt, Human
aaugauuaugaauua

SEQ ID NO: 2287505 - RNA, 17 nt, Human
aaucuuauaauuuaaaa

SEQ ID NO: 2287506 - RNA, 22 nt, Human
cuccagccugagcgacagugag

SEQ ID NO: 2287507 - RNA, 21 nt, Human
augucauuugcuggagcucug

SEQ ID NO: 2287508 - RNA, 20 nt, Human
agccuaguugaucagcuuau

SEQ ID NO: 2287509 - RNA, 18 nt, Human
ugccauaauuacuauguc

SEQ ID NO: 2287510 - RNA, 22 nt, Human
cuucaacucccugccccccagc

SEQ ID NO: 2287511 - RNA, 17 nt, Human
uccagcuggccgggagc

SEQ ID NO: 2287512 - RNA, 14 nt, Human
agauguagaggaga

SEQ ID NO: 2287513 - RNA, 22 nt, Human
aggcuccacuuggucugugaga

SEQ ID NO: 2287514 - RNA, 21 nt, Human
ccaaggaugccccgucccccu

SEQ ID NO: 2287515 - RNA, 21 nt, Human
uuuauauaagcuuguauuccu

SEQ ID NO: 2287516 - RNA, 14 nt, Human
aauauaaauaaaaa

SEQ ID NO: 2287517 - RNA, 17 nt, Human
aguugauaaguacauga

SEQ ID NO: 2287518 - RNA, 22 nt, Human
cuccugccuaagugcagccccg

SEQ ID NO: 2287519 - RNA, 18 nt, Human
ccuucggccuccauccug

SEQ ID NO: 2287520 - RNA, 22 nt, Human
ccacagcuguaugauucccagc

SEQ ID NO: 2287521 - RNA, 22 nt, Human
cagcccuggugggcagagaggu

SEQ ID NO: 2287522 - RNA, 13 nt, Human
augcuagaacucc

SEQ ID NO: 2287523 - RNA, 13 nt, Human
acacacaugaagu

SEQ ID NO: 2287524 - RNA, 16 nt, Human
agaugcuagaacuccc

SEQ ID NO: 2287525 - RNA, 14 nt, Human
agcucuaucaccaa

SEQ ID NO: 2287526 - RNA, 13 nt, Human
uaauuuuuauauu

SEQ ID NO: 2287527 - RNA, 15 nt, Human
auaauuuugugaagc

SEQ ID NO: 2287528 - RNA, 19 nt, Human
aaguugcauagguuuaaua

SEQ ID NO: 2287529 - RNA, 18 nt, Human
ugugaccacugcagaaga

SEQ ID NO: 2287530 - RNA, 16 nt, Human
aucaaaagaaagaaaa

SEQ ID NO: 2287531 - RNA, 21 nt, Human
aauaauguuucaaacauauau

SEQ ID NO: 2287532 - RNA, 21 nt, Human
cugauauuggacaguaaaauc

SEQ ID NO: 2287533 - RNA, 20 nt, Human
cucccugccccccagcccuc

SEQ ID NO: 2287534 - RNA, 13 nt, Human
cacaccaggcuug

SEQ ID NO: 2287535 - RNA, 18 nt, Human
uaagcuucacuguaaaau

SEQ ID NO: 2287536 - RNA, 14 nt, Human
ucuaggaaauauuu

SEQ ID NO: 2287537 - RNA, 14 nt, Human
cagauccccaagcc

SEQ ID NO: 2287538 - RNA, 17 nt, Human
guguccccuauccuacu

SEQ ID NO: 2287539 - RNA, 22 nt, Human
caaauuuacagagacagaaagc

SEQ ID NO: 2287540 - RNA, 18 nt, Human
aaguugauaugccuuuuc

SEQ ID NO: 2287541 - RNA, 14 nt, Human
agcaaguauuagaa

SEQ ID NO: 2287542 - RNA, 15 nt, Human
uucugcacacagcac

SEQ ID NO: 2287543 - RNA, 20 nt, Human
aaagagugaaggauuuaugu

SEQ ID NO: 2287544 - RNA, 15 nt, Human
aauugacccacaaga

SEQ ID NO: 2287545 - RNA, 15 nt, Human
auaaauaaaaauaau

SEQ ID NO: 2287546 - RNA, 23 nt, Human
cuggccgggagccugaucaccug

SEQ ID NO: 2287547 - RNA, 20 nt, Human
cagccugagcgacagugaga

SEQ ID NO: 2287548 - RNA, 15 nt, Human
uaauauugcaaggca

SEQ ID NO: 2287549 - RNA, 14 nt, Human
gauaaaagacagug

SEQ ID NO: 2287550 - RNA, 17 nt, Human
ccugccccccagcccuc

SEQ ID NO: 2287551 - RNA, 14 nt, Human
auccuugaagauuu

SEQ ID NO: 2287552 - RNA, 17 nt, Human
cauuuguauaaaauaau

SEQ ID NO: 2287553 - RNA, 15 nt, Human
agugacaagcucaca

SEQ ID NO: 2287554 - RNA, 22 nt, Human
ugggcacuguggguagacacac

SEQ ID NO: 2287555 - RNA, 18 nt, Human
uuauuacuguaagaaaau

SEQ ID NO: 2287556 - RNA, 17 nt, Human
guugcugggggggauug

SEQ ID NO: 2287557 - RNA, 20 nt, Human
accucugccucagaaaacaa

SEQ ID NO: 2287558 - RNA, 16 nt, Human
uaucaaaagaaagaaa

SEQ ID NO: 2287559 - RNA, 14 nt, Human
gaaaacaauaacga

SEQ ID NO: 2287560 - RNA, 17 nt, Human
cuucacuguaaaauaau

SEQ ID NO: 2287561 - RNA, 12 nt, Human
cuuccucugagc

SEQ ID NO: 2287562 - RNA, 19 nt, Human
uccccuauccuacuucccc

SEQ ID NO: 2287563 - RNA, 15 nt, Human
acucugagcagugcu

SEQ ID NO: 2287564 - RNA, 13 nt, Human
ccucuggcuccag

SEQ ID NO: 2287565 - RNA, 19 nt, Human
agaugcuagaacucccuuu

SEQ ID NO: 2287566 - RNA, 13 nt, Human
agcucugcccauc

SEQ ID NO: 2287567 - RNA, 14 nt, Human
aagaagugaaaauc

SEQ ID NO: 2287568 - RNA, 21 nt, Human
acaguuaccucugccucagaa

SEQ ID NO: 2287569 - RNA, 19 nt, Human
aaacaaaaggauaaugaau

SEQ ID NO: 2287570 - RNA, 13 nt, Human
uggcuccagcugg

SEQ ID NO: 2287571 - RNA, 22 nt, Human
agucuuucacauuuaaauaaag

SEQ ID NO: 2287572 - RNA, 15 nt, Human
agccucagucucccu

SEQ ID NO: 2287573 - RNA, 19 nt, Human
ucugagcauuuaauaugga

SEQ ID NO: 2287574 - RNA, 14 nt, Human
agagguccacaaca

SEQ ID NO: 2287575 - RNA, 15 nt, Human
gagaugcuagaacuc

SEQ ID NO: 2287576 - RNA, 20 nt, Human
gcccauccugccccugagcc

SEQ ID NO: 2287577 - RNA, 14 nt, Human
ggccuucggccucc

SEQ ID NO: 2287578 - RNA, 23 nt, Human
cacaagaaaugaaagcagggacu

SEQ ID NO: 2287579 - RNA, 15 nt, Human
aaggguacacugccu

SEQ ID NO: 2287580 - RNA, 11 nt, Human
ucaccuccccc

SEQ ID NO: 2287581 - RNA, 23 nt, Human
ggcaaagacuauucccuucuaac

SEQ ID NO: 2287582 - RNA, 21 nt, Human
gggagccugaucaccugcccu

SEQ ID NO: 2287583 - RNA, 17 nt, Human
ccacuggacucaccucc

SEQ ID NO: 2287584 - RNA, 20 nt, Human
guccccuauccuacuucccc

SEQ ID NO: 2287585 - RNA, 21 nt, Human
cacaugaacuuguaaaggaau

SEQ ID NO: 2287586 - RNA, 21 nt, Human
gcccauccugccccugagccc

SEQ ID NO: 2287587 - RNA, 22 nt, Human
ugaguuuuucuuuucauuuacc

SEQ ID NO: 2287588 - RNA, 20 nt, Human
gcuugcagagaugaggccgc

SEQ ID NO: 2287589 - RNA, 15 nt, Human
ucuggcuccagcugg

SEQ ID NO: 2287590 - RNA, 19 nt, Human
ccccucuggcuccagcugg

SEQ ID NO: 2287591 - RNA, 21 nt, Human
ugaaauggacuuuuguacaua

SEQ ID NO: 2287592 - RNA, 16 nt, Human
cuagaaccaccugccu

SEQ ID NO: 2287593 - RNA, 17 nt, Human
cuaucucauuuccaagc

SEQ ID NO: 2287594 - RNA, 14 nt, Human
cucagucucccucc

SEQ ID NO: 2287595 - RNA, 15 nt, Human
accugggcugaggca

SEQ ID NO: 2287596 - RNA, 16 nt, Human
cagcuucucauccugc

SEQ ID NO: 2287597 - RNA, 23 nt, Human
uuuuauagcuacuaauuuuaaaa

SEQ ID NO: 2287598 - RNA, 17 nt, Human
cacuagacaaguccagc

SEQ ID NO: 2287599 - RNA, 19 nt, Human
cuugccugcaggcaugagu

SEQ ID NO: 2287600 - RNA, 18 nt, Human
gaaaugaaagcagggacu

SEQ ID NO: 2287601 - RNA, 23 nt, Human
agcucugcccauccugccccuga

SEQ ID NO: 2287602 - RNA, 18 nt, Human
ccaaccuggaguugaaaa

SEQ ID NO: 2287603 - RNA, 11 nt, Human
gcaugguuuag

SEQ ID NO: 2287604 - RNA, 19 nt, Human
acuaucucauuuccaagca

SEQ ID NO: 2287605 - RNA, 12 nt, Human
gguauuuuaauc

SEQ ID NO: 2287606 - RNA, 16 nt, Human
aagaaaauaacaauaa

SEQ ID NO: 2287607 - RNA, 17 nt, Human
gccuccuuuuaaaguaa

SEQ ID NO: 2287608 - RNA, 14 nt, Human
aauuguauuacaaa

SEQ ID NO: 2287609 - RNA, 23 nt, Human
cccacuggacucaccucccccau

SEQ ID NO: 2287610 - RNA, 17 nt, Human
uuccaagccucaugucc

SEQ ID NO: 2287611 - RNA, 22 nt, Human
auuacuguaagaaaauaucacu

SEQ ID NO: 2287612 - RNA, 13 nt, Human
ugaaagaaaauaa

SEQ ID NO: 2287613 - RNA, 16 nt, Human
ugaaguccaagcauuu

SEQ ID NO: 2287614 - RNA, 14 nt, Human
cucauccugcaggc

SEQ ID NO: 2287615 - RNA, 16 nt, Human
gacauagaauuaacac

SEQ ID NO: 2287616 - RNA, 22 nt, Human
caugaguaacugauuuguaaca

SEQ ID NO: 2287617 - RNA, 16 nt, Human
ccuccuuaucaaagga

SEQ ID NO: 2287618 - RNA, 20 nt, Human
ccagcuugaaaccuucacuu

SEQ ID NO: 2287619 - RNA, 20 nt, Human
aaaaucuuauaauuuaaaau

SEQ ID NO: 2287620 - RNA, 23 nt, Human
aucucuucuggguuccuuccucu

SEQ ID NO: 2287621 - RNA, 17 nt, Human
caauaacgauaaaagac

SEQ ID NO: 2287622 - RNA, 17 nt, Human
cagugcuugaaugaagu

SEQ ID NO: 2287623 - RNA, 18 nt, Human
auaaaguguuugaaagcu

SEQ ID NO: 2287624 - RNA, 23 nt, Human
ccagagggaauugcagaguacug

SEQ ID NO: 2287625 - RNA, 17 nt, Human
ccucuggcuccagcugg

SEQ ID NO: 2287626 - RNA, 20 nt, Human
acagcuucucauccugcagg

SEQ ID NO: 2287627 - RNA, 15 nt, Human
guucugcagauaaac

SEQ ID NO: 2287628 - RNA, 23 nt, Human
ugaaaugaguuuuucuuuucauu

SEQ ID NO: 2287629 - RNA, 16 nt, Human
ugcauagguuuaauaa

SEQ ID NO: 2287630 - RNA, 16 nt, Human
uuguaaaggaauuuaa

SEQ ID NO: 2287631 - RNA, 14 nt, Human
gagcccauggcacu

SEQ ID NO: 2287632 - RNA, 20 nt, Human
ucaaaacuucagacauagaa

SEQ ID NO: 2287633 - RNA, 18 nt, Human
cccacuagacccacugga

SEQ ID NO: 2287634 - RNA, 24 nt, Human
aaagacagcuucucauccugcagg

SEQ ID NO: 2287635 - RNA, 21 nt, Human
aggcucuuuugggauuuuuga

SEQ ID NO: 2287636 - RNA, 20 nt, Human
cugcacacagcacgggggcc

SEQ ID NO: 2287637 - RNA, 18 nt, Human
uaaaauccauacauuugu

SEQ ID NO: 2287638 - RNA, 21 nt, Human
auuauauuuauuacuguaaga

SEQ ID NO: 2287639 - RNA, 18 nt, Human
acugccuucucaacucca

SEQ ID NO: 2287640 - RNA, 17 nt, Human
agaaucacuugaacccg

SEQ ID NO: 2287641 - RNA, 17 nt, Human
aucaaggguacacugcc

SEQ ID NO: 2287642 - RNA, 14 nt, Human
ugagacucugucuc

SEQ ID NO: 2287643 - RNA, 22 nt, Human
cucuggccuucggccuccaucc

SEQ ID NO: 2287644 - RNA, 15 nt, Human
agcucuaucaccaag

SEQ ID NO: 2287645 - RNA, 14 nt, Human
uuccugagccagug

SEQ ID NO: 2287646 - RNA, 18 nt, Human
cugagucccaggcugagc

SEQ ID NO: 2287647 - RNA, 20 nt, Human
ugccccccagcccuccuuau

SEQ ID NO: 2287648 - RNA, 20 nt, Human
ugagagacacacugaagaag

SEQ ID NO: 2287649 - RNA, 12 nt, Human
aagagcuuaaca

SEQ ID NO: 2287650 - RNA, 24 nt, Human
cauaugaaaaggcuaagcuucacu

SEQ ID NO: 2287651 - RNA, 20 nt, Human
aaauccuugaagauuuacca

SEQ ID NO: 2287652 - RNA, 16 nt, Human
cuucuggguuccuucc

SEQ ID NO: 2287653 - RNA, 20 nt, Human
aaaagacagugaaagaaaau

SEQ ID NO: 2287654 - RNA, 15 nt, Human
ugucaauaaaaucca

SEQ ID NO: 2287655 - RNA, 14 nt, Human
gccucagucucccu

SEQ ID NO: 2287656 - RNA, 20 nt, Human
auaauccuaaacauaugaau

SEQ ID NO: 2287657 - RNA, 17 nt, Human
agaugggagaaucacuu

SEQ ID NO: 2287658 - RNA, 18 nt, Human
aagucuuucacauuuaaa

SEQ ID NO: 2287659 - RNA, 14 nt, Human
auaaaauaauuuuu

SEQ ID NO: 2287660 - RNA, 14 nt, Human
uugcuggagcucug

SEQ ID NO: 2287661 - RNA, 17 nt, Human
cuauccuacuuccccuu

SEQ ID NO: 2287662 - RNA, 22 nt, Human
uguucugauauuggacaguaaa

SEQ ID NO: 2287663 - RNA, 22 nt, Human
aaacaaggaugaauuaaguuuu

SEQ ID NO: 2287664 - RNA, 18 nt, Human
cuuucacauuuaaauaaa

SEQ ID NO: 2287665 - RNA, 18 nt, Human
guuuaugguuguauuauu

SEQ ID NO: 2287666 - RNA, 16 nt, Human
aggccaugggacaggg

SEQ ID NO: 2287667 - RNA, 14 nt, Human
guaacugauuugua

SEQ ID NO: 2287668 - RNA, 16 nt, Human
cauuuguauaaaauaa

SEQ ID NO: 2287669 - RNA, 17 nt, Human
aaaaauccuacuuucau

SEQ ID NO: 2287670 - RNA, 15 nt, Human
caggaaguagaggag

SEQ ID NO: 2287671 - RNA, 22 nt, Human
aaugaaauggugaaaugcagag

SEQ ID NO: 2287672 - RNA, 15 nt, Human
aauucugaaagcaac

SEQ ID NO: 2287673 - RNA, 19 nt, Human
acaaauuuacagagacaga

SEQ ID NO: 2287674 - RNA, 21 nt, Human
acagugaaagaaaauaacaau

SEQ ID NO: 2287675 - RNA, 13 nt, Human
acacuuaaaaaug

SEQ ID NO: 2287676 - RNA, 16 nt, Human
aauuuuuaauuauaug

SEQ ID NO: 2287677 - RNA, 22 nt, Human
ugaaaaaguucugcagauaaac

SEQ ID NO: 2287678 - RNA, 20 nt, Human
caggcugagccucagucucc

SEQ ID NO: 2287679 - RNA, 23 nt, Human
ggcuaagcuucacuguaaaauaa

SEQ ID NO: 2287680 - RNA, 23 nt, Human
uccaaacugacucuuaagaagac

SEQ ID NO: 2287681 - RNA, 13 nt, Human
cucaccuccccca

SEQ ID NO: 2287682 - RNA, 21 nt, Human
auucagagcuuacuuaaaauu

SEQ ID NO: 2287683 - RNA, 22 nt, Human
agcuuguauuccuuuuucucuc

SEQ ID NO: 2287684 - RNA, 21 nt, Human
cuaccuuuugcuguggcaaau

SEQ ID NO: 2287685 - RNA, 19 nt, Human
gcacuaguauuucuaugaa

SEQ ID NO: 2287686 - RNA, 17 nt, Human
acaagaaaugaaagcag

SEQ ID NO: 2287687 - RNA, 12 nt, Human
cucauggaauug

SEQ ID NO: 2287688 - RNA, 15 nt, Human
uggacgagaaaacaa

SEQ ID NO: 2287689 - RNA, 13 nt, Human
cacaacacacaga

SEQ ID NO: 2287690 - RNA, 15 nt, Human
caggaggaaggcuua

SEQ ID NO: 2287691 - RNA, 16 nt, Human
aacaauaaaagacaag

SEQ ID NO: 2287692 - RNA, 22 nt, Human
uuccccuuccuaauuccacagc

SEQ ID NO: 2287693 - RNA, 14 nt, Human
cacaacacacagau

SEQ ID NO: 2287694 - RNA, 17 nt, Human
caagaaaugaaagcagg

SEQ ID NO: 2287695 - RNA, 21 nt, Human
aggcaugagucagucugauga

SEQ ID NO: 2287696 - RNA, 18 nt, Human
auccccaagccuggcaag

SEQ ID NO: 2287697 - RNA, 17 nt, Human
caaacauauauaacaau

SEQ ID NO: 2287698 - RNA, 15 nt, Human
cugcagauaaacagu

SEQ ID NO: 2287699 - RNA, 13 nt, Human
caacaucuaguga

SEQ ID NO: 2287700 - RNA, 19 nt, Human
uuauggcacuaguauuucu

SEQ ID NO: 2287701 - RNA, 15 nt, Human
ucugucucaguccau

SEQ ID NO: 2287702 - RNA, 16 nt, Human
acagagacagaaagca

SEQ ID NO: 2287703 - RNA, 12 nt, Human
uaguacacacuu

SEQ ID NO: 2287704 - RNA, 20 nt, Human
acuaaauugacacuuaaaaa

SEQ ID NO: 2287705 - RNA, 19 nt, Human
aauguuuacagauccccaa

SEQ ID NO: 2287706 - RNA, 22 nt, Human
cuccagagggaauugcagagua

SEQ ID NO: 2287707 - RNA, 18 nt, Human
uccagcuggccgggagcc

SEQ ID NO: 2287708 - RNA, 17 nt, Human
uggugaaaugcagaguc

SEQ ID NO: 2287709 - RNA, 13 nt, Human
uuccucugagccu

SEQ ID NO: 2287710 - RNA, 13 nt, Human
agccucagucucc

SEQ ID NO: 2287711 - RNA, 14 nt, Human
cugagucccaggcu

SEQ ID NO: 2287712 - RNA, 18 nt, Human
cucuauguucuaagaagu

SEQ ID NO: 2287713 - RNA, 17 nt, Human
aggcaugagucagucug

SEQ ID NO: 2287714 - RNA, 19 nt, Human
uucccuugaugaagaaguu

SEQ ID NO: 2287715 - RNA, 16 nt, Human
caugguuuagaaagcu

SEQ ID NO: 2287716 - RNA, 19 nt, Human
ugaaauggacuuuuguaca

SEQ ID NO: 2287717 - RNA, 15 nt, Human
ccaaggagccaaaca

SEQ ID NO: 2287718 - RNA, 14 nt, Human
ucagucucccuccc

SEQ ID NO: 2287719 - RNA, 17 nt, Human
ugaaauggugaaaugca

SEQ ID NO: 2287720 - RNA, 17 nt, Human
guauuauuuuuuaaaaa

SEQ ID NO: 2287721 - RNA, 19 nt, Human
auuuucuauaauuuaaaua

SEQ ID NO: 2287722 - RNA, 20 nt, Human
auaaauggcuuccuggcaau

SEQ ID NO: 2287723 - RNA, 15 nt, Human
auuuuaaaagaauga

SEQ ID NO: 2287724 - RNA, 17 nt, Human
agacacacugaagaagc

SEQ ID NO: 2287725 - RNA, 13 nt, Human
auugucuagugaa

SEQ ID NO: 2287726 - RNA, 17 nt, Human
uuauauuugaaauauug

SEQ ID NO: 2287727 - RNA, 15 nt, Human
cuucaacucccugcc

SEQ ID NO: 2287728 - RNA, 22 nt, Human
ggcagcuuuccucaaaacuuca

SEQ ID NO: 2287729 - RNA, 23 nt, Human
caggcaugagucagucugaugag

SEQ ID NO: 2287730 - RNA, 20 nt, Human
agccuuuuuuugaaaaaaag

SEQ ID NO: 2287731 - RNA, 23 nt, Human
ugauggguuucuccagagggaau

SEQ ID NO: 2287732 - RNA, 18 nt, Human
agaagcaacccaaauguu

SEQ ID NO: 2287733 - RNA, 14 nt, Human
cauagaaguaaaaa

SEQ ID NO: 2287734 - RNA, 20 nt, Human
ucaagucuuucacauuuaaa

SEQ ID NO: 2287735 - RNA, 11 nt, Human
ccugagcccca

SEQ ID NO: 2287736 - RNA, 19 nt, Human
cccccucuggcuccagcug

SEQ ID NO: 2287737 - RNA, 19 nt, Human
auagugaggagcuuugaaa

SEQ ID NO: 2287738 - RNA, 19 nt, Human
auuauuuuuuaaaaaaauu

SEQ ID NO: 2287739 - RNA, 14 nt, Human
ucaaugcagccccc

SEQ ID NO: 2287740 - RNA, 18 nt, Human
caguuguugcccacagcu

SEQ ID NO: 2287741 - RNA, 16 nt, Human
ucagucucccucccuu

SEQ ID NO: 2287742 - RNA, 18 nt, Human
ccugaaagaggaaugaag

SEQ ID NO: 2287743 - RNA, 15 nt, Human
gaaaugaaagcaggg

SEQ ID NO: 2287744 - RNA, 24 nt, Human
uaauuuaaaauaugcucuaaacau

SEQ ID NO: 2287745 - RNA, 14 nt, Human
cgcuaccuuuugcu

SEQ ID NO: 2287746 - RNA, 19 nt, Human
cugcaaagcccagcuugaa

SEQ ID NO: 2287747 - RNA, 13 nt, Human
gaagaacugaaau

SEQ ID NO: 2287748 - RNA, 16 nt, Human
agaacucugagcagug

SEQ ID NO: 2287749 - RNA, 23 nt, Human
uguagguagaucuggucuuuaga

SEQ ID NO: 2287750 - RNA, 15 nt, Human
gccuugggaccccug

SEQ ID NO: 2287751 - RNA, 15 nt, Human
aagaagugaaaaucu

SEQ ID NO: 2287752 - RNA, 18 nt, Human
uaaugaauacuuuauaaa

SEQ ID NO: 2287753 - RNA, 13 nt, Human
acggggugaaacc

SEQ ID NO: 2287754 - RNA, 15 nt, Human
cuacuaauuuuaaaa

SEQ ID NO: 2287755 - RNA, 23 nt, Human
ugagucagucugaugagaacucu

SEQ ID NO: 2287756 - RNA, 23 nt, Human
ucuaccaaaaaucucaauauuuc

SEQ ID NO: 2287757 - RNA, 17 nt, Human
aaauauaaauaaaaaua

SEQ ID NO: 2287758 - RNA, 19 nt, Human
aauuuuuauauuugaaaua

SEQ ID NO: 2287759 - RNA, 14 nt, Human
uucuaugaaauauu

SEQ ID NO: 2287760 - RNA, 22 nt, Human
agaaugagagacacacugaaga

SEQ ID NO: 2287761 - RNA, 19 nt, Human
cagcuacuugggaggcuga

SEQ ID NO: 2287762 - RNA, 19 nt, Human
cuuccagauccuggaaauc

SEQ ID NO: 2287763 - RNA, 14 nt, Human
ugguauguuuucag

SEQ ID NO: 2287764 - RNA, 21 nt, Human
gaacuuuccacauucagagcu

SEQ ID NO: 2287765 - RNA, 19 nt, Human
aaauaugccccauucaaca

SEQ ID NO: 2287766 - RNA, 17 nt, Human
gacaaggaaaaaauaac

SEQ ID NO: 2287767 - RNA, 15 nt, Human
auggugaaaugcaga

SEQ ID NO: 2287768 - RNA, 18 nt, Human
caugaauuaguuuuauau

SEQ ID NO: 2287769 - RNA, 23 nt, Human
cucauguccacugguucuucuug

SEQ ID NO: 2287770 - RNA, 17 nt, Human
gcuucucauccugcagg

SEQ ID NO: 2287771 - RNA, 15 nt, Human
agacaaggaaaaaau

SEQ ID NO: 2287772 - RNA, 19 nt, Human
gguuuaauaauuuuuaauu

SEQ ID NO: 2287773 - RNA, 18 nt, Human
cagccucuuagaugcagu

SEQ ID NO: 2287774 - RNA, 18 nt, Human
uuguaaaggaauuuaaaa

SEQ ID NO: 2287775 - RNA, 22 nt, Human
ucuccagagggaauugcagagu

SEQ ID NO: 2287776 - RNA, 13 nt, Human
acagcccuucuuu

SEQ ID NO: 2287777 - RNA, 21 nt, Human
auuuuuucucuaggaaauauu

SEQ ID NO: 2287778 - RNA, 23 nt, Human
cuucaacucccugccccccagcc

SEQ ID NO: 2287779 - RNA, 23 nt, Human
caugcugucuacacuaagagaga

SEQ ID NO: 2287780 - RNA, 23 nt, Human
ccccucuggcuccagcuggccgg

SEQ ID NO: 2287781 - RNA, 20 nt, Human
auuuugugauugauuauaug

SEQ ID NO: 2287782 - RNA, 23 nt, Human
uccagguagaggguguguaagua

SEQ ID NO: 2287783 - RNA, 15 nt, Human
ucauaauaaguugca

SEQ ID NO: 2287784 - RNA, 23 nt, Human
uggcuugaguuuaaauuguaaua

SEQ ID NO: 2287785 - RNA, 15 nt, Human
cucguggaacaguua

SEQ ID NO: 2287786 - RNA, 11 nt, Human
auuuuugaagc

SEQ ID NO: 2287787 - RNA, 20 nt, Human
cccugcacuccagccugagc

SEQ ID NO: 2287788 - RNA, 17 nt, Human
auaaaguacaagagcuu

SEQ ID NO: 2287789 - RNA, 16 nt, Human
ugugagaugcuagaac

SEQ ID NO: 2287790 - RNA, 19 nt, Human
auuguaguccuguaaugga

SEQ ID NO: 2287791 - RNA, 20 nt, Human
cccugccccccagcccuccu

SEQ ID NO: 2287792 - RNA, 12 nt, Human
uauuauuuuuua

SEQ ID NO: 2287793 - RNA, 22 nt, Human
uauuucagauaaucacaauaca

SEQ ID NO: 2287794 - RNA, 13 nt, Human
aagugcagccccg

SEQ ID NO: 2287795 - RNA, 15 nt, Human
cugcacuccagccug

SEQ ID NO: 2287796 - RNA, 17 nt, Human
aaccuagggugauauua

SEQ ID NO: 2287797 - RNA, 19 nt, Human
ucaguuauuauauuuacaa

SEQ ID NO: 2287798 - RNA, 21 nt, Human
cccuauccuacuuccccuucc

SEQ ID NO: 2287799 - RNA, 12 nt, Human
cuugguuuuaau

SEQ ID NO: 2287800 - RNA, 23 nt, Human
uugccugcaggcaugagucaguc

SEQ ID NO: 2287801 - RNA, 20 nt, Human
augucgucaaagcugaaaug

SEQ ID NO: 2287802 - RNA, 21 nt, Human
auauaugcuaagucuuauaua

SEQ ID NO: 2287803 - RNA, 15 nt, Human
ggccuccauccugag

SEQ ID NO: 2287804 - RNA, 20 nt, Human
aaggaugccccgucccccuc

SEQ ID NO: 2287805 - RNA, 16 nt, Human
uuaaauuguaauaggc

SEQ ID NO: 2287806 - RNA, 15 nt, Human
ugauuucauucaaua

SEQ ID NO: 2287807 - RNA, 19 nt, Human
acagucaccucauggaauu

SEQ ID NO: 2287808 - RNA, 19 nt, Human
cgcccacuagacccacugg

SEQ ID NO: 2287809 - RNA, 20 nt, Human
uccagccugagcgacaguga

SEQ ID NO: 2287810 - RNA, 16 nt, Human
ucaaaagaaagaaaau

SEQ ID NO: 2287811 - RNA, 15 nt, Human
cccccagcccuccuu

SEQ ID NO: 2287812 - RNA, 18 nt, Human
uggucaauuuuguuaugu

SEQ ID NO: 2287813 - RNA, 23 nt, Human
gccccugcacuccagccugagcg

SEQ ID NO: 2287814 - RNA, 17 nt, Human
auuauuuuuuaaaaaaa

SEQ ID NO: 2287815 - RNA, 14 nt, Human
gagcucagcccugg

SEQ ID NO: 2287816 - RNA, 14 nt, Human
uaacuaauuuuaac

SEQ ID NO: 2287817 - RNA, 15 nt, Human
uuuaugguuguauua

SEQ ID NO: 2287818 - RNA, 14 nt, Human
cagugaaagaaaau

SEQ ID NO: 2287819 - RNA, 21 nt, Human
ugaaacgaggauugggaaaaa

SEQ ID NO: 2287820 - RNA, 22 nt, Human
gagucccaggcugagccucagu

SEQ ID NO: 2287821 - RNA, 18 nt, Human
ucuucaacucccugcccc

SEQ ID NO: 2287822 - RNA, 22 nt, Human
gcuaaaacaagcacuaaacaaa

SEQ ID NO: 2287823 - RNA, 18 nt, Human
gaaacaaaaggauaauga

SEQ ID NO: 2287824 - RNA, 18 nt, Human
ucucuaggaaauauuuau

SEQ ID NO: 2287825 - RNA, 14 nt, Human
cucaccccuugcca

SEQ ID NO: 2287826 - RNA, 17 nt, Human
ccuacuuccccuuccua

SEQ ID NO: 2287827 - RNA, 22 nt, Human
gucucuacuaaaaauacaaaaa

SEQ ID NO: 2287828 - RNA, 23 nt, Human
ggaugguucccuugaugaagaag

SEQ ID NO: 2287829 - RNA, 15 nt, Human
uugacccacaagaaa

SEQ ID NO: 2287830 - RNA, 16 nt, Human
cugagccucagucucc

SEQ ID NO: 2287831 - RNA, 16 nt, Human
ggccuccauccugagg

SEQ ID NO: 2287832 - RNA, 16 nt, Human
aaagacaaggaaaaaa

SEQ ID NO: 2287833 - RNA, 16 nt, Human
cuugccugcaggcaug

SEQ ID NO: 2287834 - RNA, 13 nt, Human
uuaugcuaaguga

SEQ ID NO: 2287835 - RNA, 21 nt, Human
aaacaauaacgauaaaagaca

SEQ ID NO: 2287836 - RNA, 13 nt, Human
gauuguaaaaugg

SEQ ID NO: 2287837 - RNA, 16 nt, Human
aaaauccauacauuug

SEQ ID NO: 2287838 - RNA, 12 nt, Human
cuccauuuuuag

SEQ ID NO: 2287839 - RNA, 14 nt, Human
uggcuugaguuuaa

SEQ ID NO: 2287840 - RNA, 18 nt, Human
uauuuucaguuauuauau

SEQ ID NO: 2287841 - RNA, 17 nt, Human
ugguucccuugaugaag

SEQ ID NO: 2287842 - RNA, 20 nt, Human
aguuguuucuacuacaugga

SEQ ID NO: 2287843 - RNA, 19 nt, Human
cacaggaaccacaagacug

SEQ ID NO: 2287844 - RNA, 22 nt, Human
uuuuauagcuacuaauuuuaaa

SEQ ID NO: 2287845 - RNA, 13 nt, Human
ugcauuucuaaag

SEQ ID NO: 2287846 - RNA, 15 nt, Human
uguauuuuaaaagaa

SEQ ID NO: 2287847 - RNA, 15 nt, Human
aauauaaauaaaaau

SEQ ID NO: 2287848 - RNA, 15 nt, Human
uauaaauaaaaauaa

SEQ ID NO: 2287849 - RNA, 20 nt, Human
aacaaugcuguauuuuaaaa

SEQ ID NO: 2287850 - RNA, 19 nt, Human
ugagcgcccacuagaccca

SEQ ID NO: 2287851 - RNA, 21 nt, Human
ccuggugccucaccccuugcc

SEQ ID NO: 2287852 - RNA, 15 nt, Human
aaauauaaauaaaaa

SEQ ID NO: 2287853 - RNA, 16 nt, Human
cuacacuccagugaga

SEQ ID NO: 2287854 - RNA, 18 nt, Human
accaccugccuauauuuu

SEQ ID NO: 2287855 - RNA, 16 nt, Human
cagcuuuuucucuccc

SEQ ID NO: 2287856 - RNA, 16 nt, Human
uaccuuuugcuguggc

SEQ ID NO: 2287857 - RNA, 12 nt, Human
cuuccucacacc

SEQ ID NO: 2287858 - RNA, 14 nt, Human
cucccucccuuggg

SEQ ID NO: 2287859 - RNA, 21 nt, Human
aauuuuuauauuugaaauauu

SEQ ID NO: 2287860 - RNA, 13 nt, Human
aucaggcuggcca

SEQ ID NO: 2287861 - RNA, 18 nt, Human
uguaaaggaauuuaaaaa

SEQ ID NO: 2287862 - RNA, 13 nt, Human
ugaaaaucuuaua

SEQ ID NO: 2287863 - RNA, 19 nt, Human
auguuuacagauccccaag

SEQ ID NO: 2287864 - RNA, 22 nt, Human
gaagugaaaaucuacacuccag

SEQ ID NO: 2287865 - RNA, 18 nt, Human
uaaaagacaaggaaaaaa

SEQ ID NO: 2287866 - RNA, 11 nt, Human
uucacagggga

SEQ ID NO: 2287867 - RNA, 15 nt, Human
aaacauaugaauuau

SEQ ID NO: 2287868 - RNA, 18 nt, Human
accaggcuugccugcagg

SEQ ID NO: 2287869 - RNA, 22 nt, Human
ccccuuccuaauuccacagcug

SEQ ID NO: 2287870 - RNA, 16 nt, Human
aauuacauuuguauaa

SEQ ID NO: 2287871 - RNA, 22 nt, Human
ccgggagccugaucaccugccc

SEQ ID NO: 2287872 - RNA, 17 nt, Human
uaauuuuuauauuugaa

SEQ ID NO: 2287873 - RNA, 17 nt, Human
uuucacauuuaaauaaa

SEQ ID NO: 2287874 - RNA, 19 nt, Human
aaauggugaaaugcagagu

SEQ ID NO: 2287875 - RNA, 20 nt, Human
aauuuugugaagcaaaauuu

SEQ ID NO: 2287876 - RNA, 18 nt, Human
cugagggcauagaaguaa

SEQ ID NO: 2287877 - RNA, 22 nt, Human
gugccucaccccuugccauaau

SEQ ID NO: 2287878 - RNA, 17 nt, Human
uaaaagacaaggaaaaa

SEQ ID NO: 2287879 - RNA, 22 nt, Human
caucgcaauguaagacucggga

SEQ ID NO: 2287880 - RNA, 17 nt, Human
gacgagaaaacaauaac

SEQ ID NO: 2287881 - RNA, 16 nt, Human
auuuuaauaauguuuc

SEQ ID NO: 2287882 - RNA, 21 nt, Human
cagagucaaugaacuuuccac

SEQ ID NO: 2287883 - RNA, 19 nt, Human
aauuuuguuauguauauuu

SEQ ID NO: 2287884 - RNA, 14 nt, Human
acuaauuuuaaaau

SEQ ID NO: 2287885 - RNA, 20 nt, Human
uagaugcaguucugaagaag

SEQ ID NO: 2287886 - RNA, 14 nt, Human
ccugggcugaggca

SEQ ID NO: 2287887 - RNA, 15 nt, Human
cauccugcaggcagc

SEQ ID NO: 2287888 - RNA, 12 nt, Human
auauaaauaaaa

SEQ ID NO: 2287889 - RNA, 19 nt, Human
ugaucaccugcccugcuga

SEQ ID NO: 2287890 - RNA, 12 nt, Human
uaagaagacugc

SEQ ID NO: 2287891 - RNA, 21 nt, Human
cucaguccaugaagauguaga

SEQ ID NO: 2287892 - RNA, 16 nt, Human
ccugagcgacagugag

SEQ ID NO: 2287893 - RNA, 22 nt, Human
uuugaugcuacaggauuugaaa

SEQ ID NO: 2287894 - RNA, 18 nt, Human
gccuuggggcugaugcag

SEQ ID NO: 2287895 - RNA, 15 nt, Human
gcaacccaaauguuc

SEQ ID NO: 2287896 - RNA, 17 nt, Human
caaauauaaauaaaaau

SEQ ID NO: 2287897 - RNA, 23 nt, Human
auauaacaaugcuguauuuuaaa

SEQ ID NO: 2287898 - RNA, 18 nt, Human
gacccacuggacucaccu

SEQ ID NO: 2287899 - RNA, 15 nt, Human
aaauauuuauuuuaa

SEQ ID NO: 2287900 - RNA, 22 nt, Human
agugagcagucaggaaagagaa

SEQ ID NO: 2287901 - RNA, 17 nt, Human
cuggcaaggguucaccu

SEQ ID NO: 2287902 - RNA, 22 nt, Human
agaagcaccaaucaugaauuag

SEQ ID NO: 2287903 - RNA, 20 nt, Human
cuuauucacaagacccaaaa

SEQ ID NO: 2287904 - RNA, 18 nt, Human
uaaguuuuuuuuuaaaaa

SEQ ID NO: 2287905 - RNA, 15 nt, Human
uuauagcuacuaauu

SEQ ID NO: 2287906 - RNA, 15 nt, Human
gcccacuagacccac

SEQ ID NO: 2287907 - RNA, 20 nt, Human
ugauuucugagcauuuaaua

SEQ ID NO: 2287908 - RNA, 16 nt, Human
cacgggggccaaggau

SEQ ID NO: 2287909 - RNA, 22 nt, Human
uacaugagguacugagagugaa

SEQ ID NO: 2287910 - RNA, 15 nt, Human
cuggacucaccuccc

SEQ ID NO: 2287911 - RNA, 20 nt, Human
uuuaguaagagauuccugag

SEQ ID NO: 2287912 - RNA, 17 nt, Human
caaauccaaugaaauga

SEQ ID NO: 2287913 - RNA, 21 nt, Human
auuuuccugaaaacccuugcc

SEQ ID NO: 2287914 - RNA, 20 nt, Human
uuuaaauaaaguguuugaaa

SEQ ID NO: 2287915 - RNA, 20 nt, Human
ccauacuaauuauacccccu

SEQ ID NO: 2287916 - RNA, 13 nt, Human
cacacugaagaag

SEQ ID NO: 2287917 - RNA, 23 nt, Human
caccucauggaauuggagcucgu

SEQ ID NO: 2287918 - RNA, 13 nt, Human
cuugccugcaggc

SEQ ID NO: 2287919 - RNA, 18 nt, Human
acaugaacuuguaaagga

SEQ ID NO: 2287920 - RNA, 16 nt, Human
uucccaacuccagaaa

SEQ ID NO: 2287921 - RNA, 23 nt, Human
cuuaagaagacugcauuauauuu

SEQ ID NO: 2287922 - RNA, 16 nt, Human
cagcuuuccucaaaac

SEQ ID NO: 2287923 - RNA, 14 nt, Human
acuuggucugugag

SEQ ID NO: 2287924 - RNA, 20 nt, Human
aagcuucacuguaaaauaau

SEQ ID NO: 2287925 - RNA, 18 nt, Human
auagcuacuaauuuuaaa

SEQ ID NO: 2287926 - RNA, 23 nt, Human
gauagauaggucagugcaaauac

SEQ ID NO: 2287927 - RNA, 20 nt, Human
aggcugagaugggagaauca

SEQ ID NO: 2287928 - RNA, 18 nt, Human
caaggcuagaaccaccug

SEQ ID NO: 2287929 - RNA, 15 nt, Human
ucuuauaauuuaaaa

SEQ ID NO: 2287930 - RNA, 21 nt, Human
caagacccaaaaggcagaagc

SEQ ID NO: 2287931 - RNA, 12 nt, Human
gcugaugcaguu

SEQ ID NO: 2287932 - RNA, 23 nt, Human
agcccuccuuaucaaaggacacc

SEQ ID NO: 2287933 - RNA, 22 nt, Human
aauuuaaaaaaaaaccugagcc

SEQ ID NO: 2287934 - RNA, 16 nt, Human
gaaggcuuacacccac

SEQ ID NO: 2287935 - RNA, 12 nt, Human
cucccugccccc

SEQ ID NO: 2287936 - RNA, 16 nt, Human
aaauauuauguuaaaa

SEQ ID NO: 2287937 - RNA, 20 nt, Human
aauaauuuuuauauuugaaa

SEQ ID NO: 2287938 - RNA, 12 nt, Human
caugggaaguga

SEQ ID NO: 2287939 - RNA, 17 nt, Human
aagcuuuuuuugaauca

SEQ ID NO: 2287940 - RNA, 15 nt, Human
auccugccccugagc

SEQ ID NO: 2287941 - RNA, 21 nt, Human
cccccauuguggucacaggaa

SEQ ID NO: 2287942 - RNA, 20 nt, Human
uguuggugaacuugguuuua

SEQ ID NO: 2287943 - RNA, 14 nt, Human
cgucccccucuggc

SEQ ID NO: 2287944 - RNA, 15 nt, Human
agacagcucugcaua

SEQ ID NO: 2287945 - RNA, 19 nt, Human
cucaccucccccaucucuu

SEQ ID NO: 2287946 - RNA, 18 nt, Human
cagaaagcagaacaguga

SEQ ID NO: 2287947 - RNA, 19 nt, Human
uauauuuuugugauuuugu

SEQ ID NO: 2287948 - RNA, 14 nt, Human
aaaagacagugaaa

SEQ ID NO: 2287949 - RNA, 13 nt, Human
uauuucuaugaaa

SEQ ID NO: 2287950 - RNA, 16 nt, Human
augcuguauuuuaaaa

SEQ ID NO: 2287951 - RNA, 17 nt, Human
uguaaaggaauuuaaaa

SEQ ID NO: 2287952 - RNA, 17 nt, Human
agcucugcccauccugc

SEQ ID NO: 2287953 - RNA, 16 nt, Human
agguugcagugagccg

SEQ ID NO: 2287954 - RNA, 14 nt, Human
uuaugauuaaguaa

SEQ ID NO: 2287955 - RNA, 19 nt, Human
auccuacaagacacaguga

SEQ ID NO: 2287956 - RNA, 18 nt, Human
agagaaugagagacacac

SEQ ID NO: 2287957 - RNA, 22 nt, Human
acaugagguacugagagugaac

SEQ ID NO: 2287958 - RNA, 18 nt, Human
cuccagccugagcgacag

SEQ ID NO: 2287959 - RNA, 16 nt, Human
gacauuugcucaugga

SEQ ID NO: 2287960 - RNA, 15 nt, Human
acucaacaaacauaa

SEQ ID NO: 2287961 - RNA, 14 nt, Human
cagagguugcagug

SEQ ID NO: 2287962 - RNA, 13 nt, Human
caccaaggagcca

SEQ ID NO: 2287963 - RNA, 21 nt, Human
cuaguaucaaaagaaagaaaa

SEQ ID NO: 2287964 - RNA, 23 nt, Human
cauuguggucacaggaaguagag

SEQ ID NO: 2287965 - RNA, 23 nt, Human
ucggccuccauccugaggcucca

SEQ ID NO: 2287966 - RNA, 22 nt, Human
auauauaacaaugcuguauuuu

SEQ ID NO: 2287967 - RNA, 18 nt, Human
uguacuuuauuuucuaua

SEQ ID NO: 2287968 - RNA, 15 nt, Human
uggaguaaaucgcua

SEQ ID NO: 2287969 - RNA, 13 nt, Human
agagguccacaac

SEQ ID NO: 2287970 - RNA, 13 nt, Human
uuuucuuuucauu

SEQ ID NO: 2287971 - RNA, 15 nt, Human
ccagcacagccucuu

SEQ ID NO: 2287972 - RNA, 22 nt, Human
caauaaaagacaaggaaaaaau

SEQ ID NO: 2287973 - RNA, 16 nt, Human
aaaguguuugaaagcu

SEQ ID NO: 2287974 - RNA, 16 nt, Human
uaggauguugaaaaag

SEQ ID NO: 2287975 - RNA, 13 nt, Human
caacucccugccc

SEQ ID NO: 2287976 - RNA, 18 nt, Human
uuuuagugaaauauuauu

SEQ ID NO: 2287977 - RNA, 16 nt, Human
cauccuuccucacacc

SEQ ID NO: 2287978 - RNA, 17 nt, Human
uaugcuaagugaaauaa

SEQ ID NO: 2287979 - RNA, 23 nt, Human
gcccuggugccucaccccuugcc

SEQ ID NO: 2287980 - RNA, 21 nt, Human
auaguuguaccgcaaugugac

SEQ ID NO: 2287981 - RNA, 13 nt, Human
uuaaaaaagaaac

SEQ ID NO: 2287982 - RNA, 17 nt, Human
uuauaucaauuuaaaaa

SEQ ID NO: 2287983 - RNA, 19 nt, Human
ucaguccaugaagauguag

SEQ ID NO: 2287984 - RNA, 18 nt, Human
uaauaauguuucaaacau

SEQ ID NO: 2287985 - RNA, 15 nt, Human
ccccugagcuugcag

SEQ ID NO: 2287986 - RNA, 21 nt, Human
ucuucaacucccugcccccca

SEQ ID NO: 2287987 - RNA, 14 nt, Human
cuccagugagacag

SEQ ID NO: 2287988 - RNA, 22 nt, Human
ugauaguuguaccgcaauguga

SEQ ID NO: 2287989 - RNA, 22 nt, Human
aaguuguagguaauauugcaag

SEQ ID NO: 2287990 - RNA, 15 nt, Human
ccacaggaaccacaa

SEQ ID NO: 2287991 - RNA, 14 nt, Human
ccagcuggccggga

SEQ ID NO: 2287992 - RNA, 13 nt, Human
ucacuguaaaaua

SEQ ID NO: 2287993 - RNA, 19 nt, Human
uggaaauguuuacagaucc

SEQ ID NO: 2287994 - RNA, 23 nt, Human
uagacacacaugaaguccaagca

SEQ ID NO: 2287995 - RNA, 16 nt, Human
ccuccuuuuaaaguaa

SEQ ID NO: 2287996 - RNA, 21 nt, Human
uuacauuuguauaaaauaauu

SEQ ID NO: 2287997 - RNA, 10 nt, Human
caacucccug

SEQ ID NO: 2287998 - RNA, 22 nt, Human
gugaacaaauuuacagagacag

SEQ ID NO: 2287999 - RNA, 15 nt, Human
gcaggcaugagucag

SEQ ID NO: 2288000 - RNA, 18 nt, Human
auuugcuggagcucugcc

SEQ ID NO: 2288001 - RNA, 22 nt, Human
gaaaacaauaacgauaaaagac

SEQ ID NO: 2288002 - RNA, 13 nt, Human
ccuccuuuuaaag

SEQ ID NO: 2288003 - RNA, 19 nt, Human
ucagugucaaugcagcccc

SEQ ID NO: 2288004 - RNA, 23 nt, Human
agcagugcuugaaugaaguugua

SEQ ID NO: 2288005 - RNA, 16 nt, Human
caggcugagccucagu

SEQ ID NO: 2288006 - RNA, 13 nt, Human
acaaggaaaaaau

SEQ ID NO: 2288007 - RNA, 11 nt, Human
aauuccacagc

SEQ ID NO: 2288008 - RNA, 18 nt, Human
ccauccugccccugagcc

SEQ ID NO: 2288009 - RNA, 19 nt, Human
acuucagcgguuuauauaa

SEQ ID NO: 2288010 - RNA, 17 nt, Human
ggccaugggacagggag

SEQ ID NO: 2288011 - RNA, 12 nt, Human
aauaauuuuuaa

SEQ ID NO: 2288012 - RNA, 19 nt, Human
gugaacuugguuuuaauua

SEQ ID NO: 2288013 - RNA, 22 nt, Human
acauccuacaagacacagugac

SEQ ID NO: 2288014 - RNA, 18 nt, Human
uaucaaaagaaagaaaau

SEQ ID NO: 2288015 - RNA, 17 nt, Human
uuauuacuguaagaaaa

SEQ ID NO: 2288016 - RNA, 23 nt, Human
auuucugagcauuuaauauggau

SEQ ID NO: 2288017 - RNA, 21 nt, Human
uccuucagccugaaagaggaa

SEQ ID NO: 2288018 - RNA, 19 nt, Human
gcucauggaauuggagcuc

SEQ ID NO: 2288019 - RNA, 13 nt, Human
ucuuauaauuuaa

SEQ ID NO: 2288020 - RNA, 19 nt, Human
cucugcauacucauuagga

SEQ ID NO: 2288021 - RNA, 16 nt, Human
auuuguauaaaauaau

SEQ ID NO: 2288022 - RNA, 14 nt, Human
gcaaagcccagcuu

SEQ ID NO: 2288023 - RNA, 22 nt, Human
gcuucucauccugcaggcagcu

SEQ ID NO: 2288024 - RNA, 17 nt, Human
ucauacuucuuaggguu

SEQ ID NO: 2288025 - RNA, 21 nt, Human
cugcccugcugagucccaggc

SEQ ID NO: 2288026 - RNA, 18 nt, Human
uccuaauuccacagcugc

SEQ ID NO: 2288027 - RNA, 22 nt, Human
cccaugauguuuagaaacacaa

SEQ ID NO: 2288028 - RNA, 12 nt, Human
aagaaaauaaca

SEQ ID NO: 2288029 - RNA, 21 nt, Human
uagggugauauuaaccagggg

SEQ ID NO: 2288030 - RNA, 19 nt, Human
uuuauaucaauuuaaaaaa

SEQ ID NO: 2288031 - RNA, 21 nt, Human
uuauagcuacuaauuuuaaaa

SEQ ID NO: 2288032 - RNA, 19 nt, Human
auuucuucaacucccugcc

SEQ ID NO: 2288033 - RNA, 14 nt, Human
uaugaauuacauuu

SEQ ID NO: 2288034 - RNA, 22 nt, Human
augcagagguccacaacacaca

SEQ ID NO: 2288035 - RNA, 18 nt, Human
uagugaaauauuauuuua

SEQ ID NO: 2288036 - RNA, 18 nt, Human
cagcuuauugucuaguga

SEQ ID NO: 2288037 - RNA, 16 nt, Human
guuuuuuuuuaaaaaa

SEQ ID NO: 2288038 - RNA, 19 nt, Human
gagguacugagagugaaca

SEQ ID NO: 2288039 - RNA, 21 nt, Human
gccaaauauaaauaaaaauaa

SEQ ID NO: 2288040 - RNA, 17 nt, Human
uaacugauuuguaacaa

SEQ ID NO: 2288041 - RNA, 12 nt, Human
uucagccugaaa

SEQ ID NO: 2288042 - RNA, 22 nt, Human
cucagcccuggugggcagagag

SEQ ID NO: 2288043 - RNA, 14 nt, Human
cuacaagacacagu

SEQ ID NO: 2288044 - RNA, 14 nt, Human
accauuuuuacuug

SEQ ID NO: 2288045 - RNA, 13 nt, Human
ccacaacacacag

SEQ ID NO: 2288046 - RNA, 20 nt, Human
aagacagugaaagaaaauaa

SEQ ID NO: 2288047 - RNA, 23 nt, Human
auugcagaguacuggcugaugga

SEQ ID NO: 2288048 - RNA, 16 nt, Human
ccucaaaacuucagac

SEQ ID NO: 2288049 - RNA, 16 nt, Human
cagauccccaagccug

SEQ ID NO: 2288050 - RNA, 22 nt, Human
cagaguacuggcugauggagua

SEQ ID NO: 2288051 - RNA, 18 nt, Human
uaauuuuaacucuauaau

SEQ ID NO: 2288052 - RNA, 14 nt, Human
auuuguauaaaaua

SEQ ID NO: 2288053 - RNA, 13 nt, Human
ugagcgacaguga

SEQ ID NO: 2288054 - RNA, 21 nt, Human
ccuuuuuuugaaaaaaagcuu

SEQ ID NO: 2288055 - RNA, 19 nt, Human
cuggacucaccucccccau

SEQ ID NO: 2288056 - RNA, 19 nt, Human
guccaggucuaccaaaaau

SEQ ID NO: 2288057 - RNA, 18 nt, Human
acaaaugcauuucuaaag

SEQ ID NO: 2288058 - RNA, 16 nt, Human
ccugagcuugcagaga

SEQ ID NO: 2288059 - RNA, 18 nt, Human
ccuugggaccccugagcu

SEQ ID NO: 2288060 - RNA, 19 nt, Human
gcauccuuccucacaccag

SEQ ID NO: 2288061 - RNA, 13 nt, Human
aaaauaacaauga

SEQ ID NO: 2288062 - RNA, 16 nt, Human
cugcacuccagccuga

SEQ ID NO: 2288063 - RNA, 19 nt, Human
agucaaugaacuuuccaca

SEQ ID NO: 2288064 - RNA, 13 nt, Human
augauuccaccua

SEQ ID NO: 2288065 - RNA, 12 nt, Human
aaaagaaagaaa

SEQ ID NO: 2288066 - RNA, 20 nt, Human
acuagaguuuagcuggaaaa

SEQ ID NO: 2288067 - RNA, 16 nt, Human
uccuguaauggaagca

SEQ ID NO: 2288068 - RNA, 16 nt, Human
ucuuauaauuuaaaau

SEQ ID NO: 2288069 - RNA, 24 nt, Human
cauucuggaauaauccuaaacaua

SEQ ID NO: 2288070 - RNA, 14 nt, Human
agaguacuggcuga

SEQ ID NO: 2288071 - RNA, 16 nt, Human
gacaagcucacagacc

SEQ ID NO: 2288072 - RNA, 23 nt, Human
aucacagcuacuugggaggcuga

SEQ ID NO: 2288073 - RNA, 12 nt, Human
aauugcagagua

SEQ ID NO: 2288074 - RNA, 15 nt, Human
uuuaauaauuuuuaa

SEQ ID NO: 2288075 - RNA, 14 nt, Human
aaagaggaaugaag

SEQ ID NO: 2288076 - RNA, 23 nt, Human
ggaacaguuaccucugccucaga

SEQ ID NO: 2288077 - RNA, 22 nt, Human
aaaaaaccugagccccaaaagg

SEQ ID NO: 2288078 - RNA, 12 nt, Human
uguuugaaagcu

SEQ ID NO: 2288079 - RNA, 14 nt, Human
cucaacaaacauaa

SEQ ID NO: 2288080 - RNA, 20 nt, Human
aaugaauacuuuauaaagga

SEQ ID NO: 2288081 - RNA, 18 nt, Human
acucuuaagaagacugca

SEQ ID NO: 2288082 - RNA, 18 nt, Human
cauagguuuaauaauuuu

SEQ ID NO: 2288083 - RNA, 16 nt, Human
ucuucaacucccugcc

SEQ ID NO: 2288084 - RNA, 19 nt, Human
cucauggaauuggagcucg

SEQ ID NO: 2288085 - RNA, 15 nt, Human
ugccugcaggcauga

SEQ ID NO: 2288086 - RNA, 17 nt, Human
uaucuuuuuuuuaauaa

SEQ ID NO: 2288087 - RNA, 17 nt, Human
auaucaauuuaaaaaaa

SEQ ID NO: 2288088 - RNA, 11 nt, Human
acugggacagg

SEQ ID NO: 2288089 - RNA, 15 nt, Human
aagccuggcaaggga

SEQ ID NO: 2288090 - RNA, 18 nt, Human
ccucuggcuccagcuggc

SEQ ID NO: 2288091 - RNA, 22 nt, Human
auauuuacaaaugggaaacaaa

SEQ ID NO: 2288092 - RNA, 22 nt, Human
aaacauguuuaucguauuugau

SEQ ID NO: 2288093 - RNA, 17 nt, Human
aauaacaauaaaagaca

SEQ ID NO: 2288094 - RNA, 16 nt, Human
aaaauaacaauaaaag

SEQ ID NO: 2288095 - RNA, 22 nt, Human
ccgggaggcagagguugcagug

SEQ ID NO: 2288096 - RNA, 23 nt, Human
aacuuguaaaggaauuuaaaaau

SEQ ID NO: 2288097 - RNA, 16 nt, Human
uaaaagacaaggaaaa

SEQ ID NO: 2288098 - RNA, 17 nt, Human
gaaaaucaggcuggcca

SEQ ID NO: 2288099 - RNA, 18 nt, Human
agccugaucaccugcccu

SEQ ID NO: 2288100 - RNA, 16 nt, Human
uucaguuauuauauuu

SEQ ID NO: 2288101 - RNA, 20 nt, Human
uuacaaauccaaugaaauga

SEQ ID NO: 2288102 - RNA, 16 nt, Human
accaggcuugccugca

SEQ ID NO: 2288103 - RNA, 13 nt, Human
aacaauaaaagac

SEQ ID NO: 2288104 - RNA, 20 nt, Human
augaaguuguagguaauauu

SEQ ID NO: 2288105 - RNA, 21 nt, Human
ugcucaauaaaguacaagagc

SEQ ID NO: 2288106 - RNA, 14 nt, Human
ccaugggacaggga

SEQ ID NO: 2288107 - RNA, 12 nt, Human
ccaggcugagcc

SEQ ID NO: 2288108 - RNA, 16 nt, Human
aauaaaguguuugaaa

SEQ ID NO: 2288109 - RNA, 15 nt, Human
gugaacuugguuuua

SEQ ID NO: 2288110 - RNA, 16 nt, Human
gccaaggaugccccgu

SEQ ID NO: 2288111 - RNA, 22 nt, Human
caaaugggaaacaaaaggauaa

SEQ ID NO: 2288112 - RNA, 18 nt, Human
ugagcucagcccuggugg

SEQ ID NO: 2288113 - RNA, 17 nt, Human
uaaaagacagugaaaga

SEQ ID NO: 2288114 - RNA, 17 nt, Human
aggccaugggacaggga

SEQ ID NO: 2288115 - RNA, 15 nt, Human
auauaaauaaaaaua

SEQ ID NO: 2288116 - RNA, 17 nt, Human
ugaaauauuauuuuaua

SEQ ID NO: 2288117 - RNA, 22 nt, Human
cucccacuagacaaguccagcc

SEQ ID NO: 2288118 - RNA, 17 nt, Human
caagccuccuuuuaaag

SEQ ID NO: 2288119 - RNA, 21 nt, Human
auuuuaguaagagauuccuga

SEQ ID NO: 2288120 - RNA, 18 nt, Human
ccugccuaagugcagccc

SEQ ID NO: 2288121 - RNA, 18 nt, Human
uauuuucuauaauuuaaa

SEQ ID NO: 2288122 - RNA, 13 nt, Human
aucuacacuccag

SEQ ID NO: 2288123 - RNA, 11 nt, Human
ggguuucucca

SEQ ID NO: 2288124 - RNA, 23 nt, Human
aauauugcaaggcaaagacuauu

SEQ ID NO: 2288125 - RNA, 12 nt, Human
cagugaaagaaa

SEQ ID NO: 2288126 - RNA, 17 nt, Human
aauaaaguguuugaaag

SEQ ID NO: 2288127 - RNA, 21 nt, Human
auaauuuuuauauuugaaaua

SEQ ID NO: 2288128 - RNA, 23 nt, Human
ugcauagguuuaauaauuuuuaa

SEQ ID NO: 2288129 - RNA, 23 nt, Human
aaauuuacagagacagaaagcag

SEQ ID NO: 2288130 - RNA, 13 nt, Human
aacucuauaaugu

SEQ ID NO: 2288131 - RNA, 21 nt, Human
cauuucuugagguaaaagcau

SEQ ID NO: 2288132 - RNA, 21 nt, Human
ugggaggcugagaugggagaa

SEQ ID NO: 2288133 - RNA, 13 nt, Human
aaaaaugguuuaa

SEQ ID NO: 2288134 - RNA, 15 nt, Human
aaaauaacaaugaaa

SEQ ID NO: 2288135 - RNA, 16 nt, Human
gccucagucucccucc

SEQ ID NO: 2288136 - RNA, 19 nt, Human
augaauuacauuuguauaa

SEQ ID NO: 2288137 - RNA, 16 nt, Human
uauuuuugugauuuug

SEQ ID NO: 2288138 - RNA, 22 nt, Human
aauuacauuuguauaaaauaau

SEQ ID NO: 2288139 - RNA, 18 nt, Human
uaaauugacacuuaaaaa

SEQ ID NO: 2288140 - RNA, 17 nt, Human
uauauuguagauaauac

SEQ ID NO: 2288141 - RNA, 16 nt, Human
aauauaaauaaaaaua

SEQ ID NO: 2288142 - RNA, 20 nt, Human
acagcccuucuuuccacaga

SEQ ID NO: 2288143 - RNA, 15 nt, Human
ucaaaggacaccauu

SEQ ID NO: 2288144 - RNA, 15 nt, Human
gcacagccucuuaga

SEQ ID NO: 2288145 - RNA, 22 nt, Human
uugaaaaucuuauaauuuaaaa

SEQ ID NO: 2288146 - RNA, 18 nt, Human
cuuccucugagccuuggg

SEQ ID NO: 2288147 - RNA, 12 nt, Human
guagacacacau

SEQ ID NO: 2288148 - RNA, 16 nt, Human
cuucacuguaaaauaa

SEQ ID NO: 2288149 - RNA, 12 nt, Human
aucguguccccu

SEQ ID NO: 2288150 - RNA, 23 nt, Human
uuuccaucaaggguacacugccu

SEQ ID NO: 2288151 - RNA, 14 nt, Human
uaguuucccuugca

SEQ ID NO: 2288152 - RNA, 15 nt, Human
aguucugaagaagau

SEQ ID NO: 2288153 - RNA, 16 nt, Human
auccuacaagacacag

SEQ ID NO: 2288154 - RNA, 23 nt, Human
uguugcccacagcuguaugauuc

SEQ ID NO: 2288155 - RNA, 15 nt, Human
acaagacccaaaagg

SEQ ID NO: 2288156 - RNA, 22 nt, Human
uaauaggcguaacuaauuuuaa

SEQ ID NO: 2288157 - RNA, 14 nt, Human
ugcuguauuuuaaa

SEQ ID NO: 2288158 - RNA, 17 nt, Human
uccucugagccuuggga

SEQ ID NO: 2288159 - RNA, 21 nt, Human
ugcaggcagcuuuuucucucc

SEQ ID NO: 2288160 - RNA, 15 nt, Human
agaaaacaauaacga

SEQ ID NO: 2288161 - RNA, 12 nt, Human
aaugcagccccc

SEQ ID NO: 2288162 - RNA, 13 nt, Human
aaaaauccuacuu

SEQ ID NO: 2288163 - RNA, 17 nt, Human
gaagaccucauuuugaa

SEQ ID NO: 2288164 - RNA, 14 nt, Human
gugagcuacaaaug

SEQ ID NO: 2288165 - RNA, 23 nt, Human
uuuaguaagagauuccugagcca

SEQ ID NO: 2288166 - RNA, 18 nt, Human
cccaggcugagccucagu

SEQ ID NO: 2288167 - RNA, 17 nt, Human
gaacucugagcagugcu

SEQ ID NO: 2288168 - RNA, 17 nt, Human
cugagaugggagaauca

SEQ ID NO: 2288169 - RNA, 20 nt, Human
uuguagguaauauugcaagg

SEQ ID NO: 2288170 - RNA, 14 nt, Human
aauggcuaagcaaa

SEQ ID NO: 2288171 - RNA, 15 nt, Human
caaauccaaugaaau

SEQ ID NO: 2288172 - RNA, 15 nt, Human
aagaaaauaacaaua

SEQ ID NO: 2288173 - RNA, 15 nt, Human
aagcacuaaacaaag

SEQ ID NO: 2288174 - RNA, 13 nt, Human
cccaaaaggcaga

SEQ ID NO: 2288175 - RNA, 12 nt, Human
cuucaacucccu

SEQ ID NO: 2288176 - RNA, 23 nt, Human
aaguauccuucagccugaaagag

SEQ ID NO: 2288177 - RNA, 12 nt, Human
agggauggggcu

SEQ ID NO: 2288178 - RNA, 15 nt, Human
aaugaauggcuaagc

SEQ ID NO: 2288179 - RNA, 20 nt, Human
ggccuaugcagagguccaca

SEQ ID NO: 2288180 - RNA, 18 nt, Human
cucccuuggggccuaugc

SEQ ID NO: 2288181 - RNA, 16 nt, Human
auaacuggaaacuuca

SEQ ID NO: 2288182 - RNA, 23 nt, Human
ugaauuauguuugcauguucacu

SEQ ID NO: 2288183 - RNA, 14 nt, Human
aaauauuauuuuau

SEQ ID NO: 2288184 - RNA, 13 nt, Human
aguuaccucugcc

SEQ ID NO: 2288185 - RNA, 20 nt, Human
uuaaguuuuuuuuuaaaaaa

SEQ ID NO: 2288186 - RNA, 20 nt, Human
ugagcgcccacuagacccac

SEQ ID NO: 2288187 - RNA, 23 nt, Human
uagauaggucagugcaaauacuc

SEQ ID NO: 2288188 - RNA, 19 nt, Human
auuuacagagacagaaagc

SEQ ID NO: 2288189 - RNA, 22 nt, Human
aauuuuuucucuaggaaauauu

SEQ ID NO: 2288190 - RNA, 17 nt, Human
cucgugggacagucacc

SEQ ID NO: 2288191 - RNA, 20 nt, Human
ucaggaggaaggcuuacacc

SEQ ID NO: 2288192 - RNA, 18 nt, Human
auuauuuuuuaaaaaaau

SEQ ID NO: 2288193 - RNA, 14 nt, Human
gagccagugucagg

SEQ ID NO: 2288194 - RNA, 15 nt, Human
gcagagguugcagug

SEQ ID NO: 2288195 - RNA, 16 nt, Human
ugcaaauugucacagg

SEQ ID NO: 2288196 - RNA, 15 nt, Human
gucaaugcagccccc

SEQ ID NO: 2288197 - RNA, 17 nt, Human
cucagucucccucccuu

SEQ ID NO: 2288198 - RNA, 15 nt, Human
cagaauucauucacu

SEQ ID NO: 2288199 - RNA, 23 nt, Human
cuagacccacuggacucaccucc

SEQ ID NO: 2288200 - RNA, 16 nt, Human
aaaagcuccauuuuua

SEQ ID NO: 2288201 - RNA, 18 nt, Human
aggaaggcuuacacccac

SEQ ID NO: 2288202 - RNA, 20 nt, Human
acaagacccaaaaggcagaa

SEQ ID NO: 2288203 - RNA, 21 nt, Human
cgaaguauccuucagccugaa

SEQ ID NO: 2288204 - RNA, 13 nt, Human
cuaugaaauauua

SEQ ID NO: 2288205 - RNA, 22 nt, Human
ggacagcccuucuuuccacaga

SEQ ID NO: 2288206 - RNA, 22 nt, Human
caguauggcagcuuuccucaaa

SEQ ID NO: 2288207 - RNA, 21 nt, Human
ccucccuuggggccuaugcag

SEQ ID NO: 2288208 - RNA, 19 nt, Human
acauuuguauaaaauaauu

SEQ ID NO: 2288209 - RNA, 18 nt, Human
uuggggccuaugcagagg

SEQ ID NO: 2288210 - RNA, 15 nt, Human
cugaaagaggaauga

SEQ ID NO: 2288211 - RNA, 16 nt, Human
cugcucucaguucacu

SEQ ID NO: 2288212 - RNA, 17 nt, Human
cuuccuaauuccacagc

SEQ ID NO: 2288213 - RNA, 17 nt, Human
uggcuaagcaaaaugug

SEQ ID NO: 2288214 - RNA, 15 nt, Human
ugcagauaaacagua

SEQ ID NO: 2288215 - RNA, 15 nt, Human
aauacuuuauaaagg

SEQ ID NO: 2288216 - RNA, 22 nt, Human
aggacaccauuuuggcaagcuc

SEQ ID NO: 2288217 - RNA, 15 nt, Human
caaggaaaaaauaac

SEQ ID NO: 2288218 - RNA, 19 nt, Human
uggugagugccuguaauca

SEQ ID NO: 2288219 - RNA, 22 nt, Human
ucuggguuccuuccucugagcc

SEQ ID NO: 2288220 - RNA, 20 nt, Human
ugagcagugcuugaaugaag

SEQ ID NO: 2288221 - RNA, 21 nt, Human
aagucuuucacauuuaaauaa

SEQ ID NO: 2288222 - RNA, 17 nt, Human
ucauccugcaggcagcu

SEQ ID NO: 2288223 - RNA, 14 nt, Human
uaguaucaaaagaa

SEQ ID NO: 2288224 - RNA, 19 nt, Human
aagucuuucacauuuaaau

SEQ ID NO: 2288225 - RNA, 13 nt, Human
ccagcacagccuc

SEQ ID NO: 2288226 - RNA, 20 nt, Human
gagccugaucaccugcccug

SEQ ID NO: 2288227 - RNA, 20 nt, Human
uaggaauugacccacaagaa

SEQ ID NO: 2288228 - RNA, 16 nt, Human
uaacaauaaaagacaa

SEQ ID NO: 2288229 - RNA, 21 nt, Human
ccaaauauaaauaaaaauaau

SEQ ID NO: 2288230 - RNA, 15 nt, Human
auaaaguguuugaaa

SEQ ID NO: 2288231 - RNA, 17 nt, Human
aaucuuucacaggggac

SEQ ID NO: 2288232 - RNA, 19 nt, Human
aauauuauguuaaaacugg

SEQ ID NO: 2288233 - RNA, 19 nt, Human
uggugaacuugguuuuaau

SEQ ID NO: 2288234 - RNA, 23 nt, Human
agccuugggaccccugagcuugc

SEQ ID NO: 2288235 - RNA, 22 nt, Human
agaauuuuaugcggcauuuucu

SEQ ID NO: 2288236 - RNA, 18 nt, Human
aaauauuuauuuuaauaa

SEQ ID NO: 2288237 - RNA, 18 nt, Human
auagaauuaacacaugau

SEQ ID NO: 2288238 - RNA, 23 nt, Human
guaauuccguagguuauuuucag

SEQ ID NO: 2288239 - RNA, 15 nt, Human
ucucauccugcaggc

SEQ ID NO: 2288240 - RNA, 16 nt, Human
cuucaacucccugccc

SEQ ID NO: 2288241 - RNA, 22 nt, Human
uagacacacaugaaguccaagc

SEQ ID NO: 2288242 - RNA, 19 nt, Human
gcuaccuuuugcuguggca

SEQ ID NO: 2288243 - RNA, 23 nt, Human
auucaauaucuuuuuuuuaauaa

SEQ ID NO: 2288244 - RNA, 17 nt, Human
aaacauccuacaagaca

SEQ ID NO: 2288245 - RNA, 22 nt, Human
ugaccauacuaauuauaccccc

SEQ ID NO: 2288246 - RNA, 20 nt, Human
ugaaaaucuuauaauuuaaa

SEQ ID NO: 2288247 - RNA, 15 nt, Human
cuaucuuugagcgcc

SEQ ID NO: 2288248 - RNA, 18 nt, Human
aaaaguucugcagauaaa

SEQ ID NO: 2288249 - RNA, 12 nt, Human
auucugaaagca

SEQ ID NO: 2288250 - RNA, 16 nt, Human
uguaguccuguaaugg

SEQ ID NO: 2288251 - RNA, 11 nt, Human
gagguaaaagc

SEQ ID NO: 2288252 - RNA, 13 nt, Human
auuuuaaaagaau

SEQ ID NO: 2288253 - RNA, 19 nt, Human
cagauccccaagccuggca

SEQ ID NO: 2288254 - RNA, 21 nt, Human
cucagugucaaugcagccccc

SEQ ID NO: 2288255 - RNA, 16 nt, Human
agugaaauauuauuuu

SEQ ID NO: 2288256 - RNA, 16 nt, Human
cacuuaaaaaugguuu

SEQ ID NO: 2288257 - RNA, 22 nt, Human
caccucccccaucucuucuggg

SEQ ID NO: 2288258 - RNA, 14 nt, Human
uugccaugugcuag

SEQ ID NO: 2288259 - RNA, 18 nt, Human
cuccauccugaggcucca

SEQ ID NO: 2288260 - RNA, 18 nt, Human
auaauccuaaacauauga

SEQ ID NO: 2288261 - RNA, 16 nt, Human
gaagauguagaggaga

SEQ ID NO: 2288262 - RNA, 21 nt, Human
cccacuggacucaccuccccc

SEQ ID NO: 2288263 - RNA, 16 nt, Human
ccaggcugagccucag

SEQ ID NO: 2288264 - RNA, 13 nt, Human
uaaacauguuuau

SEQ ID NO: 2288265 - RNA, 17 nt, Human
aguauuucuaugaaaua

SEQ ID NO: 2288266 - RNA, 20 nt, Human
gaccauacuaauuauacccc

SEQ ID NO: 2288267 - RNA, 13 nt, Human
uucuauaauuuaa

SEQ ID NO: 2288268 - RNA, 21 nt, Human
cuaaauugacacuuaaaaaug

SEQ ID NO: 2288269 - RNA, 13 nt, Human
cauuuguauaaaa

SEQ ID NO: 2288270 - RNA, 13 nt, Human
ugaaaugcagagu

SEQ ID NO: 2288271 - RNA, 21 nt, Human
auuccuuuuucucuccucucc

SEQ ID NO: 2288272 - RNA, 16 nt, Human
uaaaggaauuuaaaaa

SEQ ID NO: 2288273 - RNA, 17 nt, Human
cugauggguuucuccag

SEQ ID NO: 2288274 - RNA, 17 nt, Human
agugauuaccagggacu

SEQ ID NO: 2288275 - RNA, 23 nt, Human
uagauguauagguugaugguggu

SEQ ID NO: 2288276 - RNA, 20 nt, Human
aagggcuguuauaaucuuuc

SEQ ID NO: 2288277 - RNA, 16 nt, Human
uauaucaauuuaaaaa

SEQ ID NO: 2288278 - RNA, 22 nt, Human
accauuucuugagguaaaagca

SEQ ID NO: 2288279 - RNA, 17 nt, Human
aaagcuccauuuuuagu

SEQ ID NO: 2288280 - RNA, 23 nt, Human
uuguaacaagccuccuuuuaaag

SEQ ID NO: 2288281 - RNA, 14 nt, Human
ccucagucucccuc

SEQ ID NO: 2288282 - RNA, 18 nt, Human
ucugaugagaacucugag

SEQ ID NO: 2288283 - RNA, 17 nt, Human
gauaaaagacagugaaa

SEQ ID NO: 2288284 - RNA, 13 nt, Human
agaaguaaaaaca

SEQ ID NO: 2288285 - RNA, 23 nt, Human
agaguuuagcuggaaaaguaugu

SEQ ID NO: 2288286 - RNA, 18 nt, Human
ucuaugaaauauuauguu

SEQ ID NO: 2288287 - RNA, 21 nt, Human
acagugauuaccagggacuga

SEQ ID NO: 2288288 - RNA, 16 nt, Human
auaaugaauacuuuau

SEQ ID NO: 2288289 - RNA, 19 nt, Human
agcuucucauccugcaggc

SEQ ID NO: 2288290 - RNA, 16 nt, Human
ccauuuuuagugaaau

SEQ ID NO: 2288291 - RNA, 19 nt, Human
uacuucuuaggguuaugau

SEQ ID NO: 2288292 - RNA, 22 nt, Human
aucaucaagucuuucacauuua

SEQ ID NO: 2288293 - RNA, 23 nt, Human
agcaugucgucaaagcugaaaug

SEQ ID NO: 2288294 - RNA, 22 nt, Human
ccauacuaauuauacccccugc

SEQ ID NO: 2288295 - RNA, 23 nt, Human
uuauagcuacuaauuuuaaaaug

SEQ ID NO: 2288296 - RNA, 14 nt, Human
uauaauuuaaauau

SEQ ID NO: 2288297 - RNA, 18 nt, Human
ccaagccuggcaagggaa

SEQ ID NO: 2288298 - RNA, 14 nt, Human
aauauuauuuuaua

SEQ ID NO: 2288299 - RNA, 23 nt, Human
cuugauaaauggcuuccuggcaa

SEQ ID NO: 2288300 - RNA, 18 nt, Human
aagaccucauuuugaagg

SEQ ID NO: 2288301 - RNA, 14 nt, Human
cugucucaguccau

SEQ ID NO: 2288302 - RNA, 20 nt, Human
ccagcuggccgggagccuga

SEQ ID NO: 2288303 - RNA, 15 nt, Human
gccccugcacuccag

SEQ ID NO: 2288304 - RNA, 15 nt, Human
agucaccucauggaa

SEQ ID NO: 2288305 - RNA, 11 nt, Human
auuuaaaaauc

SEQ ID NO: 2288306 - RNA, 15 nt, Human
ugagcgcccacuaga

SEQ ID NO: 2288307 - RNA, 19 nt, Human
auaaaagacagugaaagaa

SEQ ID NO: 2288308 - RNA, 12 nt, Human
gacgagaaaaca

SEQ ID NO: 2288309 - RNA, 13 nt, Human
aucucaauauuuc

SEQ ID NO: 2288310 - RNA, 19 nt, Human
ucaauucuugccaaauaua

SEQ ID NO: 2288311 - RNA, 17 nt, Human
uuacagagacagaaagc

SEQ ID NO: 2288312 - RNA, 15 nt, Human
ccucagucucccucc

SEQ ID NO: 2288313 - RNA, 18 nt, Human
gcaaagcccagcuugaaa

SEQ ID NO: 2288314 - RNA, 23 nt, Human
aggaugguucccuugaugaagaa

SEQ ID NO: 2288315 - RNA, 20 nt, Human
aaaacaagcacuaaacaaag

SEQ ID NO: 2288316 - RNA, 22 nt, Human
aaauaacaaugaaaguugauaa

SEQ ID NO: 2288317 - RNA, 23 nt, Human
gaaaaaguucugcagauaaacag

SEQ ID NO: 2288318 - RNA, 17 nt, Human
uguucuaagaagugaaa

SEQ ID NO: 2288319 - RNA, 16 nt, Human
ccacuuggucugugag

SEQ ID NO: 2288320 - RNA, 21 nt, Human
uguaaaauggugugaccacug

SEQ ID NO: 2288321 - RNA, 20 nt, Human
agaggagaaacuggaacucu

SEQ ID NO: 2288322 - RNA, 13 nt, Human
uaacgauaaaaga

SEQ ID NO: 2288323 - RNA, 19 nt, Human
uccauccugaggcuccacu

SEQ ID NO: 2288324 - RNA, 21 nt, Human
uauacugugugcuaaaacaag

SEQ ID NO: 2288325 - RNA, 17 nt, Human
agaaaugaaagcaggga

SEQ ID NO: 2288326 - RNA, 19 nt, Human
ugagucccaggcugagccu

SEQ ID NO: 2288327 - RNA, 14 nt, Human
uuucuaugaaauau

SEQ ID NO: 2288328 - RNA, 22 nt, Human
cuggguuccuuccucugagccu

SEQ ID NO: 2288329 - RNA, 21 nt, Human
uauuauuuuauagcuacuaau

SEQ ID NO: 2288330 - RNA, 21 nt, Human
cuggccuucggccuccauccu

SEQ ID NO: 2288331 - RNA, 20 nt, Human
uaaaacaagcacuaaacaaa

SEQ ID NO: 2288332 - RNA, 18 nt, Human
uaguaucaaaagaaagaa

SEQ ID NO: 2288333 - RNA, 13 nt, Human
aauuuuuauauuu

SEQ ID NO: 2288334 - RNA, 15 nt, Human
auaucaauuuaaaaa

SEQ ID NO: 2288335 - RNA, 22 nt, Human
uuuaauaauguuucaaacauau

SEQ ID NO: 2288336 - RNA, 15 nt, Human
gauuccugagccagu

SEQ ID NO: 2288337 - RNA, 12 nt, Human
acaagaaaugaa

SEQ ID NO: 2288338 - RNA, 19 nt, Human
uuccucccuucucuucaca

SEQ ID NO: 2288339 - RNA, 19 nt, Human
acuagacaaguccagccug

SEQ ID NO: 2288340 - RNA, 20 nt, Human
aauuuuuucucuaggaaaua

SEQ ID NO: 2288341 - RNA, 14 nt, Human
aaaagaaacauuug

SEQ ID NO: 2288342 - RNA, 19 nt, Human
auucccagccagcacagcc

SEQ ID NO: 2288343 - RNA, 13 nt, Human
agacagcucugca

SEQ ID NO: 2288344 - RNA, 16 nt, Human
agugucaaugcagccc

SEQ ID NO: 2288345 - RNA, 19 nt, Human
agacagugaaagaaaauaa

SEQ ID NO: 2288346 - RNA, 20 nt, Human
auacugugugcuaaaacaag

SEQ ID NO: 2288347 - RNA, 11 nt, Human
ucaccugcccu

SEQ ID NO: 2288348 - RNA, 20 nt, Human
aguuuuuuuuuaaaaaagaa

SEQ ID NO: 2288349 - RNA, 22 nt, Human
cuuguaaaggaauuuaaaaauc

SEQ ID NO: 2288350 - RNA, 17 nt, Human
caagacccaaaaggcag

SEQ ID NO: 2288351 - RNA, 21 nt, Human
cagugagacagcucugcauac

SEQ ID NO: 2288352 - RNA, 15 nt, Human
ucagucucccucccu

SEQ ID NO: 2288353 - RNA, 14 nt, Human
auuuauguuuaauu

SEQ ID NO: 2288354 - RNA, 12 nt, Human
gcaaagcccagc

SEQ ID NO: 2288355 - RNA, 16 nt, Human
guucugcacacagcac

SEQ ID NO: 2288356 - RNA, 19 nt, Human
aagcauuccaacuaucuca

SEQ ID NO: 2288357 - RNA, 16 nt, Human
gaauggcuaagcaaaa

SEQ ID NO: 2288358 - RNA, 22 nt, Human
agaaaacaauaacgauaaaaga

SEQ ID NO: 2288359 - RNA, 20 nt, Human
auuuucaguuauuauauuua

SEQ ID NO: 2288360 - RNA, 23 nt, Human
cuaguaauuggaaaggcagcucu

SEQ ID NO: 2288361 - RNA, 18 nt, Human
aagggaauuucuucaacu

SEQ ID NO: 2288362 - RNA, 15 nt, Human
uuagugaaauauuau

SEQ ID NO: 2288363 - RNA, 16 nt, Human
cagggacuugaaccca

SEQ ID NO: 2288364 - RNA, 16 nt, Human
aauuccacagcugcuc

SEQ ID NO: 2288365 - RNA, 14 nt, Human
gaaaaaauaacaau

SEQ ID NO: 2288366 - RNA, 20 nt, Human
agcccuggugggcagagagg

SEQ ID NO: 2288367 - RNA, 18 nt, Human
auggugaaaugcagaguc

SEQ ID NO: 2288368 - RNA, 17 nt, Human
ucugugagaugcuagaa

SEQ ID NO: 2288369 - RNA, 19 nt, Human
ugaacaaauuuacagagac

SEQ ID NO: 2288370 - RNA, 13 nt, Human
aaauaaaaauaau

SEQ ID NO: 2288371 - RNA, 13 nt, Human
uuaaauuguaaua

SEQ ID NO: 2288372 - RNA, 23 nt, Human
ucuuagaugcaguucugaagaag

SEQ ID NO: 2288373 - RNA, 17 nt, Human
ggagcucguggaacagu

SEQ ID NO: 2288374 - RNA, 18 nt, Human
gaugccccgucccccucu

SEQ ID NO: 2288375 - RNA, 15 nt, Human
augaauuaaguuuuu

SEQ ID NO: 2288376 - RNA, 14 nt, Human
ccugccccugagcc

SEQ ID NO: 2288377 - RNA, 14 nt, Human
ugagcuugcagaga

SEQ ID NO: 2288378 - RNA, 15 nt, Human
augauaacuggaaac

SEQ ID NO: 2288379 - RNA, 16 nt, Human
uuuuagugaaauauua

SEQ ID NO: 2288380 - RNA, 22 nt, Human
uauuccuuuuucucuccucucc

SEQ ID NO: 2288381 - RNA, 18 nt, Human
uaaaagacagugaaagaa

SEQ ID NO: 2288382 - RNA, 18 nt, Human
cuggaaacuucagcgguu

SEQ ID NO: 2288383 - RNA, 19 nt, Human
auauugcaaggcaaagacu

SEQ ID NO: 2288384 - RNA, 12 nt, Human
gacagugaaaga

SEQ ID NO: 2288385 - RNA, 16 nt, Human
gccuaagugcagcccc

SEQ ID NO: 2288386 - RNA, 15 nt, Human
cacuuggucugugag

SEQ ID NO: 2288387 - RNA, 22 nt, Human
gauaaaagacagugaaagaaaa

SEQ ID NO: 2288388 - RNA, 20 nt, Human
agccuuggggcugaugcagu

SEQ ID NO: 2288389 - RNA, 19 nt, Human
uccagaaagugacaagcuc

SEQ ID NO: 2288390 - RNA, 23 nt, Human
caucaacagauaaauaguuuaug

SEQ ID NO: 2288391 - RNA, 20 nt, Human
caagcucuaucaccaaggag

SEQ ID NO: 2288392 - RNA, 19 nt, Human
gucaaauugugugaaaggu

SEQ ID NO: 2288393 - RNA, 22 nt, Human
uuuccaagcaaguauuagaaua

SEQ ID NO: 2288394 - RNA, 22 nt, Human
uuuauggcacuaguauuucuau

SEQ ID NO: 2288395 - RNA, 19 nt, Human
ccuccauccugaggcucca

SEQ ID NO: 2288396 - RNA, 12 nt, Human
accccugagcuu

SEQ ID NO: 2288397 - RNA, 21 nt, Human
auguuuaauucugaaagcaac

SEQ ID NO: 2288398 - RNA, 20 nt, Human
guaucaaaagaaagaaaauc

SEQ ID NO: 2288399 - RNA, 23 nt, Human
aggcaugagucagucugaugaga

SEQ ID NO: 2288400 - RNA, 21 nt, Human
cucaaaacuucagacauagaa

SEQ ID NO: 2288401 - RNA, 15 nt, Human
aaauaauuuuuauau

SEQ ID NO: 2288402 - RNA, 22 nt, Human
uggaaaguuuaugguuguauua

SEQ ID NO: 2288403 - RNA, 13 nt, Human
agagauuccugag

SEQ ID NO: 2288404 - RNA, 15 nt, Human
ugcaauuccacuuau

SEQ ID NO: 2288405 - RNA, 13 nt, Human
uuuugaaucauca

SEQ ID NO: 2288406 - RNA, 17 nt, Human
gucaaagcugaaaugga

SEQ ID NO: 2288407 - RNA, 23 nt, Human
ugaauuacauuuguauaaaauaa

SEQ ID NO: 2288408 - RNA, 13 nt, Human
ccucauggaauug

SEQ ID NO: 2288409 - RNA, 23 nt, Human
uaaaagacagugaaagaaaauaa

SEQ ID NO: 2288410 - RNA, 20 nt, Human
cagugaaagaaaauaacgau

SEQ ID NO: 2288411 - RNA, 11 nt, Human
ugcagugagcc

SEQ ID NO: 2288412 - RNA, 21 nt, Human
uuuuauggcacuaguauuucu

SEQ ID NO: 2288413 - RNA, 22 nt, Human
ccucccuuggggccuaugcaga

SEQ ID NO: 2288414 - RNA, 15 nt, Human
cagugucaggaggaa

SEQ ID NO: 2288415 - RNA, 13 nt, Human
ucuaagaagugaa

SEQ ID NO: 2288416 - RNA, 15 nt, Human
aaggaaaaaauaaca

SEQ ID NO: 2288417 - RNA, 14 nt, Human
accacaagacugca

SEQ ID NO: 2288418 - RNA, 20 nt, Human
acuccagugagacagcucug

SEQ ID NO: 2288419 - RNA, 15 nt, Human
aucaaaggacaccau

SEQ ID NO: 2288420 - RNA, 21 nt, Human
gucucagugucaaugcagccc

SEQ ID NO: 2288421 - RNA, 12 nt, Human
gucccaggcuga

SEQ ID NO: 2288422 - RNA, 13 nt, Human
cacauuuaaauaa

SEQ ID NO: 2288423 - RNA, 15 nt, Human
gacucaccuccccca

SEQ ID NO: 2288424 - RNA, 10 nt, Human
auguuuucag

SEQ ID NO: 2288425 - RNA, 16 nt, Human
agugaaggauuuaugu

SEQ ID NO: 2288426 - RNA, 21 nt, Human
aucuuuuuuuuaauaaaccau

SEQ ID NO: 2288427 - RNA, 17 nt, Human
agacagugaaagaaaau

SEQ ID NO: 2288428 - RNA, 18 nt, Human
uuacuguaagaaaauauc

SEQ ID NO: 2288429 - RNA, 17 nt, Human
aaauguucaucaaugaa

SEQ ID NO: 2288430 - RNA, 18 nt, Human
gagucccaggcugagccu

SEQ ID NO: 2288431 - RNA, 23 nt, Human
gaaugagagacacacugaagaag

SEQ ID NO: 2288432 - RNA, 19 nt, Human
gucaaucagccuaguugau

SEQ ID NO: 2288433 - RNA, 22 nt, Human
accccugagcuugcagagauga

SEQ ID NO: 2288434 - RNA, 21 nt, Human
aaaauaugccccauucaacau

SEQ ID NO: 2288435 - RNA, 19 nt, Human
cccugccccccagcccucc

SEQ ID NO: 2288436 - RNA, 21 nt, Human
aaauaauuuuuauauuugaaa

SEQ ID NO: 2288437 - RNA, 13 nt, Human
aguguuugaaagc

SEQ ID NO: 2288438 - RNA, 22 nt, Human
uaaaauaauuuuuauauuugaa

SEQ ID NO: 2288439 - RNA, 16 nt, Human
uggucugugagaugcu

SEQ ID NO: 2288440 - RNA, 16 nt, Human
acaaggaugaauuaag

SEQ ID NO: 2288441 - RNA, 22 nt, Human
agacucugucucaguccaugaa

SEQ ID NO: 2288442 - RNA, 17 nt, Human
aggguguguaaguagau

SEQ ID NO: 2288443 - RNA, 21 nt, Human
gaaaaguauguuagugcaaau

SEQ ID NO: 2288444 - RNA, 18 nt, Human
aaaguaacccuacaaaac

SEQ ID NO: 2288445 - RNA, 16 nt, Human
auuuuuagugaaauau

SEQ ID NO: 2288446 - RNA, 21 nt, Human
ugagcucagcccuggugggca

SEQ ID NO: 2288447 - RNA, 15 nt, Human
ucaguuuuugugaaa

SEQ ID NO: 2288448 - RNA, 17 nt, Human
aacaguuaccucugccu

SEQ ID NO: 2288449 - RNA, 12 nt, Human
ucaccccuugcc

SEQ ID NO: 2288450 - RNA, 21 nt, Human
aggguucaccugggcugaggc

SEQ ID NO: 2288451 - RNA, 20 nt, Human
gaacguaaucguguccccua

SEQ ID NO: 2288452 - RNA, 22 nt, Human
caaggaugccccgucccccucu

SEQ ID NO: 2288453 - RNA, 19 nt, Human
cucugccucagaaaacaag

SEQ ID NO: 2288454 - RNA, 18 nt, Human
auuuauuacuguaagaaa

SEQ ID NO: 2288455 - RNA, 20 nt, Human
uaaaagacagugaaagaaaa

SEQ ID NO: 2288456 - RNA, 14 nt, Human
acccgggaggcaga

SEQ ID NO: 2288457 - RNA, 19 nt, Human
ccaccugccuauauuuuuu

SEQ ID NO: 2288458 - RNA, 19 nt, Human
acucugucucaguccauga

SEQ ID NO: 2288459 - RNA, 20 nt, Human
aaaaaccugagccccaaaag

SEQ ID NO: 2288460 - RNA, 22 nt, Human
aagacccaaaaggcagaagcaa

SEQ ID NO: 2288461 - RNA, 19 nt, Human
ggcaaggguucaccugggc

SEQ ID NO: 2288462 - RNA, 14 nt, Human
cuucucuucacagu

SEQ ID NO: 2288463 - RNA, 15 nt, Human
gagauuccugagcca

SEQ ID NO: 2288464 - RNA, 19 nt, Human
aaugaaauggugaaaugca

SEQ ID NO: 2288465 - RNA, 17 nt, Human
gaaugagagacacacug

SEQ ID NO: 2288466 - RNA, 19 nt, Human
uacaaaaaaaaaaaaaaau

SEQ ID NO: 2288467 - RNA, 18 nt, Human
agcuucucauccugcagg

SEQ ID NO: 2288468 - RNA, 23 nt, Human
ugcagagguccacaacacacaga

SEQ ID NO: 2288469 - RNA, 16 nt, Human
ugagaugcuagaacuc

SEQ ID NO: 2288470 - RNA, 14 nt, Human
uugccugcaggcau

SEQ ID NO: 2288471 - RNA, 14 nt, Human
cagauccuggaaau

SEQ ID NO: 2288472 - RNA, 22 nt, Human
uucauucacucaacaaacauaa

SEQ ID NO: 2288473 - RNA, 18 nt, Human
aaaagacaaggaaaaaau

SEQ ID NO: 2288474 - RNA, 16 nt, Human
aauuucuucaacuccc

SEQ ID NO: 2288475 - RNA, 11 nt, Human
auaauuuaaau

SEQ ID NO: 2288476 - RNA, 20 nt, Human
cacuguggguagacacacau

SEQ ID NO: 2288477 - RNA, 15 nt, Human
ucuaugaaauauuau

SEQ ID NO: 2288478 - RNA, 14 nt, Human
aaucucaauauuuc

SEQ ID NO: 2288479 - RNA, 17 nt, Human
cugcacuccagccugag

SEQ ID NO: 2288480 - RNA, 15 nt, Human
gucccaggcugagcc

SEQ ID NO: 2288481 - RNA, 23 nt, Human
auguuaaaacugggacaggggag

SEQ ID NO: 2288482 - RNA, 22 nt, Human
ugaagcaaaauuuuuucucuag

SEQ ID NO: 2288483 - RNA, 20 nt, Human
auucccagccagcacagccu

SEQ ID NO: 2288484 - RNA, 12 nt, Human
gccccugagccc

SEQ ID NO: 2288485 - RNA, 16 nt, Human
gagcucgugggacagu

SEQ ID NO: 2288486 - RNA, 18 nt, Human
acauguuacaacacggac

SEQ ID NO: 2288487 - RNA, 13 nt, Human
gagacagcucugc

SEQ ID NO: 2288488 - RNA, 19 nt, Human
auuguauuuuaguaagaga

SEQ ID NO: 2288489 - RNA, 20 nt, Human
ccugccuaagugcagccccg

SEQ ID NO: 2288490 - RNA, 17 nt, Human
auaauuuaaauauaugc

SEQ ID NO: 2288491 - RNA, 19 nt, Human
uguuggacgagaaaacaau

SEQ ID NO: 2288492 - RNA, 11 nt, Human
cuguuuuauaa

SEQ ID NO: 2288493 - RNA, 13 nt, Human
cugcacuccagcc

SEQ ID NO: 2288494 - RNA, 15 nt, Human
cuguaaaauaauaac

SEQ ID NO: 2288495 - RNA, 22 nt, Human
gaaauaagccagacaucaacag

SEQ ID NO: 2288496 - RNA, 20 nt, Human
acaguggaaagacagcuucu

SEQ ID NO: 2288497 - RNA, 22 nt, Human
uguugcccacagcuguaugauu

SEQ ID NO: 2288498 - RNA, 22 nt, Human
uuuauagcuacuaauuuuaaaa

SEQ ID NO: 2288499 - RNA, 20 nt, Human
augguuuagaaagcuugccc

SEQ ID NO: 2288500 - RNA, 15 nt, Human
uaacaauaaaagaca

SEQ ID NO: 2288501 - RNA, 15 nt, Human
auagaaguaaaaaca

SEQ ID NO: 2288502 - RNA, 17 nt, Human
uacaaaugcauuucuaa

SEQ ID NO: 2288503 - RNA, 13 nt, Human
aaaugaaagcagg

SEQ ID NO: 2288504 - RNA, 13 nt, Human
cuucucaacucca

SEQ ID NO: 2288505 - RNA, 12 nt, Human
ucccccucuggc

SEQ ID NO: 2288506 - RNA, 15 nt, Human
agagacagaaagcag

SEQ ID NO: 2288507 - RNA, 18 nt, Human
cccacuggacucaccucc

SEQ ID NO: 2288508 - RNA, 18 nt, Human
acaaaaggauaaugaaua

SEQ ID NO: 2288509 - RNA, 17 nt, Human
cuccuuaucaaaggaca

SEQ ID NO: 2288510 - RNA, 14 nt, Human
gaaagcagaacagu

SEQ ID NO: 2288511 - RNA, 21 nt, Human
ugaccauacuaauuauacccc

SEQ ID NO: 2288512 - RNA, 12 nt, Human
aguguuugaaag

SEQ ID NO: 2288513 - RNA, 21 nt, Human
aauuaaguuuuuuuuuaaaaa

SEQ ID NO: 2288514 - RNA, 19 nt, Human
caugaguaacugauuugua

SEQ ID NO: 2288515 - RNA, 18 nt, Human
gaaaauaacgauaaaaga

SEQ ID NO: 2288516 - RNA, 16 nt, Human
uguucuaagaagugaa

SEQ ID NO: 2288517 - RNA, 21 nt, Human
ucaagucuuucacauuuaaau

SEQ ID NO: 2288518 - RNA, 11 nt, Human
cauaugaaaag

SEQ ID NO: 2288519 - RNA, 23 nt, Human
cucagucucccucccuuggggcc

SEQ ID NO: 2288520 - RNA, 16 nt, Human
acauuugcucauggaa

SEQ ID NO: 2288521 - RNA, 16 nt, Human
ugacacuuaaaaaugg

SEQ ID NO: 2288522 - RNA, 23 nt, Human
aauauuuauuuuaauaauguuuc

SEQ ID NO: 2288523 - RNA, 18 nt, Human
caaggcugauuaaaccaa

SEQ ID NO: 2288524 - RNA, 21 nt, Human
cuaccaaaaaucucaauauuu

SEQ ID NO: 2288525 - RNA, 13 nt, Human
ugccugcaggcau

SEQ ID NO: 2288526 - RNA, 16 nt, Human
ggcugagccucagucu

SEQ ID NO: 2288527 - RNA, 15 nt, Human
gccucuuagaugcag

SEQ ID NO: 2288528 - RNA, 22 nt, Human
cugggacaggggagaaccuagg

SEQ ID NO: 2288529 - RNA, 18 nt, Human
auuuuaacucuauaaugu

SEQ ID NO: 2288530 - RNA, 15 nt, Human
caggcagcuuuuucu

SEQ ID NO: 2288531 - RNA, 19 nt, Human
ugcacacagcacgggggcc

SEQ ID NO: 2288532 - RNA, 20 nt, Human
ugaggcuccacuuggucugu

SEQ ID NO: 2288533 - RNA, 18 nt, Human
uuacaaaugggaaacaaa

SEQ ID NO: 2288534 - RNA, 21 nt, Human
aagcuccauuuuuagugaaau

SEQ ID NO: 2288535 - RNA, 22 nt, Human
agcagcauaaauguugacaugg

SEQ ID NO: 2288536 - RNA, 19 nt, Human
auagcuacuaauuuuaaaa

SEQ ID NO: 2288537 - RNA, 21 nt, Human
auucauagcagcuuauucaca

SEQ ID NO: 2288538 - RNA, 20 nt, Human
ccagugagacagcucugcau

SEQ ID NO: 2288539 - RNA, 21 nt, Human
uguauaaaauaauuuuuauau

SEQ ID NO: 2288540 - RNA, 15 nt, Human
gccagugucaggagg

SEQ ID NO: 2288541 - RNA, 15 nt, Human
cucccugccccccag

SEQ ID NO: 2288542 - RNA, 16 nt, Human
aagcuucacuguaaaa

SEQ ID NO: 2288543 - RNA, 21 nt, Human
auuuacaaaugggaaacaaaa

SEQ ID NO: 2288544 - RNA, 19 nt, Human
aaugaauggcuaagcaaaa

SEQ ID NO: 2288545 - RNA, 14 nt, Human
uccagauccuggaa

SEQ ID NO: 2288546 - RNA, 21 nt, Human
auuauauggcuugaguuuaaa

SEQ ID NO: 2288547 - RNA, 14 nt, Human
agacaucaacagau

SEQ ID NO: 2288548 - RNA, 18 nt, Human
uuuugugaagcaaaauuu

SEQ ID NO: 2288549 - RNA, 20 nt, Human
uguaaaggaauuuaaaaauc

SEQ ID NO: 2288550 - RNA, 17 nt, Human
guuuaauaauuuuuaau

SEQ ID NO: 2288551 - RNA, 12 nt, Human
acaagacacagu

SEQ ID NO: 2288552 - RNA, 20 nt, Human
uauacugugugcuaaaacaa

SEQ ID NO: 2288553 - RNA, 15 nt, Human
cucaacaaacauaau

SEQ ID NO: 2288554 - RNA, 22 nt, Human
gaggggagcaugggaagugacg

SEQ ID NO: 2288555 - RNA, 16 nt, Human
caugggacagggagga

SEQ ID NO: 2288556 - RNA, 15 nt, Human
ugcuguauuuuaaaa

SEQ ID NO: 2288557 - RNA, 13 nt, Human
cucugagccuugg

SEQ ID NO: 2288558 - RNA, 20 nt, Human
acaagacacagugaccauac

SEQ ID NO: 2288559 - RNA, 23 nt, Human
uuagaugcaguucugaagaagau

SEQ ID NO: 2288560 - RNA, 17 nt, Human
uucacuguaaaauaaua

SEQ ID NO: 2288561 - RNA, 14 nt, Human
uucacauuuaaaua

SEQ ID NO: 2288562 - RNA, 17 nt, Human
aauaacgauaaaagaca

SEQ ID NO: 2288563 - RNA, 17 nt, Human
uuccaagugauugaaac

SEQ ID NO: 2288564 - RNA, 13 nt, Human
aagaaaauaacga

SEQ ID NO: 2288565 - RNA, 15 nt, Human
ugccccgucccccuc

SEQ ID NO: 2288566 - RNA, 16 nt, Human
cccacuggacucaccu

SEQ ID NO: 2288567 - RNA, 16 nt, Human
auuugaugcuacagga

SEQ ID NO: 2288568 - RNA, 21 nt, Human
cccccucuggcuccagcuggc

SEQ ID NO: 2288569 - RNA, 14 nt, Human
cugcugagucccag

SEQ ID NO: 2288570 - RNA, 19 nt, Human
acaauaacgauaaaagaca

SEQ ID NO: 2288571 - RNA, 19 nt, Human
uugugccccugcacuccag

SEQ ID NO: 2288572 - RNA, 21 nt, Human
augcuacaggauuugaaauug

SEQ ID NO: 2288573 - RNA, 14 nt, Human
acauauauaacaau

SEQ ID NO: 2288574 - RNA, 15 nt, Human
guuuuucuuuucauu

SEQ ID NO: 2288575 - RNA, 22 nt, Human
aagagccuuuuuuugaaaaaaa

SEQ ID NO: 2288576 - RNA, 17 nt, Human
auuuuaauaauguuuca

SEQ ID NO: 2288577 - RNA, 22 nt, Human
aucaccaaggcugauuaaacca

SEQ ID NO: 2288578 - RNA, 14 nt, Human
ugcuggagcucugc

SEQ ID NO: 2288579 - RNA, 15 nt, Human
gcuguauuuuaaaag

SEQ ID NO: 2288580 - RNA, 18 nt, Human
gaggcuccacuuggucug

SEQ ID NO: 2288581 - RNA, 15 nt, Human
accucccccaucucu

SEQ ID NO: 2288582 - RNA, 22 nt, Human
cucugagccuugggaccccuga

SEQ ID NO: 2288583 - RNA, 14 nt, Human
acgagaaaacaaua

SEQ ID NO: 2288584 - RNA, 16 nt, Human
aaaaugugauauguac

SEQ ID NO: 2288585 - RNA, 17 nt, Human
cgauaaaagacagugaa

SEQ ID NO: 2288586 - RNA, 15 nt, Human
aaucucaauauuuca

SEQ ID NO: 2288587 - RNA, 17 nt, Human
aaagacaaggaaaaaau

SEQ ID NO: 2288588 - RNA, 13 nt, Human
auugauuauaugu

SEQ ID NO: 2288589 - RNA, 15 nt, Human
ggcaagcucuaucac

SEQ ID NO: 2288590 - RNA, 17 nt, Human
auguuuacagaucccca

SEQ ID NO: 2288591 - RNA, 14 nt, Human
cccugccccccagc

SEQ ID NO: 2288592 - RNA, 22 nt, Human
uauccuacuuccccuuccuaau

SEQ ID NO: 2288593 - RNA, 13 nt, Human
auccugaggcucc

SEQ ID NO: 2288594 - RNA, 14 nt, Human
uaaaggaauuuaaa

SEQ ID NO: 2288595 - RNA, 17 nt, Human
cagacaucaacagauaa

SEQ ID NO: 2288596 - RNA, 17 nt, Human
gacagucaccucaugga

SEQ ID NO: 2288597 - RNA, 16 nt, Human
uaaaauccauacauuu

SEQ ID NO: 2288598 - RNA, 19 nt, Human
gagccugaucaccugcccu

SEQ ID NO: 2288599 - RNA, 19 nt, Human
uauacugugugcuaaaaca

SEQ ID NO: 2288600 - RNA, 17 nt, Human
cucuuuugggauuuuug

SEQ ID NO: 2288601 - RNA, 17 nt, Human
aggcuagaaccaccugc

SEQ ID NO: 2288602 - RNA, 17 nt, Human
uuaauaauuuuuaauua

SEQ ID NO: 2288603 - RNA, 14 nt, Human
aauugcagaguacu

SEQ ID NO: 2288604 - RNA, 14 nt, Human
ccuugaugaagaag

SEQ ID NO: 2288605 - RNA, 22 nt, Human
cuuuccacagaagcuccaggua

SEQ ID NO: 2288606 - RNA, 17 nt, Human
aaagaaacauuugguaa

SEQ ID NO: 2288607 - RNA, 21 nt, Human
gacagaaagcagaacagugau

SEQ ID NO: 2288608 - RNA, 12 nt, Human
acucccugcccc

SEQ ID NO: 2288609 - RNA, 14 nt, Human
uggacucaccuccc

SEQ ID NO: 2288610 - RNA, 20 nt, Human
ccccuauccuacuuccccuu

SEQ ID NO: 2288611 - RNA, 22 nt, Human
auaucuuuuuuuuaauaaacca

SEQ ID NO: 2288612 - RNA, 18 nt, Human
uauagcuacuaauuuuaa

SEQ ID NO: 2288613 - RNA, 22 nt, Human
auggaaauguuuacagaucccc

SEQ ID NO: 2288614 - RNA, 12 nt, Human
aaaugaaagcag

SEQ ID NO: 2288615 - RNA, 21 nt, Human
uauaaaauaauuuuuauauuu

SEQ ID NO: 2288616 - RNA, 17 nt, Human
gcaugguuuagaaagcu

SEQ ID NO: 2288617 - RNA, 14 nt, Human
auauuugaaauauu

SEQ ID NO: 2288618 - RNA, 22 nt, Human
ccaaacauccuacaagacacag

SEQ ID NO: 2288619 - RNA, 12 nt, Human
ucuacacuccag

SEQ ID NO: 2288620 - RNA, 16 nt, Human
caggaaguagaggagg

SEQ ID NO: 2288621 - RNA, 17 nt, Human
auggcuaguaucaaaag

SEQ ID NO: 2288622 - RNA, 14 nt, Human
ccccugagcuugca

SEQ ID NO: 2288623 - RNA, 13 nt, Human
aaaguguuugaaa

SEQ ID NO: 2288624 - RNA, 23 nt, Human
uaauuuguaguguuggagaagaa

SEQ ID NO: 2288625 - RNA, 22 nt, Human
agccaaacauccuacaagacac

SEQ ID NO: 2288626 - RNA, 14 nt, Human
aagagugaaggauu

SEQ ID NO: 2288627 - RNA, 20 nt, Human
accugauuucugagcauuua

SEQ ID NO: 2288628 - RNA, 18 nt, Human
agcuuacuuaaaauugua

SEQ ID NO: 2288629 - RNA, 17 nt, Human
agucugacuguuuccau

SEQ ID NO: 2288630 - RNA, 22 nt, Human
gcuugcagagaugaggccgcca

SEQ ID NO: 2288631 - RNA, 18 nt, Human
aaauauaaauaaaaauaa

SEQ ID NO: 2288632 - RNA, 18 nt, Human
aguucuccacuagcuaug

SEQ ID NO: 2288633 - RNA, 16 nt, Human
cucauccugcaggcag

SEQ ID NO: 2288634 - RNA, 19 nt, Human
guacugagagugaacaaau

SEQ ID NO: 2288635 - RNA, 14 nt, Human
cuguaaucacagcu

SEQ ID NO: 2288636 - RNA, 13 nt, Human
guaacuaauuuua

SEQ ID NO: 2288637 - RNA, 15 nt, Human
guaaggggaauugag

SEQ ID NO: 2288638 - RNA, 16 nt, Human
aaaauaauccucaguu

SEQ ID NO: 2288639 - RNA, 21 nt, Human
aagacucgggauuaguacaca

SEQ ID NO: 2288640 - RNA, 16 nt, Human
cucaauaaaguacaag

SEQ ID NO: 2288641 - RNA, 22 nt, Human
aggauggcuaguaucaaaagaa

SEQ ID NO: 2288642 - RNA, 21 nt, Human
aaaugucuugcuugauuguau

SEQ ID NO: 2288643 - RNA, 20 nt, Human
aaacuuuaugcuaagugaaa

SEQ ID NO: 2288644 - RNA, 23 nt, Human
cacuggacucaccucccccaucu

SEQ ID NO: 2288645 - RNA, 19 nt, Human
auaaaagacaaggaaaaaa

SEQ ID NO: 2288646 - RNA, 23 nt, Human
uggaaauguuuacagauccccaa

SEQ ID NO: 2288647 - RNA, 12 nt, Human
acagagacagaa

SEQ ID NO: 2288648 - RNA, 14 nt, Human
caguucugaagaag

SEQ ID NO: 2288649 - RNA, 14 nt, Human
uugugauugauuau

SEQ ID NO: 2288650 - RNA, 16 nt, Human
agugaaagaaaauaac

SEQ ID NO: 2288651 - RNA, 17 nt, Human
augccccgucccccucu

SEQ ID NO: 2288652 - RNA, 15 nt, Human
uugcucauggaauug

SEQ ID NO: 2288653 - RNA, 22 nt, Human
uauuucuaugaaauauuauguu

SEQ ID NO: 2288654 - RNA, 21 nt, Human
ccccugcaaagcccagcuuga

SEQ ID NO: 2288655 - RNA, 20 nt, Human
acuuuauuuucuauaauuua

SEQ ID NO: 2288656 - RNA, 18 nt, Human
gaaaauaacaauaaaaga

SEQ ID NO: 2288657 - RNA, 17 nt, Human
cccaggcugagccucag

SEQ ID NO: 2288658 - RNA, 14 nt, Human
agagacagaaagca

SEQ ID NO: 2288659 - RNA, 20 nt, Human
ggccaugggacagggaggac

SEQ ID NO: 2288660 - RNA, 23 nt, Human
gggagccugaucaccugcccugc

SEQ ID NO: 2288661 - RNA, 15 nt, Human
cuaguaauuggaaag

SEQ ID NO: 2288662 - RNA, 22 nt, Human
ggacaguaaaauccacagacca

SEQ ID NO: 2288663 - RNA, 18 nt, Human
aucuacacuccagugaga

SEQ ID NO: 2288664 - RNA, 22 nt, Human
uugacccacaagaaaugaaagc

SEQ ID NO: 2288665 - RNA, 15 nt, Human
ccacaagaaaugaaa

SEQ ID NO: 2288666 - RNA, 17 nt, Human
ccaaaagguauuuuaau

SEQ ID NO: 2288667 - RNA, 22 nt, Human
augguuguauuauuuuuuaaaa

SEQ ID NO: 2288668 - RNA, 15 nt, Human
uaaaagacaaggaaa

SEQ ID NO: 2288669 - RNA, 11 nt, Human
ggucacaggaa

SEQ ID NO: 2288670 - RNA, 21 nt, Human
cuauguucuaagaagugaaaa

SEQ ID NO: 2288671 - RNA, 19 nt, Human
auaauuuuuauauuugaaa

SEQ ID NO: 2288672 - RNA, 22 nt, Human
cacuaguauuucuaugaaauau

SEQ ID NO: 2288673 - RNA, 19 nt, Human
uaguuuaugauuccaccua

SEQ ID NO: 2288674 - RNA, 16 nt, Human
agagggaauugcagag

SEQ ID NO: 2288675 - RNA, 21 nt, Human
uauuacuguaagaaaauauca

SEQ ID NO: 2288676 - RNA, 14 nt, Human
aauauuuauuuuaa

SEQ ID NO: 2288677 - RNA, 14 nt, Human
uuuuaaaaaagaaa

SEQ ID NO: 2288678 - RNA, 17 nt, Human
uuuuuaauuauauggcu

SEQ ID NO: 2288679 - RNA, 12 nt, Human
uugccugcaggc

SEQ ID NO: 2288680 - RNA, 14 nt, Human
ggaaguagaggagg

SEQ ID NO: 2288681 - RNA, 19 nt, Human
gugacuuaaugccacuaaa

SEQ ID NO: 2288682 - RNA, 15 nt, Human
aaaaaauaacaauga

SEQ ID NO: 2288683 - RNA, 21 nt, Human
agccucuuagaugcaguucug

SEQ ID NO: 2288684 - RNA, 18 nt, Human
auucuugccaaauauaaa

SEQ ID NO: 2288685 - RNA, 19 nt, Human
agauuugagcucagcccug

SEQ ID NO: 2288686 - RNA, 16 nt, Human
auaauccuaaacauau

SEQ ID NO: 2288687 - RNA, 17 nt, Human
acuugaacccauauuug

SEQ ID NO: 2288688 - RNA, 15 nt, Human
ugagcucagcccugg

SEQ ID NO: 2288689 - RNA, 13 nt, Human
uuuaaaaaagaaa

SEQ ID NO: 2288690 - RNA, 14 nt, Human
uuuguauaaaauaa

SEQ ID NO: 2288691 - RNA, 16 nt, Human
ugccucaccccuugcc

SEQ ID NO: 2288692 - RNA, 21 nt, Human
aaaaaguucugcagauaaaca

SEQ ID NO: 2288693 - RNA, 18 nt, Human
guaauauugcaaggcaaa

SEQ ID NO: 2288694 - RNA, 21 nt, Human
ugaacugauggguuucuccag

SEQ ID NO: 2288695 - RNA, 19 nt, Human
uuggcaagcucuaucacca

SEQ ID NO: 2288696 - RNA, 19 nt, Human
cuaagcuucacuguaaaau

SEQ ID NO: 2288697 - RNA, 14 nt, Human
aagcucuaucacca

SEQ ID NO: 2288698 - RNA, 19 nt, Human
cagaaagcagaacagugau

SEQ ID NO: 2288699 - RNA, 20 nt, Human
caaauauaaauaaaaauaau

SEQ ID NO: 2288700 - RNA, 21 nt, Human
agucucccucccuuggggccu

SEQ ID NO: 2288701 - RNA, 17 nt, Human
ggaaauauuuauuuuaa

SEQ ID NO: 2288702 - RNA, 15 nt, Human
cuaagugcagccccg

SEQ ID NO: 2288703 - RNA, 21 nt, Human
gcccugcugagucccaggcug

SEQ ID NO: 2288704 - RNA, 16 nt, Human
aaauaguuuaugauuc

SEQ ID NO: 2288705 - RNA, 18 nt, Human
acaagccuccuuuuaaag

SEQ ID NO: 2288706 - RNA, 16 nt, Human
augaauacuuuauaaa

SEQ ID NO: 2288707 - RNA, 17 nt, Human
uccauccugaggcucca

SEQ ID NO: 2288708 - RNA, 12 nt, Human
aagaaaauaacg

SEQ ID NO: 2288709 - RNA, 17 nt, Human
ccuauccuacuuccccu

SEQ ID NO: 2288710 - RNA, 18 nt, Human
ggaaagacagcuucucau

SEQ ID NO: 2288711 - RNA, 18 nt, Human
gcccuggugggcagagag

SEQ ID NO: 2288712 - RNA, 16 nt, Human
acuaguuucccuugca

SEQ ID NO: 2288713 - RNA, 12 nt, Human
auaacuggaaac

SEQ ID NO: 2288714 - RNA, 23 nt, Human
ggaggcagagguugcagugagcc

SEQ ID NO: 2288715 - RNA, 14 nt, Human
aaaggaauuuaaaa

SEQ ID NO: 2288716 - RNA, 23 nt, Human
aucaccaaggcugauuaaaccaa

SEQ ID NO: 2288717 - RNA, 22 nt, Human
cugagcagugcuugaaugaagu

SEQ ID NO: 2288718 - RNA, 17 nt, Human
cccacuggacucaccuc

SEQ ID NO: 2288719 - RNA, 23 nt, Human
cccagcccuccuuaucaaaggac

SEQ ID NO: 2288720 - RNA, 20 nt, Human
aaagacaaggaaaaaauaac

SEQ ID NO: 2288721 - RNA, 22 nt, Human
cuaagcuucacuguaaaauaau

SEQ ID NO: 2288722 - RNA, 17 nt, Human
cccacuagacccacugg

SEQ ID NO: 2288723 - RNA, 22 nt, Human
ugagacucugucucaguccaug

SEQ ID NO: 2288724 - RNA, 18 nt, Human
gacauuugcucauggaau

SEQ ID NO: 2288725 - RNA, 23 nt, Human
auaucuuuuuuuuaauaaaccau

SEQ ID NO: 2288726 - RNA, 18 nt, Human
gccccgucccccucuggc

SEQ ID NO: 2288727 - RNA, 21 nt, Human
gacagugaaagaaaauaacaa

SEQ ID NO: 2288728 - RNA, 23 nt, Human
acugucuuguuggacgagaaaac

SEQ ID NO: 2288729 - RNA, 19 nt, Human
agugaggagcuuugaaacg

SEQ ID NO: 2288730 - RNA, 15 nt, Human
aagccagauuuuccu

SEQ ID NO: 2288731 - RNA, 13 nt, Human
cuuaucaaaggac

SEQ ID NO: 2288732 - RNA, 16 nt, Human
aucaauuuaaaaaaaa

SEQ ID NO: 2288733 - RNA, 21 nt, Human
cauuuucuucucacauuuaua

SEQ ID NO: 2288734 - RNA, 14 nt, Human
auuucuaugaaaua

SEQ ID NO: 2288735 - RNA, 16 nt, Human
cagaagcaacccaaau

SEQ ID NO: 2288736 - RNA, 21 nt, Human
acgcucucuggccuucggccu

SEQ ID NO: 2288737 - RNA, 16 nt, Human
gcuuuuucucucccac

SEQ ID NO: 2288738 - RNA, 21 nt, Human
uacaugagguacugagaguga

SEQ ID NO: 2288739 - RNA, 16 nt, Human
auaucaauuuaaaaaa

SEQ ID NO: 2288740 - RNA, 21 nt, Human
ugcagaguacuggcugaugga

SEQ ID NO: 2288741 - RNA, 12 nt, Human
gauaaaagacag

SEQ ID NO: 2288742 - RNA, 22 nt, Human
aaaucaggguuaguauugucca

SEQ ID NO: 2288743 - RNA, 18 nt, Human
uuuuauaucaauuuaaaa

SEQ ID NO: 2288744 - RNA, 19 nt, Human
gccccccagcccuccuuau

SEQ ID NO: 2288745 - RNA, 21 nt, Human
gcugagucccaggcugagccu

SEQ ID NO: 2288746 - RNA, 17 nt, Human
aaauaacgauaaaagac

SEQ ID NO: 2288747 - RNA, 13 nt, Human
aucaaugaaugaa

SEQ ID NO: 2288748 - RNA, 16 nt, Human
ugaaguacucauacau

SEQ ID NO: 2288749 - RNA, 14 nt, Human
uccacaacacacag

SEQ ID NO: 2288750 - RNA, 13 nt, Human
acaauaaaagaca

SEQ ID NO: 2288751 - RNA, 17 nt, Human
ugaccacugcagaagac

SEQ ID NO: 2288752 - RNA, 15 nt, Human
uuaauucugaaagca

SEQ ID NO: 2288753 - RNA, 17 nt, Human
cuggacucaccuccccc

SEQ ID NO: 2288754 - RNA, 13 nt, Human
ccugccccccagc

SEQ ID NO: 2288755 - RNA, 14 nt, Human
agaaaugaaagcag

SEQ ID NO: 2288756 - RNA, 15 nt, Human
uaggaaauauuuauu

SEQ ID NO: 2288757 - RNA, 19 nt, Human
uggaacaguuaccucugcc

SEQ ID NO: 2288758 - RNA, 21 nt, Human
ugagccagugucaggaggaag

SEQ ID NO: 2288759 - RNA, 12 nt, Human
cccccagcccuc

SEQ ID NO: 2288760 - RNA, 15 nt, Human
gacagggaggacgcu

SEQ ID NO: 2288761 - RNA, 20 nt, Human
ugguuguauuauuuuuuaaa

SEQ ID NO: 2288762 - RNA, 20 nt, Human
caaauguucaucaaugaaug

SEQ ID NO: 2288763 - RNA, 21 nt, Human
accaaggagccaaacauccua

SEQ ID NO: 2288764 - RNA, 14 nt, Human
acauagugaggagc

SEQ ID NO: 2288765 - RNA, 16 nt, Human
ccuacaugagguacug

SEQ ID NO: 2288766 - RNA, 16 nt, Human
ucuugagguaaaagca

SEQ ID NO: 2288767 - RNA, 22 nt, Human
ucuagcaugucgucaaagcuga

SEQ ID NO: 2288768 - RNA, 23 nt, Human
ggucucagugucaaugcagcccc

SEQ ID NO: 2288769 - RNA, 13 nt, Human
gguccacaacaca

SEQ ID NO: 2288770 - RNA, 16 nt, Human
uuauaauuuaaaauau

SEQ ID NO: 2288771 - RNA, 15 nt, Human
gccccauucaacauc

SEQ ID NO: 2288772 - RNA, 20 nt, Human
aagucuuucacauuuaaaua

SEQ ID NO: 2288773 - RNA, 13 nt, Human
cacaacuauauug

SEQ ID NO: 2288774 - RNA, 16 nt, Human
auuauacccccugcaa

SEQ ID NO: 2288775 - RNA, 14 nt, Human
aagcaacccaaaug

SEQ ID NO: 2288776 - RNA, 20 nt, Human
aaauaauuuuuauauuugaa

SEQ ID NO: 2288777 - RNA, 18 nt, Human
acagagacagaaagcaga

SEQ ID NO: 2288778 - RNA, 13 nt, Human
uaugaaauauuau

SEQ ID NO: 2288779 - RNA, 22 nt, Human
cccagcccuccuuaucaaagga

SEQ ID NO: 2288780 - RNA, 18 nt, Human
cucuggccuucggccucc

SEQ ID NO: 2288781 - RNA, 17 nt, Human
uccuacaagacacagug

SEQ ID NO: 2288782 - RNA, 14 nt, Human
aaaauacaaaaaaa

SEQ ID NO: 2288783 - RNA, 15 nt, Human
acaaggaaaaaauaa

SEQ ID NO: 2288784 - RNA, 20 nt, Human
cuucaacucccugcccccca

SEQ ID NO: 2288785 - RNA, 23 nt, Human
gaaaacaauaacgauaaaagaca

SEQ ID NO: 2288786 - RNA, 16 nt, Human
aaauaacaaugaaagu

SEQ ID NO: 2288787 - RNA, 16 nt, Human
gaaaaaauaacaauga

SEQ ID NO: 2288788 - RNA, 18 nt, Human
cagaguacuggcugaugg

SEQ ID NO: 2288789 - RNA, 17 nt, Human
ucgggauuaguacacac

SEQ ID NO: 2288790 - RNA, 23 nt, Human
uccaacuaucucauuuccaagca

SEQ ID NO: 2288791 - RNA, 22 nt, Human
cacagauuugagcucagcccug

SEQ ID NO: 2288792 - RNA, 14 nt, Human
aaagagaacuucca

SEQ ID NO: 2288793 - RNA, 19 nt, Human
auuggagcucgugggacag

SEQ ID NO: 2288794 - RNA, 15 nt, Human
cagugaaagaaaaua

SEQ ID NO: 2288795 - RNA, 16 nt, Human
agccucagucucccuc

SEQ ID NO: 2288796 - RNA, 14 nt, Human
auugucuagugaaa

SEQ ID NO: 2288797 - RNA, 18 nt, Human
uuuauguuuaauucugaa

SEQ ID NO: 2288798 - RNA, 18 nt, Human
uguauuauuuuuuaaaaa

SEQ ID NO: 2288799 - RNA, 15 nt, Human
uucacauuuaaauaa

SEQ ID NO: 2288800 - RNA, 19 nt, Human
caacucccugccccccagc

SEQ ID NO: 2288801 - RNA, 13 nt, Human
uguauauuuuaua

SEQ ID NO: 2288802 - RNA, 20 nt, Human
uauaugcuaagucuuauaua

SEQ ID NO: 2288803 - RNA, 14 nt, Human
ucuauaauuuaaau

SEQ ID NO: 2288804 - RNA, 22 nt, Human
gaaaaucuuauaauuuaaaaua

SEQ ID NO: 2288805 - RNA, 13 nt, Human
gaaccuaggguga

SEQ ID NO: 2288806 - RNA, 15 nt, Human
cucgugggacaguca

SEQ ID NO: 2288807 - RNA, 20 nt, Human
uaacgauaaaagacagugaa

SEQ ID NO: 2288808 - RNA, 16 nt, Human
aagcauuuagauguau

SEQ ID NO: 2288809 - RNA, 19 nt, Human
ccccugcaaagcccagcuu

SEQ ID NO: 2288810 - RNA, 23 nt, Human
acucuauguucuaagaagugaaa

SEQ ID NO: 2288811 - RNA, 20 nt, Human
uguaauaggcguaacuaauu

SEQ ID NO: 2288812 - RNA, 20 nt, Human
agaugcaguucugaagaaga

SEQ ID NO: 2288813 - RNA, 19 nt, Human
agaguuuagcuggaaaagu

SEQ ID NO: 2288814 - RNA, 16 nt, Human
uaaugaauacuuuaua

SEQ ID NO: 2288815 - RNA, 16 nt, Human
cagggcucacagaauu

SEQ ID NO: 2288816 - RNA, 19 nt, Human
cuucuggguuccuuccucu

SEQ ID NO: 2288817 - RNA, 24 nt, Human
ccccugagcuugcagagaugaggc

SEQ ID NO: 2288818 - RNA, 15 nt, Human
aagugaaaaucuaca

SEQ ID NO: 2288819 - RNA, 12 nt, Human
acugaaaucaua

SEQ ID NO: 2288820 - RNA, 20 nt, Human
auauuuuauaucaauuuaaa

SEQ ID NO: 2288821 - RNA, 12 nt, Human
cuggcuccagcu

SEQ ID NO: 2288822 - RNA, 13 nt, Human
aagacaaggaaaa

SEQ ID NO: 2288823 - RNA, 13 nt, Human
cccugcacuccag

SEQ ID NO: 2288824 - RNA, 20 nt, Human
uugaacccgggaggcagagg

SEQ ID NO: 2288825 - RNA, 13 nt, Human
ucuauaauuuaaa

SEQ ID NO: 2288826 - RNA, 17 nt, Human
auauuugaaauauugac

SEQ ID NO: 2288827 - RNA, 16 nt, Human
uaaauaaaaauaaucc

SEQ ID NO: 2288828 - RNA, 14 nt, Human
uauuuauuuuaaua

SEQ ID NO: 2288829 - RNA, 13 nt, Human
ccucccccaucuc

SEQ ID NO: 2288830 - RNA, 16 nt, Human
cacuaguauuucuaug

SEQ ID NO: 2288831 - RNA, 19 nt, Human
gcacacagcacgggggcca

SEQ ID NO: 2288832 - RNA, 16 nt, Human
ucaucaaugaaugaau

SEQ ID NO: 2288833 - RNA, 20 nt, Human
uuugcaagccagauuuuccu

SEQ ID NO: 2288834 - RNA, 21 nt, Human
uuuucaggcuagauguaugua

SEQ ID NO: 2288835 - RNA, 18 nt, Human
gaaaauaucacuugucaa

SEQ ID NO: 2288836 - RNA, 14 nt, Human
cuaagcauuccaac

SEQ ID NO: 2288837 - RNA, 16 nt, Human
cugagcgacagugaga

SEQ ID NO: 2288838 - RNA, 18 nt, Human
cagucucccucccuuggg

SEQ ID NO: 2288839 - RNA, 18 nt, Human
cagagacagaaagcagaa

SEQ ID NO: 2288840 - RNA, 16 nt, Human
cuccauccugaggcuc

SEQ ID NO: 2288841 - RNA, 15 nt, Human
guacuggcugaugga

SEQ ID NO: 2288842 - RNA, 19 nt, Human
ccgggcgugguggugagug

SEQ ID NO: 2288843 - RNA, 16 nt, Human
aacuugguuuuaauua

SEQ ID NO: 2288844 - RNA, 17 nt, Human
acaaaugggaaacaaaa

SEQ ID NO: 2288845 - RNA, 21 nt, Human
gacagcuucucauccugcagg

SEQ ID NO: 2288846 - RNA, 13 nt, Human
auccugcaggcag

SEQ ID NO: 2288847 - RNA, 19 nt, Human
uauuuuaauaauguuucaa

SEQ ID NO: 2288848 - RNA, 15 nt, Human
uccauccugaggcuc

SEQ ID NO: 2288849 - RNA, 14 nt, Human
uaaaagacaaggaa

SEQ ID NO: 2288850 - RNA, 21 nt, Human
caccagucugacuguuuccau

SEQ ID NO: 2288851 - RNA, 15 nt, Human
cgggagccugaucac

SEQ ID NO: 2288852 - RNA, 14 nt, Human
agcucguggaacag

SEQ ID NO: 2288853 - RNA, 14 nt, Human
cucccuuggggccu

SEQ ID NO: 2288854 - RNA, 22 nt, Human
uguauacugugugcuaaaacaa

SEQ ID NO: 2288855 - RNA, 19 nt, Human
agccugaucaccugcccug

SEQ ID NO: 2288856 - RNA, 23 nt, Human
aggcuuacacccacaguggaaag

SEQ ID NO: 2288857 - RNA, 20 nt, Human
aaggagccaaacauccuaca

SEQ ID NO: 2288858 - RNA, 21 nt, Human
guccccuauccuacuuccccu

SEQ ID NO: 2288859 - RNA, 13 nt, Human
acuaauuuuaaaa

SEQ ID NO: 2288860 - RNA, 16 nt, Human
cuggccuucggccucc

SEQ ID NO: 2288861 - RNA, 14 nt, Human
agaauucauucacu

SEQ ID NO: 2288862 - RNA, 13 nt, Human
aagcauuccaacu

SEQ ID NO: 2288863 - RNA, 19 nt, Human
uccagccuggcaaggguuc

SEQ ID NO: 2288864 - RNA, 18 nt, Human
ugggcacaggguuuaugu

SEQ ID NO: 2288865 - RNA, 17 nt, Human
cugccucagaaaacaag

SEQ ID NO: 2288866 - RNA, 20 nt, Human
uaugcuucuguuuuauaauu

SEQ ID NO: 2288867 - RNA, 22 nt, Human
cuggcaaggguucaccugggcu

SEQ ID NO: 2288868 - RNA, 17 nt, Human
acaaguccagccuggca

SEQ ID NO: 2288869 - RNA, 13 nt, Human
agcgacagugaga

SEQ ID NO: 2288870 - RNA, 16 nt, Human
auccuugaagauuuac

SEQ ID NO: 2288871 - RNA, 18 nt, Human
cauggaauuggagcucgu

SEQ ID NO: 2288872 - RNA, 16 nt, Human
uccugcaauuccacuu

SEQ ID NO: 2288873 - RNA, 20 nt, Human
cuugccauaauuacuauguc

SEQ ID NO: 2288874 - RNA, 13 nt, Human
uccuacuuccccu

SEQ ID NO: 2288875 - RNA, 18 nt, Human
ggaggacgcucucuggcc

SEQ ID NO: 2288876 - RNA, 17 nt, Human
augauuaaguaaugaua

SEQ ID NO: 2288877 - RNA, 16 nt, Human
uauaugucacuuugcu

SEQ ID NO: 2288878 - RNA, 14 nt, Human
aauauuauguuaaa

SEQ ID NO: 2288879 - RNA, 23 nt, Human
ugucaauucuugccaaauauaaa

SEQ ID NO: 2288880 - RNA, 19 nt, Human
gccugaucaccugcccugc

SEQ ID NO: 2288881 - RNA, 23 nt, Human
uaacgauaaaagacagugaaaga

SEQ ID NO: 2288882 - RNA, 18 nt, Human
uacauuuguauaaaauaa

SEQ ID NO: 2288883 - RNA, 13 nt, Human
ugggaggcugaga

SEQ ID NO: 2288884 - RNA, 14 nt, Human
cagucugaugagaa

SEQ ID NO: 2288885 - RNA, 16 nt, Human
aagacugcacaucaaa

SEQ ID NO: 2288886 - RNA, 19 nt, Human
aagcuuguauuccuuuuuc

SEQ ID NO: 2288887 - RNA, 16 nt, Human
agcuugaaaccuucac

SEQ ID NO: 2288888 - RNA, 21 nt, Human
cuucuaaccugaacugauggg

SEQ ID NO: 2288889 - RNA, 13 nt, Human
acaagaaaugaaa

SEQ ID NO: 2288890 - RNA, 18 nt, Human
auuuguauaaaauaauuu

SEQ ID NO: 2288891 - RNA, 17 nt, Human
cugaucaccugcccugc

SEQ ID NO: 2288892 - RNA, 12 nt, Human
ucuuaagaagac

SEQ ID NO: 2288893 - RNA, 21 nt, Human
aaguuuaugguuguauuauuu

SEQ ID NO: 2288894 - RNA, 14 nt, Human
auuuaaauauaugc

SEQ ID NO: 2288895 - RNA, 16 nt, Human
cugagcuugcagagau

SEQ ID NO: 2288896 - RNA, 22 nt, Human
gacucaccucccccaucucuuc

SEQ ID NO: 2288897 - RNA, 20 nt, Human
gauugugccccugcacucca

SEQ ID NO: 2288898 - RNA, 17 nt, Human
gaggcauccuuccucac

SEQ ID NO: 2288899 - RNA, 18 nt, Human
uuuguuaaaugauuucau

SEQ ID NO: 2288900 - RNA, 11 nt, Human
caauaaaagac

SEQ ID NO: 2288901 - RNA, 22 nt, Human
agcacagccucuuagaugcagu

SEQ ID NO: 2288902 - RNA, 14 nt, Human
agaugcuagaacuc

SEQ ID NO: 2288903 - RNA, 18 nt, Human
ugcauagguuuaauaauu

SEQ ID NO: 2288904 - RNA, 21 nt, Human
aaagaaaauaacgauaaaaga

SEQ ID NO: 2288905 - RNA, 13 nt, Human
ccugagcuugcag

SEQ ID NO: 2288906 - RNA, 13 nt, Human
ccaaggaugcccc

SEQ ID NO: 2288907 - RNA, 22 nt, Human
guacacugccuucucaacucca

SEQ ID NO: 2288908 - RNA, 15 nt, Human
uugacacuuaaaaau

SEQ ID NO: 2288909 - RNA, 15 nt, Human
aaaagacaaggaaaa

SEQ ID NO: 2288910 - RNA, 14 nt, Human
ggcuccagcuggcc

SEQ ID NO: 2288911 - RNA, 18 nt, Human
cccucuggcuccagcugg

SEQ ID NO: 2288912 - RNA, 14 nt, Human
gcugauuaaaccaa

SEQ ID NO: 2288913 - RNA, 13 nt, Human
auaaauaaaaaua

SEQ ID NO: 2288914 - RNA, 16 nt, Human
ucccugccccccagcc

SEQ ID NO: 2288915 - RNA, 20 nt, Human
uaacaagccuccuuuuaaag

SEQ ID NO: 2288916 - RNA, 19 nt, Human
guuauuauauuuacaaaug

SEQ ID NO: 2288917 - RNA, 19 nt, Human
gaggcagagguugcaguga

SEQ ID NO: 2288918 - RNA, 19 nt, Human
cagagaugaggccgccaug

SEQ ID NO: 2288919 - RNA, 17 nt, Human
ugaucaccugcccugcu

SEQ ID NO: 2288920 - RNA, 18 nt, Human
gccccugcacuccagccu

SEQ ID NO: 2288921 - RNA, 13 nt, Human
ugauuauauguca

SEQ ID NO: 2288922 - RNA, 20 nt, Human
guucugcagauaaacaguag

SEQ ID NO: 2288923 - RNA, 14 nt, Human
uauaaauaaaaaua

SEQ ID NO: 2288924 - RNA, 17 nt, Human
gaacuuuccacauucag

SEQ ID NO: 2288925 - RNA, 18 nt, Human
cagggaggacgcucucug

SEQ ID NO: 2288926 - RNA, 21 nt, Human
cuucucacauuuauauuuuug

SEQ ID NO: 2288927 - RNA, 15 nt, Human
ugaaacccugucucu

SEQ ID NO: 2288928 - RNA, 19 nt, Human
aaaagacagugaaagaaaa

SEQ ID NO: 2288929 - RNA, 15 nt, Human
aaggaauuuaaaaau

SEQ ID NO: 2288930 - RNA, 15 nt, Human
ccugccccccagccc

SEQ ID NO: 2288931 - RNA, 18 nt, Human
auuaaguuuuuuuuuaaa

SEQ ID NO: 2288932 - RNA, 14 nt, Human
caaggaaaaaauaa

SEQ ID NO: 2288933 - RNA, 13 nt, Human
ucuacuaaaaaua

SEQ ID NO: 2288934 - RNA, 14 nt, Human
cacaagaaaugaaa

SEQ ID NO: 2288935 - RNA, 23 nt, Human
ucacaccaggcuugccugcaggc

SEQ ID NO: 2288936 - RNA, 16 nt, Human
cccuauccuacuuccc

SEQ ID NO: 2288937 - RNA, 18 nt, Human
acaaauccaaugaaauga

SEQ ID NO: 2288938 - RNA, 16 nt, Human
uguccccuauccuacu

SEQ ID NO: 2288939 - RNA, 22 nt, Human
accaaucaugaauuaguuuuau

SEQ ID NO: 2288940 - RNA, 13 nt, Human
aggcuagauguau

SEQ ID NO: 2288941 - RNA, 13 nt, Human
uacagagacagaa

SEQ ID NO: 2288942 - RNA, 22 nt, Human
auuuucuucucacauuuauauu

SEQ ID NO: 2288943 - RNA, 13 nt, Human
uuggacgagaaaa

SEQ ID NO: 2288944 - RNA, 17 nt, Human
gacucaccucccccauc

SEQ ID NO: 2288945 - RNA, 20 nt, Human
accuacacgagauacagaau

SEQ ID NO: 2288946 - RNA, 14 nt, Human
auuguccaggucua

SEQ ID NO: 2288947 - RNA, 20 nt, Human
aauaagccagacaucaacag

SEQ ID NO: 2288948 - RNA, 22 nt, Human
ugguuguauuauuuuuuaaaaa

SEQ ID NO: 2288949 - RNA, 21 nt, Human
caacacacagauuugagcuca

SEQ ID NO: 2288950 - RNA, 14 nt, Human
uauaauuuaaaaua

SEQ ID NO: 2288951 - RNA, 14 nt, Human
auuauuuuuuaaaa

SEQ ID NO: 2288952 - RNA, 15 nt, Human
uggacucaccucccc

SEQ ID NO: 2288953 - RNA, 15 nt, Human
uagauaggccauggg

SEQ ID NO: 2288954 - RNA, 15 nt, Human
aaaaauaacaaugaa

SEQ ID NO: 2288955 - RNA, 15 nt, Human
aauaacgauaaaaga

SEQ ID NO: 2288956 - RNA, 15 nt, Human
ccgucccccucuggc

SEQ ID NO: 2288957 - RNA, 16 nt, Human
uacauuuguauaaaau

SEQ ID NO: 2288958 - RNA, 21 nt, Human
cagagguccacaacacacaga

SEQ ID NO: 2288959 - RNA, 16 nt, Human
gaaucacuugaacccg

SEQ ID NO: 2288960 - RNA, 16 nt, Human
uuuauauuugaaauau

SEQ ID NO: 2288961 - RNA, 15 nt, Human
ugccccccagcccuc

SEQ ID NO: 2288962 - RNA, 18 nt, Human
caugaagauguagaggag

SEQ ID NO: 2288963 - RNA, 13 nt, Human
cgggaggcagagg

SEQ ID NO: 2288964 - RNA, 12 nt, Human
uccugcaggcag

SEQ ID NO: 2288965 - RNA, 12 nt, Human
aaaauaacaaua

SEQ ID NO: 2288966 - RNA, 20 nt, Human
guauuauuuuuuaaaaaaau

SEQ ID NO: 2288967 - RNA, 22 nt, Human
cccuauccuacuuccccuuccu

SEQ ID NO: 2288968 - RNA, 13 nt, Human
uuuuaaaaaagaa

SEQ ID NO: 2288969 - RNA, 16 nt, Human
augccccgucccccuc

SEQ ID NO: 2288970 - RNA, 16 nt, Human
ccccaucucuucuggg

SEQ ID NO: 2288971 - RNA, 19 nt, Human
gagggaauugcagaguacu

SEQ ID NO: 2288972 - RNA, 18 nt, Human
acuuuaugcuaagugaaa

SEQ ID NO: 2288973 - RNA, 19 nt, Human
aaagacagugaaagaaaau

SEQ ID NO: 2288974 - RNA, 15 nt, Human
cuugaaaacuuuaug

SEQ ID NO: 2288975 - RNA, 17 nt, Human
acaaaugcauuucuaaa

SEQ ID NO: 2288976 - RNA, 21 nt, Human
aauuuacagagacagaaagca

SEQ ID NO: 2288977 - RNA, 18 nt, Human
agcugcucaauaaaguac

SEQ ID NO: 2288978 - RNA, 22 nt, Human
cagcacgggggccaaggaugcc

SEQ ID NO: 2288979 - RNA, 20 nt, Human
gaaaauaacgauaaaagaca

SEQ ID NO: 2288980 - RNA, 19 nt, Human
caucaaggguacacugccu

SEQ ID NO: 2288981 - RNA, 16 nt, Human
ccacuuauaggaauug

SEQ ID NO: 2288982 - RNA, 20 nt, Human
agcuucacuguaaaauaaua

SEQ ID NO: 2288983 - RNA, 13 nt, Human
uacuuuauuuucu

SEQ ID NO: 2288984 - RNA, 19 nt, Human
cccacuggacucaccuccc

SEQ ID NO: 2288985 - RNA, 20 nt, Human
uuccacagaagcuccaggua

SEQ ID NO: 2288986 - RNA, 17 nt, Human
ucuauaauuuaaauaua

SEQ ID NO: 2288987 - RNA, 21 nt, Human
aaucaccaaggcugauuaaac

SEQ ID NO: 2288988 - RNA, 18 nt, Human
agcaaaauuuuuucucua

SEQ ID NO: 2288989 - RNA, 20 nt, Human
uuucuucaacucccugcccc

SEQ ID NO: 2288990 - RNA, 18 nt, Human
ccacauucagagcuuacu

SEQ ID NO: 2288991 - RNA, 21 nt, Human
caaggaaaaaauaacaaugaa

SEQ ID NO: 2288992 - RNA, 22 nt, Human
aacucccugccccccagcccuc

SEQ ID NO: 2288993 - RNA, 17 nt, Human
cugagcgacagugagac

SEQ ID NO: 2288994 - RNA, 17 nt, Human
auaaguacaugauaagc

SEQ ID NO: 2288995 - RNA, 22 nt, Human
caaugcuguauuuuaaaagaau

SEQ ID NO: 2288996 - RNA, 19 nt, Human
aguauuucuaugaaauauu

SEQ ID NO: 2288997 - RNA, 16 nt, Human
cauagaaguaaaaaca

SEQ ID NO: 2288998 - RNA, 21 nt, Human
gauaaaagacagugaaagaaa

SEQ ID NO: 2288999 - RNA, 22 nt, Human
ucaacuccaaacugacucuuaa

SEQ ID NO: 2289000 - RNA, 21 nt, Human
aauucauucacucaacaaaca

SEQ ID NO: 2289001 - RNA, 20 nt, Human
ucaauaaaauccauacauuu

SEQ ID NO: 2289002 - RNA, 17 nt, Human
gacagugaaagaaaaua

SEQ ID NO: 2289003 - RNA, 17 nt, Human
cuuccucugagccuugg

SEQ ID NO: 2289004 - RNA, 21 nt, Human
agcccuucuuuccacagaagc

SEQ ID NO: 2289005 - RNA, 15 nt, Human
gccuaagugcagccc

SEQ ID NO: 2289006 - RNA, 17 nt, Human
ugaaauaagccagacau

SEQ ID NO: 2289007 - RNA, 19 nt, Human
accccugagcuugcagaga

SEQ ID NO: 2289008 - RNA, 19 nt, Human
gaaaauaacgauaaaagac

SEQ ID NO: 2289009 - RNA, 18 nt, Human
agguccacaacacacaga

SEQ ID NO: 2289010 - RNA, 16 nt, Human
uugccauaauuacuau

SEQ ID NO: 2289011 - RNA, 23 nt, Human
ggaugaauuaaguuuuuuuuuaa

SEQ ID NO: 2289012 - RNA, 21 nt, Human
uaauaggcguaacuaauuuua

SEQ ID NO: 2289013 - RNA, 21 nt, Human
caagacugcacaucaaaauau

SEQ ID NO: 2289014 - RNA, 18 nt, Human
auccuucagccugaaaga

SEQ ID NO: 2289015 - RNA, 15 nt, Human
gaaaacaaggaugaa

SEQ ID NO: 2289016 - RNA, 20 nt, Human
cagcuggccgggagccugau

SEQ ID NO: 2289017 - RNA, 22 nt, Human
caagcacuaaacaaagagugaa

SEQ ID NO: 2289018 - RNA, 23 nt, Human
cugaaaucauacuucuuaggguu

SEQ ID NO: 2289019 - RNA, 15 nt, Human
ugaaauuguauuaca

SEQ ID NO: 2289020 - RNA, 22 nt, Human
agacccacuggacucaccuccc

SEQ ID NO: 2289021 - RNA, 19 nt, Human
accauuuuggcaagcucua

SEQ ID NO: 2289022 - RNA, 14 nt, Human
ugugaaaagcucca

SEQ ID NO: 2289023 - RNA, 20 nt, Human
augcaguuguugcccacagc

SEQ ID NO: 2289024 - RNA, 18 nt, Human
uucugauauuggacagua

SEQ ID NO: 2289025 - RNA, 23 nt, Human
uauguuaaaacugggacagggga

SEQ ID NO: 2289026 - RNA, 23 nt, Human
uuuguauaaaauaauuuuuauau

SEQ ID NO: 2289027 - RNA, 15 nt, Human
augggacagggagga

SEQ ID NO: 2289028 - RNA, 15 nt, Human
auuugguaaggggaa

SEQ ID NO: 2289029 - RNA, 21 nt, Human
caaagcccagcuugaaaccuu

SEQ ID NO: 2289030 - RNA, 14 nt, Human
gcuggagcucugcc

SEQ ID NO: 2289031 - RNA, 13 nt, Human
aaaugggaaacaa

SEQ ID NO: 2289032 - RNA, 13 nt, Human
uaagugcagcccc

SEQ ID NO: 2289033 - RNA, 19 nt, Human
cccauggcacucuauguuc

SEQ ID NO: 2289034 - RNA, 19 nt, Human
cuccagcuggccgggagcc

SEQ ID NO: 2289035 - RNA, 14 nt, Human
ucccuugaugaaga

SEQ ID NO: 2289036 - RNA, 17 nt, Human
aauucuugccaaauaua

SEQ ID NO: 2289037 - RNA, 20 nt, Human
ucauucacucaacaaacaua

SEQ ID NO: 2289038 - RNA, 20 nt, Human
ggguuccuuccucugagccu

SEQ ID NO: 2289039 - RNA, 21 nt, Human
caucuagcaugucgucaaagc

SEQ ID NO: 2289040 - RNA, 22 nt, Human
aaagagugaaggauuuauguuu

SEQ ID NO: 2289041 - RNA, 17 nt, Human
ccugcaggcaugaguca

SEQ ID NO: 2289042 - RNA, 15 nt, Human
ccuggugggcagaga

SEQ ID NO: 2289043 - RNA, 14 nt, Human
cuggagcucugccc

SEQ ID NO: 2289044 - RNA, 19 nt, Human
aaaauaacgauaaaagaca

SEQ ID NO: 2289045 - RNA, 22 nt, Human
guguccccuauccuacuucccc

SEQ ID NO: 2289046 - RNA, 16 nt, Human
ucugcagauaaacagu

SEQ ID NO: 2289047 - RNA, 18 nt, Human
gaagcaccaaucaugaau

SEQ ID NO: 2289048 - RNA, 14 nt, Human
cugaggcuccacuu

SEQ ID NO: 2289049 - RNA, 22 nt, Human
gcagagagguagggauggggcu

SEQ ID NO: 2289050 - RNA, 17 nt, Human
gaagcaccaaucaugaa

SEQ ID NO: 2289051 - RNA, 19 nt, Human
uauauuuuuuguuaaauga

SEQ ID NO: 2289052 - RNA, 19 nt, Human
uagugagcagucaggaaag

SEQ ID NO: 2289053 - RNA, 17 nt, Human
guuuaauucugaaagca

SEQ ID NO: 2289054 - RNA, 17 nt, Human
ucuuucacauuuaaaua

SEQ ID NO: 2289055 - RNA, 14 nt, Human
ccaaugaaaugagu

SEQ ID NO: 2289056 - RNA, 20 nt, Human
gagccucagucucccucccu

SEQ ID NO: 2289057 - RNA, 16 nt, Human
agguacuucaaauccu

SEQ ID NO: 2289058 - RNA, 15 nt, Human
acaaaugggaaacaa

SEQ ID NO: 2289059 - RNA, 12 nt, Human
ggcugaugcagu

SEQ ID NO: 2289060 - RNA, 12 nt, Human
agaaaacaauaa

SEQ ID NO: 2289061 - RNA, 17 nt, Human
ugaaaaucuuauaauuu

SEQ ID NO: 2289062 - RNA, 23 nt, Human
cuacacgagauacagaauuuuau

SEQ ID NO: 2289063 - RNA, 14 nt, Human
acccaaaaggcaga

SEQ ID NO: 2289064 - RNA, 13 nt, Human
uuuaaaaauccua

SEQ ID NO: 2289065 - RNA, 20 nt, Human
ggagccugaucaccugcccu

SEQ ID NO: 2289066 - RNA, 18 nt, Human
gccuucggccuccauccu

SEQ ID NO: 2289067 - RNA, 11 nt, Human
caucuagugag

SEQ ID NO: 2289068 - RNA, 11 nt, Human
aauugcagagu

SEQ ID NO: 2289069 - RNA, 17 nt, Human
aagacagugaaagaaaa

SEQ ID NO: 2289070 - RNA, 23 nt, Human
augaauuaaguuuuuuuuuaaaa

SEQ ID NO: 2289071 - RNA, 19 nt, Human
cugccccccagcccuccuu

SEQ ID NO: 2289072 - RNA, 23 nt, Human
uaaguuuuuuuuuaaaaaagaaa

SEQ ID NO: 2289073 - RNA, 23 nt, Human
agaaugauuaugaauuacauuug

SEQ ID NO: 2289074 - RNA, 14 nt, Human
uaaaauccauacau

SEQ ID NO: 2289075 - RNA, 19 nt, Human
ggaaaaaauaacaaugaaa

SEQ ID NO: 2289076 - RNA, 13 nt, Human
aggauuugaaauu

SEQ ID NO: 2289077 - RNA, 21 nt, Human
aguuguugcccacagcuguau

SEQ ID NO: 2289078 - RNA, 20 nt, Human
cugcacuccagccugagcga

SEQ ID NO: 2289079 - RNA, 14 nt, Human
uccacuuggucugu

SEQ ID NO: 2289080 - RNA, 15 nt, Human
ucugcagauaaacag

SEQ ID NO: 2289081 - RNA, 20 nt, Human
cucuguucugcacacagcac

SEQ ID NO: 2289082 - RNA, 17 nt, Human
aauauugcaaggcaaag

SEQ ID NO: 2289083 - RNA, 12 nt, Human
acacugaagaag

SEQ ID NO: 2289084 - RNA, 17 nt, Human
gugccuguaaucacagc

SEQ ID NO: 2289085 - RNA, 19 nt, Human
aggucuaccaaaaaucuca

SEQ ID NO: 2289086 - RNA, 15 nt, Human
cauguccacugguuc

SEQ ID NO: 2289087 - RNA, 18 nt, Human
acagaaagcagaacagug

SEQ ID NO: 2289088 - RNA, 14 nt, Human
ugaagauguagagg

SEQ ID NO: 2289089 - RNA, 23 nt, Human
gggccuaugcagagguccacaac

SEQ ID NO: 2289090 - RNA, 17 nt, Human
uuauaaucuuucacagg

SEQ ID NO: 2289091 - RNA, 20 nt, Human
gaaacgaggauugggaaaaa

SEQ ID NO: 2289092 - RNA, 13 nt, Human
gcagaacagugau

SEQ ID NO: 2289093 - RNA, 13 nt, Human
ucucccucccuug

SEQ ID NO: 2289094 - RNA, 16 nt, Human
ccugcaaagcccagcu

SEQ ID NO: 2289095 - RNA, 23 nt, Human
gaccccugagcuugcagagauga

SEQ ID NO: 2289096 - RNA, 18 nt, Human
cagcugcucaauaaagua

SEQ ID NO: 2289097 - RNA, 20 nt, Human
auaacaaugcuguauuuuaa

SEQ ID NO: 2289098 - RNA, 16 nt, Human
ugacuuaaugccacua

SEQ ID NO: 2289099 - RNA, 12 nt, Human
gcucagcccugg

SEQ ID NO: 2289100 - RNA, 14 nt, Human
augauguuuagaaa

SEQ ID NO: 2289101 - RNA, 23 nt, Human
gaggcauuuaggccaugggacag

SEQ ID NO: 2289102 - RNA, 19 nt, Human
cuggccuucggccuccauc

SEQ ID NO: 2289103 - RNA, 16 nt, Human
aaauauaaauaaaaau

SEQ ID NO: 2289104 - RNA, 18 nt, Human
gcuccauuuuuagugaaa

SEQ ID NO: 2289105 - RNA, 19 nt, Human
ggacucaccucccccaucu

SEQ ID NO: 2289106 - RNA, 22 nt, Human
caccagucugacuguuuccauc

SEQ ID NO: 2289107 - RNA, 15 nt, Human
acaucaacagauaaa

SEQ ID NO: 2289108 - RNA, 14 nt, Human
aguuuuuuuuuaaa

SEQ ID NO: 2289109 - RNA, 14 nt, Human
cugccccccagccc

SEQ ID NO: 2289110 - RNA, 20 nt, Human
cuggccuucggccuccaucc

SEQ ID NO: 2289111 - RNA, 14 nt, Human
agaaaauaacaaua

SEQ ID NO: 2289112 - RNA, 13 nt, Human
aacacaacuauau

SEQ ID NO: 2289113 - RNA, 20 nt, Human
cacuagacccacuggacuca

SEQ ID NO: 2289114 - RNA, 19 nt, Human
cuaguaucaaaagaaagaa

SEQ ID NO: 2289115 - RNA, 16 nt, Human
ugaauuaguuuuauau

SEQ ID NO: 2289116 - RNA, 21 nt, Human
agggugauauuaaccaggggc

SEQ ID NO: 2289117 - RNA, 17 nt, Human
agaacucccuuucaaca

SEQ ID NO: 2289118 - RNA, 18 nt, Human
ccuuccuaauuccacagc

SEQ ID NO: 2289119 - RNA, 22 nt, Human
aauuguauuuuaguaagagauu

SEQ ID NO: 2289120 - RNA, 14 nt, Human
cuaagucuuauaua

SEQ ID NO: 2289121 - RNA, 17 nt, Human
uucucuaggaaauauuu

SEQ ID NO: 2289122 - RNA, 21 nt, Human
cuccagcuggccgggagccug

SEQ ID NO: 2289123 - RNA, 14 nt, Human
ucuuuuuuuuaaua

SEQ ID NO: 2289124 - RNA, 13 nt, Human
aagacagugaaag

SEQ ID NO: 2289125 - RNA, 16 nt, Human
uugucaauaaaaucca

SEQ ID NO: 2289126 - RNA, 23 nt, Human
aaaauaucacuugucaauaaaau

SEQ ID NO: 2289127 - RNA, 12 nt, Human
agacagugaaag

SEQ ID NO: 2289128 - RNA, 16 nt, Human
caauaacgauaaaaga

SEQ ID NO: 2289129 - RNA, 18 nt, Human
cacuccagugagacagcu

SEQ ID NO: 2289130 - RNA, 15 nt, Human
cuuuucccaacucca

SEQ ID NO: 2289131 - RNA, 19 nt, Human
augaaguacucauacaugu

SEQ ID NO: 2289132 - RNA, 17 nt, Human
ccugagcuugcagagau

SEQ ID NO: 2289133 - RNA, 19 nt, Human
gcuuguauuccuuuuucuc

SEQ ID NO: 2289134 - RNA, 16 nt, Human
ugcuguauuuuaaaag

SEQ ID NO: 2289135 - RNA, 16 nt, Human
ucuuggucucaguguc

SEQ ID NO: 2289136 - RNA, 18 nt, Human
uucucuaggaaauauuua

SEQ ID NO: 2289137 - RNA, 18 nt, Human
gaauaauccuaaacauau

SEQ ID NO: 2289138 - RNA, 20 nt, Human
agcuuauugucuagugaaac

SEQ ID NO: 2289139 - RNA, 14 nt, Human
gaaugauuaugaau

SEQ ID NO: 2289140 - RNA, 23 nt, Human
uacaaaugggaaacaaaaggaua

SEQ ID NO: 2289141 - RNA, 19 nt, Human
gagccucagucucccuccc

SEQ ID NO: 2289142 - RNA, 13 nt, Human
caguuauuauauu

SEQ ID NO: 2289143 - RNA, 16 nt, Human
cuagaacucccuuuca

SEQ ID NO: 2289144 - RNA, 16 nt, Human
uuaauaauuuuuaauu

SEQ ID NO: 2289145 - RNA, 16 nt, Human
aguaagagauuccuga

SEQ ID NO: 2289146 - RNA, 16 nt, Human
gcuugccugcaggcau

SEQ ID NO: 2289147 - RNA, 15 nt, Human
ccuugccaugugcua

SEQ ID NO: 2289148 - RNA, 17 nt, Human
ucuuauaauuuaaaaua

SEQ ID NO: 2289149 - RNA, 14 nt, Human
aauaguuuaugauu

SEQ ID NO: 2289150 - RNA, 21 nt, Human
gccugaucaccugcccugcug

SEQ ID NO: 2289151 - RNA, 17 nt, Human
uccacaacacacagauu

SEQ ID NO: 2289152 - RNA, 13 nt, Human
uuauucacaagac

SEQ ID NO: 2289153 - RNA, 12 nt, Human
acacuuaaaaau

SEQ ID NO: 2289154 - RNA, 14 nt, Human
acuggacucaccuc

SEQ ID NO: 2289155 - RNA, 22 nt, Human
gaugcaguuguugcccacagcu

SEQ ID NO: 2289156 - RNA, 15 nt, Human
agaauaccacaggaa

SEQ ID NO: 2289157 - RNA, 21 nt, Human
ccucuguucugcacacagcac

SEQ ID NO: 2289158 - RNA, 23 nt, Human
acguaaucguguccccuauccua

SEQ ID NO: 2289159 - RNA, 15 nt, Human
gccucagucucccuc

SEQ ID NO: 2289160 - RNA, 23 nt, Human
ggccuccauccugaggcuccacu

SEQ ID NO: 2289161 - RNA, 19 nt, Human
ccauccugccccugagccc

SEQ ID NO: 2289162 - RNA, 16 nt, Human
acaugaacuuguaaag

SEQ ID NO: 2289163 - RNA, 13 nt, Human
gcuugccugcagg

SEQ ID NO: 2289164 - RNA, 15 nt, Human
auuauuuuuuaaaaa

SEQ ID NO: 2289165 - RNA, 17 nt, Human
cucguggaacaguuacc

SEQ ID NO: 2289166 - RNA, 20 nt, Human
auaagccagacaucaacaga

SEQ ID NO: 2289167 - RNA, 21 nt, Human
gaagugaaaaucuacacucca

SEQ ID NO: 2289168 - RNA, 18 nt, Human
acagcuucucauccugca

SEQ ID NO: 2289169 - RNA, 18 nt, Human
uacuuuauuuucuauaau

SEQ ID NO: 2289170 - RNA, 17 nt, Human
ccucagucucccucccu

SEQ ID NO: 2289171 - RNA, 15 nt, Human
ucacaggacagcccu

SEQ ID NO: 2289172 - RNA, 18 nt, Human
aaauaacgauaaaagaca

SEQ ID NO: 2289173 - RNA, 14 nt, Human
acagaauuuuaugc

SEQ ID NO: 2289174 - RNA, 19 nt, Human
acuggacucaccuccccca

SEQ ID NO: 2289175 - RNA, 20 nt, Human
auuacuguaagaaaauauca

SEQ ID NO: 2289176 - RNA, 13 nt, Human
auaacgauaaaag

SEQ ID NO: 2289177 - RNA, 19 nt, Human
caaggaugccccguccccc

SEQ ID NO: 2289178 - RNA, 18 nt, Human
ccacuuggucugugagau

SEQ ID NO: 2289179 - RNA, 17 nt, Human
gccaugggacagggagg

SEQ ID NO: 2289180 - RNA, 10 nt, Human
accugagccc

SEQ ID NO: 2289181 - RNA, 17 nt, Human
agguccacaacacacag

SEQ ID NO: 2289182 - RNA, 16 nt, Human
agggaggacgcucucu

SEQ ID NO: 2289183 - RNA, 17 nt, Human
uuaaauggucaauuuug

SEQ ID NO: 2289184 - RNA, 15 nt, Human
gcaagcucuaucacc

SEQ ID NO: 2289185 - RNA, 22 nt, Human
aaugggcacaggguuuauguuu

SEQ ID NO: 2289186 - RNA, 20 nt, Human
uggaauaauccuaaacauau

SEQ ID NO: 2289187 - RNA, 14 nt, Human
cuugagguaaaagc

SEQ ID NO: 2289188 - RNA, 14 nt, Human
auuugaaauuguau

SEQ ID NO: 2289189 - RNA, 19 nt, Human
uuugccaaguucuccacua

SEQ ID NO: 2289190 - RNA, 18 nt, Human
auguuaaaacugggacag

SEQ ID NO: 2289191 - RNA, 14 nt, Human
ugcuagaacucccu

SEQ ID NO: 2289192 - RNA, 18 nt, Human
aaaucuuauaauuuaaaa

SEQ ID NO: 2289193 - RNA, 20 nt, Human
uccaagccucauguccacug

SEQ ID NO: 2289194 - RNA, 16 nt, Human
uucacauuuaaauaaa

SEQ ID NO: 2289195 - RNA, 21 nt, Human
uccuacaagacacagugacca

SEQ ID NO: 2289196 - RNA, 20 nt, Human
uugauaaguacaugauaagc

SEQ ID NO: 2289197 - RNA, 17 nt, Human
accugagccccaaaagg

SEQ ID NO: 2289198 - RNA, 19 nt, Human
ugggacaggggagaaccua

SEQ ID NO: 2289199 - RNA, 20 nt, Human
gggaggcagagguugcagug

SEQ ID NO: 2289200 - RNA, 15 nt, Human
uuuagugaaauauua

SEQ ID NO: 2289201 - RNA, 19 nt, Human
uuuccugaaaacccuugcc

SEQ ID NO: 2289202 - RNA, 12 nt, Human
uuuuuuuuaaaa

SEQ ID NO: 2289203 - RNA, 14 nt, Human
uucagccugaaaga

SEQ ID NO: 2289204 - RNA, 17 nt, Human
cguaaucguguccccua

SEQ ID NO: 2289205 - RNA, 12 nt, Human
cuaagaagugaa

SEQ ID NO: 2289206 - RNA, 12 nt, Human
cuacaagacaca

SEQ ID NO: 2289207 - RNA, 14 nt, Human
uucuggaauaaucc

SEQ ID NO: 2289208 - RNA, 13 nt, Human
ccaggcugagccu

SEQ ID NO: 2289209 - RNA, 23 nt, Human
aguaauuggaaaggcagcucuaa

SEQ ID NO: 2289210 - RNA, 17 nt, Human
ccaaaaaucucaauauu

SEQ ID NO: 2289211 - RNA, 19 nt, Human
agagccuuuuuuugaaaaa

SEQ ID NO: 2289212 - RNA, 15 nt, Human
ggcagcuuuuucucu

SEQ ID NO: 2289213 - RNA, 16 nt, Human
aaugaaagcagggacu

SEQ ID NO: 2289214 - RNA, 17 nt, Human
agggcauagaaguaaaa

SEQ ID NO: 2289215 - RNA, 14 nt, Human
ugacacuuaaaaau

SEQ ID NO: 2289216 - RNA, 16 nt, Human
ggaugccccguccccc

SEQ ID NO: 2289217 - RNA, 19 nt, Human
uguauacugugugcuaaaa

SEQ ID NO: 2289218 - RNA, 12 nt, Human
aauuuuaaaaug

SEQ ID NO: 2289219 - RNA, 14 nt, Human
agguugcagugagc

SEQ ID NO: 2289220 - RNA, 13 nt, Human
auaacuggaaacu

SEQ ID NO: 2289221 - RNA, 17 nt, Human
gccugagcgacagugag

SEQ ID NO: 2289222 - RNA, 13 nt, Human
cucagaaaacaag

SEQ ID NO: 2289223 - RNA, 18 nt, Human
gccugagcgacagugaga

SEQ ID NO: 2289224 - RNA, 15 nt, Human
ugguuuagaaagcuu

SEQ ID NO: 2289225 - RNA, 19 nt, Human
cuuggggccuaugcagagg

SEQ ID NO: 2289226 - RNA, 22 nt, Human
caucucuucuggguuccuuccu

SEQ ID NO: 2289227 - RNA, 20 nt, Human
ccauuguggucacaggaagu

SEQ ID NO: 2289228 - RNA, 16 nt, Human
gugagacagcucugca

SEQ ID NO: 2289229 - RNA, 16 nt, Human
ugcaugguuuagaaag

SEQ ID NO: 2289230 - RNA, 22 nt, Human
auauaugcuaagucuuauauau

SEQ ID NO: 2289231 - RNA, 12 nt, Human
ggaggcugagau

SEQ ID NO: 2289232 - RNA, 15 nt, Human
auauuuuuuguuaaa

SEQ ID NO: 2289233 - RNA, 19 nt, Human
uggcaagcucuaucaccaa

SEQ ID NO: 2289234 - RNA, 12 nt, Human
cagaacagugau

SEQ ID NO: 2289235 - RNA, 14 nt, Human
aacgauaaaagaca

SEQ ID NO: 2289236 - RNA, 18 nt, Human
agucagucugaugagaac

SEQ ID NO: 2289237 - RNA, 19 nt, Human
uaucucauuuccaagcaag

SEQ ID NO: 2289238 - RNA, 15 nt, Human
acuuuauaaaggauu

SEQ ID NO: 2289239 - RNA, 19 nt, Human
auuuugugaagcaaaauuu

SEQ ID NO: 2289240 - RNA, 17 nt, Human
aaaguacaagagcuuaa

SEQ ID NO: 2289241 - RNA, 22 nt, Human
ugaauggcuaagcaaaauguga

SEQ ID NO: 2289242 - RNA, 20 nt, Human
gacauuugcucauggaauug

SEQ ID NO: 2289243 - RNA, 18 nt, Human
auuuaggccaugggacag

SEQ ID NO: 2289244 - RNA, 18 nt, Human
auggcuugaguuuaaauu

SEQ ID NO: 2289245 - RNA, 22 nt, Human
ccauuucuugagguaaaagcau

SEQ ID NO: 2289246 - RNA, 11 nt, Human
augggacaggg

SEQ ID NO: 2289247 - RNA, 13 nt, Human
ccaccugccuaua

SEQ ID NO: 2289248 - RNA, 14 nt, Human
caaggcuagaacca

SEQ ID NO: 2289249 - RNA, 21 nt, Human
cugagccucagucucccuccc

SEQ ID NO: 2289250 - RNA, 22 nt, Human
caagcucuaucaccaaggagcc

SEQ ID NO: 2289251 - RNA, 19 nt, Human
augcagagguccacaacac

SEQ ID NO: 2289252 - RNA, 18 nt, Human
uguggucacaggaaguag

SEQ ID NO: 2289253 - RNA, 19 nt, Human
cugagccucagucucccuc

SEQ ID NO: 2289254 - RNA, 16 nt, Human
uagcuacuaauuuuaa

SEQ ID NO: 2289255 - RNA, 16 nt, Human
ccccugcacuccagcc

SEQ ID NO: 2289256 - RNA, 16 nt, Human
acaugaaguccaagca

SEQ ID NO: 2289257 - RNA, 12 nt, Human
gaaaauaacaau

SEQ ID NO: 2289258 - RNA, 22 nt, Human
ucuacuaaaaauacaaaaaaaa

SEQ ID NO: 2289259 - RNA, 14 nt, Human
gucccaggcugagc

SEQ ID NO: 2289260 - RNA, 15 nt, Human
cagccagcacagccu

SEQ ID NO: 2289261 - RNA, 15 nt, Human
aacgauaaaagacag

SEQ ID NO: 2289262 - RNA, 14 nt, Human
guaacuaauuuuaa

SEQ ID NO: 2289263 - RNA, 21 nt, Human
aggcagcuuuuucucucccac

SEQ ID NO: 2289264 - RNA, 14 nt, Human
acacugaagaagca

SEQ ID NO: 2289265 - RNA, 18 nt, Human
gaugcaguucugaagaag

SEQ ID NO: 2289266 - RNA, 16 nt, Human
uucuauaauuuaaaua

SEQ ID NO: 2289267 - RNA, 19 nt, Human
augaguaacugauuuguaa

SEQ ID NO: 2289268 - RNA, 17 nt, Human
cccccugcaaagcccag

SEQ ID NO: 2289269 - RNA, 15 nt, Human
cugacucuuaagaag

SEQ ID NO: 2289270 - RNA, 16 nt, Human
ccuggugggcagagag

SEQ ID NO: 2289271 - RNA, 14 nt, Human
aucaccaaggcuga

SEQ ID NO: 2289272 - RNA, 16 nt, Human
uuuucucuaggaaaua

SEQ ID NO: 2289273 - RNA, 16 nt, Human
uccucacaccaggcuu

SEQ ID NO: 2289274 - RNA, 21 nt, Human
gcacuguggguagacacacau

SEQ ID NO: 2289275 - RNA, 23 nt, Human
gaaaaucuuauaauuuaaaauau

SEQ ID NO: 2289276 - RNA, 13 nt, Human
auuggacaguaaa

SEQ ID NO: 2289277 - RNA, 13 nt, Human
ccagcccuccuua

SEQ ID NO: 2289278 - RNA, 21 nt, Human
gaaaacaauaacgauaaaaga

SEQ ID NO: 2289279 - RNA, 14 nt, Human
ugagcucagcccug

SEQ ID NO: 2289280 - RNA, 22 nt, Human
gaugcaguucugaagaagaugg

SEQ ID NO: 2289281 - RNA, 18 nt, Human
ucaaggguacacugccuu

SEQ ID NO: 2289282 - RNA, 19 nt, Human
agaaaauaacgauaaaaga

SEQ ID NO: 2289283 - RNA, 12 nt, Human
uuuuauauuuga

SEQ ID NO: 2289284 - RNA, 16 nt, Human
accucugccucagaaa

SEQ ID NO: 2289285 - RNA, 16 nt, Human
ccugaucaccugcccu

SEQ ID NO: 2289286 - RNA, 14 nt, Human
aaauauaaauaaaa

SEQ ID NO: 2289287 - RNA, 14 nt, Human
auaaauaaaaauaa

SEQ ID NO: 2289288 - RNA, 17 nt, Human
gcaagcucuaucaccaa

SEQ ID NO: 2289289 - RNA, 14 nt, Human
acaaauccaaugaa

SEQ ID NO: 2289290 - RNA, 17 nt, Human
cagugaaagaaaauaac

SEQ ID NO: 2289291 - RNA, 14 nt, Human
cguguccccuaucc

SEQ ID NO: 2289292 - RNA, 16 nt, Human
uauccuacuuccccuu

SEQ ID NO: 2289293 - RNA, 17 nt, Human
auguugacaugggacau

SEQ ID NO: 2289294 - RNA, 22 nt, Human
cuuccuaauuccacagcugcuc

SEQ ID NO: 2289295 - RNA, 13 nt, Human
ccccagcccuccu

SEQ ID NO: 2289296 - RNA, 17 nt, Human
ccccaguuguuucuacu

SEQ ID NO: 2289297 - RNA, 14 nt, Human
cagugucaggagga

SEQ ID NO: 2289298 - RNA, 17 nt, Human
cuacacuccagugagac

SEQ ID NO: 2289299 - RNA, 15 nt, Human
cuacaagacacagug

SEQ ID NO: 2289300 - RNA, 22 nt, Human
uuaccucugccucagaaaacaa

SEQ ID NO: 2289301 - RNA, 22 nt, Human
aaacauccuacaagacacagug

SEQ ID NO: 2289302 - RNA, 18 nt, Human
auuuuuagugaaauauua

SEQ ID NO: 2289303 - RNA, 20 nt, Human
uaauaaguugcauagguuua

SEQ ID NO: 2289304 - RNA, 19 nt, Human
gacagucaccucauggaau

SEQ ID NO: 2289305 - RNA, 15 nt, Human
cucccuuggggccua

SEQ ID NO: 2289306 - RNA, 21 nt, Human
acagcccuucuuuccacagaa

SEQ ID NO: 2289307 - RNA, 16 nt, Human
caggcuugccugcagg

SEQ ID NO: 2289308 - RNA, 20 nt, Human
aacaagccuccuuuuaaagu

SEQ ID NO: 2289309 - RNA, 16 nt, Human
cucagcccuggugggc

SEQ ID NO: 2289310 - RNA, 18 nt, Human
cuuugagcgcccacuaga

SEQ ID NO: 2289311 - RNA, 22 nt, Human
ggcuaagcuucacuguaaaaua

SEQ ID NO: 2289312 - RNA, 14 nt, Human
aaaagaaagaaaau

SEQ ID NO: 2289313 - RNA, 19 nt, Human
guaguccuguaauggaagc

SEQ ID NO: 2289314 - RNA, 20 nt, Human
agcuacuaauuuuaaaaugu

SEQ ID NO: 2289315 - RNA, 16 nt, Human
augcuaagugaaauaa

SEQ ID NO: 2289316 - RNA, 22 nt, Human
uuguaacaagccuccuuuuaaa

SEQ ID NO: 2289317 - RNA, 14 nt, Human
cagauuugagcuca

SEQ ID NO: 2289318 - RNA, 22 nt, Human
acagauuugagcucagcccugg

SEQ ID NO: 2289319 - RNA, 23 nt, Human
ggucuaucuuugagcgcccacua

SEQ ID NO: 2289320 - RNA, 19 nt, Human
agcagcuuauucacaagac

SEQ ID NO: 2289321 - RNA, 23 nt, Human
ucuccauguacuggcaagaccug

SEQ ID NO: 2289322 - RNA, 18 nt, Human
aaggaugccccguccccc

SEQ ID NO: 2289323 - RNA, 14 nt, Human
uacuaauuuuaaaa

SEQ ID NO: 2289324 - RNA, 22 nt, Human
aggaugccccgucccccucugg

SEQ ID NO: 2289325 - RNA, 16 nt, Human
ucaccugggcugaggc

SEQ ID NO: 2289326 - RNA, 21 nt, Human
uuccuaauuccacagcugcuc

SEQ ID NO: 2289327 - RNA, 14 nt, Human
uaaauaguuuauga

SEQ ID NO: 2289328 - RNA, 16 nt, Human
cuuauaauuuaaaaua

SEQ ID NO: 2289329 - RNA, 14 nt, Human
ggacucaccucccc

SEQ ID NO: 2289330 - RNA, 18 nt, Human
ugaaaaaguucugcagau

SEQ ID NO: 2289331 - RNA, 12 nt, Human
caacccaaaugu

SEQ ID NO: 2289332 - RNA, 18 nt, Human
cugagccuugggaccccu

SEQ ID NO: 2289333 - RNA, 16 nt, Human
acaaauccaaugaaau

SEQ ID NO: 2289334 - RNA, 14 nt, Human
auuuauuuuaauaa

SEQ ID NO: 2289335 - RNA, 13 nt, Human
uggacgagaaaac

SEQ ID NO: 2289336 - RNA, 13 nt, Human
uuuagugaaauau

SEQ ID NO: 2289337 - RNA, 18 nt, Human
cuucucacauuuauauuu

SEQ ID NO: 2289338 - RNA, 23 nt, Human
ucaauaucuuuuuuuuaauaaac

SEQ ID NO: 2289339 - RNA, 16 nt, Human
acugauggguuucucc

SEQ ID NO: 2289340 - RNA, 22 nt, Human
cugaggcuccacuuggucugug

SEQ ID NO: 2289341 - RNA, 20 nt, Human
guuccuuccucugagccuug

SEQ ID NO: 2289342 - RNA, 17 nt, Human
ccacugcagaagacagu

SEQ ID NO: 2289343 - RNA, 15 nt, Human
aucuuauaauuuaaa

SEQ ID NO: 2289344 - RNA, 18 nt, Human
uuuuaaaaaagaaacauu

SEQ ID NO: 2289345 - RNA, 14 nt, Human
ccacuggacucacc

SEQ ID NO: 2289346 - RNA, 17 nt, Human
augcagagguccacaac

SEQ ID NO: 2289347 - RNA, 20 nt, Human
cugagccucagucucccucc

SEQ ID NO: 2289348 - RNA, 16 nt, Human
cugauggguuucucca

SEQ ID NO: 2289349 - RNA, 18 nt, Human
aucuuauaauuuaaaaua

SEQ ID NO: 2289350 - RNA, 15 nt, Human
uacaaaugcauuucu

SEQ ID NO: 2289351 - RNA, 19 nt, Human
cuuccuaauuccacagcug

SEQ ID NO: 2289352 - RNA, 14 nt, Human
cacuaaacaaagag

SEQ ID NO: 2289353 - RNA, 13 nt, Human
aacaagccuccuu

SEQ ID NO: 2289354 - RNA, 22 nt, Human
gaacuuuccacauucagagcuu

SEQ ID NO: 2289355 - RNA, 21 nt, Human
ccugaucaccugcccugcuga

SEQ ID NO: 2289356 - RNA, 17 nt, Human
aaauaacaauaaaagac

SEQ ID NO: 2289357 - RNA, 20 nt, Human
aagaugguaccaccagucug

SEQ ID NO: 2289358 - RNA, 22 nt, Human
gaauuucuucaacucccugccc

SEQ ID NO: 2289359 - RNA, 20 nt, Human
aauaucuuuuuuuuaauaaa

SEQ ID NO: 2289360 - RNA, 18 nt, Human
acaaaugggaaacaaaag

SEQ ID NO: 2289361 - RNA, 15 nt, Human
cccugccccccagcc

SEQ ID NO: 2289362 - RNA, 23 nt, Human
auuauauggcuugaguuuaaauu

SEQ ID NO: 2289363 - RNA, 22 nt, Human
auauaaauaaaaauaauccuca

SEQ ID NO: 2289364 - RNA, 14 nt, Human
acaagagcuuaaca

SEQ ID NO: 2289365 - RNA, 19 nt, Human
cucuguucugcacacagca

SEQ ID NO: 2289366 - RNA, 16 nt, Human
ggcagagagguaggga

SEQ ID NO: 2289367 - RNA, 14 nt, Human
gaaggcuuacaccc

SEQ ID NO: 2289368 - RNA, 18 nt, Human
cuucacuguaaaauaaua

SEQ ID NO: 2289369 - RNA, 18 nt, Human
auagucaaauugugugaa

SEQ ID NO: 2289370 - RNA, 19 nt, Human
ucaccaaggcugauuaaac

SEQ ID NO: 2289371 - RNA, 17 nt, Human
agucccaggcugagccu

SEQ ID NO: 2289372 - RNA, 21 nt, Human
auaugcucuaaacauguuuau

SEQ ID NO: 2289373 - RNA, 20 nt, Human
gaaaauaacaauaaaagaca

SEQ ID NO: 2289374 - RNA, 16 nt, Human
cugagcauuuaauaug

SEQ ID NO: 2289375 - RNA, 17 nt, Human
agcuucacuguaaaaua

SEQ ID NO: 2289376 - RNA, 19 nt, Human
gaaagaaaauaacaauaaa

SEQ ID NO: 2289377 - RNA, 17 nt, Human
caccucccccaucucuu

SEQ ID NO: 2289378 - RNA, 18 nt, Human
acugacucuuaagaagac

SEQ ID NO: 2289379 - RNA, 13 nt, Human
cugagagugaaca

SEQ ID NO: 2289380 - RNA, 16 nt, Human
caaaaggauaaugaau

SEQ ID NO: 2289381 - RNA, 21 nt, Human
aaugaauggcuaagcaaaaug

SEQ ID NO: 2289382 - RNA, 21 nt, Human
auuuguauaaaauaauuuuua

SEQ ID NO: 2289383 - RNA, 22 nt, Human
ugucucuacuaaaaauacaaaa

SEQ ID NO: 2289384 - RNA, 19 nt, Human
aaucuacacuccagugaga

SEQ ID NO: 2289385 - RNA, 15 nt, Human
auuucuaugaaauau

SEQ ID NO: 2289386 - RNA, 21 nt, Human
gccuuuucccaacuccagaaa

SEQ ID NO: 2289387 - RNA, 22 nt, Human
cuucagccugaaagaggaauga

SEQ ID NO: 2289388 - RNA, 17 nt, Human
gccuaagugcagccccg

SEQ ID NO: 2289389 - RNA, 12 nt, Human
aaggaugccccg

SEQ ID NO: 2289390 - RNA, 16 nt, Human
auccaaugaaaugagu

SEQ ID NO: 2289391 - RNA, 15 nt, Human
ggacucaccuccccc

SEQ ID NO: 2289392 - RNA, 12 nt, Human
auuuuaaaagaa

SEQ ID NO: 2289393 - RNA, 15 nt, Human
aagccuccuuuuaaa

SEQ ID NO: 2289394 - RNA, 22 nt, Human
auaacaaugcuguauuuuaaaa

SEQ ID NO: 2289395 - RNA, 16 nt, Human
gagaaacuggaacucu

SEQ ID NO: 2289396 - RNA, 22 nt, Human
gaauuaaguuuuuuuuuaaaaa

SEQ ID NO: 2289397 - RNA, 19 nt, Human
gucuuucacauuuaaauaa

SEQ ID NO: 2289398 - RNA, 14 nt, Human
uugacccacaagaa

SEQ ID NO: 2289399 - RNA, 15 nt, Human
ugcuucuguuuuaua

SEQ ID NO: 2289400 - RNA, 23 nt, Human
caaagcugaaauggacuuuugua

SEQ ID NO: 2289401 - RNA, 21 nt, Human
ccauccugccccugagcccau

SEQ ID NO: 2289402 - RNA, 15 nt, Human
augguuguauuauuu

SEQ ID NO: 2289403 - RNA, 14 nt, Human
gauuaguacacacu

SEQ ID NO: 2289404 - RNA, 17 nt, Human
ucucuggccuucggccu

SEQ ID NO: 2289405 - RNA, 16 nt, Human
uuucuauaauuuaaau

SEQ ID NO: 2289406 - RNA, 16 nt, Human
aaaaauuccaagugau

SEQ ID NO: 2289407 - RNA, 16 nt, Human
acuaaacaaagaguga

SEQ ID NO: 2289408 - RNA, 14 nt, Human
ugcuucuguuuuau

SEQ ID NO: 2289409 - RNA, 15 nt, Human
acucaccucccccau

SEQ ID NO: 2289410 - RNA, 20 nt, Human
aaagacagugaaagaaaaua

SEQ ID NO: 2289411 - RNA, 14 nt, Human
auccaaugaaauga

SEQ ID NO: 2289412 - RNA, 17 nt, Human
agugagacagcucugca

SEQ ID NO: 2289413 - RNA, 22 nt, Human
aaccuacacgagauacagaauu

SEQ ID NO: 2289414 - RNA, 16 nt, Human
ugaaauuguauuacaa

SEQ ID NO: 2289415 - RNA, 15 nt, Human
cuaagcaaaauguga

SEQ ID NO: 2289416 - RNA, 20 nt, Human
augcuucuguuuuauaauuu

SEQ ID NO: 2289417 - RNA, 15 nt, Human
ucccccaucucuucu

SEQ ID NO: 2289418 - RNA, 20 nt, Human
cacagcacgggggccaagga

SEQ ID NO: 2289419 - RNA, 14 nt, Human
ggcaauagucaaau

SEQ ID NO: 2289420 - RNA, 15 nt, Human
acagugaaagaaaau

SEQ ID NO: 2289421 - RNA, 20 nt, Human
agaagaacugaaaucauacu

SEQ ID NO: 2289422 - RNA, 16 nt, Human
uacaaaugggaaacaa

SEQ ID NO: 2289423 - RNA, 16 nt, Human
gucuaucuuugagcgc

SEQ ID NO: 2289424 - RNA, 20 nt, Human
uguaagaaaauaucacuugu

SEQ ID NO: 2289425 - RNA, 14 nt, Human
ggccgggagccuga

SEQ ID NO: 2289426 - RNA, 18 nt, Human
acauuugcucauggaauu

SEQ ID NO: 2289427 - RNA, 16 nt, Human
agugagacagcucugc

SEQ ID NO: 2289428 - RNA, 15 nt, Human
acaggguuuauguuu

SEQ ID NO: 2289429 - RNA, 15 nt, Human
acugaagaagcacca

SEQ ID NO: 2289430 - RNA, 17 nt, Human
aaagcagggacuugaac

SEQ ID NO: 2289431 - RNA, 15 nt, Human
auaauccuaaacaua

SEQ ID NO: 2289432 - RNA, 22 nt, Human
ggcauuuaggccaugggacagg

SEQ ID NO: 2289433 - RNA, 17 nt, Human
aaauccuacuuucauaa

SEQ ID NO: 2289434 - RNA, 23 nt, Human
gauauuaaccaggggccaugaau

SEQ ID NO: 2289435 - RNA, 20 nt, Human
caaacauccuacaagacaca

SEQ ID NO: 2289436 - RNA, 16 nt, Human
ugacaagcucacagac

SEQ ID NO: 2289437 - RNA, 21 nt, Human
ugcccauccugccccugagcc

SEQ ID NO: 2289438 - RNA, 11 nt, Human
caacucccugc

SEQ ID NO: 2289439 - RNA, 12 nt, Human
gaagaccucauu

SEQ ID NO: 2289440 - RNA, 23 nt, Human
uaggauggcuaguaucaaaagaa

SEQ ID NO: 2289441 - RNA, 20 nt, Human
acuucuuaggguuaugauua

SEQ ID NO: 2289442 - RNA, 11 nt, Human
uuauauuuauu

SEQ ID NO: 2289443 - RNA, 14 nt, Human
cuuggucugugaga

SEQ ID NO: 2289444 - RNA, 21 nt, Human
gaaagcagggacuugaaccca

SEQ ID NO: 2289445 - RNA, 18 nt, Human
cccaagccuggcaaggga

SEQ ID NO: 2289446 - RNA, 19 nt, Human
cccugcaaagcccagcuug

SEQ ID NO: 2289447 - RNA, 14 nt, Human
cuggaaaucagggu

SEQ ID NO: 2289448 - RNA, 21 nt, Human
auggcagcuuuccucaaaacu

SEQ ID NO: 2289449 - RNA, 12 nt, Human
cacaacacacag

SEQ ID NO: 2289450 - RNA, 14 nt, Human
uaaauaaaaauaau

SEQ ID NO: 2289451 - RNA, 15 nt, Human
cccugcaaagcccag

SEQ ID NO: 2289452 - RNA, 15 nt, Human
uauaauuuaaauaua

SEQ ID NO: 2289453 - RNA, 12 nt, Human
acaugagguacu

SEQ ID NO: 2289454 - RNA, 19 nt, Human
agcuacuaauuuuaaaaug

SEQ ID NO: 2289455 - RNA, 17 nt, Human
agcgacagugagacucu

SEQ ID NO: 2289456 - RNA, 17 nt, Human
ugcacaucaaaauaugc

SEQ ID NO: 2289457 - RNA, 13 nt, Human
cccuccuuaucaa

SEQ ID NO: 2289458 - RNA, 20 nt, Human
gaauucauucacucaacaaa

SEQ ID NO: 2289459 - RNA, 15 nt, Human
ugggacagggaggac

SEQ ID NO: 2289460 - RNA, 20 nt, Human
uaugaaaaggcuaagcuuca

SEQ ID NO: 2289461 - RNA, 16 nt, Human
ccuaugcagaggucca

SEQ ID NO: 2289462 - RNA, 19 nt, Human
acagugauuaccagggacu

SEQ ID NO: 2289463 - RNA, 15 nt, Human
uacaggauuugaaau

SEQ ID NO: 2289464 - RNA, 20 nt, Human
aauucuugccaaauauaaau

SEQ ID NO: 2289465 - RNA, 22 nt, Human
uuugaaacgaggauugggaaaa

SEQ ID NO: 2289466 - RNA, 20 nt, Human
accuuuugcuguggcaaaug

SEQ ID NO: 2289467 - RNA, 13 nt, Human
aggaaaaaauaac

SEQ ID NO: 2289468 - RNA, 16 nt, Human
ccugccccccagcccu

SEQ ID NO: 2289469 - RNA, 15 nt, Human
aaaauacaaaaaaaa

SEQ ID NO: 2289470 - RNA, 21 nt, Human
gacagucaccucauggaauug

SEQ ID NO: 2289471 - RNA, 16 nt, Human
cacuggacucaccucc

SEQ ID NO: 2289472 - RNA, 19 nt, Human
ccccuauccuacuuccccu

SEQ ID NO: 2289473 - RNA, 13 nt, Human
aaaauaacgauaa

SEQ ID NO: 2289474 - RNA, 13 nt, Human
uaacaauaaaaga

SEQ ID NO: 2289475 - RNA, 16 nt, Human
gacaaggaaaaaauaa

SEQ ID NO: 2289476 - RNA, 18 nt, Human
guuaguauuguccagguc

SEQ ID NO: 2289477 - RNA, 12 nt, Human
uuaauaaaccau

SEQ ID NO: 2289478 - RNA, 21 nt, Human
aaaagguauuuuaaucaccaa

SEQ ID NO: 2289479 - RNA, 12 nt, Human
ugagagacacac

SEQ ID NO: 2289480 - RNA, 19 nt, Human
agaaaauaacaauaaaaga

SEQ ID NO: 2289481 - RNA, 15 nt, Human
uauuuauuuuaauaa

SEQ ID NO: 2289482 - RNA, 20 nt, Human
acaugagguacugagaguga

SEQ ID NO: 2289483 - RNA, 11 nt, Human
aauuuaaauau

SEQ ID NO: 2289484 - RNA, 22 nt, Human
cacuuccaagagccuuuuuuug

SEQ ID NO: 2289485 - RNA, 15 nt, Human
uccuacaagacacag

SEQ ID NO: 2289486 - RNA, 16 nt, Human
aggguguguaaguaga

SEQ ID NO: 2289487 - RNA, 16 nt, Human
uauguucuaagaagug

SEQ ID NO: 2289488 - RNA, 23 nt, Human
aauaauccucaguuuuugugaaa

SEQ ID NO: 2289489 - RNA, 23 nt, Human
caccaaggagccaaacauccuac

SEQ ID NO: 2289490 - RNA, 17 nt, Human
uucugagcauuuaauau

SEQ ID NO: 2289491 - RNA, 15 nt, Human
uguuaaaugauuuca

SEQ ID NO: 2289492 - RNA, 14 nt, Human
ugcuaagucuuaua

SEQ ID NO: 2289493 - RNA, 21 nt, Human
auguuuacagauccccaagcc

SEQ ID NO: 2289494 - RNA, 17 nt, Human
ccaaggaugccccgucc

SEQ ID NO: 2289495 - RNA, 17 nt, Human
agcuacuaauuuuaaaa

SEQ ID NO: 2289496 - RNA, 13 nt, Human
acaagagcuuaac

SEQ ID NO: 2289497 - RNA, 20 nt, Human
uauuuauuacuguaagaaaa

SEQ ID NO: 2289498 - RNA, 15 nt, Human
gaagauguagaggag

SEQ ID NO: 2289499 - RNA, 14 nt, Human
cagucucccucccu

SEQ ID NO: 2289500 - RNA, 13 nt, Human
augaacuuuccac

SEQ ID NO: 2289501 - RNA, 19 nt, Human
agcucugcccauccugccc

SEQ ID NO: 2289502 - RNA, 23 nt, Human
ugaaaaucuuauaauuuaaaaua

SEQ ID NO: 2289503 - RNA, 14 nt, Human
uauuugaaauauug

SEQ ID NO: 2289504 - RNA, 15 nt, Human
cagucucccucccuu

SEQ ID NO: 2289505 - RNA, 22 nt, Human
aauaugccccauucaacaucua

SEQ ID NO: 2289506 - RNA, 17 nt, Human
acacuaagagagaauga

SEQ ID NO: 2289507 - RNA, 12 nt, Human
ucugcacacagc

SEQ ID NO: 2289508 - RNA, 15 nt, Human
uccagauccuggaaa

SEQ ID NO: 2289509 - RNA, 21 nt, Human
gaaauguuuacagauccccaa

SEQ ID NO: 2289510 - RNA, 15 nt, Human
aucaauuuaaaaaaa

SEQ ID NO: 2289511 - RNA, 22 nt, Human
accuaacgaaguauccuucagc

SEQ ID NO: 2289512 - RNA, 22 nt, Human
uggguuccuuccucugagccuu

SEQ ID NO: 2289513 - RNA, 23 nt, Human
cacagauuugagcucagcccugg

SEQ ID NO: 2289514 - RNA, 12 nt, Human
aauaaaguacaa

SEQ ID NO: 2289515 - RNA, 18 nt, Human
cagauuugagcucagccc

SEQ ID NO: 2289516 - RNA, 23 nt, Human
augucaauucuugccaaauauaa

SEQ ID NO: 2289517 - RNA, 21 nt, Human
acaugagguacugagagugaa

SEQ ID NO: 2289518 - RNA, 18 nt, Human
aaagagugaaggauuuau

SEQ ID NO: 2289519 - RNA, 18 nt, Human
uuuucucuccucucccca

SEQ ID NO: 2289520 - RNA, 18 nt, Human
gaacucugagcagugcuu

SEQ ID NO: 2289521 - RNA, 14 nt, Human
cucuggcuccagcu

SEQ ID NO: 2289522 - RNA, 21 nt, Human
cacuugaacccgggaggcaga

SEQ ID NO: 2289523 - RNA, 12 nt, Human
gguuuauauaag

SEQ ID NO: 2289524 - RNA, 21 nt, Human
ugaugcuacaggauuugaaau

SEQ ID NO: 2289525 - RNA, 18 nt, Human
cugcucaauaaaguacaa

SEQ ID NO: 2289526 - RNA, 22 nt, Human
aaauguugacaugggacauuug

SEQ ID NO: 2289527 - RNA, 20 nt, Human
uaaaagacaaggaaaaaaua

SEQ ID NO: 2289528 - RNA, 21 nt, Human
uuauguuuaauucugaaagca

SEQ ID NO: 2289529 - RNA, 13 nt, Human
gcuggagcucugc

SEQ ID NO: 2289530 - RNA, 16 nt, Human
cugaucaccugcccug

SEQ ID NO: 2289531 - RNA, 13 nt, Human
uauuuauuuuaau

SEQ ID NO: 2289532 - RNA, 18 nt, Human
cucauccugcaggcagcu

SEQ ID NO: 2289533 - RNA, 20 nt, Human
aauuaaguuuuuuuuuaaaa

SEQ ID NO: 2289534 - RNA, 18 nt, Human
gaagcaaaauuuuuucuc

SEQ ID NO: 2289535 - RNA, 20 nt, Human
accucauggaauuggagcuc

SEQ ID NO: 2289536 - RNA, 22 nt, Human
aaagacagugaaagaaaauaac

SEQ ID NO: 2289537 - RNA, 16 nt, Human
uucucuaggaaauauu

SEQ ID NO: 2289538 - RNA, 20 nt, Human
cuacuuccccuuccuaauuc

SEQ ID NO: 2289539 - RNA, 14 nt, Human
uuauuauauuuaca

SEQ ID NO: 2289540 - RNA, 24 nt, Human
uggccgggagccugaucaccugcc

SEQ ID NO: 2289541 - RNA, 21 nt, Human
cuuguuggacgagaaaacaau

SEQ ID NO: 2289542 - RNA, 21 nt, Human
gcaaaauuuuuucucuaggaa

SEQ ID NO: 2289543 - RNA, 21 nt, Human
uaguauuucuaugaaauauua

SEQ ID NO: 2289544 - RNA, 14 nt, Human
caugagucagucug

SEQ ID NO: 2289545 - RNA, 17 nt, Human
ucuauaauguguucauu

SEQ ID NO: 2289546 - RNA, 17 nt, Human
cuggagggaagccuugg

SEQ ID NO: 2289547 - RNA, 14 nt, Human
uaauccuaaacaua

SEQ ID NO: 2289548 - RNA, 16 nt, Human
cuuuaugcuaagugaa

SEQ ID NO: 2289549 - RNA, 20 nt, Human
ucuucuggguuccuuccucu

SEQ ID NO: 2289550 - RNA, 23 nt, Human
gucucccucccuuggggccuaug

SEQ ID NO: 2289551 - RNA, 21 nt, Human
aacuuguaaaggaauuuaaaa

SEQ ID NO: 2289552 - RNA, 20 nt, Human
uacaucccuuaccugggaaa

SEQ ID NO: 2289553 - RNA, 16 nt, Human
ugcuaagucuuauaua

SEQ ID NO: 2289554 - RNA, 18 nt, Human
agugucaaugcagccccc

SEQ ID NO: 2289555 - RNA, 20 nt, Human
uaagugaaauaagccagaca

SEQ ID NO: 2289556 - RNA, 19 nt, Human
augaaagcagggacuugaa

SEQ ID NO: 2289557 - RNA, 18 nt, Human
uauaacaaugcuguauuu

SEQ ID NO: 2289558 - RNA, 21 nt, Human
uaaaagacagugaaagaaaau

SEQ ID NO: 2289559 - RNA, 17 nt, Human
aagacaaggaaaaaaua

SEQ ID NO: 2289560 - RNA, 23 nt, Human
gggaaacaaaaggauaaugaaua

SEQ ID NO: 2289561 - RNA, 12 nt, Human
caggacagcccu

SEQ ID NO: 2289562 - RNA, 13 nt, Human
ggaaguagaggag

SEQ ID NO: 2289563 - RNA, 15 nt, Human
uuaauuuguaguguu

SEQ ID NO: 2289564 - RNA, 15 nt, Human
cacaggacagcccuu

SEQ ID NO: 2289565 - RNA, 15 nt, Human
ccucauguccacugg

SEQ ID NO: 2289566 - RNA, 22 nt, Human
cauuuaaauaaaguguuugaaa

SEQ ID NO: 2289567 - RNA, 17 nt, Human
ucagacauagaauuaac

SEQ ID NO: 2289568 - RNA, 13 nt, Human
uuuugcuguggca

SEQ ID NO: 2289569 - RNA, 22 nt, Human
gcacagccucuuagaugcaguu

SEQ ID NO: 2289570 - RNA, 12 nt, Human
cauuauauuuau

SEQ ID NO: 2289571 - RNA, 19 nt, Human
aaaauaacaauaaaagaca

SEQ ID NO: 2289572 - RNA, 16 nt, Human
ccuaagugcagccccg

SEQ ID NO: 2289573 - RNA, 20 nt, Human
acggacgaaccuugaaaacu

SEQ ID NO: 2289574 - RNA, 21 nt, Human
aauaauccucaguuuuuguga

SEQ ID NO: 2289575 - RNA, 12 nt, Human
cauagaaguaaa

SEQ ID NO: 2289576 - RNA, 16 nt, Human
auugucuagugaaacu

SEQ ID NO: 2289577 - RNA, 15 nt, Human
uacuaauuuuaaaau

SEQ ID NO: 2289578 - RNA, 15 nt, Human
agucugaugagaacu

SEQ ID NO: 2289579 - RNA, 17 nt, Human
gccccccagcccuccuu

SEQ ID NO: 2289580 - RNA, 18 nt, Human
aaaaucuuauaauuuaaa

SEQ ID NO: 2289581 - RNA, 14 nt, Human
auacaaaaaaaaaa

SEQ ID NO: 2289582 - RNA, 23 nt, Human
auuuuauagcuacuaauuuuaaa

SEQ ID NO: 2289583 - RNA, 13 nt, Human
gacaaggaaaaaa

SEQ ID NO: 2289584 - RNA, 16 nt, Human
ugagcucagcccuggu

SEQ ID NO: 2289585 - RNA, 19 nt, Human
uaucacuugucaauaaaau

SEQ ID NO: 2289586 - RNA, 13 nt, Human
cacuguaaaauaa

SEQ ID NO: 2289587 - RNA, 20 nt, Human
auuacauuuguauaaaauaa

SEQ ID NO: 2289588 - RNA, 14 nt, Human
uauguauauuuuau

SEQ ID NO: 2289589 - RNA, 19 nt, Human
aaacaauaacgauaaaaga

SEQ ID NO: 2289590 - RNA, 21 nt, Human
uuuguauaaaauaauuuuuau

SEQ ID NO: 2289591 - RNA, 14 nt, Human
cuaaacauaugaau

SEQ ID NO: 2289592 - RNA, 14 nt, Human
gagagugaacaaau

SEQ ID NO: 2289593 - RNA, 15 nt, Human
uaacgauaaaagaca

SEQ ID NO: 2289594 - RNA, 19 nt, Human
agucaaauugugugaaagg

SEQ ID NO: 2289595 - RNA, 22 nt, Human
aucucuucuggguuccuuccuc

SEQ ID NO: 2289596 - RNA, 16 nt, Human
cauuucuaaagccauu

SEQ ID NO: 2289597 - RNA, 20 nt, Human
cugauauuggacaguaaaau

SEQ ID NO: 2289598 - RNA, 13 nt, Human
gcucucuggccuu

SEQ ID NO: 2289599 - RNA, 23 nt, Human
agacagcuucucauccugcaggc

SEQ ID NO: 2289600 - RNA, 22 nt, Human
cugaggcauccuuccucacacc

SEQ ID NO: 2289601 - RNA, 12 nt, Human
gaauuggagcuc

SEQ ID NO: 2289602 - RNA, 20 nt, Human
gcagagaugaggccgccaug

SEQ ID NO: 2289603 - RNA, 15 nt, Human
ccugcaaagcccagc

SEQ ID NO: 2289604 - RNA, 19 nt, Human
auuuucaguuauuauauuu

SEQ ID NO: 2289605 - RNA, 23 nt, Human
uuuauaugcuucuguuuuauaau

SEQ ID NO: 2289606 - RNA, 12 nt, Human
ccccuugccaua

SEQ ID NO: 2289607 - RNA, 14 nt, Human
aagcaucacaugaa

SEQ ID NO: 2289608 - RNA, 16 nt, Human
auuccaccuacaugag

SEQ ID NO: 2289609 - RNA, 13 nt, Human
ucauccugcaggc

SEQ ID NO: 2289610 - RNA, 12 nt, Human
uauaauuuaaaa

SEQ ID NO: 2289611 - RNA, 19 nt, Human
uguaguguuggagaagaac

SEQ ID NO: 2289612 - RNA, 13 nt, Human
cugccuucucaac

SEQ ID NO: 2289613 - RNA, 19 nt, Human
auacuaauuauacccccug

SEQ ID NO: 2289614 - RNA, 14 nt, Human
agucugacuguuuc

SEQ ID NO: 2289615 - RNA, 15 nt, Human
gaccacugcagaaga

SEQ ID NO: 2289616 - RNA, 19 nt, Human
cagcuucucauccugcagg

SEQ ID NO: 2289617 - RNA, 17 nt, Human
gcaaauugucacaggac

SEQ ID NO: 2289618 - RNA, 22 nt, Human
uucaauaucuuuuuuuuaauaa

SEQ ID NO: 2289619 - RNA, 15 nt, Human
auauugacuuuuuau

SEQ ID NO: 2289620 - RNA, 16 nt, Human
ccucagucucccuccc

SEQ ID NO: 2289621 - RNA, 17 nt, Human
uaacgauaaaagacagu

SEQ ID NO: 2289622 - RNA, 16 nt, Human
uggcaagcucuaucac

SEQ ID NO: 2289623 - RNA, 18 nt, Human
guuucaaacauauauaac

SEQ ID NO: 2289624 - RNA, 22 nt, Human
agcccuccuuaucaaaggacac

SEQ ID NO: 2289625 - RNA, 21 nt, Human
uccauccugaggcuccacuug

SEQ ID NO: 2289626 - RNA, 18 nt, Human
gaccccugagcuugcaga

SEQ ID NO: 2289627 - RNA, 18 nt, Human
cuuuucccaacuccagaa

SEQ ID NO: 2289628 - RNA, 16 nt, Human
cuucggccuccauccu

SEQ ID NO: 2289629 - RNA, 14 nt, Human
auuuucuauaauuu

SEQ ID NO: 2289630 - RNA, 22 nt, Human
cugcucaauaaaguacaagagc

SEQ ID NO: 2289631 - RNA, 14 nt, Human
ccugccccccagcc

SEQ ID NO: 2289632 - RNA, 21 nt, Human
ugaacaaauuuacagagacag

SEQ ID NO: 2289633 - RNA, 15 nt, Human
uagggugauauuaac

SEQ ID NO: 2289634 - RNA, 15 nt, Human
gugaccacugcagaa

SEQ ID NO: 2289635 - RNA, 17 nt, Human
acuuccagauccuggaa

SEQ ID NO: 2289636 - RNA, 11 nt, Human
gccaugggaca

SEQ ID NO: 2289637 - RNA, 19 nt, Human
cagcuuuuucucucccacu

SEQ ID NO: 2289638 - RNA, 12 nt, Human
uucucuaggaaa

SEQ ID NO: 2289639 - RNA, 16 nt, Human
ugcacaucaaaauaug

SEQ ID NO: 2289640 - RNA, 19 nt, Human
auugaggacacugauaugg

SEQ ID NO: 2289641 - RNA, 21 nt, Human
aaacgaggauugggaaaaagu

SEQ ID NO: 2289642 - RNA, 14 nt, Human
ugaucaccugcccu

SEQ ID NO: 2289643 - RNA, 23 nt, Human
ucuagcaugucgucaaagcugaa

SEQ ID NO: 2289644 - RNA, 22 nt, Human
agacucgggauuaguacacacu

SEQ ID NO: 2289645 - RNA, 16 nt, Human
auacauguuacaacac

SEQ ID NO: 2289646 - RNA, 18 nt, Human
caagccucauguccacug

SEQ ID NO: 2289647 - RNA, 19 nt, Human
aaaaucuuauaauuuaaaa

SEQ ID NO: 2289648 - RNA, 20 nt, Human
gaaacauuugguaaggggaa

SEQ ID NO: 2289649 - RNA, 22 nt, Human
cauaaauguugacaugggacau

SEQ ID NO: 2289650 - RNA, 17 nt, Human
aauaugcucuaaacaug

SEQ ID NO: 2289651 - RNA, 15 nt, Human
aaagaaagaaaauca

SEQ ID NO: 2289652 - RNA, 19 nt, Human
cucacauuuauauuuuugu

SEQ ID NO: 2289653 - RNA, 12 nt, Human
cagauuuuccug

SEQ ID NO: 2289654 - RNA, 13 nt, Human
ugaaauuguauua

SEQ ID NO: 2289655 - RNA, 17 nt, Human
agagacagaaagcagaa

SEQ ID NO: 2289656 - RNA, 18 nt, Human
gagccucagucucccucc

SEQ ID NO: 2289657 - RNA, 21 nt, Human
auccccaagccuggcaaggga

SEQ ID NO: 2289658 - RNA, 21 nt, Human
cuaagcuucacuguaaaauaa

SEQ ID NO: 2289659 - RNA, 17 nt, Human
cugagcagugcuugaau

SEQ ID NO: 2289660 - RNA, 14 nt, Human
uugggaaaaaguaa

SEQ ID NO: 2289661 - RNA, 22 nt, Human
ggguuccuuccucugagccuug

SEQ ID NO: 2289662 - RNA, 20 nt, Human
agagacacacugaagaagca

SEQ ID NO: 2289663 - RNA, 15 nt, Human
caagcucacagaccu

SEQ ID NO: 2289664 - RNA, 15 nt, Human
agggcucacagaauu

SEQ ID NO: 2289665 - RNA, 19 nt, Human
auuaaguuuuuuuuuaaaa

SEQ ID NO: 2289666 - RNA, 14 nt, Human
auauuuauuuuaau

SEQ ID NO: 2289667 - RNA, 19 nt, Human
ggagccugaucaccugccc

SEQ ID NO: 2289668 - RNA, 20 nt, Human
gccgggcgugguggugagug

SEQ ID NO: 2289669 - RNA, 14 nt, Human
uugaaauuguauua

SEQ ID NO: 2289670 - RNA, 23 nt, Human
gcuuuggucuaucuuugagcgcc

SEQ ID NO: 2289671 - RNA, 19 nt, Human
cauggaauuggagcucgug

SEQ ID NO: 2289672 - RNA, 19 nt, Human
agacucgggauuaguacac

SEQ ID NO: 2289673 - RNA, 16 nt, Human
gccaugugcuaguaau

SEQ ID NO: 2289674 - RNA, 13 nt, Human
uuuaaaaaaaaac

SEQ ID NO: 2289675 - RNA, 19 nt, Human
agggaauugcagaguacug

SEQ ID NO: 2289676 - RNA, 21 nt, Human
aggguuaugauuaaguaauga

SEQ ID NO: 2289677 - RNA, 21 nt, Human
aaugugacuuaaugccacuaa

SEQ ID NO: 2289678 - RNA, 23 nt, Human
acgaggauugggaaaaaguaauu

SEQ ID NO: 2289679 - RNA, 16 nt, Human
ggcagcuuuuucucuc

SEQ ID NO: 2289680 - RNA, 21 nt, Human
ucuuaggguuaugauuaagua

SEQ ID NO: 2289681 - RNA, 18 nt, Human
acauuuauauuuuuguga

SEQ ID NO: 2289682 - RNA, 11 nt, Human
aaccugagccc

SEQ ID NO: 2289683 - RNA, 15 nt, Human
ggcaauagucaaauu

SEQ ID NO: 2289684 - RNA, 14 nt, Human
cuggccgggagccu

SEQ ID NO: 2289685 - RNA, 22 nt, Human
gucacaggaaguagaggaggcc

SEQ ID NO: 2289686 - RNA, 16 nt, Human
aaaagcaucacaugaa

SEQ ID NO: 2289687 - RNA, 17 nt, Human
ucucauccugcaggcag

SEQ ID NO: 2289688 - RNA, 20 nt, Human
uuaacacaugauccugcaau

SEQ ID NO: 2289689 - RNA, 19 nt, Human
ccccugagcuugcagagau

SEQ ID NO: 2289690 - RNA, 14 nt, Human
agucucccucccuu

SEQ ID NO: 2289691 - RNA, 19 nt, Human
guacaagagcuuaacagug

SEQ ID NO: 2289692 - RNA, 14 nt, Human
aaaacuucagacau

SEQ ID NO: 2289693 - RNA, 22 nt, Human
aauaauccuaaacauaugaauu

SEQ ID NO: 2289694 - RNA, 18 nt, Human
ccugcaaagcccagcuug

SEQ ID NO: 2289695 - RNA, 17 nt, Human
uuuccacauucagagcu

SEQ ID NO: 2289696 - RNA, 18 nt, Human
aacaaugcuguauuuuaa

SEQ ID NO: 2289697 - RNA, 17 nt, Human
uaauuccacagcugcuc

SEQ ID NO: 2289698 - RNA, 13 nt, Human
acuguaaaauaau

SEQ ID NO: 2289699 - RNA, 14 nt, Human
ugagaugcuagaac

SEQ ID NO: 2289700 - RNA, 18 nt, Human
uuuauggcacuaguauuu

SEQ ID NO: 2289701 - RNA, 13 nt, Human
aaauccuugaaga

SEQ ID NO: 2289702 - RNA, 23 nt, Human
aguacucauacauguuacaacac

SEQ ID NO: 2289703 - RNA, 19 nt, Human
guuguauuauuuuuuaaaa

SEQ ID NO: 2289704 - RNA, 16 nt, Human
acauuuauauuuuugu

SEQ ID NO: 2289705 - RNA, 18 nt, Human
uggagggaagccuugggg

SEQ ID NO: 2289706 - RNA, 20 nt, Human
ugagucccaggcugagccuc

SEQ ID NO: 2289707 - RNA, 21 nt, Human
aaaauuuuuucucuaggaaau

SEQ ID NO: 2289708 - RNA, 19 nt, Human
gguuccuuccucugagccu

SEQ ID NO: 2289709 - RNA, 14 nt, Human
aucaaaagaaagaa

SEQ ID NO: 2289710 - RNA, 12 nt, Human
aauuuaaauaua

SEQ ID NO: 2289711 - RNA, 17 nt, Human
uugccaaauauaaauaa

SEQ ID NO: 2289712 - RNA, 15 nt, Human
uaucaauuuaaaaaa

SEQ ID NO: 2289713 - RNA, 13 nt, Human
agaaaugaaagca

SEQ ID NO: 2289714 - RNA, 15 nt, Human
auuucauucaauauc

SEQ ID NO: 2289715 - RNA, 22 nt, Human
gugugaccacugcagaagacag

SEQ ID NO: 2289716 - RNA, 17 nt, Human
acccacuggacucaccu

SEQ ID NO: 2289717 - RNA, 15 nt, Human
cauuccaagccucau

SEQ ID NO: 2289718 - RNA, 20 nt, Human
cuaaaugucaaucagccuag

SEQ ID NO: 2289719 - RNA, 18 nt, Human
ugaacuugguuuuaauua

SEQ ID NO: 2289720 - RNA, 20 nt, Human
caagccuccuuuuaaaguaa

SEQ ID NO: 2289721 - RNA, 21 nt, Human
gaaaugaguuuuucuuuucau

SEQ ID NO: 2289722 - RNA, 16 nt, Human
aauugacccacaagaa

SEQ ID NO: 2289723 - RNA, 21 nt, Human
ugccuguaaucacagcuacuu

SEQ ID NO: 2289724 - RNA, 17 nt, Human
uaucaauuuaaaaaaaa

SEQ ID NO: 2289725 - RNA, 18 nt, Human
ucuucuggguuccuuccu

SEQ ID NO: 2289726 - RNA, 16 nt, Human
cugcugagucccaggc

SEQ ID NO: 2289727 - RNA, 18 nt, Human
agauccccaagccuggca

SEQ ID NO: 2289728 - RNA, 16 nt, Human
gcuucacuguaaaaua

SEQ ID NO: 2289729 - RNA, 16 nt, Human
uggggauagugaggca

SEQ ID NO: 2289730 - RNA, 23 nt, Human
auaauguguucauucuggaauaa

SEQ ID NO: 2289731 - RNA, 19 nt, Human
ccugccuaagugcagcccc

SEQ ID NO: 2289732 - RNA, 14 nt, Human
aaugauuaugaauu

SEQ ID NO: 2289733 - RNA, 15 nt, Human
gacaguauggcagcu

SEQ ID NO: 2289734 - RNA, 18 nt, Human
gcacuccagccugagcga

SEQ ID NO: 2289735 - RNA, 17 nt, Human
auuuucuauaauuuaaa

SEQ ID NO: 2289736 - RNA, 15 nt, Human
uucacuguaaaauaa

SEQ ID NO: 2289737 - RNA, 18 nt, Human
acugauggguuucuccag

SEQ ID NO: 2289738 - RNA, 14 nt, Human
guauuuuaaaagaa

SEQ ID NO: 2289739 - RNA, 19 nt, Human
cggccuccauccugaggcu

SEQ ID NO: 2289740 - RNA, 18 nt, Human
aggaaaaaauaacaauga

SEQ ID NO: 2289741 - RNA, 22 nt, Human
agaaagugacaagcucacagac

SEQ ID NO: 2289742 - RNA, 14 nt, Human
caaaugcauuucua

SEQ ID NO: 2289743 - RNA, 22 nt, Human
gagccucagucucccucccuug

SEQ ID NO: 2289744 - RNA, 16 nt, Human
agagguccacaacaca

SEQ ID NO: 2289745 - RNA, 11 nt, Human
cgauaaaagac

SEQ ID NO: 2289746 - RNA, 14 nt, Human
aaccugagccccaa

SEQ ID NO: 2289747 - RNA, 14 nt, Human
augggccauaugaa

SEQ ID NO: 2289748 - RNA, 17 nt, Human
ugaaggauuuauguuua

SEQ ID NO: 2289749 - RNA, 22 nt, Human
uggacgagaaaacaauaacgau

SEQ ID NO: 2289750 - RNA, 18 nt, Human
guauuauuuuuuaaaaaa

SEQ ID NO: 2289751 - RNA, 15 nt, Human
aaaaaagaaacauuu

SEQ ID NO: 2289752 - RNA, 16 nt, Human
ucaguuuuugugaaaa

SEQ ID NO: 2289753 - RNA, 20 nt, Human
ucacaugaacuuguaaagga

SEQ ID NO: 2289754 - RNA, 17 nt, Human
uccugccccugagccca

SEQ ID NO: 2289755 - RNA, 15 nt, Human
agccugaaagaggaa

SEQ ID NO: 2289756 - RNA, 21 nt, Human
accaccugccuauauuuuuug

SEQ ID NO: 2289757 - RNA, 15 nt, Human
cuuaagaagacugca

SEQ ID NO: 2289758 - RNA, 14 nt, Human
ugcucauggaauug

SEQ ID NO: 2289759 - RNA, 20 nt, Human
ugagagugaacaaauuuaca

SEQ ID NO: 2289760 - RNA, 13 nt, Human
cagucugaugaga

SEQ ID NO: 2289761 - RNA, 23 nt, Human
caacggggugaaacccugucucu

SEQ ID NO: 2289762 - RNA, 11 nt, Human
accauuuuuac

SEQ ID NO: 2289763 - RNA, 12 nt, Human
uauucacaagac

SEQ ID NO: 2289764 - RNA, 13 nt, Human
uuauguuuaauuc

SEQ ID NO: 2289765 - RNA, 17 nt, Yersinia pestis KIM
uuuuuguguuuuggcua

SEQ ID NO: 2289766 - RNA, 19 nt, Yersinia pestis KIM
uuuuugcauauaaaacacg

SEQ ID NO: 2289767 - RNA, 18 nt, Yersinia pestis KIM
uuuguagugaaugacagu

SEQ ID NO: 2289768 - RNA, 16 nt, Yersinia pestis KIM
uuuuaaugccaauuga

SEQ ID NO: 2289769 - RNA, 22 nt, Yersinia pestis KIM
uuuuacucaggauuagcuucug

SEQ ID NO: 2289770 - RNA, 14 nt, Yersinia pestis KIM
uuugccuauuucag

SEQ ID NO: 2289771 - RNA, 20 nt, Yersinia pestis KIM
uugucagcagucugaaaucu

SEQ ID NO: 2289772 - RNA, 20 nt, Yersinia pestis KIM
uugucagcagucugagggcc

SEQ ID NO: 2289773 - RNA, 15 nt, Yersinia pestis KIM
uugugcuacggcaaa

SEQ ID NO: 2289774 - RNA, 20 nt, Yersinia pestis KIM
uugugcuccugaugacucau

SEQ ID NO: 2289775 - RNA, 17 nt, Yersinia pestis KIM
uuggccugcacaucaau

SEQ ID NO: 2289776 - RNA, 15 nt, Yersinia pestis KIM
uuuauaagcguuauu

SEQ ID NO: 2289777 - RNA, 23 nt, Yersinia pestis KIM
uuuauuacuacaaacgcguuaau

SEQ ID NO: 2289778 - RNA, 13 nt, Yersinia pestis KIM
uuuagcgaugacc

SEQ ID NO: 2289779 - RNA, 14 nt, Yersinia pestis KIM
uuuaagauccaguu

SEQ ID NO: 2289780 - RNA, 17 nt, Yersinia pestis KIM
uuuaagcugucuaaauu

SEQ ID NO: 2289781 - RNA, 17 nt, Yersinia pestis KIM
uuucagugucaguucga

SEQ ID NO: 2289782 - RNA, 20 nt, Yersinia pestis KIM
uuucauugauucaucaacug

SEQ ID NO: 2289783 - RNA, 21 nt, Yersinia pestis KIM
uuuccgucagcccaacgucau

SEQ ID NO: 2289784 - RNA, 16 nt, Yersinia pestis KIM
uugcccugcaauaccg

SEQ ID NO: 2289785 - RNA, 16 nt, Yersinia pestis KIM
uugccgcgucuguuau

SEQ ID NO: 2289786 - RNA, 14 nt, Yersinia pestis KIM
uugccgugcaaucu

SEQ ID NO: 2289787 - RNA, 15 nt, Yersinia pestis KIM
uugcucaauaccauu

SEQ ID NO: 2289788 - RNA, 18 nt, Yersinia pestis KIM
uugcucagauacaucaau

SEQ ID NO: 2289789 - RNA, 23 nt, Yersinia pestis KIM
uugcucagauacaucaauggguu

SEQ ID NO: 2289790 - RNA, 12 nt, Yersinia pestis KIM
uugcugcaaccg

SEQ ID NO: 2289791 - RNA, 14 nt, Yersinia pestis KIM
uugcuggcuaucau

SEQ ID NO: 2289792 - RNA, 17 nt, Yersinia pestis KIM
uugcuuuaaauaacgca

SEQ ID NO: 2289793 - RNA, 18 nt, Yersinia pestis KIM
uugagacccccaaugagu

SEQ ID NO: 2289794 - RNA, 17 nt, Yersinia pestis KIM
uugacuuaacaguuaaa

SEQ ID NO: 2289795 - RNA, 19 nt, Yersinia pestis KIM
uugaccguguuuucacaca

SEQ ID NO: 2289796 - RNA, 15 nt, Yersinia pestis KIM
uugaagcagauaaag

SEQ ID NO: 2289797 - RNA, 22 nt, Yersinia pestis KIM
uugcacaaagcuuacuguucac

SEQ ID NO: 2289798 - RNA, 15 nt, Yersinia pestis KIM
uugcaccuuugcgag

SEQ ID NO: 2289799 - RNA, 13 nt, Yersinia pestis KIM
uugccaccagcgu

SEQ ID NO: 2289800 - RNA, 15 nt, Yersinia pestis KIM
uugcccccaucacua

SEQ ID NO: 2289801 - RNA, 14 nt, Yersinia pestis KIM
uugcccggcugaua

SEQ ID NO: 2289802 - RNA, 20 nt, Yersinia pestis KIM
uugauggcugucuauugauu

SEQ ID NO: 2289803 - RNA, 16 nt, Yersinia pestis KIM
uugauuugaacgacau

SEQ ID NO: 2289804 - RNA, 14 nt, Yersinia pestis KIM
uugaugaaguuauu

SEQ ID NO: 2289805 - RNA, 13 nt, Yersinia pestis KIM
uugaugaucgcag

SEQ ID NO: 2289806 - RNA, 23 nt, Yersinia pestis KIM
uugauccaaauggcugcguucuu

SEQ ID NO: 2289807 - RNA, 19 nt, Yersinia pestis KIM
uugagugccgugucuucca

SEQ ID NO: 2289808 - RNA, 17 nt, Yersinia pestis KIM
uggccgacauuauguuc

SEQ ID NO: 2289809 - RNA, 21 nt, Yersinia pestis KIM
uggcguuacagcaaggcagca

SEQ ID NO: 2289810 - RNA, 18 nt, Yersinia pestis KIM
uggcugcacucauugccu

SEQ ID NO: 2289811 - RNA, 18 nt, Yersinia pestis KIM
uggguucaucaacugaca

SEQ ID NO: 2289812 - RNA, 13 nt, Yersinia pestis KIM
ugggugugaacag

SEQ ID NO: 2289813 - RNA, 16 nt, Yersinia pestis KIM
uggccauggaaaccgg

SEQ ID NO: 2289814 - RNA, 18 nt, Yersinia pestis KIM
uggcagcggcaaauagag

SEQ ID NO: 2289815 - RNA, 18 nt, Yersinia pestis KIM
uggcauguucacaucggu

SEQ ID NO: 2289816 - RNA, 19 nt, Yersinia pestis KIM
uggcaucaauauaacgccc

SEQ ID NO: 2289817 - RNA, 16 nt, Yersinia pestis KIM
uggccacagaguggcg

SEQ ID NO: 2289818 - RNA, 20 nt, Yersinia pestis KIM
uggauauuuuccgggucaaa

SEQ ID NO: 2289819 - RNA, 21 nt, Yersinia pestis KIM
uggauaauuugccuggcgaau

SEQ ID NO: 2289820 - RNA, 22 nt, Yersinia pestis KIM
uggauccagcaccacaauggca

SEQ ID NO: 2289821 - RNA, 13 nt, Yersinia pestis KIM
uggaacgugacau

SEQ ID NO: 2289822 - RNA, 15 nt, Yersinia pestis KIM
ugucaguaugaaauu

SEQ ID NO: 2289823 - RNA, 18 nt, Yersinia pestis KIM
uguccacugaccagcggu

SEQ ID NO: 2289824 - RNA, 14 nt, Yersinia pestis KIM
ugucagagauaaac

SEQ ID NO: 2289825 - RNA, 21 nt, Yersinia pestis KIM
uguaccgguucauuuagcagc

SEQ ID NO: 2289826 - RNA, 14 nt, Yersinia pestis KIM
ugguuggcuaucaa

SEQ ID NO: 2289827 - RNA, 12 nt, Yersinia pestis KIM
ugguuucaaacu

SEQ ID NO: 2289828 - RNA, 19 nt, Yersinia pestis KIM
ugguacgacgccagauagc

SEQ ID NO: 2289829 - RNA, 21 nt, Yersinia pestis KIM
ugguaccuuucagguaagcag

SEQ ID NO: 2289830 - RNA, 14 nt, Yersinia pestis KIM
uguuacugaccgug

SEQ ID NO: 2289831 - RNA, 23 nt, Yersinia pestis KIM
uguuacagcaaggcagcaagcaa

SEQ ID NO: 2289832 - RNA, 14 nt, Yersinia pestis KIM
ugugugguauucac

SEQ ID NO: 2289833 - RNA, 17 nt, Yersinia pestis KIM
uguugauacuccauuug

SEQ ID NO: 2289834 - RNA, 15 nt, Yersinia pestis KIM
uguugcaugaaauca

SEQ ID NO: 2289835 - RNA, 15 nt, Yersinia pestis KIM
uguucggcaaugggu

SEQ ID NO: 2289836 - RNA, 14 nt, Yersinia pestis KIM
ugugggcuggugcg

SEQ ID NO: 2289837 - RNA, 18 nt, Yersinia pestis KIM
ugugauaaccguucaaga

SEQ ID NO: 2289838 - RNA, 20 nt, Yersinia pestis KIM
ugugauuuccaucuagcuca

SEQ ID NO: 2289839 - RNA, 22 nt, Yersinia pestis KIM
uucaucaauagguguugccggc

SEQ ID NO: 2289840 - RNA, 15 nt, Yersinia pestis KIM
uucaucauuauuaug

SEQ ID NO: 2289841 - RNA, 22 nt, Yersinia pestis KIM
uucaucagggcagcaucgucaa

SEQ ID NO: 2289842 - RNA, 21 nt, Yersinia pestis KIM
uuccacgcccaacucuuuagc

SEQ ID NO: 2289843 - RNA, 13 nt, Yersinia pestis KIM
uucaggguacugu

SEQ ID NO: 2289844 - RNA, 20 nt, Yersinia pestis KIM
uucaggccuuuacuguuaau

SEQ ID NO: 2289845 - RNA, 23 nt, Yersinia pestis KIM
uucacuguggcggccagugcggu

SEQ ID NO: 2289846 - RNA, 12 nt, Yersinia pestis KIM
uucacugaacca

SEQ ID NO: 2289847 - RNA, 22 nt, Yersinia pestis KIM
uucacuucuggggucaucaacg

SEQ ID NO: 2289848 - RNA, 14 nt, Yersinia pestis KIM
uucauaaaccugau

SEQ ID NO: 2289849 - RNA, 21 nt, Yersinia pestis KIM
uucacacgcccaggccauagc

SEQ ID NO: 2289850 - RNA, 14 nt, Yersinia pestis KIM
uucacccaggcugu

SEQ ID NO: 2289851 - RNA, 22 nt, Yersinia pestis KIM
uucacuggccuauuaagauaau

SEQ ID NO: 2289852 - RNA, 19 nt, Yersinia pestis KIM
uucaacucuacauugacua

SEQ ID NO: 2289853 - RNA, 18 nt, Yersinia pestis KIM
uucaacgccaauaccggu

SEQ ID NO: 2289854 - RNA, 19 nt, Yersinia pestis KIM
uuauguaacaacugaacca

SEQ ID NO: 2289855 - RNA, 14 nt, Yersinia pestis KIM
uuauguuaaaucag

SEQ ID NO: 2289856 - RNA, 17 nt, Yersinia pestis KIM
uuaugccccucacccgu

SEQ ID NO: 2289857 - RNA, 19 nt, Yersinia pestis KIM
uguuugagaacaguucgau

SEQ ID NO: 2289858 - RNA, 16 nt, Yersinia pestis KIM
uguuuuaaaugccaac

SEQ ID NO: 2289859 - RNA, 12 nt, Yersinia pestis KIM
uguuuuaaucgg

SEQ ID NO: 2289860 - RNA, 16 nt, Yersinia pestis KIM
uuaacaccccuucagc

SEQ ID NO: 2289861 - RNA, 16 nt, Yersinia pestis KIM
uuaaucuuuaauucau

SEQ ID NO: 2289862 - RNA, 22 nt, Yersinia pestis KIM
uuaaucgccguggugccaucgc

SEQ ID NO: 2289863 - RNA, 17 nt, Yersinia pestis KIM
uuaaugagucaaugaga

SEQ ID NO: 2289864 - RNA, 21 nt, Yersinia pestis KIM
uuaacccauauuacucacaca

SEQ ID NO: 2289865 - RNA, 14 nt, Yersinia pestis KIM
uuaacuuauugauu

SEQ ID NO: 2289866 - RNA, 12 nt, Yersinia pestis KIM
uuaacuguuaaa

SEQ ID NO: 2289867 - RNA, 16 nt, Yersinia pestis KIM
uuaucuaucuguucac

SEQ ID NO: 2289868 - RNA, 20 nt, Yersinia pestis KIM
uuaucucuuacauaaagacc

SEQ ID NO: 2289869 - RNA, 22 nt, Yersinia pestis KIM
uuaucuguuguauacuguuuau

SEQ ID NO: 2289870 - RNA, 21 nt, Yersinia pestis KIM
uuaucuagcguccauguaucc

SEQ ID NO: 2289871 - RNA, 19 nt, Yersinia pestis KIM
uuaucaaauacgaccguca

SEQ ID NO: 2289872 - RNA, 14 nt, Yersinia pestis KIM
uuacugucauugcu

SEQ ID NO: 2289873 - RNA, 13 nt, Yersinia pestis KIM
uuacugccacuga

SEQ ID NO: 2289874 - RNA, 20 nt, Yersinia pestis KIM
uuaccgcgcuugcaucaacu

SEQ ID NO: 2289875 - RNA, 12 nt, Yersinia pestis KIM
uuacuugguuac

SEQ ID NO: 2289876 - RNA, 17 nt, Yersinia pestis KIM
uuagcuggcugaacgcu

SEQ ID NO: 2289877 - RNA, 17 nt, Yersinia pestis KIM
guugucuauguuugaug

SEQ ID NO: 2289878 - RNA, 13 nt, Yersinia pestis KIM
guuguuggcgaag

SEQ ID NO: 2289879 - RNA, 11 nt, Yersinia pestis KIM
guuggcuuuaa

SEQ ID NO: 2289880 - RNA, 11 nt, Yersinia pestis KIM
guucugcgccc

SEQ ID NO: 2289881 - RNA, 15 nt, Yersinia pestis KIM
guucuuggaacaggc

SEQ ID NO: 2289882 - RNA, 18 nt, Yersinia pestis KIM
guucccuuaugguuauca

SEQ ID NO: 2289883 - RNA, 14 nt, Yersinia pestis KIM
guucgagcggcaua

SEQ ID NO: 2289884 - RNA, 18 nt, Yersinia pestis KIM
guucacggaaaguagcca

SEQ ID NO: 2289885 - RNA, 13 nt, Yersinia pestis KIM
guucagcaccagu

SEQ ID NO: 2289886 - RNA, 15 nt, Yersinia pestis KIM
guuccaguggucauc

SEQ ID NO: 2289887 - RNA, 21 nt, Yersinia pestis KIM
guucaucaugcucauguugca

SEQ ID NO: 2289888 - RNA, 19 nt, Yersinia pestis KIM
guuaauuaagauuaagcca

SEQ ID NO: 2289889 - RNA, 21 nt, Yersinia pestis KIM
guuaccauggcaggucucgca

SEQ ID NO: 2289890 - RNA, 22 nt, Yersinia pestis KIM
guuacacacauagguacccgca

SEQ ID NO: 2289891 - RNA, 20 nt, Yersinia pestis KIM
guuauaaccaugaugacaau

SEQ ID NO: 2289892 - RNA, 23 nt, Yersinia pestis KIM
guuacugaccgugcagggcgaua

SEQ ID NO: 2289893 - RNA, 15 nt, Yersinia pestis KIM
guuaucacagcaaau

SEQ ID NO: 2289894 - RNA, 17 nt, Yersinia pestis KIM
guuauuacugucacugu

SEQ ID NO: 2289895 - RNA, 13 nt, Yersinia pestis KIM
guuaucugcuauu

SEQ ID NO: 2289896 - RNA, 13 nt, Yersinia pestis KIM
guucaagaaccga

SEQ ID NO: 2289897 - RNA, 20 nt, Yersinia pestis KIM
guucaaccuuuuccgccaug

SEQ ID NO: 2289898 - RNA, 20 nt, Yersinia pestis KIM
gugucaguucgacaccuuca

SEQ ID NO: 2289899 - RNA, 20 nt, Yersinia pestis KIM
gugucacaaucucuggcaac

SEQ ID NO: 2289900 - RNA, 14 nt, Yersinia pestis KIM
gugguuaacagcgu

SEQ ID NO: 2289901 - RNA, 15 nt, Yersinia pestis KIM
guguaaaugcccguc

SEQ ID NO: 2289902 - RNA, 16 nt, Yersinia pestis KIM
guuaaugagcguuauu

SEQ ID NO: 2289903 - RNA, 15 nt, Yersinia pestis KIM
guuaacgacgcauua

SEQ ID NO: 2289904 - RNA, 17 nt, Yersinia pestis KIM
gugugcgcaucagccag

SEQ ID NO: 2289905 - RNA, 20 nt, Yersinia pestis KIM
gugugaccgcugaaguggcc

SEQ ID NO: 2289906 - RNA, 12 nt, Yersinia pestis KIM
uacgcaggcggu

SEQ ID NO: 2289907 - RNA, 11 nt, Yersinia pestis KIM
uacgccagcag

SEQ ID NO: 2289908 - RNA, 16 nt, Yersinia pestis KIM
uacgcccgccccagca

SEQ ID NO: 2289909 - RNA, 13 nt, Yersinia pestis KIM
uacgauaacgcuc

SEQ ID NO: 2289910 - RNA, 13 nt, Yersinia pestis KIM
uaccgccaagcgc

SEQ ID NO: 2289911 - RNA, 23 nt, Yersinia pestis KIM
uaccgcaaccaccuuuaccaugc

SEQ ID NO: 2289912 - RNA, 19 nt, Yersinia pestis KIM
uaccgaucaucaggcaggu

SEQ ID NO: 2289913 - RNA, 22 nt, Yersinia pestis KIM
uaccgauaugcccuguagaagu

SEQ ID NO: 2289914 - RNA, 18 nt, Yersinia pestis KIM
uacaguagugaagauaau

SEQ ID NO: 2289915 - RNA, 21 nt, Yersinia pestis KIM
uacagguguugaguaacgcca

SEQ ID NO: 2289916 - RNA, 16 nt, Yersinia pestis KIM
uacagucuagugcgcu

SEQ ID NO: 2289917 - RNA, 18 nt, Yersinia pestis KIM
uaccaauuucauacaggc

SEQ ID NO: 2289918 - RNA, 17 nt, Yersinia pestis KIM
uaccaacccgauaccga

SEQ ID NO: 2289919 - RNA, 20 nt, Yersinia pestis KIM
uaccaaccgcuuuaucgcca

SEQ ID NO: 2289920 - RNA, 20 nt, Yersinia pestis KIM
uacccaaaauaauucgaguu

SEQ ID NO: 2289921 - RNA, 15 nt, Yersinia pestis KIM
uacccaaagucauug

SEQ ID NO: 2289922 - RNA, 12 nt, Yersinia pestis KIM
uagccaugucau

SEQ ID NO: 2289923 - RNA, 17 nt, Yersinia pestis KIM
uagccccaaaugccagc

SEQ ID NO: 2289924 - RNA, 16 nt, Yersinia pestis KIM
uagauagaaaucacug

SEQ ID NO: 2289925 - RNA, 15 nt, Yersinia pestis KIM
uagcaaccgcugcag

SEQ ID NO: 2289926 - RNA, 19 nt, Yersinia pestis KIM
uagaguucguguugugcca

SEQ ID NO: 2289927 - RNA, 19 nt, Yersinia pestis KIM
uagccaaaauaauuaccgu

SEQ ID NO: 2289928 - RNA, 23 nt, Yersinia pestis KIM
uagagcaaagucccggcuaggag

SEQ ID NO: 2289929 - RNA, 19 nt, Yersinia pestis KIM
uagagcacgcgacucauaa

SEQ ID NO: 2289930 - RNA, 17 nt, Yersinia pestis KIM
uagaauagaaccggaau

SEQ ID NO: 2289931 - RNA, 21 nt, Yersinia pestis KIM
uagaauguguaguugaaguuc

SEQ ID NO: 2289932 - RNA, 16 nt, Yersinia pestis KIM
uacuuucggguaucug

SEQ ID NO: 2289933 - RNA, 14 nt, Yersinia pestis KIM
uacuucuuacggug

SEQ ID NO: 2289934 - RNA, 16 nt, Yersinia pestis KIM
uacugcgguuaaucgg

SEQ ID NO: 2289935 - RNA, 15 nt, Yersinia pestis KIM
uaaucggauggucau

SEQ ID NO: 2289936 - RNA, 19 nt, Yersinia pestis KIM
uaaugaaaucuaaguucag

SEQ ID NO: 2289937 - RNA, 14 nt, Yersinia pestis KIM
uaaugacgcccgca

SEQ ID NO: 2289938 - RNA, 15 nt, Yersinia pestis KIM
uaaugacauaaucag

SEQ ID NO: 2289939 - RNA, 18 nt, Yersinia pestis KIM
uaaugagccgcauugauc

SEQ ID NO: 2289940 - RNA, 17 nt, Yersinia pestis KIM
uaaugagaaucaaucaa

SEQ ID NO: 2289941 - RNA, 23 nt, Yersinia pestis KIM
uaaucccccgcgccgacugcuga

SEQ ID NO: 2289942 - RNA, 21 nt, Yersinia pestis KIM
uaauccgaccaccacugcauc

SEQ ID NO: 2289943 - RNA, 23 nt, Yersinia pestis KIM
uaaucgccguggugccaucgcuu

SEQ ID NO: 2289944 - RNA, 17 nt, Yersinia pestis KIM
uaauagguuggcauuag

SEQ ID NO: 2289945 - RNA, 14 nt, Yersinia pestis KIM
uaauaucaaugaug

SEQ ID NO: 2289946 - RNA, 21 nt, Yersinia pestis KIM
uaagccgcagaugccagacuu

SEQ ID NO: 2289947 - RNA, 23 nt, Yersinia pestis KIM
uaagccaugggucauuaauuaag

SEQ ID NO: 2289948 - RNA, 15 nt, Yersinia pestis KIM
uaaguugaugcagua

SEQ ID NO: 2289949 - RNA, 16 nt, Yersinia pestis KIM
uaagugucaauaacag

SEQ ID NO: 2289950 - RNA, 18 nt, Yersinia pestis KIM
uaagugaauuaauaacag

SEQ ID NO: 2289951 - RNA, 20 nt, Yersinia pestis KIM
uacagccggauaggcuuaau

SEQ ID NO: 2289952 - RNA, 19 nt, Yersinia pestis KIM
uacacccgaaggccauugc

SEQ ID NO: 2289953 - RNA, 16 nt, Yersinia pestis KIM
uacaccaauaaucggg

SEQ ID NO: 2289954 - RNA, 16 nt, Yersinia pestis KIM
uacacaugaaaaucaa

SEQ ID NO: 2289955 - RNA, 17 nt, Yersinia pestis KIM
uaauuaauucaaucggc

SEQ ID NO: 2289956 - RNA, 16 nt, Yersinia pestis KIM
uaaugcaccuguuaaa

SEQ ID NO: 2289957 - RNA, 16 nt, Yersinia pestis KIM
uaauugaagauuuaaa

SEQ ID NO: 2289958 - RNA, 13 nt, Yersinia pestis KIM
uaauuucuugaug

SEQ ID NO: 2289959 - RNA, 17 nt, Yersinia pestis KIM
uaacaacgacuccauca

SEQ ID NO: 2289960 - RNA, 15 nt, Yersinia pestis KIM
uaaaugauugcuaua

SEQ ID NO: 2289961 - RNA, 14 nt, Yersinia pestis KIM
uaaauaaaauagcg

SEQ ID NO: 2289962 - RNA, 23 nt, Yersinia pestis KIM
uaaauacagcaccauucaaugua

SEQ ID NO: 2289963 - RNA, 20 nt, Yersinia pestis KIM
uaaauacgguucaaaucagu

SEQ ID NO: 2289964 - RNA, 14 nt, Yersinia pestis KIM
uaaauagauaucga

SEQ ID NO: 2289965 - RNA, 13 nt, Yersinia pestis KIM
uaaaucgggcaaa

SEQ ID NO: 2289966 - RNA, 12 nt, Yersinia pestis KIM
uaaaucgcccaa

SEQ ID NO: 2289967 - RNA, 18 nt, Yersinia pestis KIM
uaacgccggcgccauugc

SEQ ID NO: 2289968 - RNA, 16 nt, Yersinia pestis KIM
uaacucaaguaugcag

SEQ ID NO: 2289969 - RNA, 15 nt, Yersinia pestis KIM
uaacuaaagccgauu

SEQ ID NO: 2289970 - RNA, 17 nt, Yersinia pestis KIM
uaacgacgcauuaaucc

SEQ ID NO: 2289971 - RNA, 16 nt, Yersinia pestis KIM
uaacgacgauaagaau

SEQ ID NO: 2289972 - RNA, 16 nt, Yersinia pestis KIM
uaaccaguuaucgaua

SEQ ID NO: 2289973 - RNA, 16 nt, Yersinia pestis KIM
uaaccaugaugacaau

SEQ ID NO: 2289974 - RNA, 20 nt, Yersinia pestis KIM
uaaccaugaugacaaugcgu

SEQ ID NO: 2289975 - RNA, 19 nt, Yersinia pestis KIM
uaacaauguuuauccgcua

SEQ ID NO: 2289976 - RNA, 14 nt, Yersinia pestis KIM
guuuauuacgaucg

SEQ ID NO: 2289977 - RNA, 17 nt, Yersinia pestis KIM
uaaagaaugcaaccagu

SEQ ID NO: 2289978 - RNA, 18 nt, Yersinia pestis KIM
uaaacuugauucaccaga

SEQ ID NO: 2289979 - RNA, 14 nt, Yersinia pestis KIM
uaaacguucugcca

SEQ ID NO: 2289980 - RNA, 14 nt, Yersinia pestis KIM
uaaacccggcauca

SEQ ID NO: 2289981 - RNA, 21 nt, Yersinia pestis KIM
uaaacacgucuaauuccgcca

SEQ ID NO: 2289982 - RNA, 21 nt, Yersinia pestis KIM
uaaacagacuaaaaaccgcca

SEQ ID NO: 2289983 - RNA, 20 nt, Yersinia pestis KIM
uaaaauagcguaacgggaag

SEQ ID NO: 2289984 - RNA, 15 nt, Yersinia pestis KIM
ucaccagauggcgau

SEQ ID NO: 2289985 - RNA, 17 nt, Yersinia pestis KIM
ucaccaggcucucauau

SEQ ID NO: 2289986 - RNA, 20 nt, Yersinia pestis KIM
ucaccccgcguugucagcca

SEQ ID NO: 2289987 - RNA, 20 nt, Yersinia pestis KIM
ucacccagcaaaauagcaca

SEQ ID NO: 2289988 - RNA, 12 nt, Yersinia pestis KIM
ucaccauucaag

SEQ ID NO: 2289989 - RNA, 17 nt, Yersinia pestis KIM
ucaccaguagcccagcc

SEQ ID NO: 2289990 - RNA, 23 nt, Yersinia pestis KIM
ucaccaaucggaucgagcuguuu

SEQ ID NO: 2289991 - RNA, 17 nt, Yersinia pestis KIM
ucaccaccucguuggcu

SEQ ID NO: 2289992 - RNA, 12 nt, Yersinia pestis KIM
ucacaaugcugu

SEQ ID NO: 2289993 - RNA, 20 nt, Yersinia pestis KIM
ucacacgcccaggccauagc

SEQ ID NO: 2289994 - RNA, 18 nt, Yersinia pestis KIM
ucacaccacggcgcugca

SEQ ID NO: 2289995 - RNA, 17 nt, Yersinia pestis KIM
ucacacgggaucuacau

SEQ ID NO: 2289996 - RNA, 21 nt, Yersinia pestis KIM
ucaaugggauccgcgauaacg

SEQ ID NO: 2289997 - RNA, 20 nt, Yersinia pestis KIM
ucaauguauugcuccagagg

SEQ ID NO: 2289998 - RNA, 15 nt, Yersinia pestis KIM
ucaccuagauaauca

SEQ ID NO: 2289999 - RNA, 15 nt, Yersinia pestis KIM
ucaccugagccaauc

SEQ ID NO: 2290000 - RNA, 20 nt, Yersinia pestis KIM
ucaccugaaugccauucaag

SEQ ID NO: 2290001 - RNA, 21 nt, Yersinia pestis KIM
ucacgcgaagcccuguuucau

SEQ ID NO: 2290002 - RNA, 22 nt, Yersinia pestis KIM
ucacuagcgggccuuuuaccuu

SEQ ID NO: 2290003 - RNA, 14 nt, Yersinia pestis KIM
ucacucucaucuga

SEQ ID NO: 2290004 - RNA, 13 nt, Yersinia pestis KIM
ucacucgaugacg

SEQ ID NO: 2290005 - RNA, 16 nt, Yersinia pestis KIM
ucacucagcgcuggcg

SEQ ID NO: 2290006 - RNA, 16 nt, Yersinia pestis KIM
ucagauaaaaagccag

SEQ ID NO: 2290007 - RNA, 19 nt, Yersinia pestis KIM
ucagcccccucaauaccgg

SEQ ID NO: 2290008 - RNA, 21 nt, Yersinia pestis KIM
ucagccaaagcauucgcgguu

SEQ ID NO: 2290009 - RNA, 19 nt, Yersinia pestis KIM
ucagccuauccucaccguu

SEQ ID NO: 2290010 - RNA, 15 nt, Yersinia pestis KIM
ucaacugcucaacgc

SEQ ID NO: 2290011 - RNA, 18 nt, Yersinia pestis KIM
ucaacucgagcauuugac

SEQ ID NO: 2290012 - RNA, 17 nt, Yersinia pestis KIM
ucaagcccgaaauucag

SEQ ID NO: 2290013 - RNA, 16 nt, Yersinia pestis KIM
ucaagccuaaucggua

SEQ ID NO: 2290014 - RNA, 16 nt, Yersinia pestis KIM
ucaauaccaaauuuac

SEQ ID NO: 2290015 - RNA, 22 nt, Yersinia pestis KIM
ucaauaauuucacuaucguuag

SEQ ID NO: 2290016 - RNA, 20 nt, Yersinia pestis KIM
ucaaggcggcagagccaauc

SEQ ID NO: 2290017 - RNA, 23 nt, Yersinia pestis KIM
ucaauagaaaagcgaaucuggua

SEQ ID NO: 2290018 - RNA, 23 nt, Yersinia pestis KIM
ucaauccgggcaaacgccagugc

SEQ ID NO: 2290019 - RNA, 11 nt, Yersinia pestis KIM
ucaaucggcug

SEQ ID NO: 2290020 - RNA, 15 nt, Yersinia pestis KIM
ucaaucggcugguaa

SEQ ID NO: 2290021 - RNA, 17 nt, Yersinia pestis KIM
uaucgcauccgggaacc

SEQ ID NO: 2290022 - RNA, 22 nt, Yersinia pestis KIM
uagcgguaaccgacaucaaccg

SEQ ID NO: 2290023 - RNA, 14 nt, Yersinia pestis KIM
uagcggcaacgauc

SEQ ID NO: 2290024 - RNA, 15 nt, Yersinia pestis KIM
uaucuguuucaaaua

SEQ ID NO: 2290025 - RNA, 20 nt, Yersinia pestis KIM
uaucugcugcgguauuaccc

SEQ ID NO: 2290026 - RNA, 14 nt, Yersinia pestis KIM
uaucugccaauuca

SEQ ID NO: 2290027 - RNA, 20 nt, Yersinia pestis KIM
uaucucguaacaacggcugg

SEQ ID NO: 2290028 - RNA, 15 nt, Yersinia pestis KIM
uaugcauuauugaug

SEQ ID NO: 2290029 - RNA, 16 nt, Yersinia pestis KIM
uaugauauagcuguuu

SEQ ID NO: 2290030 - RNA, 21 nt, Yersinia pestis KIM
uaugauccuuuagcgcugcau

SEQ ID NO: 2290031 - RNA, 17 nt, Yersinia pestis KIM
uauugauccaaauggcu

SEQ ID NO: 2290032 - RNA, 21 nt, Yersinia pestis KIM
uauugaccaauauaaaagcca

SEQ ID NO: 2290033 - RNA, 22 nt, Yersinia pestis KIM
uauuagaauguguaguugaagu

SEQ ID NO: 2290034 - RNA, 13 nt, Yersinia pestis KIM
uauuaucaauggc

SEQ ID NO: 2290035 - RNA, 14 nt, Yersinia pestis KIM
uauucuggcggcuu

SEQ ID NO: 2290036 - RNA, 14 nt, Yersinia pestis KIM
uauuacuaucgaaa

SEQ ID NO: 2290037 - RNA, 14 nt, Yersinia pestis KIM
uauuuucuauacca

SEQ ID NO: 2290038 - RNA, 23 nt, Yersinia pestis KIM
ucaaaaggauggcccaagccauc

SEQ ID NO: 2290039 - RNA, 12 nt, Yersinia pestis KIM
ucaaaaucacuu

SEQ ID NO: 2290040 - RNA, 17 nt, Yersinia pestis KIM
ucccgaugauugcauca

SEQ ID NO: 2290041 - RNA, 15 nt, Yersinia pestis KIM
ucccgcuuggguaaa

SEQ ID NO: 2290042 - RNA, 14 nt, Yersinia pestis KIM
ucccgagauaacca

SEQ ID NO: 2290043 - RNA, 19 nt, Yersinia pestis KIM
ucccccuccggcgcccuuc

SEQ ID NO: 2290044 - RNA, 17 nt, Yersinia pestis KIM
ucccagaaccucaacau

SEQ ID NO: 2290045 - RNA, 23 nt, Yersinia pestis KIM
ucccaagcaggaaacaugcugaa

SEQ ID NO: 2290046 - RNA, 21 nt, Yersinia pestis KIM
uccauaauagagcuucgcgau

SEQ ID NO: 2290047 - RNA, 15 nt, Yersinia pestis KIM
uccggcggcuagcag

SEQ ID NO: 2290048 - RNA, 19 nt, Yersinia pestis KIM
uccaggacgacauccacau

SEQ ID NO: 2290049 - RNA, 20 nt, Yersinia pestis KIM
uccaggcaagaaacuucauu

SEQ ID NO: 2290050 - RNA, 18 nt, Yersinia pestis KIM
ucauugguguuacagcaa

SEQ ID NO: 2290051 - RNA, 17 nt, Yersinia pestis KIM
uccacgccccaacggua

SEQ ID NO: 2290052 - RNA, 22 nt, Yersinia pestis KIM
ucagggaaauugucgcuagcac

SEQ ID NO: 2290053 - RNA, 12 nt, Yersinia pestis KIM
ucagggugaccg

SEQ ID NO: 2290054 - RNA, 20 nt, Yersinia pestis KIM
ucaggguacuguugaugcag

SEQ ID NO: 2290055 - RNA, 18 nt, Yersinia pestis KIM
ucauaucgaugacagcau

SEQ ID NO: 2290056 - RNA, 15 nt, Yersinia pestis KIM
ucauaucgauaccga

SEQ ID NO: 2290057 - RNA, 12 nt, Yersinia pestis KIM
ucaguaacgccu

SEQ ID NO: 2290058 - RNA, 13 nt, Yersinia pestis KIM
ucagguugaucag

SEQ ID NO: 2290059 - RNA, 15 nt, Yersinia pestis KIM
ucaguagcaggcgca

SEQ ID NO: 2290060 - RNA, 21 nt, Yersinia pestis KIM
ucaguaucuuuccagccaaua

SEQ ID NO: 2290061 - RNA, 23 nt, Yersinia pestis KIM
ucauuacguaaucccagaaacgg

SEQ ID NO: 2290062 - RNA, 18 nt, Yersinia pestis KIM
ucauuaacuguuaaaaca

SEQ ID NO: 2290063 - RNA, 17 nt, Yersinia pestis KIM
ucaucuucgcuuucauc

SEQ ID NO: 2290064 - RNA, 20 nt, Yersinia pestis KIM
ucaucgcaccauaaccaauc

SEQ ID NO: 2290065 - RNA, 16 nt, Yersinia pestis KIM
ucaucgacuugaugaa

SEQ ID NO: 2290066 - RNA, 20 nt, Yersinia pestis KIM
ucauauuccucucugucuga

SEQ ID NO: 2290067 - RNA, 22 nt, Yersinia pestis KIM
ucauccaucacaaaaccuuuaa

SEQ ID NO: 2290068 - RNA, 18 nt, Yersinia pestis KIM
ucaucccagucgucuuca

SEQ ID NO: 2290069 - RNA, 22 nt, Yersinia pestis KIM
ugcggcauaaauucuagcaaca

SEQ ID NO: 2290070 - RNA, 16 nt, Yersinia pestis KIM
ugccugugcggcagug

SEQ ID NO: 2290071 - RNA, 20 nt, Yersinia pestis KIM
ugccugugcggcagugaacc

SEQ ID NO: 2290072 - RNA, 20 nt, Yersinia pestis KIM
ugccugugcggcagugaacu

SEQ ID NO: 2290073 - RNA, 22 nt, Yersinia pestis KIM
ugcgacauaaagcaaacgccgc

SEQ ID NO: 2290074 - RNA, 23 nt, Yersinia pestis KIM
ugcgaauggaaaaacgugaauau

SEQ ID NO: 2290075 - RNA, 19 nt, Yersinia pestis KIM
ugccugauuuuuaucauca

SEQ ID NO: 2290076 - RNA, 18 nt, Yersinia pestis KIM
ugccugaguaaucgccug

SEQ ID NO: 2290077 - RNA, 17 nt, Yersinia pestis KIM
ugccuauccucaccguu

SEQ ID NO: 2290078 - RNA, 12 nt, Yersinia pestis KIM
ugcccggcugau

SEQ ID NO: 2290079 - RNA, 17 nt, Yersinia pestis KIM
ugcaucggauugcaaca

SEQ ID NO: 2290080 - RNA, 13 nt, Yersinia pestis KIM
ugcaucaacgaca

SEQ ID NO: 2290081 - RNA, 15 nt, Yersinia pestis KIM
ugcaucaacgacagc

SEQ ID NO: 2290082 - RNA, 16 nt, Yersinia pestis KIM
ugcaucaauaaauaga

SEQ ID NO: 2290083 - RNA, 15 nt, Yersinia pestis KIM
ugcauccgcuuucac

SEQ ID NO: 2290084 - RNA, 19 nt, Yersinia pestis KIM
ugcaccugaucgugccauu

SEQ ID NO: 2290085 - RNA, 17 nt, Yersinia pestis KIM
ugcccccuguaacgcua

SEQ ID NO: 2290086 - RNA, 21 nt, Yersinia pestis KIM
ugccccgaagcucaagcuggc

SEQ ID NO: 2290087 - RNA, 16 nt, Yersinia pestis KIM
ugcccaucagcaucaa

SEQ ID NO: 2290088 - RNA, 20 nt, Yersinia pestis KIM
ugcccacauaaagauagcca

SEQ ID NO: 2290089 - RNA, 13 nt, Yersinia pestis KIM
ugccagauaguca

SEQ ID NO: 2290090 - RNA, 14 nt, Yersinia pestis KIM
ugaaauaucaucag

SEQ ID NO: 2290091 - RNA, 21 nt, Yersinia pestis KIM
ugaaaucauagcuaaaugaca

SEQ ID NO: 2290092 - RNA, 14 nt, Yersinia pestis KIM
ugaaccgccauugc

SEQ ID NO: 2290093 - RNA, 20 nt, Yersinia pestis KIM
ucuuugauuccucugugacu

SEQ ID NO: 2290094 - RNA, 14 nt, Yersinia pestis KIM
ucuccaguugccag

SEQ ID NO: 2290095 - RNA, 15 nt, Yersinia pestis KIM
ugaaucagccagaga

SEQ ID NO: 2290096 - RNA, 17 nt, Yersinia pestis KIM
ugaauaugucauuaccg

SEQ ID NO: 2290097 - RNA, 12 nt, Yersinia pestis KIM
ugaauaccgcua

SEQ ID NO: 2290098 - RNA, 22 nt, Yersinia pestis KIM
ugacaaaccccgaugacucacu

SEQ ID NO: 2290099 - RNA, 22 nt, Yersinia pestis KIM
ugaaugugaguguucauugaga

SEQ ID NO: 2290100 - RNA, 15 nt, Yersinia pestis KIM
ugaagacacuuuggu

SEQ ID NO: 2290101 - RNA, 21 nt, Yersinia pestis KIM
ugaagagugaccaaagcagua

SEQ ID NO: 2290102 - RNA, 12 nt, Yersinia pestis KIM
ugaagauaacga

SEQ ID NO: 2290103 - RNA, 12 nt, Yersinia pestis KIM
ugaagauaacgc

SEQ ID NO: 2290104 - RNA, 19 nt, Yersinia pestis KIM
ugaaguuaaaaagccugaa

SEQ ID NO: 2290105 - RNA, 16 nt, Yersinia pestis KIM
ugaccgguaauaucgg

SEQ ID NO: 2290106 - RNA, 13 nt, Yersinia pestis KIM
ugaccgcagccuu

SEQ ID NO: 2290107 - RNA, 15 nt, Yersinia pestis KIM
ugaccuuaauaccgu

SEQ ID NO: 2290108 - RNA, 13 nt, Yersinia pestis KIM
ugacgaacgcccg

SEQ ID NO: 2290109 - RNA, 15 nt, Yersinia pestis KIM
ugacauccgcuugca

SEQ ID NO: 2290110 - RNA, 22 nt, Yersinia pestis KIM
ugacaucuaucggugcagugca

SEQ ID NO: 2290111 - RNA, 17 nt, Yersinia pestis KIM
ugacagaaaaaucacau

SEQ ID NO: 2290112 - RNA, 21 nt, Yersinia pestis KIM
ugacagacgcgguuaacgacg

SEQ ID NO: 2290113 - RNA, 11 nt, Yersinia pestis KIM
ugacagcaacg

SEQ ID NO: 2290114 - RNA, 15 nt, Yersinia pestis KIM
ugacagcaacgacgc

SEQ ID NO: 2290115 - RNA, 23 nt, Yersinia pestis KIM
ugcaaucuaaaggccaugcgguu

SEQ ID NO: 2290116 - RNA, 15 nt, Yersinia pestis KIM
ugaguuuuguccuga

SEQ ID NO: 2290117 - RNA, 21 nt, Yersinia pestis KIM
ugaguugcucaaguucaagca

SEQ ID NO: 2290118 - RNA, 23 nt, Yersinia pestis KIM
ugaguggacgauaaauucaaaua

SEQ ID NO: 2290119 - RNA, 18 nt, Yersinia pestis KIM
ugauccggcgaugaccga

SEQ ID NO: 2290120 - RNA, 19 nt, Yersinia pestis KIM
ugauccaaauggcugcguu

SEQ ID NO: 2290121 - RNA, 19 nt, Yersinia pestis KIM
ugaucgccgcuaauuuucc

SEQ ID NO: 2290122 - RNA, 14 nt, Yersinia pestis KIM
ugacggugcccaca

SEQ ID NO: 2290123 - RNA, 15 nt, Yersinia pestis KIM
ugacggagcuaucac

SEQ ID NO: 2290124 - RNA, 21 nt, Yersinia pestis KIM
ugacgcuaaccaccgucacca

SEQ ID NO: 2290125 - RNA, 22 nt, Yersinia pestis KIM
ugacgcugacauucaaauacgg

SEQ ID NO: 2290126 - RNA, 13 nt, Yersinia pestis KIM
ugacucagcgaau

SEQ ID NO: 2290127 - RNA, 14 nt, Yersinia pestis KIM
ugacugugcgcggc

SEQ ID NO: 2290128 - RNA, 19 nt, Yersinia pestis KIM
ugagggcgucucuacgacg

SEQ ID NO: 2290129 - RNA, 20 nt, Yersinia pestis KIM
ugaggcuaccugcaccaauc

SEQ ID NO: 2290130 - RNA, 16 nt, Yersinia pestis KIM
ugagggugaugacaau

SEQ ID NO: 2290131 - RNA, 18 nt, Yersinia pestis KIM
ugagcgcuguugcaagca

SEQ ID NO: 2290132 - RNA, 13 nt, Yersinia pestis KIM
ucgccuucuggca

SEQ ID NO: 2290133 - RNA, 16 nt, Yersinia pestis KIM
ucgcgaauagccaagc

SEQ ID NO: 2290134 - RNA, 16 nt, Yersinia pestis KIM
ucgccauaaaugcgua

SEQ ID NO: 2290135 - RNA, 17 nt, Yersinia pestis KIM
ucgcaucaggucgucua

SEQ ID NO: 2290136 - RNA, 17 nt, Yersinia pestis KIM
ucgacgcgccauaagcc

SEQ ID NO: 2290137 - RNA, 21 nt, Yersinia pestis KIM
ucgcacgggcuuuaaugagua

SEQ ID NO: 2290138 - RNA, 21 nt, Yersinia pestis KIM
ucgauuuuuauuuucgaccaa

SEQ ID NO: 2290139 - RNA, 22 nt, Yersinia pestis KIM
ucgauggauaaauucagccgcu

SEQ ID NO: 2290140 - RNA, 14 nt, Yersinia pestis KIM
ucgauauuacaguu

SEQ ID NO: 2290141 - RNA, 20 nt, Yersinia pestis KIM
ucgauaaacaucaugacaaa

SEQ ID NO: 2290142 - RNA, 19 nt, Yersinia pestis KIM
ucgauaacccuaucgucag

SEQ ID NO: 2290143 - RNA, 13 nt, Yersinia pestis KIM
ucgcgcuucaggu

SEQ ID NO: 2290144 - RNA, 21 nt, Yersinia pestis KIM
ucgcuaucugugucaguaccu

SEQ ID NO: 2290145 - RNA, 20 nt, Yersinia pestis KIM
ucgcuaucgagauuacgguc

SEQ ID NO: 2290146 - RNA, 14 nt, Yersinia pestis KIM
ucggcccagauauc

SEQ ID NO: 2290147 - RNA, 23 nt, Yersinia pestis KIM
ucuccaacgccccacgguugaua

SEQ ID NO: 2290148 - RNA, 13 nt, Yersinia pestis KIM
ucuaaguucagcg

SEQ ID NO: 2290149 - RNA, 14 nt, Yersinia pestis KIM
ucguuucugucuga

SEQ ID NO: 2290150 - RNA, 12 nt, Yersinia pestis KIM
ucguuuacgguu

SEQ ID NO: 2290151 - RNA, 21 nt, Yersinia pestis KIM
gucgcucuuugauuccucugu

SEQ ID NO: 2290152 - RNA, 20 nt, Yersinia pestis KIM
gucccuacgguaccgcaggu

SEQ ID NO: 2290153 - RNA, 12 nt, Yersinia pestis KIM
gucacggaaagc

SEQ ID NO: 2290154 - RNA, 20 nt, Yersinia pestis KIM
gucagauuaguuuuagacgu

SEQ ID NO: 2290155 - RNA, 23 nt, Yersinia pestis KIM
gucccgaugauugcaucaucagu

SEQ ID NO: 2290156 - RNA, 16 nt, Yersinia pestis KIM
gugccaacccuugaua

SEQ ID NO: 2290157 - RNA, 17 nt, Yersinia pestis KIM
gugccaaugccucuuca

SEQ ID NO: 2290158 - RNA, 15 nt, Yersinia pestis KIM
gugcgcggcuagcca

SEQ ID NO: 2290159 - RNA, 18 nt, Yersinia pestis KIM
gugcaaucaagggcgaua

SEQ ID NO: 2290160 - RNA, 17 nt, Yersinia pestis KIM
gugcaaaaugcucuuca

SEQ ID NO: 2290161 - RNA, 22 nt, Yersinia pestis KIM
gugaucgcucaggcggucaccg

SEQ ID NO: 2290162 - RNA, 16 nt, Yersinia pestis KIM
gugaguggcugggaau

SEQ ID NO: 2290163 - RNA, 22 nt, Yersinia pestis KIM
gugauaaauacggucaacgauu

SEQ ID NO: 2290164 - RNA, 15 nt, Yersinia pestis KIM
gugaucgcugccgca

SEQ ID NO: 2290165 - RNA, 20 nt, Yersinia pestis KIM
gugaucguuuuauggcgaug

SEQ ID NO: 2290166 - RNA, 18 nt, Yersinia pestis KIM
gucugcgucauaccauuc

SEQ ID NO: 2290167 - RNA, 20 nt, Yersinia pestis KIM
gugacauccgcuugcagcaa

SEQ ID NO: 2290168 - RNA, 16 nt, Yersinia pestis KIM
gugacauuuucaccga

SEQ ID NO: 2290169 - RNA, 14 nt, Yersinia pestis KIM
gugaaucagccaga

SEQ ID NO: 2290170 - RNA, 15 nt, Yersinia pestis KIM
gugaauaccauuuca

SEQ ID NO: 2290171 - RNA, 13 nt, Yersinia pestis KIM
gugacaaacgcuu

SEQ ID NO: 2290172 - RNA, 17 nt, Yersinia pestis KIM
gugaauaacgcuggaua

SEQ ID NO: 2290173 - RNA, 13 nt, Yersinia pestis KIM
gugaagacaucgc

SEQ ID NO: 2290174 - RNA, 18 nt, Yersinia pestis KIM
gucuucgcccagaucauc

SEQ ID NO: 2290175 - RNA, 13 nt, Yersinia pestis KIM
gguacuuaacugg

SEQ ID NO: 2290176 - RNA, 15 nt, Yersinia pestis KIM
gguagaccaccaacu

SEQ ID NO: 2290177 - RNA, 18 nt, Yersinia pestis KIM
gguaccguuuuauuuccc

SEQ ID NO: 2290178 - RNA, 23 nt, Yersinia pestis KIM
gguagccugcacggcucaggugc

SEQ ID NO: 2290179 - RNA, 20 nt, Yersinia pestis KIM
gguaucaccuuuuuccgcug

SEQ ID NO: 2290180 - RNA, 21 nt, Yersinia pestis KIM
ggucagaaccuguuacaucag

SEQ ID NO: 2290181 - RNA, 16 nt, Yersinia pestis KIM
gguauugaccacuugc

SEQ ID NO: 2290182 - RNA, 22 nt, Yersinia pestis KIM
gguaacuuacaggcugccugcc

SEQ ID NO: 2290183 - RNA, 16 nt, Yersinia pestis KIM
gguaacgcagauaaau

SEQ ID NO: 2290184 - RNA, 17 nt, Yersinia pestis KIM
gguaaccagcaucagua

SEQ ID NO: 2290185 - RNA, 14 nt, Yersinia pestis KIM
gguaaauccuucug

SEQ ID NO: 2290186 - RNA, 21 nt, Yersinia pestis KIM
gguaauuaaacgcucaucaac

SEQ ID NO: 2290187 - RNA, 23 nt, Yersinia pestis KIM
gguaauugacuuuuuuaucgcca

SEQ ID NO: 2290188 - RNA, 21 nt, Yersinia pestis KIM
gguaccaaucaaaaauugccc

SEQ ID NO: 2290189 - RNA, 20 nt, Yersinia pestis KIM
ggguugauuggcgaugcgcu

SEQ ID NO: 2290190 - RNA, 17 nt, Yersinia pestis KIM
ggucuuaucagcgguau

SEQ ID NO: 2290191 - RNA, 15 nt, Yersinia pestis KIM
ggucgguaaccugaa

SEQ ID NO: 2290192 - RNA, 12 nt, Yersinia pestis KIM
ggugaucaacug

SEQ ID NO: 2290193 - RNA, 21 nt, Yersinia pestis KIM
guacgacgccagauagcauca

SEQ ID NO: 2290194 - RNA, 22 nt, Yersinia pestis KIM
guaccugcuaaccgaagauaac

SEQ ID NO: 2290195 - RNA, 22 nt, Yersinia pestis KIM
guacgugacggcagcgagcacu

SEQ ID NO: 2290196 - RNA, 15 nt, Yersinia pestis KIM
guacgugaagauaac

SEQ ID NO: 2290197 - RNA, 23 nt, Yersinia pestis KIM
guaccgccuguucgacauucucu

SEQ ID NO: 2290198 - RNA, 14 nt, Yersinia pestis KIM
guaccgcaggucag

SEQ ID NO: 2290199 - RNA, 23 nt, Yersinia pestis KIM
guacccgaucugagccauuaucg

SEQ ID NO: 2290200 - RNA, 19 nt, Yersinia pestis KIM
gucacccgcacguagcaca

SEQ ID NO: 2290201 - RNA, 17 nt, Yersinia pestis KIM
gucaaaccaauuucucg

SEQ ID NO: 2290202 - RNA, 23 nt, Yersinia pestis KIM
gucacaccagacagaauauccag

SEQ ID NO: 2290203 - RNA, 16 nt, Yersinia pestis KIM
guauaacucaucagua

SEQ ID NO: 2290204 - RNA, 23 nt, Yersinia pestis KIM
guauauugcucuggauucggcuu

SEQ ID NO: 2290205 - RNA, 15 nt, Yersinia pestis KIM
guauaugaagauaac

SEQ ID NO: 2290206 - RNA, 22 nt, Yersinia pestis KIM
guaucaauaccuuacugcauca

SEQ ID NO: 2290207 - RNA, 14 nt, Yersinia pestis KIM
guauccaucugaug

SEQ ID NO: 2290208 - RNA, 15 nt, Yersinia pestis KIM
guauccguuaucauc

SEQ ID NO: 2290209 - RNA, 18 nt, Yersinia pestis KIM
guaguuagaugacaucga

SEQ ID NO: 2290210 - RNA, 16 nt, Yersinia pestis KIM
guaacggaauucagaa

SEQ ID NO: 2290211 - RNA, 16 nt, Yersinia pestis KIM
guaaugucacugccau

SEQ ID NO: 2290212 - RNA, 13 nt, Yersinia pestis KIM
guaacuaagagua

SEQ ID NO: 2290213 - RNA, 17 nt, Yersinia pestis KIM
guaauugaucggcaucg

SEQ ID NO: 2290214 - RNA, 21 nt, Yersinia pestis KIM
guaccaccaccaacagcauua

SEQ ID NO: 2290215 - RNA, 23 nt, Yersinia pestis KIM
guacaucacgcagugcaucuucc

SEQ ID NO: 2290216 - RNA, 13 nt, Yersinia pestis KIM
ggcggccauguug

SEQ ID NO: 2290217 - RNA, 22 nt, Yersinia pestis KIM
ggcggaugaugaucaccgccug

SEQ ID NO: 2290218 - RNA, 14 nt, Yersinia pestis KIM
gggcggcggcuacg

SEQ ID NO: 2290219 - RNA, 19 nt, Yersinia pestis KIM
gggcggcuguaaccgccug

SEQ ID NO: 2290220 - RNA, 23 nt, Yersinia pestis KIM
ggcuuuuuuaauaaaaaacugac

SEQ ID NO: 2290221 - RNA, 15 nt, Yersinia pestis KIM
ggcucccccuugauu

SEQ ID NO: 2290222 - RNA, 20 nt, Yersinia pestis KIM
ggcucccguuugcagcucaa

SEQ ID NO: 2290223 - RNA, 18 nt, Yersinia pestis KIM
ggcugcacuuuuacgggc

SEQ ID NO: 2290224 - RNA, 14 nt, Yersinia pestis KIM
ggcuaaaacuggca

SEQ ID NO: 2290225 - RNA, 17 nt, Yersinia pestis KIM
ggcuagccagcguucaa

SEQ ID NO: 2290226 - RNA, 15 nt, Yersinia pestis KIM
ggccgacaauaccgc

SEQ ID NO: 2290227 - RNA, 13 nt, Yersinia pestis KIM
ggccgcgcacagc

SEQ ID NO: 2290228 - RNA, 16 nt, Yersinia pestis KIM
ggccugcacaucaaua

SEQ ID NO: 2290229 - RNA, 14 nt, Yersinia pestis KIM
ggccacccugccaa

SEQ ID NO: 2290230 - RNA, 21 nt, Yersinia pestis KIM
ggcaugcucccuccugcggca

SEQ ID NO: 2290231 - RNA, 22 nt, Yersinia pestis KIM
ggcaucgguaauacucuggcca

SEQ ID NO: 2290232 - RNA, 14 nt, Yersinia pestis KIM
ggcagucacugcug

SEQ ID NO: 2290233 - RNA, 18 nt, Yersinia pestis KIM
ggcagggcgguaacgcag

SEQ ID NO: 2290234 - RNA, 16 nt, Yersinia pestis KIM
ggcacuaauagcauuu

SEQ ID NO: 2290235 - RNA, 17 nt, Yersinia pestis KIM
ggcaccagcgcacugaa

SEQ ID NO: 2290236 - RNA, 19 nt, Yersinia pestis KIM
ggcaauaaaaaaggcagcg

SEQ ID NO: 2290237 - RNA, 20 nt, Yersinia pestis KIM
ggcaacuuaagcauuggcaa

SEQ ID NO: 2290238 - RNA, 20 nt, Yersinia pestis KIM
ggcaaucucuccccaagcgg

SEQ ID NO: 2290239 - RNA, 16 nt, Yersinia pestis KIM
ggcaaaaauaaucaac

SEQ ID NO: 2290240 - RNA, 17 nt, Yersinia pestis KIM
gcgaucaauacaccaga

SEQ ID NO: 2290241 - RNA, 18 nt, Yersinia pestis KIM
gcgcagagaucgauagca

SEQ ID NO: 2290242 - RNA, 16 nt, Yersinia pestis KIM
gcgcaucagccagcca

SEQ ID NO: 2290243 - RNA, 18 nt, Yersinia pestis KIM
gcgccaguggcaucaaua

SEQ ID NO: 2290244 - RNA, 23 nt, Yersinia pestis KIM
gcgccgcuucggucucuggaugc

SEQ ID NO: 2290245 - RNA, 19 nt, Yersinia pestis KIM
gcgcugaucaucaucaaug

SEQ ID NO: 2290246 - RNA, 15 nt, Yersinia pestis KIM
gccgggauuugcuca

SEQ ID NO: 2290247 - RNA, 21 nt, Yersinia pestis KIM
gccgugaccaccgcagcaacc

SEQ ID NO: 2290248 - RNA, 18 nt, Yersinia pestis KIM
gccgugccugcuggcaaa

SEQ ID NO: 2290249 - RNA, 13 nt, Yersinia pestis KIM
gcgauauacauca

SEQ ID NO: 2290250 - RNA, 20 nt, Yersinia pestis KIM
gccugcgaauuaucauccag

SEQ ID NO: 2290251 - RNA, 19 nt, Yersinia pestis KIM
gccuuuuuauaagcguuau

SEQ ID NO: 2290252 - RNA, 16 nt, Yersinia pestis KIM
gcgaaaauccuucauu

SEQ ID NO: 2290253 - RNA, 14 nt, Yersinia pestis KIM
gcggcgaaacugac

SEQ ID NO: 2290254 - RNA, 20 nt, Yersinia pestis KIM
gcgcuuuuuaggauguuaug

SEQ ID NO: 2290255 - RNA, 14 nt, Yersinia pestis KIM
gcgggcuggccaca

SEQ ID NO: 2290256 - RNA, 16 nt, Yersinia pestis KIM
gcguacgucacgguau

SEQ ID NO: 2290257 - RNA, 19 nt, Yersinia pestis KIM
gcguguucuucucaccccg

SEQ ID NO: 2290258 - RNA, 17 nt, Yersinia pestis KIM
gcguuuucugcauaagc

SEQ ID NO: 2290259 - RNA, 19 nt, Yersinia pestis KIM
gcuaaaccacggcguacug

SEQ ID NO: 2290260 - RNA, 22 nt, Yersinia pestis KIM
gcuaaauacugcuggaacguug

SEQ ID NO: 2290261 - RNA, 15 nt, Yersinia pestis KIM
gcuaaaucaucaaau

SEQ ID NO: 2290262 - RNA, 19 nt, Yersinia pestis KIM
gcuaacaaccgugcaccau

SEQ ID NO: 2290263 - RNA, 16 nt, Yersinia pestis KIM
gcuaaccccugcaucu

SEQ ID NO: 2290264 - RNA, 16 nt, Yersinia pestis KIM
gcuaacgucgcuguua

SEQ ID NO: 2290265 - RNA, 16 nt, Yersinia pestis KIM
gcuggcuaucaucccu

SEQ ID NO: 2290266 - RNA, 14 nt, Yersinia pestis KIM
gcuggcgcugauca

SEQ ID NO: 2290267 - RNA, 19 nt, Yersinia pestis KIM
gcuguccaguugcuggaac

SEQ ID NO: 2290268 - RNA, 15 nt, Yersinia pestis KIM
gcuguagcagccugu

SEQ ID NO: 2290269 - RNA, 19 nt, Yersinia pestis KIM
gcuguaaccgccugccgug

SEQ ID NO: 2290270 - RNA, 13 nt, Yersinia pestis KIM
gcuguuauuacug

SEQ ID NO: 2290271 - RNA, 13 nt, Yersinia pestis KIM
gcuuccugcgcca

SEQ ID NO: 2290272 - RNA, 16 nt, Yersinia pestis KIM
gcuuccaucaggaagc

SEQ ID NO: 2290273 - RNA, 15 nt, Yersinia pestis KIM
gcuuauuaauuaaug

SEQ ID NO: 2290274 - RNA, 19 nt, Yersinia pestis KIM
gcuuaaauaaaacacccuu

SEQ ID NO: 2290275 - RNA, 22 nt, Yersinia pestis KIM
gcuuaacgcccugccgggcaau

SEQ ID NO: 2290276 - RNA, 20 nt, Yersinia pestis KIM
gcuuaacugugcagcccauu

SEQ ID NO: 2290277 - RNA, 23 nt, Yersinia pestis KIM
gcuuccagcucugggaucgauug

SEQ ID NO: 2290278 - RNA, 14 nt, Yersinia pestis KIM
ggaauaaccuacaa

SEQ ID NO: 2290279 - RNA, 12 nt, Yersinia pestis KIM
ggaaauuucccc

SEQ ID NO: 2290280 - RNA, 12 nt, Yersinia pestis KIM
gcuuuaaugagu

SEQ ID NO: 2290281 - RNA, 14 nt, Yersinia pestis KIM
gcuuuacuccucug

SEQ ID NO: 2290282 - RNA, 20 nt, Yersinia pestis KIM
gcuuuagcggcgauuucauc

SEQ ID NO: 2290283 - RNA, 23 nt, Yersinia pestis KIM
gcuuucugugguuggcagcucag

SEQ ID NO: 2290284 - RNA, 17 nt, Yersinia pestis KIM
gcucgcuguggcuacca

SEQ ID NO: 2290285 - RNA, 21 nt, Yersinia pestis KIM
gcuccugagggugaugacaau

SEQ ID NO: 2290286 - RNA, 22 nt, Yersinia pestis KIM
gcuaccaagacuucaugacuac

SEQ ID NO: 2290287 - RNA, 13 nt, Yersinia pestis KIM
gcuaccaggaagc

SEQ ID NO: 2290288 - RNA, 20 nt, Yersinia pestis KIM
gcucccccuugauucacuga

SEQ ID NO: 2290289 - RNA, 22 nt, Yersinia pestis KIM
gcuaauuugggugccauagcaa

SEQ ID NO: 2290290 - RNA, 23 nt, Yersinia pestis KIM
gcugacgauaacuuuuggcagca

SEQ ID NO: 2290291 - RNA, 14 nt, Yersinia pestis KIM
gcugaucugccccu

SEQ ID NO: 2290292 - RNA, 15 nt, Yersinia pestis KIM
gcugaucugccagua

SEQ ID NO: 2290293 - RNA, 21 nt, Yersinia pestis KIM
gcugauaucauuugcucgaaa

SEQ ID NO: 2290294 - RNA, 22 nt, Yersinia pestis KIM
gcugaauuuuugugcuagcuca

SEQ ID NO: 2290295 - RNA, 15 nt, Yersinia pestis KIM
gcucucacugcucca

SEQ ID NO: 2290296 - RNA, 18 nt, Yersinia pestis KIM
gcugcgccauaugccaug

SEQ ID NO: 2290297 - RNA, 23 nt, Yersinia pestis KIM
gcugccuguucucuucgccauag

SEQ ID NO: 2290298 - RNA, 15 nt, Yersinia pestis KIM
cggcgacuuacgucg

SEQ ID NO: 2290299 - RNA, 16 nt, Yersinia pestis KIM
cggcgauuucaucagc

SEQ ID NO: 2290300 - RNA, 15 nt, Yersinia pestis KIM
cggccucugcugcug

SEQ ID NO: 2290301 - RNA, 20 nt, Yersinia pestis KIM
cggccauuuuuuaccauuac

SEQ ID NO: 2290302 - RNA, 20 nt, Yersinia pestis KIM
cggacaucuuacugauaccc

SEQ ID NO: 2290303 - RNA, 14 nt, Yersinia pestis KIM
cggcauagcaaaau

SEQ ID NO: 2290304 - RNA, 17 nt, Yersinia pestis KIM
cggcauaaauucuagca

SEQ ID NO: 2290305 - RNA, 20 nt, Yersinia pestis KIM
cggcuaugugaaugcaguca

SEQ ID NO: 2290306 - RNA, 22 nt, Yersinia pestis KIM
cggcguuaauauaacaauguuu

SEQ ID NO: 2290307 - RNA, 15 nt, Yersinia pestis KIM
cggcgucagccgcga

SEQ ID NO: 2290308 - RNA, 21 nt, Yersinia pestis KIM
cggcuuugcugugcgauuuca

SEQ ID NO: 2290309 - RNA, 14 nt, Yersinia pestis KIM
cgggcacaggcgau

SEQ ID NO: 2290310 - RNA, 15 nt, Yersinia pestis KIM
cgggcucaugcagca

SEQ ID NO: 2290311 - RNA, 15 nt, Yersinia pestis KIM
cgggguuugucagca

SEQ ID NO: 2290312 - RNA, 18 nt, Yersinia pestis KIM
cggguagaaacguucaau

SEQ ID NO: 2290313 - RNA, 18 nt, Yersinia pestis KIM
cgguaucggccaauucag

SEQ ID NO: 2290314 - RNA, 23 nt, Yersinia pestis KIM
cgguauguguguacuuaucgauu

SEQ ID NO: 2290315 - RNA, 13 nt, Yersinia pestis KIM
cgguaucaaucag

SEQ ID NO: 2290316 - RNA, 19 nt, Yersinia pestis KIM
cgguaucacuugggcauga

SEQ ID NO: 2290317 - RNA, 23 nt, Yersinia pestis KIM
cggguugcccaucagcaucaaua

SEQ ID NO: 2290318 - RNA, 20 nt, Yersinia pestis KIM
cgcgccauaaaagauaacga

SEQ ID NO: 2290319 - RNA, 22 nt, Yersinia pestis KIM
cgcgucaauaacauuaccaccg

SEQ ID NO: 2290320 - RNA, 23 nt, Yersinia pestis KIM
cgcggguaaugcuguuguagcgc

SEQ ID NO: 2290321 - RNA, 23 nt, Yersinia pestis KIM
cgcgggucaugucgcuguagcgc

SEQ ID NO: 2290322 - RNA, 22 nt, Yersinia pestis KIM
cgcgucugagguggcacccagu

SEQ ID NO: 2290323 - RNA, 22 nt, Yersinia pestis KIM
cgcuggccgcaacgcauuguuu

SEQ ID NO: 2290324 - RNA, 16 nt, Yersinia pestis KIM
cgcuccaucagguuua

SEQ ID NO: 2290325 - RNA, 19 nt, Yersinia pestis KIM
cgcucauaccaugccauca

SEQ ID NO: 2290326 - RNA, 15 nt, Yersinia pestis KIM
cgcucaucgguacca

SEQ ID NO: 2290327 - RNA, 13 nt, Yersinia pestis KIM
cgcgaccagcaga

SEQ ID NO: 2290328 - RNA, 16 nt, Yersinia pestis KIM
cgccuccgauucauag

SEQ ID NO: 2290329 - RNA, 13 nt, Yersinia pestis KIM
cgccuccgauuca

SEQ ID NO: 2290330 - RNA, 17 nt, Yersinia pestis KIM
cgccugaucgauaaccc

SEQ ID NO: 2290331 - RNA, 18 nt, Yersinia pestis KIM
cgcccaguggagccauga

SEQ ID NO: 2290332 - RNA, 21 nt, Yersinia pestis KIM
cgcauccgggaaccccuucag

SEQ ID NO: 2290333 - RNA, 14 nt, Yersinia pestis KIM
cgccagcaacagcg

SEQ ID NO: 2290334 - RNA, 18 nt, Yersinia pestis KIM
cgcaccggggugaucaac

SEQ ID NO: 2290335 - RNA, 12 nt, Yersinia pestis KIM
cgcaaggcaaac

SEQ ID NO: 2290336 - RNA, 18 nt, Yersinia pestis KIM
cgcacgaaaggcuggagc

SEQ ID NO: 2290337 - RNA, 18 nt, Yersinia pestis KIM
cgcacugggaucugauca

SEQ ID NO: 2290338 - RNA, 16 nt, Yersinia pestis KIM
cgcacugucugagcaa

SEQ ID NO: 2290339 - RNA, 15 nt, Yersinia pestis KIM
cgcacugugagcggc

SEQ ID NO: 2290340 - RNA, 20 nt, Yersinia pestis KIM
cgcacugguugcuucaucaa

SEQ ID NO: 2290341 - RNA, 15 nt, Yersinia pestis KIM
cgcacugauagccaa

SEQ ID NO: 2290342 - RNA, 19 nt, Yersinia pestis KIM
cgcacucuguaacugccag

SEQ ID NO: 2290343 - RNA, 18 nt, Yersinia pestis KIM
cgcaggauaaagcugaau

SEQ ID NO: 2290344 - RNA, 13 nt, Yersinia pestis KIM
cgaugcgcugcuc

SEQ ID NO: 2290345 - RNA, 17 nt, Yersinia pestis KIM
cgaucugaaacggugag

SEQ ID NO: 2290346 - RNA, 15 nt, Yersinia pestis KIM
cgaucuguugauaaa

SEQ ID NO: 2290347 - RNA, 23 nt, Yersinia pestis KIM
cgaucuauucucuguaauggcgc

SEQ ID NO: 2290348 - RNA, 15 nt, Yersinia pestis KIM
cgauguccagccagu

SEQ ID NO: 2290349 - RNA, 19 nt, Yersinia pestis KIM
cgauugaaucaaggcuuua

SEQ ID NO: 2290350 - RNA, 16 nt, Yersinia pestis KIM
cgauguuuacggcauu

SEQ ID NO: 2290351 - RNA, 12 nt, Yersinia pestis KIM
cgauuucugcau

SEQ ID NO: 2290352 - RNA, 14 nt, Yersinia pestis KIM
cgauacaggcucug

SEQ ID NO: 2290353 - RNA, 14 nt, Yersinia pestis KIM
cgauaaaaaccauu

SEQ ID NO: 2290354 - RNA, 21 nt, Yersinia pestis KIM
cgauagaaacaucagauagau

SEQ ID NO: 2290355 - RNA, 19 nt, Yersinia pestis KIM
cgaguaacuccaucaggcu

SEQ ID NO: 2290356 - RNA, 20 nt, Yersinia pestis KIM
cgaguaagcgcuggcuuaau

SEQ ID NO: 2290357 - RNA, 18 nt, Yersinia pestis KIM
cgaguauuccccacugua

SEQ ID NO: 2290358 - RNA, 14 nt, Yersinia pestis KIM
cgacagcagugauc

SEQ ID NO: 2290359 - RNA, 17 nt, Yersinia pestis KIM
cgaauuugcugcucgac

SEQ ID NO: 2290360 - RNA, 17 nt, Yersinia pestis KIM
cgaaucacuuacugguc

SEQ ID NO: 2290361 - RNA, 20 nt, Yersinia pestis KIM
cgaauacacagcgagaaucu

SEQ ID NO: 2290362 - RNA, 20 nt, Yersinia pestis KIM
cgaacugauaacugccgaua

SEQ ID NO: 2290363 - RNA, 21 nt, Yersinia pestis KIM
cgaagcccuguuucauuucgc

SEQ ID NO: 2290364 - RNA, 16 nt, Yersinia pestis KIM
cgaacaaaaugccgua

SEQ ID NO: 2290365 - RNA, 22 nt, Yersinia pestis KIM
ccuguagaagugcaggcuacca

SEQ ID NO: 2290366 - RNA, 14 nt, Yersinia pestis KIM
ccuguaaagccagu

SEQ ID NO: 2290367 - RNA, 21 nt, Yersinia pestis KIM
ccugguuuuaccaucaccaua

SEQ ID NO: 2290368 - RNA, 19 nt, Yersinia pestis KIM
ccugguuuuacgcuaucaa

SEQ ID NO: 2290369 - RNA, 20 nt, Yersinia pestis KIM
ccuugagguuauugacaaag

SEQ ID NO: 2290370 - RNA, 14 nt, Yersinia pestis KIM
ccuucgcccuguaa

SEQ ID NO: 2290371 - RNA, 18 nt, Yersinia pestis KIM
ccuucagaugaauccagc

SEQ ID NO: 2290372 - RNA, 20 nt, Yersinia pestis KIM
ccuucacgcaucacaucuug

SEQ ID NO: 2290373 - RNA, 20 nt, Yersinia pestis KIM
ccuucaggccuuuacuguua

SEQ ID NO: 2290374 - RNA, 18 nt, Yersinia pestis KIM
ccuucaucgacaauggcu

SEQ ID NO: 2290375 - RNA, 22 nt, Yersinia pestis KIM
cgaaaaauuucacuggcaccgc

SEQ ID NO: 2290376 - RNA, 20 nt, Yersinia pestis KIM
ccuuuacgggcggcauaauc

SEQ ID NO: 2290377 - RNA, 14 nt, Yersinia pestis KIM
cgaaauagcgccug

SEQ ID NO: 2290378 - RNA, 17 nt, Yersinia pestis KIM
cgaaaucacccggccau

SEQ ID NO: 2290379 - RNA, 23 nt, Yersinia pestis KIM
cgaaauaucaggaugaaccggcg

SEQ ID NO: 2290380 - RNA, 16 nt, Yersinia pestis KIM
cgagauagucagcgac

SEQ ID NO: 2290381 - RNA, 15 nt, Yersinia pestis KIM
cgacgugccaacugg

SEQ ID NO: 2290382 - RNA, 12 nt, Yersinia pestis KIM
cgacuaacugau

SEQ ID NO: 2290383 - RNA, 14 nt, Yersinia pestis KIM
cgacguuggaauua

SEQ ID NO: 2290384 - RNA, 23 nt, Yersinia pestis KIM
cgacccgcugaacuucugggauc

SEQ ID NO: 2290385 - RNA, 16 nt, Yersinia pestis KIM
ccgauucggauaaccg

SEQ ID NO: 2290386 - RNA, 23 nt, Yersinia pestis KIM
ccgcaccaaugccgguccagacc

SEQ ID NO: 2290387 - RNA, 15 nt, Yersinia pestis KIM
ccgauucgauggcau

SEQ ID NO: 2290388 - RNA, 19 nt, Yersinia pestis KIM
ccgaugcaauaaaccauac

SEQ ID NO: 2290389 - RNA, 19 nt, Yersinia pestis KIM
ccgccagauuauccagccc

SEQ ID NO: 2290390 - RNA, 21 nt, Yersinia pestis KIM
ccgcaguccaaaaaacugcgg

SEQ ID NO: 2290391 - RNA, 20 nt, Yersinia pestis KIM
ccgauaaaaacuauccgccc

SEQ ID NO: 2290392 - RNA, 12 nt, Yersinia pestis KIM
ccgcuggcaaua

SEQ ID NO: 2290393 - RNA, 19 nt, Yersinia pestis KIM
ccgcuaauauuuucagccc

SEQ ID NO: 2290394 - RNA, 18 nt, Yersinia pestis KIM
ccgcguugucagccaugc

SEQ ID NO: 2290395 - RNA, 22 nt, Yersinia pestis KIM
ccgcgucgugaugaaauccaga

SEQ ID NO: 2290396 - RNA, 17 nt, Yersinia pestis KIM
ccgcgcauauaggcgaa

SEQ ID NO: 2290397 - RNA, 15 nt, Yersinia pestis KIM
ccgcgcaaccauccg

SEQ ID NO: 2290398 - RNA, 21 nt, Yersinia pestis KIM
ccgggggcguauuaucggauc

SEQ ID NO: 2290399 - RNA, 23 nt, Yersinia pestis KIM
ccggcuaggcucagcauggaaga

SEQ ID NO: 2290400 - RNA, 11 nt, Yersinia pestis KIM
ccguuagccau

SEQ ID NO: 2290401 - RNA, 16 nt, Yersinia pestis KIM
ccguuagccaugcauu

SEQ ID NO: 2290402 - RNA, 21 nt, Yersinia pestis KIM
ccguguucauggugaugauca

SEQ ID NO: 2290403 - RNA, 16 nt, Yersinia pestis KIM
ccgucuuggauauuug

SEQ ID NO: 2290404 - RNA, 17 nt, Yersinia pestis KIM
ccgucuguggugccaua

SEQ ID NO: 2290405 - RNA, 12 nt, Yersinia pestis KIM
ccguacauuaaa

SEQ ID NO: 2290406 - RNA, 14 nt, Yersinia pestis KIM
ccguacaucuggcc

SEQ ID NO: 2290407 - RNA, 13 nt, Yersinia pestis KIM
ccguaugcgcaua

SEQ ID NO: 2290408 - RNA, 15 nt, Yersinia pestis KIM
ccgguuguucaaucg

SEQ ID NO: 2290409 - RNA, 16 nt, Yersinia pestis KIM
ccguaaauacauccau

SEQ ID NO: 2290410 - RNA, 17 nt, Yersinia pestis KIM
ccguaauucagauaaga

SEQ ID NO: 2290411 - RNA, 16 nt, Yersinia pestis KIM
ccguaacuccaguaag

SEQ ID NO: 2290412 - RNA, 11 nt, Yersinia pestis KIM
ccuccggcaua

SEQ ID NO: 2290413 - RNA, 20 nt, Yersinia pestis KIM
ccuccggaaucagcguuuua

SEQ ID NO: 2290414 - RNA, 18 nt, Yersinia pestis KIM
ccucaugauuuguugaug

SEQ ID NO: 2290415 - RNA, 13 nt, Yersinia pestis KIM
ccucauucaugag

SEQ ID NO: 2290416 - RNA, 13 nt, Yersinia pestis KIM
ccucaguuaucag

SEQ ID NO: 2290417 - RNA, 11 nt, Yersinia pestis KIM
ccuacuggcgg

SEQ ID NO: 2290418 - RNA, 19 nt, Yersinia pestis KIM
ccguuccuucagccaccag

SEQ ID NO: 2290419 - RNA, 13 nt, Yersinia pestis KIM
ccugccaaaaaau

SEQ ID NO: 2290420 - RNA, 20 nt, Yersinia pestis KIM
ccugauucgcgaccagcaga

SEQ ID NO: 2290421 - RNA, 17 nt, Yersinia pestis KIM
ccugaauggcaucaccg

SEQ ID NO: 2290422 - RNA, 17 nt, Yersinia pestis KIM
ccugauaucaaccuggc

SEQ ID NO: 2290423 - RNA, 14 nt, Yersinia pestis KIM
ccucuuucuuaaua

SEQ ID NO: 2290424 - RNA, 20 nt, Yersinia pestis KIM
ccucucagacugcugacaaa

SEQ ID NO: 2290425 - RNA, 16 nt, Yersinia pestis KIM
ccucuguccccgcuau

SEQ ID NO: 2290426 - RNA, 12 nt, Yersinia pestis KIM
ccucgccguuau

SEQ ID NO: 2290427 - RNA, 13 nt, Yersinia pestis KIM
gacgauaacgcgg

SEQ ID NO: 2290428 - RNA, 20 nt, Yersinia pestis KIM
gacgauaaauucaaauauca

SEQ ID NO: 2290429 - RNA, 17 nt, Yersinia pestis KIM
gacguaucuauaaacuu

SEQ ID NO: 2290430 - RNA, 20 nt, Yersinia pestis KIM
gaccauggcgaucaaaggcg

SEQ ID NO: 2290431 - RNA, 20 nt, Yersinia pestis KIM
gaccucauuauuaaacugau

SEQ ID NO: 2290432 - RNA, 13 nt, Yersinia pestis KIM
gaccuuaauaccg

SEQ ID NO: 2290433 - RNA, 17 nt, Yersinia pestis KIM
gacgacauccacauuga

SEQ ID NO: 2290434 - RNA, 14 nt, Yersinia pestis KIM
gacgaccaauauca

SEQ ID NO: 2290435 - RNA, 21 nt, Yersinia pestis KIM
gaagcaaggggcggaaaugcc

SEQ ID NO: 2290436 - RNA, 16 nt, Yersinia pestis KIM
gaacuucgaaagaaau

SEQ ID NO: 2290437 - RNA, 17 nt, Yersinia pestis KIM
gaagacagauccugccg

SEQ ID NO: 2290438 - RNA, 16 nt, Yersinia pestis KIM
gaagaccagauaaucg

SEQ ID NO: 2290439 - RNA, 22 nt, Yersinia pestis KIM
gaacgaggcccgauaaacugac

SEQ ID NO: 2290440 - RNA, 13 nt, Yersinia pestis KIM
gaaacgcaauuuu

SEQ ID NO: 2290441 - RNA, 18 nt, Yersinia pestis KIM
gaaguacaguaccugcua

SEQ ID NO: 2290442 - RNA, 19 nt, Yersinia pestis KIM
gaaguacuuauuugaaaca

SEQ ID NO: 2290443 - RNA, 15 nt, Yersinia pestis KIM
gaauauaauuucaag

SEQ ID NO: 2290444 - RNA, 13 nt, Yersinia pestis KIM
gaauaucaggcac

SEQ ID NO: 2290445 - RNA, 19 nt, Yersinia pestis KIM
gaauagcgcugcaucagca

SEQ ID NO: 2290446 - RNA, 16 nt, Yersinia pestis KIM
gaauagcgcugcauca

SEQ ID NO: 2290447 - RNA, 17 nt, Yersinia pestis KIM
gaccaaauagcaagcca

SEQ ID NO: 2290448 - RNA, 13 nt, Yersinia pestis KIM
gaccaaacauugu

SEQ ID NO: 2290449 - RNA, 16 nt, Yersinia pestis KIM
gacauugcccgccaga

SEQ ID NO: 2290450 - RNA, 22 nt, Yersinia pestis KIM
gacauugcgcaagccccuauaa

SEQ ID NO: 2290451 - RNA, 20 nt, Yersinia pestis KIM
gaccaauauaaaagccagca

SEQ ID NO: 2290452 - RNA, 22 nt, Yersinia pestis KIM
gacauucucuacucgcucacca

SEQ ID NO: 2290453 - RNA, 17 nt, Yersinia pestis KIM
gacaggauaaucaucag

SEQ ID NO: 2290454 - RNA, 14 nt, Yersinia pestis KIM
gacauaaaccgcau

SEQ ID NO: 2290455 - RNA, 18 nt, Yersinia pestis KIM
gacagaaaaaucacaugc

SEQ ID NO: 2290456 - RNA, 20 nt, Yersinia pestis KIM
gacacuuauuggucgcuuuu

SEQ ID NO: 2290457 - RNA, 13 nt, Yersinia pestis KIM
gacaaccaauaca

SEQ ID NO: 2290458 - RNA, 12 nt, Yersinia pestis KIM
cugcgauaaucu

SEQ ID NO: 2290459 - RNA, 19 nt, Yersinia pestis KIM
cugcugacaaaccccgaug

SEQ ID NO: 2290460 - RNA, 12 nt, Yersinia pestis KIM
cugcuccagcca

SEQ ID NO: 2290461 - RNA, 17 nt, Yersinia pestis KIM
cugcuaguauuaucgcu

SEQ ID NO: 2290462 - RNA, 17 nt, Yersinia pestis KIM
cugcguacggacgguaa

SEQ ID NO: 2290463 - RNA, 21 nt, Yersinia pestis KIM
cuggcgcugaucaucaucaau

SEQ ID NO: 2290464 - RNA, 19 nt, Yersinia pestis KIM
cugcuugcgcgccuguuua

SEQ ID NO: 2290465 - RNA, 19 nt, Yersinia pestis KIM
cugcuguggguucaucaac

SEQ ID NO: 2290466 - RNA, 18 nt, Yersinia pestis KIM
cuggcaaaguuauugacc

SEQ ID NO: 2290467 - RNA, 19 nt, Yersinia pestis KIM
cuggcauacaguuuugccg

SEQ ID NO: 2290468 - RNA, 13 nt, Yersinia pestis KIM
cuugauuugcccg

SEQ ID NO: 2290469 - RNA, 15 nt, Yersinia pestis KIM
cuugauuugcccgau

SEQ ID NO: 2290470 - RNA, 16 nt, Yersinia pestis KIM
cuuggagccagccauu

SEQ ID NO: 2290471 - RNA, 16 nt, Yersinia pestis KIM
gaaaaacacuggcagc

SEQ ID NO: 2290472 - RNA, 23 nt, Yersinia pestis KIM
gaaaaccaauucaguuuuucccg

SEQ ID NO: 2290473 - RNA, 15 nt, Yersinia pestis KIM
gaaaaguagccaaua

SEQ ID NO: 2290474 - RNA, 21 nt, Yersinia pestis KIM
gaaaaucuuuuuguaauguuu

SEQ ID NO: 2290475 - RNA, 23 nt, Yersinia pestis KIM
cuuucauaucaaaaggauaaccu

SEQ ID NO: 2290476 - RNA, 16 nt, Yersinia pestis KIM
cuuucuuaauaauauc

SEQ ID NO: 2290477 - RNA, 19 nt, Yersinia pestis KIM
cuucauguuuaucaaacag

SEQ ID NO: 2290478 - RNA, 22 nt, Yersinia pestis KIM
cuuccgccaguugcucacggug

SEQ ID NO: 2290479 - RNA, 21 nt, Yersinia pestis KIM
cuucucgaugccuucuuucaa

SEQ ID NO: 2290480 - RNA, 22 nt, Yersinia pestis KIM
cuucuucgcuaucgagauuacg

SEQ ID NO: 2290481 - RNA, 20 nt, Yersinia pestis KIM
cuguguuuugagcaucacuu

SEQ ID NO: 2290482 - RNA, 21 nt, Yersinia pestis KIM
cuguguaacugccaccguauu

SEQ ID NO: 2290483 - RNA, 20 nt, Yersinia pestis KIM
cugugguuggcagcucagca

SEQ ID NO: 2290484 - RNA, 16 nt, Yersinia pestis KIM
cugugauuugcccggu

SEQ ID NO: 2290485 - RNA, 20 nt, Yersinia pestis KIM
cugucaaucgaugagcuggu

SEQ ID NO: 2290486 - RNA, 13 nt, Yersinia pestis KIM
cuuaacugaaagc

SEQ ID NO: 2290487 - RNA, 15 nt, Yersinia pestis KIM
cuuaacugcauagcu

SEQ ID NO: 2290488 - RNA, 17 nt, Yersinia pestis KIM
cuuaccuugauccgcca

SEQ ID NO: 2290489 - RNA, 21 nt, Yersinia pestis KIM
cuuaccuuguuuguuacugcu

SEQ ID NO: 2290490 - RNA, 17 nt, Yersinia pestis KIM
cuguuguggcagcguuu

SEQ ID NO: 2290491 - RNA, 15 nt, Yersinia pestis KIM
cuucaagcacccauu

SEQ ID NO: 2290492 - RNA, 13 nt, Yersinia pestis KIM
cgucugauaaccg

SEQ ID NO: 2290493 - RNA, 17 nt, Yersinia pestis KIM
cgucuuggauauuugaa

SEQ ID NO: 2290494 - RNA, 13 nt, Yersinia pestis KIM
cgugaucgccgua

SEQ ID NO: 2290495 - RNA, 20 nt, Yersinia pestis KIM
cgugaacauugcaguauuuu

SEQ ID NO: 2290496 - RNA, 15 nt, Yersinia pestis KIM
cgucuuuacgaucug

SEQ ID NO: 2290497 - RNA, 17 nt, Yersinia pestis KIM
cgugacgcucgcugcug

SEQ ID NO: 2290498 - RNA, 13 nt, Yersinia pestis KIM
cgugccguucagg

SEQ ID NO: 2290499 - RNA, 18 nt, Yersinia pestis KIM
cguccgcuuagcaggccc

SEQ ID NO: 2290500 - RNA, 17 nt, Yersinia pestis KIM
cggugagcacgauuacc

SEQ ID NO: 2290501 - RNA, 16 nt, Yersinia pestis KIM
cggugcugauguuguc

SEQ ID NO: 2290502 - RNA, 15 nt, Yersinia pestis KIM
cguagauuuucucag

SEQ ID NO: 2290503 - RNA, 18 nt, Yersinia pestis KIM
cguagacaaugacugugc

SEQ ID NO: 2290504 - RNA, 22 nt, Yersinia pestis KIM
cguagcccuuugcuuucaggau

SEQ ID NO: 2290505 - RNA, 19 nt, Yersinia pestis KIM
cgucacggcgcuccaucag

SEQ ID NO: 2290506 - RNA, 14 nt, Yersinia pestis KIM
cgucacuaaaucca

SEQ ID NO: 2290507 - RNA, 18 nt, Yersinia pestis KIM
cgucaagacaacaaacag

SEQ ID NO: 2290508 - RNA, 15 nt, Yersinia pestis KIM
cguaucuucugccag

SEQ ID NO: 2290509 - RNA, 18 nt, Yersinia pestis KIM
cguauccuuacuuugcga

SEQ ID NO: 2290510 - RNA, 20 nt, Yersinia pestis KIM
cgguucccacggauuaacuu

SEQ ID NO: 2290511 - RNA, 14 nt, Yersinia pestis KIM
cgguuaaugccagc

SEQ ID NO: 2290512 - RNA, 20 nt, Yersinia pestis KIM
cgguguaaagcgcccgccag

SEQ ID NO: 2290513 - RNA, 24 nt, Yersinia pestis KIM
cgguucuguaucauauguucgauc

SEQ ID NO: 2290514 - RNA, 19 nt, Yersinia pestis KIM
cgguuugagcuugcugcug

SEQ ID NO: 2290515 - RNA, 13 nt, Yersinia pestis KIM
cgguuugccauca

SEQ ID NO: 2290516 - RNA, 18 nt, Yersinia pestis KIM
cgguuucgcaucaggcuu

SEQ ID NO: 2290517 - RNA, 15 nt, Yersinia pestis KIM
cguaauuuacuggua

SEQ ID NO: 2290518 - RNA, 17 nt, Yersinia pestis KIM
cguaauuauuguucaaa

SEQ ID NO: 2290519 - RNA, 22 nt, Yersinia pestis KIM
cguaaucguauucucaauggcu

SEQ ID NO: 2290520 - RNA, 15 nt, Yersinia pestis KIM
cguaaucaccauuaa

SEQ ID NO: 2290521 - RNA, 15 nt, Yersinia pestis KIM
cgguuuuaucaauag

SEQ ID NO: 2290522 - RNA, 17 nt, Yersinia pestis KIM
cucggucugauuggcac

SEQ ID NO: 2290523 - RNA, 16 nt, Yersinia pestis KIM
cucuguggauugccaa

SEQ ID NO: 2290524 - RNA, 15 nt, Yersinia pestis KIM
cucuuaguuucuacg

SEQ ID NO: 2290525 - RNA, 19 nt, Yersinia pestis KIM
cucuggcgcggacguuuua

SEQ ID NO: 2290526 - RNA, 15 nt, Yersinia pestis KIM
cucucugcugcgaau

SEQ ID NO: 2290527 - RNA, 14 nt, Yersinia pestis KIM
cucguuaucuguaa

SEQ ID NO: 2290528 - RNA, 22 nt, Yersinia pestis KIM
cucgugcuuuuugcgacaggcu

SEQ ID NO: 2290529 - RNA, 20 nt, Yersinia pestis KIM
cugcaaugcccagagcgcgg

SEQ ID NO: 2290530 - RNA, 20 nt, Yersinia pestis KIM
cugauucgcgaccagcagaa

SEQ ID NO: 2290531 - RNA, 23 nt, Yersinia pestis KIM
cugauuuuuucgaguaguuuggc

SEQ ID NO: 2290532 - RNA, 14 nt, Yersinia pestis KIM
cugauaccgauaug

SEQ ID NO: 2290533 - RNA, 19 nt, Yersinia pestis KIM
cugaggcagaauggugcca

SEQ ID NO: 2290534 - RNA, 14 nt, Yersinia pestis KIM
cugagucagucagg

SEQ ID NO: 2290535 - RNA, 15 nt, Yersinia pestis KIM
cugacgaaaugccgc

SEQ ID NO: 2290536 - RNA, 19 nt, Yersinia pestis KIM
cugacgcacagcacgguaa

SEQ ID NO: 2290537 - RNA, 22 nt, Yersinia pestis KIM
cuccgucgcgggcacuuuguca

SEQ ID NO: 2290538 - RNA, 17 nt, Yersinia pestis KIM
cuccguugcaggcacuu

SEQ ID NO: 2290539 - RNA, 21 nt, Yersinia pestis KIM
cucgaauaaacggauuugucu

SEQ ID NO: 2290540 - RNA, 16 nt, Yersinia pestis KIM
cucgcgccugaaauca

SEQ ID NO: 2290541 - RNA, 14 nt, Yersinia pestis KIM
cucggcgucagccg

SEQ ID NO: 2290542 - RNA, 15 nt, Yersinia pestis KIM
cguuccucuugagcg

SEQ ID NO: 2290543 - RNA, 20 nt, Yersinia pestis KIM
cguuggcagaaagugaccca

SEQ ID NO: 2290544 - RNA, 16 nt, Yersinia pestis KIM
cguugccccaucagca

SEQ ID NO: 2290545 - RNA, 17 nt, Yersinia pestis KIM
cguugccccaucagcac

SEQ ID NO: 2290546 - RNA, 22 nt, Yersinia pestis KIM
cguuuaaauaagcuaucauuaa

SEQ ID NO: 2290547 - RNA, 20 nt, Yersinia pestis KIM
cguuguuuucccucagccaa

SEQ ID NO: 2290548 - RNA, 18 nt, Yersinia pestis KIM
cguuucaguaaaaccagc

SEQ ID NO: 2290549 - RNA, 21 nt, Yersinia pestis KIM
cguuucagauaaaaagccagu

SEQ ID NO: 2290550 - RNA, 22 nt, Yersinia pestis KIM
cguuucccgauggaacaggauu

SEQ ID NO: 2290551 - RNA, 15 nt, Yersinia pestis KIM
cguuuccagcggcgu

SEQ ID NO: 2290552 - RNA, 21 nt, Yersinia pestis KIM
cguuuccgguaaugucacguu

SEQ ID NO: 2290553 - RNA, 19 nt, Yersinia pestis KIM
cguuuugcagaucaaucgc

SEQ ID NO: 2290554 - RNA, 14 nt, Yersinia pestis KIM
cguuuugcaucaac

SEQ ID NO: 2290555 - RNA, 17 nt, Yersinia pestis KIM
cguuuuuuuaucaaugg

SEQ ID NO: 2290556 - RNA, 23 nt, Yersinia pestis KIM
cuaaaguguacuguuaacucaug

SEQ ID NO: 2290557 - RNA, 17 nt, Yersinia pestis KIM
cuaaagggcugagcgga

SEQ ID NO: 2290558 - RNA, 17 nt, Yersinia pestis KIM
cuaacauugagcggcga

SEQ ID NO: 2290559 - RNA, 21 nt, Yersinia pestis KIM
cuaacauacucagaucguuaa

SEQ ID NO: 2290560 - RNA, 21 nt, Yersinia pestis KIM
cuaaacccaaccccaucagca

SEQ ID NO: 2290561 - RNA, 18 nt, Yersinia pestis KIM
cucaucagaggcucaucc

SEQ ID NO: 2290562 - RNA, 20 nt, Yersinia pestis KIM
cuccaguugcacaccaucag

SEQ ID NO: 2290563 - RNA, 21 nt, Yersinia pestis KIM
cucagauuuucguucggugca

SEQ ID NO: 2290564 - RNA, 19 nt, Yersinia pestis KIM
cucagcaagguucucgcug

SEQ ID NO: 2290565 - RNA, 19 nt, Yersinia pestis KIM
cucacuuuuauauccgcca

SEQ ID NO: 2290566 - RNA, 14 nt, Yersinia pestis KIM
cuauuuccgaaagc

SEQ ID NO: 2290567 - RNA, 21 nt, Yersinia pestis KIM
cuauugauguuaacucagcca

SEQ ID NO: 2290568 - RNA, 14 nt, Yersinia pestis KIM
cuauucugccuauc

SEQ ID NO: 2290569 - RNA, 20 nt, Yersinia pestis KIM
cucacccaauaagauaaaca

SEQ ID NO: 2290570 - RNA, 19 nt, Yersinia pestis KIM
cuacgcuggcgcaucccca

SEQ ID NO: 2290571 - RNA, 14 nt, Yersinia pestis KIM
cuagcucacggaag

SEQ ID NO: 2290572 - RNA, 16 nt, Yersinia pestis KIM
cuaucggguaacggcu

SEQ ID NO: 2290573 - RNA, 19 nt, Yersinia pestis KIM
cuauccgcgccgagcgcua

SEQ ID NO: 2290574 - RNA, 19 nt, Yersinia pestis KIM
cuacccgacaccggcugau

SEQ ID NO: 2290575 - RNA, 14 nt, Yersinia pestis KIM
cuacaaucaucggc

SEQ ID NO: 2290576 - RNA, 14 nt, Yersinia pestis KIM
cuaaugcgagugcc

SEQ ID NO: 2290577 - RNA, 16 nt, Yersinia pestis KIM
cuaauaauaaucuuaa

SEQ ID NO: 2290578 - RNA, 21 nt, Yersinia pestis KIM
cuaauaauaaugcgccuugcu

SEQ ID NO: 2290579 - RNA, 18 nt, Yersinia pestis KIM
cuaauacggguuucugcu

SEQ ID NO: 2290580 - RNA, 18 nt, Yersinia pestis KIM
cuaacguccccugagcga

SEQ ID NO: 2290581 - RNA, 21 nt, Yersinia pestis KIM
gcccaucuaugggcuucgcca

SEQ ID NO: 2290582 - RNA, 16 nt, Yersinia pestis KIM
gcccagcgguaaauug

SEQ ID NO: 2290583 - RNA, 21 nt, Yersinia pestis KIM
gcccgcaauuuuaaaggcaac

SEQ ID NO: 2290584 - RNA, 14 nt, Yersinia pestis KIM
gccauaacaucguu

SEQ ID NO: 2290585 - RNA, 13 nt, Yersinia pestis KIM
gccauaacgcaca

SEQ ID NO: 2290586 - RNA, 14 nt, Yersinia pestis KIM
gccauaccaggcca

SEQ ID NO: 2290587 - RNA, 22 nt, Yersinia pestis KIM
gccauacccaaaccaacaauau

SEQ ID NO: 2290588 - RNA, 22 nt, Yersinia pestis KIM
gccaugccugcgaauuaucauc

SEQ ID NO: 2290589 - RNA, 15 nt, Yersinia pestis KIM
gccaguaaaccuggc

SEQ ID NO: 2290590 - RNA, 18 nt, Yersinia pestis KIM
gccagugugugguauuca

SEQ ID NO: 2290591 - RNA, 12 nt, Yersinia pestis KIM
gccaguucauca

SEQ ID NO: 2290592 - RNA, 19 nt, Yersinia pestis KIM
gccaguucuggaucggcau

SEQ ID NO: 2290593 - RNA, 19 nt, Yersinia pestis KIM
gccaguugccacucauauu

SEQ ID NO: 2290594 - RNA, 15 nt, Yersinia pestis KIM
gcccacgaggacagg

SEQ ID NO: 2290595 - RNA, 14 nt, Yersinia pestis KIM
gcccagauauccau

SEQ ID NO: 2290596 - RNA, 22 nt, Yersinia pestis KIM
gccacgaauggcgacuaauggc

SEQ ID NO: 2290597 - RNA, 13 nt, Yersinia pestis KIM
gccagcugcaauu

SEQ ID NO: 2290598 - RNA, 23 nt, Yersinia pestis KIM
gccaccagauuacgcgucaucau

SEQ ID NO: 2290599 - RNA, 13 nt, Yersinia pestis KIM
gccaagcuaacgc

SEQ ID NO: 2290600 - RNA, 18 nt, Yersinia pestis KIM
gccaauaccggugguuua

SEQ ID NO: 2290601 - RNA, 18 nt, Yersinia pestis KIM
gcauccuccugaucuuca

SEQ ID NO: 2290602 - RNA, 16 nt, Yersinia pestis KIM
gcauccccaucgccaa

SEQ ID NO: 2290603 - RNA, 19 nt, Yersinia pestis KIM
gcauccagcucauauaauc

SEQ ID NO: 2290604 - RNA, 21 nt, Yersinia pestis KIM
gccaacucagcggccugggua

SEQ ID NO: 2290605 - RNA, 20 nt, Yersinia pestis KIM
gccaauggccacugcgggca

SEQ ID NO: 2290606 - RNA, 14 nt, Yersinia pestis KIM
gccaaugcugcugu

SEQ ID NO: 2290607 - RNA, 19 nt, Yersinia pestis KIM
gccaaugcuuuuugcaucg

SEQ ID NO: 2290608 - RNA, 13 nt, Yersinia pestis KIM
gccaauugcaucg

SEQ ID NO: 2290609 - RNA, 12 nt, Yersinia pestis KIM
gccaaucgcucu

SEQ ID NO: 2290610 - RNA, 13 nt, Yersinia pestis KIM
gccacacaauaca

SEQ ID NO: 2290611 - RNA, 16 nt, Yersinia pestis KIM
gccgcuaguuugacgc

SEQ ID NO: 2290612 - RNA, 23 nt, Yersinia pestis KIM
gccggccauucagcguauagccu

SEQ ID NO: 2290613 - RNA, 17 nt, Yersinia pestis KIM
gccgaggugaagacacc

SEQ ID NO: 2290614 - RNA, 23 nt, Yersinia pestis KIM
gccgacugauuaaccaagcucgc

SEQ ID NO: 2290615 - RNA, 22 nt, Yersinia pestis KIM
gcccucguuguuguaugacaag

SEQ ID NO: 2290616 - RNA, 13 nt, Yersinia pestis KIM
gcccucuugaacg

SEQ ID NO: 2290617 - RNA, 16 nt, Yersinia pestis KIM
gcccugaauuucaaua

SEQ ID NO: 2290618 - RNA, 14 nt, Yersinia pestis KIM
gcccgucaauauca

SEQ ID NO: 2290619 - RNA, 16 nt, Yersinia pestis KIM
gcccgucaauaucauc

SEQ ID NO: 2290620 - RNA, 16 nt, Yersinia pestis KIM
gcccuucccauuuaug

SEQ ID NO: 2290621 - RNA, 21 nt, Yersinia pestis KIM
gcccuguaaagccaguaaacg

SEQ ID NO: 2290622 - RNA, 16 nt, Yersinia pestis KIM
gccgaaccccuagcca

SEQ ID NO: 2290623 - RNA, 14 nt, Yersinia pestis KIM
gauccauaggaucc

SEQ ID NO: 2290624 - RNA, 15 nt, Yersinia pestis KIM
gaucucaucauugac

SEQ ID NO: 2290625 - RNA, 22 nt, Yersinia pestis KIM
gaugaaaaacugugcaaauggc

SEQ ID NO: 2290626 - RNA, 19 nt, Yersinia pestis KIM
gaugaucaccgccugcgua

SEQ ID NO: 2290627 - RNA, 21 nt, Yersinia pestis KIM
gaugaguauuaccucaucauu

SEQ ID NO: 2290628 - RNA, 23 nt, Yersinia pestis KIM
gaugagaaugugacucagcgaau

SEQ ID NO: 2290629 - RNA, 18 nt, Yersinia pestis KIM
gaugauugaggcguacca

SEQ ID NO: 2290630 - RNA, 13 nt, Yersinia pestis KIM
gaugcguguaaug

SEQ ID NO: 2290631 - RNA, 17 nt, Yersinia pestis KIM
gaugccaaauuaaucuu

SEQ ID NO: 2290632 - RNA, 13 nt, Yersinia pestis KIM
gaugcccgcauua

SEQ ID NO: 2290633 - RNA, 15 nt, Yersinia pestis KIM
gauuaagccaugggu

SEQ ID NO: 2290634 - RNA, 15 nt, Yersinia pestis KIM
gcaaaaauugacgaa

SEQ ID NO: 2290635 - RNA, 13 nt, Yersinia pestis KIM
gcaaaagcgauca

SEQ ID NO: 2290636 - RNA, 17 nt, Yersinia pestis KIM
gagccagccauucugaa

SEQ ID NO: 2290637 - RNA, 12 nt, Yersinia pestis KIM
gagcuaaugcuc

SEQ ID NO: 2290638 - RNA, 20 nt, Yersinia pestis KIM
gaguagcaggccgacaauac

SEQ ID NO: 2290639 - RNA, 20 nt, Yersinia pestis KIM
gagucagggagucagggagu

SEQ ID NO: 2290640 - RNA, 13 nt, Yersinia pestis KIM
gagcuguuauagc

SEQ ID NO: 2290641 - RNA, 21 nt, Yersinia pestis KIM
gaggaagagauaaacgaccau

SEQ ID NO: 2290642 - RNA, 19 nt, Yersinia pestis KIM
gauaauuugccuggcgaau

SEQ ID NO: 2290643 - RNA, 17 nt, Yersinia pestis KIM
gauacuacaaucaucgg

SEQ ID NO: 2290644 - RNA, 17 nt, Yersinia pestis KIM
gauacggucaucgccgc

SEQ ID NO: 2290645 - RNA, 13 nt, Yersinia pestis KIM
gauaucugaauca

SEQ ID NO: 2290646 - RNA, 19 nt, Yersinia pestis KIM
gauaaccguuuuuucaacu

SEQ ID NO: 2290647 - RNA, 17 nt, Yersinia pestis KIM
gauaacgguaucaguca

SEQ ID NO: 2290648 - RNA, 18 nt, Yersinia pestis KIM
gauaacuccaggguaaua

SEQ ID NO: 2290649 - RNA, 21 nt, Yersinia pestis KIM
gauaacguuguuucugaaggg

SEQ ID NO: 2290650 - RNA, 16 nt, Yersinia pestis KIM
gauaacccuaucguca

SEQ ID NO: 2290651 - RNA, 23 nt, Yersinia pestis KIM
gauaacaccggcuucuccugcgg

SEQ ID NO: 2290652 - RNA, 21 nt, Yersinia pestis KIM
gauaacauuauugaacgcuug

SEQ ID NO: 2290653 - RNA, 23 nt, Yersinia pestis KIM
gauaagaaucuugggaucagcca

SEQ ID NO: 2290654 - RNA, 19 nt, Yersinia pestis KIM
gauaauuaaugcaccuaca

SEQ ID NO: 2290655 - RNA, 23 nt, Yersinia pestis KIM
gauaauuauccauuuucugccaa

SEQ ID NO: 2290656 - RNA, 19 nt, Yersinia pestis KIM
gauaauaaauauccuccgg

SEQ ID NO: 2290657 - RNA, 24 nt, Yersinia pestis KIM
gcagcagugcgguucaagccgaua

SEQ ID NO: 2290658 - RNA, 12 nt, Yersinia pestis KIM
gcagaggaguaa

SEQ ID NO: 2290659 - RNA, 16 nt, Yersinia pestis KIM
gcacucgcaagacgau

SEQ ID NO: 2290660 - RNA, 20 nt, Yersinia pestis KIM
gcagauacucggcaaaggcu

SEQ ID NO: 2290661 - RNA, 21 nt, Yersinia pestis KIM
gcagaucguaaagacgccgua

SEQ ID NO: 2290662 - RNA, 14 nt, Yersinia pestis KIM
gcagcgcgcagcca

SEQ ID NO: 2290663 - RNA, 13 nt, Yersinia pestis KIM
gcaggauuucccg

SEQ ID NO: 2290664 - RNA, 21 nt, Yersinia pestis KIM
gcagcuuuugugcaggaguaa

SEQ ID NO: 2290665 - RNA, 17 nt, Yersinia pestis KIM
gcagcuuggcgucugac

SEQ ID NO: 2290666 - RNA, 16 nt, Yersinia pestis KIM
gcauccacugcggcca

SEQ ID NO: 2290667 - RNA, 17 nt, Yersinia pestis KIM
gcaucauuaagaugcau

SEQ ID NO: 2290668 - RNA, 16 nt, Yersinia pestis KIM
gcaucauccagcucaa

SEQ ID NO: 2290669 - RNA, 11 nt, Yersinia pestis KIM
gcaucagccag

SEQ ID NO: 2290670 - RNA, 20 nt, Yersinia pestis KIM
gcaguacucggcauugccag

SEQ ID NO: 2290671 - RNA, 20 nt, Yersinia pestis KIM
gcaggggguuagcugcaagc

SEQ ID NO: 2290672 - RNA, 14 nt, Yersinia pestis KIM
gcaccgcugauaac

SEQ ID NO: 2290673 - RNA, 20 nt, Yersinia pestis KIM
gcaccucugcugaugucagu

SEQ ID NO: 2290674 - RNA, 20 nt, Yersinia pestis KIM
gcaccucuuccggcguacca

SEQ ID NO: 2290675 - RNA, 11 nt, Yersinia pestis KIM
gcaccagcgca

SEQ ID NO: 2290676 - RNA, 17 nt, Yersinia pestis KIM
gcaccauaaccaaucca

SEQ ID NO: 2290677 - RNA, 15 nt, Yersinia pestis KIM
gcaccauuugcccug

SEQ ID NO: 2290678 - RNA, 23 nt, Yersinia pestis KIM
gcacaugccgucaccucaucagu

SEQ ID NO: 2290679 - RNA, 17 nt, Yersinia pestis KIM
gcaccaaauucagaaug

SEQ ID NO: 2290680 - RNA, 20 nt, Yersinia pestis KIM
gcaccaaucauuacaucauc

SEQ ID NO: 2290681 - RNA, 20 nt, Yersinia pestis KIM
gcaauuugcuugaaguacgg

SEQ ID NO: 2290682 - RNA, 20 nt, Yersinia pestis KIM
gcaauggcucaggcucauca

SEQ ID NO: 2290683 - RNA, 19 nt, Yersinia pestis KIM
gcaauacaccgccaguaug

SEQ ID NO: 2290684 - RNA, 21 nt, Yersinia pestis KIM
gcaauaugaaggccauaaucu

SEQ ID NO: 2290685 - RNA, 23 nt, Yersinia pestis KIM
cacgauuaccugcauauccuccc

SEQ ID NO: 2290686 - RNA, 21 nt, Yersinia pestis KIM
cacgaggaaaacgccagcaga

SEQ ID NO: 2290687 - RNA, 13 nt, Yersinia pestis KIM
cacgaggacaggu

SEQ ID NO: 2290688 - RNA, 18 nt, Yersinia pestis KIM
cacgcauuccaucagcca

SEQ ID NO: 2290689 - RNA, 14 nt, Yersinia pestis KIM
cacgcaugacggug

SEQ ID NO: 2290690 - RNA, 17 nt, Yersinia pestis KIM
cacgcauuucuugcucg

SEQ ID NO: 2290691 - RNA, 16 nt, Yersinia pestis KIM
caccucuugcauacuc

SEQ ID NO: 2290692 - RNA, 15 nt, Yersinia pestis KIM
caccucgcucaggcg

SEQ ID NO: 2290693 - RNA, 17 nt, Yersinia pestis KIM
cacucuugaacggugag

SEQ ID NO: 2290694 - RNA, 20 nt, Yersinia pestis KIM
cacugaaaguguauuucuca

SEQ ID NO: 2290695 - RNA, 14 nt, Yersinia pestis KIM
cacucgcaucgccu

SEQ ID NO: 2290696 - RNA, 17 nt, Yersinia pestis KIM
cacgucuucaccaauga

SEQ ID NO: 2290697 - RNA, 13 nt, Yersinia pestis KIM
cacugcaucaucg

SEQ ID NO: 2290698 - RNA, 17 nt, Yersinia pestis KIM
cacuguuuuucauuacg

SEQ ID NO: 2290699 - RNA, 18 nt, Yersinia pestis KIM
cacuguuuuuccagcccu

SEQ ID NO: 2290700 - RNA, 18 nt, Yersinia pestis KIM
cagaagggcggccagcaa

SEQ ID NO: 2290701 - RNA, 14 nt, Yersinia pestis KIM
cagaagguaagcca

SEQ ID NO: 2290702 - RNA, 21 nt, Yersinia pestis KIM
cacuuugucaauaaccucaaa

SEQ ID NO: 2290703 - RNA, 23 nt, Yersinia pestis KIM
cacuuugucaauaaccucagccu

SEQ ID NO: 2290704 - RNA, 21 nt, Yersinia pestis KIM
cacuuuuauauccgccauccu

SEQ ID NO: 2290705 - RNA, 21 nt, Yersinia pestis KIM
cacggcgaguaggucucgccg

SEQ ID NO: 2290706 - RNA, 20 nt, Yersinia pestis KIM
cagccucauacaagccguga

SEQ ID NO: 2290707 - RNA, 16 nt, Yersinia pestis KIM
cagcgacuccuggcaa

SEQ ID NO: 2290708 - RNA, 14 nt, Yersinia pestis KIM
cagcccuccagccg

SEQ ID NO: 2290709 - RNA, 19 nt, Yersinia pestis KIM
cagccccaaacacuuagca

SEQ ID NO: 2290710 - RNA, 23 nt, Yersinia pestis KIM
cagcagcuuuugugcaggaguaa

SEQ ID NO: 2290711 - RNA, 14 nt, Yersinia pestis KIM
cagcaggaauaccc

SEQ ID NO: 2290712 - RNA, 16 nt, Yersinia pestis KIM
cagcaucaguagcauc

SEQ ID NO: 2290713 - RNA, 14 nt, Yersinia pestis KIM
cagccagacgagua

SEQ ID NO: 2290714 - RNA, 21 nt, Yersinia pestis KIM
cagaauacguagcccuuugcu

SEQ ID NO: 2290715 - RNA, 16 nt, Yersinia pestis KIM
cagaauaguggguaaa

SEQ ID NO: 2290716 - RNA, 18 nt, Yersinia pestis KIM
cagaauggugccauacag

SEQ ID NO: 2290717 - RNA, 19 nt, Yersinia pestis KIM
cagaaugaaaggcggugaa

SEQ ID NO: 2290718 - RNA, 17 nt, Yersinia pestis KIM
cagauauuacgcagcca

SEQ ID NO: 2290719 - RNA, 12 nt, Yersinia pestis KIM
cagauauggcau

SEQ ID NO: 2290720 - RNA, 17 nt, Yersinia pestis KIM
cagcgucucguguaaca

SEQ ID NO: 2290721 - RNA, 21 nt, Yersinia pestis KIM
cagcggcguaacauauccugu

SEQ ID NO: 2290722 - RNA, 12 nt, Yersinia pestis KIM
cagcggcgauua

SEQ ID NO: 2290723 - RNA, 12 nt, Yersinia pestis KIM
cagcggcaaaua

SEQ ID NO: 2290724 - RNA, 23 nt, Yersinia pestis KIM
caggccuaucucgcgucgcguac

SEQ ID NO: 2290725 - RNA, 14 nt, Yersinia pestis KIM
caggccaaagcugu

SEQ ID NO: 2290726 - RNA, 18 nt, Yersinia pestis KIM
caggcccugguugcagca

SEQ ID NO: 2290727 - RNA, 22 nt, Yersinia pestis KIM
caggaucaggccagagacaccg

SEQ ID NO: 2290728 - RNA, 19 nt, Yersinia pestis KIM
cagcuuguugauaucaauc

SEQ ID NO: 2290729 - RNA, 20 nt, Yersinia pestis KIM
cagggcgauagcccuacugg

SEQ ID NO: 2290730 - RNA, 12 nt, Yersinia pestis KIM
cagggccacuuc

SEQ ID NO: 2290731 - RNA, 13 nt, Yersinia pestis KIM
caggggguuaucc

SEQ ID NO: 2290732 - RNA, 19 nt, Yersinia pestis KIM
cagguaccccauaaauccc

SEQ ID NO: 2290733 - RNA, 13 nt, Yersinia pestis KIM
cagguaaauccuu

SEQ ID NO: 2290734 - RNA, 20 nt, Yersinia pestis KIM
cagggugaaagcccaacuga

SEQ ID NO: 2290735 - RNA, 20 nt, Yersinia pestis KIM
cagguauucuccaguuggcg

SEQ ID NO: 2290736 - RNA, 15 nt, Yersinia pestis KIM
cagguaguuacagca

SEQ ID NO: 2290737 - RNA, 21 nt, Yersinia pestis KIM
cagguaguucauuuugaccag

SEQ ID NO: 2290738 - RNA, 17 nt, Yersinia pestis KIM
caggugggcauaccggu

SEQ ID NO: 2290739 - RNA, 14 nt, Yersinia pestis KIM
caguaccgcuggug

SEQ ID NO: 2290740 - RNA, 19 nt, Yersinia pestis KIM
caguagaagcuaccagcac

SEQ ID NO: 2290741 - RNA, 18 nt, Yersinia pestis KIM
cagucauccaaacggaau

SEQ ID NO: 2290742 - RNA, 15 nt, Yersinia pestis KIM
caguucaguauuggu

SEQ ID NO: 2290743 - RNA, 14 nt, Yersinia pestis KIM
caguuggccaccau

SEQ ID NO: 2290744 - RNA, 19 nt, Yersinia pestis KIM
cagugccugacgcggugac

SEQ ID NO: 2290745 - RNA, 22 nt, Yersinia pestis KIM
caguuuauuuucccuuucucag

SEQ ID NO: 2290746 - RNA, 16 nt, Yersinia pestis KIM
cauaagacaacgccgc

SEQ ID NO: 2290747 - RNA, 17 nt, Yersinia pestis KIM
cauaacugaauacuuug

SEQ ID NO: 2290748 - RNA, 22 nt, Yersinia pestis KIM
cauacuguugugggaucuuggc

SEQ ID NO: 2290749 - RNA, 19 nt, Yersinia pestis KIM
cauacuccgcugagcauau

SEQ ID NO: 2290750 - RNA, 17 nt, Yersinia pestis KIM
cauauaaaccagccagu

SEQ ID NO: 2290751 - RNA, 19 nt, Yersinia pestis KIM
cauccgcaaaauggguaua

SEQ ID NO: 2290752 - RNA, 21 nt, Yersinia pestis KIM
caucccuucgcaaaaugccaa

SEQ ID NO: 2290753 - RNA, 12 nt, Yersinia pestis KIM
caucagauagau

SEQ ID NO: 2290754 - RNA, 15 nt, Yersinia pestis KIM
caucaucuucuucau

SEQ ID NO: 2290755 - RNA, 21 nt, Yersinia pestis KIM
caucaucgguaccgccagaau

SEQ ID NO: 2290756 - RNA, 23 nt, Yersinia pestis KIM
caucacccgcgagcgaccuugau

SEQ ID NO: 2290757 - RNA, 16 nt, Yersinia pestis KIM
caucacaucggcgacu

SEQ ID NO: 2290758 - RNA, 19 nt, Yersinia pestis KIM
caucaccaaagauauguuc

SEQ ID NO: 2290759 - RNA, 20 nt, Yersinia pestis KIM
caucaccaaagauauguucu

SEQ ID NO: 2290760 - RNA, 18 nt, Yersinia pestis KIM
caucaaaucagaggcuuc

SEQ ID NO: 2290761 - RNA, 22 nt, Yersinia pestis KIM
caucaauuggcagcggcaaaua

SEQ ID NO: 2290762 - RNA, 19 nt, Yersinia pestis KIM
cauaucuuuaaaaacccgc

SEQ ID NO: 2290763 - RNA, 18 nt, Yersinia pestis KIM
cauauccucaagaccgau

SEQ ID NO: 2290764 - RNA, 16 nt, Yersinia pestis KIM
cauauccugugccaac

SEQ ID NO: 2290765 - RNA, 12 nt, Yersinia pestis KIM
cauaucagcgcc

SEQ ID NO: 2290766 - RNA, 17 nt, Yersinia pestis KIM
cauauaguuuuugcgcc

SEQ ID NO: 2290767 - RNA, 19 nt, Yersinia pestis KIM
caucaaaggagugcccggc

SEQ ID NO: 2290768 - RNA, 18 nt, Yersinia pestis KIM
cauauggaugaugcacag

SEQ ID NO: 2290769 - RNA, 14 nt, Yersinia pestis KIM
cauauggaugaugc

SEQ ID NO: 2290770 - RNA, 23 nt, Yersinia pestis KIM
cauaucuuuauuaucaauggcgc

SEQ ID NO: 2290771 - RNA, 19 nt, Yersinia pestis KIM
ccacgcaggcaaucagaau

SEQ ID NO: 2290772 - RNA, 13 nt, Yersinia pestis KIM
ccacgaaggcacc

SEQ ID NO: 2290773 - RNA, 14 nt, Yersinia pestis KIM
ccacuacggcgacu

SEQ ID NO: 2290774 - RNA, 17 nt, Yersinia pestis KIM
ccacuacacgcuuuacu

SEQ ID NO: 2290775 - RNA, 12 nt, Yersinia pestis KIM
ccagccaacugg

SEQ ID NO: 2290776 - RNA, 15 nt, Yersinia pestis KIM
ccagccaacuggcgc

SEQ ID NO: 2290777 - RNA, 20 nt, Yersinia pestis KIM
ccagcaugugguuaccauca

SEQ ID NO: 2290778 - RNA, 22 nt, Yersinia pestis KIM
ccagcaugugguuaccaucaac

SEQ ID NO: 2290779 - RNA, 15 nt, Yersinia pestis KIM
ccagcauucaggcuu

SEQ ID NO: 2290780 - RNA, 23 nt, Yersinia pestis KIM
cauccgggaaccccuucaggcca

SEQ ID NO: 2290781 - RNA, 21 nt, Yersinia pestis KIM
cauccucaacaguacugccaa

SEQ ID NO: 2290782 - RNA, 16 nt, Yersinia pestis KIM
caucuaugcuauccag

SEQ ID NO: 2290783 - RNA, 13 nt, Yersinia pestis KIM
caucucugcauca

SEQ ID NO: 2290784 - RNA, 20 nt, Yersinia pestis KIM
caucuuuuuuuuuauuauca

SEQ ID NO: 2290785 - RNA, 23 nt, Yersinia pestis KIM
caugaaugaggcugagguugaug

SEQ ID NO: 2290786 - RNA, 19 nt, Yersinia pestis KIM
caucuuacugauaucuuug

SEQ ID NO: 2290787 - RNA, 24 nt, Yersinia pestis KIM
caucuggugacccgucagcguccu

SEQ ID NO: 2290788 - RNA, 16 nt, Yersinia pestis KIM
cauggcguaaccgccg

SEQ ID NO: 2290789 - RNA, 14 nt, Yersinia pestis KIM
caugguacaacugc

SEQ ID NO: 2290790 - RNA, 12 nt, Yersinia pestis KIM
caugcuguucac

SEQ ID NO: 2290791 - RNA, 12 nt, Yersinia pestis KIM
caugcgagcagu

SEQ ID NO: 2290792 - RNA, 21 nt, Yersinia pestis KIM
caugcagcauuucaggaucga

SEQ ID NO: 2290793 - RNA, 14 nt, Yersinia pestis KIM
caugaugccgagug

SEQ ID NO: 2290794 - RNA, 18 nt, Yersinia pestis KIM
caugaugaauacggugua

SEQ ID NO: 2290795 - RNA, 18 nt, Yersinia pestis KIM
caugauagcuugcccgau

SEQ ID NO: 2290796 - RNA, 17 nt, Yersinia pestis KIM
ccaaagggcgacagggu

SEQ ID NO: 2290797 - RNA, 14 nt, Yersinia pestis KIM
ccaaauucagaaug

SEQ ID NO: 2290798 - RNA, 20 nt, Yersinia pestis KIM
ccaaaugcccauuaguaaug

SEQ ID NO: 2290799 - RNA, 16 nt, Yersinia pestis KIM
ccaaaugccgaaggcu

SEQ ID NO: 2290800 - RNA, 19 nt, Yersinia pestis KIM
ccaaauccgacugauagca

SEQ ID NO: 2290801 - RNA, 18 nt, Yersinia pestis KIM
ccaaacauugucaccuga

SEQ ID NO: 2290802 - RNA, 22 nt, Yersinia pestis KIM
ccaaagcccuuauccguuaacc

SEQ ID NO: 2290803 - RNA, 24 nt, Yersinia pestis KIM
cauuuugaccagcauacgugccaa

SEQ ID NO: 2290804 - RNA, 17 nt, Yersinia pestis KIM
cauuuuggccgcuuugg

SEQ ID NO: 2290805 - RNA, 16 nt, Yersinia pestis KIM
cauuuucuaagcugcc

SEQ ID NO: 2290806 - RNA, 23 nt, Yersinia pestis KIM
cauuuuaaucucuccaugauaua

SEQ ID NO: 2290807 - RNA, 15 nt, Yersinia pestis KIM
cauucaugaggcuca

SEQ ID NO: 2290808 - RNA, 16 nt, Yersinia pestis KIM
cauucaugaggcuucu

SEQ ID NO: 2290809 - RNA, 23 nt, Yersinia pestis KIM
cauucuaguuugugcugcuaaua

SEQ ID NO: 2290810 - RNA, 17 nt, Yersinia pestis KIM
cauucugaaucgcugcc

SEQ ID NO: 2290811 - RNA, 15 nt, Yersinia pestis KIM
cauuggcaaaggcca

SEQ ID NO: 2290812 - RNA, 21 nt, Yersinia pestis KIM
ccacauuucccuuacugucga

SEQ ID NO: 2290813 - RNA, 16 nt, Yersinia pestis KIM
ccaccaguaaacgcca

SEQ ID NO: 2290814 - RNA, 17 nt, Yersinia pestis KIM
ccacauugaucgguuug

SEQ ID NO: 2290815 - RNA, 17 nt, Yersinia pestis KIM
ccaauaaaaugcaccgc

SEQ ID NO: 2290816 - RNA, 17 nt, Yersinia pestis KIM
cccgaagcucaagcugg

SEQ ID NO: 2290817 - RNA, 19 nt, Yersinia pestis KIM
ccccuaacugaugcugaca

SEQ ID NO: 2290818 - RNA, 12 nt, Yersinia pestis KIM
cccauucaucaa

SEQ ID NO: 2290819 - RNA, 18 nt, Yersinia pestis KIM
cccauucgcgccccaaau

SEQ ID NO: 2290820 - RNA, 18 nt, Yersinia pestis KIM
cccauggcguaaccgccg

SEQ ID NO: 2290821 - RNA, 12 nt, Yersinia pestis KIM
cccaugcgagca

SEQ ID NO: 2290822 - RNA, 18 nt, Yersinia pestis KIM
cccgguugauaucggcaa

SEQ ID NO: 2290823 - RNA, 23 nt, Yersinia pestis KIM
cccguaaacgggcuaccgggaua

SEQ ID NO: 2290824 - RNA, 17 nt, Yersinia pestis KIM
cccguucaacaguauca

SEQ ID NO: 2290825 - RNA, 20 nt, Yersinia pestis KIM
cccgugcgcucuaaacgaau

SEQ ID NO: 2290826 - RNA, 21 nt, Yersinia pestis KIM
cccgugauaugcaaaucaugc

SEQ ID NO: 2290827 - RNA, 14 nt, Yersinia pestis KIM
ccgaaccaaggccc

SEQ ID NO: 2290828 - RNA, 19 nt, Yersinia pestis KIM
ccagugcuuuauccaaugg

SEQ ID NO: 2290829 - RNA, 23 nt, Yersinia pestis KIM
ccauauucgguaaguuggcauca

SEQ ID NO: 2290830 - RNA, 15 nt, Yersinia pestis KIM
ccauauccaguugcc

SEQ ID NO: 2290831 - RNA, 16 nt, Yersinia pestis KIM
ccauauacgcauaaug

SEQ ID NO: 2290832 - RNA, 21 nt, Yersinia pestis KIM
ccauagcgcauuauaaggaga

SEQ ID NO: 2290833 - RNA, 20 nt, Yersinia pestis KIM
ccauaagcgacgacauuaau

SEQ ID NO: 2290834 - RNA, 14 nt, Yersinia pestis KIM
ccauaaaguuacug

SEQ ID NO: 2290835 - RNA, 12 nt, Yersinia pestis KIM
ccagguuacugc

SEQ ID NO: 2290836 - RNA, 22 nt, Yersinia pestis KIM
ccaggcaagaaacuucauuuca

SEQ ID NO: 2290837 - RNA, 19 nt, Yersinia pestis KIM
cccacuggccccgaucauc

SEQ ID NO: 2290838 - RNA, 20 nt, Yersinia pestis KIM
cccaguuacuaccuuuugca

SEQ ID NO: 2290839 - RNA, 22 nt, Yersinia pestis KIM
cccaguugauggcugucuauug

SEQ ID NO: 2290840 - RNA, 14 nt, Yersinia pestis KIM
ccauggcguaaccg

SEQ ID NO: 2290841 - RNA, 13 nt, Yersinia pestis KIM
ccaugcgagcagu

SEQ ID NO: 2290842 - RNA, 16 nt, Yersinia pestis KIM
ccaucacgcagcagac

SEQ ID NO: 2290843 - RNA, 13 nt, Yersinia pestis KIM
cccaaucaucauc

SEQ ID NO: 2290844 - RNA, 20 nt, Yersinia pestis KIM
cccaaaggggagccaaugua

SEQ ID NO: 2290845 - RNA, 21 nt, Yersinia pestis KIM
cccaaaauaauguuugcgaca

SEQ ID NO: 2290846 - RNA, 17 nt, Yersinia pestis KIM
ccauuuuuaugccauua

SEQ ID NO: 2290847 - RNA, 19 nt, Yersinia pestis KIM
ccauuucucugaugguauc

SEQ ID NO: 2290848 - RNA, 20 nt, Yersinia pestis KIM
ccauuuccaggcuaccaagg

SEQ ID NO: 2290849 - RNA, 22 nt, Yersinia pestis KIM
ccauuucccugcggccauccag

SEQ ID NO: 2290850 - RNA, 13 nt, Yersinia pestis KIM
ccauuuccuuaua

SEQ ID NO: 2290851 - RNA, 15 nt, Yersinia pestis KIM
aucauguaaggcaau

SEQ ID NO: 2290852 - RNA, 13 nt, Yersinia pestis KIM
auccaagccauca

SEQ ID NO: 2290853 - RNA, 22 nt, Yersinia pestis KIM
auccaaucauucugucaucaag

SEQ ID NO: 2290854 - RNA, 21 nt, Yersinia pestis KIM
auccaacuuaccuugauccgc

SEQ ID NO: 2290855 - RNA, 21 nt, Yersinia pestis KIM
aucaucgcucaucgccaaagc

SEQ ID NO: 2290856 - RNA, 19 nt, Yersinia pestis KIM
aucaucgggcauucacugc

SEQ ID NO: 2290857 - RNA, 16 nt, Yersinia pestis KIM
aucaugcgggauuacu

SEQ ID NO: 2290858 - RNA, 14 nt, Yersinia pestis KIM
auauugauauagcg

SEQ ID NO: 2290859 - RNA, 17 nt, Yersinia pestis KIM
auauugcacaauagcua

SEQ ID NO: 2290860 - RNA, 18 nt, Yersinia pestis KIM
aucaggcgcacgaauauc

SEQ ID NO: 2290861 - RNA, 14 nt, Yersinia pestis KIM
aucaguaacgccgu

SEQ ID NO: 2290862 - RNA, 16 nt, Yersinia pestis KIM
aucaguagucaauaca

SEQ ID NO: 2290863 - RNA, 19 nt, Yersinia pestis KIM
aucaguuccugauucgguu

SEQ ID NO: 2290864 - RNA, 17 nt, Yersinia pestis KIM
aucaguggcgguucgag

SEQ ID NO: 2290865 - RNA, 17 nt, Yersinia pestis KIM
aucauauguucgaucaa

SEQ ID NO: 2290866 - RNA, 17 nt, Yersinia pestis KIM
aucauaaugguaccggc

SEQ ID NO: 2290867 - RNA, 17 nt, Yersinia pestis KIM
aucccuaaaaucauuga

SEQ ID NO: 2290868 - RNA, 18 nt, Yersinia pestis KIM
auccccuuugacagcauc

SEQ ID NO: 2290869 - RNA, 19 nt, Yersinia pestis KIM
auccauguccguguuggca

SEQ ID NO: 2290870 - RNA, 19 nt, Yersinia pestis KIM
auccaguauuucaguaacc

SEQ ID NO: 2290871 - RNA, 23 nt, Yersinia pestis KIM
auccagaacaccaacaccacacu

SEQ ID NO: 2290872 - RNA, 14 nt, Yersinia pestis KIM
aucgcacugauagc

SEQ ID NO: 2290873 - RNA, 21 nt, Yersinia pestis KIM
aucgccaauggucaguuguuc

SEQ ID NO: 2290874 - RNA, 19 nt, Yersinia pestis KIM
aucgcaccauaaccaaucc

SEQ ID NO: 2290875 - RNA, 14 nt, Yersinia pestis KIM
aucgcgaccaauuc

SEQ ID NO: 2290876 - RNA, 18 nt, Yersinia pestis KIM
aucguauucucaauggcu

SEQ ID NO: 2290877 - RNA, 16 nt, Yersinia pestis KIM
aucucaucggcauacu

SEQ ID NO: 2290878 - RNA, 18 nt, Yersinia pestis KIM
aucggccaauucagcaac

SEQ ID NO: 2290879 - RNA, 13 nt, Yersinia pestis KIM
aucgguaucggcc

SEQ ID NO: 2290880 - RNA, 16 nt, Yersinia pestis KIM
aucgguaacuuacagg

SEQ ID NO: 2290881 - RNA, 17 nt, Yersinia pestis KIM
aucggguuuaauucagg

SEQ ID NO: 2290882 - RNA, 20 nt, Yersinia pestis KIM
aucugaucaaucucaucaau

SEQ ID NO: 2290883 - RNA, 18 nt, Yersinia pestis KIM
aucugauacugaacgcaa

SEQ ID NO: 2290884 - RNA, 19 nt, Yersinia pestis KIM
aucugaccagugagccaug

SEQ ID NO: 2290885 - RNA, 17 nt, Yersinia pestis KIM
aucugaccaaacauugu

SEQ ID NO: 2290886 - RNA, 21 nt, Yersinia pestis KIM
aucugaccaaacauugucacc

SEQ ID NO: 2290887 - RNA, 14 nt, Yersinia pestis KIM
aucugaaucagcgg

SEQ ID NO: 2290888 - RNA, 21 nt, Yersinia pestis KIM
aucugccaguaaacggcgguu

SEQ ID NO: 2290889 - RNA, 21 nt, Yersinia pestis KIM
augaggcuaccugcaccaauc

SEQ ID NO: 2290890 - RNA, 16 nt, Yersinia pestis KIM
augagcugaauagccu

SEQ ID NO: 2290891 - RNA, 19 nt, Yersinia pestis KIM
augagauugaugggauuaa

SEQ ID NO: 2290892 - RNA, 12 nt, Yersinia pestis KIM
augacugaacau

SEQ ID NO: 2290893 - RNA, 14 nt, Yersinia pestis KIM
augccagcccauca

SEQ ID NO: 2290894 - RNA, 19 nt, Yersinia pestis KIM
augccacuucgcuacgccg

SEQ ID NO: 2290895 - RNA, 20 nt, Yersinia pestis KIM
augcaauuacugcauugcgu

SEQ ID NO: 2290896 - RNA, 14 nt, Yersinia pestis KIM
augcaccuguuaaa

SEQ ID NO: 2290897 - RNA, 17 nt, Yersinia pestis KIM
augcgcucacuuuuauu

SEQ ID NO: 2290898 - RNA, 21 nt, Yersinia pestis KIM
augccuggugcaaccgcugaa

SEQ ID NO: 2290899 - RNA, 13 nt, Yersinia pestis KIM
auggcggucgcac

SEQ ID NO: 2290900 - RNA, 21 nt, Yersinia pestis KIM
auggcggcucgccugauagcg

SEQ ID NO: 2290901 - RNA, 21 nt, Yersinia pestis KIM
auggcggcuggaaaaccaauu

SEQ ID NO: 2290902 - RNA, 15 nt, Yersinia pestis KIM
auggcuacguagcuc

SEQ ID NO: 2290903 - RNA, 22 nt, Yersinia pestis KIM
augcucuacgccccaugcaccu

SEQ ID NO: 2290904 - RNA, 15 nt, Yersinia pestis KIM
augcucgcuaaucaa

SEQ ID NO: 2290905 - RNA, 19 nt, Yersinia pestis KIM
auggugcuguauuuaaccg

SEQ ID NO: 2290906 - RNA, 12 nt, Yersinia pestis KIM
augguggcagcc

SEQ ID NO: 2290907 - RNA, 17 nt, Yersinia pestis KIM
auggcugccaucaggau

SEQ ID NO: 2290908 - RNA, 18 nt, Yersinia pestis KIM
auggcuccaccguucagg

SEQ ID NO: 2290909 - RNA, 21 nt, Yersinia pestis KIM
auggucacccuuuugaauuca

SEQ ID NO: 2290910 - RNA, 16 nt, Yersinia pestis KIM
auggucaguuguucac

SEQ ID NO: 2290911 - RNA, 20 nt, Yersinia pestis KIM
auguagcacacuaccgucuu

SEQ ID NO: 2290912 - RNA, 18 nt, Yersinia pestis KIM
augucgauugggccacau

SEQ ID NO: 2290913 - RNA, 16 nt, Yersinia pestis KIM
auuaaggaaacucaug

SEQ ID NO: 2290914 - RNA, 15 nt, Yersinia pestis KIM
auuaagcggcguauu

SEQ ID NO: 2290915 - RNA, 22 nt, Yersinia pestis KIM
auuaaccaagcucgccaucgca

SEQ ID NO: 2290916 - RNA, 20 nt, Yersinia pestis KIM
auuaacggucacuggcguuu

SEQ ID NO: 2290917 - RNA, 16 nt, Yersinia pestis KIM
auguuuauccgcuauu

SEQ ID NO: 2290918 - RNA, 18 nt, Yersinia pestis KIM
augucgcuguagcgccag

SEQ ID NO: 2290919 - RNA, 20 nt, Yersinia pestis KIM
auuaaugucgccauaacgca

SEQ ID NO: 2290920 - RNA, 15 nt, Yersinia pestis KIM
auuaccgagcgucaa

SEQ ID NO: 2290921 - RNA, 19 nt, Yersinia pestis KIM
auuaccucaauacguuucc

SEQ ID NO: 2290922 - RNA, 16 nt, Yersinia pestis KIM
auuacgccauccacuc

SEQ ID NO: 2290923 - RNA, 14 nt, Yersinia pestis KIM
auuacacgguggcc

SEQ ID NO: 2290924 - RNA, 23 nt, Yersinia pestis KIM
auuacagacuggccaacaggcgg

SEQ ID NO: 2290925 - RNA, 22 nt, Yersinia pestis KIM
auuacacgaucccucggugaua

SEQ ID NO: 2290926 - RNA, 22 nt, Yersinia pestis KIM
auucaaauacggcaccaauggc

SEQ ID NO: 2290927 - RNA, 17 nt, Yersinia pestis KIM
auucaagagagguaaug

SEQ ID NO: 2290928 - RNA, 17 nt, Yersinia pestis KIM
auuauuuauuuacagcc

SEQ ID NO: 2290929 - RNA, 21 nt, Yersinia pestis KIM
auucauuagccagccaauggc

SEQ ID NO: 2290930 - RNA, 13 nt, Yersinia pestis KIM
auucacaggcgag

SEQ ID NO: 2290931 - RNA, 20 nt, Yersinia pestis KIM
auuagugagcgguugaaaag

SEQ ID NO: 2290932 - RNA, 19 nt, Yersinia pestis KIM
auuagucccuaaagagcga

SEQ ID NO: 2290933 - RNA, 16 nt, Yersinia pestis KIM
auuagggcugacagag

SEQ ID NO: 2290934 - RNA, 19 nt, Yersinia pestis KIM
auuaucaucauuacacuga

SEQ ID NO: 2290935 - RNA, 13 nt, Yersinia pestis KIM
auuauaugcguuu

SEQ ID NO: 2290936 - RNA, 14 nt, Yersinia pestis KIM
auuagaaaacaagu

SEQ ID NO: 2290937 - RNA, 20 nt, Yersinia pestis KIM
auuacuucuuuuuaacgacg

SEQ ID NO: 2290938 - RNA, 12 nt, Yersinia pestis KIM
auuagccauaag

SEQ ID NO: 2290939 - RNA, 17 nt, Yersinia pestis KIM
auuagccagaaauagca

SEQ ID NO: 2290940 - RNA, 11 nt, Yersinia pestis KIM
auuacggguau

SEQ ID NO: 2290941 - RNA, 21 nt, Yersinia pestis KIM
caaauaacccgccuagcauca

SEQ ID NO: 2290942 - RNA, 17 nt, Yersinia pestis KIM
caaagucauuggcguua

SEQ ID NO: 2290943 - RNA, 15 nt, Yersinia pestis KIM
caacagcauuaccaa

SEQ ID NO: 2290944 - RNA, 12 nt, Yersinia pestis KIM
caacagcauuac

SEQ ID NO: 2290945 - RNA, 16 nt, Yersinia pestis KIM
caacagacucacucuc

SEQ ID NO: 2290946 - RNA, 17 nt, Yersinia pestis KIM
caacagcgcucauagca

SEQ ID NO: 2290947 - RNA, 21 nt, Yersinia pestis KIM
caaccaggccgccaucaucau

SEQ ID NO: 2290948 - RNA, 14 nt, Yersinia pestis KIM
caacaucuccgcca

SEQ ID NO: 2290949 - RNA, 18 nt, Yersinia pestis KIM
caacggacacauaagugu

SEQ ID NO: 2290950 - RNA, 17 nt, Yersinia pestis KIM
caacgcccagcuuuagc

SEQ ID NO: 2290951 - RNA, 12 nt, Yersinia pestis KIM
caacgaccagua

SEQ ID NO: 2290952 - RNA, 17 nt, Yersinia pestis KIM
caagcccuuuggcaauc

SEQ ID NO: 2290953 - RNA, 21 nt, Yersinia pestis KIM
caagccgcguucaaaucugcu

SEQ ID NO: 2290954 - RNA, 14 nt, Yersinia pestis KIM
caaggccagcgccc

SEQ ID NO: 2290955 - RNA, 16 nt, Yersinia pestis KIM
caagccaccgcuggug

SEQ ID NO: 2290956 - RNA, 17 nt, Yersinia pestis KIM
caagcccgaaauucagu

SEQ ID NO: 2290957 - RNA, 19 nt, Yersinia pestis KIM
caagcaaccgcaaugccgc

SEQ ID NO: 2290958 - RNA, 18 nt, Yersinia pestis KIM
caagaucccaagcaggaa

SEQ ID NO: 2290959 - RNA, 17 nt, Yersinia pestis KIM
caacugagcuaacgacc

SEQ ID NO: 2290960 - RNA, 16 nt, Yersinia pestis KIM
caacucuuccggugcg

SEQ ID NO: 2290961 - RNA, 20 nt, Yersinia pestis KIM
caacucuagcgccagcaauu

SEQ ID NO: 2290962 - RNA, 23 nt, Yersinia pestis KIM
caagaauuucgucuucgcccaga

SEQ ID NO: 2290963 - RNA, 14 nt, Yersinia pestis KIM
caagacaagcccga

SEQ ID NO: 2290964 - RNA, 18 nt, Yersinia pestis KIM
caagaauaauuacugacg

SEQ ID NO: 2290965 - RNA, 13 nt, Yersinia pestis KIM
caacuugcuggca

SEQ ID NO: 2290966 - RNA, 13 nt, Yersinia pestis KIM
caacuucacuuca

SEQ ID NO: 2290967 - RNA, 20 nt, Yersinia pestis KIM
caacuggcgcaacagcgccu

SEQ ID NO: 2290968 - RNA, 19 nt, Yersinia pestis KIM
auuuauuuuguaaccgcgg

SEQ ID NO: 2290969 - RNA, 23 nt, Yersinia pestis KIM
auuucaauccgaccacugacaaa

SEQ ID NO: 2290970 - RNA, 22 nt, Yersinia pestis KIM
auuuaugccagacccgcuaauu

SEQ ID NO: 2290971 - RNA, 15 nt, Yersinia pestis KIM
auuccccaccauugc

SEQ ID NO: 2290972 - RNA, 17 nt, Yersinia pestis KIM
auucccaccacuugcua

SEQ ID NO: 2290973 - RNA, 21 nt, Yersinia pestis KIM
auuuacaccgugcaauagcua

SEQ ID NO: 2290974 - RNA, 19 nt, Yersinia pestis KIM
auuuauauuuacgcauaau

SEQ ID NO: 2290975 - RNA, 14 nt, Yersinia pestis KIM
auuuagccgcaacu

SEQ ID NO: 2290976 - RNA, 20 nt, Yersinia pestis KIM
auuugaccuccguaggccaa

SEQ ID NO: 2290977 - RNA, 15 nt, Yersinia pestis KIM
auuucgaaaacucaa

SEQ ID NO: 2290978 - RNA, 22 nt, Yersinia pestis KIM
auuugguauuggcuagaaauca

SEQ ID NO: 2290979 - RNA, 23 nt, Yersinia pestis KIM
auuugguucacggaaaguagcca

SEQ ID NO: 2290980 - RNA, 21 nt, Yersinia pestis KIM
auuugauauuaauaucagcga

SEQ ID NO: 2290981 - RNA, 19 nt, Yersinia pestis KIM
auuuuacccgaaagccaug

SEQ ID NO: 2290982 - RNA, 12 nt, Yersinia pestis KIM
auuuuaacaauu

SEQ ID NO: 2290983 - RNA, 14 nt, Yersinia pestis KIM
auuuguucaagcgu

SEQ ID NO: 2290984 - RNA, 15 nt, Yersinia pestis KIM
auuuuuagccgcaau

SEQ ID NO: 2290985 - RNA, 22 nt, Yersinia pestis KIM
auuuuauuaccaaggcaugaua

SEQ ID NO: 2290986 - RNA, 18 nt, Yersinia pestis KIM
auuuuacuuccugccaac

SEQ ID NO: 2290987 - RNA, 15 nt, Yersinia pestis KIM
auuuucuaagcugcc

SEQ ID NO: 2290988 - RNA, 20 nt, Yersinia pestis KIM
auuuuucaccuugcgcaauu

SEQ ID NO: 2290989 - RNA, 23 nt, Yersinia pestis KIM
caaacggcgcgucgccauaacca

SEQ ID NO: 2290990 - RNA, 17 nt, Yersinia pestis KIM
caaacggauaaucgcgg

SEQ ID NO: 2290991 - RNA, 22 nt, Yersinia pestis KIM
caaacgggugcgccaaucgcca

SEQ ID NO: 2290992 - RNA, 20 nt, Yersinia pestis KIM
caaacgcugggcgauaaagu

SEQ ID NO: 2290993 - RNA, 22 nt, Yersinia pestis KIM
caaacauaauaaagcgaugcuc

SEQ ID NO: 2290994 - RNA, 13 nt, Yersinia pestis KIM
caaacauugucac

SEQ ID NO: 2290995 - RNA, 23 nt, Yersinia pestis KIM
caaaauaauguuugcgacaggcg

SEQ ID NO: 2290996 - RNA, 12 nt, Yersinia pestis KIM
caaacacguucg

SEQ ID NO: 2290997 - RNA, 12 nt, Yersinia pestis KIM
caaaagcgauca

SEQ ID NO: 2290998 - RNA, 14 nt, Yersinia pestis KIM
caaaacgacgggcu

SEQ ID NO: 2290999 - RNA, 22 nt, Yersinia pestis KIM
cacccucaagagcgauaaccgc

SEQ ID NO: 2291000 - RNA, 23 nt, Yersinia pestis KIM
cacccugugagcgguaagcugau

SEQ ID NO: 2291001 - RNA, 16 nt, Yersinia pestis KIM
caccaguaaacgccaa

SEQ ID NO: 2291002 - RNA, 15 nt, Yersinia pestis KIM
caccaguagcccagc

SEQ ID NO: 2291003 - RNA, 16 nt, Yersinia pestis KIM
caccagguuaccuaua

SEQ ID NO: 2291004 - RNA, 17 nt, Yersinia pestis KIM
caccauauucccagcca

SEQ ID NO: 2291005 - RNA, 12 nt, Yersinia pestis KIM
caccauagccac

SEQ ID NO: 2291006 - RNA, 15 nt, Yersinia pestis KIM
caccaucugccugca

SEQ ID NO: 2291007 - RNA, 14 nt, Yersinia pestis KIM
caccaucuucgcug

SEQ ID NO: 2291008 - RNA, 20 nt, Yersinia pestis KIM
cacccggccaucuucagaaa

SEQ ID NO: 2291009 - RNA, 23 nt, Yersinia pestis KIM
caauuacacgguggcccggaagg

SEQ ID NO: 2291010 - RNA, 22 nt, Yersinia pestis KIM
caauucaaggccagcacguuuu

SEQ ID NO: 2291011 - RNA, 17 nt, Yersinia pestis KIM
caauucacgcaaggcca

SEQ ID NO: 2291012 - RNA, 19 nt, Yersinia pestis KIM
caauuaugacguucaguag

SEQ ID NO: 2291013 - RNA, 15 nt, Yersinia pestis KIM
caaugauaaaauccu

SEQ ID NO: 2291014 - RNA, 21 nt, Yersinia pestis KIM
caaugagugcagccaacgccc

SEQ ID NO: 2291015 - RNA, 22 nt, Yersinia pestis KIM
caaugagaucgaacugauaacu

SEQ ID NO: 2291016 - RNA, 15 nt, Yersinia pestis KIM
caaugaaguaaggau

SEQ ID NO: 2291017 - RNA, 19 nt, Yersinia pestis KIM
caaugcgguacgcaggccu

SEQ ID NO: 2291018 - RNA, 20 nt, Yersinia pestis KIM
caaggggcgagccacgauca

SEQ ID NO: 2291019 - RNA, 18 nt, Yersinia pestis KIM
caaggucaacgaccagua

SEQ ID NO: 2291020 - RNA, 20 nt, Yersinia pestis KIM
cacaaagcgcccuucggacg

SEQ ID NO: 2291021 - RNA, 16 nt, Yersinia pestis KIM
cacacagaugcuggcu

SEQ ID NO: 2291022 - RNA, 14 nt, Yersinia pestis KIM
cacaacacauuacu

SEQ ID NO: 2291023 - RNA, 22 nt, Yersinia pestis KIM
cacaaaucgucgucagcgacau

SEQ ID NO: 2291024 - RNA, 19 nt, Yersinia pestis KIM
cacagcacggcaacaggcu

SEQ ID NO: 2291025 - RNA, 16 nt, Yersinia pestis KIM
cacagcacucauaaug

SEQ ID NO: 2291026 - RNA, 20 nt, Yersinia pestis KIM
cacauagcauggucaucgcu

SEQ ID NO: 2291027 - RNA, 23 nt, Yersinia pestis KIM
cacauaccuucgguaaucaauuu

SEQ ID NO: 2291028 - RNA, 16 nt, Yersinia pestis KIM
cacauauuucaggcug

SEQ ID NO: 2291029 - RNA, 14 nt, Yersinia pestis KIM
cacaucaaccugau

SEQ ID NO: 2291030 - RNA, 13 nt, Yersinia pestis KIM
cacagcuggaugu

SEQ ID NO: 2291031 - RNA, 15 nt, Yersinia pestis KIM
cacagucugucguac

SEQ ID NO: 2291032 - RNA, 15 nt, Yersinia pestis KIM
caccaaaaugacaau

SEQ ID NO: 2291033 - RNA, 20 nt, Yersinia pestis KIM
caccaaaaaacggauuucca

SEQ ID NO: 2291034 - RNA, 19 nt, Yersinia pestis KIM
caccaaaucuuccagcggc

SEQ ID NO: 2291035 - RNA, 15 nt, Yersinia pestis KIM
caccaagaggcugcg

SEQ ID NO: 2291036 - RNA, 18 nt, Yersinia pestis KIM
auacgcgcaccggcuaac

SEQ ID NO: 2291037 - RNA, 15 nt, Yersinia pestis KIM
auacggucaaaagcu

SEQ ID NO: 2291038 - RNA, 17 nt, Yersinia pestis KIM
auaccuuacugcaucaa

SEQ ID NO: 2291039 - RNA, 13 nt, Yersinia pestis KIM
auaccgguggcau

SEQ ID NO: 2291040 - RNA, 15 nt, Yersinia pestis KIM
auaccacuuaguggc

SEQ ID NO: 2291041 - RNA, 16 nt, Yersinia pestis KIM
auaauauuggccgcca

SEQ ID NO: 2291042 - RNA, 17 nt, Yersinia pestis KIM
auaauuugucaguaaug

SEQ ID NO: 2291043 - RNA, 17 nt, Yersinia pestis KIM
auaauuuuauggcguuu

SEQ ID NO: 2291044 - RNA, 15 nt, Yersinia pestis KIM
auacaacgguuuaug

SEQ ID NO: 2291045 - RNA, 13 nt, Yersinia pestis KIM
auaauaauccaua

SEQ ID NO: 2291046 - RNA, 17 nt, Yersinia pestis KIM
auaagugaucagcuaac

SEQ ID NO: 2291047 - RNA, 21 nt, Yersinia pestis KIM
auaacguuguuucugaagggc

SEQ ID NO: 2291048 - RNA, 15 nt, Yersinia pestis KIM
auaacucaucaguaa

SEQ ID NO: 2291049 - RNA, 18 nt, Yersinia pestis KIM
auaacucaucaguaacgc

SEQ ID NO: 2291050 - RNA, 14 nt, Yersinia pestis KIM
auaacggcggcaau

SEQ ID NO: 2291051 - RNA, 15 nt, Yersinia pestis KIM
auaacggcggcaaua

SEQ ID NO: 2291052 - RNA, 18 nt, Yersinia pestis KIM
auaacccgccuagcauca

SEQ ID NO: 2291053 - RNA, 11 nt, Yersinia pestis KIM
auaaccauuaa

SEQ ID NO: 2291054 - RNA, 12 nt, Yersinia pestis KIM
auaacagcuaaa

SEQ ID NO: 2291055 - RNA, 18 nt, Yersinia pestis KIM
auaacaugggguaauccc

SEQ ID NO: 2291056 - RNA, 12 nt, Yersinia pestis KIM
auauuccuaauu

SEQ ID NO: 2291057 - RNA, 19 nt, Yersinia pestis KIM
auauuccaaaaaauagccg

SEQ ID NO: 2291058 - RNA, 15 nt, Yersinia pestis KIM
auaucgaugacagca

SEQ ID NO: 2291059 - RNA, 23 nt, Yersinia pestis KIM
auauccuggaagcagaauacugu

SEQ ID NO: 2291060 - RNA, 23 nt, Yersinia pestis KIM
auaucaacagaacuaaacgccaa

SEQ ID NO: 2291061 - RNA, 16 nt, Yersinia pestis KIM
auauauuagccaguau

SEQ ID NO: 2291062 - RNA, 23 nt, Yersinia pestis KIM
auauacagaagaguacgcuuugg

SEQ ID NO: 2291063 - RNA, 19 nt, Yersinia pestis KIM
auacuuucccauagcuggc

SEQ ID NO: 2291064 - RNA, 13 nt, Yersinia pestis KIM
auagcugauugcu

SEQ ID NO: 2291065 - RNA, 23 nt, Yersinia pestis KIM
auagcuggcuucaaaaucaccug

SEQ ID NO: 2291066 - RNA, 13 nt, Yersinia pestis KIM
auaguccuuccau

SEQ ID NO: 2291067 - RNA, 20 nt, Yersinia pestis KIM
auaguuagugaguuauucgc

SEQ ID NO: 2291068 - RNA, 22 nt, Yersinia pestis KIM
auagucacgucuucaccaauga

SEQ ID NO: 2291069 - RNA, 17 nt, Yersinia pestis KIM
auaggcgaaaggcgcaa

SEQ ID NO: 2291070 - RNA, 15 nt, Yersinia pestis KIM
auaggccacuagcca

SEQ ID NO: 2291071 - RNA, 17 nt, Yersinia pestis KIM
agugaagacaucgccag

SEQ ID NO: 2291072 - RNA, 12 nt, Yersinia pestis KIM
agugaagacauc

SEQ ID NO: 2291073 - RNA, 15 nt, Yersinia pestis KIM
agugaacauagcuaa

SEQ ID NO: 2291074 - RNA, 17 nt, Yersinia pestis KIM
agugaaggguugaccgc

SEQ ID NO: 2291075 - RNA, 18 nt, Yersinia pestis KIM
agugaaaagguuaacugc

SEQ ID NO: 2291076 - RNA, 21 nt, Yersinia pestis KIM
agucucuguggauugccaaau

SEQ ID NO: 2291077 - RNA, 16 nt, Yersinia pestis KIM
agucugaaaugaucac

SEQ ID NO: 2291078 - RNA, 22 nt, Yersinia pestis KIM
aguagcaggcgcacguuaccgu

SEQ ID NO: 2291079 - RNA, 14 nt, Yersinia pestis KIM
aguacuaacgucaa

SEQ ID NO: 2291080 - RNA, 15 nt, Yersinia pestis KIM
agucaccgcuguaaa

SEQ ID NO: 2291081 - RNA, 14 nt, Yersinia pestis KIM
agucacugcugcac

SEQ ID NO: 2291082 - RNA, 17 nt, Yersinia pestis KIM
aguggcuuugcaccauc

SEQ ID NO: 2291083 - RNA, 21 nt, Yersinia pestis KIM
aguguucggggguugucagca

SEQ ID NO: 2291084 - RNA, 23 nt, Yersinia pestis KIM
agugguacuuaacuggccaauua

SEQ ID NO: 2291085 - RNA, 20 nt, Yersinia pestis KIM
aguuaagacaauuauagcca

SEQ ID NO: 2291086 - RNA, 14 nt, Yersinia pestis KIM
aguuaaaaccagua

SEQ ID NO: 2291087 - RNA, 21 nt, Yersinia pestis KIM
aguuacauuuuuaacaucugg

SEQ ID NO: 2291088 - RNA, 15 nt, Yersinia pestis KIM
aguuauucgccccuu

SEQ ID NO: 2291089 - RNA, 21 nt, Yersinia pestis KIM
aguucaagcagcuuuucacga

SEQ ID NO: 2291090 - RNA, 15 nt, Yersinia pestis KIM
aguuaucaucaccaa

SEQ ID NO: 2291091 - RNA, 14 nt, Yersinia pestis KIM
aguuggauauacau

SEQ ID NO: 2291092 - RNA, 21 nt, Yersinia pestis KIM
agugcugccgcaacggcaccu

SEQ ID NO: 2291093 - RNA, 21 nt, Yersinia pestis KIM
aguggaugauaaauaucauua

SEQ ID NO: 2291094 - RNA, 18 nt, Yersinia pestis KIM
agugcgaucaaaaacguc

SEQ ID NO: 2291095 - RNA, 19 nt, Yersinia pestis KIM
agugauguaauccauacag

SEQ ID NO: 2291096 - RNA, 18 nt, Yersinia pestis KIM
agugauucgggugaguga

SEQ ID NO: 2291097 - RNA, 12 nt, Yersinia pestis KIM
aggcauaucacu

SEQ ID NO: 2291098 - RNA, 14 nt, Yersinia pestis KIM
aggcccgcuaucac

SEQ ID NO: 2291099 - RNA, 23 nt, Yersinia pestis KIM
aggcagauugagugcggacagcg

SEQ ID NO: 2291100 - RNA, 14 nt, Yersinia pestis KIM
aggauaaccaauuc

SEQ ID NO: 2291101 - RNA, 23 nt, Yersinia pestis KIM
aggauagccaaccccucuggugu

SEQ ID NO: 2291102 - RNA, 15 nt, Yersinia pestis KIM
agcuucuggcugauu

SEQ ID NO: 2291103 - RNA, 21 nt, Yersinia pestis KIM
agcuuucugugguuggcagcu

SEQ ID NO: 2291104 - RNA, 20 nt, Yersinia pestis KIM
agcuuuagcggcgauuucau

SEQ ID NO: 2291105 - RNA, 13 nt, Yersinia pestis KIM
agcuugcuggcgg

SEQ ID NO: 2291106 - RNA, 15 nt, Yersinia pestis KIM
aggaaauucacguuu

SEQ ID NO: 2291107 - RNA, 17 nt, Yersinia pestis KIM
agcguccauguaucccg

SEQ ID NO: 2291108 - RNA, 17 nt, Yersinia pestis KIM
agcuuccaacugauaaa

SEQ ID NO: 2291109 - RNA, 20 nt, Yersinia pestis KIM
agcuguuggcuuuaucucac

SEQ ID NO: 2291110 - RNA, 13 nt, Yersinia pestis KIM
aggcgacugccca

SEQ ID NO: 2291111 - RNA, 18 nt, Yersinia pestis KIM
aggcucauuaauccugau

SEQ ID NO: 2291112 - RNA, 20 nt, Yersinia pestis KIM
agggcgauagcccuacuggc

SEQ ID NO: 2291113 - RNA, 16 nt, Yersinia pestis KIM
agggccuacguucagg

SEQ ID NO: 2291114 - RNA, 23 nt, Yersinia pestis KIM
agguaacgccgcuguagcgccaa

SEQ ID NO: 2291115 - RNA, 18 nt, Yersinia pestis KIM
agguaacuuaaaauaugg

SEQ ID NO: 2291116 - RNA, 21 nt, Yersinia pestis KIM
agguaaacagacacagcaaca

SEQ ID NO: 2291117 - RNA, 13 nt, Yersinia pestis KIM
aggguugucagca

SEQ ID NO: 2291118 - RNA, 15 nt, Yersinia pestis KIM
agcgcuuccacugcg

SEQ ID NO: 2291119 - RNA, 22 nt, Yersinia pestis KIM
agcgcgguaacuaacaucagcg

SEQ ID NO: 2291120 - RNA, 12 nt, Yersinia pestis KIM
agcgaugaccau

SEQ ID NO: 2291121 - RNA, 13 nt, Yersinia pestis KIM
agcgggcggcaau

SEQ ID NO: 2291122 - RNA, 14 nt, Yersinia pestis KIM
agcgggcggcaaug

SEQ ID NO: 2291123 - RNA, 21 nt, Yersinia pestis KIM
agcguacacgcaguacgugac

SEQ ID NO: 2291124 - RNA, 15 nt, Yersinia pestis KIM
agcguauagcggcau

SEQ ID NO: 2291125 - RNA, 20 nt, Yersinia pestis KIM
agcgucauggucucacugcg

SEQ ID NO: 2291126 - RNA, 17 nt, Yersinia pestis KIM
agcggccauuaggcgug

SEQ ID NO: 2291127 - RNA, 21 nt, Yersinia pestis KIM
agcccguucggucacacuggc

SEQ ID NO: 2291128 - RNA, 19 nt, Yersinia pestis KIM
agccgcugcucacauagcg

SEQ ID NO: 2291129 - RNA, 16 nt, Yersinia pestis KIM
agccucuguagccgca

SEQ ID NO: 2291130 - RNA, 19 nt, Yersinia pestis KIM
agccucuauuaccucaaua

SEQ ID NO: 2291131 - RNA, 16 nt, Yersinia pestis KIM
agccucauucaugagg

SEQ ID NO: 2291132 - RNA, 17 nt, Yersinia pestis KIM
agccuuaacugcauagc

SEQ ID NO: 2291133 - RNA, 22 nt, Yersinia pestis KIM
agcaggcaguaaaauauugaua

SEQ ID NO: 2291134 - RNA, 18 nt, Yersinia pestis KIM
agcagcgcgguagcgaua

SEQ ID NO: 2291135 - RNA, 18 nt, Yersinia pestis KIM
agcauacguugccagcca

SEQ ID NO: 2291136 - RNA, 15 nt, Yersinia pestis KIM
agcauugagcgccac

SEQ ID NO: 2291137 - RNA, 19 nt, Yersinia pestis KIM
agcauguggaagauauucu

SEQ ID NO: 2291138 - RNA, 22 nt, Yersinia pestis KIM
agcacuuccaacuuuucauugg

SEQ ID NO: 2291139 - RNA, 13 nt, Yersinia pestis KIM
agcacgauuacca

SEQ ID NO: 2291140 - RNA, 16 nt, Yersinia pestis KIM
agcacgaccuugccaa

SEQ ID NO: 2291141 - RNA, 21 nt, Yersinia pestis KIM
agcaccuaucgccgccgccag

SEQ ID NO: 2291142 - RNA, 22 nt, Yersinia pestis KIM
agauugagugcggacagcgcgc

SEQ ID NO: 2291143 - RNA, 20 nt, Yersinia pestis KIM
agauccuggcccgccagcau

SEQ ID NO: 2291144 - RNA, 20 nt, Yersinia pestis KIM
agauuuuuagcgugccgcag

SEQ ID NO: 2291145 - RNA, 16 nt, Yersinia pestis KIM
agcaaaaaaacugacu

SEQ ID NO: 2291146 - RNA, 13 nt, Yersinia pestis KIM
agcaaaaaggcug

SEQ ID NO: 2291147 - RNA, 19 nt, Yersinia pestis KIM
agauugugcgaucaucacg

SEQ ID NO: 2291148 - RNA, 19 nt, Yersinia pestis KIM
agauuucaagcaauucaga

SEQ ID NO: 2291149 - RNA, 17 nt, Yersinia pestis KIM
agauuucagacugcuga

SEQ ID NO: 2291150 - RNA, 23 nt, Yersinia pestis KIM
agauuugcccaaucuaacuggcc

SEQ ID NO: 2291151 - RNA, 13 nt, Yersinia pestis KIM
agcacacugguug

SEQ ID NO: 2291152 - RNA, 13 nt, Yersinia pestis KIM
agcacaaugccua

SEQ ID NO: 2291153 - RNA, 13 nt, Yersinia pestis KIM
agauaaucgccaa

SEQ ID NO: 2291154 - RNA, 12 nt, Yersinia pestis KIM
agauaaaucugu

SEQ ID NO: 2291155 - RNA, 19 nt, Yersinia pestis KIM
agaguuaccgugagcagca

SEQ ID NO: 2291156 - RNA, 18 nt, Yersinia pestis KIM
agagcgauugacugaaug

SEQ ID NO: 2291157 - RNA, 20 nt, Yersinia pestis KIM
agagaauuauuucucguggc

SEQ ID NO: 2291158 - RNA, 23 nt, Yersinia pestis KIM
agagaaauaacccauauuggcaa

SEQ ID NO: 2291159 - RNA, 22 nt, Yersinia pestis KIM
agacuucgguauggcgcuuaac

SEQ ID NO: 2291160 - RNA, 15 nt, Yersinia pestis KIM
agaccguaucacccg

SEQ ID NO: 2291161 - RNA, 20 nt, Yersinia pestis KIM
agaaggguauugaagauacc

SEQ ID NO: 2291162 - RNA, 18 nt, Yersinia pestis KIM
agaagcuucaacuuaauu

SEQ ID NO: 2291163 - RNA, 20 nt, Yersinia pestis KIM
agaauaaacgagaauucaga

SEQ ID NO: 2291164 - RNA, 16 nt, Yersinia pestis KIM
agaaugggucguugau

SEQ ID NO: 2291165 - RNA, 16 nt, Yersinia pestis KIM
agaauagugauauccc

SEQ ID NO: 2291166 - RNA, 20 nt, Yersinia pestis KIM
agaauagaaccggaauaaau

SEQ ID NO: 2291167 - RNA, 14 nt, Yersinia pestis KIM
agacaucgccagau

SEQ ID NO: 2291168 - RNA, 16 nt, Yersinia pestis KIM
agacacugacaucauc

SEQ ID NO: 2291169 - RNA, 13 nt, Yersinia pestis KIM
agaacaggcagca

SEQ ID NO: 2291170 - RNA, 23 nt, Yersinia pestis KIM
agaacaagacugcuaauaccacc

SEQ ID NO: 2291171 - RNA, 20 nt, Yersinia pestis KIM
acugcucuaucucuuccgac

SEQ ID NO: 2291172 - RNA, 16 nt, Yersinia pestis KIM
acugcucgagccaauu

SEQ ID NO: 2291173 - RNA, 19 nt, Yersinia pestis KIM
acugcucgagccaauugca

SEQ ID NO: 2291174 - RNA, 18 nt, Yersinia pestis KIM
agaagcauauggauguga

SEQ ID NO: 2291175 - RNA, 12 nt, Yersinia pestis KIM
agaagacgagua

SEQ ID NO: 2291176 - RNA, 22 nt, Yersinia pestis KIM
gugccagcaaagacaauaacgg

SEQ ID NO: 2291177 - RNA, 17 nt, Yersinia pestis KIM
gugcagccaacgcccug

SEQ ID NO: 2291178 - RNA, 17 nt, Yersinia pestis KIM
gugaugacaaugcguua

SEQ ID NO: 2291179 - RNA, 15 nt, Yersinia pestis KIM
gugauugaagcgugg

SEQ ID NO: 2291180 - RNA, 17 nt, Yersinia pestis KIM
aagugcugcaaggcauu

SEQ ID NO: 2291181 - RNA, 13 nt, Yersinia pestis KIM
gugccuaucugaa

SEQ ID NO: 2291182 - RNA, 13 nt, Yersinia pestis KIM
gugcuacggcaaa

SEQ ID NO: 2291183 - RNA, 19 nt, Yersinia pestis KIM
gugcuaucugcugcgguau

SEQ ID NO: 2291184 - RNA, 15 nt, Yersinia pestis KIM
gugcugccgcaacgg

SEQ ID NO: 2291185 - RNA, 14 nt, Yersinia pestis KIM
guggcuaccaauua

SEQ ID NO: 2291186 - RNA, 15 nt, Yersinia pestis KIM
guguaacugccaccg

SEQ ID NO: 2291187 - RNA, 17 nt, Yersinia pestis KIM
gugugaaauugcccgcc

SEQ ID NO: 2291188 - RNA, 22 nt, Yersinia pestis KIM
guguucauaaauuaaaacugaa

SEQ ID NO: 2291189 - RNA, 16 nt, Yersinia pestis KIM
guuaacuuauagcuca

SEQ ID NO: 2291190 - RNA, 20 nt, Yersinia pestis KIM
guuacagcaaggcagaaaau

SEQ ID NO: 2291191 - RNA, 20 nt, Yersinia pestis KIM
guuacagcaaggcagcaagu

SEQ ID NO: 2291192 - RNA, 20 nt, Yersinia pestis KIM
guuacaguaaggcagcaagu

SEQ ID NO: 2291193 - RNA, 19 nt, Yersinia pestis KIM
guuaauccguaugucacug

SEQ ID NO: 2291194 - RNA, 15 nt, Yersinia pestis KIM
guguugacgccauuc

SEQ ID NO: 2291195 - RNA, 23 nt, Yersinia pestis KIM
guuaaagguaaaaggcccgcuag

SEQ ID NO: 2291196 - RNA, 12 nt, Yersinia pestis KIM
guuaaacagcgc

SEQ ID NO: 2291197 - RNA, 16 nt, Yersinia pestis KIM
guuaccagaaaaccuu

SEQ ID NO: 2291198 - RNA, 19 nt, Yersinia pestis KIM
guuaccgaugauugguauu

SEQ ID NO: 2291199 - RNA, 18 nt, Yersinia pestis KIM
guuauggcuuuacggcuc

SEQ ID NO: 2291200 - RNA, 13 nt, Yersinia pestis KIM
guuauggcuuuac

SEQ ID NO: 2291201 - RNA, 13 nt, Yersinia pestis KIM
guuauugacaaag

SEQ ID NO: 2291202 - RNA, 21 nt, Yersinia pestis KIM
guugccgugccgaagugcaua

SEQ ID NO: 2291203 - RNA, 18 nt, Yersinia pestis KIM
guugcgauacagcgcauc

SEQ ID NO: 2291204 - RNA, 16 nt, Yersinia pestis KIM
guuuaucaaacagcac

SEQ ID NO: 2291205 - RNA, 22 nt, Yersinia pestis KIM
guuuauccuuuuuauuuaagca

SEQ ID NO: 2291206 - RNA, 21 nt, Yersinia pestis KIM
guuuauacuauuuauggcgug

SEQ ID NO: 2291207 - RNA, 16 nt, Yersinia pestis KIM
guuuaacaauguggua

SEQ ID NO: 2291208 - RNA, 17 nt, Yersinia pestis KIM
guucgcguggcagauug

SEQ ID NO: 2291209 - RNA, 20 nt, Yersinia pestis KIM
guucaagcagcuuuucacga

SEQ ID NO: 2291210 - RNA, 21 nt, Yersinia pestis KIM
guucaagcagcuuuucacgag

SEQ ID NO: 2291211 - RNA, 16 nt, Yersinia pestis KIM
guucuaucucaucuua

SEQ ID NO: 2291212 - RNA, 21 nt, Yersinia pestis KIM
guucucgcuguacugcugcaa

SEQ ID NO: 2291213 - RNA, 16 nt, Yersinia pestis KIM
guucugcucaauagcc

SEQ ID NO: 2291214 - RNA, 18 nt, Yersinia pestis KIM
uaaaaggauagggagcca

SEQ ID NO: 2291215 - RNA, 17 nt, Yersinia pestis KIM
uaaaagcaugcccagcc

SEQ ID NO: 2291216 - RNA, 13 nt, Yersinia pestis KIM
uaaaagauaacga

SEQ ID NO: 2291217 - RNA, 19 nt, Yersinia pestis KIM
guuucaguuggccaccauu

SEQ ID NO: 2291218 - RNA, 17 nt, Yersinia pestis KIM
uaaacaggguugagcca

SEQ ID NO: 2291219 - RNA, 19 nt, Yersinia pestis KIM
uaaacugauuuaaccgaug

SEQ ID NO: 2291220 - RNA, 22 nt, Yersinia pestis KIM
uaaacgucuuaugccauaacau

SEQ ID NO: 2291221 - RNA, 23 nt, Yersinia pestis KIM
uaaagaaauaccccccaccaauu

SEQ ID NO: 2291222 - RNA, 14 nt, Yersinia pestis KIM
uaaagauacccgcc

SEQ ID NO: 2291223 - RNA, 17 nt, Yersinia pestis KIM
uaaagcagcaucuggcg

SEQ ID NO: 2291224 - RNA, 14 nt, Yersinia pestis KIM
uaaauagcggccau

SEQ ID NO: 2291225 - RNA, 13 nt, Yersinia pestis KIM
uaaauacugcugg

SEQ ID NO: 2291226 - RNA, 12 nt, Yersinia pestis KIM
uaaauaagaagu

SEQ ID NO: 2291227 - RNA, 23 nt, Yersinia pestis KIM
uaaauggcgugcacugacccauu

SEQ ID NO: 2291228 - RNA, 23 nt, Yersinia pestis KIM
uaaauggagggcagcuugacgac

SEQ ID NO: 2291229 - RNA, 14 nt, Yersinia pestis KIM
uaaaucgcaggcuu

SEQ ID NO: 2291230 - RNA, 15 nt, Yersinia pestis KIM
uaacaccaucaacau

SEQ ID NO: 2291231 - RNA, 19 nt, Yersinia pestis KIM
uaacaccagcauccugcaa

SEQ ID NO: 2291232 - RNA, 15 nt, Yersinia pestis KIM
uaaauucaaaauaga

SEQ ID NO: 2291233 - RNA, 20 nt, Yersinia pestis KIM
uaaugauugccguagcguca

SEQ ID NO: 2291234 - RNA, 17 nt, Yersinia pestis KIM
uaaugagauuaauucaa

SEQ ID NO: 2291235 - RNA, 17 nt, Yersinia pestis KIM
uaauggcauacuccgcu

SEQ ID NO: 2291236 - RNA, 14 nt, Yersinia pestis KIM
uaaugcgcgcagca

SEQ ID NO: 2291237 - RNA, 22 nt, Yersinia pestis KIM
uaaugccagcguggcccaggca

SEQ ID NO: 2291238 - RNA, 14 nt, Yersinia pestis KIM
uaauucagauguua

SEQ ID NO: 2291239 - RNA, 13 nt, Yersinia pestis KIM
uaauuaaugcacc

SEQ ID NO: 2291240 - RNA, 23 nt, Yersinia pestis KIM
uaauccaaaauaauauaauucaa

SEQ ID NO: 2291241 - RNA, 16 nt, Yersinia pestis KIM
uaauacguuggcggcu

SEQ ID NO: 2291242 - RNA, 14 nt, Yersinia pestis KIM
uaaucugcccagcc

SEQ ID NO: 2291243 - RNA, 20 nt, Yersinia pestis KIM
uaagcuagagccgcgcuaua

SEQ ID NO: 2291244 - RNA, 13 nt, Yersinia pestis KIM
uaauacgccaucc

SEQ ID NO: 2291245 - RNA, 13 nt, Yersinia pestis KIM
uaauaauaucaaa

SEQ ID NO: 2291246 - RNA, 19 nt, Yersinia pestis KIM
uaauaauaugcacgucauu

SEQ ID NO: 2291247 - RNA, 16 nt, Yersinia pestis KIM
uaauaaugaugaacua

SEQ ID NO: 2291248 - RNA, 15 nt, Yersinia pestis KIM
uaauaacgccgagua

SEQ ID NO: 2291249 - RNA, 18 nt, Yersinia pestis KIM
uaauaacaguaucaagua

SEQ ID NO: 2291250 - RNA, 12 nt, Yersinia pestis KIM
uaagacaacgcc

SEQ ID NO: 2291251 - RNA, 13 nt, Yersinia pestis KIM
uaagcaauaccga

SEQ ID NO: 2291252 - RNA, 18 nt, Yersinia pestis KIM
uaagcaauaccgacauca

SEQ ID NO: 2291253 - RNA, 14 nt, Yersinia pestis KIM
uaagcacaacgcuc

SEQ ID NO: 2291254 - RNA, 17 nt, Yersinia pestis KIM
uaagcaucggcaacguc

SEQ ID NO: 2291255 - RNA, 12 nt, Yersinia pestis KIM
uaagcauuggca

SEQ ID NO: 2291256 - RNA, 21 nt, Yersinia pestis KIM
uaagcauuuaauguucgcuga

SEQ ID NO: 2291257 - RNA, 13 nt, Yersinia pestis KIM
uaagagugcuggc

SEQ ID NO: 2291258 - RNA, 15 nt, Yersinia pestis KIM
uaagaugacuacugu

SEQ ID NO: 2291259 - RNA, 14 nt, Yersinia pestis KIM
uagcgcauccaacc

SEQ ID NO: 2291260 - RNA, 12 nt, Yersinia pestis KIM
uagcgauaacag

SEQ ID NO: 2291261 - RNA, 10 nt, Yersinia pestis KIM
uagcgauaaa

SEQ ID NO: 2291262 - RNA, 14 nt, Yersinia pestis KIM
uagcgcaauucagc

SEQ ID NO: 2291263 - RNA, 12 nt, Yersinia pestis KIM
uagcgccagcaa

SEQ ID NO: 2291264 - RNA, 21 nt, Yersinia pestis KIM
uagcccaucuuaugcauguuc

SEQ ID NO: 2291265 - RNA, 20 nt, Yersinia pestis KIM
uagccaguauguuguucgaa

SEQ ID NO: 2291266 - RNA, 22 nt, Yersinia pestis KIM
uagccauuuggugauaagcugc

SEQ ID NO: 2291267 - RNA, 22 nt, Yersinia pestis KIM
uagccaaauacccuaauucaga

SEQ ID NO: 2291268 - RNA, 18 nt, Yersinia pestis KIM
uagauaacaaacuacuug

SEQ ID NO: 2291269 - RNA, 18 nt, Yersinia pestis KIM
uagaucuccugcaacgcc

SEQ ID NO: 2291270 - RNA, 15 nt, Yersinia pestis KIM
uagaacuuaagcaau

SEQ ID NO: 2291271 - RNA, 22 nt, Yersinia pestis KIM
uacuguuaccgcgcuugcauca

SEQ ID NO: 2291272 - RNA, 22 nt, Yersinia pestis KIM
uacugggcuuauuaauuaauga

SEQ ID NO: 2291273 - RNA, 18 nt, Yersinia pestis KIM
uacugguaauaaugcugu

SEQ ID NO: 2291274 - RNA, 18 nt, Yersinia pestis KIM
uacgcuuuuuggccgcua

SEQ ID NO: 2291275 - RNA, 15 nt, Yersinia pestis KIM
uacggaaaauagggg

SEQ ID NO: 2291276 - RNA, 19 nt, Yersinia pestis KIM
uaccgccgucaugcugaau

SEQ ID NO: 2291277 - RNA, 22 nt, Yersinia pestis KIM
uaccgccccuguuugcgcagca

SEQ ID NO: 2291278 - RNA, 14 nt, Yersinia pestis KIM
uaccugcuaaccga

SEQ ID NO: 2291279 - RNA, 15 nt, Yersinia pestis KIM
uaccuugauccgcca

SEQ ID NO: 2291280 - RNA, 22 nt, Yersinia pestis KIM
uaccucguaguaaugacgcuau

SEQ ID NO: 2291281 - RNA, 20 nt, Yersinia pestis KIM
uacccguuauauuucaagcu

SEQ ID NO: 2291282 - RNA, 19 nt, Yersinia pestis KIM
uaccgacagcaucuagcag

SEQ ID NO: 2291283 - RNA, 20 nt, Yersinia pestis KIM
uaccagucgucaaaagcggc

SEQ ID NO: 2291284 - RNA, 15 nt, Yersinia pestis KIM
uaccauaacaauggc

SEQ ID NO: 2291285 - RNA, 22 nt, Yersinia pestis KIM
uacaaaaagcgacuaauaucag

SEQ ID NO: 2291286 - RNA, 13 nt, Yersinia pestis KIM
uaccaugccauca

SEQ ID NO: 2291287 - RNA, 23 nt, Yersinia pestis KIM
ucaacagauaugcauuauugaug

SEQ ID NO: 2291288 - RNA, 22 nt, Yersinia pestis KIM
ucaacagaacuaauaucaacag

SEQ ID NO: 2291289 - RNA, 18 nt, Yersinia pestis KIM
ucaacagcaucaucaaau

SEQ ID NO: 2291290 - RNA, 21 nt, Yersinia pestis KIM
ucaaauucagguugaucagua

SEQ ID NO: 2291291 - RNA, 15 nt, Yersinia pestis KIM
uauugacaggaucag

SEQ ID NO: 2291292 - RNA, 18 nt, Yersinia pestis KIM
uauugacccucuuaauga

SEQ ID NO: 2291293 - RNA, 16 nt, Yersinia pestis KIM
uauuuucggguaucug

SEQ ID NO: 2291294 - RNA, 19 nt, Yersinia pestis KIM
uauuucuccccacuucauc

SEQ ID NO: 2291295 - RNA, 14 nt, Yersinia pestis KIM
uauucgucaccauc

SEQ ID NO: 2291296 - RNA, 16 nt, Yersinia pestis KIM
uauuccgucgauaucu

SEQ ID NO: 2291297 - RNA, 12 nt, Yersinia pestis KIM
uauggauuggca

SEQ ID NO: 2291298 - RNA, 20 nt, Yersinia pestis KIM
uauucagacgguugcuagag

SEQ ID NO: 2291299 - RNA, 17 nt, Yersinia pestis KIM
uauucauagguagaaua

SEQ ID NO: 2291300 - RNA, 17 nt, Yersinia pestis KIM
uauucauaucgcucauc

SEQ ID NO: 2291301 - RNA, 17 nt, Yersinia pestis KIM
uauucauauuucacugu

SEQ ID NO: 2291302 - RNA, 20 nt, Yersinia pestis KIM
uauggauaaauccugaacau

SEQ ID NO: 2291303 - RNA, 22 nt, Yersinia pestis KIM
uauggagaggcgcuagccucuc

SEQ ID NO: 2291304 - RNA, 15 nt, Yersinia pestis KIM
uaugcuugcggcguu

SEQ ID NO: 2291305 - RNA, 18 nt, Yersinia pestis KIM
uauaacgaauauucaaga

SEQ ID NO: 2291306 - RNA, 21 nt, Yersinia pestis KIM
uauaacaauguuuauccgcua

SEQ ID NO: 2291307 - RNA, 18 nt, Yersinia pestis KIM
uauaaaccagccagugau

SEQ ID NO: 2291308 - RNA, 18 nt, Yersinia pestis KIM
uauaaauaauuaucgaua

SEQ ID NO: 2291309 - RNA, 15 nt, Yersinia pestis KIM
uaucaucccuuaacc

SEQ ID NO: 2291310 - RNA, 23 nt, Yersinia pestis KIM
uaucaaacagcacaucgccauua

SEQ ID NO: 2291311 - RNA, 20 nt, Yersinia pestis KIM
uaucaacgauguaaacgaau

SEQ ID NO: 2291312 - RNA, 18 nt, Yersinia pestis KIM
uauccucuggguaugcuc

SEQ ID NO: 2291313 - RNA, 12 nt, Yersinia pestis KIM
uaucauucaaga

SEQ ID NO: 2291314 - RNA, 16 nt, Yersinia pestis KIM
uagucuuagacgucag

SEQ ID NO: 2291315 - RNA, 18 nt, Yersinia pestis KIM
uagucaauguucucuggg

SEQ ID NO: 2291316 - RNA, 20 nt, Yersinia pestis KIM
uagucacgucuucaccaaug

SEQ ID NO: 2291317 - RNA, 18 nt, Yersinia pestis KIM
uaguaacaaaaugcggug

SEQ ID NO: 2291318 - RNA, 22 nt, Yersinia pestis KIM
uagcuuauccccugagaaacau

SEQ ID NO: 2291319 - RNA, 16 nt, Yersinia pestis KIM
aaguugagaucaacuc

SEQ ID NO: 2291320 - RNA, 18 nt, Yersinia pestis KIM
ucacccgcacguagcaca

SEQ ID NO: 2291321 - RNA, 24 nt, Yersinia pestis KIM
ucaccuuugaucauggcuugugca

SEQ ID NO: 2291322 - RNA, 21 nt, Yersinia pestis KIM
ucacccaauaagauaaacagc

SEQ ID NO: 2291323 - RNA, 14 nt, Yersinia pestis KIM
ucaccagguccgcc

SEQ ID NO: 2291324 - RNA, 14 nt, Yersinia pestis KIM
ucaccaaucggauc

SEQ ID NO: 2291325 - RNA, 18 nt, Yersinia pestis KIM
ucaacgcccagcuuuagc

SEQ ID NO: 2291326 - RNA, 17 nt, Yersinia pestis KIM
ucacaccauagcgguuu

SEQ ID NO: 2291327 - RNA, 20 nt, Yersinia pestis KIM
ucacaguaaaucaggccggu

SEQ ID NO: 2291328 - RNA, 19 nt, Yersinia pestis KIM
ucaccaaaggaagccgagc

SEQ ID NO: 2291329 - RNA, 23 nt, Yersinia pestis KIM
ucacaugcggauugaacugcgcu

SEQ ID NO: 2291330 - RNA, 19 nt, Yersinia pestis KIM
ucagcagucugagccucau

SEQ ID NO: 2291331 - RNA, 18 nt, Yersinia pestis KIM
aauacaggugucaucaag

SEQ ID NO: 2291332 - RNA, 23 nt, Yersinia pestis KIM
aauacaggcaucgguaauacucu

SEQ ID NO: 2291333 - RNA, 17 nt, Yersinia pestis KIM
ucagauuuacuccccaa

SEQ ID NO: 2291334 - RNA, 16 nt, Yersinia pestis KIM
ucagacugcugacaac

SEQ ID NO: 2291335 - RNA, 21 nt, Yersinia pestis KIM
ucagcacauccaugccauggc

SEQ ID NO: 2291336 - RNA, 19 nt, Yersinia pestis KIM
ucacuguggcggccagugc

SEQ ID NO: 2291337 - RNA, 18 nt, Yersinia pestis KIM
ucacuguggcggccagug

SEQ ID NO: 2291338 - RNA, 17 nt, Yersinia pestis KIM
ucacugcuccagccaac

SEQ ID NO: 2291339 - RNA, 23 nt, Yersinia pestis KIM
ucagaaugaaaggcggugaacag

SEQ ID NO: 2291340 - RNA, 12 nt, Yersinia pestis KIM
uccaggcauuaa

SEQ ID NO: 2291341 - RNA, 18 nt, Yersinia pestis KIM
uccaggcaagcaaccgca

SEQ ID NO: 2291342 - RNA, 20 nt, Yersinia pestis KIM
ucaugcucugcuaauacgcu

SEQ ID NO: 2291343 - RNA, 17 nt, Yersinia pestis KIM
uccaaaugcccauuagu

SEQ ID NO: 2291344 - RNA, 12 nt, Yersinia pestis KIM
uccacauugauc

SEQ ID NO: 2291345 - RNA, 15 nt, Yersinia pestis KIM
ucaucaacugacagc

SEQ ID NO: 2291346 - RNA, 17 nt, Yersinia pestis KIM
ucaucaagccaauggcc

SEQ ID NO: 2291347 - RNA, 22 nt, Yersinia pestis KIM
ucaguuaacggaaaugauaucu

SEQ ID NO: 2291348 - RNA, 15 nt, Yersinia pestis KIM
ucagugaaggaugaa

SEQ ID NO: 2291349 - RNA, 23 nt, Yersinia pestis KIM
ucaucccgguugcgauacagcgc

SEQ ID NO: 2291350 - RNA, 20 nt, Yersinia pestis KIM
ucaucccagucgucuucagc

SEQ ID NO: 2291351 - RNA, 14 nt, Yersinia pestis KIM
ucaugaauaggaua

SEQ ID NO: 2291352 - RNA, 19 nt, Yersinia pestis KIM
ucagguguucagccaaguc

SEQ ID NO: 2291353 - RNA, 14 nt, Yersinia pestis KIM
ucagguggugcccg

SEQ ID NO: 2291354 - RNA, 19 nt, Yersinia pestis KIM
ucagggcgucucuacgacg

SEQ ID NO: 2291355 - RNA, 21 nt, Yersinia pestis KIM
ucagguaaaccgguuaaaaca

SEQ ID NO: 2291356 - RNA, 15 nt, Yersinia pestis KIM
ucgagcuaccggcau

SEQ ID NO: 2291357 - RNA, 18 nt, Yersinia pestis KIM
uccugaugacucaucugg

SEQ ID NO: 2291358 - RNA, 22 nt, Yersinia pestis KIM
uccggugguuucgccgccaauc

SEQ ID NO: 2291359 - RNA, 17 nt, Yersinia pestis KIM
uccuggcaaugcgcggg

SEQ ID NO: 2291360 - RNA, 14 nt, Yersinia pestis KIM
ucccuguuacggua

SEQ ID NO: 2291361 - RNA, 13 nt, Yersinia pestis KIM
ucccucggcuuau

SEQ ID NO: 2291362 - RNA, 16 nt, Yersinia pestis KIM
ucccugacucccugac

SEQ ID NO: 2291363 - RNA, 14 nt, Yersinia pestis KIM
ucccuaaagccauc

SEQ ID NO: 2291364 - RNA, 17 nt, Yersinia pestis KIM
uccccccuucaucgaca

SEQ ID NO: 2291365 - RNA, 18 nt, Yersinia pestis KIM
uccccacuucaucaucaa

SEQ ID NO: 2291366 - RNA, 16 nt, Yersinia pestis KIM
ucgccaaaguaaucag

SEQ ID NO: 2291367 - RNA, 21 nt, Yersinia pestis KIM
ucgccaacaggccuaaugccg

SEQ ID NO: 2291368 - RNA, 14 nt, Yersinia pestis KIM
aauaccaaugcugu

SEQ ID NO: 2291369 - RNA, 14 nt, Yersinia pestis KIM
aauaccgcuaacgu

SEQ ID NO: 2291370 - RNA, 19 nt, Yersinia pestis KIM
aauaccccccaccaauugg

SEQ ID NO: 2291371 - RNA, 17 nt, Yersinia pestis KIM
ucggccuguucucgccg

SEQ ID NO: 2291372 - RNA, 22 nt, Yersinia pestis KIM
ucggcgaaaucacguacacggc

SEQ ID NO: 2291373 - RNA, 14 nt, Yersinia pestis KIM
ugacgcgaucgucg

SEQ ID NO: 2291374 - RNA, 15 nt, Yersinia pestis KIM
ugacggucagccaac

SEQ ID NO: 2291375 - RNA, 22 nt, Yersinia pestis KIM
ugacgcgaaacgcccaaaucug

SEQ ID NO: 2291376 - RNA, 14 nt, Yersinia pestis KIM
ugaccuaaaccgcu

SEQ ID NO: 2291377 - RNA, 16 nt, Yersinia pestis KIM
ugaggagccauugauu

SEQ ID NO: 2291378 - RNA, 14 nt, Yersinia pestis KIM
ugauaaaaccgcuu

SEQ ID NO: 2291379 - RNA, 14 nt, Yersinia pestis KIM
ugauaaaauccuga

SEQ ID NO: 2291380 - RNA, 23 nt, Yersinia pestis KIM
ugaggccaacacucaugacaaaa

SEQ ID NO: 2291381 - RNA, 23 nt, Yersinia pestis KIM
ugaggauaggccggggagccaag

SEQ ID NO: 2291382 - RNA, 16 nt, Yersinia pestis KIM
ugauaccacaauccgg

SEQ ID NO: 2291383 - RNA, 19 nt, Yersinia pestis KIM
ugauaaguuggaggcguuu

SEQ ID NO: 2291384 - RNA, 22 nt, Yersinia pestis KIM
ugauauuuaagccaugacaggu

SEQ ID NO: 2291385 - RNA, 16 nt, Yersinia pestis KIM
ugauauucgcccgcug

SEQ ID NO: 2291386 - RNA, 20 nt, Yersinia pestis KIM
ugaucagauuucugaccgga

SEQ ID NO: 2291387 - RNA, 18 nt, Yersinia pestis KIM
ugaucguuuuauggcgau

SEQ ID NO: 2291388 - RNA, 23 nt, Yersinia pestis KIM
ugaucuguacccccguaucaacg

SEQ ID NO: 2291389 - RNA, 21 nt, Yersinia pestis KIM
ugaugacgcuaaccaccguca

SEQ ID NO: 2291390 - RNA, 15 nt, Yersinia pestis KIM
ugaugaaugacuggc

SEQ ID NO: 2291391 - RNA, 21 nt, Yersinia pestis KIM
ugcccagucacuaccgcucag

SEQ ID NO: 2291392 - RNA, 19 nt, Yersinia pestis KIM
ugccacggauauccaacgg

SEQ ID NO: 2291393 - RNA, 16 nt, Yersinia pestis KIM
ugccacugacugcuuu

SEQ ID NO: 2291394 - RNA, 19 nt, Yersinia pestis KIM
ugccagacacaagauaaau

SEQ ID NO: 2291395 - RNA, 23 nt, Yersinia pestis KIM
ugcauacccgucguacuuuaagc

SEQ ID NO: 2291396 - RNA, 17 nt, Yersinia pestis KIM
ugcauauccucccgcua

SEQ ID NO: 2291397 - RNA, 20 nt, Yersinia pestis KIM
ugcauauaaaacacgcauau

SEQ ID NO: 2291398 - RNA, 23 nt, Yersinia pestis KIM
ugccacgccaguaaacagccagc

SEQ ID NO: 2291399 - RNA, 22 nt, Yersinia pestis KIM
ugcaguuuuccucccugccaag

SEQ ID NO: 2291400 - RNA, 24 nt, Yersinia pestis KIM
ugcagcggaacugaugaucauugc

SEQ ID NO: 2291401 - RNA, 19 nt, Yersinia pestis KIM
ugcacuucuacagggcaua

SEQ ID NO: 2291402 - RNA, 18 nt, Yersinia pestis KIM
ugauguaacagcggcgau

SEQ ID NO: 2291403 - RNA, 14 nt, Yersinia pestis KIM
ugcaccuuugcgag

SEQ ID NO: 2291404 - RNA, 17 nt, Yersinia pestis KIM
ucgguauauuucccguu

SEQ ID NO: 2291405 - RNA, 22 nt, Yersinia pestis KIM
ucgggcugaguaaagcccagca

SEQ ID NO: 2291406 - RNA, 17 nt, Yersinia pestis KIM
ucgggggcucguuggcc

SEQ ID NO: 2291407 - RNA, 12 nt, Yersinia pestis KIM
ucgggccacuga

SEQ ID NO: 2291408 - RNA, 13 nt, Yersinia pestis KIM
ucggcuuuaccuu

SEQ ID NO: 2291409 - RNA, 13 nt, Yersinia pestis KIM
ucggcuuaaccaa

SEQ ID NO: 2291410 - RNA, 21 nt, Yersinia pestis KIM
ucgguuagcuguccucuacca

SEQ ID NO: 2291411 - RNA, 20 nt, Yersinia pestis KIM
ucggucaguuucauaccggu

SEQ ID NO: 2291412 - RNA, 14 nt, Yersinia pestis KIM
ucgucuucgacagc

SEQ ID NO: 2291413 - RNA, 21 nt, Yersinia pestis KIM
ucgugaucaaccgaggcgcug

SEQ ID NO: 2291414 - RNA, 22 nt, Yersinia pestis KIM
ucucaauacgcugucugaauag

SEQ ID NO: 2291415 - RNA, 23 nt, Yersinia pestis KIM
ucuauuuuuauaaucaucuacaa

SEQ ID NO: 2291416 - RNA, 14 nt, Yersinia pestis KIM
ucucccucagugag

SEQ ID NO: 2291417 - RNA, 14 nt, Yersinia pestis KIM
ucucguucuuaacc

SEQ ID NO: 2291418 - RNA, 13 nt, Yersinia pestis KIM
ucucguggcguuc

SEQ ID NO: 2291419 - RNA, 21 nt, Yersinia pestis KIM
ucucuuaggcaaccuugguga

SEQ ID NO: 2291420 - RNA, 18 nt, Yersinia pestis KIM
ucucuccgcaaugccucu

SEQ ID NO: 2291421 - RNA, 20 nt, Yersinia pestis KIM
ucugaauuuauuauuggcag

SEQ ID NO: 2291422 - RNA, 15 nt, Yersinia pestis KIM
ucugaaacggugagg

SEQ ID NO: 2291423 - RNA, 19 nt, Yersinia pestis KIM
ucugcaauacugggcuuau

SEQ ID NO: 2291424 - RNA, 15 nt, Yersinia pestis KIM
ucugcaauagccaug

SEQ ID NO: 2291425 - RNA, 16 nt, Yersinia pestis KIM
ucugcaacucagugaa

SEQ ID NO: 2291426 - RNA, 18 nt, Yersinia pestis KIM
ugaaaugauuaaacgccu

SEQ ID NO: 2291427 - RNA, 19 nt, Yersinia pestis KIM
ugaaauugcuucaauaccg

SEQ ID NO: 2291428 - RNA, 18 nt, Yersinia pestis KIM
ugaaccaguugaucgucc

SEQ ID NO: 2291429 - RNA, 18 nt, Yersinia pestis KIM
ugaacccuuucagcgcuu

SEQ ID NO: 2291430 - RNA, 17 nt, Yersinia pestis KIM
ugaacagauagauaaau

SEQ ID NO: 2291431 - RNA, 20 nt, Yersinia pestis KIM
ugaacgaggacuuccugccc

SEQ ID NO: 2291432 - RNA, 20 nt, Yersinia pestis KIM
ugaaauacuuauuugaaaca

SEQ ID NO: 2291433 - RNA, 23 nt, Yersinia pestis KIM
ucuuggauaacagauuugguauu

SEQ ID NO: 2291434 - RNA, 22 nt, Yersinia pestis KIM
ucuucggcaaaauaaucggcaa

SEQ ID NO: 2291435 - RNA, 16 nt, Yersinia pestis KIM
ucuucaaucaggugaa

SEQ ID NO: 2291436 - RNA, 14 nt, Yersinia pestis KIM
ucuuacugauaucu

SEQ ID NO: 2291437 - RNA, 15 nt, Yersinia pestis KIM
ucuuaaaaauaacuu

SEQ ID NO: 2291438 - RNA, 15 nt, Yersinia pestis KIM
acgcgcgucaucaac

SEQ ID NO: 2291439 - RNA, 14 nt, Yersinia pestis KIM
acgccugggaucca

SEQ ID NO: 2291440 - RNA, 18 nt, Yersinia pestis KIM
acgccuacggcuucccau

SEQ ID NO: 2291441 - RNA, 18 nt, Yersinia pestis KIM
acgccuaucucgacaaau

SEQ ID NO: 2291442 - RNA, 22 nt, Yersinia pestis KIM
acgcgaucuugaacggugagga

SEQ ID NO: 2291443 - RNA, 19 nt, Yersinia pestis KIM
acgccgcuaaaucaucaaa

SEQ ID NO: 2291444 - RNA, 12 nt, Yersinia pestis KIM
acgccgcuacaa

SEQ ID NO: 2291445 - RNA, 15 nt, Yersinia pestis KIM
acgccacaccacguu

SEQ ID NO: 2291446 - RNA, 16 nt, Yersinia pestis KIM
acgcaguacgugacgg

SEQ ID NO: 2291447 - RNA, 14 nt, Yersinia pestis KIM
acgcccaaaucugc

SEQ ID NO: 2291448 - RNA, 18 nt, Yersinia pestis KIM
acgcaauacgguaggcau

SEQ ID NO: 2291449 - RNA, 14 nt, Yersinia pestis KIM
accugcaucaucac

SEQ ID NO: 2291450 - RNA, 16 nt, Yersinia pestis KIM
accugcccagacucaa

SEQ ID NO: 2291451 - RNA, 17 nt, Yersinia pestis KIM
accugaaugccauucaa

SEQ ID NO: 2291452 - RNA, 16 nt, Yersinia pestis KIM
accucguaguaaugac

SEQ ID NO: 2291453 - RNA, 16 nt, Yersinia pestis KIM
accucgaaaucauccg

SEQ ID NO: 2291454 - RNA, 18 nt, Yersinia pestis KIM
accucaggcccgcuauca

SEQ ID NO: 2291455 - RNA, 17 nt, Yersinia pestis KIM
accucagggagccaaua

SEQ ID NO: 2291456 - RNA, 16 nt, Yersinia pestis KIM
accuauugauaaaacc

SEQ ID NO: 2291457 - RNA, 19 nt, Yersinia pestis KIM
accuaccgcaccaaugccg

SEQ ID NO: 2291458 - RNA, 16 nt, Yersinia pestis KIM
accuaccgcaccaaug

SEQ ID NO: 2291459 - RNA, 14 nt, Yersinia pestis KIM
accuaggcuuucaa

SEQ ID NO: 2291460 - RNA, 14 nt, Yersinia pestis KIM
acgaccgucaccaa

SEQ ID NO: 2291461 - RNA, 14 nt, Yersinia pestis KIM
accuuuauguaaca

SEQ ID NO: 2291462 - RNA, 18 nt, Yersinia pestis KIM
accugcucaacugcucaa

SEQ ID NO: 2291463 - RNA, 12 nt, Yersinia pestis KIM
accugcucaacu

SEQ ID NO: 2291464 - RNA, 16 nt, Yersinia pestis KIM
accugcuggcgcaacu

SEQ ID NO: 2291465 - RNA, 21 nt, Yersinia pestis KIM
accuggacgcuggcagccuuu

SEQ ID NO: 2291466 - RNA, 17 nt, Yersinia pestis KIM
accuucaaacgggugau

SEQ ID NO: 2291467 - RNA, 17 nt, Yersinia pestis KIM
accuuacugcaucaaua

SEQ ID NO: 2291468 - RNA, 12 nt, Yersinia pestis KIM
acggcggccuua

SEQ ID NO: 2291469 - RNA, 17 nt, Yersinia pestis KIM
acgggcgcaauggaaga

SEQ ID NO: 2291470 - RNA, 22 nt, Yersinia pestis KIM
acggguuccgcguuuaucgacc

SEQ ID NO: 2291471 - RNA, 13 nt, Yersinia pestis KIM
acgggugauuucc

SEQ ID NO: 2291472 - RNA, 22 nt, Yersinia pestis KIM
acggcagugaucgcacuucaac

SEQ ID NO: 2291473 - RNA, 13 nt, Yersinia pestis KIM
acggcaggcgguu

SEQ ID NO: 2291474 - RNA, 23 nt, Yersinia pestis KIM
acggcagauuggaugucaggauc

SEQ ID NO: 2291475 - RNA, 14 nt, Yersinia pestis KIM
acggccagaaucaa

SEQ ID NO: 2291476 - RNA, 14 nt, Yersinia pestis KIM
acggauaucaacau

SEQ ID NO: 2291477 - RNA, 11 nt, Yersinia pestis KIM
acgcuggccag

SEQ ID NO: 2291478 - RNA, 17 nt, Yersinia pestis KIM
acgcugcguuucaauug

SEQ ID NO: 2291479 - RNA, 19 nt, Yersinia pestis KIM
acucgacaaccuucucccg

SEQ ID NO: 2291480 - RNA, 14 nt, Yersinia pestis KIM
acucccauucgcgc

SEQ ID NO: 2291481 - RNA, 20 nt, Yersinia pestis KIM
acucuuugaguagcaggccg

SEQ ID NO: 2291482 - RNA, 13 nt, Yersinia pestis KIM
acugaucaucaac

SEQ ID NO: 2291483 - RNA, 21 nt, Yersinia pestis KIM
acugaucaucaacgcgccuuu

SEQ ID NO: 2291484 - RNA, 21 nt, Yersinia pestis KIM
acugaaucccagaaccucaac

SEQ ID NO: 2291485 - RNA, 17 nt, Yersinia pestis KIM
acugcgcaaauccugaa

SEQ ID NO: 2291486 - RNA, 14 nt, Yersinia pestis KIM
acugauuucaggaa

SEQ ID NO: 2291487 - RNA, 16 nt, Yersinia pestis KIM
acugauuucaggaaug

SEQ ID NO: 2291488 - RNA, 15 nt, Yersinia pestis KIM
acgguauagcuauca

SEQ ID NO: 2291489 - RNA, 18 nt, Yersinia pestis KIM
acgucaguuaaauaugac

SEQ ID NO: 2291490 - RNA, 21 nt, Yersinia pestis KIM
acguuggcggcuccaggcauu

SEQ ID NO: 2291491 - RNA, 21 nt, Yersinia pestis KIM
acuaaaacugaagcaucaaua

SEQ ID NO: 2291492 - RNA, 23 nt, Yersinia pestis KIM
acuacugcaagccguaauucaga

SEQ ID NO: 2291493 - RNA, 20 nt, Yersinia pestis KIM
acccuuuagaggcugauaac

SEQ ID NO: 2291494 - RNA, 22 nt, Yersinia pestis KIM
acccgcuugucuugaaaguguc

SEQ ID NO: 2291495 - RNA, 22 nt, Yersinia pestis KIM
acccccaaugaguagcuguagc

SEQ ID NO: 2291496 - RNA, 23 nt, Yersinia pestis KIM
accagcuugggugaagacacuuu

SEQ ID NO: 2291497 - RNA, 18 nt, Yersinia pestis KIM
accggauuguucagcaac

SEQ ID NO: 2291498 - RNA, 17 nt, Yersinia pestis KIM
accgcgcuugcaucaac

SEQ ID NO: 2291499 - RNA, 15 nt, Yersinia pestis KIM
accgcguuauggaga

SEQ ID NO: 2291500 - RNA, 15 nt, Yersinia pestis KIM
accggcugauuaccu

SEQ ID NO: 2291501 - RNA, 11 nt, Yersinia pestis KIM
accgcauaaga

SEQ ID NO: 2291502 - RNA, 16 nt, Yersinia pestis KIM
accgcaggucagaaug

SEQ ID NO: 2291503 - RNA, 18 nt, Yersinia pestis KIM
accgcaugaauauucacc

SEQ ID NO: 2291504 - RNA, 23 nt, Yersinia pestis KIM
accgcacugcccagguucaaaau

SEQ ID NO: 2291505 - RNA, 19 nt, Yersinia pestis KIM
accgcgaucacaauacagc

SEQ ID NO: 2291506 - RNA, 15 nt, Yersinia pestis KIM
acacuggugcucacu

SEQ ID NO: 2291507 - RNA, 16 nt, Yersinia pestis KIM
acagccaccagccaac

SEQ ID NO: 2291508 - RNA, 20 nt, Yersinia pestis KIM
acacagcacggcaacaggcu

SEQ ID NO: 2291509 - RNA, 13 nt, Yersinia pestis KIM
acaccgccagcaa

SEQ ID NO: 2291510 - RNA, 20 nt, Yersinia pestis KIM
acacgacauguguaguaugc

SEQ ID NO: 2291511 - RNA, 13 nt, Yersinia pestis KIM
acaccggucgccg

SEQ ID NO: 2291512 - RNA, 14 nt, Yersinia pestis KIM
acacgcccaggcca

SEQ ID NO: 2291513 - RNA, 16 nt, Yersinia pestis KIM
acaaacagggcagcca

SEQ ID NO: 2291514 - RNA, 16 nt, Yersinia pestis KIM
aauguucggucauaau

SEQ ID NO: 2291515 - RNA, 19 nt, Yersinia pestis KIM
aauuaaaaagaguguucau

SEQ ID NO: 2291516 - RNA, 14 nt, Yersinia pestis KIM
aauguuaucgccaa

SEQ ID NO: 2291517 - RNA, 16 nt, Yersinia pestis KIM
acaaccccaugaccgc

SEQ ID NO: 2291518 - RNA, 16 nt, Yersinia pestis KIM
acaacccgauccagaa

SEQ ID NO: 2291519 - RNA, 15 nt, Yersinia pestis KIM
acaacgcucuaacgu

SEQ ID NO: 2291520 - RNA, 16 nt, Yersinia pestis KIM
acaacgucauuuguga

SEQ ID NO: 2291521 - RNA, 12 nt, Yersinia pestis KIM
acaagacaauau

SEQ ID NO: 2291522 - RNA, 20 nt, Yersinia pestis KIM
acaagggguuucagacuccu

SEQ ID NO: 2291523 - RNA, 11 nt, Yersinia pestis KIM
acaauccggug

SEQ ID NO: 2291524 - RNA, 19 nt, Yersinia pestis KIM
acaaucucuggcaacggca

SEQ ID NO: 2291525 - RNA, 15 nt, Yersinia pestis KIM
acaauaaaucgccac

SEQ ID NO: 2291526 - RNA, 16 nt, Yersinia pestis KIM
acaauaaguugaacag

SEQ ID NO: 2291527 - RNA, 17 nt, Yersinia pestis KIM
acaauagucucuugggc

SEQ ID NO: 2291528 - RNA, 16 nt, Yersinia pestis KIM
accacugauacccagu

SEQ ID NO: 2291529 - RNA, 15 nt, Yersinia pestis KIM
accacccgcuggcgc

SEQ ID NO: 2291530 - RNA, 15 nt, Yersinia pestis KIM
accaccagguuaccu

SEQ ID NO: 2291531 - RNA, 22 nt, Yersinia pestis KIM
accaccaaaaacuucaucgaua

SEQ ID NO: 2291532 - RNA, 15 nt, Yersinia pestis KIM
accaccaaaauagcg

SEQ ID NO: 2291533 - RNA, 15 nt, Yersinia pestis KIM
acaucuucauuuggc

SEQ ID NO: 2291534 - RNA, 22 nt, Yersinia pestis KIM
acauuuucaucugaccaaacau

SEQ ID NO: 2291535 - RNA, 13 nt, Yersinia pestis KIM
accaauaccggcg

SEQ ID NO: 2291536 - RNA, 12 nt, Yersinia pestis KIM
accaauagucac

SEQ ID NO: 2291537 - RNA, 14 nt, Yersinia pestis KIM
accaacuggcaauc

SEQ ID NO: 2291538 - RNA, 17 nt, Yersinia pestis KIM
accaaccgguugacguu

SEQ ID NO: 2291539 - RNA, 22 nt, Yersinia pestis KIM
accaacaccaucgcagcgacau

SEQ ID NO: 2291540 - RNA, 21 nt, Yersinia pestis KIM
accaaaucuuccagcggcaaa

SEQ ID NO: 2291541 - RNA, 18 nt, Yersinia pestis KIM
accaaaauguuuauacgc

SEQ ID NO: 2291542 - RNA, 21 nt, Yersinia pestis KIM
accaaacagaccccagaagau

SEQ ID NO: 2291543 - RNA, 18 nt, Yersinia pestis KIM
accaaagcaacagccaua

SEQ ID NO: 2291544 - RNA, 19 nt, Yersinia pestis KIM
acauauccugugccaacau

SEQ ID NO: 2291545 - RNA, 19 nt, Yersinia pestis KIM
acauauaaaccagccagug

SEQ ID NO: 2291546 - RNA, 15 nt, Yersinia pestis KIM
acaguuguuucaaua

SEQ ID NO: 2291547 - RNA, 21 nt, Yersinia pestis KIM
uggcggcuugccugacagccu

SEQ ID NO: 2291548 - RNA, 21 nt, Yersinia pestis KIM
uggcgaagagaacaggcagca

SEQ ID NO: 2291549 - RNA, 22 nt, Yersinia pestis KIM
uggcauuggcguuuuggauaac

SEQ ID NO: 2291550 - RNA, 17 nt, Yersinia pestis KIM
uggcauuuuuuacgguu

SEQ ID NO: 2291551 - RNA, 22 nt, Yersinia pestis KIM
ugguugcacgugaggauucaag

SEQ ID NO: 2291552 - RNA, 22 nt, Yersinia pestis KIM
ugguugcccggcaaacuuaauu

SEQ ID NO: 2291553 - RNA, 21 nt, Yersinia pestis KIM
uguaagcggaugguuaaucca

SEQ ID NO: 2291554 - RNA, 14 nt, Yersinia pestis KIM
uguaauccggcaaa

SEQ ID NO: 2291555 - RNA, 18 nt, Yersinia pestis KIM
uguagcccacugacacug

SEQ ID NO: 2291556 - RNA, 21 nt, Yersinia pestis KIM
uguagcagcaccauacagcag

SEQ ID NO: 2291557 - RNA, 13 nt, Yersinia pestis KIM
ugggcgauagucg

SEQ ID NO: 2291558 - RNA, 17 nt, Yersinia pestis KIM
aauaugaaggccauaau

SEQ ID NO: 2291559 - RNA, 13 nt, Yersinia pestis KIM
aauaugcacguca

SEQ ID NO: 2291560 - RNA, 21 nt, Yersinia pestis KIM
aauaucggccaucgccaguaa

SEQ ID NO: 2291561 - RNA, 23 nt, Yersinia pestis KIM
aauauucgcauucgugccauaaa

SEQ ID NO: 2291562 - RNA, 15 nt, Yersinia pestis KIM
aauauuccauacugu

SEQ ID NO: 2291563 - RNA, 23 nt, Yersinia pestis KIM
aauagcaccauuaggcuuaggca

SEQ ID NO: 2291564 - RNA, 13 nt, Yersinia pestis KIM
ugcgcaacuugcu

SEQ ID NO: 2291565 - RNA, 16 nt, Yersinia pestis KIM
aauagcguuaacgaua

SEQ ID NO: 2291566 - RNA, 20 nt, Yersinia pestis KIM
ugccugugcggcagugaacg

SEQ ID NO: 2291567 - RNA, 14 nt, Yersinia pestis KIM
ugcgccauaaugcg

SEQ ID NO: 2291568 - RNA, 17 nt, Yersinia pestis KIM
ugcgccaguggcaucaa

SEQ ID NO: 2291569 - RNA, 14 nt, Yersinia pestis KIM
ugcgccagccaauc

SEQ ID NO: 2291570 - RNA, 15 nt, Yersinia pestis KIM
ugcgguggccagagc

SEQ ID NO: 2291571 - RNA, 16 nt, Yersinia pestis KIM
ugcguaaauuacguuc

SEQ ID NO: 2291572 - RNA, 16 nt, Yersinia pestis KIM
ugcugcaaggcauuaa

SEQ ID NO: 2291573 - RNA, 16 nt, Yersinia pestis KIM
ugcugaucgagcauca

SEQ ID NO: 2291574 - RNA, 22 nt, Yersinia pestis KIM
ugcuccagaggguaugacauuc

SEQ ID NO: 2291575 - RNA, 12 nt, Yersinia pestis KIM
ugcuccagcacu

SEQ ID NO: 2291576 - RNA, 13 nt, Yersinia pestis KIM
ugcuccgggcaag

SEQ ID NO: 2291577 - RNA, 14 nt, Yersinia pestis KIM
ugcucccgcacucu

SEQ ID NO: 2291578 - RNA, 12 nt, Yersinia pestis KIM
aauaucaaugau

SEQ ID NO: 2291579 - RNA, 19 nt, Yersinia pestis KIM
ugcucagcgggcuaaaugc

SEQ ID NO: 2291580 - RNA, 22 nt, Yersinia pestis KIM
aauauauucucuuaucgauuca

SEQ ID NO: 2291581 - RNA, 20 nt, Yersinia pestis KIM
ugcugugguugauccgaguu

SEQ ID NO: 2291582 - RNA, 19 nt, Yersinia pestis KIM
ugcuguggguucaucaacu

SEQ ID NO: 2291583 - RNA, 23 nt, Yersinia pestis KIM
ugcuguuaguaacuguaaggcca

SEQ ID NO: 2291584 - RNA, 22 nt, Yersinia pestis KIM
ugcuguuuugucacaaugcugu

SEQ ID NO: 2291585 - RNA, 15 nt, Yersinia pestis KIM
ugcuucacggacagc

SEQ ID NO: 2291586 - RNA, 19 nt, Yersinia pestis KIM
ugcuucacggacagcaacc

SEQ ID NO: 2291587 - RNA, 13 nt, Yersinia pestis KIM
ugcuuuuugcgcu

SEQ ID NO: 2291588 - RNA, 14 nt, Yersinia pestis KIM
uggaaauagaaaac

SEQ ID NO: 2291589 - RNA, 19 nt, Yersinia pestis KIM
aaucuacaaagucugauac

SEQ ID NO: 2291590 - RNA, 16 nt, Yersinia pestis KIM
aaugacaaaucagcgu

SEQ ID NO: 2291591 - RNA, 22 nt, Yersinia pestis KIM
aaugacagacgcgguuaacgac

SEQ ID NO: 2291592 - RNA, 23 nt, Yersinia pestis KIM
aaugaagguacgcaccauugagc

SEQ ID NO: 2291593 - RNA, 16 nt, Yersinia pestis KIM
aaugaauaacgccggc

SEQ ID NO: 2291594 - RNA, 22 nt, Yersinia pestis KIM
aaugaacauuauuuuucacgag

SEQ ID NO: 2291595 - RNA, 22 nt, Yersinia pestis KIM
uuuuuguagugaaagcguuaau

SEQ ID NO: 2291596 - RNA, 17 nt, Yersinia pestis KIM
aaugguuugcuguucuu

SEQ ID NO: 2291597 - RNA, 16 nt, Yersinia pestis KIM
aauggucgaucagcgu

SEQ ID NO: 2291598 - RNA, 18 nt, Yersinia pestis KIM
aauggcgaauaucaccgu

SEQ ID NO: 2291599 - RNA, 16 nt, Yersinia pestis KIM
aauggauuaucggcgg

SEQ ID NO: 2291600 - RNA, 15 nt, Yersinia pestis KIM
aaugcgcgcagcaag

SEQ ID NO: 2291601 - RNA, 16 nt, Yersinia pestis KIM
aaugaugguaacgcgc

SEQ ID NO: 2291602 - RNA, 23 nt, Yersinia pestis KIM
aaugaugagguaauacucaucca

SEQ ID NO: 2291603 - RNA, 23 nt, Yersinia pestis KIM
aaugagauugaucaguggcuuaa

SEQ ID NO: 2291604 - RNA, 20 nt, Yersinia pestis KIM
aaugacuaauugugcagcau

SEQ ID NO: 2291605 - RNA, 15 nt, Yersinia pestis KIM
aaugacuuaacugaa

SEQ ID NO: 2291606 - RNA, 21 nt, Yersinia pestis KIM
uuucuucaauaauguggcaug

SEQ ID NO: 2291607 - RNA, 23 nt, Yersinia pestis KIM
uuucugaagggcaaauugccgcu

SEQ ID NO: 2291608 - RNA, 14 nt, Yersinia pestis KIM
uuucucuuggcuga

SEQ ID NO: 2291609 - RNA, 22 nt, Yersinia pestis KIM
uuucuuaagcguacacuuucua

SEQ ID NO: 2291610 - RNA, 15 nt, Yersinia pestis KIM
uuuccagguuuuggc

SEQ ID NO: 2291611 - RNA, 14 nt, Yersinia pestis KIM
uuuaccauccagug

SEQ ID NO: 2291612 - RNA, 18 nt, Yersinia pestis KIM
uuuaccaaaagcauccaa

SEQ ID NO: 2291613 - RNA, 21 nt, Yersinia pestis KIM
uuuaccgguaccgcuaugcua

SEQ ID NO: 2291614 - RNA, 19 nt, Yersinia pestis KIM
uuuaaauaugaucuugaua

SEQ ID NO: 2291615 - RNA, 13 nt, Yersinia pestis KIM
uuugauacuguuc

SEQ ID NO: 2291616 - RNA, 15 nt, Yersinia pestis KIM
uuugauacaguaauu

SEQ ID NO: 2291617 - RNA, 20 nt, Yersinia pestis KIM
uuugaacaacauugaugcua

SEQ ID NO: 2291618 - RNA, 23 nt, Yersinia pestis KIM
uuuuaauaaaaaacugacucacg

SEQ ID NO: 2291619 - RNA, 14 nt, Yersinia pestis KIM
uuuuacgaucaacc

SEQ ID NO: 2291620 - RNA, 20 nt, Yersinia pestis KIM
uuuuaccgcagggcguucag

SEQ ID NO: 2291621 - RNA, 11 nt, Yersinia pestis KIM
uuggucagcag

SEQ ID NO: 2291622 - RNA, 20 nt, Yersinia pestis KIM
uugguaacguucgcguggca

SEQ ID NO: 2291623 - RNA, 15 nt, Yersinia pestis KIM
uugguaauacgcggc

SEQ ID NO: 2291624 - RNA, 18 nt, Yersinia pestis KIM
aaucgauacgcauugagg

SEQ ID NO: 2291625 - RNA, 15 nt, Yersinia pestis KIM
aaucgaucauaaucu

SEQ ID NO: 2291626 - RNA, 20 nt, Yersinia pestis KIM
uugucagcagucugaaacgc

SEQ ID NO: 2291627 - RNA, 18 nt, Yersinia pestis KIM
aaucgcacugaguucugc

SEQ ID NO: 2291628 - RNA, 12 nt, Yersinia pestis KIM
uuguaugacaag

SEQ ID NO: 2291629 - RNA, 19 nt, Yersinia pestis KIM
uuguaagucagauugucag

SEQ ID NO: 2291630 - RNA, 23 nt, Yersinia pestis KIM
uuguuaaaacaguuugcggucug

SEQ ID NO: 2291631 - RNA, 17 nt, Yersinia pestis KIM
uugugccaguagaucuc

SEQ ID NO: 2291632 - RNA, 13 nt, Yersinia pestis KIM
uugugaugaaauu

SEQ ID NO: 2291633 - RNA, 22 nt, Yersinia pestis KIM
uugugcaaaauacaaaguaaac

SEQ ID NO: 2291634 - RNA, 19 nt, Yersinia pestis KIM
uugucagcagucugaggcc

SEQ ID NO: 2291635 - RNA, 19 nt, Yersinia pestis KIM
uugucagcagucugaagcc

SEQ ID NO: 2291636 - RNA, 18 nt, Yersinia pestis KIM
uugucagguuaauaccug

SEQ ID NO: 2291637 - RNA, 11 nt, Yersinia pestis KIM
uugccagugaa

SEQ ID NO: 2291638 - RNA, 18 nt, Yersinia pestis KIM
aaucaugggguuuauugg

SEQ ID NO: 2291639 - RNA, 22 nt, Yersinia pestis KIM
aaucauguaacacacagcagac

SEQ ID NO: 2291640 - RNA, 10 nt, Yersinia pestis KIM
aaucaugggg

SEQ ID NO: 2291641 - RNA, 23 nt, Yersinia pestis KIM
aaucaugcucugcuaauacgcua

SEQ ID NO: 2291642 - RNA, 21 nt, Yersinia pestis KIM
aaucaucgcucaucgccaaag

SEQ ID NO: 2291643 - RNA, 10 nt, Yersinia pestis KIM
aaucaucauc

SEQ ID NO: 2291644 - RNA, 23 nt, Yersinia pestis KIM
uugccucacugucuuugacaucu

SEQ ID NO: 2291645 - RNA, 17 nt, Yersinia pestis KIM
aaucauuuaauuuaucc

SEQ ID NO: 2291646 - RNA, 18 nt, Yersinia pestis KIM
aaucauuggcaacuuaag

SEQ ID NO: 2291647 - RNA, 22 nt, Yersinia pestis KIM
aaucauuggcaacuuaagcauu

SEQ ID NO: 2291648 - RNA, 22 nt, Yersinia pestis KIM
uugauuccucugugacucuauu

SEQ ID NO: 2291649 - RNA, 21 nt, Yersinia pestis KIM
uugcacacccauacauaccag

SEQ ID NO: 2291650 - RNA, 17 nt, Yersinia pestis KIM
uugcagaucggcauuau

SEQ ID NO: 2291651 - RNA, 12 nt, Yersinia pestis KIM
uugcauacucag

SEQ ID NO: 2291652 - RNA, 17 nt, Yersinia pestis KIM
aaucaguuccugauucg

SEQ ID NO: 2291653 - RNA, 21 nt, Yersinia pestis KIM
uugauggcgcaguaacugugu

SEQ ID NO: 2291654 - RNA, 14 nt, Yersinia pestis KIM
uucuucgaucaacg

SEQ ID NO: 2291655 - RNA, 21 nt, Yersinia pestis KIM
uucuucagccgcucaucaucc

SEQ ID NO: 2291656 - RNA, 13 nt, Yersinia pestis KIM
uucuucacgaaga

SEQ ID NO: 2291657 - RNA, 22 nt, Yersinia pestis KIM
uucgcuggggcauuuaauucag

SEQ ID NO: 2291658 - RNA, 19 nt, Yersinia pestis KIM
uucggauuaccggcacugg

SEQ ID NO: 2291659 - RNA, 22 nt, Yersinia pestis KIM
uucgucaugauaaugccaugcu

SEQ ID NO: 2291660 - RNA, 13 nt, Yersinia pestis KIM
uucuacaauggcc

SEQ ID NO: 2291661 - RNA, 13 nt, Yersinia pestis KIM
uucucccuuucac

SEQ ID NO: 2291662 - RNA, 15 nt, Yersinia pestis KIM
uucucccuuuccagc

SEQ ID NO: 2291663 - RNA, 14 nt, Yersinia pestis KIM
uucauguugcaaca

SEQ ID NO: 2291664 - RNA, 18 nt, Yersinia pestis KIM
uucauugauucaucaacu

SEQ ID NO: 2291665 - RNA, 13 nt, Yersinia pestis KIM
uuccaauauugag

SEQ ID NO: 2291666 - RNA, 13 nt, Yersinia pestis KIM
uuccaaaaugcgu

SEQ ID NO: 2291667 - RNA, 21 nt, Yersinia pestis KIM
uuccagacaaagugagggaua

SEQ ID NO: 2291668 - RNA, 11 nt, Yersinia pestis KIM
uuccagcaaaa

SEQ ID NO: 2291669 - RNA, 18 nt, Yersinia pestis KIM
uucccacggguugccauu

SEQ ID NO: 2291670 - RNA, 18 nt, Yersinia pestis KIM
uucccuuguuugcgccgu

SEQ ID NO: 2291671 - RNA, 22 nt, Yersinia pestis KIM
uuccauauugauauagcgguaa

SEQ ID NO: 2291672 - RNA, 22 nt, Yersinia pestis KIM
uuccaucaaaggagaacaaugg

SEQ ID NO: 2291673 - RNA, 13 nt, Yersinia pestis KIM
uucauaugacaaa

SEQ ID NO: 2291674 - RNA, 14 nt, Yersinia pestis KIM
uucaucauucaaua

SEQ ID NO: 2291675 - RNA, 23 nt, Yersinia pestis KIM
uucaucacccaucaauaauuaag

SEQ ID NO: 2291676 - RNA, 13 nt, Yersinia pestis KIM
uucaucaucaaca

SEQ ID NO: 2291677 - RNA, 14 nt, Yersinia pestis KIM
uucauaugacaaau

SEQ ID NO: 2291678 - RNA, 17 nt, Yersinia pestis KIM
uucauaugcgccuauaa

SEQ ID NO: 2291679 - RNA, 19 nt, Yersinia pestis KIM
uucauauuucacuguuaua

SEQ ID NO: 2291680 - RNA, 13 nt, Yersinia pestis KIM
uucaucgcuuaac

SEQ ID NO: 2291681 - RNA, 12 nt, Yersinia pestis KIM
uucagcaccaua

SEQ ID NO: 2291682 - RNA, 22 nt, Yersinia pestis KIM
uucagcacgguguguugaaauu

SEQ ID NO: 2291683 - RNA, 17 nt, Yersinia pestis KIM
uucagcaggggcaaccu

SEQ ID NO: 2291684 - RNA, 14 nt, Yersinia pestis KIM
uucagcuugcaaca

SEQ ID NO: 2291685 - RNA, 17 nt, Yersinia pestis KIM
uucacgcccuacugaga

SEQ ID NO: 2291686 - RNA, 16 nt, Yersinia pestis KIM
uguuagcccaaggcga

SEQ ID NO: 2291687 - RNA, 23 nt, Yersinia pestis KIM
uguuacccggaauggagccgcua

SEQ ID NO: 2291688 - RNA, 23 nt, Yersinia pestis KIM
uguuacagcaaggcggcaagcaa

SEQ ID NO: 2291689 - RNA, 21 nt, Yersinia pestis KIM
uguggcuaccaauuauucggg

SEQ ID NO: 2291690 - RNA, 20 nt, Yersinia pestis KIM
ugucuccuaucugagguuag

SEQ ID NO: 2291691 - RNA, 19 nt, Yersinia pestis KIM
ugucuguaaccucacgcca

SEQ ID NO: 2291692 - RNA, 20 nt, Yersinia pestis KIM
ugugauaaccagcaguugcu

SEQ ID NO: 2291693 - RNA, 22 nt, Yersinia pestis KIM
ugucgggugguugucuauguuu

SEQ ID NO: 2291694 - RNA, 20 nt, Yersinia pestis KIM
ugucaauaaccucuaaucuc

SEQ ID NO: 2291695 - RNA, 13 nt, Yersinia pestis KIM
ugucagccaugcc

SEQ ID NO: 2291696 - RNA, 18 nt, Yersinia pestis KIM
uguugacguucaggccug

SEQ ID NO: 2291697 - RNA, 22 nt, Yersinia pestis KIM
uguucugauagagacgggcguu

SEQ ID NO: 2291698 - RNA, 15 nt, Yersinia pestis KIM
uuaaagccuuucagc

SEQ ID NO: 2291699 - RNA, 14 nt, Yersinia pestis KIM
uuaaauacagauca

SEQ ID NO: 2291700 - RNA, 18 nt, Yersinia pestis KIM
uuaaucgcagcagagaau

SEQ ID NO: 2291701 - RNA, 17 nt, Yersinia pestis KIM
uuacacgguuaauucau

SEQ ID NO: 2291702 - RNA, 12 nt, Yersinia pestis KIM
uuaauaauucag

SEQ ID NO: 2291703 - RNA, 21 nt, Yersinia pestis KIM
uuaaccaacaugagccacaca

SEQ ID NO: 2291704 - RNA, 17 nt, Yersinia pestis KIM
uuagugggugagcagag

SEQ ID NO: 2291705 - RNA, 13 nt, Yersinia pestis KIM
uuagugcucauga

SEQ ID NO: 2291706 - RNA, 15 nt, Yersinia pestis KIM
uuagucuuagacguc

SEQ ID NO: 2291707 - RNA, 18 nt, Yersinia pestis KIM
uuaggauacguucgccgu

SEQ ID NO: 2291708 - RNA, 18 nt, Yersinia pestis KIM
uuagcugcaagcguuacu

SEQ ID NO: 2291709 - RNA, 14 nt, Yersinia pestis KIM
uuaucacgucgcca

SEQ ID NO: 2291710 - RNA, 18 nt, Yersinia pestis KIM
uuaucagggccuacguuc

SEQ ID NO: 2291711 - RNA, 16 nt, Yersinia pestis KIM
uuauccacuaauucau

SEQ ID NO: 2291712 - RNA, 14 nt, Yersinia pestis KIM
uuauaagcguuauu

SEQ ID NO: 2291713 - RNA, 15 nt, Yersinia pestis KIM
uuaguuuuagacguc

SEQ ID NO: 2291714 - RNA, 19 nt, Yersinia pestis KIM
uuacgucaaaacuauuuau

SEQ ID NO: 2291715 - RNA, 17 nt, Yersinia pestis KIM
uuagaccggacauuaau

SEQ ID NO: 2291716 - RNA, 18 nt, Yersinia pestis KIM
uuagcaccggauggucac

SEQ ID NO: 2291717 - RNA, 14 nt, Yersinia pestis KIM
uuagcggcaacgau

SEQ ID NO: 2291718 - RNA, 17 nt, Yersinia pestis KIM
uuagccuacuggcggcg

SEQ ID NO: 2291719 - RNA, 19 nt, Yersinia pestis KIM
uuagaugauugaaaaucag

SEQ ID NO: 2291720 - RNA, 20 nt, Yersinia pestis KIM
uuagauaccgcaaccauugc

SEQ ID NO: 2291721 - RNA, 20 nt, Yersinia pestis KIM
acgccugggauccauaggau

SEQ ID NO: 2291722 - RNA, 20 nt, Yersinia pestis KIM
acgccgcucaauuaaccuga

SEQ ID NO: 2291723 - RNA, 19 nt, Yersinia pestis KIM
acgcggcacauaccccauu

SEQ ID NO: 2291724 - RNA, 23 nt, Yersinia pestis KIM
acgcguucaaucuucgcaccuag

SEQ ID NO: 2291725 - RNA, 13 nt, Yersinia pestis KIM
acgcuaucaacuu

SEQ ID NO: 2291726 - RNA, 16 nt, Yersinia pestis KIM
aaacauugucaccuga

SEQ ID NO: 2291727 - RNA, 20 nt, Yersinia pestis KIM
aaacauuuacuuauaaacac

SEQ ID NO: 2291728 - RNA, 15 nt, Yersinia pestis KIM
acgcugggcgauaaa

SEQ ID NO: 2291729 - RNA, 12 nt, Yersinia pestis KIM
acgcagcgcuug

SEQ ID NO: 2291730 - RNA, 12 nt, Yersinia pestis KIM
acgcaggcggug

SEQ ID NO: 2291731 - RNA, 18 nt, Yersinia pestis KIM
acgcaggcggugaucauc

SEQ ID NO: 2291732 - RNA, 13 nt, Yersinia pestis KIM
acgccaauaccgg

SEQ ID NO: 2291733 - RNA, 21 nt, Yersinia pestis KIM
acgcaucaugguccaguggcg

SEQ ID NO: 2291734 - RNA, 19 nt, Yersinia pestis KIM
acgcauugucagguuaaua

SEQ ID NO: 2291735 - RNA, 20 nt, Yersinia pestis KIM
accuguuugcaacauuaucc

SEQ ID NO: 2291736 - RNA, 15 nt, Yersinia pestis KIM
accuuacuguaucaa

SEQ ID NO: 2291737 - RNA, 12 nt, Yersinia pestis KIM
accuuauccaau

SEQ ID NO: 2291738 - RNA, 21 nt, Yersinia pestis KIM
accuguuacaucagagcucaa

SEQ ID NO: 2291739 - RNA, 20 nt, Yersinia pestis KIM
accugcuuuaccauccgucc

SEQ ID NO: 2291740 - RNA, 20 nt, Yersinia pestis KIM
accugcugcaccucugcuga

SEQ ID NO: 2291741 - RNA, 15 nt, Yersinia pestis KIM
acggcgacuugccgu

SEQ ID NO: 2291742 - RNA, 21 nt, Yersinia pestis KIM
aaaccauggcggcucgccuga

SEQ ID NO: 2291743 - RNA, 18 nt, Yersinia pestis KIM
acgggcuuccaucaggaa

SEQ ID NO: 2291744 - RNA, 18 nt, Yersinia pestis KIM
acgggccucgcggaaauc

SEQ ID NO: 2291745 - RNA, 21 nt, Yersinia pestis KIM
acguauucgucaccaucaaua

SEQ ID NO: 2291746 - RNA, 21 nt, Yersinia pestis KIM
acuuaucgaccaacuggcaau

SEQ ID NO: 2291747 - RNA, 16 nt, Yersinia pestis KIM
acuguaguucaauggu

SEQ ID NO: 2291748 - RNA, 13 nt, Yersinia pestis KIM
acugucauugcug

SEQ ID NO: 2291749 - RNA, 20 nt, Yersinia pestis KIM
acuucuaacaagcuguuauu

SEQ ID NO: 2291750 - RNA, 20 nt, Yersinia pestis KIM
acuucaggccaauagcccaa

SEQ ID NO: 2291751 - RNA, 14 nt, Yersinia pestis KIM
acuucaucaucaac

SEQ ID NO: 2291752 - RNA, 16 nt, Yersinia pestis KIM
acuugagcacauagca

SEQ ID NO: 2291753 - RNA, 14 nt, Yersinia pestis KIM
acuggcagccauug

SEQ ID NO: 2291754 - RNA, 19 nt, Yersinia pestis KIM
acuggcugccuaccugcaa

SEQ ID NO: 2291755 - RNA, 20 nt, Yersinia pestis KIM
acuggcuagauagccauaau

SEQ ID NO: 2291756 - RNA, 16 nt, Yersinia pestis KIM
acugccgucaaugccu

SEQ ID NO: 2291757 - RNA, 16 nt, Yersinia pestis KIM
acucuagcgccagcaa

SEQ ID NO: 2291758 - RNA, 18 nt, Yersinia pestis KIM
acucuagcgccagcaauu

SEQ ID NO: 2291759 - RNA, 17 nt, Yersinia pestis KIM
acugcucaacugcucaa

SEQ ID NO: 2291760 - RNA, 14 nt, Yersinia pestis KIM
acugcuccagccaa

SEQ ID NO: 2291761 - RNA, 17 nt, Yersinia pestis KIM
acugcuccagccaacug

SEQ ID NO: 2291762 - RNA, 21 nt, Yersinia pestis KIM
acucaagcguacaucagggug

SEQ ID NO: 2291763 - RNA, 15 nt, Yersinia pestis KIM
acucagccauugcuu

SEQ ID NO: 2291764 - RNA, 16 nt, Yersinia pestis KIM
acguugaauauucaac

SEQ ID NO: 2291765 - RNA, 17 nt, Yersinia pestis KIM
acucauauuguccaaag

SEQ ID NO: 2291766 - RNA, 20 nt, Yersinia pestis KIM
acucccccauuuccuguguu

SEQ ID NO: 2291767 - RNA, 22 nt, Yersinia pestis KIM
acuccuuuaccuacaaccuggu

SEQ ID NO: 2291768 - RNA, 22 nt, Yersinia pestis KIM
acucgccaacagagugaaucgc

SEQ ID NO: 2291769 - RNA, 14 nt, Yersinia pestis KIM
accgccgcaggcca

SEQ ID NO: 2291770 - RNA, 13 nt, Yersinia pestis KIM
accgccaauaucu

SEQ ID NO: 2291771 - RNA, 18 nt, Yersinia pestis KIM
accgcucaguauucgcca

SEQ ID NO: 2291772 - RNA, 18 nt, Yersinia pestis KIM
accgcuccaggcuggcca

SEQ ID NO: 2291773 - RNA, 16 nt, Yersinia pestis KIM
accggccgcuugccaa

SEQ ID NO: 2291774 - RNA, 14 nt, Yersinia pestis KIM
accccauugcacca

SEQ ID NO: 2291775 - RNA, 16 nt, Yersinia pestis KIM
accccauugcaccaau

SEQ ID NO: 2291776 - RNA, 15 nt, Yersinia pestis KIM
accccaucagcauau

SEQ ID NO: 2291777 - RNA, 13 nt, Yersinia pestis KIM
acccacguucaga

SEQ ID NO: 2291778 - RNA, 14 nt, Yersinia pestis KIM
acccacguucagau

SEQ ID NO: 2291779 - RNA, 13 nt, Yersinia pestis KIM
acccaguaacuga

SEQ ID NO: 2291780 - RNA, 18 nt, Yersinia pestis KIM
accccacucgguuagcug

SEQ ID NO: 2291781 - RNA, 15 nt, Yersinia pestis KIM
acccaauauucgcca

SEQ ID NO: 2291782 - RNA, 14 nt, Yersinia pestis KIM
acccguuacugcau

SEQ ID NO: 2291783 - RNA, 21 nt, Yersinia pestis KIM
acccucgacaccaaaacuccc

SEQ ID NO: 2291784 - RNA, 23 nt, Yersinia pestis KIM
accgaaauauucgucucaucaau

SEQ ID NO: 2291785 - RNA, 20 nt, Yersinia pestis KIM
aaaaugcggcggcugaccac

SEQ ID NO: 2291786 - RNA, 17 nt, Yersinia pestis KIM
acccggcuggcaccaag

SEQ ID NO: 2291787 - RNA, 18 nt, Yersinia pestis KIM
accacgguaucaaucagc

SEQ ID NO: 2291788 - RNA, 21 nt, Yersinia pestis KIM
accacgcauuccaucagccaa

SEQ ID NO: 2291789 - RNA, 10 nt, Yersinia pestis KIM
accaaugguu

SEQ ID NO: 2291790 - RNA, 19 nt, Yersinia pestis KIM
accagaaugguuuggccgu

SEQ ID NO: 2291791 - RNA, 19 nt, Yersinia pestis KIM
accagauugccgucacuuu

SEQ ID NO: 2291792 - RNA, 20 nt, Yersinia pestis KIM
accagcccuguugcccagca

SEQ ID NO: 2291793 - RNA, 21 nt, Yersinia pestis KIM
accagccccgguuaaauuccc

SEQ ID NO: 2291794 - RNA, 13 nt, Yersinia pestis KIM
acaucgcaccgau

SEQ ID NO: 2291795 - RNA, 17 nt, Yersinia pestis KIM
acaucccaauauucacu

SEQ ID NO: 2291796 - RNA, 16 nt, Yersinia pestis KIM
acaucgguaucggcca

SEQ ID NO: 2291797 - RNA, 16 nt, Yersinia pestis KIM
acaugagacagcgcgg

SEQ ID NO: 2291798 - RNA, 20 nt, Yersinia pestis KIM
accaacaauauucgcagcca

SEQ ID NO: 2291799 - RNA, 23 nt, Yersinia pestis KIM
accaacacugauugugccgacau

SEQ ID NO: 2291800 - RNA, 17 nt, Yersinia pestis KIM
accaaccgcuuuaucgc

SEQ ID NO: 2291801 - RNA, 20 nt, Yersinia pestis KIM
accaaucuccaaugaccccg

SEQ ID NO: 2291802 - RNA, 18 nt, Yersinia pestis KIM
accaaguuugacuuauga

SEQ ID NO: 2291803 - RNA, 15 nt, Yersinia pestis KIM
accaauaaucgggaa

SEQ ID NO: 2291804 - RNA, 21 nt, Yersinia pestis KIM
accaagacuucaugacuaccu

SEQ ID NO: 2291805 - RNA, 17 nt, Yersinia pestis KIM
accaaaauauucgcauu

SEQ ID NO: 2291806 - RNA, 22 nt, Yersinia pestis KIM
acauuguuaccuaaccaaacau

SEQ ID NO: 2291807 - RNA, 22 nt, Yersinia pestis KIM
acauuaagcauauccaacgcuu

SEQ ID NO: 2291808 - RNA, 16 nt, Yersinia pestis KIM
acauuauccguuugca

SEQ ID NO: 2291809 - RNA, 17 nt, Yersinia pestis KIM
acaggccccaauccacc

SEQ ID NO: 2291810 - RNA, 18 nt, Yersinia pestis KIM
acaggccccaauccacca

SEQ ID NO: 2291811 - RNA, 19 nt, Yersinia pestis KIM
acauacccgucauaccguu

SEQ ID NO: 2291812 - RNA, 19 nt, Yersinia pestis KIM
acauacucuuccaacgcuu

SEQ ID NO: 2291813 - RNA, 12 nt, Yersinia pestis KIM
acauagcgcauc

SEQ ID NO: 2291814 - RNA, 13 nt, Yersinia pestis KIM
acaucauccaguu

SEQ ID NO: 2291815 - RNA, 18 nt, Yersinia pestis KIM
acaucaaaccggcuaaug

SEQ ID NO: 2291816 - RNA, 16 nt, Yersinia pestis KIM
acaaacauggcggcag

SEQ ID NO: 2291817 - RNA, 13 nt, Yersinia pestis KIM
aauuuucaguuca

SEQ ID NO: 2291818 - RNA, 15 nt, Yersinia pestis KIM
acagcccccugccua

SEQ ID NO: 2291819 - RNA, 12 nt, Yersinia pestis KIM
aauaccgcugcc

SEQ ID NO: 2291820 - RNA, 22 nt, Yersinia pestis KIM
aauagagcaccaaaucuuccag

SEQ ID NO: 2291821 - RNA, 16 nt, Yersinia pestis KIM
aauagauaaaaacauu

SEQ ID NO: 2291822 - RNA, 18 nt, Yersinia pestis KIM
aauaauugguagccacaa

SEQ ID NO: 2291823 - RNA, 19 nt, Yersinia pestis KIM
aaguuuucuggcaauuucu

SEQ ID NO: 2291824 - RNA, 18 nt, Yersinia pestis KIM
aagucauuaacuguuaaa

SEQ ID NO: 2291825 - RNA, 15 nt, Yersinia pestis KIM
aauaacugccagggc

SEQ ID NO: 2291826 - RNA, 22 nt, Yersinia pestis KIM
aauaagcuacgccaugcagcua

SEQ ID NO: 2291827 - RNA, 18 nt, Yersinia pestis KIM
aauaaaccgaaaugaucu

SEQ ID NO: 2291828 - RNA, 22 nt, Yersinia pestis KIM
aagggcacagcgagauaaacug

SEQ ID NO: 2291829 - RNA, 22 nt, Yersinia pestis KIM
aagggaaauacccaaagucauu

SEQ ID NO: 2291830 - RNA, 16 nt, Yersinia pestis KIM
aagcuguugaccugaa

SEQ ID NO: 2291831 - RNA, 14 nt, Yersinia pestis KIM
aagcugucagucca

SEQ ID NO: 2291832 - RNA, 18 nt, Yersinia pestis KIM
aagcgccuuccuuuuauu

SEQ ID NO: 2291833 - RNA, 18 nt, Yersinia pestis KIM
aagcgucagaugcugacg

SEQ ID NO: 2291834 - RNA, 18 nt, Yersinia pestis KIM
aagcucgccaucgcacca

SEQ ID NO: 2291835 - RNA, 23 nt, Yersinia pestis KIM
aagcucugacaaaaugccagaau

SEQ ID NO: 2291836 - RNA, 15 nt, Yersinia pestis KIM
aagcccccguaucau

SEQ ID NO: 2291837 - RNA, 20 nt, Yersinia pestis KIM
aagccauuuuuuauaaacac

SEQ ID NO: 2291838 - RNA, 13 nt, Yersinia pestis KIM
aagcccaacugac

SEQ ID NO: 2291839 - RNA, 16 nt, Yersinia pestis KIM
aagcacuguuacccgg

SEQ ID NO: 2291840 - RNA, 13 nt, Yersinia pestis KIM
aagcaaaucgaua

SEQ ID NO: 2291841 - RNA, 21 nt, Yersinia pestis KIM
aagaucuucgaacggcgcuga

SEQ ID NO: 2291842 - RNA, 18 nt, Yersinia pestis KIM
aacguuaugugccauaag

SEQ ID NO: 2291843 - RNA, 16 nt, Yersinia pestis KIM
aacguucugccaauuu

SEQ ID NO: 2291844 - RNA, 12 nt, Yersinia pestis KIM
aacguuuaucgc

SEQ ID NO: 2291845 - RNA, 17 nt, Yersinia pestis KIM
aacuacaccgcuaaccu

SEQ ID NO: 2291846 - RNA, 14 nt, Yersinia pestis KIM
aagagugaccaaag

SEQ ID NO: 2291847 - RNA, 14 nt, Yersinia pestis KIM
aagagucacagcau

SEQ ID NO: 2291848 - RNA, 13 nt, Yersinia pestis KIM
aauuugcugcucg

SEQ ID NO: 2291849 - RNA, 15 nt, Yersinia pestis KIM
aauuuaucugcuaau

SEQ ID NO: 2291850 - RNA, 22 nt, Yersinia pestis KIM
aauucagacggcagauccugaa

SEQ ID NO: 2291851 - RNA, 16 nt, Yersinia pestis KIM
aauucagccucauaca

SEQ ID NO: 2291852 - RNA, 14 nt, Yersinia pestis KIM
aauucaagagaggu

SEQ ID NO: 2291853 - RNA, 17 nt, Yersinia pestis KIM
aaugguguaaaugcccg

SEQ ID NO: 2291854 - RNA, 19 nt, Yersinia pestis KIM
aauggccagcgggaaucaa

SEQ ID NO: 2291855 - RNA, 21 nt, Yersinia pestis KIM
aaugcgaccggccgcuugcca

SEQ ID NO: 2291856 - RNA, 14 nt, Yersinia pestis KIM
aaugccuaaagcca

SEQ ID NO: 2291857 - RNA, 21 nt, Yersinia pestis KIM
aauggagggcagcuugacgac

SEQ ID NO: 2291858 - RNA, 17 nt, Yersinia pestis KIM
aaugauucauugaguua

SEQ ID NO: 2291859 - RNA, 13 nt, Yersinia pestis KIM
aaugagccugaau

SEQ ID NO: 2291860 - RNA, 16 nt, Yersinia pestis KIM
aaucugcacuguaauu

SEQ ID NO: 2291861 - RNA, 13 nt, Yersinia pestis KIM
aaucgucaacggu

SEQ ID NO: 2291862 - RNA, 13 nt, Yersinia pestis KIM
aaucucaucggca

SEQ ID NO: 2291863 - RNA, 13 nt, Yersinia pestis KIM
aaucuacuuuauu

SEQ ID NO: 2291864 - RNA, 19 nt, Yersinia pestis KIM
aaucggaaaccgcuguuuu

SEQ ID NO: 2291865 - RNA, 15 nt, Yersinia pestis KIM
aaucgcauugucacc

SEQ ID NO: 2291866 - RNA, 15 nt, Yersinia pestis KIM
aauccgacugauagc

SEQ ID NO: 2291867 - RNA, 18 nt, Yersinia pestis KIM
aauccccacggccagagc

SEQ ID NO: 2291868 - RNA, 13 nt, Yersinia pestis KIM
aaucaugacgcug

SEQ ID NO: 2291869 - RNA, 15 nt, Yersinia pestis KIM
aauccaaaugacacu

SEQ ID NO: 2291870 - RNA, 20 nt, Yersinia pestis KIM
aauagguuggcauuagcgaa

SEQ ID NO: 2291871 - RNA, 22 nt, Yersinia pestis KIM
aauagugcuaucugcugcggua

SEQ ID NO: 2291872 - RNA, 15 nt, Yersinia pestis KIM
aauagcgaucagcaa

SEQ ID NO: 2291873 - RNA, 14 nt, Yersinia pestis KIM
aauagcaaccugga

SEQ ID NO: 2291874 - RNA, 19 nt, Yersinia pestis KIM
aauagcaacgcucaauggc

SEQ ID NO: 2291875 - RNA, 17 nt, Yersinia pestis KIM
aauagccuaggccagca

SEQ ID NO: 2291876 - RNA, 18 nt, Yersinia pestis KIM
aaucaguaaauauggcgg

SEQ ID NO: 2291877 - RNA, 23 nt, Yersinia pestis KIM
aaucagcucauuaaacuguucuu

SEQ ID NO: 2291878 - RNA, 16 nt, Yersinia pestis KIM
aaucagaucaacagau

SEQ ID NO: 2291879 - RNA, 18 nt, Yersinia pestis KIM
aaucacuucuucaauaga

SEQ ID NO: 2291880 - RNA, 15 nt, Yersinia pestis KIM
aacgcacaucaaucc

SEQ ID NO: 2291881 - RNA, 14 nt, Yersinia pestis KIM
aacgccggcgccau

SEQ ID NO: 2291882 - RNA, 19 nt, Yersinia pestis KIM
aacgaucgcuuaacgaggc

SEQ ID NO: 2291883 - RNA, 11 nt, Yersinia pestis KIM
aacgugacaua

SEQ ID NO: 2291884 - RNA, 18 nt, Yersinia pestis KIM
aacggugaggauaggcag

SEQ ID NO: 2291885 - RNA, 15 nt, Yersinia pestis KIM
aacgguaucagucau

SEQ ID NO: 2291886 - RNA, 14 nt, Yersinia pestis KIM
aacggauaauguug

SEQ ID NO: 2291887 - RNA, 15 nt, Yersinia pestis KIM
aacggauacccagca

SEQ ID NO: 2291888 - RNA, 20 nt, Yersinia pestis KIM
aacgcgccggaauuagcgaa

SEQ ID NO: 2291889 - RNA, 16 nt, Yersinia pestis KIM
aacgcuugcgccaaau

SEQ ID NO: 2291890 - RNA, 20 nt, Yersinia pestis KIM
aacgcuuucagguuguuauu

SEQ ID NO: 2291891 - RNA, 12 nt, Yersinia pestis KIM
aaccacagcaau

SEQ ID NO: 2291892 - RNA, 20 nt, Yersinia pestis KIM
aacauuuucuaagcugccug

SEQ ID NO: 2291893 - RNA, 18 nt, Yersinia pestis KIM
aacaugguaugccacuua

SEQ ID NO: 2291894 - RNA, 23 nt, Yersinia pestis KIM
aaccaaaaagggcacagcgagau

SEQ ID NO: 2291895 - RNA, 17 nt, Yersinia pestis KIM
aacaguuaaacaacgcu

SEQ ID NO: 2291896 - RNA, 17 nt, Yersinia pestis KIM
aacauauaaaccagcca

SEQ ID NO: 2291897 - RNA, 17 nt, Yersinia pestis KIM
aacauauccugugccaa

SEQ ID NO: 2291898 - RNA, 13 nt, Yersinia pestis KIM
aacaucgcccuuu

SEQ ID NO: 2291899 - RNA, 18 nt, Yersinia pestis KIM
aacaucgccacgaauggc

SEQ ID NO: 2291900 - RNA, 11 nt, Yersinia pestis KIM
aacaucgaagg

SEQ ID NO: 2291901 - RNA, 20 nt, Yersinia pestis KIM
aaccgccacugauaccgaua

SEQ ID NO: 2291902 - RNA, 22 nt, Yersinia pestis KIM
aaccgccaguucuggaucggca

SEQ ID NO: 2291903 - RNA, 12 nt, Yersinia pestis KIM
aacccggcgacg

SEQ ID NO: 2291904 - RNA, 19 nt, Yersinia pestis KIM
aaccaucggaaccaccaag

SEQ ID NO: 2291905 - RNA, 14 nt, Yersinia pestis KIM
aaccccaucagcau

SEQ ID NO: 2291906 - RNA, 15 nt, Yersinia pestis KIM
aacccauauuggcaa

SEQ ID NO: 2291907 - RNA, 13 nt, Yersinia pestis KIM
aaccccuagccag

SEQ ID NO: 2291908 - RNA, 13 nt, Yersinia pestis KIM
aacaggcagaucg

SEQ ID NO: 2291909 - RNA, 23 nt, Yersinia pestis KIM
aacaggcaacgacguuaucaaua

SEQ ID NO: 2291910 - RNA, 16 nt, Yersinia pestis KIM
aacagcuuaucagcgu

SEQ ID NO: 2291911 - RNA, 17 nt, Yersinia pestis KIM
aacaguaagcuuugugc

SEQ ID NO: 2291912 - RNA, 20 nt, Yersinia pestis KIM
aacagccggccauucagcgu

SEQ ID NO: 2291913 - RNA, 15 nt, Yersinia pestis KIM
aacagauauacggcg

SEQ ID NO: 2291914 - RNA, 17 nt, Yersinia pestis KIM
aacagcauccgcccaca

SEQ ID NO: 2291915 - RNA, 20 nt, Yersinia pestis KIM
aacacuuuaucgaccacuuu

SEQ ID NO: 2291916 - RNA, 17 nt, Yersinia pestis KIM
aacacuguuuaucgcau

SEQ ID NO: 2291917 - RNA, 23 nt, Yersinia pestis KIM
aacacuuaauuccaugcaaaaua

SEQ ID NO: 2291918 - RNA, 21 nt, Yersinia pestis KIM
aaaaggaguucugcagcaauc

SEQ ID NO: 2291919 - RNA, 21 nt, Yersinia pestis KIM
aacaauaauucgcaugguuaa

SEQ ID NO: 2291920 - RNA, 24 nt, Yersinia pestis KIM
aaaagcaccgcagucgauaaacau

SEQ ID NO: 2291921 - RNA, 19 nt, Yersinia pestis KIM
aaauucucaaugauaaaau

SEQ ID NO: 2291922 - RNA, 15 nt, Yersinia pestis KIM
aaauucuaucugguu

SEQ ID NO: 2291923 - RNA, 15 nt, Yersinia pestis KIM
aaauucuaccuggcu

SEQ ID NO: 2291924 - RNA, 15 nt, Yersinia pestis KIM
aaauucgugcucauc

SEQ ID NO: 2291925 - RNA, 12 nt, Yersinia pestis KIM
aaaucacguuca

SEQ ID NO: 2291926 - RNA, 19 nt, Yersinia pestis KIM
aaaucuacaaagucugaua

SEQ ID NO: 2291927 - RNA, 20 nt, Yersinia pestis KIM
aaauguaagcguaauucagc

SEQ ID NO: 2291928 - RNA, 19 nt, Yersinia pestis KIM
aaacggugaggauaggcag

SEQ ID NO: 2291929 - RNA, 23 nt, Yersinia pestis KIM
aaacgcauucauaucguccaaag

SEQ ID NO: 2291930 - RNA, 15 nt, Yersinia pestis KIM
aaacguuacugcucg

SEQ ID NO: 2291931 - RNA, 17 nt, Yersinia pestis KIM
aaacugagauuugccaa

SEQ ID NO: 2291932 - RNA, 22 nt, Yersinia pestis KIM
aaacugaugccgguauccccgc

SEQ ID NO: 2291933 - RNA, 22 nt, Yersinia pestis KIM
aaagauccccacaaaaucaacg

SEQ ID NO: 2291934 - RNA, 23 nt, Yersinia pestis KIM
aaacuugaucagcgccugcugug

SEQ ID NO: 2291935 - RNA, 12 nt, Yersinia pestis KIM
aaaaagggcaag

SEQ ID NO: 2291936 - RNA, 20 nt, Yersinia pestis KIM
aaaggccagcgcagguggau

SEQ ID NO: 2291937 - RNA, 21 nt, Yersinia pestis KIM
aaaggcccgcuagugauagcg

SEQ ID NO: 2291938 - RNA, 21 nt, Yersinia pestis KIM
aaaggcauccccggcaccaac

SEQ ID NO: 2291939 - RNA, 21 nt, Yersinia pestis KIM
aaagucauugguguuacagca

SEQ ID NO: 2291940 - RNA, 21 nt, Yersinia pestis KIM
aaagucauuggcguuacagca

SEQ ID NO: 2291941 - RNA, 23 nt, Yersinia pestis KIM
aaaaauugacgaaaguuaaacaa

SEQ ID NO: 2291942 - RNA, 19 nt, Yersinia pestis KIM
aaagcaccgcagucgauaa

SEQ ID NO: 2291943 - RNA, 22 nt, Yersinia pestis KIM
aaagcaccgcgcgaugauggcg

SEQ ID NO: 2291944 - RNA, 16 nt, Yersinia pestis KIM
aaagcuauccaccauc

SEQ ID NO: 2291945 - RNA, 20 nt, Yersinia pestis KIM
aaagcuaaaaaucucaacaa

SEQ ID NO: 2291946 - RNA, 19 nt, Yersinia pestis KIM
aaaaaucugcaauaucauc

SEQ ID NO: 2291947 - RNA, 22 nt, Yersinia pestis KIM
aaauauccuccggcauagccgg

SEQ ID NO: 2291948 - RNA, 15 nt, Yersinia pestis KIM
aaauauuuaauaugu

SEQ ID NO: 2291949 - RNA, 13 nt, Yersinia pestis KIM
aaauacugccaau

SEQ ID NO: 2291950 - RNA, 14 nt, Yersinia pestis KIM
aaauagauaucgaa

SEQ ID NO: 2291951 - RNA, 13 nt, Yersinia pestis KIM
agcccaaggcgac

SEQ ID NO: 2291952 - RNA, 16 nt, Yersinia pestis KIM
aaaccugugugaccuc

SEQ ID NO: 2291953 - RNA, 12 nt, Yersinia pestis KIM
agccgcaccauc

SEQ ID NO: 2291954 - RNA, 18 nt, Yersinia pestis KIM
agcagccucuaacauacu

SEQ ID NO: 2291955 - RNA, 21 nt, Yersinia pestis KIM
agcaguaugucgucgcaugac

SEQ ID NO: 2291956 - RNA, 17 nt, Yersinia pestis KIM
agcaucaauaucgccac

SEQ ID NO: 2291957 - RNA, 15 nt, Yersinia pestis KIM
agccagccaauggcc

SEQ ID NO: 2291958 - RNA, 16 nt, Yersinia pestis KIM
agccaccagaaucauc

SEQ ID NO: 2291959 - RNA, 16 nt, Yersinia pestis KIM
agcaugugguuaccau

SEQ ID NO: 2291960 - RNA, 14 nt, Yersinia pestis KIM
agcaucgacgagcg

SEQ ID NO: 2291961 - RNA, 17 nt, Yersinia pestis KIM
agcacugccccgaagcu

SEQ ID NO: 2291962 - RNA, 15 nt, Yersinia pestis KIM
agcacucgguggcau

SEQ ID NO: 2291963 - RNA, 20 nt, Yersinia pestis KIM
agcagacucaagcauuguca

SEQ ID NO: 2291964 - RNA, 14 nt, Yersinia pestis KIM
aaaccccgaugacg

SEQ ID NO: 2291965 - RNA, 20 nt, Yersinia pestis KIM
agcacauccaugccauggcg

SEQ ID NO: 2291966 - RNA, 16 nt, Yersinia pestis KIM
acuuucggguaucugu

SEQ ID NO: 2291967 - RNA, 14 nt, Yersinia pestis KIM
acuuucuacggcau

SEQ ID NO: 2291968 - RNA, 18 nt, Yersinia pestis KIM
agcaaaaaggcugcaccu

SEQ ID NO: 2291969 - RNA, 16 nt, Yersinia pestis KIM
agcaaccacgguauca

SEQ ID NO: 2291970 - RNA, 16 nt, Yersinia pestis KIM
agcaagggcagcuaac

SEQ ID NO: 2291971 - RNA, 21 nt, Yersinia pestis KIM
agcacaccggccaaaaucacc

SEQ ID NO: 2291972 - RNA, 17 nt, Yersinia pestis KIM
agcaauaugaauacgaa

SEQ ID NO: 2291973 - RNA, 20 nt, Yersinia pestis KIM
agcaaucaaaagggaucacc

SEQ ID NO: 2291974 - RNA, 19 nt, Yersinia pestis KIM
agcgcgcuccagauuguca

SEQ ID NO: 2291975 - RNA, 21 nt, Yersinia pestis KIM
agcgccuucuuguaaaucuug

SEQ ID NO: 2291976 - RNA, 13 nt, Yersinia pestis KIM
agccugugcgaca

SEQ ID NO: 2291977 - RNA, 21 nt, Yersinia pestis KIM
agcgacgucccuaaagccauc

SEQ ID NO: 2291978 - RNA, 18 nt, Yersinia pestis KIM
agcgacuccuggcaaugc

SEQ ID NO: 2291979 - RNA, 14 nt, Yersinia pestis KIM
aaacgcugcacauc

SEQ ID NO: 2291980 - RNA, 22 nt, Yersinia pestis KIM
aaacgcucaguuaaacgguaac

SEQ ID NO: 2291981 - RNA, 21 nt, Yersinia pestis KIM
agcgacacuuauuggucgcuu

SEQ ID NO: 2291982 - RNA, 19 nt, Yersinia pestis KIM
agcgcguugcgcugaccau

SEQ ID NO: 2291983 - RNA, 14 nt, Yersinia pestis KIM
agcgcucaaauacg

SEQ ID NO: 2291984 - RNA, 20 nt, Yersinia pestis KIM
agcgcgggugaucgucauca

SEQ ID NO: 2291985 - RNA, 22 nt, Yersinia pestis KIM
agcggcuuaaugauggccgcua

SEQ ID NO: 2291986 - RNA, 17 nt, Yersinia pestis KIM
agcgguaugaccgucac

SEQ ID NO: 2291987 - RNA, 15 nt, Yersinia pestis KIM
agcgguagagaucuc

SEQ ID NO: 2291988 - RNA, 17 nt, Yersinia pestis KIM
agcugaauagccuugau

SEQ ID NO: 2291989 - RNA, 20 nt, Yersinia pestis KIM
agcucucacugcuccagcca

SEQ ID NO: 2291990 - RNA, 21 nt, Yersinia pestis KIM
agcucguugguggauaagcuc

SEQ ID NO: 2291991 - RNA, 23 nt, Yersinia pestis KIM
agcucaagggcacaguuuaucuc

SEQ ID NO: 2291992 - RNA, 14 nt, Yersinia pestis KIM
agcgugaaagcauc

SEQ ID NO: 2291993 - RNA, 21 nt, Yersinia pestis KIM
agcguccugugcaaagugcug

SEQ ID NO: 2291994 - RNA, 20 nt, Yersinia pestis KIM
agcgucccugauggggcaau

SEQ ID NO: 2291995 - RNA, 16 nt, Yersinia pestis KIM
agcuauccaccaucgg

SEQ ID NO: 2291996 - RNA, 13 nt, Yersinia pestis KIM
aggcgaccaaugg

SEQ ID NO: 2291997 - RNA, 15 nt, Yersinia pestis KIM
aggcgauuaaacguc

SEQ ID NO: 2291998 - RNA, 23 nt, Yersinia pestis KIM
aggccguucuuugguuaaagcgc

SEQ ID NO: 2291999 - RNA, 14 nt, Yersinia pestis KIM
aggcgcaucgcgau

SEQ ID NO: 2292000 - RNA, 19 nt, Yersinia pestis KIM
aggcgccaagauagaacca

SEQ ID NO: 2292001 - RNA, 20 nt, Yersinia pestis KIM
aggcagaggaguaaagcguc

SEQ ID NO: 2292002 - RNA, 22 nt, Yersinia pestis KIM
agcugcuuuaucguagccaaua

SEQ ID NO: 2292003 - RNA, 17 nt, Yersinia pestis KIM
aggcagaaaaucccgau

SEQ ID NO: 2292004 - RNA, 13 nt, Yersinia pestis KIM
aggccccaucaua

SEQ ID NO: 2292005 - RNA, 14 nt, Yersinia pestis KIM
aggcguuggcuucu

SEQ ID NO: 2292006 - RNA, 20 nt, Yersinia pestis KIM
aggggcacaauucugaaagu

SEQ ID NO: 2292007 - RNA, 21 nt, Yersinia pestis KIM
aggucauucccgagauaacca

SEQ ID NO: 2292008 - RNA, 16 nt, Yersinia pestis KIM
aggucaucgucacgau

SEQ ID NO: 2292009 - RNA, 18 nt, Yersinia pestis KIM
agguauuacaggccccuu

SEQ ID NO: 2292010 - RNA, 19 nt, Yersinia pestis KIM
aguacggugccagcagcaa

SEQ ID NO: 2292011 - RNA, 16 nt, Yersinia pestis KIM
aguaucuuuccagcca

SEQ ID NO: 2292012 - RNA, 20 nt, Yersinia pestis KIM
aguaacaaaaugcgguggca

SEQ ID NO: 2292013 - RNA, 22 nt, Yersinia pestis KIM
aggugcgccaguggcaucaaua

SEQ ID NO: 2292014 - RNA, 14 nt, Yersinia pestis KIM
aucagcagugacgu

SEQ ID NO: 2292015 - RNA, 19 nt, Yersinia pestis KIM
aucagaucguuaaacccgg

SEQ ID NO: 2292016 - RNA, 13 nt, Yersinia pestis KIM
aucagacugcuga

SEQ ID NO: 2292017 - RNA, 17 nt, Yersinia pestis KIM
aucacugaccugacguu

SEQ ID NO: 2292018 - RNA, 14 nt, Yersinia pestis KIM
aucacuagcgggcc

SEQ ID NO: 2292019 - RNA, 15 nt, Yersinia pestis KIM
aucacuauccuuuga

SEQ ID NO: 2292020 - RNA, 14 nt, Yersinia pestis KIM
aucacccagcaaaa

SEQ ID NO: 2292021 - RNA, 16 nt, Yersinia pestis KIM
aucaccauaucagcgc

SEQ ID NO: 2292022 - RNA, 19 nt, Yersinia pestis KIM
aucaccuuggauggcgaaa

SEQ ID NO: 2292023 - RNA, 12 nt, Yersinia pestis KIM
aucaagccgcuu

SEQ ID NO: 2292024 - RNA, 14 nt, Yersinia pestis KIM
aucaauguuaucgc

SEQ ID NO: 2292025 - RNA, 12 nt, Yersinia pestis KIM
aucacaauacag

SEQ ID NO: 2292026 - RNA, 16 nt, Yersinia pestis KIM
aucacacccagcgaac

SEQ ID NO: 2292027 - RNA, 18 nt, Yersinia pestis KIM
aucaauugcuggcuauca

SEQ ID NO: 2292028 - RNA, 19 nt, Yersinia pestis KIM
aucaauugcuggcuaucau

SEQ ID NO: 2292029 - RNA, 17 nt, Yersinia pestis KIM
aucacaucggcgacuuu

SEQ ID NO: 2292030 - RNA, 19 nt, Yersinia pestis KIM
aucaacacugccugaugcu

SEQ ID NO: 2292031 - RNA, 18 nt, Yersinia pestis KIM
aucaaaggcaauaccggu

SEQ ID NO: 2292032 - RNA, 14 nt, Yersinia pestis KIM
aucaaagugcuuaa

SEQ ID NO: 2292033 - RNA, 13 nt, Yersinia pestis KIM
auauuaauccaua

SEQ ID NO: 2292034 - RNA, 14 nt, Yersinia pestis KIM
auauuaacauauca

SEQ ID NO: 2292035 - RNA, 20 nt, Yersinia pestis KIM
auaugucagauagaccaaug

SEQ ID NO: 2292036 - RNA, 22 nt, Yersinia pestis KIM
auauaaauccagcccacuggcc

SEQ ID NO: 2292037 - RNA, 18 nt, Yersinia pestis KIM
auauaacguuuaccuauu

SEQ ID NO: 2292038 - RNA, 13 nt, Yersinia pestis KIM
auauccugauagg

SEQ ID NO: 2292039 - RNA, 21 nt, Yersinia pestis KIM
auauagcggcguucagcaaua

SEQ ID NO: 2292040 - RNA, 17 nt, Yersinia pestis KIM
auauacgcauaaugcgc

SEQ ID NO: 2292041 - RNA, 15 nt, Yersinia pestis KIM
auaucgcucaucaug

SEQ ID NO: 2292042 - RNA, 15 nt, Yersinia pestis KIM
auaucggaguguaaa

SEQ ID NO: 2292043 - RNA, 19 nt, Yersinia pestis KIM
auaggcguuaucggcgcag

SEQ ID NO: 2292044 - RNA, 15 nt, Yersinia pestis KIM
auaggcugaucaacg

SEQ ID NO: 2292045 - RNA, 17 nt, Yersinia pestis KIM
auaggcuuaauaugcca

SEQ ID NO: 2292046 - RNA, 16 nt, Yersinia pestis KIM
auaguggggcgucguu

SEQ ID NO: 2292047 - RNA, 15 nt, Yersinia pestis KIM
auagcgaucagcaac

SEQ ID NO: 2292048 - RNA, 14 nt, Yersinia pestis KIM
auacuguugcuagg

SEQ ID NO: 2292049 - RNA, 17 nt, Yersinia pestis KIM
auacugcccgucguuau

SEQ ID NO: 2292050 - RNA, 21 nt, Yersinia pestis KIM
auacguucguagccacgaucg

SEQ ID NO: 2292051 - RNA, 16 nt, Yersinia pestis KIM
auacguugccagccau

SEQ ID NO: 2292052 - RNA, 13 nt, Yersinia pestis KIM
auagccggcgaca

SEQ ID NO: 2292053 - RNA, 22 nt, Yersinia pestis KIM
auagaagagaggcaaugauuuu

SEQ ID NO: 2292054 - RNA, 12 nt, Yersinia pestis KIM
auagaaaggcua

SEQ ID NO: 2292055 - RNA, 23 nt, Yersinia pestis KIM
auacuuucccauagcuggcuuca

SEQ ID NO: 2292056 - RNA, 16 nt, Yersinia pestis KIM
agugcucccugaacgc

SEQ ID NO: 2292057 - RNA, 16 nt, Yersinia pestis KIM
agugcggacagcgcgc

SEQ ID NO: 2292058 - RNA, 21 nt, Yersinia pestis KIM
agugauagugaguauguaucc

SEQ ID NO: 2292059 - RNA, 16 nt, Yersinia pestis KIM
agugaguuaacgagug

SEQ ID NO: 2292060 - RNA, 15 nt, Yersinia pestis KIM
agucugagccucaug

SEQ ID NO: 2292061 - RNA, 15 nt, Yersinia pestis KIM
aguauuaccaauaag

SEQ ID NO: 2292062 - RNA, 23 nt, Yersinia pestis KIM
aguauuuaacgccaccaaugcau

SEQ ID NO: 2292063 - RNA, 21 nt, Yersinia pestis KIM
agucaaagcgcucagcgccau

SEQ ID NO: 2292064 - RNA, 15 nt, Yersinia pestis KIM
agugaacguagcuaa

SEQ ID NO: 2292065 - RNA, 21 nt, Yersinia pestis KIM
agugaauuaauaacaguauca

SEQ ID NO: 2292066 - RNA, 14 nt, Yersinia pestis KIM
agugacagccacaa

SEQ ID NO: 2292067 - RNA, 18 nt, Yersinia pestis KIM
agugaccuuauauaacua

SEQ ID NO: 2292068 - RNA, 20 nt, Yersinia pestis KIM
agugaaaacguuaacugcag

SEQ ID NO: 2292069 - RNA, 18 nt, Yersinia pestis KIM
agugaaaacguuaacugc

SEQ ID NO: 2292070 - RNA, 23 nt, Yersinia pestis KIM
aguugcagaagggcggccagcaa

SEQ ID NO: 2292071 - RNA, 15 nt, Yersinia pestis KIM
aguugcagugggccu

SEQ ID NO: 2292072 - RNA, 19 nt, Yersinia pestis KIM
aguucauuuugaccagcau

SEQ ID NO: 2292073 - RNA, 18 nt, Yersinia pestis KIM
aguguauuuaucaaaguu

SEQ ID NO: 2292074 - RNA, 24 nt, Yersinia pestis KIM
agugugcugcgaagaucacucaug

SEQ ID NO: 2292075 - RNA, 15 nt, Yersinia pestis KIM
aguggugagcgccau

SEQ ID NO: 2292076 - RNA, 17 nt, Yersinia pestis KIM
aguguccgcgccauaaa

SEQ ID NO: 2292077 - RNA, 12 nt, Yersinia pestis KIM
auaacagcuaau

SEQ ID NO: 2292078 - RNA, 21 nt, Yersinia pestis KIM
auaacagauauuacgcagcca

SEQ ID NO: 2292079 - RNA, 12 nt, Yersinia pestis KIM
auaaccagcagc

SEQ ID NO: 2292080 - RNA, 18 nt, Yersinia pestis KIM
auaaccacuucaauugcc

SEQ ID NO: 2292081 - RNA, 13 nt, Yersinia pestis KIM
auaaaaaacccgc

SEQ ID NO: 2292082 - RNA, 23 nt, Yersinia pestis KIM
aguuuauuuuauuuaaucaucga

SEQ ID NO: 2292083 - RNA, 17 nt, Yersinia pestis KIM
auaaccucagggagcca

SEQ ID NO: 2292084 - RNA, 22 nt, Yersinia pestis KIM
auaacgcacacgaaucaggcgg

SEQ ID NO: 2292085 - RNA, 13 nt, Yersinia pestis KIM
auaagcaucggca

SEQ ID NO: 2292086 - RNA, 19 nt, Yersinia pestis KIM
auaaguaggcaucugccac

SEQ ID NO: 2292087 - RNA, 14 nt, Yersinia pestis KIM
auaacugaauacuu

SEQ ID NO: 2292088 - RNA, 16 nt, Yersinia pestis KIM
auaacguuucagggug

SEQ ID NO: 2292089 - RNA, 15 nt, Yersinia pestis KIM
auaauuggcaauaau

SEQ ID NO: 2292090 - RNA, 18 nt, Yersinia pestis KIM
auaauuucagcagcacgu

SEQ ID NO: 2292091 - RNA, 20 nt, Yersinia pestis KIM
auaauagauaacaaacuacu

SEQ ID NO: 2292092 - RNA, 20 nt, Yersinia pestis KIM
auacaucgcuggacgcauca

SEQ ID NO: 2292093 - RNA, 14 nt, Yersinia pestis KIM
auacauaccauaag

SEQ ID NO: 2292094 - RNA, 16 nt, Yersinia pestis KIM
auaccgcaaccauugc

SEQ ID NO: 2292095 - RNA, 14 nt, Yersinia pestis KIM
auacgcauuacccu

SEQ ID NO: 2292096 - RNA, 12 nt, Yersinia pestis KIM
auaccuuacugu

SEQ ID NO: 2292097 - RNA, 20 nt, Yersinia pestis KIM
aucuuccgucaguugcccgu

SEQ ID NO: 2292098 - RNA, 19 nt, Yersinia pestis KIM
aucuucaguuugcugaaua

SEQ ID NO: 2292099 - RNA, 18 nt, Yersinia pestis KIM
augaaugaggcugagguu

SEQ ID NO: 2292100 - RNA, 12 nt, Yersinia pestis KIM
augaucaacagu

SEQ ID NO: 2292101 - RNA, 22 nt, Yersinia pestis KIM
augauccuuuagcgcugcaucu

SEQ ID NO: 2292102 - RNA, 17 nt, Yersinia pestis KIM
augacuuagcacggcau

SEQ ID NO: 2292103 - RNA, 20 nt, Yersinia pestis KIM
augacucgaucuugaacggu

SEQ ID NO: 2292104 - RNA, 19 nt, Yersinia pestis KIM
augacucuggcagugaggc

SEQ ID NO: 2292105 - RNA, 21 nt, Yersinia pestis KIM
aucgucagccccugccagaau

SEQ ID NO: 2292106 - RNA, 17 nt, Yersinia pestis KIM
aucguccugcuuaaugc

SEQ ID NO: 2292107 - RNA, 18 nt, Yersinia pestis KIM
aucgguaccagaccggau

SEQ ID NO: 2292108 - RNA, 14 nt, Yersinia pestis KIM
aucggguagcaucc

SEQ ID NO: 2292109 - RNA, 22 nt, Yersinia pestis KIM
aucuacauaaucuuuacugcau

SEQ ID NO: 2292110 - RNA, 17 nt, Yersinia pestis KIM
aucuauaaacuucacga

SEQ ID NO: 2292111 - RNA, 18 nt, Yersinia pestis KIM
aucuauaaacuucacgag

SEQ ID NO: 2292112 - RNA, 20 nt, Yersinia pestis KIM
aucguuggugcgacaaagau

SEQ ID NO: 2292113 - RNA, 20 nt, Yersinia pestis KIM
aucgaguugaugcaauggca

SEQ ID NO: 2292114 - RNA, 22 nt, Yersinia pestis KIM
aucgaguaauauuuuguugcug

SEQ ID NO: 2292115 - RNA, 13 nt, Yersinia pestis KIM
aucgaccaacugg

SEQ ID NO: 2292116 - RNA, 17 nt, Yersinia pestis KIM
aucgccaauaaccgcag

SEQ ID NO: 2292117 - RNA, 16 nt, Yersinia pestis KIM
aucgcacugaguucug

SEQ ID NO: 2292118 - RNA, 21 nt, Yersinia pestis KIM
aucgcgggcgcgcugcugcuc

SEQ ID NO: 2292119 - RNA, 20 nt, Yersinia pestis KIM
aucgcggcgguaaccccauu

SEQ ID NO: 2292120 - RNA, 14 nt, Yersinia pestis KIM
aucggaauccauua

SEQ ID NO: 2292121 - RNA, 20 nt, Yersinia pestis KIM
aucgcuuggucacugguuca

SEQ ID NO: 2292122 - RNA, 19 nt, Yersinia pestis KIM
aucgcuucacggcaccaac

SEQ ID NO: 2292123 - RNA, 23 nt, Yersinia pestis KIM
aucgcugccauaugcauggcaua

SEQ ID NO: 2292124 - RNA, 13 nt, Yersinia pestis KIM
augguggcagccu

SEQ ID NO: 2292125 - RNA, 23 nt, Yersinia pestis KIM
auggugagcucaucuuauuucac

SEQ ID NO: 2292126 - RNA, 14 nt, Yersinia pestis KIM
augucucuauucac

SEQ ID NO: 2292127 - RNA, 21 nt, Yersinia pestis KIM
auggcuugcucaauaccauug

SEQ ID NO: 2292128 - RNA, 17 nt, Yersinia pestis KIM
auggcuggcaaggcacg

SEQ ID NO: 2292129 - RNA, 20 nt, Yersinia pestis KIM
auggcgcuuaacugcacgac

SEQ ID NO: 2292130 - RNA, 13 nt, Yersinia pestis KIM
auggccaccauua

SEQ ID NO: 2292131 - RNA, 19 nt, Yersinia pestis KIM
auggaaaccggcaauagcc

SEQ ID NO: 2292132 - RNA, 12 nt, Yersinia pestis KIM
auggaagaauca

SEQ ID NO: 2292133 - RNA, 18 nt, Yersinia pestis KIM
auggaacuguaaauauca

SEQ ID NO: 2292134 - RNA, 21 nt, Yersinia pestis KIM
augcguuuagcuuccaacuga

SEQ ID NO: 2292135 - RNA, 16 nt, Yersinia pestis KIM
augcgauuaaccucgg

SEQ ID NO: 2292136 - RNA, 14 nt, Yersinia pestis KIM
augcgcuccgccau

SEQ ID NO: 2292137 - RNA, 14 nt, Yersinia pestis KIM
augaugauaucacc

SEQ ID NO: 2292138 - RNA, 13 nt, Yersinia pestis KIM
auuggagucauga

SEQ ID NO: 2292139 - RNA, 15 nt, Yersinia pestis KIM
auugcuguuguuauu

SEQ ID NO: 2292140 - RNA, 23 nt, Yersinia pestis KIM
auuggucgcuuuuuacugaccgc

SEQ ID NO: 2292141 - RNA, 17 nt, Yersinia pestis KIM
auuggucuuaucagcgg

SEQ ID NO: 2292142 - RNA, 23 nt, Yersinia pestis KIM
auuguuaccuaaccaaacauugu

SEQ ID NO: 2292143 - RNA, 15 nt, Yersinia pestis KIM
auuuaaaaggcgcug

SEQ ID NO: 2292144 - RNA, 20 nt, Yersinia pestis KIM
auugcacgguauagcuauca

SEQ ID NO: 2292145 - RNA, 20 nt, Yersinia pestis KIM
auugccggaaggucauuccc

SEQ ID NO: 2292146 - RNA, 17 nt, Yersinia pestis KIM
auugccgcgucuguuau

SEQ ID NO: 2292147 - RNA, 22 nt, Yersinia pestis KIM
auugcugcccggucgccauaau

SEQ ID NO: 2292148 - RNA, 14 nt, Yersinia pestis KIM
auugcucaguuccc

SEQ ID NO: 2292149 - RNA, 16 nt, Yersinia pestis KIM
auugcuccuguauauu

SEQ ID NO: 2292150 - RNA, 20 nt, Yersinia pestis KIM
auugccgugcaaucuguuau

SEQ ID NO: 2292151 - RNA, 10 nt, Yersinia pestis KIM
auugccggua

SEQ ID NO: 2292152 - RNA, 16 nt, Yersinia pestis KIM
auuccuuaccugaugu

SEQ ID NO: 2292153 - RNA, 22 nt, Yersinia pestis KIM
auucgggcugaguaaagcccag

SEQ ID NO: 2292154 - RNA, 13 nt, Yersinia pestis KIM
auucuggcugaua

SEQ ID NO: 2292155 - RNA, 19 nt, Yersinia pestis KIM
auucugggaucgcgcagug

SEQ ID NO: 2292156 - RNA, 20 nt, Yersinia pestis KIM
auugagcgccacaucggcgu

SEQ ID NO: 2292157 - RNA, 15 nt, Yersinia pestis KIM
auugagaagaaauca

SEQ ID NO: 2292158 - RNA, 18 nt, Yersinia pestis KIM
auuagccagccaauggcc

SEQ ID NO: 2292159 - RNA, 14 nt, Yersinia pestis KIM
auuaauaacgccga

SEQ ID NO: 2292160 - RNA, 21 nt, Yersinia pestis KIM
auuagccaagguccaacuccc

SEQ ID NO: 2292161 - RNA, 22 nt, Yersinia pestis KIM
auuagccugaccgguaauaucg

SEQ ID NO: 2292162 - RNA, 18 nt, Yersinia pestis KIM
auuaguuuuagaugucag

SEQ ID NO: 2292163 - RNA, 18 nt, Yersinia pestis KIM
auuaguuuuaauaaccau

SEQ ID NO: 2292164 - RNA, 14 nt, Yersinia pestis KIM
auuaggaugucggg

SEQ ID NO: 2292165 - RNA, 11 nt, Yersinia pestis KIM
auuaacugcag

SEQ ID NO: 2292166 - RNA, 17 nt, Yersinia pestis KIM
auuaagauuaagccaug

SEQ ID NO: 2292167 - RNA, 14 nt, Yersinia pestis KIM
auuaaggcgauauu

SEQ ID NO: 2292168 - RNA, 12 nt, Yersinia pestis KIM
auuaacaagcga

SEQ ID NO: 2292169 - RNA, 19 nt, Yersinia pestis KIM
auuaacaccuuauucccgu

SEQ ID NO: 2292170 - RNA, 20 nt, Yersinia pestis KIM
auuaaccuaaaaacgucacu

SEQ ID NO: 2292171 - RNA, 16 nt, Yersinia pestis KIM
auucaacgccaauacc

SEQ ID NO: 2292172 - RNA, 14 nt, Yersinia pestis KIM
auucaaaguugccg

SEQ ID NO: 2292173 - RNA, 14 nt, Yersinia pestis KIM
auucaaauaucauu

SEQ ID NO: 2292174 - RNA, 15 nt, Yersinia pestis KIM
auucaaucggcagau

SEQ ID NO: 2292175 - RNA, 16 nt, Yersinia pestis KIM
auucagguugagcauc

SEQ ID NO: 2292176 - RNA, 16 nt, Yersinia pestis KIM
auucauauuucacugu

SEQ ID NO: 2292177 - RNA, 15 nt, Yersinia pestis KIM
auucaguugauugca

SEQ ID NO: 2292178 - RNA, 16 nt, Yersinia pestis KIM
auucaaacggugugca

SEQ ID NO: 2292179 - RNA, 14 nt, Yersinia pestis KIM
auuauuuuucacga

SEQ ID NO: 2292180 - RNA, 22 nt, Yersinia pestis KIM
auuauagccaaaucuggauaau

SEQ ID NO: 2292181 - RNA, 17 nt, Yersinia pestis KIM
augugcaaucuaaaggc

SEQ ID NO: 2292182 - RNA, 22 nt, Yersinia pestis KIM
augugauaagucgucugauauu

SEQ ID NO: 2292183 - RNA, 18 nt, Yersinia pestis KIM
auguguuuguaccgauuu

SEQ ID NO: 2292184 - RNA, 14 nt, Yersinia pestis KIM
auguguugaauauc

SEQ ID NO: 2292185 - RNA, 19 nt, Yersinia pestis KIM
augugguguuggcgauaaa

SEQ ID NO: 2292186 - RNA, 18 nt, Yersinia pestis KIM
auguucaacaagaaauca

SEQ ID NO: 2292187 - RNA, 16 nt, Yersinia pestis KIM
auuaaaggccgcaaua

SEQ ID NO: 2292188 - RNA, 23 nt, Yersinia pestis KIM
auguugggguagccaauguuggg

SEQ ID NO: 2292189 - RNA, 15 nt, Yersinia pestis KIM
caccgcuaaccuuaa

SEQ ID NO: 2292190 - RNA, 16 nt, Yersinia pestis KIM
caccgcuaaccuuaac

SEQ ID NO: 2292191 - RNA, 21 nt, Yersinia pestis KIM
cacccuuuacgcauugguaua

SEQ ID NO: 2292192 - RNA, 19 nt, Yersinia pestis KIM
caccauuuucaaaccgcug

SEQ ID NO: 2292193 - RNA, 20 nt, Yersinia pestis KIM
caccagggaaauuagcgccu

SEQ ID NO: 2292194 - RNA, 20 nt, Yersinia pestis KIM
cacagccugccgggaugacu

SEQ ID NO: 2292195 - RNA, 21 nt, Yersinia pestis KIM
cacaaaaccuuuaaucagaua

SEQ ID NO: 2292196 - RNA, 15 nt, Yersinia pestis KIM
cacauauuucauuag

SEQ ID NO: 2292197 - RNA, 20 nt, Yersinia pestis KIM
cacaugcagcauuucaggau

SEQ ID NO: 2292198 - RNA, 14 nt, Yersinia pestis KIM
cacauaaccaucaa

SEQ ID NO: 2292199 - RNA, 22 nt, Yersinia pestis KIM
cacauaccuucgguaaucaauu

SEQ ID NO: 2292200 - RNA, 20 nt, Yersinia pestis KIM
cacauuucagcguagcagga

SEQ ID NO: 2292201 - RNA, 15 nt, Yersinia pestis KIM
caccaacagcauuac

SEQ ID NO: 2292202 - RNA, 18 nt, Yersinia pestis KIM
caccaaacaguguugacc

SEQ ID NO: 2292203 - RNA, 22 nt, Yersinia pestis KIM
caccacggcgcugcagcgauau

SEQ ID NO: 2292204 - RNA, 20 nt, Yersinia pestis KIM
caacauccaguucgaccaau

SEQ ID NO: 2292205 - RNA, 17 nt, Yersinia pestis KIM
caaccaguuauagcggu

SEQ ID NO: 2292206 - RNA, 22 nt, Yersinia pestis KIM
caacaugagccacacauucagu

SEQ ID NO: 2292207 - RNA, 21 nt, Yersinia pestis KIM
caacauuuggggugcaguuca

SEQ ID NO: 2292208 - RNA, 21 nt, Yersinia pestis KIM
caaccaagacauaaugccggc

SEQ ID NO: 2292209 - RNA, 13 nt, Yersinia pestis KIM
caaauacggcacc

SEQ ID NO: 2292210 - RNA, 14 nt, Yersinia pestis KIM
caaagcgauaucgu

SEQ ID NO: 2292211 - RNA, 21 nt, Yersinia pestis KIM
caaagccucuaccaaugcccc

SEQ ID NO: 2292212 - RNA, 18 nt, Yersinia pestis KIM
auuuacguuuuuugcggu

SEQ ID NO: 2292213 - RNA, 17 nt, Yersinia pestis KIM
auuuagcaaagcgauau

SEQ ID NO: 2292214 - RNA, 16 nt, Yersinia pestis KIM
caaaucuggauaaugu

SEQ ID NO: 2292215 - RNA, 23 nt, Yersinia pestis KIM
caacgcacgauccgcccauugcg

SEQ ID NO: 2292216 - RNA, 14 nt, Yersinia pestis KIM
caacgcacucagca

SEQ ID NO: 2292217 - RNA, 15 nt, Yersinia pestis KIM
caacgcccugcaucu

SEQ ID NO: 2292218 - RNA, 14 nt, Yersinia pestis KIM
caacggugaacaga

SEQ ID NO: 2292219 - RNA, 17 nt, Yersinia pestis KIM
caacgguaucccgguga

SEQ ID NO: 2292220 - RNA, 22 nt, Yersinia pestis KIM
caacuaauucuuaggauaacca

SEQ ID NO: 2292221 - RNA, 15 nt, Yersinia pestis KIM
caacguuuuaccugc

SEQ ID NO: 2292222 - RNA, 20 nt, Yersinia pestis KIM
caacguaacaugcagcccga

SEQ ID NO: 2292223 - RNA, 12 nt, Yersinia pestis KIM
caaggcuaaccg

SEQ ID NO: 2292224 - RNA, 16 nt, Yersinia pestis KIM
caaggcacgagcggug

SEQ ID NO: 2292225 - RNA, 21 nt, Yersinia pestis KIM
caagcuuugccuaacggcaua

SEQ ID NO: 2292226 - RNA, 19 nt, Yersinia pestis KIM
caacugcucaacugcucaa

SEQ ID NO: 2292227 - RNA, 14 nt, Yersinia pestis KIM
caacugcucaucca

SEQ ID NO: 2292228 - RNA, 21 nt, Yersinia pestis KIM
caacugccgccaugcuggaug

SEQ ID NO: 2292229 - RNA, 17 nt, Yersinia pestis KIM
caagacgauaucgacgc

SEQ ID NO: 2292230 - RNA, 21 nt, Yersinia pestis KIM
caagauaccgaguucucacca

SEQ ID NO: 2292231 - RNA, 21 nt, Yersinia pestis KIM
caagacuuuccccagaugaau

SEQ ID NO: 2292232 - RNA, 19 nt, Yersinia pestis KIM
caaucagaacuauacgcgg

SEQ ID NO: 2292233 - RNA, 13 nt, Yersinia pestis KIM
caaucagaauguc

SEQ ID NO: 2292234 - RNA, 16 nt, Yersinia pestis KIM
caauauggguauugag

SEQ ID NO: 2292235 - RNA, 15 nt, Yersinia pestis KIM
caauauucgcagcca

SEQ ID NO: 2292236 - RNA, 24 nt, Yersinia pestis KIM
caauaucgauuuuuaagucaauuu

SEQ ID NO: 2292237 - RNA, 10 nt, Yersinia pestis KIM
caaucacugc

SEQ ID NO: 2292238 - RNA, 18 nt, Yersinia pestis KIM
caauagccaagaucacau

SEQ ID NO: 2292239 - RNA, 13 nt, Yersinia pestis KIM
caauagaggcucc

SEQ ID NO: 2292240 - RNA, 20 nt, Yersinia pestis KIM
caauagagaauagaccugau

SEQ ID NO: 2292241 - RNA, 23 nt, Yersinia pestis KIM
caaguccuccuugagauccucca

SEQ ID NO: 2292242 - RNA, 13 nt, Yersinia pestis KIM
caauucaucagcg

SEQ ID NO: 2292243 - RNA, 16 nt, Yersinia pestis KIM
caauucgcuucgcucc

SEQ ID NO: 2292244 - RNA, 14 nt, Yersinia pestis KIM
caauuuuauggaua

SEQ ID NO: 2292245 - RNA, 17 nt, Yersinia pestis KIM
caauuacuuuggcauuu

SEQ ID NO: 2292246 - RNA, 14 nt, Yersinia pestis KIM
caauguucucuggg

SEQ ID NO: 2292247 - RNA, 21 nt, Yersinia pestis KIM
caauggcucaccuuucaacaa

SEQ ID NO: 2292248 - RNA, 16 nt, Yersinia pestis KIM
caaucucuugacgccg

SEQ ID NO: 2292249 - RNA, 23 nt, Yersinia pestis KIM
caaugaugucaucuuccgucagu

SEQ ID NO: 2292250 - RNA, 16 nt, Yersinia pestis KIM
cagguaaucacauaac

SEQ ID NO: 2292251 - RNA, 13 nt, Yersinia pestis KIM
cagguguucagcc

SEQ ID NO: 2292252 - RNA, 16 nt, Yersinia pestis KIM
cagguucagcgaccag

SEQ ID NO: 2292253 - RNA, 23 nt, Yersinia pestis KIM
cagguuuacgccauacaucaaug

SEQ ID NO: 2292254 - RNA, 17 nt, Yersinia pestis KIM
caggugcguuaucuuca

SEQ ID NO: 2292255 - RNA, 22 nt, Yersinia pestis KIM
caguaaccccuucgagcaccgc

SEQ ID NO: 2292256 - RNA, 19 nt, Yersinia pestis KIM
caguaacggaauucagaac

SEQ ID NO: 2292257 - RNA, 15 nt, Yersinia pestis KIM
caguaacugaucaau

SEQ ID NO: 2292258 - RNA, 16 nt, Yersinia pestis KIM
caguaagguauugaca

SEQ ID NO: 2292259 - RNA, 21 nt, Yersinia pestis KIM
caguaaacagccagcaucacg

SEQ ID NO: 2292260 - RNA, 23 nt, Yersinia pestis KIM
caguaaguugaugacaugcucuu

SEQ ID NO: 2292261 - RNA, 17 nt, Yersinia pestis KIM
caguaauucacugcuua

SEQ ID NO: 2292262 - RNA, 17 nt, Yersinia pestis KIM
caguaccgacaccaaua

SEQ ID NO: 2292263 - RNA, 15 nt, Yersinia pestis KIM
caguaccgcuggugc

SEQ ID NO: 2292264 - RNA, 19 nt, Yersinia pestis KIM
cagugagcauuuuguuacc

SEQ ID NO: 2292265 - RNA, 21 nt, Yersinia pestis KIM
caguucagcccccucaauacc

SEQ ID NO: 2292266 - RNA, 21 nt, Yersinia pestis KIM
caguggcaugaugcgcucacu

SEQ ID NO: 2292267 - RNA, 22 nt, Yersinia pestis KIM
caguugcacaccaucaguacgg

SEQ ID NO: 2292268 - RNA, 20 nt, Yersinia pestis KIM
caucgaggaauagccagcgu

SEQ ID NO: 2292269 - RNA, 15 nt, Yersinia pestis KIM
caucgauugcuggcg

SEQ ID NO: 2292270 - RNA, 19 nt, Yersinia pestis KIM
caucgccaaagccgucagu

SEQ ID NO: 2292271 - RNA, 22 nt, Yersinia pestis KIM
caucaugguccaguggcgguau

SEQ ID NO: 2292272 - RNA, 20 nt, Yersinia pestis KIM
caucaucacaaauaacccgc

SEQ ID NO: 2292273 - RNA, 13 nt, Yersinia pestis KIM
caucauaucgaug

SEQ ID NO: 2292274 - RNA, 14 nt, Yersinia pestis KIM
caucauaacgaaug

SEQ ID NO: 2292275 - RNA, 13 nt, Yersinia pestis KIM
caucauaacgaau

SEQ ID NO: 2292276 - RNA, 16 nt, Yersinia pestis KIM
caucaccauugaccag

SEQ ID NO: 2292277 - RNA, 15 nt, Yersinia pestis KIM
cauccacugcggcca

SEQ ID NO: 2292278 - RNA, 14 nt, Yersinia pestis KIM
cauccacgcaggca

SEQ ID NO: 2292279 - RNA, 22 nt, Yersinia pestis KIM
caucaauaaaauuacccagcau

SEQ ID NO: 2292280 - RNA, 16 nt, Yersinia pestis KIM
caucaacgacagcagc

SEQ ID NO: 2292281 - RNA, 17 nt, Yersinia pestis KIM
caucaaaggcaauaccg

SEQ ID NO: 2292282 - RNA, 18 nt, Yersinia pestis KIM
cauaucaacacugccuga

SEQ ID NO: 2292283 - RNA, 21 nt, Yersinia pestis KIM
cauauauugauccaaauggcu

SEQ ID NO: 2292284 - RNA, 20 nt, Yersinia pestis KIM
cauauauuuuucuuucucga

SEQ ID NO: 2292285 - RNA, 12 nt, Yersinia pestis KIM
cauauauugauc

SEQ ID NO: 2292286 - RNA, 23 nt, Yersinia pestis KIM
cauauagcggcguucagcaauau

SEQ ID NO: 2292287 - RNA, 13 nt, Yersinia pestis KIM
cauaucggccaag

SEQ ID NO: 2292288 - RNA, 17 nt, Yersinia pestis KIM
cauaggucuuuacgcag

SEQ ID NO: 2292289 - RNA, 19 nt, Yersinia pestis KIM
cauauaaaccagccaguga

SEQ ID NO: 2292290 - RNA, 22 nt, Yersinia pestis KIM
cauauaagcggcaaaaagcgcc

SEQ ID NO: 2292291 - RNA, 16 nt, Yersinia pestis KIM
cauauaagcaauaccg

SEQ ID NO: 2292292 - RNA, 22 nt, Yersinia pestis KIM
cauagguacggguauagcggcg

SEQ ID NO: 2292293 - RNA, 19 nt, Yersinia pestis KIM
caguuugaucgcuaaucgc

SEQ ID NO: 2292294 - RNA, 16 nt, Yersinia pestis KIM
cauaauccagaagcca

SEQ ID NO: 2292295 - RNA, 15 nt, Yersinia pestis KIM
cauaaaccggugacu

SEQ ID NO: 2292296 - RNA, 14 nt, Yersinia pestis KIM
cauaauaaugcgau

SEQ ID NO: 2292297 - RNA, 13 nt, Yersinia pestis KIM
cagcuuguugaua

SEQ ID NO: 2292298 - RNA, 19 nt, Yersinia pestis KIM
caggcaaugagugcagcca

SEQ ID NO: 2292299 - RNA, 13 nt, Yersinia pestis KIM
caggccaagugcu

SEQ ID NO: 2292300 - RNA, 22 nt, Yersinia pestis KIM
caggcgaucucuucggcccaga

SEQ ID NO: 2292301 - RNA, 21 nt, Yersinia pestis KIM
cagcuuauaggucauugguua

SEQ ID NO: 2292302 - RNA, 23 nt, Yersinia pestis KIM
cagcugcuuuaucguagccaaua

SEQ ID NO: 2292303 - RNA, 19 nt, Yersinia pestis KIM
cagcguagacaaugacugu

SEQ ID NO: 2292304 - RNA, 22 nt, Yersinia pestis KIM
cagcguaggcaacuaagcugcc

SEQ ID NO: 2292305 - RNA, 22 nt, Yersinia pestis KIM
cagcguagguaacuaagcugcc

SEQ ID NO: 2292306 - RNA, 23 nt, Yersinia pestis KIM
cagccaucaguucacugaauccc

SEQ ID NO: 2292307 - RNA, 15 nt, Yersinia pestis KIM
cagccugguugguaa

SEQ ID NO: 2292308 - RNA, 17 nt, Yersinia pestis KIM
cagccucuaacauacuc

SEQ ID NO: 2292309 - RNA, 13 nt, Yersinia pestis KIM
cagcaccauacag

SEQ ID NO: 2292310 - RNA, 16 nt, Yersinia pestis KIM
cagcacaucgccauua

SEQ ID NO: 2292311 - RNA, 21 nt, Yersinia pestis KIM
cagcacagagcacaacggaag

SEQ ID NO: 2292312 - RNA, 16 nt, Yersinia pestis KIM
cagcacagagcacaac

SEQ ID NO: 2292313 - RNA, 13 nt, Yersinia pestis KIM
cagauaaucccuu

SEQ ID NO: 2292314 - RNA, 21 nt, Yersinia pestis KIM
cagcacgggcuaucggguaac

SEQ ID NO: 2292315 - RNA, 20 nt, Yersinia pestis KIM
cagcaggcugugaucugcca

SEQ ID NO: 2292316 - RNA, 16 nt, Yersinia pestis KIM
cagcagucugacaccg

SEQ ID NO: 2292317 - RNA, 14 nt, Yersinia pestis KIM
cagcauauugagca

SEQ ID NO: 2292318 - RNA, 13 nt, Yersinia pestis KIM
cagcaucaaggac

SEQ ID NO: 2292319 - RNA, 19 nt, Yersinia pestis KIM
cagcaucacccguuuuccc

SEQ ID NO: 2292320 - RNA, 14 nt, Yersinia pestis KIM
aaacuuguaucaaa

SEQ ID NO: 2292321 - RNA, 13 nt, Yersinia pestis KIM
aaacugucaguca

SEQ ID NO: 2292322 - RNA, 19 nt, Yersinia pestis KIM
cacgcuauccgcgccgagc

SEQ ID NO: 2292323 - RNA, 22 nt, Yersinia pestis KIM
cacggaagguugcccccaccau

SEQ ID NO: 2292324 - RNA, 18 nt, Yersinia pestis KIM
cacguuaaauuucuucaa

SEQ ID NO: 2292325 - RNA, 18 nt, Yersinia pestis KIM
cacguagcacacgacuga

SEQ ID NO: 2292326 - RNA, 23 nt, Yersinia pestis KIM
cacuaacgccgcguuagcuauau

SEQ ID NO: 2292327 - RNA, 14 nt, Yersinia pestis KIM
cacucggccagagc

SEQ ID NO: 2292328 - RNA, 18 nt, Yersinia pestis KIM
cacugagggugauaucgu

SEQ ID NO: 2292329 - RNA, 17 nt, Yersinia pestis KIM
cacuuuuauccagccau

SEQ ID NO: 2292330 - RNA, 16 nt, Yersinia pestis KIM
cagacgaaagauaauu

SEQ ID NO: 2292331 - RNA, 17 nt, Yersinia pestis KIM
cagacgaaccgcuuuga

SEQ ID NO: 2292332 - RNA, 19 nt, Yersinia pestis KIM
cagaccgcguaagccgugc

SEQ ID NO: 2292333 - RNA, 15 nt, Yersinia pestis KIM
cagacugcugacaaa

SEQ ID NO: 2292334 - RNA, 19 nt, Yersinia pestis KIM
cagagauccggugaagaau

SEQ ID NO: 2292335 - RNA, 15 nt, Yersinia pestis KIM
aaagaagacauaucu

SEQ ID NO: 2292336 - RNA, 15 nt, Yersinia pestis KIM
cagagccaaucccca

SEQ ID NO: 2292337 - RNA, 16 nt, Yersinia pestis KIM
cagagccaauccccag

SEQ ID NO: 2292338 - RNA, 18 nt, Yersinia pestis KIM
ccagcaauaaaccacugg

SEQ ID NO: 2292339 - RNA, 21 nt, Yersinia pestis KIM
ccagauaaucgccaauaaccg

SEQ ID NO: 2292340 - RNA, 12 nt, Yersinia pestis KIM
ccagauagucau

SEQ ID NO: 2292341 - RNA, 17 nt, Yersinia pestis KIM
ccacuagguccauaaug

SEQ ID NO: 2292342 - RNA, 12 nt, Yersinia pestis KIM
ccacuucaucau

SEQ ID NO: 2292343 - RNA, 16 nt, Yersinia pestis KIM
ccacguuuugacgcgu

SEQ ID NO: 2292344 - RNA, 18 nt, Yersinia pestis KIM
aaauaaucagcucauuaa

SEQ ID NO: 2292345 - RNA, 20 nt, Yersinia pestis KIM
aaauaagcguagggauaaau

SEQ ID NO: 2292346 - RNA, 21 nt, Yersinia pestis KIM
aaagugcuuaacccaccaaua

SEQ ID NO: 2292347 - RNA, 23 nt, Yersinia pestis KIM
ccaccgucaccaaauauuaccgu

SEQ ID NO: 2292348 - RNA, 16 nt, Yersinia pestis KIM
aaauagagcaccaaau

SEQ ID NO: 2292349 - RNA, 12 nt, Yersinia pestis KIM
aaauaucauuaa

SEQ ID NO: 2292350 - RNA, 15 nt, Yersinia pestis KIM
ccagcagaaccaugg

SEQ ID NO: 2292351 - RNA, 13 nt, Yersinia pestis KIM
ccagcccuacugg

SEQ ID NO: 2292352 - RNA, 22 nt, Yersinia pestis KIM
ccagcgaggcuucucagcaagg

SEQ ID NO: 2292353 - RNA, 14 nt, Yersinia pestis KIM
aaaucaagggcgau

SEQ ID NO: 2292354 - RNA, 22 nt, Yersinia pestis KIM
aaauauccuccgacauagccgg

SEQ ID NO: 2292355 - RNA, 13 nt, Yersinia pestis KIM
cauggcuuucagg

SEQ ID NO: 2292356 - RNA, 15 nt, Yersinia pestis KIM
cauggcuuucaggau

SEQ ID NO: 2292357 - RNA, 17 nt, Yersinia pestis KIM
caugcuguagcagccug

SEQ ID NO: 2292358 - RNA, 16 nt, Yersinia pestis KIM
caugcgguuggcggcu

SEQ ID NO: 2292359 - RNA, 21 nt, Yersinia pestis KIM
caucgccgacaaaauccccca

SEQ ID NO: 2292360 - RNA, 23 nt, Yersinia pestis KIM
cauucaucccgguugcgauacag

SEQ ID NO: 2292361 - RNA, 17 nt, Yersinia pestis KIM
cauuauugaacgcuugc

SEQ ID NO: 2292362 - RNA, 15 nt, Yersinia pestis KIM
cauuauccguuugca

SEQ ID NO: 2292363 - RNA, 16 nt, Yersinia pestis KIM
cauuccccaucgccaa

SEQ ID NO: 2292364 - RNA, 18 nt, Yersinia pestis KIM
cauucugcagauguauua

SEQ ID NO: 2292365 - RNA, 16 nt, Yersinia pestis KIM
cauugacuagccauuu

SEQ ID NO: 2292366 - RNA, 16 nt, Yersinia pestis KIM
cauugaggagcgauaa

SEQ ID NO: 2292367 - RNA, 22 nt, Yersinia pestis KIM
cauuaaagauuucaucauucaa

SEQ ID NO: 2292368 - RNA, 12 nt, Yersinia pestis KIM
cauguugcaucg

SEQ ID NO: 2292369 - RNA, 20 nt, Yersinia pestis KIM
cauuaccgcgccgaaugaac

SEQ ID NO: 2292370 - RNA, 15 nt, Yersinia pestis KIM
cauuaaucagcgaau

SEQ ID NO: 2292371 - RNA, 13 nt, Yersinia pestis KIM
ccaccauucgcca

SEQ ID NO: 2292372 - RNA, 19 nt, Yersinia pestis KIM
ccaauugaguaacugauua

SEQ ID NO: 2292373 - RNA, 19 nt, Yersinia pestis KIM
ccaauugcaggguauucca

SEQ ID NO: 2292374 - RNA, 17 nt, Yersinia pestis KIM
ccaauugacuagcaggu

SEQ ID NO: 2292375 - RNA, 15 nt, Yersinia pestis KIM
ccaauuggcuuaacu

SEQ ID NO: 2292376 - RNA, 18 nt, Yersinia pestis KIM
ccaauuugggcauuaagu

SEQ ID NO: 2292377 - RNA, 14 nt, Yersinia pestis KIM
ccaauggcucaccu

SEQ ID NO: 2292378 - RNA, 20 nt, Yersinia pestis KIM
ccaauggucaguuguucacc

SEQ ID NO: 2292379 - RNA, 20 nt, Yersinia pestis KIM
ccaauucaaggccagcacgu

SEQ ID NO: 2292380 - RNA, 14 nt, Yersinia pestis KIM
ccaauaaugcuuug

SEQ ID NO: 2292381 - RNA, 19 nt, Yersinia pestis KIM
ccaauaaagcucugacaaa

SEQ ID NO: 2292382 - RNA, 13 nt, Yersinia pestis KIM
cauuuaauucagu

SEQ ID NO: 2292383 - RNA, 14 nt, Yersinia pestis KIM
cauuuaccaucagg

SEQ ID NO: 2292384 - RNA, 14 nt, Yersinia pestis KIM
cauuuaaauacaga

SEQ ID NO: 2292385 - RNA, 19 nt, Yersinia pestis KIM
cauugguauaccguacccg

SEQ ID NO: 2292386 - RNA, 22 nt, Yersinia pestis KIM
cauugcgguucaggauccgccu

SEQ ID NO: 2292387 - RNA, 23 nt, Yersinia pestis KIM
cauuucugguugugcuucagaca

SEQ ID NO: 2292388 - RNA, 16 nt, Yersinia pestis KIM
cauuuuccugcauauu

SEQ ID NO: 2292389 - RNA, 15 nt, Yersinia pestis KIM
ccaagcccaguaaag

SEQ ID NO: 2292390 - RNA, 12 nt, Yersinia pestis KIM
ccaacugaaacg

SEQ ID NO: 2292391 - RNA, 17 nt, Yersinia pestis KIM
ccaacugaggcagaaug

SEQ ID NO: 2292392 - RNA, 16 nt, Yersinia pestis KIM
ccaaccccaucagcau

SEQ ID NO: 2292393 - RNA, 22 nt, Yersinia pestis KIM
ccaacaccacacugagcaccgc

SEQ ID NO: 2292394 - RNA, 15 nt, Yersinia pestis KIM
ccaacaaugaacugu

SEQ ID NO: 2292395 - RNA, 12 nt, Yersinia pestis KIM
ccaacacgauau

SEQ ID NO: 2292396 - RNA, 18 nt, Yersinia pestis KIM
ccaaaucucaucggcaua

SEQ ID NO: 2292397 - RNA, 14 nt, Yersinia pestis KIM
ccaaacggaauggu

SEQ ID NO: 2292398 - RNA, 18 nt, Yersinia pestis KIM
ccaaacauuuucaucuga

SEQ ID NO: 2292399 - RNA, 17 nt, Yersinia pestis KIM
cccgcuaacaugccaca

SEQ ID NO: 2292400 - RNA, 17 nt, Yersinia pestis KIM
cccgcguugucagccau

SEQ ID NO: 2292401 - RNA, 23 nt, Yersinia pestis KIM
cccgccagggguaagauccacca

SEQ ID NO: 2292402 - RNA, 15 nt, Yersinia pestis KIM
cccgauuauugugcc

SEQ ID NO: 2292403 - RNA, 19 nt, Yersinia pestis KIM
ccccaguagcacaaugccu

SEQ ID NO: 2292404 - RNA, 20 nt, Yersinia pestis KIM
ccccagaugaaugguuuccu

SEQ ID NO: 2292405 - RNA, 13 nt, Yersinia pestis KIM
cccugaaccaugg

SEQ ID NO: 2292406 - RNA, 20 nt, Yersinia pestis KIM
cccuauuuguacuuaacguu

SEQ ID NO: 2292407 - RNA, 17 nt, Yersinia pestis KIM
cccuaucgaacuauuga

SEQ ID NO: 2292408 - RNA, 23 nt, Yersinia pestis KIM
cccguacaaaaauaaacgggcuu

SEQ ID NO: 2292409 - RNA, 10 nt, Yersinia pestis KIM
cccgugccag

SEQ ID NO: 2292410 - RNA, 22 nt, Yersinia pestis KIM
cccugcuccaaagcuuccaaua

SEQ ID NO: 2292411 - RNA, 20 nt, Yersinia pestis KIM
cccugcggguagaaacguuc

SEQ ID NO: 2292412 - RNA, 21 nt, Yersinia pestis KIM
cccugagguugcucagcgggc

SEQ ID NO: 2292413 - RNA, 18 nt, Yersinia pestis KIM
cccugacucccugacucc

SEQ ID NO: 2292414 - RNA, 14 nt, Yersinia pestis KIM
cccuuaucuacugg

SEQ ID NO: 2292415 - RNA, 14 nt, Yersinia pestis KIM
cccaaucuaugacc

SEQ ID NO: 2292416 - RNA, 14 nt, Yersinia pestis KIM
cccaagccauccuu

SEQ ID NO: 2292417 - RNA, 22 nt, Yersinia pestis KIM
ccaugucggcagguaaugcauu

SEQ ID NO: 2292418 - RNA, 16 nt, Yersinia pestis KIM
ccauccccuguugauc

SEQ ID NO: 2292419 - RNA, 20 nt, Yersinia pestis KIM
ccauccccaacucuuucaac

SEQ ID NO: 2292420 - RNA, 13 nt, Yersinia pestis KIM
ccaucaugaucug

SEQ ID NO: 2292421 - RNA, 20 nt, Yersinia pestis KIM
ccaucauugaguuugucacc

SEQ ID NO: 2292422 - RNA, 13 nt, Yersinia pestis KIM
ccaugacuuugga

SEQ ID NO: 2292423 - RNA, 22 nt, Yersinia pestis KIM
ccaggguuucugcgagcguuua

SEQ ID NO: 2292424 - RNA, 19 nt, Yersinia pestis KIM
ccagucauccaaacggaau

SEQ ID NO: 2292425 - RNA, 17 nt, Yersinia pestis KIM
ccagugaguccuuuacu

SEQ ID NO: 2292426 - RNA, 23 nt, Yersinia pestis KIM
ccaguuacuaccuuuugcauauu

SEQ ID NO: 2292427 - RNA, 20 nt, Yersinia pestis KIM
ccagugcuuuauccaauggc

SEQ ID NO: 2292428 - RNA, 20 nt, Yersinia pestis KIM
ccaguugccacucauauuca

SEQ ID NO: 2292429 - RNA, 19 nt, Yersinia pestis KIM
ccauauugauauagcggua

SEQ ID NO: 2292430 - RNA, 13 nt, Yersinia pestis KIM
ccauauuuuucaa

SEQ ID NO: 2292431 - RNA, 14 nt, Yersinia pestis KIM
ccaucaagccaccg

SEQ ID NO: 2292432 - RNA, 22 nt, Yersinia pestis KIM
ccaucacaaaaccuuuaaucag

SEQ ID NO: 2292433 - RNA, 17 nt, Yersinia pestis KIM
ccaucagcgcacugcau

SEQ ID NO: 2292434 - RNA, 23 nt, Yersinia pestis KIM
ccaucagacaggauaaucaucag

SEQ ID NO: 2292435 - RNA, 16 nt, Yersinia pestis KIM
ccaucagaguccaaua

SEQ ID NO: 2292436 - RNA, 18 nt, Yersinia pestis KIM
ccauaaggccaggcaaua

SEQ ID NO: 2292437 - RNA, 22 nt, Yersinia pestis KIM
ccauaaccauugaaaccacggc

SEQ ID NO: 2292438 - RNA, 18 nt, Yersinia pestis KIM
cgggggccccugauugca

SEQ ID NO: 2292439 - RNA, 14 nt, Yersinia pestis KIM
cggguaacaacuca

SEQ ID NO: 2292440 - RNA, 18 nt, Yersinia pestis KIM
cgggcuuauucgaguagg

SEQ ID NO: 2292441 - RNA, 19 nt, Yersinia pestis KIM
cgggccuuuuaccuuuaac

SEQ ID NO: 2292442 - RNA, 17 nt, Yersinia pestis KIM
cgggagauaguuaucuc

SEQ ID NO: 2292443 - RNA, 20 nt, Yersinia pestis KIM
cgggauaugacuaaacugau

SEQ ID NO: 2292444 - RNA, 21 nt, Yersinia pestis KIM
aacauuacuuugaauagcacc

SEQ ID NO: 2292445 - RNA, 24 nt, Yersinia pestis KIM
aacauuauugaacgcuugcaacaa

SEQ ID NO: 2292446 - RNA, 13 nt, Yersinia pestis KIM
aacauuauccguu

SEQ ID NO: 2292447 - RNA, 16 nt, Yersinia pestis KIM
cgggcaugaacguguu

SEQ ID NO: 2292448 - RNA, 17 nt, Yersinia pestis KIM
cggcuuucucuugccau

SEQ ID NO: 2292449 - RNA, 12 nt, Yersinia pestis KIM
cggcuucaucag

SEQ ID NO: 2292450 - RNA, 14 nt, Yersinia pestis KIM
cggcauugagcgga

SEQ ID NO: 2292451 - RNA, 16 nt, Yersinia pestis KIM
cggccaauucagcaac

SEQ ID NO: 2292452 - RNA, 14 nt, Yersinia pestis KIM
cggcauugccagcg

SEQ ID NO: 2292453 - RNA, 21 nt, Yersinia pestis KIM
cggcaucauccucauugagca

SEQ ID NO: 2292454 - RNA, 22 nt, Yersinia pestis KIM
cggcaaugggucauugcgugca

SEQ ID NO: 2292455 - RNA, 14 nt, Yersinia pestis KIM
cggcacccacggcg

SEQ ID NO: 2292456 - RNA, 14 nt, Yersinia pestis KIM
cggcaacgaucaga

SEQ ID NO: 2292457 - RNA, 21 nt, Yersinia pestis KIM
cggaugccggaaucagccaga

SEQ ID NO: 2292458 - RNA, 23 nt, Yersinia pestis KIM
cggauuguucagcaaccgcauca

SEQ ID NO: 2292459 - RNA, 17 nt, Yersinia pestis KIM
cggacgccccaccgaua

SEQ ID NO: 2292460 - RNA, 20 nt, Yersinia pestis KIM
cgcugagcgggcggcaauga

SEQ ID NO: 2292461 - RNA, 20 nt, Yersinia pestis KIM
cggagcugacgucagaucgc

SEQ ID NO: 2292462 - RNA, 16 nt, Yersinia pestis KIM
cggagcguacacgcag

SEQ ID NO: 2292463 - RNA, 23 nt, Yersinia pestis KIM
cggauaugccgcucgaaccgcca

SEQ ID NO: 2292464 - RNA, 21 nt, Yersinia pestis KIM
cggauacguuccaacaucucg

SEQ ID NO: 2292465 - RNA, 23 nt, Yersinia pestis KIM
cggauaaacacuguuuaucgcau

SEQ ID NO: 2292466 - RNA, 21 nt, Yersinia pestis KIM
cggaguuugagacccccaaug

SEQ ID NO: 2292467 - RNA, 13 nt, Yersinia pestis KIM
cgcccauucgaau

SEQ ID NO: 2292468 - RNA, 20 nt, Yersinia pestis KIM
cgccccugaauucgauaaca

SEQ ID NO: 2292469 - RNA, 18 nt, Yersinia pestis KIM
cgccgauggugugcagca

SEQ ID NO: 2292470 - RNA, 14 nt, Yersinia pestis KIM
cgccgcuguagcgc

SEQ ID NO: 2292471 - RNA, 17 nt, Yersinia pestis KIM
cgccgugagcaaucugg

SEQ ID NO: 2292472 - RNA, 14 nt, Yersinia pestis KIM
aacacuggcagcca

SEQ ID NO: 2292473 - RNA, 17 nt, Yersinia pestis KIM
aacacugaauaacugaa

SEQ ID NO: 2292474 - RNA, 19 nt, Yersinia pestis KIM
aacacguggguauccagug

SEQ ID NO: 2292475 - RNA, 23 nt, Yersinia pestis KIM
cgccguuacccccuucaccaaua

SEQ ID NO: 2292476 - RNA, 19 nt, Yersinia pestis KIM
aacagauauuacgcagcca

SEQ ID NO: 2292477 - RNA, 21 nt, Yersinia pestis KIM
cgccucaguaucuuuccagcc

SEQ ID NO: 2292478 - RNA, 21 nt, Yersinia pestis KIM
cgcgcccauccgcaggaagca

SEQ ID NO: 2292479 - RNA, 21 nt, Yersinia pestis KIM
cgcuauccccacggcgacguu

SEQ ID NO: 2292480 - RNA, 19 nt, Yersinia pestis KIM
cgcguugcgcugaccaugg

SEQ ID NO: 2292481 - RNA, 13 nt, Yersinia pestis KIM
cgcuaugcagccc

SEQ ID NO: 2292482 - RNA, 12 nt, Yersinia pestis KIM
cgcuccagcacu

SEQ ID NO: 2292483 - RNA, 23 nt, Yersinia pestis KIM
cgcugacaauuuacacccaguua

SEQ ID NO: 2292484 - RNA, 17 nt, Yersinia pestis KIM
cgcugaaguggcugaau

SEQ ID NO: 2292485 - RNA, 18 nt, Yersinia pestis KIM
aacagcgccucaguaucu

SEQ ID NO: 2292486 - RNA, 13 nt, Yersinia pestis KIM
ccgaucaccgcaa

SEQ ID NO: 2292487 - RNA, 15 nt, Yersinia pestis KIM
ccgauuccaucagcg

SEQ ID NO: 2292488 - RNA, 17 nt, Yersinia pestis KIM
ccgagguauuguugcca

SEQ ID NO: 2292489 - RNA, 16 nt, Yersinia pestis KIM
ccgaaauaaaaccauc

SEQ ID NO: 2292490 - RNA, 19 nt, Yersinia pestis KIM
ccgcaaucucuugacgccg

SEQ ID NO: 2292491 - RNA, 22 nt, Yersinia pestis KIM
ccgcaaaauggguauauuuacc

SEQ ID NO: 2292492 - RNA, 13 nt, Yersinia pestis KIM
ccgccauugccag

SEQ ID NO: 2292493 - RNA, 22 nt, Yersinia pestis KIM
ccgccaugagaaccaguucugg

SEQ ID NO: 2292494 - RNA, 19 nt, Yersinia pestis KIM
aaauggguauauuuaccaa

SEQ ID NO: 2292495 - RNA, 13 nt, Yersinia pestis KIM
aaauggcugcguu

SEQ ID NO: 2292496 - RNA, 16 nt, Yersinia pestis KIM
aaaugagucauuaucu

SEQ ID NO: 2292497 - RNA, 17 nt, Yersinia pestis KIM
ccgcuggucgauaagca

SEQ ID NO: 2292498 - RNA, 20 nt, Yersinia pestis KIM
aaauuaacggaaaagagcgc

SEQ ID NO: 2292499 - RNA, 18 nt, Yersinia pestis KIM
ccguaaacauugacgaug

SEQ ID NO: 2292500 - RNA, 20 nt, Yersinia pestis KIM
ccgguuuuaaauuacgguuu

SEQ ID NO: 2292501 - RNA, 13 nt, Yersinia pestis KIM
ccggguaacgcca

SEQ ID NO: 2292502 - RNA, 18 nt, Yersinia pestis KIM
ccguuuucuuucaacugc

SEQ ID NO: 2292503 - RNA, 16 nt, Yersinia pestis KIM
ccuaagaaucggccag

SEQ ID NO: 2292504 - RNA, 22 nt, Yersinia pestis KIM
ccuaaucccuuguucaggcaga

SEQ ID NO: 2292505 - RNA, 22 nt, Yersinia pestis KIM
ccuaagguagugagaugauuuu

SEQ ID NO: 2292506 - RNA, 10 nt, Yersinia pestis KIM
ccucaugaau

SEQ ID NO: 2292507 - RNA, 15 nt, Yersinia pestis KIM
ccucaggcccgcuau

SEQ ID NO: 2292508 - RNA, 18 nt, Yersinia pestis KIM
ccuaggcuauugacaaag

SEQ ID NO: 2292509 - RNA, 19 nt, Yersinia pestis KIM
ccuaggcuaaugugaugaa

SEQ ID NO: 2292510 - RNA, 19 nt, Yersinia pestis KIM
ccuauuuaauagugccaau

SEQ ID NO: 2292511 - RNA, 22 nt, Yersinia pestis KIM
ccucaaaauucgugcucaucaa

SEQ ID NO: 2292512 - RNA, 14 nt, Yersinia pestis KIM
ccuaucugaaugcu

SEQ ID NO: 2292513 - RNA, 18 nt, Yersinia pestis KIM
ccgcuuuagcgaugacca

SEQ ID NO: 2292514 - RNA, 16 nt, Yersinia pestis KIM
ccgcuuuaaucagccc

SEQ ID NO: 2292515 - RNA, 18 nt, Yersinia pestis KIM
ccgcuuuuuagcgaucag

SEQ ID NO: 2292516 - RNA, 13 nt, Yersinia pestis KIM
ccggcauggacga

SEQ ID NO: 2292517 - RNA, 19 nt, Yersinia pestis KIM
ccggcgugaguuccagccc

SEQ ID NO: 2292518 - RNA, 23 nt, Yersinia pestis KIM
aaauuggcuucacccuggcucug

SEQ ID NO: 2292519 - RNA, 15 nt, Yersinia pestis KIM
aaauucauuaucagg

SEQ ID NO: 2292520 - RNA, 19 nt, Yersinia pestis KIM
aaauuuucuaagcugccug

SEQ ID NO: 2292521 - RNA, 18 nt, Yersinia pestis KIM
cgcaugcaacagauaauu

SEQ ID NO: 2292522 - RNA, 22 nt, Yersinia pestis KIM
cgcauuagguguuaacgcgccg

SEQ ID NO: 2292523 - RNA, 21 nt, Yersinia pestis KIM
cgccaacagagugaaucgccg

SEQ ID NO: 2292524 - RNA, 13 nt, Yersinia pestis KIM
cgcaucagccagc

SEQ ID NO: 2292525 - RNA, 21 nt, Yersinia pestis KIM
cgcauaaucaguacaucaaua

SEQ ID NO: 2292526 - RNA, 14 nt, Yersinia pestis KIM
cgcacugauagcca

SEQ ID NO: 2292527 - RNA, 17 nt, Yersinia pestis KIM
cgcagauccagaauuuc

SEQ ID NO: 2292528 - RNA, 17 nt, Yersinia pestis KIM
cgcacgggcuuuaauga

SEQ ID NO: 2292529 - RNA, 13 nt, Yersinia pestis KIM
cgauuuucgaaaa

SEQ ID NO: 2292530 - RNA, 21 nt, Yersinia pestis KIM
cgcaaucagccgcaucacuga

SEQ ID NO: 2292531 - RNA, 21 nt, Yersinia pestis KIM
cgcaaguaaaagucagcaaau

SEQ ID NO: 2292532 - RNA, 22 nt, Yersinia pestis KIM
cgcaaguaaaagucagcaaauc

SEQ ID NO: 2292533 - RNA, 23 nt, Yersinia pestis KIM
cgcacacagcccugccuggcagg

SEQ ID NO: 2292534 - RNA, 20 nt, Yersinia pestis KIM
cgaucaguggcacacguucg

SEQ ID NO: 2292535 - RNA, 17 nt, Yersinia pestis KIM
cgaucagcaacggcuuc

SEQ ID NO: 2292536 - RNA, 16 nt, Yersinia pestis KIM
cgaucaacccccugug

SEQ ID NO: 2292537 - RNA, 14 nt, Yersinia pestis KIM
cgauauacaucacg

SEQ ID NO: 2292538 - RNA, 18 nt, Yersinia pestis KIM
cgaucaacgccucacaac

SEQ ID NO: 2292539 - RNA, 18 nt, Yersinia pestis KIM
cgaucacaacgcaucagu

SEQ ID NO: 2292540 - RNA, 15 nt, Yersinia pestis KIM
cgauagcccaucuua

SEQ ID NO: 2292541 - RNA, 17 nt, Yersinia pestis KIM
cgauaaccaaaucaccu

SEQ ID NO: 2292542 - RNA, 16 nt, Yersinia pestis KIM
cgauaacccacguuca

SEQ ID NO: 2292543 - RNA, 17 nt, Yersinia pestis KIM
cgauacuaauuucuaau

SEQ ID NO: 2292544 - RNA, 18 nt, Yersinia pestis KIM
cgagggcucaaucucugc

SEQ ID NO: 2292545 - RNA, 15 nt, Yersinia pestis KIM
cgaggacuuccugcc

SEQ ID NO: 2292546 - RNA, 17 nt, Yersinia pestis KIM
cgaucuauccaauccuu

SEQ ID NO: 2292547 - RNA, 16 nt, Yersinia pestis KIM
cgaugacgcgaucuug

SEQ ID NO: 2292548 - RNA, 16 nt, Yersinia pestis KIM
cgaucaucaucgguac

SEQ ID NO: 2292549 - RNA, 22 nt, Yersinia pestis KIM
cgacgauggaguggucaugcuc

SEQ ID NO: 2292550 - RNA, 18 nt, Yersinia pestis KIM
cgacauccaauucaguac

SEQ ID NO: 2292551 - RNA, 21 nt, Yersinia pestis KIM
cgaaugcgacaccugcuauca

SEQ ID NO: 2292552 - RNA, 16 nt, Yersinia pestis KIM
cgaaugcgacaccugc

SEQ ID NO: 2292553 - RNA, 14 nt, Yersinia pestis KIM
cgaauuugcugcuc

SEQ ID NO: 2292554 - RNA, 13 nt, Yersinia pestis KIM
cgacaaaaccgau

SEQ ID NO: 2292555 - RNA, 22 nt, Yersinia pestis KIM
cgaccaacuggcaaucaugggc

SEQ ID NO: 2292556 - RNA, 16 nt, Yersinia pestis KIM
cgaccaauucaucagc

SEQ ID NO: 2292557 - RNA, 16 nt, Yersinia pestis KIM
cgacgguuucugucuu

SEQ ID NO: 2292558 - RNA, 21 nt, Yersinia pestis KIM
aacacacuucgccaggucagg

SEQ ID NO: 2292559 - RNA, 19 nt, Yersinia pestis KIM
aacaaucgauuccuguuga

SEQ ID NO: 2292560 - RNA, 14 nt, Yersinia pestis KIM
aacaauguuuaucc

SEQ ID NO: 2292561 - RNA, 15 nt, Yersinia pestis KIM
cgaagcccuguuuca

SEQ ID NO: 2292562 - RNA, 22 nt, Yersinia pestis KIM
cgaauagcaucagggguaaucu

SEQ ID NO: 2292563 - RNA, 16 nt, Yersinia pestis KIM
cgaauagcuggcugac

SEQ ID NO: 2292564 - RNA, 18 nt, Yersinia pestis KIM
cgaauauugcguuaccua

SEQ ID NO: 2292565 - RNA, 19 nt, Yersinia pestis KIM
cgaaucugguacuccugcu

SEQ ID NO: 2292566 - RNA, 20 nt, Yersinia pestis KIM
cgaaucugguacuccugcuc

SEQ ID NO: 2292567 - RNA, 21 nt, Yersinia pestis KIM
cgaaucugguacuccugcuca

SEQ ID NO: 2292568 - RNA, 22 nt, Yersinia pestis KIM
cgaauaaauauccuccggcaua

SEQ ID NO: 2292569 - RNA, 15 nt, Yersinia pestis KIM
cgaauaccauaacgc

SEQ ID NO: 2292570 - RNA, 20 nt, Yersinia pestis KIM
cgaauaccauaacgcugcuc

SEQ ID NO: 2292571 - RNA, 20 nt, Yersinia pestis KIM
cgaagcugauggcgaucaaa

SEQ ID NO: 2292572 - RNA, 14 nt, Yersinia pestis KIM
cgaacccuucagca

SEQ ID NO: 2292573 - RNA, 16 nt, Yersinia pestis KIM
cgaacaucuccugguu

SEQ ID NO: 2292574 - RNA, 19 nt, Yersinia pestis KIM
cgaaauauucgucucauca

SEQ ID NO: 2292575 - RNA, 21 nt, Yersinia pestis KIM
cgaaauauucgucucaucaau

SEQ ID NO: 2292576 - RNA, 23 nt, Yersinia pestis KIM
cgaaauaaauauccuccggcaua

SEQ ID NO: 2292577 - RNA, 14 nt, Yersinia pestis KIM
cgaacagugccaac

SEQ ID NO: 2292578 - RNA, 15 nt, Yersinia pestis KIM
ccuguuucgauccag

SEQ ID NO: 2292579 - RNA, 13 nt, Yersinia pestis KIM
ccuuacugcauca

SEQ ID NO: 2292580 - RNA, 19 nt, Yersinia pestis KIM
ccuuaacggucagauccac

SEQ ID NO: 2292581 - RNA, 21 nt, Yersinia pestis KIM
ccugucguuacugccgacagg

SEQ ID NO: 2292582 - RNA, 19 nt, Yersinia pestis KIM
ccuucagacugcugacaaa

SEQ ID NO: 2292583 - RNA, 17 nt, Yersinia pestis KIM
ccuucagacugacgcag

SEQ ID NO: 2292584 - RNA, 20 nt, Yersinia pestis KIM
ccuucagacugcugacaaac

SEQ ID NO: 2292585 - RNA, 20 nt, Yersinia pestis KIM
ccuucuccgcgcaaccuggc

SEQ ID NO: 2292586 - RNA, 22 nt, Yersinia pestis KIM
ccuugcuugcggaucagcgcua

SEQ ID NO: 2292587 - RNA, 20 nt, Yersinia pestis KIM
ccuuuaaacgcacaucaauc

SEQ ID NO: 2292588 - RNA, 22 nt, Yersinia pestis KIM
cgaaagccaagcaagcggcagc

SEQ ID NO: 2292589 - RNA, 15 nt, Yersinia pestis KIM
cgaaaggcuggagca

SEQ ID NO: 2292590 - RNA, 20 nt, Yersinia pestis KIM
cgaaaaaccaugagaauacu

SEQ ID NO: 2292591 - RNA, 16 nt, Yersinia pestis KIM
ccuuucgguugcauca

SEQ ID NO: 2292592 - RNA, 23 nt, Yersinia pestis KIM
ccuuucuggugguaccugcauca

SEQ ID NO: 2292593 - RNA, 20 nt, Yersinia pestis KIM
ccuuucgaguuuauauugcc

SEQ ID NO: 2292594 - RNA, 22 nt, Yersinia pestis KIM
ccuuuaauggcauacuccgcug

SEQ ID NO: 2292595 - RNA, 17 nt, Yersinia pestis KIM
ccuuuagcgcugcaucu

SEQ ID NO: 2292596 - RNA, 22 nt, Yersinia pestis KIM
gucgcugaaaugcuauggguaa

SEQ ID NO: 2292597 - RNA, 22 nt, Yersinia pestis KIM
gucgauaaacaucaugacaaaa

SEQ ID NO: 2292598 - RNA, 22 nt, Yersinia pestis KIM
gucgcccugaauuucaauaaca

SEQ ID NO: 2292599 - RNA, 14 nt, Yersinia pestis KIM
gucgcguuggcuaa

SEQ ID NO: 2292600 - RNA, 13 nt, Yersinia pestis KIM
gucaucaucuucu

SEQ ID NO: 2292601 - RNA, 20 nt, Yersinia pestis KIM
gucagauuagucuuagacgu

SEQ ID NO: 2292602 - RNA, 17 nt, Yersinia pestis KIM
gucacuguucuugaugg

SEQ ID NO: 2292603 - RNA, 13 nt, Yersinia pestis KIM
gucagaaccugca

SEQ ID NO: 2292604 - RNA, 16 nt, Yersinia pestis KIM
gucagaaacaucuuca

SEQ ID NO: 2292605 - RNA, 22 nt, Yersinia pestis KIM
gucacuaaaacugaagcaucaa

SEQ ID NO: 2292606 - RNA, 21 nt, Yersinia pestis KIM
gucacuaaaccauucagccac

SEQ ID NO: 2292607 - RNA, 19 nt, Yersinia pestis KIM
gucaauccaaucauucugu

SEQ ID NO: 2292608 - RNA, 19 nt, Yersinia pestis KIM
gucaauuaaaauugcuagc

SEQ ID NO: 2292609 - RNA, 16 nt, Yersinia pestis KIM
gucaacugugccaacc

SEQ ID NO: 2292610 - RNA, 16 nt, Yersinia pestis KIM
gucaccagauugccgu

SEQ ID NO: 2292611 - RNA, 13 nt, Yersinia pestis KIM
guaucagcggcgu

SEQ ID NO: 2292612 - RNA, 18 nt, Yersinia pestis KIM
guauuuaacauuagccgg

SEQ ID NO: 2292613 - RNA, 19 nt, Yersinia pestis KIM
guauuuaagcgggcuuuaa

SEQ ID NO: 2292614 - RNA, 18 nt, Yersinia pestis KIM
guauugcuuuuaagcuca

SEQ ID NO: 2292615 - RNA, 19 nt, Yersinia pestis KIM
guauugaccagauaggcuu

SEQ ID NO: 2292616 - RNA, 13 nt, Yersinia pestis KIM
guauugaagauac

SEQ ID NO: 2292617 - RNA, 12 nt, Yersinia pestis KIM
guauucccgcua

SEQ ID NO: 2292618 - RNA, 13 nt, Yersinia pestis KIM
guauucccgcuac

SEQ ID NO: 2292619 - RNA, 15 nt, Yersinia pestis KIM
guauucccgcuaccg

SEQ ID NO: 2292620 - RNA, 13 nt, Yersinia pestis KIM
guauuuacggcgu

SEQ ID NO: 2292621 - RNA, 18 nt, Yersinia pestis KIM
gucaaagaagcgcaggau

SEQ ID NO: 2292622 - RNA, 18 nt, Yersinia pestis KIM
guaaucagacugcugaca

SEQ ID NO: 2292623 - RNA, 19 nt, Yersinia pestis KIM
guaauccaccccggcguua

SEQ ID NO: 2292624 - RNA, 16 nt, Yersinia pestis KIM
guaauuuacugacggu

SEQ ID NO: 2292625 - RNA, 14 nt, Yersinia pestis KIM
guaaggcagcaagu

SEQ ID NO: 2292626 - RNA, 15 nt, Yersinia pestis KIM
guaaggcccgcagua

SEQ ID NO: 2292627 - RNA, 23 nt, Yersinia pestis KIM
guaauaauaauucauaugacaaa

SEQ ID NO: 2292628 - RNA, 19 nt, Yersinia pestis KIM
guaaauuagccacugguug

SEQ ID NO: 2292629 - RNA, 12 nt, Yersinia pestis KIM
guaaauccugau

SEQ ID NO: 2292630 - RNA, 13 nt, Yersinia pestis KIM
guaacugaucaau

SEQ ID NO: 2292631 - RNA, 20 nt, Yersinia pestis KIM
guaacuccaucaggcuacgg

SEQ ID NO: 2292632 - RNA, 15 nt, Yersinia pestis KIM
guaacuaagaguauc

SEQ ID NO: 2292633 - RNA, 21 nt, Yersinia pestis KIM
guaagcagagaauuucaagcu

SEQ ID NO: 2292634 - RNA, 17 nt, Yersinia pestis KIM
guaacuuacaggcugcc

SEQ ID NO: 2292635 - RNA, 14 nt, Yersinia pestis KIM
gguuuuaucaauag

SEQ ID NO: 2292636 - RNA, 20 nt, Yersinia pestis KIM
guaaauaaauaaucauuugu

SEQ ID NO: 2292637 - RNA, 12 nt, Yersinia pestis KIM
guaaaucgucag

SEQ ID NO: 2292638 - RNA, 16 nt, Yersinia pestis KIM
guaaaagucagcaaau

SEQ ID NO: 2292639 - RNA, 13 nt, Yersinia pestis KIM
guagugccgccag

SEQ ID NO: 2292640 - RNA, 18 nt, Yersinia pestis KIM
guaguaagcaugccaucc

SEQ ID NO: 2292641 - RNA, 16 nt, Yersinia pestis KIM
aaguaucuuaccgaca

SEQ ID NO: 2292642 - RNA, 19 nt, Yersinia pestis KIM
aaguauuaccaauaagcug

SEQ ID NO: 2292643 - RNA, 20 nt, Yersinia pestis KIM
ggucauauuuaucuuaucca

SEQ ID NO: 2292644 - RNA, 23 nt, Yersinia pestis KIM
gguaaugcuguuguagcgccagg

SEQ ID NO: 2292645 - RNA, 19 nt, Yersinia pestis KIM
gguaaccgauguauugccc

SEQ ID NO: 2292646 - RNA, 18 nt, Yersinia pestis KIM
gguagcagccacaugguu

SEQ ID NO: 2292647 - RNA, 11 nt, Yersinia pestis KIM
gguauccaucc

SEQ ID NO: 2292648 - RNA, 12 nt, Yersinia pestis KIM
ggucuaaugcaa

SEQ ID NO: 2292649 - RNA, 21 nt, Yersinia pestis KIM
ggugagaaacgugaauugcua

SEQ ID NO: 2292650 - RNA, 18 nt, Yersinia pestis KIM
ggugacauguuccagugc

SEQ ID NO: 2292651 - RNA, 16 nt, Yersinia pestis KIM
gggcagcgacaaccug

SEQ ID NO: 2292652 - RNA, 13 nt, Yersinia pestis KIM
gggccaucaagcc

SEQ ID NO: 2292653 - RNA, 22 nt, Yersinia pestis KIM
gggaugccuuguuucuggcaca

SEQ ID NO: 2292654 - RNA, 18 nt, Yersinia pestis KIM
gggcaaucaggaaaggcc

SEQ ID NO: 2292655 - RNA, 19 nt, Yersinia pestis KIM
gggcuucggucagguggug

SEQ ID NO: 2292656 - RNA, 22 nt, Yersinia pestis KIM
aaguaaauguuagcucaauuug

SEQ ID NO: 2292657 - RNA, 16 nt, Yersinia pestis KIM
aaguaaaagucagcaa

SEQ ID NO: 2292658 - RNA, 15 nt, Yersinia pestis KIM
ggccauucagcguau

SEQ ID NO: 2292659 - RNA, 11 nt, Yersinia pestis KIM
ggccauuaccc

SEQ ID NO: 2292660 - RNA, 22 nt, Yersinia pestis KIM
ggccauuacccucuaucgcuca

SEQ ID NO: 2292661 - RNA, 15 nt, Yersinia pestis KIM
ggccacucaccucag

SEQ ID NO: 2292662 - RNA, 17 nt, Yersinia pestis KIM
ggccacucgcaucgccu

SEQ ID NO: 2292663 - RNA, 20 nt, Yersinia pestis KIM
ggcauaucgagcaucugguc

SEQ ID NO: 2292664 - RNA, 20 nt, Yersinia pestis KIM
ggcaucaucugcgguaacca

SEQ ID NO: 2292665 - RNA, 15 nt, Yersinia pestis KIM
ggcaucccaccuuca

SEQ ID NO: 2292666 - RNA, 15 nt, Yersinia pestis KIM
ggcaaauuuagccgc

SEQ ID NO: 2292667 - RNA, 17 nt, Yersinia pestis KIM
ggcaacacccaacucaa

SEQ ID NO: 2292668 - RNA, 16 nt, Yersinia pestis KIM
ggaaucuucaauggug

SEQ ID NO: 2292669 - RNA, 19 nt, Yersinia pestis KIM
ggaacgaaguuagacccaa

SEQ ID NO: 2292670 - RNA, 14 nt, Yersinia pestis KIM
ggacgcaucagauc

SEQ ID NO: 2292671 - RNA, 21 nt, Yersinia pestis KIM
ggaguaaagcguccgcgccaa

SEQ ID NO: 2292672 - RNA, 21 nt, Yersinia pestis KIM
aaggccucggcgauugaacau

SEQ ID NO: 2292673 - RNA, 13 nt, Yersinia pestis KIM
ggauccaucugau

SEQ ID NO: 2292674 - RNA, 18 nt, Yersinia pestis KIM
ggaucacgcuguucaccg

SEQ ID NO: 2292675 - RNA, 14 nt, Yersinia pestis KIM
ggaucaccucuuca

SEQ ID NO: 2292676 - RNA, 21 nt, Yersinia pestis KIM
ggauauuucacguucaucaau

SEQ ID NO: 2292677 - RNA, 12 nt, Yersinia pestis KIM
aaggccaaugga

SEQ ID NO: 2292678 - RNA, 21 nt, Yersinia pestis KIM
aaggccaaccucuucguuguc

SEQ ID NO: 2292679 - RNA, 13 nt, Yersinia pestis KIM
aaggcacccaugc

SEQ ID NO: 2292680 - RNA, 16 nt, Yersinia pestis KIM
ggagaauguuaaaccc

SEQ ID NO: 2292681 - RNA, 21 nt, Yersinia pestis KIM
aaggcucuguuaccagccgcg

SEQ ID NO: 2292682 - RNA, 18 nt, Yersinia pestis KIM
aaggcuucggccagacgg

SEQ ID NO: 2292683 - RNA, 19 nt, Yersinia pestis KIM
ggcgacuuacgucgcuacg

SEQ ID NO: 2292684 - RNA, 20 nt, Yersinia pestis KIM
aaggcgcguuggcagagugg

SEQ ID NO: 2292685 - RNA, 21 nt, Yersinia pestis KIM
ggccuguaccaccaccaacag

SEQ ID NO: 2292686 - RNA, 20 nt, Yersinia pestis KIM
ggccuagcccaguaccgcug

SEQ ID NO: 2292687 - RNA, 14 nt, Yersinia pestis KIM
aagggguuucagac

SEQ ID NO: 2292688 - RNA, 17 nt, Yersinia pestis KIM
aagguaaaaggcccgcu

SEQ ID NO: 2292689 - RNA, 19 nt, Yersinia pestis KIM
aaggugcgccacuguucuu

SEQ ID NO: 2292690 - RNA, 15 nt, Yersinia pestis KIM
gcggacauggcaaca

SEQ ID NO: 2292691 - RNA, 18 nt, Yersinia pestis KIM
gcggacagcgcgcagcca

SEQ ID NO: 2292692 - RNA, 19 nt, Yersinia pestis KIM
gcggagcugacgucagauc

SEQ ID NO: 2292693 - RNA, 15 nt, Yersinia pestis KIM
aagccgucagcuuac

SEQ ID NO: 2292694 - RNA, 20 nt, Yersinia pestis KIM
gcggcaucuaugcuauccag

SEQ ID NO: 2292695 - RNA, 21 nt, Yersinia pestis KIM
gcgcucgccguuuuuacccgu

SEQ ID NO: 2292696 - RNA, 19 nt, Yersinia pestis KIM
gcgcugcgucuuuaucgcc

SEQ ID NO: 2292697 - RNA, 14 nt, Yersinia pestis KIM
gcggaauggcaacg

SEQ ID NO: 2292698 - RNA, 20 nt, Yersinia pestis KIM
gcgcuuuaaccaaagaacgg

SEQ ID NO: 2292699 - RNA, 19 nt, Yersinia pestis KIM
gcgcuugccacgccaguaa

SEQ ID NO: 2292700 - RNA, 20 nt, Yersinia pestis KIM
gcgggugaucgucaucagcg

SEQ ID NO: 2292701 - RNA, 21 nt, Yersinia pestis KIM
gcgguaugaaacaaccguguu

SEQ ID NO: 2292702 - RNA, 19 nt, Yersinia pestis KIM
gcgggcaguaacgccauaa

SEQ ID NO: 2292703 - RNA, 18 nt, Yersinia pestis KIM
gcgggaauucuuuggcaa

SEQ ID NO: 2292704 - RNA, 18 nt, Yersinia pestis KIM
gcgggaauugaaccugac

SEQ ID NO: 2292705 - RNA, 16 nt, Yersinia pestis KIM
gcgggcuaaaacuggc

SEQ ID NO: 2292706 - RNA, 20 nt, Yersinia pestis KIM
aagcucgccaucgcaccaaa

SEQ ID NO: 2292707 - RNA, 15 nt, Yersinia pestis KIM
aagcugcgcugaccu

SEQ ID NO: 2292708 - RNA, 12 nt, Yersinia pestis KIM
gcugaagccagc

SEQ ID NO: 2292709 - RNA, 18 nt, Yersinia pestis KIM
gcucgcucaacaugccag

SEQ ID NO: 2292710 - RNA, 18 nt, Yersinia pestis KIM
gcucacucgguaaugagc

SEQ ID NO: 2292711 - RNA, 21 nt, Yersinia pestis KIM
gcucacugauuuuuuaccuga

SEQ ID NO: 2292712 - RNA, 16 nt, Yersinia pestis KIM
gcucacucaccgccag

SEQ ID NO: 2292713 - RNA, 14 nt, Yersinia pestis KIM
gcucacgucaccac

SEQ ID NO: 2292714 - RNA, 14 nt, Yersinia pestis KIM
gcuggcaaggcacg

SEQ ID NO: 2292715 - RNA, 22 nt, Yersinia pestis KIM
gcugcuuuuaccgcagggcguu

SEQ ID NO: 2292716 - RNA, 18 nt, Yersinia pestis KIM
gcugcuuuaucguagcca

SEQ ID NO: 2292717 - RNA, 18 nt, Yersinia pestis KIM
gcuggacgcaucagaucg

SEQ ID NO: 2292718 - RNA, 17 nt, Yersinia pestis KIM
gcugauucacuggcaaa

SEQ ID NO: 2292719 - RNA, 18 nt, Yersinia pestis KIM
gcugauguucugccaacc

SEQ ID NO: 2292720 - RNA, 22 nt, Yersinia pestis KIM
gcugauuaauaucaaaacugau

SEQ ID NO: 2292721 - RNA, 16 nt, Yersinia pestis KIM
gcugacgucagaucgc

SEQ ID NO: 2292722 - RNA, 13 nt, Yersinia pestis KIM
gcugcaucagcag

SEQ ID NO: 2292723 - RNA, 20 nt, Yersinia pestis KIM
gcugccaguaaaaucaucag

SEQ ID NO: 2292724 - RNA, 14 nt, Yersinia pestis KIM
gcgucaaauuagca

SEQ ID NO: 2292725 - RNA, 15 nt, Yersinia pestis KIM
gcguauugaagucgg

SEQ ID NO: 2292726 - RNA, 16 nt, Yersinia pestis KIM
aagcuuaguauccgcg

SEQ ID NO: 2292727 - RNA, 16 nt, Yersinia pestis KIM
gcgucugagguggcac

SEQ ID NO: 2292728 - RNA, 22 nt, Yersinia pestis KIM
aaggaaaauacccaaagucauu

SEQ ID NO: 2292729 - RNA, 15 nt, Yersinia pestis KIM
gcguugcgcugacca

SEQ ID NO: 2292730 - RNA, 18 nt, Yersinia pestis KIM
gcuaacaacuaacgauug

SEQ ID NO: 2292731 - RNA, 19 nt, Yersinia pestis KIM
gcuaaaugcucgcuaauca

SEQ ID NO: 2292732 - RNA, 14 nt, Yersinia pestis KIM
gcuaaagcugcuuu

SEQ ID NO: 2292733 - RNA, 16 nt, Yersinia pestis KIM
gcguuuucaccgugac

SEQ ID NO: 2292734 - RNA, 15 nt, Yersinia pestis KIM
gcuaaccuauagcaa

SEQ ID NO: 2292735 - RNA, 18 nt, Yersinia pestis KIM
gcuaaccaccgucaccaa

SEQ ID NO: 2292736 - RNA, 14 nt, Yersinia pestis KIM
gcuaaccacagcaa

SEQ ID NO: 2292737 - RNA, 14 nt, Yersinia pestis KIM
gcuaauacggcuug

SEQ ID NO: 2292738 - RNA, 16 nt, Yersinia pestis KIM
gcguuguuuuucaauc

SEQ ID NO: 2292739 - RNA, 15 nt, Yersinia pestis KIM
gcuaccagcagugca

SEQ ID NO: 2292740 - RNA, 15 nt, Yersinia pestis KIM
gcuaccccaacauug

SEQ ID NO: 2292741 - RNA, 18 nt, Yersinia pestis KIM
gcuacccgcagcaugacg

SEQ ID NO: 2292742 - RNA, 21 nt, Yersinia pestis KIM
gcuacggauugcaaauccguc

SEQ ID NO: 2292743 - RNA, 20 nt, Yersinia pestis KIM
gcucaacugcucaacugcuc

SEQ ID NO: 2292744 - RNA, 18 nt, Yersinia pestis KIM
gcucaacugcucaacugc

SEQ ID NO: 2292745 - RNA, 14 nt, Yersinia pestis KIM
gcucaagcuggcca

SEQ ID NO: 2292746 - RNA, 18 nt, Yersinia pestis KIM
gcuaucaccggaugaaac

SEQ ID NO: 2292747 - RNA, 16 nt, Yersinia pestis KIM
gcuauccaccaucgga

SEQ ID NO: 2292748 - RNA, 13 nt, Yersinia pestis KIM
gcuauugacaaag

SEQ ID NO: 2292749 - RNA, 15 nt, Yersinia pestis KIM
gcuauugagcauauu

SEQ ID NO: 2292750 - RNA, 14 nt, Yersinia pestis KIM
gcucaaauacggua

SEQ ID NO: 2292751 - RNA, 18 nt, Yersinia pestis KIM
gcgcaguacucaccgccg

SEQ ID NO: 2292752 - RNA, 21 nt, Yersinia pestis KIM
gcgccaaaauuaugccagucu

SEQ ID NO: 2292753 - RNA, 17 nt, Yersinia pestis KIM
gcgccaaccgcuugcau

SEQ ID NO: 2292754 - RNA, 14 nt, Yersinia pestis KIM
gcgccaaucgccac

SEQ ID NO: 2292755 - RNA, 19 nt, Yersinia pestis KIM
gcgacuuacgucgcuacga

SEQ ID NO: 2292756 - RNA, 15 nt, Yersinia pestis KIM
gcgaccagcagaagu

SEQ ID NO: 2292757 - RNA, 22 nt, Yersinia pestis KIM
gcgcacguucccaggccaaggu

SEQ ID NO: 2292758 - RNA, 13 nt, Yersinia pestis KIM
gcgcaaccauccg

SEQ ID NO: 2292759 - RNA, 19 nt, Yersinia pestis KIM
gcgaucccagaauggcaaa

SEQ ID NO: 2292760 - RNA, 22 nt, Yersinia pestis KIM
gcgaugaggcucuucugggcug

SEQ ID NO: 2292761 - RNA, 14 nt, Yersinia pestis KIM
gcgaugacugagua

SEQ ID NO: 2292762 - RNA, 22 nt, Yersinia pestis KIM
gccgcuucgcugacauuuucua

SEQ ID NO: 2292763 - RNA, 19 nt, Yersinia pestis KIM
gccgcuuuagcgaugacca

SEQ ID NO: 2292764 - RNA, 15 nt, Yersinia pestis KIM
gccggaaucagccag

SEQ ID NO: 2292765 - RNA, 13 nt, Yersinia pestis KIM
gccggcaacagcg

SEQ ID NO: 2292766 - RNA, 18 nt, Yersinia pestis KIM
aagcauccaauaccacca

SEQ ID NO: 2292767 - RNA, 16 nt, Yersinia pestis KIM
gccgguauucagccaa

SEQ ID NO: 2292768 - RNA, 16 nt, Yersinia pestis KIM
gccggguuuugcauca

SEQ ID NO: 2292769 - RNA, 15 nt, Yersinia pestis KIM
gccgugcugcaacuc

SEQ ID NO: 2292770 - RNA, 15 nt, Yersinia pestis KIM
gccugagaacccaug

SEQ ID NO: 2292771 - RNA, 15 nt, Yersinia pestis KIM
aagccauuagcguug

SEQ ID NO: 2292772 - RNA, 22 nt, Yersinia pestis KIM
aagcccaguaaagcaaauuccc

SEQ ID NO: 2292773 - RNA, 17 nt, Yersinia pestis KIM
gcaccuuugucauugag

SEQ ID NO: 2292774 - RNA, 17 nt, Yersinia pestis KIM
gcacgggcuuuaaugag

SEQ ID NO: 2292775 - RNA, 19 nt, Yersinia pestis KIM
gcaccauccagcaaaucau

SEQ ID NO: 2292776 - RNA, 15 nt, Yersinia pestis KIM
gcaccccacaugcca

SEQ ID NO: 2292777 - RNA, 21 nt, Yersinia pestis KIM
gcacagagcgggaacgccaag

SEQ ID NO: 2292778 - RNA, 20 nt, Yersinia pestis KIM
gcagcaugacggagcuauca

SEQ ID NO: 2292779 - RNA, 17 nt, Yersinia pestis KIM
gcagaagaguaaagcgu

SEQ ID NO: 2292780 - RNA, 22 nt, Yersinia pestis KIM
gcagcagagaauguuggcguug

SEQ ID NO: 2292781 - RNA, 15 nt, Yersinia pestis KIM
gcaagccgcguucaa

SEQ ID NO: 2292782 - RNA, 14 nt, Yersinia pestis KIM
gcaagcaaacugau

SEQ ID NO: 2292783 - RNA, 22 nt, Yersinia pestis KIM
gcaacuucagccaccagauuac

SEQ ID NO: 2292784 - RNA, 20 nt, Yersinia pestis KIM
gcaauagcgaucacggguuu

SEQ ID NO: 2292785 - RNA, 19 nt, Yersinia pestis KIM
gcaauaaccaacgggcaca

SEQ ID NO: 2292786 - RNA, 18 nt, Yersinia pestis KIM
gcaauguguuugcgagcc

SEQ ID NO: 2292787 - RNA, 14 nt, Yersinia pestis KIM
gcacaacggaaggc

SEQ ID NO: 2292788 - RNA, 19 nt, Yersinia pestis KIM
gcacacccauacauaccag

SEQ ID NO: 2292789 - RNA, 16 nt, Yersinia pestis KIM
gcaaacauccguuccc

SEQ ID NO: 2292790 - RNA, 16 nt, Yersinia pestis KIM
gcaaaccccgaaccaa

SEQ ID NO: 2292791 - RNA, 24 nt, Yersinia pestis KIM
gcaacaacagauaaagcuugauca

SEQ ID NO: 2292792 - RNA, 21 nt, Yersinia pestis KIM
gcaaccaaucguugcugguua

SEQ ID NO: 2292793 - RNA, 16 nt, Yersinia pestis KIM
gcaaccacgguaucaa

SEQ ID NO: 2292794 - RNA, 14 nt, Yersinia pestis KIM
gauucgucugccau

SEQ ID NO: 2292795 - RNA, 16 nt, Yersinia pestis KIM
gauuacgcaucgucag

SEQ ID NO: 2292796 - RNA, 16 nt, Yersinia pestis KIM
gaucaguaaacgguug

SEQ ID NO: 2292797 - RNA, 14 nt, Yersinia pestis KIM
gaucagcaagauug

SEQ ID NO: 2292798 - RNA, 15 nt, Yersinia pestis KIM
gauccauaggaucuc

SEQ ID NO: 2292799 - RNA, 15 nt, Yersinia pestis KIM
gaucgcuucacggca

SEQ ID NO: 2292800 - RNA, 14 nt, Yersinia pestis KIM
gaguuaaacugggu

SEQ ID NO: 2292801 - RNA, 13 nt, Yersinia pestis KIM
gaguaguugucaa

SEQ ID NO: 2292802 - RNA, 16 nt, Yersinia pestis KIM
gagucagggagucagg

SEQ ID NO: 2292803 - RNA, 21 nt, Yersinia pestis KIM
gagguggccgagaggcugaag

SEQ ID NO: 2292804 - RNA, 17 nt, Yersinia pestis KIM
gauaucccaacugaaac

SEQ ID NO: 2292805 - RNA, 14 nt, Yersinia pestis KIM
gauagacagcaaac

SEQ ID NO: 2292806 - RNA, 21 nt, Yersinia pestis KIM
gauagaaaguugagcagcaau

SEQ ID NO: 2292807 - RNA, 13 nt, Yersinia pestis KIM
gauagccaauaac

SEQ ID NO: 2292808 - RNA, 13 nt, Yersinia pestis KIM
gauagccagugac

SEQ ID NO: 2292809 - RNA, 12 nt, Yersinia pestis KIM
gauaucugcuca

SEQ ID NO: 2292810 - RNA, 14 nt, Yersinia pestis KIM
gaucaacagugagg

SEQ ID NO: 2292811 - RNA, 20 nt, Yersinia pestis KIM
gaucaacaggccaccuaaca

SEQ ID NO: 2292812 - RNA, 22 nt, Yersinia pestis KIM
gaucaccgaugauaagugaaua

SEQ ID NO: 2292813 - RNA, 21 nt, Yersinia pestis KIM
gauaauagcuaaacauccguu

SEQ ID NO: 2292814 - RNA, 15 nt, Yersinia pestis KIM
gauaaugcugaugca

SEQ ID NO: 2292815 - RNA, 13 nt, Yersinia pestis KIM
gauaagccucggu

SEQ ID NO: 2292816 - RNA, 12 nt, Yersinia pestis KIM
gauaaacuguuu

SEQ ID NO: 2292817 - RNA, 19 nt, Yersinia pestis KIM
gauaaaccgcuauaucauc

SEQ ID NO: 2292818 - RNA, 16 nt, Yersinia pestis KIM
gauaaaaccacugacc

SEQ ID NO: 2292819 - RNA, 19 nt, Yersinia pestis KIM
gauaaauauuuaauaugua

SEQ ID NO: 2292820 - RNA, 16 nt, Yersinia pestis KIM
gauaacgugcgacuuu

SEQ ID NO: 2292821 - RNA, 12 nt, Yersinia pestis KIM
gaguuucaaguc

SEQ ID NO: 2292822 - RNA, 18 nt, Yersinia pestis KIM
gaguuggauauacauauu

SEQ ID NO: 2292823 - RNA, 22 nt, Yersinia pestis KIM
gagcauacuguuggcaauuuca

SEQ ID NO: 2292824 - RNA, 20 nt, Yersinia pestis KIM
gagcauaccaauaccggcga

SEQ ID NO: 2292825 - RNA, 20 nt, Yersinia pestis KIM
gagcagccaacacaccugca

SEQ ID NO: 2292826 - RNA, 16 nt, Yersinia pestis KIM
aacucgaacaaccggu

SEQ ID NO: 2292827 - RNA, 14 nt, Yersinia pestis KIM
gagcauauacagcc

SEQ ID NO: 2292828 - RNA, 21 nt, Yersinia pestis KIM
gagcaccaaaucuuccagcgg

SEQ ID NO: 2292829 - RNA, 19 nt, Yersinia pestis KIM
gagauuucagacugcugac

SEQ ID NO: 2292830 - RNA, 22 nt, Yersinia pestis KIM
gagcagcaauaauuacgcguuc

SEQ ID NO: 2292831 - RNA, 20 nt, Yersinia pestis KIM
gagaguaaggccaauuggcu

SEQ ID NO: 2292832 - RNA, 13 nt, Yersinia pestis KIM
gacgacagauuau

SEQ ID NO: 2292833 - RNA, 24 nt, Yersinia pestis KIM
gacguggauuuucaaaucaugcau

SEQ ID NO: 2292834 - RNA, 21 nt, Yersinia pestis KIM
gacuaauauuucaggcuguga

SEQ ID NO: 2292835 - RNA, 14 nt, Yersinia pestis KIM
gacuaaggcaaccu

SEQ ID NO: 2292836 - RNA, 19 nt, Yersinia pestis KIM
gacuaaccaagccaucggc

SEQ ID NO: 2292837 - RNA, 15 nt, Yersinia pestis KIM
gacuaaaaaccgcca

SEQ ID NO: 2292838 - RNA, 19 nt, Yersinia pestis KIM
aacguuuaucgcuaccgcg

SEQ ID NO: 2292839 - RNA, 22 nt, Yersinia pestis KIM
aacguguacuuucccugcuggc

SEQ ID NO: 2292840 - RNA, 16 nt, Yersinia pestis KIM
aacucaaacugauaaa

SEQ ID NO: 2292841 - RNA, 23 nt, Yersinia pestis KIM
gacuuggguaaccaaucacauca

SEQ ID NO: 2292842 - RNA, 17 nt, Yersinia pestis KIM
gacuggaaacugacaua

SEQ ID NO: 2292843 - RNA, 18 nt, Yersinia pestis KIM
gccgcagaugccagacuu

SEQ ID NO: 2292844 - RNA, 19 nt, Yersinia pestis KIM
gccgccagccccgcuacca

SEQ ID NO: 2292845 - RNA, 20 nt, Yersinia pestis KIM
gccgccagccccgcuaccaa

SEQ ID NO: 2292846 - RNA, 16 nt, Yersinia pestis KIM
gccgcccuuuagccag

SEQ ID NO: 2292847 - RNA, 20 nt, Yersinia pestis KIM
gccgcccccuuucuuaucga

SEQ ID NO: 2292848 - RNA, 23 nt, Yersinia pestis KIM
gccgaucauaaaucacaauuuca

SEQ ID NO: 2292849 - RNA, 20 nt, Yersinia pestis KIM
gccgauaguuggcaagacgg

SEQ ID NO: 2292850 - RNA, 20 nt, Yersinia pestis KIM
gccgaaagccaagcaagcgg

SEQ ID NO: 2292851 - RNA, 12 nt, Yersinia pestis KIM
aagaucucagca

SEQ ID NO: 2292852 - RNA, 18 nt, Yersinia pestis KIM
aagaucggccugccauuu

SEQ ID NO: 2292853 - RNA, 18 nt, Yersinia pestis KIM
gcccgucaauaucaucau

SEQ ID NO: 2292854 - RNA, 14 nt, Yersinia pestis KIM
gcccggcauggacg

SEQ ID NO: 2292855 - RNA, 16 nt, Yersinia pestis KIM
gcccaguggagccaug

SEQ ID NO: 2292856 - RNA, 21 nt, Yersinia pestis KIM
gccccgcaacgccgaugaagg

SEQ ID NO: 2292857 - RNA, 22 nt, Yersinia pestis KIM
aagagauugcguuauaucuaua

SEQ ID NO: 2292858 - RNA, 21 nt, Yersinia pestis KIM
aagagccugaaucugaauggc

SEQ ID NO: 2292859 - RNA, 15 nt, Yersinia pestis KIM
aagauaacccaaugc

SEQ ID NO: 2292860 - RNA, 21 nt, Yersinia pestis KIM
gcaucgcgaucugacauuugc

SEQ ID NO: 2292861 - RNA, 17 nt, Yersinia pestis KIM
gcaucuaugcuauccag

SEQ ID NO: 2292862 - RNA, 14 nt, Yersinia pestis KIM
gcaucucugcaucu

SEQ ID NO: 2292863 - RNA, 15 nt, Yersinia pestis KIM
gcagugcuucaucac

SEQ ID NO: 2292864 - RNA, 17 nt, Yersinia pestis KIM
gcauaagcgguuucaug

SEQ ID NO: 2292865 - RNA, 20 nt, Yersinia pestis KIM
gcauaacaacgacuccauca

SEQ ID NO: 2292866 - RNA, 21 nt, Yersinia pestis KIM
gcauaaaccggugacuggaaa

SEQ ID NO: 2292867 - RNA, 19 nt, Yersinia pestis KIM
gcaguuuuuuauggcauaa

SEQ ID NO: 2292868 - RNA, 18 nt, Yersinia pestis KIM
gcaguuugagaaacugau

SEQ ID NO: 2292869 - RNA, 19 nt, Yersinia pestis KIM
gcaucacgauagccaguga

SEQ ID NO: 2292870 - RNA, 13 nt, Yersinia pestis KIM
gcaucagcccauu

SEQ ID NO: 2292871 - RNA, 15 nt, Yersinia pestis KIM
gcaucagccagccac

SEQ ID NO: 2292872 - RNA, 14 nt, Yersinia pestis KIM
gcaucaccaaagau

SEQ ID NO: 2292873 - RNA, 13 nt, Yersinia pestis KIM
gcauauucaccag

SEQ ID NO: 2292874 - RNA, 12 nt, Yersinia pestis KIM
gcauauucauag

SEQ ID NO: 2292875 - RNA, 20 nt, Yersinia pestis KIM
gcauauacguuaguuauccu

SEQ ID NO: 2292876 - RNA, 12 nt, Yersinia pestis KIM
gcauaucagcaa

SEQ ID NO: 2292877 - RNA, 17 nt, Yersinia pestis KIM
gcauagcuaaccuuaac

SEQ ID NO: 2292878 - RNA, 14 nt, Yersinia pestis KIM
gcauaccuggauca

SEQ ID NO: 2292879 - RNA, 15 nt, Yersinia pestis KIM
gccaagccaguaauu

SEQ ID NO: 2292880 - RNA, 17 nt, Yersinia pestis KIM
gccacacauucagucac

SEQ ID NO: 2292881 - RNA, 21 nt, Yersinia pestis KIM
gccaauagacaaaagugacga

SEQ ID NO: 2292882 - RNA, 22 nt, Yersinia pestis KIM
gccaaauacauauaaccaucaa

SEQ ID NO: 2292883 - RNA, 16 nt, Yersinia pestis KIM
gcauuggcaaaucauc

SEQ ID NO: 2292884 - RNA, 19 nt, Yersinia pestis KIM
gccaaaaaauaagggccac

SEQ ID NO: 2292885 - RNA, 19 nt, Yersinia pestis KIM
gcauuuuagugaugauauu

SEQ ID NO: 2292886 - RNA, 21 nt, Yersinia pestis KIM
gcaucuugaaggauggcggau

SEQ ID NO: 2292887 - RNA, 22 nt, Yersinia pestis KIM
gcauuaucuaaacaauugccuu

SEQ ID NO: 2292888 - RNA, 20 nt, Yersinia pestis KIM
gcaugugggcagggcagcuu

SEQ ID NO: 2292889 - RNA, 17 nt, Yersinia pestis KIM
gcaugggcuugcauauc

SEQ ID NO: 2292890 - RNA, 18 nt, Yersinia pestis KIM
gccagcaauuggccuucc

SEQ ID NO: 2292891 - RNA, 19 nt, Yersinia pestis KIM
gccagauagcaucauccag

SEQ ID NO: 2292892 - RNA, 16 nt, Yersinia pestis KIM
gccagauagucaucuu

SEQ ID NO: 2292893 - RNA, 21 nt, Yersinia pestis KIM
gccacgccaguaaacagccag

SEQ ID NO: 2292894 - RNA, 16 nt, Yersinia pestis KIM
gccagaaucaaccacg

SEQ ID NO: 2292895 - RNA, 19 nt, Yersinia pestis KIM
gccaggugauaauggcauu

SEQ ID NO: 2292896 - RNA, 15 nt, Yersinia pestis KIM
gccaggcagcuauca

SEQ ID NO: 2292897 - RNA, 17 nt, Yersinia pestis KIM
gccauagcccaugauug

SEQ ID NO: 2292898 - RNA, 21 nt, Yersinia pestis KIM
gccauaauccagaagccauua

SEQ ID NO: 2292899 - RNA, 16 nt, Yersinia pestis KIM
gccaguuucgguacca

SEQ ID NO: 2292900 - RNA, 20 nt, Yersinia pestis KIM
gccaguugggaaucgguuuc

SEQ ID NO: 2292901 - RNA, 23 nt, Yersinia pestis KIM
gccaguugggauguucagcucaa

SEQ ID NO: 2292902 - RNA, 17 nt, Yersinia pestis KIM
gaagauucaaccaauua

SEQ ID NO: 2292903 - RNA, 12 nt, Yersinia pestis KIM
gaagcaaugaaa

SEQ ID NO: 2292904 - RNA, 24 nt, Yersinia pestis KIM
gaaucacuuuauuugccuacugaa

SEQ ID NO: 2292905 - RNA, 18 nt, Yersinia pestis KIM
gaaucaccgaaagaagac

SEQ ID NO: 2292906 - RNA, 23 nt, Yersinia pestis KIM
gaauccagcgcggcgaaacugac

SEQ ID NO: 2292907 - RNA, 13 nt, Yersinia pestis KIM
gaaagcuucaacu

SEQ ID NO: 2292908 - RNA, 12 nt, Yersinia pestis KIM
gaaccaagcaau

SEQ ID NO: 2292909 - RNA, 16 nt, Yersinia pestis KIM
aacgcaacgcacgauc

SEQ ID NO: 2292910 - RNA, 20 nt, Yersinia pestis KIM
aacgauuuucuuucaccacu

SEQ ID NO: 2292911 - RNA, 14 nt, Yersinia pestis KIM
gaccagauaaucgc

SEQ ID NO: 2292912 - RNA, 21 nt, Yersinia pestis KIM
gaccagauaaucgccaauaac

SEQ ID NO: 2292913 - RNA, 15 nt, Yersinia pestis KIM
aacgccgacuuuauu

SEQ ID NO: 2292914 - RNA, 19 nt, Yersinia pestis KIM
aacgccgaucauaaaucac

SEQ ID NO: 2292915 - RNA, 19 nt, Yersinia pestis KIM
aacgaacgcucuuuaacaa

SEQ ID NO: 2292916 - RNA, 19 nt, Yersinia pestis KIM
gacaggcaauuauccaucc

SEQ ID NO: 2292917 - RNA, 12 nt, Yersinia pestis KIM
aacgaagucagc

SEQ ID NO: 2292918 - RNA, 17 nt, Yersinia pestis KIM
gacagcgcgcagccaac

SEQ ID NO: 2292919 - RNA, 16 nt, Yersinia pestis KIM
gaauggcgcaauagca

SEQ ID NO: 2292920 - RNA, 18 nt, Yersinia pestis KIM
gaauuaacgcucuacaac

SEQ ID NO: 2292921 - RNA, 19 nt, Yersinia pestis KIM
gaauguuggugaucagcag

SEQ ID NO: 2292922 - RNA, 17 nt, Yersinia pestis KIM
gaccaacuggcaaucau

SEQ ID NO: 2292923 - RNA, 17 nt, Yersinia pestis KIM
aacgacuccaucaccgu

SEQ ID NO: 2292924 - RNA, 20 nt, Yersinia pestis KIM
gaccacaucaaccugaucau

SEQ ID NO: 2292925 - RNA, 14 nt, Yersinia pestis KIM
gaccacagauaaau

SEQ ID NO: 2292926 - RNA, 14 nt, Yersinia pestis KIM
aacgauaacggcgg

SEQ ID NO: 2292927 - RNA, 18 nt, Yersinia pestis KIM
gacauuuuacucccugac

SEQ ID NO: 2292928 - RNA, 23 nt, Yersinia pestis KIM
gacauuuccuuguggauccagca

SEQ ID NO: 2292929 - RNA, 16 nt, Yersinia pestis KIM
gacauggcaacagcau

SEQ ID NO: 2292930 - RNA, 12 nt, Yersinia pestis KIM
aacgcugaccau

SEQ ID NO: 2292931 - RNA, 16 nt, Yersinia pestis KIM
aacggguaacgaacgc

SEQ ID NO: 2292932 - RNA, 18 nt, Yersinia pestis KIM
aacggugaggauaggcug

SEQ ID NO: 2292933 - RNA, 22 nt, Yersinia pestis KIM
aacggcguugaucgguugccaa

SEQ ID NO: 2292934 - RNA, 18 nt, Yersinia pestis KIM
cuggucgauaagcacucc

SEQ ID NO: 2292935 - RNA, 19 nt, Yersinia pestis KIM
cugguaccaaucuccaaug

SEQ ID NO: 2292936 - RNA, 22 nt, Yersinia pestis KIM
cuguucaucaauagguguugcc

SEQ ID NO: 2292937 - RNA, 13 nt, Yersinia pestis KIM
cuguucuggcagg

SEQ ID NO: 2292938 - RNA, 21 nt, Yersinia pestis KIM
cuguacccccguaucaacgau

SEQ ID NO: 2292939 - RNA, 23 nt, Yersinia pestis KIM
cuguaagguugaccugcagcggu

SEQ ID NO: 2292940 - RNA, 17 nt, Yersinia pestis KIM
cuguaaugccuggugca

SEQ ID NO: 2292941 - RNA, 12 nt, Yersinia pestis KIM
cuguaaagccag

SEQ ID NO: 2292942 - RNA, 17 nt, Yersinia pestis KIM
cugguuuuaccaucacc

SEQ ID NO: 2292943 - RNA, 18 nt, Yersinia pestis KIM
cuuaccuugauccgccaa

SEQ ID NO: 2292944 - RNA, 14 nt, Yersinia pestis KIM
cuuaccccuuucaa

SEQ ID NO: 2292945 - RNA, 16 nt, Yersinia pestis KIM
cuuacauuucaucuug

SEQ ID NO: 2292946 - RNA, 15 nt, Yersinia pestis KIM
cuuaaugcgaacagc

SEQ ID NO: 2292947 - RNA, 13 nt, Yersinia pestis KIM
cuuaucagcgaaa

SEQ ID NO: 2292948 - RNA, 20 nt, Yersinia pestis KIM
cuucacccaccuuuugcgcg

SEQ ID NO: 2292949 - RNA, 13 nt, Yersinia pestis KIM
cuucgcgaucaug

SEQ ID NO: 2292950 - RNA, 19 nt, Yersinia pestis KIM
cuucgcgaucagguuguuc

SEQ ID NO: 2292951 - RNA, 16 nt, Yersinia pestis KIM
cuucgacuaaauggcu

SEQ ID NO: 2292952 - RNA, 14 nt, Yersinia pestis KIM
cuuccaugacacau

SEQ ID NO: 2292953 - RNA, 20 nt, Yersinia pestis KIM
cuucccauagacggcgaacu

SEQ ID NO: 2292954 - RNA, 15 nt, Yersinia pestis KIM
cuucagacugaaagu

SEQ ID NO: 2292955 - RNA, 13 nt, Yersinia pestis KIM
cuucagacaguaa

SEQ ID NO: 2292956 - RNA, 17 nt, Yersinia pestis KIM
cuucacucagcgcuggc

SEQ ID NO: 2292957 - RNA, 13 nt, Yersinia pestis KIM
cuuccgguuguuc

SEQ ID NO: 2292958 - RNA, 20 nt, Yersinia pestis KIM
cuuccgauaaccagaccgau

SEQ ID NO: 2292959 - RNA, 18 nt, Yersinia pestis KIM
cuucuucaaugaccggau

SEQ ID NO: 2292960 - RNA, 19 nt, Yersinia pestis KIM
cuugaaggacgacggguau

SEQ ID NO: 2292961 - RNA, 18 nt, Yersinia pestis KIM
cuucuccuuucuguucca

SEQ ID NO: 2292962 - RNA, 19 nt, Yersinia pestis KIM
cuucugaaacuucaaaauc

SEQ ID NO: 2292963 - RNA, 16 nt, Yersinia pestis KIM
cuugccugacagccug

SEQ ID NO: 2292964 - RNA, 16 nt, Yersinia pestis KIM
cuuguaagcaaacgau

SEQ ID NO: 2292965 - RNA, 17 nt, Yersinia pestis KIM
cuugagcuagauggaaa

SEQ ID NO: 2292966 - RNA, 21 nt, Yersinia pestis KIM
cuugauucguuuucggugcau

SEQ ID NO: 2292967 - RNA, 19 nt, Yersinia pestis KIM
cuugauggaaauacgcuua

SEQ ID NO: 2292968 - RNA, 23 nt, Yersinia pestis KIM
cuugcaacaacucgaacaaccgg

SEQ ID NO: 2292969 - RNA, 20 nt, Yersinia pestis KIM
cugcggauaaacacuguuua

SEQ ID NO: 2292970 - RNA, 19 nt, Yersinia pestis KIM
cugccugcaccagugccaa

SEQ ID NO: 2292971 - RNA, 22 nt, Yersinia pestis KIM
cugccguuucaguaaaaccagc

SEQ ID NO: 2292972 - RNA, 15 nt, Yersinia pestis KIM
cugccuuaucaaucu

SEQ ID NO: 2292973 - RNA, 17 nt, Yersinia pestis KIM
cugccgcaaacgcucag

SEQ ID NO: 2292974 - RNA, 13 nt, Yersinia pestis KIM
cugaaaugcuaug

SEQ ID NO: 2292975 - RNA, 12 nt, Yersinia pestis KIM
cugcuuuaucgu

SEQ ID NO: 2292976 - RNA, 23 nt, Yersinia pestis KIM
cugcuuuaggugguucaucaauc

SEQ ID NO: 2292977 - RNA, 18 nt, Yersinia pestis KIM
cugcuucuacccuggcgg

SEQ ID NO: 2292978 - RNA, 20 nt, Yersinia pestis KIM
cuggaaacugacauaagcua

SEQ ID NO: 2292979 - RNA, 15 nt, Yersinia pestis KIM
cugcuggcaggguau

SEQ ID NO: 2292980 - RNA, 11 nt, Yersinia pestis KIM
cugcuuaaucc

SEQ ID NO: 2292981 - RNA, 19 nt, Yersinia pestis KIM
cugcuguucuggcaggccg

SEQ ID NO: 2292982 - RNA, 17 nt, Yersinia pestis KIM
cugcuguggguucauca

SEQ ID NO: 2292983 - RNA, 11 nt, Yersinia pestis KIM
cugcugacaac

SEQ ID NO: 2292984 - RNA, 22 nt, Yersinia pestis KIM
aaccgcuauaucaucagcagag

SEQ ID NO: 2292985 - RNA, 15 nt, Yersinia pestis KIM
cugcucgagccaauu

SEQ ID NO: 2292986 - RNA, 16 nt, Yersinia pestis KIM
cugcgucuuuaucgcc

SEQ ID NO: 2292987 - RNA, 15 nt, Yersinia pestis KIM
cugcuacauaacgaa

SEQ ID NO: 2292988 - RNA, 19 nt, Yersinia pestis KIM
cugcuccgguaauccuugu

SEQ ID NO: 2292989 - RNA, 16 nt, Yersinia pestis KIM
cugcgguggccagagc

SEQ ID NO: 2292990 - RNA, 15 nt, Yersinia pestis KIM
cggugaauacguuca

SEQ ID NO: 2292991 - RNA, 21 nt, Yersinia pestis KIM
cgguguuccacaauguugaua

SEQ ID NO: 2292992 - RNA, 18 nt, Yersinia pestis KIM
cgguuguccuucaauggc

SEQ ID NO: 2292993 - RNA, 13 nt, Yersinia pestis KIM
cguaaacauuggc

SEQ ID NO: 2292994 - RNA, 19 nt, Yersinia pestis KIM
cguaaauaaaagcgccggu

SEQ ID NO: 2292995 - RNA, 16 nt, Yersinia pestis KIM
cgguucccaugacgau

SEQ ID NO: 2292996 - RNA, 22 nt, Yersinia pestis KIM
cgguuaauucaugugagauaac

SEQ ID NO: 2292997 - RNA, 21 nt, Yersinia pestis KIM
cgucuccggggauaaccgccg

SEQ ID NO: 2292998 - RNA, 19 nt, Yersinia pestis KIM
cgucauaccauucucuguc

SEQ ID NO: 2292999 - RNA, 15 nt, Yersinia pestis KIM
cgucccuaaagccau

SEQ ID NO: 2293000 - RNA, 12 nt, Yersinia pestis KIM
cguauucacugu

SEQ ID NO: 2293001 - RNA, 20 nt, Yersinia pestis KIM
cgucaaacgggugcgccaau

SEQ ID NO: 2293002 - RNA, 21 nt, Yersinia pestis KIM
cguggaguagagcuuccagug

SEQ ID NO: 2293003 - RNA, 20 nt, Yersinia pestis KIM
aaccgcagcagacaacugac

SEQ ID NO: 2293004 - RNA, 22 nt, Yersinia pestis KIM
cguggcacaccgcuacaggcgc

SEQ ID NO: 2293005 - RNA, 21 nt, Yersinia pestis KIM
cgugggcgcagaagaauaucu

SEQ ID NO: 2293006 - RNA, 17 nt, Yersinia pestis KIM
cguuacucggcccaucc

SEQ ID NO: 2293007 - RNA, 13 nt, Yersinia pestis KIM
cguuacugcaucu

SEQ ID NO: 2293008 - RNA, 14 nt, Yersinia pestis KIM
cguucaucaauacc

SEQ ID NO: 2293009 - RNA, 17 nt, Yersinia pestis KIM
cguguggagaacucauu

SEQ ID NO: 2293010 - RNA, 23 nt, Yersinia pestis KIM
cguucguuuacugccuuguugcc

SEQ ID NO: 2293011 - RNA, 15 nt, Yersinia pestis KIM
cguucuacugcgucc

SEQ ID NO: 2293012 - RNA, 17 nt, Yersinia pestis KIM
cguuguucacccacuug

SEQ ID NO: 2293013 - RNA, 16 nt, Yersinia pestis KIM
cguuuccagaaucaau

SEQ ID NO: 2293014 - RNA, 17 nt, Yersinia pestis KIM
cguuuacgauaagccgc

SEQ ID NO: 2293015 - RNA, 21 nt, Yersinia pestis KIM
cguuuucggugcauguaacug

SEQ ID NO: 2293016 - RNA, 18 nt, Yersinia pestis KIM
cguuuuaucgcauuacuc

SEQ ID NO: 2293017 - RNA, 12 nt, Yersinia pestis KIM
cuaaaacuggca

SEQ ID NO: 2293018 - RNA, 17 nt, Yersinia pestis KIM
cuaacaugccagccugu

SEQ ID NO: 2293019 - RNA, 22 nt, Yersinia pestis KIM
cuaaccgaagauaaccggcugg

SEQ ID NO: 2293020 - RNA, 13 nt, Yersinia pestis KIM
cuaaaaugacgau

SEQ ID NO: 2293021 - RNA, 13 nt, Yersinia pestis KIM
cuacgcuuucagg

SEQ ID NO: 2293022 - RNA, 18 nt, Yersinia pestis KIM
cuaccuguaacauuacuu

SEQ ID NO: 2293023 - RNA, 13 nt, Yersinia pestis KIM
cuacaaagucuga

SEQ ID NO: 2293024 - RNA, 19 nt, Yersinia pestis KIM
cuacagcaaacaucgguaa

SEQ ID NO: 2293025 - RNA, 13 nt, Yersinia pestis KIM
cuaccaggaagcg

SEQ ID NO: 2293026 - RNA, 15 nt, Yersinia pestis KIM
cuaccaggaagcggc

SEQ ID NO: 2293027 - RNA, 21 nt, Yersinia pestis KIM
cuaaguuaacaccaucaacau

SEQ ID NO: 2293028 - RNA, 14 nt, Yersinia pestis KIM
cuaauaaaauggcu

SEQ ID NO: 2293029 - RNA, 16 nt, Yersinia pestis KIM
cuaagaaucggccagu

SEQ ID NO: 2293030 - RNA, 22 nt, Yersinia pestis KIM
cuaauuccgccaguggcuuugc

SEQ ID NO: 2293031 - RNA, 15 nt, Yersinia pestis KIM
cuaauacggcuugca

SEQ ID NO: 2293032 - RNA, 15 nt, Yersinia pestis KIM
cuaaucaugcgggau

SEQ ID NO: 2293033 - RNA, 22 nt, Yersinia pestis KIM
cuaaucgguaugaccagugaau

SEQ ID NO: 2293034 - RNA, 16 nt, Yersinia pestis KIM
cuaaugacagacgcgg

SEQ ID NO: 2293035 - RNA, 21 nt, Yersinia pestis KIM
cuaaugccgcgcccccagcca

SEQ ID NO: 2293036 - RNA, 13 nt, Yersinia pestis KIM
cucuuccuguuca

SEQ ID NO: 2293037 - RNA, 15 nt, Yersinia pestis KIM
cucugagccauccag

SEQ ID NO: 2293038 - RNA, 23 nt, Yersinia pestis KIM
cucugacaaaaugccagaaugcg

SEQ ID NO: 2293039 - RNA, 15 nt, Yersinia pestis KIM
cucgguuguucagca

SEQ ID NO: 2293040 - RNA, 14 nt, Yersinia pestis KIM
cucgucacacuggu

SEQ ID NO: 2293041 - RNA, 18 nt, Yersinia pestis KIM
cucgaacgcuuguggaaa

SEQ ID NO: 2293042 - RNA, 18 nt, Yersinia pestis KIM
cuccugccuacgcuggcg

SEQ ID NO: 2293043 - RNA, 22 nt, Yersinia pestis KIM
cuccgccgauagcauuuuguca

SEQ ID NO: 2293044 - RNA, 19 nt, Yersinia pestis KIM
cucgaucagcgucagcaga

SEQ ID NO: 2293045 - RNA, 17 nt, Yersinia pestis KIM
cucagucaucgcuaacc

SEQ ID NO: 2293046 - RNA, 12 nt, Yersinia pestis KIM
cucaugacaaaa

SEQ ID NO: 2293047 - RNA, 20 nt, Yersinia pestis KIM
cucauccguuuuaacgcugc

SEQ ID NO: 2293048 - RNA, 20 nt, Yersinia pestis KIM
cucaucggcguuacaguaag

SEQ ID NO: 2293049 - RNA, 23 nt, Yersinia pestis KIM
cucaucuggcguucuacugcguc

SEQ ID NO: 2293050 - RNA, 20 nt, Yersinia pestis KIM
uuuuucgaguaguuuggcua

SEQ ID NO: 2293051 - RNA, 16 nt, Yersinia pestis KIM
uuuuuaacgucagaua

SEQ ID NO: 2293052 - RNA, 19 nt, Yersinia pestis KIM
uuugcgcccgcgccagaug

SEQ ID NO: 2293053 - RNA, 20 nt, Yersinia pestis KIM
uuuggccaccgcgucgccgc

SEQ ID NO: 2293054 - RNA, 13 nt, Yersinia pestis KIM
uuuggccgggagu

SEQ ID NO: 2293055 - RNA, 12 nt, Yersinia pestis KIM
uuugcuauucag

SEQ ID NO: 2293056 - RNA, 13 nt, Yersinia pestis KIM
uuugcugauucag

SEQ ID NO: 2293057 - RNA, 20 nt, Yersinia pestis KIM
uuugacauacucuuccaacg

SEQ ID NO: 2293058 - RNA, 20 nt, Yersinia pestis KIM
uuugaguaagacaacuuauu

SEQ ID NO: 2293059 - RNA, 13 nt, Yersinia pestis KIM
uuucuuuugguga

SEQ ID NO: 2293060 - RNA, 22 nt, Yersinia pestis KIM
uuugaauaaaagagauguuauu

SEQ ID NO: 2293061 - RNA, 22 nt, Yersinia pestis KIM
uuucccuuagggcaauggcguu

SEQ ID NO: 2293062 - RNA, 13 nt, Yersinia pestis KIM
uuucuaccgcuuc

SEQ ID NO: 2293063 - RNA, 19 nt, Yersinia pestis KIM
uuucucgacauccaauuca

SEQ ID NO: 2293064 - RNA, 22 nt, Yersinia pestis KIM
uuucuggcguuuugcaucaacg

SEQ ID NO: 2293065 - RNA, 19 nt, Yersinia pestis KIM
uuucuggugagcaucaaca

SEQ ID NO: 2293066 - RNA, 19 nt, Yersinia pestis KIM
uuguuaaaacaguuugcgg

SEQ ID NO: 2293067 - RNA, 21 nt, Yersinia pestis KIM
uuguucauccuguaccgcgcu

SEQ ID NO: 2293068 - RNA, 12 nt, Yersinia pestis KIM
uuguugccggua

SEQ ID NO: 2293069 - RNA, 23 nt, Yersinia pestis KIM
uuguugucagauaucugcucauu

SEQ ID NO: 2293070 - RNA, 18 nt, Yersinia pestis KIM
uuuaaucucuccaugaua

SEQ ID NO: 2293071 - RNA, 20 nt, Yersinia pestis KIM
uuuacaagccaacauugaua

SEQ ID NO: 2293072 - RNA, 12 nt, Yersinia pestis KIM
uuuaauucaggc

SEQ ID NO: 2293073 - RNA, 14 nt, Yersinia pestis KIM
uuuauccaaucuug

SEQ ID NO: 2293074 - RNA, 13 nt, Yersinia pestis KIM
uuuaucgauaacc

SEQ ID NO: 2293075 - RNA, 17 nt, Yersinia pestis KIM
uuuauauugccaucuug

SEQ ID NO: 2293076 - RNA, 14 nt, Yersinia pestis KIM
uuuauauugauacg

SEQ ID NO: 2293077 - RNA, 21 nt, Yersinia pestis KIM
uuuagccgcuucgcugacauu

SEQ ID NO: 2293078 - RNA, 15 nt, Yersinia pestis KIM
uuuacugcauugaga

SEQ ID NO: 2293079 - RNA, 20 nt, Yersinia pestis KIM
uugggauucaggcugcgguu

SEQ ID NO: 2293080 - RNA, 21 nt, Yersinia pestis KIM
uuggcuagaaaucacacuggc

SEQ ID NO: 2293081 - RNA, 23 nt, Yersinia pestis KIM
uuguaccagggcaccuaauucac

SEQ ID NO: 2293082 - RNA, 13 nt, Yersinia pestis KIM
uuguaauguuucu

SEQ ID NO: 2293083 - RNA, 20 nt, Yersinia pestis KIM
uugaacaacgcuaugcagcc

SEQ ID NO: 2293084 - RNA, 19 nt, Yersinia pestis KIM
uuggcuaaugcgagugcca

SEQ ID NO: 2293085 - RNA, 14 nt, Yersinia pestis KIM
uucuuuaugacaag

SEQ ID NO: 2293086 - RNA, 16 nt, Yersinia pestis KIM
uucuuucacucggaaa

SEQ ID NO: 2293087 - RNA, 13 nt, Yersinia pestis KIM
uucuuucaggcug

SEQ ID NO: 2293088 - RNA, 16 nt, Yersinia pestis KIM
uugaaaucagaucaac

SEQ ID NO: 2293089 - RNA, 13 nt, Yersinia pestis KIM
uuauacggcuauu

SEQ ID NO: 2293090 - RNA, 16 nt, Yersinia pestis KIM
uuauagaacggcagug

SEQ ID NO: 2293091 - RNA, 20 nt, Yersinia pestis KIM
uuaucauugcuccuguauau

SEQ ID NO: 2293092 - RNA, 17 nt, Yersinia pestis KIM
uuauaaauuacucguau

SEQ ID NO: 2293093 - RNA, 21 nt, Yersinia pestis KIM
uuaccuauaaacuugauucac

SEQ ID NO: 2293094 - RNA, 22 nt, Yersinia pestis KIM
uuaccucgccguuauuggccga

SEQ ID NO: 2293095 - RNA, 17 nt, Yersinia pestis KIM
uuaauuuggcuauugag

SEQ ID NO: 2293096 - RNA, 15 nt, Yersinia pestis KIM
uuaauuugcuuuaaa

SEQ ID NO: 2293097 - RNA, 12 nt, Yersinia pestis KIM
uuaauuaaucag

SEQ ID NO: 2293098 - RNA, 22 nt, Yersinia pestis KIM
uuacgaucgauaguaacaccag

SEQ ID NO: 2293099 - RNA, 23 nt, Yersinia pestis KIM
uuacuacaaacgcguuaauuaag

SEQ ID NO: 2293100 - RNA, 17 nt, Yersinia pestis KIM
uuaauuaagauuaagcc

SEQ ID NO: 2293101 - RNA, 19 nt, Yersinia pestis KIM
uuaauacaggcugacauuu

SEQ ID NO: 2293102 - RNA, 16 nt, Yersinia pestis KIM
uuaaguugaugcagug

SEQ ID NO: 2293103 - RNA, 16 nt, Yersinia pestis KIM
uuaaguaauaacucag

SEQ ID NO: 2293104 - RNA, 22 nt, Yersinia pestis KIM
uuaaggaaaaguagccaauaga

SEQ ID NO: 2293105 - RNA, 11 nt, Yersinia pestis KIM
uuaaauaccag

SEQ ID NO: 2293106 - RNA, 15 nt, Yersinia pestis KIM
uuaaauacagaucau

SEQ ID NO: 2293107 - RNA, 22 nt, Yersinia pestis KIM
uuaaauaagaaguagaaugaga

SEQ ID NO: 2293108 - RNA, 16 nt, Yersinia pestis KIM
uuaaagaaugcaacca

SEQ ID NO: 2293109 - RNA, 18 nt, Yersinia pestis KIM
ugugcuccgggcaagcgg

SEQ ID NO: 2293110 - RNA, 15 nt, Yersinia pestis KIM
uguuguaagauuuca

SEQ ID NO: 2293111 - RNA, 17 nt, Yersinia pestis KIM
uucauccuaaagauaau

SEQ ID NO: 2293112 - RNA, 14 nt, Yersinia pestis KIM
uucaggccgauacg

SEQ ID NO: 2293113 - RNA, 13 nt, Yersinia pestis KIM
uucccagccacuc

SEQ ID NO: 2293114 - RNA, 13 nt, Yersinia pestis KIM
uucauuagucaau

SEQ ID NO: 2293115 - RNA, 15 nt, Yersinia pestis KIM
uuccaaaacucaugu

SEQ ID NO: 2293116 - RNA, 15 nt, Yersinia pestis KIM
uucagcacggugugu

SEQ ID NO: 2293117 - RNA, 14 nt, Yersinia pestis KIM
uucagccaggcgau

SEQ ID NO: 2293118 - RNA, 22 nt, Yersinia pestis KIM
uucaccguuuccagaaucaaug

SEQ ID NO: 2293119 - RNA, 23 nt, Yersinia pestis KIM
uucaccuugcgcaauuuguuggc

SEQ ID NO: 2293120 - RNA, 23 nt, Yersinia pestis KIM
uucacgauggaaaaaauacaggu

SEQ ID NO: 2293121 - RNA, 17 nt, Yersinia pestis KIM
uucacgccaugccgguu

SEQ ID NO: 2293122 - RNA, 18 nt, Yersinia pestis KIM
uucaaugagcauaccggu

SEQ ID NO: 2293123 - RNA, 21 nt, Yersinia pestis KIM
uucaauugcccccuagugaug

SEQ ID NO: 2293124 - RNA, 14 nt, Yersinia pestis KIM
uucaccgcuggcaa

SEQ ID NO: 2293125 - RNA, 15 nt, Yersinia pestis KIM
uucaccgauucgaug

SEQ ID NO: 2293126 - RNA, 12 nt, Yersinia pestis KIM
uucaauaccaua

SEQ ID NO: 2293127 - RNA, 17 nt, Yersinia pestis KIM
uucaaucggauaaccgc

SEQ ID NO: 2293128 - RNA, 20 nt, Yersinia pestis KIM
uucaagagcgauagaucgau

SEQ ID NO: 2293129 - RNA, 19 nt, Yersinia pestis KIM
uucaagccgauaaucccug

SEQ ID NO: 2293130 - RNA, 16 nt, Yersinia pestis KIM
uuauuugaauaagaca

SEQ ID NO: 2293131 - RNA, 18 nt, Yersinia pestis KIM
uuauuugccuacugaaga

SEQ ID NO: 2293132 - RNA, 21 nt, Yersinia pestis KIM
uucaaaaucugauacugaacg

SEQ ID NO: 2293133 - RNA, 21 nt, Yersinia pestis KIM
uucaaauaaguguuucaaaua

SEQ ID NO: 2293134 - RNA, 12 nt, Yersinia pestis KIM
uucaaauacggc

SEQ ID NO: 2293135 - RNA, 22 nt, Yersinia pestis KIM
uucaaauagcugguuaauccgc

SEQ ID NO: 2293136 - RNA, 13 nt, Yersinia pestis KIM
uuaucgccagcug

SEQ ID NO: 2293137 - RNA, 16 nt, Yersinia pestis KIM
uuaucguuucuguuuu

SEQ ID NO: 2293138 - RNA, 15 nt, Yersinia pestis KIM
uuauucagcuucagc

SEQ ID NO: 2293139 - RNA, 20 nt, Yersinia pestis KIM
uuaucgguuguccuucaaug

SEQ ID NO: 2293140 - RNA, 14 nt, Yersinia pestis KIM
uuauuguaagucag

SEQ ID NO: 2293141 - RNA, 20 nt, Yersinia pestis KIM
uuauugcagugcguaaucag

SEQ ID NO: 2293142 - RNA, 20 nt, Yersinia pestis KIM
uucucuggcacgcuuucugc

SEQ ID NO: 2293143 - RNA, 15 nt, Yersinia pestis KIM
uucucggcaugcuuc

SEQ ID NO: 2293144 - RNA, 15 nt, Yersinia pestis KIM
uucuaucaaugccuu

SEQ ID NO: 2293145 - RNA, 13 nt, Yersinia pestis KIM
uucugucaucaag

SEQ ID NO: 2293146 - RNA, 21 nt, Yersinia pestis KIM
uucugugcuugaguccaacca

SEQ ID NO: 2293147 - RNA, 14 nt, Yersinia pestis KIM
uucuguuuugugcg

SEQ ID NO: 2293148 - RNA, 15 nt, Yersinia pestis KIM
uucuguucagcauaa

SEQ ID NO: 2293149 - RNA, 14 nt, Yersinia pestis KIM
uucgugcucaucaa

SEQ ID NO: 2293150 - RNA, 17 nt, Yersinia pestis KIM
uucgguuguuauggcuu

SEQ ID NO: 2293151 - RNA, 17 nt, Yersinia pestis KIM
uucuaacacuucaugac

SEQ ID NO: 2293152 - RNA, 16 nt, Yersinia pestis KIM
uucguuuacuugaugg

SEQ ID NO: 2293153 - RNA, 19 nt, Yersinia pestis KIM
uucgcugaaaucaggcugu

SEQ ID NO: 2293154 - RNA, 16 nt, Yersinia pestis KIM
uucccuaccguaucaa

SEQ ID NO: 2293155 - RNA, 19 nt, Yersinia pestis KIM
uuccugaauggcaucaccg

SEQ ID NO: 2293156 - RNA, 20 nt, Yersinia pestis KIM
uuccugcgccacgcuuuagc

SEQ ID NO: 2293157 - RNA, 15 nt, Yersinia pestis KIM
uggcgccucucuggc

SEQ ID NO: 2293158 - RNA, 18 nt, Yersinia pestis KIM
ugcuuuucuuucccgccg

SEQ ID NO: 2293159 - RNA, 15 nt, Yersinia pestis KIM
uggccggauaaugag

SEQ ID NO: 2293160 - RNA, 19 nt, Yersinia pestis KIM
uggcgggcgcuucgucauu

SEQ ID NO: 2293161 - RNA, 22 nt, Yersinia pestis KIM
uggcuaccccaacauugguuac

SEQ ID NO: 2293162 - RNA, 23 nt, Yersinia pestis KIM
ugggaucccuucggcaugcaacu

SEQ ID NO: 2293163 - RNA, 14 nt, Yersinia pestis KIM
ugggauguucagcu

SEQ ID NO: 2293164 - RNA, 12 nt, Yersinia pestis KIM
uggcuuuacggc

SEQ ID NO: 2293165 - RNA, 13 nt, Yersinia pestis KIM
uggcuuucaggau

SEQ ID NO: 2293166 - RNA, 22 nt, Yersinia pestis KIM
ugggcaaagaauugagguaaac

SEQ ID NO: 2293167 - RNA, 19 nt, Yersinia pestis KIM
ugggucauguggaacggca

SEQ ID NO: 2293168 - RNA, 14 nt, Yersinia pestis KIM
uggguaucguggua

SEQ ID NO: 2293169 - RNA, 17 nt, Yersinia pestis KIM
uggguauggucagcaau

SEQ ID NO: 2293170 - RNA, 11 nt, Yersinia pestis KIM
uggugcaaccg

SEQ ID NO: 2293171 - RNA, 22 nt, Yersinia pestis KIM
uggugaagaaaccuaaugccag

SEQ ID NO: 2293172 - RNA, 16 nt, Yersinia pestis KIM
uggugaaccagauaac

SEQ ID NO: 2293173 - RNA, 17 nt, Yersinia pestis KIM
ugguuaucacagcaaau

SEQ ID NO: 2293174 - RNA, 20 nt, Yersinia pestis KIM
uggucccuaacgcaauacgg

SEQ ID NO: 2293175 - RNA, 15 nt, Yersinia pestis KIM
ugguccagaucggca

SEQ ID NO: 2293176 - RNA, 15 nt, Yersinia pestis KIM
uggucauaaaaucga

SEQ ID NO: 2293177 - RNA, 22 nt, Yersinia pestis KIM
uggucauuaauuucaccacauc

SEQ ID NO: 2293178 - RNA, 23 nt, Yersinia pestis KIM
uggucagcaauaaccaacgggca

SEQ ID NO: 2293179 - RNA, 20 nt, Yersinia pestis KIM
uggucaacagugaacgggcg

SEQ ID NO: 2293180 - RNA, 18 nt, Yersinia pestis KIM
ugucguuucugcuuaacu

SEQ ID NO: 2293181 - RNA, 17 nt, Yersinia pestis KIM
ugucugggauacgcgcg

SEQ ID NO: 2293182 - RNA, 16 nt, Yersinia pestis KIM
ugucacaaucucuggc

SEQ ID NO: 2293183 - RNA, 20 nt, Yersinia pestis KIM
ugucaaugagugauauccgc

SEQ ID NO: 2293184 - RNA, 16 nt, Yersinia pestis KIM
uguaaggcaauaccaa

SEQ ID NO: 2293185 - RNA, 16 nt, Yersinia pestis KIM
uguaggcgaauuggca

SEQ ID NO: 2293186 - RNA, 17 nt, Yersinia pestis KIM
uguaucauauguucgau

SEQ ID NO: 2293187 - RNA, 21 nt, Yersinia pestis KIM
ugucaacaaccucuaaugcac

SEQ ID NO: 2293188 - RNA, 21 nt, Yersinia pestis KIM
ugucaauaaccucacgcagcg

SEQ ID NO: 2293189 - RNA, 14 nt, Yersinia pestis KIM
uagcguuuggcugc

SEQ ID NO: 2293190 - RNA, 20 nt, Yersinia pestis KIM
uagcuacagcaccauuaucu

SEQ ID NO: 2293191 - RNA, 17 nt, Yersinia pestis KIM
uagcucaauuugguauu

SEQ ID NO: 2293192 - RNA, 17 nt, Yersinia pestis KIM
uagcuaacaccgcugua

SEQ ID NO: 2293193 - RNA, 17 nt, Yersinia pestis KIM
uagcgcugcagcaucaa

SEQ ID NO: 2293194 - RNA, 17 nt, Yersinia pestis KIM
uagaagcucauaugcag

SEQ ID NO: 2293195 - RNA, 19 nt, Yersinia pestis KIM
uagaugauugaaaaucagu

SEQ ID NO: 2293196 - RNA, 15 nt, Yersinia pestis KIM
uagauggaaaucaca

SEQ ID NO: 2293197 - RNA, 13 nt, Yersinia pestis KIM
uagaucagccaaa

SEQ ID NO: 2293198 - RNA, 13 nt, Yersinia pestis KIM
uagggagccaaua

SEQ ID NO: 2293199 - RNA, 18 nt, Yersinia pestis KIM
uagggccguuuaccuugu

SEQ ID NO: 2293200 - RNA, 20 nt, Yersinia pestis KIM
uaggcgcugucggcgcagca

SEQ ID NO: 2293201 - RNA, 15 nt, Yersinia pestis KIM
uagcucgcuacgccu

SEQ ID NO: 2293202 - RNA, 21 nt, Yersinia pestis KIM
uaggcaaccuuggugaagauc

SEQ ID NO: 2293203 - RNA, 14 nt, Yersinia pestis KIM
uaggccacuagcca

SEQ ID NO: 2293204 - RNA, 13 nt, Yersinia pestis KIM
uacucggcauugc

SEQ ID NO: 2293205 - RNA, 18 nt, Yersinia pestis KIM
uacuuaacaaucagugca

SEQ ID NO: 2293206 - RNA, 17 nt, Yersinia pestis KIM
uacuguuuauuaaugga

SEQ ID NO: 2293207 - RNA, 17 nt, Yersinia pestis KIM
uacuguuuggucgccau

SEQ ID NO: 2293208 - RNA, 16 nt, Yersinia pestis KIM
uagaaaagcgccauca

SEQ ID NO: 2293209 - RNA, 13 nt, Yersinia pestis KIM
uagaaacaucaga

SEQ ID NO: 2293210 - RNA, 20 nt, Yersinia pestis KIM
uagaauaaguugaugcagua

SEQ ID NO: 2293211 - RNA, 20 nt, Yersinia pestis KIM
uagaaccggaauaaaucagu

SEQ ID NO: 2293212 - RNA, 13 nt, Yersinia pestis KIM
uacaugcuguuca

SEQ ID NO: 2293213 - RNA, 18 nt, Yersinia pestis KIM
uacaucucggcuuucagg

SEQ ID NO: 2293214 - RNA, 23 nt, Yersinia pestis KIM
uaccuuggugagaacucgguauc

SEQ ID NO: 2293215 - RNA, 21 nt, Yersinia pestis KIM
uaccugcgaacaucaucccca

SEQ ID NO: 2293216 - RNA, 22 nt, Yersinia pestis KIM
uaccugagaaaaaguggucauu

SEQ ID NO: 2293217 - RNA, 13 nt, Yersinia pestis KIM
uaucccuccauca

SEQ ID NO: 2293218 - RNA, 22 nt, Yersinia pestis KIM
uaucccguaacuuccggcugcg

SEQ ID NO: 2293219 - RNA, 20 nt, Yersinia pestis KIM
uauccgcaccauagauuaag

SEQ ID NO: 2293220 - RNA, 18 nt, Yersinia pestis KIM
uauccucaccguucaaga

SEQ ID NO: 2293221 - RNA, 13 nt, Yersinia pestis KIM
uaucggguaucug

SEQ ID NO: 2293222 - RNA, 19 nt, Yersinia pestis KIM
uaucguuuccagcggcgua

SEQ ID NO: 2293223 - RNA, 16 nt, Yersinia pestis KIM
uaucuuuccagccaau

SEQ ID NO: 2293224 - RNA, 17 nt, Yersinia pestis KIM
uaucaaagaauuccggc

SEQ ID NO: 2293225 - RNA, 18 nt, Yersinia pestis KIM
uaucaccccguuacggcu

SEQ ID NO: 2293226 - RNA, 22 nt, Yersinia pestis KIM
uaucaauugcuggcuaucaucc

SEQ ID NO: 2293227 - RNA, 15 nt, Yersinia pestis KIM
uauccagcgccauca

SEQ ID NO: 2293228 - RNA, 12 nt, Yersinia pestis KIM
uauccaauggcu

SEQ ID NO: 2293229 - RNA, 17 nt, Yersinia pestis KIM
uauccauccccgccuca

SEQ ID NO: 2293230 - RNA, 22 nt, Yersinia pestis KIM
uaucauggccauggaaaccggc

SEQ ID NO: 2293231 - RNA, 14 nt, Yersinia pestis KIM
uaucaguaacgccg

SEQ ID NO: 2293232 - RNA, 16 nt, Yersinia pestis KIM
uauucaaaaucugaua

SEQ ID NO: 2293233 - RNA, 13 nt, Yersinia pestis KIM
uauucaauaucac

SEQ ID NO: 2293234 - RNA, 16 nt, Yersinia pestis KIM
uauucaugguuucaaa

SEQ ID NO: 2293235 - RNA, 22 nt, Yersinia pestis KIM
uauugcucagggccacuucggu

SEQ ID NO: 2293236 - RNA, 13 nt, Yersinia pestis KIM
uaugucgucgcau

SEQ ID NO: 2293237 - RNA, 17 nt, Yersinia pestis KIM
uaugacaauauccguuu

SEQ ID NO: 2293238 - RNA, 19 nt, Yersinia pestis KIM
uaugaaugaguuucaaguc

SEQ ID NO: 2293239 - RNA, 15 nt, Yersinia pestis KIM
uaugggcauccaucg

SEQ ID NO: 2293240 - RNA, 16 nt, Yersinia pestis KIM
uauaagcaauaccgac

SEQ ID NO: 2293241 - RNA, 16 nt, Yersinia pestis KIM
uauaaggagagauuag

SEQ ID NO: 2293242 - RNA, 14 nt, Yersinia pestis KIM
uauacaccccauca

SEQ ID NO: 2293243 - RNA, 19 nt, Yersinia pestis KIM
uauacagaagaguacgcuu

SEQ ID NO: 2293244 - RNA, 13 nt, Yersinia pestis KIM
uauaauuucaaga

SEQ ID NO: 2293245 - RNA, 22 nt, Yersinia pestis KIM
uauaauccaaaaagcgcugcaa

SEQ ID NO: 2293246 - RNA, 22 nt, Yersinia pestis KIM
uauaaucaucuacaacaucauc

SEQ ID NO: 2293247 - RNA, 18 nt, Yersinia pestis KIM
uauaaacacuuaccuaua

SEQ ID NO: 2293248 - RNA, 17 nt, Yersinia pestis KIM
uauaacaaguuacauuu

SEQ ID NO: 2293249 - RNA, 16 nt, Yersinia pestis KIM
uaguuuuagacgucag

SEQ ID NO: 2293250 - RNA, 13 nt, Yersinia pestis KIM
uauacuaaauaga

SEQ ID NO: 2293251 - RNA, 21 nt, Yersinia pestis KIM
uauacuguuaacucgccaaca

SEQ ID NO: 2293252 - RNA, 15 nt, Yersinia pestis KIM
uauaccgauuaccgg

SEQ ID NO: 2293253 - RNA, 20 nt, Yersinia pestis KIM
uauagcgguaaccgacauca

SEQ ID NO: 2293254 - RNA, 22 nt, Yersinia pestis KIM
uauaguuuauuuuauuuaauca

SEQ ID NO: 2293255 - RNA, 14 nt, Yersinia pestis KIM
uagucauuaagaau

SEQ ID NO: 2293256 - RNA, 15 nt, Yersinia pestis KIM
uaguauuuaacgcca

SEQ ID NO: 2293257 - RNA, 21 nt, Yersinia pestis KIM
uaguauuuaacgccaccaaug

SEQ ID NO: 2293258 - RNA, 16 nt, Yersinia pestis KIM
uagguaauaccaaugc

SEQ ID NO: 2293259 - RNA, 13 nt, Yersinia pestis KIM
uagugaugcagua

SEQ ID NO: 2293260 - RNA, 19 nt, Yersinia pestis KIM
uagucuguuaccuaaucga

SEQ ID NO: 2293261 - RNA, 14 nt, Yersinia pestis KIM
uagucuucaucauc

SEQ ID NO: 2293262 - RNA, 13 nt, Yersinia pestis KIM
uagucggcauuaa

SEQ ID NO: 2293263 - RNA, 12 nt, Yersinia pestis KIM
guugacgccauu

SEQ ID NO: 2293264 - RNA, 15 nt, Yersinia pestis KIM
guugccaauguugcu

SEQ ID NO: 2293265 - RNA, 15 nt, Yersinia pestis KIM
guugcagcacgccag

SEQ ID NO: 2293266 - RNA, 21 nt, Yersinia pestis KIM
guugcaggggguuagcugcaa

SEQ ID NO: 2293267 - RNA, 15 nt, Yersinia pestis KIM
guugagguacggcuc

SEQ ID NO: 2293268 - RNA, 14 nt, Yersinia pestis KIM
guugcggcaccugc

SEQ ID NO: 2293269 - RNA, 12 nt, Yersinia pestis KIM
guuugcagcacu

SEQ ID NO: 2293270 - RNA, 13 nt, Yersinia pestis KIM
guuugauaggcuu

SEQ ID NO: 2293271 - RNA, 13 nt, Yersinia pestis KIM
guuuuaaauuacg

SEQ ID NO: 2293272 - RNA, 17 nt, Yersinia pestis KIM
guuuguuacgggcacug

SEQ ID NO: 2293273 - RNA, 21 nt, Yersinia pestis KIM
guuuucccgacagaacugauu

SEQ ID NO: 2293274 - RNA, 15 nt, Yersinia pestis KIM
guuuucuauuuccac

SEQ ID NO: 2293275 - RNA, 20 nt, Yersinia pestis KIM
guuuucuuucaacugcucau

SEQ ID NO: 2293276 - RNA, 14 nt, Yersinia pestis KIM
guuguauuagccgc

SEQ ID NO: 2293277 - RNA, 13 nt, Yersinia pestis KIM
guuguagcgccag

SEQ ID NO: 2293278 - RNA, 20 nt, Yersinia pestis KIM
guuuaccuggaguaaugagg

SEQ ID NO: 2293279 - RNA, 13 nt, Yersinia pestis KIM
guuuaggauugcg

SEQ ID NO: 2293280 - RNA, 17 nt, Yersinia pestis KIM
guuuacuuuaccgcuua

SEQ ID NO: 2293281 - RNA, 18 nt, Yersinia pestis KIM
uaacacgaggcgcuacug

SEQ ID NO: 2293282 - RNA, 21 nt, Yersinia pestis KIM
uaacacgaaccuucucugcac

SEQ ID NO: 2293283 - RNA, 12 nt, Yersinia pestis KIM
uaacauacucag

SEQ ID NO: 2293284 - RNA, 23 nt, Yersinia pestis KIM
uaaaucagacgagucuauugaaa

SEQ ID NO: 2293285 - RNA, 16 nt, Yersinia pestis KIM
uaaauccaaaugccca

SEQ ID NO: 2293286 - RNA, 12 nt, Yersinia pestis KIM
uaacgggagauu

SEQ ID NO: 2293287 - RNA, 17 nt, Yersinia pestis KIM
uaacgcucuacaacguc

SEQ ID NO: 2293288 - RNA, 20 nt, Yersinia pestis KIM
uaaccgggcuugauuaaaug

SEQ ID NO: 2293289 - RNA, 15 nt, Yersinia pestis KIM
uaacuuuaucagucu

SEQ ID NO: 2293290 - RNA, 13 nt, Yersinia pestis KIM
uaaccgcauaauc

SEQ ID NO: 2293291 - RNA, 20 nt, Yersinia pestis KIM
uaaccgccgcaggccauuac

SEQ ID NO: 2293292 - RNA, 21 nt, Yersinia pestis KIM
uaaccucaggcccgcuaucac

SEQ ID NO: 2293293 - RNA, 19 nt, Yersinia pestis KIM
uaaccucagggagccaaua

SEQ ID NO: 2293294 - RNA, 13 nt, Yersinia pestis KIM
uaaccccauaucc

SEQ ID NO: 2293295 - RNA, 18 nt, Yersinia pestis KIM
uaaacggcgguuaaucgg

SEQ ID NO: 2293296 - RNA, 21 nt, Yersinia pestis KIM
uaaacgaccauuucucugaug

SEQ ID NO: 2293297 - RNA, 22 nt, Yersinia pestis KIM
uaaacaccggcaauaugaaggc

SEQ ID NO: 2293298 - RNA, 15 nt, Yersinia pestis KIM
uaaaauuaauuacuu

SEQ ID NO: 2293299 - RNA, 22 nt, Yersinia pestis KIM
uaaaaccacugaccuauugaua

SEQ ID NO: 2293300 - RNA, 19 nt, Yersinia pestis KIM
uaaaaacgccuccagugau

SEQ ID NO: 2293301 - RNA, 12 nt, Yersinia pestis KIM
uaaaaaccgccc

SEQ ID NO: 2293302 - RNA, 23 nt, Yersinia pestis KIM
uaaaacuggcacgaacaaucgcc

SEQ ID NO: 2293303 - RNA, 19 nt, Yersinia pestis KIM
uacacggucuggcaacgcu

SEQ ID NO: 2293304 - RNA, 23 nt, Yersinia pestis KIM
uacaccuccaaaugucagggggu

SEQ ID NO: 2293305 - RNA, 22 nt, Yersinia pestis KIM
uacagcucaucaccaaaaugac

SEQ ID NO: 2293306 - RNA, 15 nt, Yersinia pestis KIM
uacaaauagcgcugc

SEQ ID NO: 2293307 - RNA, 22 nt, Yersinia pestis KIM
uaauuuagcaaagcgauaucgu

SEQ ID NO: 2293308 - RNA, 21 nt, Yersinia pestis KIM
uaaugccggcggcccauaucc

SEQ ID NO: 2293309 - RNA, 19 nt, Yersinia pestis KIM
uaaugccgcugaucaggaa

SEQ ID NO: 2293310 - RNA, 15 nt, Yersinia pestis KIM
uaaugcucgcucauc

SEQ ID NO: 2293311 - RNA, 18 nt, Yersinia pestis KIM
uaauugcggucaguuggc

SEQ ID NO: 2293312 - RNA, 22 nt, Yersinia pestis KIM
uaauaagacguuauuauugauu

SEQ ID NO: 2293313 - RNA, 11 nt, Yersinia pestis KIM
uaauaccgaua

SEQ ID NO: 2293314 - RNA, 17 nt, Yersinia pestis KIM
uaaucacgauacgacuu

SEQ ID NO: 2293315 - RNA, 15 nt, Yersinia pestis KIM
uaaucagacugcuga

SEQ ID NO: 2293316 - RNA, 17 nt, Yersinia pestis KIM
uaaucaacgcucaauca

SEQ ID NO: 2293317 - RNA, 14 nt, Yersinia pestis KIM
uaagaacaacgcug

SEQ ID NO: 2293318 - RNA, 17 nt, Yersinia pestis KIM
uaagaacaacgcugcaa

SEQ ID NO: 2293319 - RNA, 13 nt, Yersinia pestis KIM
uaagauucgccgc

SEQ ID NO: 2293320 - RNA, 15 nt, Yersinia pestis KIM
uaagauucucggcau

SEQ ID NO: 2293321 - RNA, 15 nt, Yersinia pestis KIM
uaagauccagucggu

SEQ ID NO: 2293322 - RNA, 19 nt, Yersinia pestis KIM
uaagcaugccauccugcca

SEQ ID NO: 2293323 - RNA, 12 nt, Yersinia pestis KIM
uaagcagccgcc

SEQ ID NO: 2293324 - RNA, 16 nt, Yersinia pestis KIM
uaagcaucggcaacgu

SEQ ID NO: 2293325 - RNA, 19 nt, Yersinia pestis KIM
uaagcucugggacgugcau

SEQ ID NO: 2293326 - RNA, 14 nt, Yersinia pestis KIM
uaaggccgcaauug

SEQ ID NO: 2293327 - RNA, 22 nt, Yersinia pestis KIM
ucagauuuucguucggugcaaa

SEQ ID NO: 2293328 - RNA, 17 nt, Yersinia pestis KIM
ucagaccuuuacaggac

SEQ ID NO: 2293329 - RNA, 13 nt, Yersinia pestis KIM
ucacugaauccca

SEQ ID NO: 2293330 - RNA, 15 nt, Yersinia pestis KIM
ucacuuagcucaauc

SEQ ID NO: 2293331 - RNA, 17 nt, Yersinia pestis KIM
ucaccgagagauucaug

SEQ ID NO: 2293332 - RNA, 19 nt, Yersinia pestis KIM
uauuuaacauuagccgguu

SEQ ID NO: 2293333 - RNA, 14 nt, Yersinia pestis KIM
ucacgaucaaccau

SEQ ID NO: 2293334 - RNA, 22 nt, Yersinia pestis KIM
ucagcccuacauccgcuuguuc

SEQ ID NO: 2293335 - RNA, 16 nt, Yersinia pestis KIM
ucagcgggaaagcgua

SEQ ID NO: 2293336 - RNA, 16 nt, Yersinia pestis KIM
ucagcgucacggaaag

SEQ ID NO: 2293337 - RNA, 23 nt, Yersinia pestis KIM
ucaucgcugagggccaugccuaa

SEQ ID NO: 2293338 - RNA, 20 nt, Yersinia pestis KIM
ucauccagcaacucaagcca

SEQ ID NO: 2293339 - RNA, 14 nt, Yersinia pestis KIM
ucaugauaaugcca

SEQ ID NO: 2293340 - RNA, 20 nt, Yersinia pestis KIM
ucaugcagauacucggcaaa

SEQ ID NO: 2293341 - RNA, 23 nt, Yersinia pestis KIM
uccaacaguagcuugaucggaua

SEQ ID NO: 2293342 - RNA, 16 nt, Yersinia pestis KIM
ucauuauuuucaacca

SEQ ID NO: 2293343 - RNA, 17 nt, Yersinia pestis KIM
ucaugguagagcuguuu

SEQ ID NO: 2293344 - RNA, 18 nt, Yersinia pestis KIM
ucagugccaauaauucac

SEQ ID NO: 2293345 - RNA, 11 nt, Yersinia pestis KIM
ucaggucgcaa

SEQ ID NO: 2293346 - RNA, 17 nt, Yersinia pestis KIM
ucaggccuugauggcua

SEQ ID NO: 2293347 - RNA, 16 nt, Yersinia pestis KIM
ucaucaagccaauggc

SEQ ID NO: 2293348 - RNA, 23 nt, Yersinia pestis KIM
ucaucaauaccgaaaauaccgga

SEQ ID NO: 2293349 - RNA, 19 nt, Yersinia pestis KIM
ucaucaaaggcaauaccgg

SEQ ID NO: 2293350 - RNA, 20 nt, Yersinia pestis KIM
ucaucaaaggcaauaccggu

SEQ ID NO: 2293351 - RNA, 23 nt, Yersinia pestis KIM
ucaucaacgcgccuuucggcaau

SEQ ID NO: 2293352 - RNA, 21 nt, Yersinia pestis KIM
ucauaaaccugauuuaccguc

SEQ ID NO: 2293353 - RNA, 17 nt, Yersinia pestis KIM
uccagauggcggucgca

SEQ ID NO: 2293354 - RNA, 21 nt, Yersinia pestis KIM
uccacacaaacgcauucauau

SEQ ID NO: 2293355 - RNA, 15 nt, Yersinia pestis KIM
uccaacuuaucacug

SEQ ID NO: 2293356 - RNA, 17 nt, Yersinia pestis KIM
uccagcggcguaucaaa

SEQ ID NO: 2293357 - RNA, 18 nt, Yersinia pestis KIM
uccaucgucaauucacug

SEQ ID NO: 2293358 - RNA, 18 nt, Yersinia pestis KIM
uccuccggcauagccgga

SEQ ID NO: 2293359 - RNA, 13 nt, Yersinia pestis KIM
uccgucaaucguu

SEQ ID NO: 2293360 - RNA, 19 nt, Yersinia pestis KIM
ucccuugacugaccauaaa

SEQ ID NO: 2293361 - RNA, 19 nt, Yersinia pestis KIM
uccaugauauaucagucuu

SEQ ID NO: 2293362 - RNA, 23 nt, Yersinia pestis KIM
uccauuaaaagaggaugccacug

SEQ ID NO: 2293363 - RNA, 23 nt, Yersinia pestis KIM
uccauuguauugcucagggccac

SEQ ID NO: 2293364 - RNA, 22 nt, Yersinia pestis KIM
uccauuaccugccccacaauga

SEQ ID NO: 2293365 - RNA, 14 nt, Yersinia pestis KIM
ucccuaacgccgug

SEQ ID NO: 2293366 - RNA, 16 nt, Yersinia pestis KIM
ucgacagcaucaacau

SEQ ID NO: 2293367 - RNA, 14 nt, Yersinia pestis KIM
ucgaacuauugaug

SEQ ID NO: 2293368 - RNA, 17 nt, Yersinia pestis KIM
uccugauuacucaggaa

SEQ ID NO: 2293369 - RNA, 17 nt, Yersinia pestis KIM
uccugaugagucuauuu

SEQ ID NO: 2293370 - RNA, 16 nt, Yersinia pestis KIM
uccuucaauggcauuu

SEQ ID NO: 2293371 - RNA, 19 nt, Yersinia pestis KIM
uccuugaaguguuuaauca

SEQ ID NO: 2293372 - RNA, 20 nt, Yersinia pestis KIM
ugcuggaacgguugcccguu

SEQ ID NO: 2293373 - RNA, 17 nt, Yersinia pestis KIM
ugcucucuucauagcua

SEQ ID NO: 2293374 - RNA, 16 nt, Yersinia pestis KIM
ugcuuccaggauauuc

SEQ ID NO: 2293375 - RNA, 19 nt, Yersinia pestis KIM
ugcuucauccaacuuaccu

SEQ ID NO: 2293376 - RNA, 24 nt, Yersinia pestis KIM
ugcuguuguuauuacugucacugu

SEQ ID NO: 2293377 - RNA, 17 nt, Yersinia pestis KIM
ugcuguguguucaaacu

SEQ ID NO: 2293378 - RNA, 16 nt, Yersinia pestis KIM
ugcuguuauuacuguc

SEQ ID NO: 2293379 - RNA, 15 nt, Yersinia pestis KIM
ugcuugauggcauca

SEQ ID NO: 2293380 - RNA, 15 nt, Yersinia pestis KIM
ugcuugccagcgcuu

SEQ ID NO: 2293381 - RNA, 20 nt, Yersinia pestis KIM
ugcguguucuucucaccccg

SEQ ID NO: 2293382 - RNA, 15 nt, Yersinia pestis KIM
ugcguauuaucauca

SEQ ID NO: 2293383 - RNA, 16 nt, Yersinia pestis KIM
ugcuauuuuauaucga

SEQ ID NO: 2293384 - RNA, 18 nt, Yersinia pestis KIM
ugcucaaacucagcauca

SEQ ID NO: 2293385 - RNA, 16 nt, Yersinia pestis KIM
ugcuagguuuacuguu

SEQ ID NO: 2293386 - RNA, 16 nt, Yersinia pestis KIM
ugcuauuaacccgcug

SEQ ID NO: 2293387 - RNA, 12 nt, Yersinia pestis KIM
ugcuaaccgccu

SEQ ID NO: 2293388 - RNA, 14 nt, Yersinia pestis KIM
ugcuacuuaacguu

SEQ ID NO: 2293389 - RNA, 12 nt, Yersinia pestis KIM
ugcuacggcaaa

SEQ ID NO: 2293390 - RNA, 22 nt, Yersinia pestis KIM
ugcucauaaagcaucagacugc

SEQ ID NO: 2293391 - RNA, 15 nt, Yersinia pestis KIM
ugcucccuccugccc

SEQ ID NO: 2293392 - RNA, 19 nt, Yersinia pestis KIM
ugcggcggagagaaauagg

SEQ ID NO: 2293393 - RNA, 23 nt, Yersinia pestis KIM
ugcggcggagagaaauaggcagg

SEQ ID NO: 2293394 - RNA, 21 nt, Yersinia pestis KIM
ugcgagcguuuaaauacccgg

SEQ ID NO: 2293395 - RNA, 12 nt, Yersinia pestis KIM
ugcgccagcagc

SEQ ID NO: 2293396 - RNA, 22 nt, Yersinia pestis KIM
ugcgcagcguccauaaacccgg

SEQ ID NO: 2293397 - RNA, 21 nt, Yersinia pestis KIM
ugcagcaagccgauaaucaau

SEQ ID NO: 2293398 - RNA, 17 nt, Yersinia pestis KIM
ugcagcgcgcagccaac

SEQ ID NO: 2293399 - RNA, 17 nt, Yersinia pestis KIM
ugcagcuaaaagaugca

SEQ ID NO: 2293400 - RNA, 13 nt, Yersinia pestis KIM
ugccauaauccag

SEQ ID NO: 2293401 - RNA, 17 nt, Yersinia pestis KIM
ugccauaauccagaagc

SEQ ID NO: 2293402 - RNA, 22 nt, Yersinia pestis KIM
ugccaguucaucagcccagcgg

SEQ ID NO: 2293403 - RNA, 17 nt, Yersinia pestis KIM
ugccagugcaauccgcu

SEQ ID NO: 2293404 - RNA, 20 nt, Yersinia pestis KIM
ugccaaaaugccuaccguua

SEQ ID NO: 2293405 - RNA, 21 nt, Yersinia pestis KIM
ugccacggauauccaacggua

SEQ ID NO: 2293406 - RNA, 13 nt, Yersinia pestis KIM
ugccaauauugcc

SEQ ID NO: 2293407 - RNA, 16 nt, Yersinia pestis KIM
ugccaugucacuguuc

SEQ ID NO: 2293408 - RNA, 20 nt, Yersinia pestis KIM
ugccauauuacucucuauug

SEQ ID NO: 2293409 - RNA, 21 nt, Yersinia pestis KIM
ugcccuucagaugaauccagc

SEQ ID NO: 2293410 - RNA, 19 nt, Yersinia pestis KIM
ugcccgguugccugacggc

SEQ ID NO: 2293411 - RNA, 22 nt, Yersinia pestis KIM
ugauggguauauuaucauucaa

SEQ ID NO: 2293412 - RNA, 19 nt, Yersinia pestis KIM
ugaucagcaguggcuuggc

SEQ ID NO: 2293413 - RNA, 20 nt, Yersinia pestis KIM
ugaucagcuaacaaaaccgg

SEQ ID NO: 2293414 - RNA, 17 nt, Yersinia pestis KIM
ugaugccaguaauucac

SEQ ID NO: 2293415 - RNA, 18 nt, Yersinia pestis KIM
ugauuguuuuauggcgau

SEQ ID NO: 2293416 - RNA, 13 nt, Yersinia pestis KIM
ugcagaccaauca

SEQ ID NO: 2293417 - RNA, 17 nt, Yersinia pestis KIM
ugcagauacucggcaaa

SEQ ID NO: 2293418 - RNA, 20 nt, Yersinia pestis KIM
ugagugaaggguugaccgca

SEQ ID NO: 2293419 - RNA, 22 nt, Yersinia pestis KIM
ugagucuugauauuuaagccau

SEQ ID NO: 2293420 - RNA, 17 nt, Yersinia pestis KIM
ugagguuauugacaaag

SEQ ID NO: 2293421 - RNA, 17 nt, Yersinia pestis KIM
ugaguaaaagauucaua

SEQ ID NO: 2293422 - RNA, 16 nt, Yersinia pestis KIM
ugaguaagacaacuua

SEQ ID NO: 2293423 - RNA, 21 nt, Yersinia pestis KIM
ugaggcccgcuagugauagcg

SEQ ID NO: 2293424 - RNA, 16 nt, Yersinia pestis KIM
ugauauagcuguuuga

SEQ ID NO: 2293425 - RNA, 14 nt, Yersinia pestis KIM
ugauauuaacuggu

SEQ ID NO: 2293426 - RNA, 16 nt, Yersinia pestis KIM
ugauaugcaaaucaug

SEQ ID NO: 2293427 - RNA, 18 nt, Yersinia pestis KIM
ugacuaucccuucaauca

SEQ ID NO: 2293428 - RNA, 22 nt, Yersinia pestis KIM
ugaacguguuagguaauaccaa

SEQ ID NO: 2293429 - RNA, 14 nt, Yersinia pestis KIM
ugaacguuuaucgc

SEQ ID NO: 2293430 - RNA, 15 nt, Yersinia pestis KIM
ugaacguuuaucgcu

SEQ ID NO: 2293431 - RNA, 22 nt, Yersinia pestis KIM
ugaagauacccuugagguuauu

SEQ ID NO: 2293432 - RNA, 15 nt, Yersinia pestis KIM
ugaacggcuggucau

SEQ ID NO: 2293433 - RNA, 17 nt, Yersinia pestis KIM
ugacuuuggauauagag

SEQ ID NO: 2293434 - RNA, 16 nt, Yersinia pestis KIM
ugagcaauugcguaau

SEQ ID NO: 2293435 - RNA, 22 nt, Yersinia pestis KIM
ugagccgcccuuuagccagcgg

SEQ ID NO: 2293436 - RNA, 15 nt, Yersinia pestis KIM
ucguaaagacgccgu

SEQ ID NO: 2293437 - RNA, 19 nt, Yersinia pestis KIM
ucguuacucgguccaucug

SEQ ID NO: 2293438 - RNA, 22 nt, Yersinia pestis KIM
ucuacucgcucaccacugaguu

SEQ ID NO: 2293439 - RNA, 21 nt, Yersinia pestis KIM
ucuaucgcgguuuuaaauaca

SEQ ID NO: 2293440 - RNA, 19 nt, Yersinia pestis KIM
ucucacaacuuuuauuggc

SEQ ID NO: 2293441 - RNA, 13 nt, Yersinia pestis KIM
ucucaauucaaua

SEQ ID NO: 2293442 - RNA, 14 nt, Yersinia pestis KIM
ucucagacugcuga

SEQ ID NO: 2293443 - RNA, 14 nt, Yersinia pestis KIM
ucuuuaaccgcauu

SEQ ID NO: 2293444 - RNA, 22 nt, Yersinia pestis KIM
ucuuuuaguaacaaaaugcggu

SEQ ID NO: 2293445 - RNA, 21 nt, Yersinia pestis KIM
ucuuuacggucgucgagaaua

SEQ ID NO: 2293446 - RNA, 15 nt, Yersinia pestis KIM
ugaacacagaaacga

SEQ ID NO: 2293447 - RNA, 23 nt, Yersinia pestis KIM
ugaaacacaacaacggugaacag

SEQ ID NO: 2293448 - RNA, 24 nt, Yersinia pestis KIM
ugaaacacaacaacggugaacaga

SEQ ID NO: 2293449 - RNA, 15 nt, Yersinia pestis KIM
ucuugcauacucagg

SEQ ID NO: 2293450 - RNA, 20 nt, Yersinia pestis KIM
ucuucauggcgcuuuagcca

SEQ ID NO: 2293451 - RNA, 13 nt, Yersinia pestis KIM
ucugccaaccagg

SEQ ID NO: 2293452 - RNA, 23 nt, Yersinia pestis KIM
ucugcccccgguuuagauaggca

SEQ ID NO: 2293453 - RNA, 19 nt, Yersinia pestis KIM
ucugacuaacucuucuggc

SEQ ID NO: 2293454 - RNA, 15 nt, Yersinia pestis KIM
ucugaaucgcugcca

SEQ ID NO: 2293455 - RNA, 16 nt, Yersinia pestis KIM
ucugaagaauuacgca

SEQ ID NO: 2293456 - RNA, 13 nt, Yersinia pestis KIM
ucuguucagauuu

SEQ ID NO: 2293457 - RNA, 14 nt, Yersinia pestis KIM
ucuuaggugacagg

SEQ ID NO: 2293458 - RNA, 22 nt, Yersinia pestis KIM
ucuuaauucccagccacucaca

SEQ ID NO: 2293459 - RNA, 15 nt, Yersinia pestis KIM
ucuuaaggacccguu

SEQ ID NO: 2293460 - RNA, 21 nt, Yersinia pestis KIM
ucuguuuuugccaccuccgca

SEQ ID NO: 2293461 - RNA, 18 nt, Yersinia pestis KIM
ucugguccagaucggcaa

SEQ ID NO: 2293462 - RNA, 13 nt, Yersinia pestis KIM
ucugucgggaaca

SEQ ID NO: 2293463 - RNA, 17 nt, Yersinia pestis KIM
ucuguaguucagucggu

SEQ ID NO: 2293464 - RNA, 22 nt, Yersinia pestis KIM
ucgcgaccaauucaucagcgcu

SEQ ID NO: 2293465 - RNA, 14 nt, Yersinia pestis KIM
ucgccguauuugua

SEQ ID NO: 2293466 - RNA, 23 nt, Yersinia pestis KIM
ucgcgacgaaaaccuaauacuuu

SEQ ID NO: 2293467 - RNA, 16 nt, Yersinia pestis KIM
ucgcgcccauccgcag

SEQ ID NO: 2293468 - RNA, 14 nt, Yersinia pestis KIM
ucggauaaccgcau

SEQ ID NO: 2293469 - RNA, 19 nt, Yersinia pestis KIM
ucgcugugaauuuaucagg

SEQ ID NO: 2293470 - RNA, 14 nt, Yersinia pestis KIM
ucggccaauucagc

SEQ ID NO: 2293471 - RNA, 21 nt, Yersinia pestis KIM
ucgcuguaggauuucauaccg

SEQ ID NO: 2293472 - RNA, 22 nt, Yersinia pestis KIM
ucggcggucugagucagucagg

SEQ ID NO: 2293473 - RNA, 18 nt, Yersinia pestis KIM
ucggccuccccugcgggu

SEQ ID NO: 2293474 - RNA, 16 nt, Yersinia pestis KIM
ggcucgagccgcgcca

SEQ ID NO: 2293475 - RNA, 14 nt, Yersinia pestis KIM
ggcucgaaccugaa

SEQ ID NO: 2293476 - RNA, 14 nt, Yersinia pestis KIM
ggcuaagcggcgua

SEQ ID NO: 2293477 - RNA, 12 nt, Yersinia pestis KIM
ggcuaccaauua

SEQ ID NO: 2293478 - RNA, 20 nt, Yersinia pestis KIM
ggcguuacaguaaggcagca

SEQ ID NO: 2293479 - RNA, 17 nt, Yersinia pestis KIM
ggcguaaacaaucgucu

SEQ ID NO: 2293480 - RNA, 20 nt, Yersinia pestis KIM
ggcgcugaucaucaucaaug

SEQ ID NO: 2293481 - RNA, 17 nt, Yersinia pestis KIM
ggcugucccgaugauug

SEQ ID NO: 2293482 - RNA, 23 nt, Yersinia pestis KIM
ggcuucaucaguaaaauaccccg

SEQ ID NO: 2293483 - RNA, 20 nt, Yersinia pestis KIM
gggcaauugaaaauauaccc

SEQ ID NO: 2293484 - RNA, 15 nt, Yersinia pestis KIM
ggggauugcugccaa

SEQ ID NO: 2293485 - RNA, 22 nt, Yersinia pestis KIM
ggggccaucaucuucaaccugg

SEQ ID NO: 2293486 - RNA, 19 nt, Yersinia pestis KIM
ggguacagaucagcgugac

SEQ ID NO: 2293487 - RNA, 18 nt, Yersinia pestis KIM
ggccgauacacaugguug

SEQ ID NO: 2293488 - RNA, 17 nt, Yersinia pestis KIM
ggccugaugcaccucag

SEQ ID NO: 2293489 - RNA, 18 nt, Yersinia pestis KIM
ggccuccgaagcauuaca

SEQ ID NO: 2293490 - RNA, 16 nt, Yersinia pestis KIM
ggccgaggaauaugcc

SEQ ID NO: 2293491 - RNA, 19 nt, Yersinia pestis KIM
ggcauauaaccaugcgaua

SEQ ID NO: 2293492 - RNA, 18 nt, Yersinia pestis KIM
ggcauacuccgcugagca

SEQ ID NO: 2293493 - RNA, 23 nt, Yersinia pestis KIM
ggcauuaaaaaucugcaauauca

SEQ ID NO: 2293494 - RNA, 16 nt, Yersinia pestis KIM
gucagcguuggaugag

SEQ ID NO: 2293495 - RNA, 19 nt, Yersinia pestis KIM
gucagguuaauaccugcac

SEQ ID NO: 2293496 - RNA, 14 nt, Yersinia pestis KIM
gucagucuugcugc

SEQ ID NO: 2293497 - RNA, 12 nt, Yersinia pestis KIM
gucagucagggu

SEQ ID NO: 2293498 - RNA, 14 nt, Yersinia pestis KIM
gucagggugaaagc

SEQ ID NO: 2293499 - RNA, 14 nt, Yersinia pestis KIM
gucagggcaauaac

SEQ ID NO: 2293500 - RNA, 13 nt, Yersinia pestis KIM
gucaucauauuca

SEQ ID NO: 2293501 - RNA, 23 nt, Yersinia pestis KIM
gucauaagguuaaugagcguuau

SEQ ID NO: 2293502 - RNA, 15 nt, Yersinia pestis KIM
gucauaaucaucugc

SEQ ID NO: 2293503 - RNA, 23 nt, Yersinia pestis KIM
gucaucgccgcaaauuaacacau

SEQ ID NO: 2293504 - RNA, 18 nt, Yersinia pestis KIM
gucaugcaauuacugcau

SEQ ID NO: 2293505 - RNA, 20 nt, Yersinia pestis KIM
gucauuaccgcacacuacag

SEQ ID NO: 2293506 - RNA, 18 nt, Yersinia pestis KIM
gucauugccugcucaccg

SEQ ID NO: 2293507 - RNA, 14 nt, Yersinia pestis KIM
gucauuggcguuac

SEQ ID NO: 2293508 - RNA, 17 nt, Yersinia pestis KIM
guaaucagacugcugac

SEQ ID NO: 2293509 - RNA, 13 nt, Yersinia pestis KIM
guaauaaaggcug

SEQ ID NO: 2293510 - RNA, 17 nt, Yersinia pestis KIM
guaaguuggcaucagcu

SEQ ID NO: 2293511 - RNA, 17 nt, Yersinia pestis KIM
guaaggccucggcgauu

SEQ ID NO: 2293512 - RNA, 16 nt, Yersinia pestis KIM
guaaucgccaaugguc

SEQ ID NO: 2293513 - RNA, 16 nt, Yersinia pestis KIM
gucacuguucuugaug

SEQ ID NO: 2293514 - RNA, 18 nt, Yersinia pestis KIM
gucacuggcaccauuugc

SEQ ID NO: 2293515 - RNA, 17 nt, Yersinia pestis KIM
gucaauaucaucaucuu

SEQ ID NO: 2293516 - RNA, 21 nt, Yersinia pestis KIM
gucaauaaccucagccucauu

SEQ ID NO: 2293517 - RNA, 18 nt, Yersinia pestis KIM
gucaaugguucacuauaa

SEQ ID NO: 2293518 - RNA, 23 nt, Yersinia pestis KIM
gucaccugaaugccauucaagcc

SEQ ID NO: 2293519 - RNA, 16 nt, Yersinia pestis KIM
guaucggguagcaucc

SEQ ID NO: 2293520 - RNA, 20 nt, Yersinia pestis KIM
guaucuauaaacuucacgag

SEQ ID NO: 2293521 - RNA, 21 nt, Yersinia pestis KIM
guauucaaaauagaaaagcgc

SEQ ID NO: 2293522 - RNA, 21 nt, Yersinia pestis KIM
guauuauaaaauucgcuauga

SEQ ID NO: 2293523 - RNA, 13 nt, Yersinia pestis KIM
gucaaaauccgga

SEQ ID NO: 2293524 - RNA, 20 nt, Yersinia pestis KIM
guauuggcuaacuggcgcug

SEQ ID NO: 2293525 - RNA, 19 nt, Yersinia pestis KIM
guauuuucuauaccaauug

SEQ ID NO: 2293526 - RNA, 12 nt, Yersinia pestis KIM
ggucucacugcg

SEQ ID NO: 2293527 - RNA, 11 nt, Yersinia pestis KIM
ggucaggaaga

SEQ ID NO: 2293528 - RNA, 11 nt, Yersinia pestis KIM
gguugaaaguu

SEQ ID NO: 2293529 - RNA, 21 nt, Yersinia pestis KIM
gguugcaggcugucaggaacu

SEQ ID NO: 2293530 - RNA, 14 nt, Yersinia pestis KIM
gguucgucaugaug

SEQ ID NO: 2293531 - RNA, 17 nt, Yersinia pestis KIM
guaaaaucacguuucca

SEQ ID NO: 2293532 - RNA, 13 nt, Yersinia pestis KIM
guaacagcggcga

SEQ ID NO: 2293533 - RNA, 18 nt, Yersinia pestis KIM
guaaccaauaacauuucg

SEQ ID NO: 2293534 - RNA, 19 nt, Yersinia pestis KIM
guaacccgccucgcuuacu

SEQ ID NO: 2293535 - RNA, 15 nt, Yersinia pestis KIM
guaagauuucaagca

SEQ ID NO: 2293536 - RNA, 20 nt, Yersinia pestis KIM
guaaacaauaauucgcaugg

SEQ ID NO: 2293537 - RNA, 17 nt, Yersinia pestis KIM
gugcgcaucagccagcc

SEQ ID NO: 2293538 - RNA, 19 nt, Yersinia pestis KIM
gugcucauuaaaaccacgc

SEQ ID NO: 2293539 - RNA, 21 nt, Yersinia pestis KIM
gugaacugaacugaacugaau

SEQ ID NO: 2293540 - RNA, 19 nt, Yersinia pestis KIM
gugauacaucucggcuuuc

SEQ ID NO: 2293541 - RNA, 11 nt, Yersinia pestis KIM
gugagccagag

SEQ ID NO: 2293542 - RNA, 17 nt, Yersinia pestis KIM
gugaugaaugacuggcu

SEQ ID NO: 2293543 - RNA, 22 nt, Yersinia pestis KIM
guggcucauuaaagguacguaa

SEQ ID NO: 2293544 - RNA, 15 nt, Yersinia pestis KIM
guggcgaagcccaua

SEQ ID NO: 2293545 - RNA, 23 nt, Yersinia pestis KIM
gugcuuuauccaauggcucaccu

SEQ ID NO: 2293546 - RNA, 12 nt, Yersinia pestis KIM
guggagccauga

SEQ ID NO: 2293547 - RNA, 15 nt, Yersinia pestis KIM
gucgcugaaaugcua

SEQ ID NO: 2293548 - RNA, 20 nt, Yersinia pestis KIM
gugaaagcaucccuucgcaa

SEQ ID NO: 2293549 - RNA, 12 nt, Yersinia pestis KIM
gucuguuaucug

SEQ ID NO: 2293550 - RNA, 20 nt, Yersinia pestis KIM
gucuuccaugacaaaauacg

SEQ ID NO: 2293551 - RNA, 13 nt, Yersinia pestis KIM
gucugagggccac

SEQ ID NO: 2293552 - RNA, 18 nt, Yersinia pestis KIM
gucugcaacucagugaaa

SEQ ID NO: 2293553 - RNA, 12 nt, Yersinia pestis KIM
gcgcgauaguca

SEQ ID NO: 2293554 - RNA, 14 nt, Yersinia pestis KIM
gcgccguaaacugc

SEQ ID NO: 2293555 - RNA, 15 nt, Yersinia pestis KIM
gcgcccggcccacuu

SEQ ID NO: 2293556 - RNA, 23 nt, Yersinia pestis KIM
gcgccaucgcuaaucauauccau

SEQ ID NO: 2293557 - RNA, 21 nt, Yersinia pestis KIM
gcgcugcaucuggucaucaug

SEQ ID NO: 2293558 - RNA, 13 nt, Yersinia pestis KIM
gcggacgggcaau

SEQ ID NO: 2293559 - RNA, 16 nt, Yersinia pestis KIM
gcggacaucuuacuga

SEQ ID NO: 2293560 - RNA, 22 nt, Yersinia pestis KIM
gccucggcgauugaacaugaug

SEQ ID NO: 2293561 - RNA, 15 nt, Yersinia pestis KIM
gccgugggcaauaac

SEQ ID NO: 2293562 - RNA, 12 nt, Yersinia pestis KIM
gcgaauuggcaa

SEQ ID NO: 2293563 - RNA, 14 nt, Yersinia pestis KIM
gcgagcaauaccaa

SEQ ID NO: 2293564 - RNA, 13 nt, Yersinia pestis KIM
gcgagauggcguu

SEQ ID NO: 2293565 - RNA, 20 nt, Yersinia pestis KIM
gcgagauggucauggcgguu

SEQ ID NO: 2293566 - RNA, 15 nt, Yersinia pestis KIM
gcgacuaauggccag

SEQ ID NO: 2293567 - RNA, 22 nt, Yersinia pestis KIM
gcgaucuauucucuguaauggc

SEQ ID NO: 2293568 - RNA, 23 nt, Yersinia pestis KIM
gcgaugccaacaauugcuccagu

SEQ ID NO: 2293569 - RNA, 14 nt, Yersinia pestis KIM
gcgcaaaaggcauc

SEQ ID NO: 2293570 - RNA, 14 nt, Yersinia pestis KIM
gcgcaacugccaug

SEQ ID NO: 2293571 - RNA, 21 nt, Yersinia pestis KIM
gcgguaaccagcaucaguagc

SEQ ID NO: 2293572 - RNA, 17 nt, Yersinia pestis KIM
gcgguaaacaccguauc

SEQ ID NO: 2293573 - RNA, 21 nt, Yersinia pestis KIM
gcggguagcauauacguuagu

SEQ ID NO: 2293574 - RNA, 20 nt, Yersinia pestis KIM
gcgggaaaagguaaacagac

SEQ ID NO: 2293575 - RNA, 18 nt, Yersinia pestis KIM
gcguuccaaucugcgccc

SEQ ID NO: 2293576 - RNA, 15 nt, Yersinia pestis KIM
gcguuaaccaguagc

SEQ ID NO: 2293577 - RNA, 14 nt, Yersinia pestis KIM
gcguuaacagcgcu

SEQ ID NO: 2293578 - RNA, 12 nt, Yersinia pestis KIM
gcguaaagcacc

SEQ ID NO: 2293579 - RNA, 21 nt, Yersinia pestis KIM
gcguaaauuuaccguccguac

SEQ ID NO: 2293580 - RNA, 22 nt, Yersinia pestis KIM
gcucaucaaccucagccucauu

SEQ ID NO: 2293581 - RNA, 18 nt, Yersinia pestis KIM
gcucaucaaccucagccu

SEQ ID NO: 2293582 - RNA, 12 nt, Yersinia pestis KIM
gcucagggccac

SEQ ID NO: 2293583 - RNA, 15 nt, Yersinia pestis KIM
gcguucgcgccauau

SEQ ID NO: 2293584 - RNA, 19 nt, Yersinia pestis KIM
gcuaccucguaguaaugac

SEQ ID NO: 2293585 - RNA, 11 nt, Yersinia pestis KIM
gcuacgccgug

SEQ ID NO: 2293586 - RNA, 19 nt, Yersinia pestis KIM
gcucaaucucugccuguga

SEQ ID NO: 2293587 - RNA, 20 nt, Yersinia pestis KIM
gcucacccauuuuauccucu

SEQ ID NO: 2293588 - RNA, 12 nt, Yersinia pestis KIM
gcucaacugcuc

SEQ ID NO: 2293589 - RNA, 19 nt, Yersinia pestis KIM
gcuauuaacccgcugcgua

SEQ ID NO: 2293590 - RNA, 21 nt, Yersinia pestis KIM
gcuauucagacgguugcuaga

SEQ ID NO: 2293591 - RNA, 21 nt, Yersinia pestis KIM
gcuauugcuuuuauugccuac

SEQ ID NO: 2293592 - RNA, 16 nt, Yersinia pestis KIM
gcuauugcaacgcuug

SEQ ID NO: 2293593 - RNA, 17 nt, Yersinia pestis KIM
gcuauugaacauucauc

SEQ ID NO: 2293594 - RNA, 22 nt, Yersinia pestis KIM
gcuauuuauccacuaauucauc

SEQ ID NO: 2293595 - RNA, 18 nt, Yersinia pestis KIM
gcuauuggcgagcaugac

SEQ ID NO: 2293596 - RNA, 13 nt, Yersinia pestis KIM
gcuaugcgcaauc

SEQ ID NO: 2293597 - RNA, 22 nt, Yersinia pestis KIM
gcuaucgaugguuggcuaucaa

SEQ ID NO: 2293598 - RNA, 17 nt, Yersinia pestis KIM
gcuagugauagcgggcc

SEQ ID NO: 2293599 - RNA, 14 nt, Yersinia pestis KIM
gcuggaucagcaga

SEQ ID NO: 2293600 - RNA, 12 nt, Yersinia pestis KIM
gcuggaaauuca

SEQ ID NO: 2293601 - RNA, 20 nt, Yersinia pestis KIM
gcugcuguugccaugccaug

SEQ ID NO: 2293602 - RNA, 18 nt, Yersinia pestis KIM
gcugcgggugccgcauua

SEQ ID NO: 2293603 - RNA, 13 nt, Yersinia pestis KIM
gcucucugagcca

SEQ ID NO: 2293604 - RNA, 18 nt, Yersinia pestis KIM
gcucucugagccauccag

SEQ ID NO: 2293605 - RNA, 22 nt, Yersinia pestis KIM
gcucuugagguuauugacaaag

SEQ ID NO: 2293606 - RNA, 14 nt, Yersinia pestis KIM
gcucugucagcccu

SEQ ID NO: 2293607 - RNA, 17 nt, Yersinia pestis KIM
gcugcccgaguaagcgc

SEQ ID NO: 2293608 - RNA, 14 nt, Yersinia pestis KIM
gcugauuaaugagg

SEQ ID NO: 2293609 - RNA, 21 nt, Yersinia pestis KIM
gcugacgcagcaggcguagcg

SEQ ID NO: 2293610 - RNA, 13 nt, Yersinia pestis KIM
gcucuuuacgguc

SEQ ID NO: 2293611 - RNA, 19 nt, Yersinia pestis KIM
gcuuggauuccgucgccaa

SEQ ID NO: 2293612 - RNA, 22 nt, Yersinia pestis KIM
gcuugcugguauucaucagcaa

SEQ ID NO: 2293613 - RNA, 20 nt, Yersinia pestis KIM
gcuugcuauuaacccgcugc

SEQ ID NO: 2293614 - RNA, 17 nt, Yersinia pestis KIM
gcuugcuuugcuucauc

SEQ ID NO: 2293615 - RNA, 21 nt, Yersinia pestis KIM
gcuuuuuuacgcgccugcuca

SEQ ID NO: 2293616 - RNA, 15 nt, Yersinia pestis KIM
gcuuuauauugccau

SEQ ID NO: 2293617 - RNA, 15 nt, Yersinia pestis KIM
ggaucugcaacuuca

SEQ ID NO: 2293618 - RNA, 20 nt, Yersinia pestis KIM
ggaucaccaccgcauuuuca

SEQ ID NO: 2293619 - RNA, 12 nt, Yersinia pestis KIM
ggagaucgcucu

SEQ ID NO: 2293620 - RNA, 21 nt, Yersinia pestis KIM
ggagauuucagacugcugaca

SEQ ID NO: 2293621 - RNA, 23 nt, Yersinia pestis KIM
ggauaccaaucccuacggcaauc

SEQ ID NO: 2293622 - RNA, 18 nt, Yersinia pestis KIM
gccggaaaagagauagca

SEQ ID NO: 2293623 - RNA, 14 nt, Yersinia pestis KIM
gccgauacgaucau

SEQ ID NO: 2293624 - RNA, 20 nt, Yersinia pestis KIM
gccgacaaacccacacccuu

SEQ ID NO: 2293625 - RNA, 18 nt, Yersinia pestis KIM
gccgaaugauucauugag

SEQ ID NO: 2293626 - RNA, 17 nt, Yersinia pestis KIM
gccgaccugcaacgcca

SEQ ID NO: 2293627 - RNA, 20 nt, Yersinia pestis KIM
gccagcaucgucauugccag

SEQ ID NO: 2293628 - RNA, 18 nt, Yersinia pestis KIM
gccagcaugugguuacca

SEQ ID NO: 2293629 - RNA, 22 nt, Yersinia pestis KIM
gccacgaguuuucccugcgcca

SEQ ID NO: 2293630 - RNA, 17 nt, Yersinia pestis KIM
gccagaucaaugugguu

SEQ ID NO: 2293631 - RNA, 23 nt, Yersinia pestis KIM
gccaucagcgccgccucuucugu

SEQ ID NO: 2293632 - RNA, 21 nt, Yersinia pestis KIM
gccauagguuagugguucacc

SEQ ID NO: 2293633 - RNA, 14 nt, Yersinia pestis KIM
gccauagaauaccc

SEQ ID NO: 2293634 - RNA, 22 nt, Yersinia pestis KIM
gcccaaccccccauugccaaau

SEQ ID NO: 2293635 - RNA, 13 nt, Yersinia pestis KIM
gccauugcauauu

SEQ ID NO: 2293636 - RNA, 15 nt, Yersinia pestis KIM
gccaugggucauuaa

SEQ ID NO: 2293637 - RNA, 14 nt, Yersinia pestis KIM
gcccccaaugacac

SEQ ID NO: 2293638 - RNA, 13 nt, Yersinia pestis KIM
gcccccaaugaca

SEQ ID NO: 2293639 - RNA, 18 nt, Yersinia pestis KIM
gcccccaauaagggccac

SEQ ID NO: 2293640 - RNA, 17 nt, Yersinia pestis KIM
gcccccccgaugacacg

SEQ ID NO: 2293641 - RNA, 22 nt, Yersinia pestis KIM
gcccccaucacuagggggcaau

SEQ ID NO: 2293642 - RNA, 22 nt, Yersinia pestis KIM
gccccaccgauauugauagcca

SEQ ID NO: 2293643 - RNA, 14 nt, Yersinia pestis KIM
gccccaaaugccag

SEQ ID NO: 2293644 - RNA, 14 nt, Yersinia pestis KIM
gccccacaaugaau

SEQ ID NO: 2293645 - RNA, 13 nt, Yersinia pestis KIM
gccccaaaugcca

SEQ ID NO: 2293646 - RNA, 17 nt, Yersinia pestis KIM
gcccagcggccaugacg

SEQ ID NO: 2293647 - RNA, 18 nt, Yersinia pestis KIM
gccccucagacugcugac

SEQ ID NO: 2293648 - RNA, 11 nt, Yersinia pestis KIM
gcacuggaugu

SEQ ID NO: 2293649 - RNA, 17 nt, Yersinia pestis KIM
gcacuggcguuggcaau

SEQ ID NO: 2293650 - RNA, 15 nt, Yersinia pestis KIM
gcacuaaaccaucag

SEQ ID NO: 2293651 - RNA, 18 nt, Yersinia pestis KIM
gcacaccggccaaaauca

SEQ ID NO: 2293652 - RNA, 21 nt, Yersinia pestis KIM
gcagaaagugacccaagauga

SEQ ID NO: 2293653 - RNA, 20 nt, Yersinia pestis KIM
gcagaaauaaauauccuccg

SEQ ID NO: 2293654 - RNA, 23 nt, Yersinia pestis KIM
gcagaaaagcaaaggcccgcuau

SEQ ID NO: 2293655 - RNA, 20 nt, Yersinia pestis KIM
gcagagagcgacucacgacg

SEQ ID NO: 2293656 - RNA, 16 nt, Yersinia pestis KIM
gcaggugcguuaucuu

SEQ ID NO: 2293657 - RNA, 23 nt, Yersinia pestis KIM
gcagguucaacgggugacgcugg

SEQ ID NO: 2293658 - RNA, 17 nt, Yersinia pestis KIM
gcauagacgaaggcacg

SEQ ID NO: 2293659 - RNA, 14 nt, Yersinia pestis KIM
gcauaaaacgauuu

SEQ ID NO: 2293660 - RNA, 14 nt, Yersinia pestis KIM
gcagugcuucauca

SEQ ID NO: 2293661 - RNA, 16 nt, Yersinia pestis KIM
gcaucacgauagccag

SEQ ID NO: 2293662 - RNA, 13 nt, Yersinia pestis KIM
gcaucaccaucau

SEQ ID NO: 2293663 - RNA, 14 nt, Yersinia pestis KIM
gcaucaaugaaaau

SEQ ID NO: 2293664 - RNA, 20 nt, Yersinia pestis KIM
gcaucgcgguuuuuccgccg

SEQ ID NO: 2293665 - RNA, 21 nt, Yersinia pestis KIM
gcaucuagcagugauuucagu

SEQ ID NO: 2293666 - RNA, 22 nt, Yersinia pestis KIM
gcaucucgauacauaccauaag

SEQ ID NO: 2293667 - RNA, 22 nt, Yersinia pestis KIM
gcaucuggccagaugauaccgc

SEQ ID NO: 2293668 - RNA, 16 nt, Yersinia pestis KIM
gcaugaaaacccuguu

SEQ ID NO: 2293669 - RNA, 15 nt, Yersinia pestis KIM
gcaugaugaauacgg

SEQ ID NO: 2293670 - RNA, 19 nt, Yersinia pestis KIM
gccaacacucaugacaaaa

SEQ ID NO: 2293671 - RNA, 15 nt, Yersinia pestis KIM
gccaaaacagccuaa

SEQ ID NO: 2293672 - RNA, 18 nt, Yersinia pestis KIM
gccaaaauaauuaccguu

SEQ ID NO: 2293673 - RNA, 18 nt, Yersinia pestis KIM
gcauugauuucaaugccg

SEQ ID NO: 2293674 - RNA, 20 nt, Yersinia pestis KIM
gcauucagguguucagccaa

SEQ ID NO: 2293675 - RNA, 23 nt, Yersinia pestis KIM
gcaugguuaaaacucaaacugau

SEQ ID NO: 2293676 - RNA, 19 nt, Yersinia pestis KIM
gauaugacuaaacugauca

SEQ ID NO: 2293677 - RNA, 17 nt, Yersinia pestis KIM
gauaugacuaaacugau

SEQ ID NO: 2293678 - RNA, 23 nt, Yersinia pestis KIM
gauauagccuucuucacgcaagg

SEQ ID NO: 2293679 - RNA, 16 nt, Yersinia pestis KIM
gauaguuaucucccau

SEQ ID NO: 2293680 - RNA, 17 nt, Yersinia pestis KIM
gauaccgccaaucucuc

SEQ ID NO: 2293681 - RNA, 18 nt, Yersinia pestis KIM
gauaccacaucaaaccgg

SEQ ID NO: 2293682 - RNA, 19 nt, Yersinia pestis KIM
gauaccagcgaagugccgc

SEQ ID NO: 2293683 - RNA, 18 nt, Yersinia pestis KIM
gauaaagaugaaggucac

SEQ ID NO: 2293684 - RNA, 21 nt, Yersinia pestis KIM
gauaaauacggucaacgauug

SEQ ID NO: 2293685 - RNA, 16 nt, Yersinia pestis KIM
gauaaauacaggcucu

SEQ ID NO: 2293686 - RNA, 19 nt, Yersinia pestis KIM
gauagaguacucggcuacg

SEQ ID NO: 2293687 - RNA, 23 nt, Yersinia pestis KIM
gauagaguugauaaacaauaaac

SEQ ID NO: 2293688 - RNA, 14 nt, Yersinia pestis KIM
gagucgcaaaacuu

SEQ ID NO: 2293689 - RNA, 22 nt, Yersinia pestis KIM
gagugaaguaucaccacguuga

SEQ ID NO: 2293690 - RNA, 18 nt, Yersinia pestis KIM
gauaaaaauaaucaauga

SEQ ID NO: 2293691 - RNA, 15 nt, Yersinia pestis KIM
gauaaaacaauagcu

SEQ ID NO: 2293692 - RNA, 22 nt, Yersinia pestis KIM
gaguguuggccucagacuaaug

SEQ ID NO: 2293693 - RNA, 13 nt, Yersinia pestis KIM
gaucucugcgaca

SEQ ID NO: 2293694 - RNA, 23 nt, Yersinia pestis KIM
gaucugccccuggcucaguagca

SEQ ID NO: 2293695 - RNA, 13 nt, Yersinia pestis KIM
gaucugaagaugc

SEQ ID NO: 2293696 - RNA, 13 nt, Yersinia pestis KIM
gaugaauccagcc

SEQ ID NO: 2293697 - RNA, 17 nt, Yersinia pestis KIM
gaucaggaucaccagca

SEQ ID NO: 2293698 - RNA, 20 nt, Yersinia pestis KIM
gaucaucgggcauucacugc

SEQ ID NO: 2293699 - RNA, 19 nt, Yersinia pestis KIM
gaucauccgcucagcaaaa

SEQ ID NO: 2293700 - RNA, 19 nt, Yersinia pestis KIM
gaucaugcucaccauguac

SEQ ID NO: 2293701 - RNA, 20 nt, Yersinia pestis KIM
gaucgauaguaacaccagca

SEQ ID NO: 2293702 - RNA, 12 nt, Yersinia pestis KIM
gaugcugccucu

SEQ ID NO: 2293703 - RNA, 16 nt, Yersinia pestis KIM
gauggcgauagugacu

SEQ ID NO: 2293704 - RNA, 20 nt, Yersinia pestis KIM
gaugccuauuugcagaaagu

SEQ ID NO: 2293705 - RNA, 15 nt, Yersinia pestis KIM
gauuuaaaaucccuc

SEQ ID NO: 2293706 - RNA, 12 nt, Yersinia pestis KIM
gauucgggugag

SEQ ID NO: 2293707 - RNA, 17 nt, Yersinia pestis KIM
gauucgggugagugaac

SEQ ID NO: 2293708 - RNA, 19 nt, Yersinia pestis KIM
gauuacguuccacugcuuu

SEQ ID NO: 2293709 - RNA, 15 nt, Yersinia pestis KIM
gauuaccugcauauc

SEQ ID NO: 2293710 - RNA, 20 nt, Yersinia pestis KIM
gauuagccugaccgguaaua

SEQ ID NO: 2293711 - RNA, 15 nt, Yersinia pestis KIM
gauuuagacaagcgc

SEQ ID NO: 2293712 - RNA, 24 nt, Yersinia pestis KIM
gcaaaccgaauaccauaacgcugc

SEQ ID NO: 2293713 - RNA, 20 nt, Yersinia pestis KIM
gcaaacaggcccacugcaac

SEQ ID NO: 2293714 - RNA, 12 nt, Yersinia pestis KIM
gcaaaguguaau

SEQ ID NO: 2293715 - RNA, 16 nt, Yersinia pestis KIM
gcaacaauaaagcggu

SEQ ID NO: 2293716 - RNA, 14 nt, Yersinia pestis KIM
gcaacacccugugu

SEQ ID NO: 2293717 - RNA, 15 nt, Yersinia pestis KIM
gcacaaucagggcac

SEQ ID NO: 2293718 - RNA, 17 nt, Yersinia pestis KIM
gcaauguguuugcgagc

SEQ ID NO: 2293719 - RNA, 18 nt, Yersinia pestis KIM
gacacccgcuucauucgc

SEQ ID NO: 2293720 - RNA, 14 nt, Yersinia pestis KIM
gacaccaauaccga

SEQ ID NO: 2293721 - RNA, 15 nt, Yersinia pestis KIM
gacauccaauucagu

SEQ ID NO: 2293722 - RNA, 14 nt, Yersinia pestis KIM
gaccaccaauuuca

SEQ ID NO: 2293723 - RNA, 13 nt, Yersinia pestis KIM
gaaucacgcguuc

SEQ ID NO: 2293724 - RNA, 19 nt, Yersinia pestis KIM
gaauaauaggcugaucaac

SEQ ID NO: 2293725 - RNA, 21 nt, Yersinia pestis KIM
gaauaacuucgcgaacacaau

SEQ ID NO: 2293726 - RNA, 20 nt, Yersinia pestis KIM
gacaacuuagguucaaucgg

SEQ ID NO: 2293727 - RNA, 12 nt, Yersinia pestis KIM
gacaagcccgau

SEQ ID NO: 2293728 - RNA, 19 nt, Yersinia pestis KIM
gacaauccuaucguuuauu

SEQ ID NO: 2293729 - RNA, 21 nt, Yersinia pestis KIM
gaaugucaugguuaaacugac

SEQ ID NO: 2293730 - RNA, 15 nt, Yersinia pestis KIM
gaaugagaugaacac

SEQ ID NO: 2293731 - RNA, 12 nt, Yersinia pestis KIM
gaauuugcuagc

SEQ ID NO: 2293732 - RNA, 16 nt, Yersinia pestis KIM
gacaaaaauaagcgua

SEQ ID NO: 2293733 - RNA, 16 nt, Yersinia pestis KIM
gaauuuuucccugcug

SEQ ID NO: 2293734 - RNA, 12 nt, Yersinia pestis KIM
gacggaacacgu

SEQ ID NO: 2293735 - RNA, 15 nt, Yersinia pestis KIM
gacgcuggcacugga

SEQ ID NO: 2293736 - RNA, 14 nt, Yersinia pestis KIM
gacgcccccgccag

SEQ ID NO: 2293737 - RNA, 23 nt, Yersinia pestis KIM
gacgugcagcgcgcagccaacgg

SEQ ID NO: 2293738 - RNA, 23 nt, Yersinia pestis KIM
gacgugcucgucuucgacagcag

SEQ ID NO: 2293739 - RNA, 21 nt, Yersinia pestis KIM
gacgguugugguauggauauu

SEQ ID NO: 2293740 - RNA, 15 nt, Yersinia pestis KIM
gacggguauaucacu

SEQ ID NO: 2293741 - RNA, 13 nt, Yersinia pestis KIM
gacggcugacaaa

SEQ ID NO: 2293742 - RNA, 15 nt, Yersinia pestis KIM
gagacccguuacugc

SEQ ID NO: 2293743 - RNA, 19 nt, Yersinia pestis KIM
gagaauagacagaagcgua

SEQ ID NO: 2293744 - RNA, 18 nt, Yersinia pestis KIM
gagaauaaauauucggua

SEQ ID NO: 2293745 - RNA, 15 nt, Yersinia pestis KIM
gagaacgggcaaccu

SEQ ID NO: 2293746 - RNA, 13 nt, Yersinia pestis KIM
gagagucagcaag

SEQ ID NO: 2293747 - RNA, 13 nt, Yersinia pestis KIM
gagauaacgcuga

SEQ ID NO: 2293748 - RNA, 19 nt, Yersinia pestis KIM
gagagccaaaauggcguug

SEQ ID NO: 2293749 - RNA, 22 nt, Yersinia pestis KIM
gagcaccgcugcuuuuacgcaa

SEQ ID NO: 2293750 - RNA, 21 nt, Yersinia pestis KIM
gagauuauuggcgauuuaaug

SEQ ID NO: 2293751 - RNA, 14 nt, Yersinia pestis KIM
gacugcuaauacca

SEQ ID NO: 2293752 - RNA, 16 nt, Yersinia pestis KIM
gacucgaucuugaacg

SEQ ID NO: 2293753 - RNA, 22 nt, Yersinia pestis KIM
gacugauaccggaaaaugcgcc

SEQ ID NO: 2293754 - RNA, 17 nt, Yersinia pestis KIM
gacucccugacucccuc

SEQ ID NO: 2293755 - RNA, 15 nt, Yersinia pestis KIM
gacucauaaucgcuu

SEQ ID NO: 2293756 - RNA, 17 nt, Yersinia pestis KIM
gacucacguauuuucau

SEQ ID NO: 2293757 - RNA, 19 nt, Yersinia pestis KIM
gacuaucccuucaaucagc

SEQ ID NO: 2293758 - RNA, 18 nt, Yersinia pestis KIM
gaacccgcuaacaugcca

SEQ ID NO: 2293759 - RNA, 13 nt, Yersinia pestis KIM
gaacccugacggc

SEQ ID NO: 2293760 - RNA, 17 nt, Yersinia pestis KIM
gaaccaccgcagccgca

SEQ ID NO: 2293761 - RNA, 16 nt, Yersinia pestis KIM
gaacucaacaauuucg

SEQ ID NO: 2293762 - RNA, 16 nt, Yersinia pestis KIM
gaaccugagcgaucaa

SEQ ID NO: 2293763 - RNA, 15 nt, Yersinia pestis KIM
gaacaggcagaucgu

SEQ ID NO: 2293764 - RNA, 20 nt, Yersinia pestis KIM
gaacaguuacaggucaacac

SEQ ID NO: 2293765 - RNA, 23 nt, Yersinia pestis KIM
gaacauagcuauuggcugauuca

SEQ ID NO: 2293766 - RNA, 18 nt, Yersinia pestis KIM
gaacauuauuuuucacga

SEQ ID NO: 2293767 - RNA, 19 nt, Yersinia pestis KIM
gaacauuauuuuucacgag

SEQ ID NO: 2293768 - RNA, 16 nt, Yersinia pestis KIM
gaacaaagagcauuac

SEQ ID NO: 2293769 - RNA, 15 nt, Yersinia pestis KIM
gaaauugucgcuagc

SEQ ID NO: 2293770 - RNA, 12 nt, Yersinia pestis KIM
gaaaugaucacc

SEQ ID NO: 2293771 - RNA, 22 nt, Yersinia pestis KIM
cuugcuuaucaccccuucacuc

SEQ ID NO: 2293772 - RNA, 11 nt, Yersinia pestis KIM
cuugugaugaa

SEQ ID NO: 2293773 - RNA, 21 nt, Yersinia pestis KIM
cuuggugcccgguugccugac

SEQ ID NO: 2293774 - RNA, 15 nt, Yersinia pestis KIM
cuuuauccacuuggc

SEQ ID NO: 2293775 - RNA, 13 nt, Yersinia pestis KIM
cuuuauauucaau

SEQ ID NO: 2293776 - RNA, 19 nt, Yersinia pestis KIM
cuuuacucuucagccuauc

SEQ ID NO: 2293777 - RNA, 20 nt, Yersinia pestis KIM
cuuuacucuucugccuaucc

SEQ ID NO: 2293778 - RNA, 15 nt, Yersinia pestis KIM
cuuuaccuacaaccu

SEQ ID NO: 2293779 - RNA, 13 nt, Yersinia pestis KIM
cuuuacgaucugc

SEQ ID NO: 2293780 - RNA, 23 nt, Yersinia pestis KIM
cuuuacggucgucgagaauaacg

SEQ ID NO: 2293781 - RNA, 20 nt, Yersinia pestis KIM
cuuuacuccccugccuaucc

SEQ ID NO: 2293782 - RNA, 19 nt, Yersinia pestis KIM
cuuuacuccucugccuauc

SEQ ID NO: 2293783 - RNA, 20 nt, Yersinia pestis KIM
cuuuacuccucugccuaucc

SEQ ID NO: 2293784 - RNA, 13 nt, Yersinia pestis KIM
cuuuaaauccauc

SEQ ID NO: 2293785 - RNA, 14 nt, Yersinia pestis KIM
gaaagaagacauau

SEQ ID NO: 2293786 - RNA, 22 nt, Yersinia pestis KIM
gaaauaaauauccuccggcaua

SEQ ID NO: 2293787 - RNA, 19 nt, Yersinia pestis KIM
gaaagugacccaagaugac

SEQ ID NO: 2293788 - RNA, 17 nt, Yersinia pestis KIM
cuuuauugcuccuuacu

SEQ ID NO: 2293789 - RNA, 20 nt, Yersinia pestis KIM
cuuuauuccucugccuauuc

SEQ ID NO: 2293790 - RNA, 16 nt, Yersinia pestis KIM
cuuuuggcagcaccag

SEQ ID NO: 2293791 - RNA, 16 nt, Yersinia pestis KIM
cuuuuuacgccuaucc

SEQ ID NO: 2293792 - RNA, 18 nt, Yersinia pestis KIM
gaaaaugcgccagccaau

SEQ ID NO: 2293793 - RNA, 19 nt, Yersinia pestis KIM
cuggccagaugauaccgcg

SEQ ID NO: 2293794 - RNA, 19 nt, Yersinia pestis KIM
cuggcgguuucaccuaucg

SEQ ID NO: 2293795 - RNA, 20 nt, Yersinia pestis KIM
cugggauaugccguauacgu

SEQ ID NO: 2293796 - RNA, 22 nt, Yersinia pestis KIM
cugguaauucgcuauaugguaa

SEQ ID NO: 2293797 - RNA, 12 nt, Yersinia pestis KIM
cuggugccguuu

SEQ ID NO: 2293798 - RNA, 14 nt, Yersinia pestis KIM
cuuccuguacguua

SEQ ID NO: 2293799 - RNA, 18 nt, Yersinia pestis KIM
cuuccugccaacaacuua

SEQ ID NO: 2293800 - RNA, 15 nt, Yersinia pestis KIM
cuucgcgaucauggu

SEQ ID NO: 2293801 - RNA, 15 nt, Yersinia pestis KIM
cuucggacggcugac

SEQ ID NO: 2293802 - RNA, 22 nt, Yersinia pestis KIM
cuucgcuuuacccugguuagca

SEQ ID NO: 2293803 - RNA, 22 nt, Yersinia pestis KIM
cuuccaguggcucgacggccaa

SEQ ID NO: 2293804 - RNA, 23 nt, Yersinia pestis KIM
cuucaguggcuggaaaggaauau

SEQ ID NO: 2293805 - RNA, 20 nt, Yersinia pestis KIM
cuucagaugaauccagccau

SEQ ID NO: 2293806 - RNA, 15 nt, Yersinia pestis KIM
cuguagcucauacuc

SEQ ID NO: 2293807 - RNA, 18 nt, Yersinia pestis KIM
cuguaggugucaccaacg

SEQ ID NO: 2293808 - RNA, 23 nt, Yersinia pestis KIM
cuguacugcugcaacucauuaac

SEQ ID NO: 2293809 - RNA, 20 nt, Yersinia pestis KIM
cuguacugcugcaacucauu

SEQ ID NO: 2293810 - RNA, 22 nt, Yersinia pestis KIM
cuguaguucaauggucaugcac

SEQ ID NO: 2293811 - RNA, 20 nt, Yersinia pestis KIM
cuguauaaaaauagccuucc

SEQ ID NO: 2293812 - RNA, 16 nt, Yersinia pestis KIM
cugguugcagcacgcc

SEQ ID NO: 2293813 - RNA, 14 nt, Yersinia pestis KIM
cugguugagauaac

SEQ ID NO: 2293814 - RNA, 20 nt, Yersinia pestis KIM
cugguuagagcacagcacuc

SEQ ID NO: 2293815 - RNA, 23 nt, Yersinia pestis KIM
cuguaaaaucuuucuguucagca

SEQ ID NO: 2293816 - RNA, 20 nt, Yersinia pestis KIM
cuguaaugccccacuucacg

SEQ ID NO: 2293817 - RNA, 23 nt, Yersinia pestis KIM
cuguaacugccaguucaucagcc

SEQ ID NO: 2293818 - RNA, 19 nt, Yersinia pestis KIM
cuguaauggcgcacauuac

SEQ ID NO: 2293819 - RNA, 13 nt, Yersinia pestis KIM
cuguucaccgauu

SEQ ID NO: 2293820 - RNA, 15 nt, Yersinia pestis KIM
cuguuaguucagacg

SEQ ID NO: 2293821 - RNA, 21 nt, Yersinia pestis KIM
cugugcgauuucacggauauc

SEQ ID NO: 2293822 - RNA, 19 nt, Yersinia pestis KIM
cugugcggaucccguuuca

SEQ ID NO: 2293823 - RNA, 19 nt, Yersinia pestis KIM
cugugccaacaucgcgcug

SEQ ID NO: 2293824 - RNA, 15 nt, Yersinia pestis KIM
cuuaaaaaacgauua

SEQ ID NO: 2293825 - RNA, 22 nt, Yersinia pestis KIM
cuuagauugcaaaucacgcaau

SEQ ID NO: 2293826 - RNA, 23 nt, Yersinia pestis KIM
cuuaguauccgcgccagacuggc

SEQ ID NO: 2293827 - RNA, 17 nt, Yersinia pestis KIM
cuguucuuuuggcgauc

SEQ ID NO: 2293828 - RNA, 20 nt, Yersinia pestis KIM
cuguugcuaggcgcagcagg

SEQ ID NO: 2293829 - RNA, 21 nt, Yersinia pestis KIM
cguucacugaccgauugaauc

SEQ ID NO: 2293830 - RNA, 17 nt, Yersinia pestis KIM
cguuaaacccugucguu

SEQ ID NO: 2293831 - RNA, 14 nt, Yersinia pestis KIM
cguuaagaacgcuu

SEQ ID NO: 2293832 - RNA, 16 nt, Yersinia pestis KIM
cguuacccacauuaaa

SEQ ID NO: 2293833 - RNA, 21 nt, Yersinia pestis KIM
cguuacacaucaggcuguuga

SEQ ID NO: 2293834 - RNA, 16 nt, Yersinia pestis KIM
cguuagccuacuggcg

SEQ ID NO: 2293835 - RNA, 13 nt, Yersinia pestis KIM
cguuagguucaau

SEQ ID NO: 2293836 - RNA, 16 nt, Yersinia pestis KIM
cguucaaaucugcucc

SEQ ID NO: 2293837 - RNA, 17 nt, Yersinia pestis KIM
cguggcauaaucaacgc

SEQ ID NO: 2293838 - RNA, 22 nt, Yersinia pestis KIM
cguggccgugacuacgguguuu

SEQ ID NO: 2293839 - RNA, 12 nt, Yersinia pestis KIM
cguggugaugau

SEQ ID NO: 2293840 - RNA, 19 nt, Yersinia pestis KIM
cguguaguuauugauuaau

SEQ ID NO: 2293841 - RNA, 17 nt, Yersinia pestis KIM
cguguacuuucccugcu

SEQ ID NO: 2293842 - RNA, 16 nt, Yersinia pestis KIM
cgugcauaaaacgauu

SEQ ID NO: 2293843 - RNA, 17 nt, Yersinia pestis KIM
cgugauugagcguugau

SEQ ID NO: 2293844 - RNA, 21 nt, Yersinia pestis KIM
cgugauuuuuauauuuugaga

SEQ ID NO: 2293845 - RNA, 19 nt, Yersinia pestis KIM
cgugccgaagugcauauua

SEQ ID NO: 2293846 - RNA, 15 nt, Yersinia pestis KIM
cgucaucgaacccgc

SEQ ID NO: 2293847 - RNA, 21 nt, Yersinia pestis KIM
cgucauugccagugaacccgc

SEQ ID NO: 2293848 - RNA, 15 nt, Yersinia pestis KIM
cgucauucuuugcca

SEQ ID NO: 2293849 - RNA, 14 nt, Yersinia pestis KIM
cguccagaugccaa

SEQ ID NO: 2293850 - RNA, 21 nt, Yersinia pestis KIM
cguccagaacaauaccgccaa

SEQ ID NO: 2293851 - RNA, 18 nt, Yersinia pestis KIM
cguccgucauccaaugac

SEQ ID NO: 2293852 - RNA, 23 nt, Yersinia pestis KIM
cguaauaucugccaccgcacagu

SEQ ID NO: 2293853 - RNA, 22 nt, Yersinia pestis KIM
cguauuaaaccagugcgccgua

SEQ ID NO: 2293854 - RNA, 21 nt, Yersinia pestis KIM
cguauuaucaguaacgccgua

SEQ ID NO: 2293855 - RNA, 17 nt, Yersinia pestis KIM
cguaaaucgguugccau

SEQ ID NO: 2293856 - RNA, 17 nt, Yersinia pestis KIM
cguaaacguucugccaa

SEQ ID NO: 2293857 - RNA, 18 nt, Yersinia pestis KIM
cgguuccaaagcaccaac

SEQ ID NO: 2293858 - RNA, 12 nt, Yersinia pestis KIM
cgguuauuuaga

SEQ ID NO: 2293859 - RNA, 19 nt, Yersinia pestis KIM
cgguuauucguggugauga

SEQ ID NO: 2293860 - RNA, 15 nt, Yersinia pestis KIM
cgguguuccacaaug

SEQ ID NO: 2293861 - RNA, 15 nt, Yersinia pestis KIM
cgguguaguuaaggu

SEQ ID NO: 2293862 - RNA, 22 nt, Yersinia pestis KIM
cucgagccgcgcccucccuggc

SEQ ID NO: 2293863 - RNA, 22 nt, Yersinia pestis KIM
cucgaaaauacaauauggguau

SEQ ID NO: 2293864 - RNA, 20 nt, Yersinia pestis KIM
cucgaaaucauccgcggcaa

SEQ ID NO: 2293865 - RNA, 23 nt, Yersinia pestis KIM
cuccuccuuggggccucacucug

SEQ ID NO: 2293866 - RNA, 23 nt, Yersinia pestis KIM
cuccggcgacuaagacuguuuua

SEQ ID NO: 2293867 - RNA, 17 nt, Yersinia pestis KIM
cucgcccaugaccacuu

SEQ ID NO: 2293868 - RNA, 16 nt, Yersinia pestis KIM
cuacucguaacgacga

SEQ ID NO: 2293869 - RNA, 23 nt, Yersinia pestis KIM
cuacugggcuacccgacaccggc

SEQ ID NO: 2293870 - RNA, 16 nt, Yersinia pestis KIM
cuacuuuggguauccu

SEQ ID NO: 2293871 - RNA, 21 nt, Yersinia pestis KIM
cuaccgacgauaaucaggcua

SEQ ID NO: 2293872 - RNA, 20 nt, Yersinia pestis KIM
cuacaucauaacgaaugagc

SEQ ID NO: 2293873 - RNA, 13 nt, Yersinia pestis KIM
cuacagaaaaccc

SEQ ID NO: 2293874 - RNA, 21 nt, Yersinia pestis KIM
cucaacguauucccgcuaccg

SEQ ID NO: 2293875 - RNA, 14 nt, Yersinia pestis KIM
cucaaugcuuaaca

SEQ ID NO: 2293876 - RNA, 19 nt, Yersinia pestis KIM
cucaauggcuuuuuuacgc

SEQ ID NO: 2293877 - RNA, 15 nt, Yersinia pestis KIM
cuaugcaguuaaggc

SEQ ID NO: 2293878 - RNA, 21 nt, Yersinia pestis KIM
cucaaaggagacuucgccaau

SEQ ID NO: 2293879 - RNA, 14 nt, Yersinia pestis KIM
cucaaccgcuggca

SEQ ID NO: 2293880 - RNA, 18 nt, Yersinia pestis KIM
cuagcaacacaucgguau

SEQ ID NO: 2293881 - RNA, 19 nt, Yersinia pestis KIM
cuaucaucccaccgaaagc

SEQ ID NO: 2293882 - RNA, 20 nt, Yersinia pestis KIM
cuaucugaaacugagauuug

SEQ ID NO: 2293883 - RNA, 13 nt, Yersinia pestis KIM
cuaucaucaccau

SEQ ID NO: 2293884 - RNA, 15 nt, Yersinia pestis KIM
cuaucacuagcgggc

SEQ ID NO: 2293885 - RNA, 19 nt, Yersinia pestis KIM
cuauaugguaacgaaugcu

SEQ ID NO: 2293886 - RNA, 20 nt, Yersinia pestis KIM
cucauuaaucagcauuaacc

SEQ ID NO: 2293887 - RNA, 16 nt, Yersinia pestis KIM
cucauucagacccgau

SEQ ID NO: 2293888 - RNA, 15 nt, Yersinia pestis KIM
cucccgcuaacgcac

SEQ ID NO: 2293889 - RNA, 24 nt, Yersinia pestis KIM
cucaucauuauagaauucauucag

SEQ ID NO: 2293890 - RNA, 14 nt, Yersinia pestis KIM
cucaucggcguuac

SEQ ID NO: 2293891 - RNA, 22 nt, Yersinia pestis KIM
cucacgucaguaaugaggguaa

SEQ ID NO: 2293892 - RNA, 18 nt, Yersinia pestis KIM
cugccuauuuaucguuac

SEQ ID NO: 2293893 - RNA, 19 nt, Yersinia pestis KIM
cugccuuuuuugauaauca

SEQ ID NO: 2293894 - RNA, 21 nt, Yersinia pestis KIM
cugcgaccaaggcucuggcaa

SEQ ID NO: 2293895 - RNA, 15 nt, Yersinia pestis KIM
cugccgcaacggcac

SEQ ID NO: 2293896 - RNA, 22 nt, Yersinia pestis KIM
cugccauaauccagaagccauu

SEQ ID NO: 2293897 - RNA, 20 nt, Yersinia pestis KIM
cugccaguaaaaucaucagc

SEQ ID NO: 2293898 - RNA, 15 nt, Yersinia pestis KIM
cugcauacagaucga

SEQ ID NO: 2293899 - RNA, 21 nt, Yersinia pestis KIM
cugcauaagcaucaguaauuu

SEQ ID NO: 2293900 - RNA, 22 nt, Yersinia pestis KIM
cugcauugcguugauuugcgcg

SEQ ID NO: 2293901 - RNA, 16 nt, Yersinia pestis KIM
cucuacucgcucacca

SEQ ID NO: 2293902 - RNA, 22 nt, Yersinia pestis KIM
cugacauuugcaucuauggauu

SEQ ID NO: 2293903 - RNA, 14 nt, Yersinia pestis KIM
cugacacugcaucu

SEQ ID NO: 2293904 - RNA, 22 nt, Yersinia pestis KIM
cugaacuucugggaucaucgcu

SEQ ID NO: 2293905 - RNA, 21 nt, Yersinia pestis KIM
cugaauaaacggcaagcggug

SEQ ID NO: 2293906 - RNA, 16 nt, Yersinia pestis KIM
cugaaccacgcauugu

SEQ ID NO: 2293907 - RNA, 16 nt, Yersinia pestis KIM
cucuuucccuucaggu

SEQ ID NO: 2293908 - RNA, 16 nt, Yersinia pestis KIM
cucuugcucuucgggu

SEQ ID NO: 2293909 - RNA, 15 nt, Yersinia pestis KIM
cucuauugcucauca

SEQ ID NO: 2293910 - RNA, 16 nt, Yersinia pestis KIM
cucugcgacaucagcg

SEQ ID NO: 2293911 - RNA, 19 nt, Yersinia pestis KIM
cugaccauuacguaauagu

SEQ ID NO: 2293912 - RNA, 22 nt, Yersinia pestis KIM
cugacggauacgcaaaccaugg

SEQ ID NO: 2293913 - RNA, 17 nt, Yersinia pestis KIM
cugacgcugacauucaa

SEQ ID NO: 2293914 - RNA, 22 nt, Yersinia pestis KIM
cugauaucuucacucagcgcug

SEQ ID NO: 2293915 - RNA, 19 nt, Yersinia pestis KIM
cugaucaaucucaucaauc

SEQ ID NO: 2293916 - RNA, 14 nt, Yersinia pestis KIM
cugauccaguuuca

SEQ ID NO: 2293917 - RNA, 19 nt, Yersinia pestis KIM
cugcagauguauuagcgcu

SEQ ID NO: 2293918 - RNA, 20 nt, Yersinia pestis KIM
cugcagaaugaaguuauccu

SEQ ID NO: 2293919 - RNA, 21 nt, Yersinia pestis KIM
cugcacuggcguuggcaauuc

SEQ ID NO: 2293920 - RNA, 13 nt, Yersinia pestis KIM
cugcacaucaaua

SEQ ID NO: 2293921 - RNA, 15 nt, Yersinia pestis KIM
cugcaacucauuaac

SEQ ID NO: 2293922 - RNA, 20 nt, Yersinia pestis KIM
cgcgauaacgguaucaguca

SEQ ID NO: 2293923 - RNA, 14 nt, Yersinia pestis KIM
cgcgaauauggcau

SEQ ID NO: 2293924 - RNA, 13 nt, Yersinia pestis KIM
cgccguaaacugc

SEQ ID NO: 2293925 - RNA, 15 nt, Yersinia pestis KIM
cgccguaaacugccg

SEQ ID NO: 2293926 - RNA, 13 nt, Yersinia pestis KIM
cgccgucaugcug

SEQ ID NO: 2293927 - RNA, 13 nt, Yersinia pestis KIM
cgccgguaauacc

SEQ ID NO: 2293928 - RNA, 12 nt, Yersinia pestis KIM
cgccucucuggc

SEQ ID NO: 2293929 - RNA, 13 nt, Yersinia pestis KIM
cgccugcucaaca

SEQ ID NO: 2293930 - RNA, 13 nt, Yersinia pestis KIM
cgccucaaugcaa

SEQ ID NO: 2293931 - RNA, 19 nt, Yersinia pestis KIM
cgcgguaacgaaucugcac

SEQ ID NO: 2293932 - RNA, 21 nt, Yersinia pestis KIM
cgcggaggguaaaacugccau

SEQ ID NO: 2293933 - RNA, 22 nt, Yersinia pestis KIM
cgcuguguuuugcuaaccgccu

SEQ ID NO: 2293934 - RNA, 20 nt, Yersinia pestis KIM
cgcuuagcaauaccagccga

SEQ ID NO: 2293935 - RNA, 19 nt, Yersinia pestis KIM
cgcuucgcuggucauaauc

SEQ ID NO: 2293936 - RNA, 21 nt, Yersinia pestis KIM
cgcuugauugauaccacaauc

SEQ ID NO: 2293937 - RNA, 17 nt, Yersinia pestis KIM
cgcuuuaaccuuucuaa

SEQ ID NO: 2293938 - RNA, 17 nt, Yersinia pestis KIM
cgcuuuuuagcgaucag

SEQ ID NO: 2293939 - RNA, 11 nt, Yersinia pestis KIM
cgcugagcggg

SEQ ID NO: 2293940 - RNA, 14 nt, Yersinia pestis KIM
cgcugcagcuuuag

SEQ ID NO: 2293941 - RNA, 18 nt, Yersinia pestis KIM
cgcucgcgugucaaacca

SEQ ID NO: 2293942 - RNA, 12 nt, Yersinia pestis KIM
cgcuaaccgcca

SEQ ID NO: 2293943 - RNA, 22 nt, Yersinia pestis KIM
cgcuaaccgccaguucuggauc

SEQ ID NO: 2293944 - RNA, 22 nt, Yersinia pestis KIM
cgcucacuuuuauauccgccau

SEQ ID NO: 2293945 - RNA, 18 nt, Yersinia pestis KIM
cgcuauaucaucagcaga

SEQ ID NO: 2293946 - RNA, 16 nt, Yersinia pestis KIM
cgcuaugcagcccaga

SEQ ID NO: 2293947 - RNA, 14 nt, Yersinia pestis KIM
cgcuagaccaguua

SEQ ID NO: 2293948 - RNA, 22 nt, Yersinia pestis KIM
cggccgguuucaccgcuuagca

SEQ ID NO: 2293949 - RNA, 13 nt, Yersinia pestis KIM
cggcgauccgccc

SEQ ID NO: 2293950 - RNA, 16 nt, Yersinia pestis KIM
cggccagccuugagcc

SEQ ID NO: 2293951 - RNA, 13 nt, Yersinia pestis KIM
cggccauauuacc

SEQ ID NO: 2293952 - RNA, 23 nt, Yersinia pestis KIM
cggcccagauauccauauucacc

SEQ ID NO: 2293953 - RNA, 14 nt, Yersinia pestis KIM
cggccauguugguc

SEQ ID NO: 2293954 - RNA, 17 nt, Yersinia pestis KIM
cggcaugcaacuuggca

SEQ ID NO: 2293955 - RNA, 12 nt, Yersinia pestis KIM
cggcaucugcca

SEQ ID NO: 2293956 - RNA, 19 nt, Yersinia pestis KIM
cggcagauuggauugaaau

SEQ ID NO: 2293957 - RNA, 22 nt, Yersinia pestis KIM
cggagucuaucugcaguauuug

SEQ ID NO: 2293958 - RNA, 19 nt, Yersinia pestis KIM
cggaaucaccuuucuccau

SEQ ID NO: 2293959 - RNA, 18 nt, Yersinia pestis KIM
cggaucauaaucgauuac

SEQ ID NO: 2293960 - RNA, 19 nt, Yersinia pestis KIM
cggaucagugugggcuggu

SEQ ID NO: 2293961 - RNA, 21 nt, Yersinia pestis KIM
cggauagccgaagaauguauu

SEQ ID NO: 2293962 - RNA, 19 nt, Yersinia pestis KIM
cggaugccggaaucagcca

SEQ ID NO: 2293963 - RNA, 22 nt, Yersinia pestis KIM
cggauggucauccacaaccaga

SEQ ID NO: 2293964 - RNA, 20 nt, Yersinia pestis KIM
cggauugcaacaacgccaga

SEQ ID NO: 2293965 - RNA, 19 nt, Yersinia pestis KIM
cggucuguuaauccuaaug

SEQ ID NO: 2293966 - RNA, 13 nt, Yersinia pestis KIM
cggucuguuaauc

SEQ ID NO: 2293967 - RNA, 23 nt, Yersinia pestis KIM
cggucugggacuuuaucugccaa

SEQ ID NO: 2293968 - RNA, 18 nt, Yersinia pestis KIM
cggucuggcaacugcaaa

SEQ ID NO: 2293969 - RNA, 18 nt, Yersinia pestis KIM
cggucuuuuuacaagcac

SEQ ID NO: 2293970 - RNA, 22 nt, Yersinia pestis KIM
cgguaaugacauauucaaccgc

SEQ ID NO: 2293971 - RNA, 20 nt, Yersinia pestis KIM
cgguaacuuacaggcugccu

SEQ ID NO: 2293972 - RNA, 20 nt, Yersinia pestis KIM
cgguaaguuggcaucagcuc

SEQ ID NO: 2293973 - RNA, 19 nt, Yersinia pestis KIM
cggcuacugcgcuuaccgu

SEQ ID NO: 2293974 - RNA, 21 nt, Yersinia pestis KIM
cggcuacuguuuugguuuccg

SEQ ID NO: 2293975 - RNA, 12 nt, Yersinia pestis KIM
cggcuaaugagc

SEQ ID NO: 2293976 - RNA, 19 nt, Yersinia pestis KIM
cggcucgcccacggcacau

SEQ ID NO: 2293977 - RNA, 23 nt, Yersinia pestis KIM
cggcucaucacaccgcgaucaca

SEQ ID NO: 2293978 - RNA, 23 nt, Yersinia pestis KIM
cgggagauuaauacaucaucaaa

SEQ ID NO: 2293979 - RNA, 14 nt, Yersinia pestis KIM
ccgcugcgauacca

SEQ ID NO: 2293980 - RNA, 15 nt, Yersinia pestis KIM
ccgcugauaaccagc

SEQ ID NO: 2293981 - RNA, 17 nt, Yersinia pestis KIM
ccgcucaucauccauca

SEQ ID NO: 2293982 - RNA, 22 nt, Yersinia pestis KIM
ccgcuuuuaccaacccagcgca

SEQ ID NO: 2293983 - RNA, 17 nt, Yersinia pestis KIM
ccgcuugcauacgcuua

SEQ ID NO: 2293984 - RNA, 12 nt, Yersinia pestis KIM
ccggaucacugg

SEQ ID NO: 2293985 - RNA, 13 nt, Yersinia pestis KIM
ccgccgccagccc

SEQ ID NO: 2293986 - RNA, 11 nt, Yersinia pestis KIM
ccgccagcaga

SEQ ID NO: 2293987 - RNA, 18 nt, Yersinia pestis KIM
ccgcagacugcugacaaa

SEQ ID NO: 2293988 - RNA, 17 nt, Yersinia pestis KIM
ccgauggugugcagcaa

SEQ ID NO: 2293989 - RNA, 14 nt, Yersinia pestis KIM
ccguuugcagcuca

SEQ ID NO: 2293990 - RNA, 17 nt, Yersinia pestis KIM
ccuaaaccuuucagaca

SEQ ID NO: 2293991 - RNA, 18 nt, Yersinia pestis KIM
ccucaaugacgcgaucug

SEQ ID NO: 2293992 - RNA, 14 nt, Yersinia pestis KIM
ccucaacaguacug

SEQ ID NO: 2293993 - RNA, 12 nt, Yersinia pestis KIM
ccuaacggcaua

SEQ ID NO: 2293994 - RNA, 16 nt, Yersinia pestis KIM
ccuaaccaaacauugu

SEQ ID NO: 2293995 - RNA, 21 nt, Yersinia pestis KIM
ccuacacagucuuuuucccaa

SEQ ID NO: 2293996 - RNA, 13 nt, Yersinia pestis KIM
ccuaucauggcug

SEQ ID NO: 2293997 - RNA, 16 nt, Yersinia pestis KIM
ccucagagacaucuuu

SEQ ID NO: 2293998 - RNA, 16 nt, Yersinia pestis KIM
ccucgaacgaagccac

SEQ ID NO: 2293999 - RNA, 15 nt, Yersinia pestis KIM
ccgugagcagcaaua

SEQ ID NO: 2294000 - RNA, 16 nt, Yersinia pestis KIM
ccgugguuauuggccg

SEQ ID NO: 2294001 - RNA, 12 nt, Yersinia pestis KIM
ccgugccugcug

SEQ ID NO: 2294002 - RNA, 21 nt, Yersinia pestis KIM
ccugcucaacugcucaacugc

SEQ ID NO: 2294003 - RNA, 13 nt, Yersinia pestis KIM
ccugcuaggcagg

SEQ ID NO: 2294004 - RNA, 17 nt, Yersinia pestis KIM
ccuggaaccaagcccgc

SEQ ID NO: 2294005 - RNA, 23 nt, Yersinia pestis KIM
ccugcaaauuaaccugcuggcgc

SEQ ID NO: 2294006 - RNA, 17 nt, Yersinia pestis KIM
ccugagguugcucagcg

SEQ ID NO: 2294007 - RNA, 23 nt, Yersinia pestis KIM
ccugcaacgccagugacuuuaac

SEQ ID NO: 2294008 - RNA, 23 nt, Yersinia pestis KIM
ccugcacacgggcgguaaucugc

SEQ ID NO: 2294009 - RNA, 22 nt, Yersinia pestis KIM
ccugacggccagcaaccuggcg

SEQ ID NO: 2294010 - RNA, 16 nt, Yersinia pestis KIM
ccugagauuaaccgcg

SEQ ID NO: 2294011 - RNA, 20 nt, Yersinia pestis KIM
ccggucaacgucaucgccac

SEQ ID NO: 2294012 - RNA, 22 nt, Yersinia pestis KIM
ccggguucaaggaaaccaaugc

SEQ ID NO: 2294013 - RNA, 16 nt, Yersinia pestis KIM
ccgggucguaccggcc

SEQ ID NO: 2294014 - RNA, 14 nt, Yersinia pestis KIM
ccggugguuuagca

SEQ ID NO: 2294015 - RNA, 21 nt, Yersinia pestis KIM
ccggugcggaauguccaguua

SEQ ID NO: 2294016 - RNA, 22 nt, Yersinia pestis KIM
ccguaggccacccccauaacca

SEQ ID NO: 2294017 - RNA, 20 nt, Yersinia pestis KIM
ccgguucccccaccguaaga

SEQ ID NO: 2294018 - RNA, 14 nt, Yersinia pestis KIM
ccggcucauccgcc

SEQ ID NO: 2294019 - RNA, 15 nt, Yersinia pestis KIM
cgccaacaggccuaa

SEQ ID NO: 2294020 - RNA, 17 nt, Yersinia pestis KIM
cgcauaagacaacgccg

SEQ ID NO: 2294021 - RNA, 15 nt, Yersinia pestis KIM
cgcaguuuaucuuca

SEQ ID NO: 2294022 - RNA, 21 nt, Yersinia pestis KIM
cgcagaguccucucaccaaga

SEQ ID NO: 2294023 - RNA, 16 nt, Yersinia pestis KIM
cgccauaacaucggcg

SEQ ID NO: 2294024 - RNA, 14 nt, Yersinia pestis KIM
cgccacgcugaugc

SEQ ID NO: 2294025 - RNA, 23 nt, Yersinia pestis KIM
cgccaauaaccgcagcaggcaga

SEQ ID NO: 2294026 - RNA, 17 nt, Yersinia pestis KIM
cgaucuugaacggugag

SEQ ID NO: 2294027 - RNA, 20 nt, Yersinia pestis KIM
cgauagugacuucgcugcua

SEQ ID NO: 2294028 - RNA, 19 nt, Yersinia pestis KIM
cgauaauggccgccauuac

SEQ ID NO: 2294029 - RNA, 12 nt, Yersinia pestis KIM
cgaucaauacac

SEQ ID NO: 2294030 - RNA, 19 nt, Yersinia pestis KIM
cgauauagucuugaugaaa

SEQ ID NO: 2294031 - RNA, 22 nt, Yersinia pestis KIM
cgcacaugccgucaccucauca

SEQ ID NO: 2294032 - RNA, 23 nt, Yersinia pestis KIM
cgcaauaggcgguugguaauacg

SEQ ID NO: 2294033 - RNA, 18 nt, Yersinia pestis KIM
cgcaauuugcccaucuuu

SEQ ID NO: 2294034 - RNA, 15 nt, Yersinia pestis KIM
cgcaaugucaccuga

SEQ ID NO: 2294035 - RNA, 18 nt, Yersinia pestis KIM
cgcaaugauuacaucacu

SEQ ID NO: 2294036 - RNA, 14 nt, Yersinia pestis KIM
cgcaaugaaccccg

SEQ ID NO: 2294037 - RNA, 13 nt, Yersinia pestis KIM
cgcaaaaucagua

SEQ ID NO: 2294038 - RNA, 14 nt, Yersinia pestis KIM
cgaugcucaauacu

SEQ ID NO: 2294039 - RNA, 13 nt, Yersinia pestis KIM
cgacgcgccauaa

SEQ ID NO: 2294040 - RNA, 20 nt, Yersinia pestis KIM
cgacggacaugcaccguaac

SEQ ID NO: 2294041 - RNA, 13 nt, Yersinia pestis KIM
cgacuccuggcaa

SEQ ID NO: 2294042 - RNA, 23 nt, Yersinia pestis KIM
cgacgccagauagcaucauccag

SEQ ID NO: 2294043 - RNA, 15 nt, Yersinia pestis KIM
cgacgauaaaggcgg

SEQ ID NO: 2294044 - RNA, 22 nt, Yersinia pestis KIM
cgagagauucaugggcuguaaa

SEQ ID NO: 2294045 - RNA, 14 nt, Yersinia pestis KIM
cgagcccaggcgac

SEQ ID NO: 2294046 - RNA, 20 nt, Yersinia pestis KIM
cgacauaaagcaaacgccgc

SEQ ID NO: 2294047 - RNA, 14 nt, Yersinia pestis KIM
cgacauuauguucu

SEQ ID NO: 2294048 - RNA, 17 nt, Yersinia pestis KIM
cgacaccuucaaucauu

SEQ ID NO: 2294049 - RNA, 15 nt, Yersinia pestis KIM
cgacacgcucaucca

SEQ ID NO: 2294050 - RNA, 23 nt, Yersinia pestis KIM
cgaaucugguacuccugcucaaa

SEQ ID NO: 2294051 - RNA, 16 nt, Yersinia pestis KIM
ccuggcaccggacaaa

SEQ ID NO: 2294052 - RNA, 18 nt, Yersinia pestis KIM
ccugugcaccacacagcg

SEQ ID NO: 2294053 - RNA, 17 nt, Yersinia pestis KIM
ccugugccaacaucgcg

SEQ ID NO: 2294054 - RNA, 18 nt, Yersinia pestis KIM
ccuucaacuguggauuau

SEQ ID NO: 2294055 - RNA, 18 nt, Yersinia pestis KIM
ccuguuuuuguuguucuu

SEQ ID NO: 2294056 - RNA, 12 nt, Yersinia pestis KIM
ccuugcgcaauu

SEQ ID NO: 2294057 - RNA, 20 nt, Yersinia pestis KIM
ccuugugucaccaugauuuc

SEQ ID NO: 2294058 - RNA, 23 nt, Yersinia pestis KIM
ccuuuuuaccugacacugcaucu

SEQ ID NO: 2294059 - RNA, 18 nt, Yersinia pestis KIM
caucgcccugaguaacga

SEQ ID NO: 2294060 - RNA, 14 nt, Yersinia pestis KIM
caucgacaauggcu

SEQ ID NO: 2294061 - RNA, 13 nt, Yersinia pestis KIM
cauccagugccaa

SEQ ID NO: 2294062 - RNA, 17 nt, Yersinia pestis KIM
caucagcguuacccaga

SEQ ID NO: 2294063 - RNA, 23 nt, Yersinia pestis KIM
caucaauaaaauuacccagcauc

SEQ ID NO: 2294064 - RNA, 15 nt, Yersinia pestis KIM
cauagcuaaccuuaa

SEQ ID NO: 2294065 - RNA, 21 nt, Yersinia pestis KIM
caucagcagagagcgacucac

SEQ ID NO: 2294066 - RNA, 21 nt, Yersinia pestis KIM
caucagccagccacugggcua

SEQ ID NO: 2294067 - RNA, 18 nt, Yersinia pestis KIM
caucagcaagugauagau

SEQ ID NO: 2294068 - RNA, 12 nt, Yersinia pestis KIM
caucagcaauuu

SEQ ID NO: 2294069 - RNA, 15 nt, Yersinia pestis KIM
caucagcgcuggcuu

SEQ ID NO: 2294070 - RNA, 21 nt, Yersinia pestis KIM
caucaauggauucuugcugca

SEQ ID NO: 2294071 - RNA, 17 nt, Yersinia pestis KIM
cagugcacaucaauacc

SEQ ID NO: 2294072 - RNA, 21 nt, Yersinia pestis KIM
cagugauuaucucaacguauu

SEQ ID NO: 2294073 - RNA, 19 nt, Yersinia pestis KIM
cagugacugaauggcuauu

SEQ ID NO: 2294074 - RNA, 22 nt, Yersinia pestis KIM
caguuaaacgguaaccauccau

SEQ ID NO: 2294075 - RNA, 14 nt, Yersinia pestis KIM
caguggagccauga

SEQ ID NO: 2294076 - RNA, 14 nt, Yersinia pestis KIM
caguggcaucaaua

SEQ ID NO: 2294077 - RNA, 23 nt, Yersinia pestis KIM
cagugcugcgcccaguggagcca

SEQ ID NO: 2294078 - RNA, 15 nt, Yersinia pestis KIM
caguguauuuaucaa

SEQ ID NO: 2294079 - RNA, 13 nt, Yersinia pestis KIM
caguguugacccg

SEQ ID NO: 2294080 - RNA, 21 nt, Yersinia pestis KIM
cauaaucaacgcucaaucacg

SEQ ID NO: 2294081 - RNA, 19 nt, Yersinia pestis KIM
cauaaucgauuacuggcua

SEQ ID NO: 2294082 - RNA, 14 nt, Yersinia pestis KIM
cauaaaaauacaua

SEQ ID NO: 2294083 - RNA, 17 nt, Yersinia pestis KIM
cauaaacggaacucauc

SEQ ID NO: 2294084 - RNA, 21 nt, Yersinia pestis KIM
cauaaagaaaugacaaugaac

SEQ ID NO: 2294085 - RNA, 16 nt, Yersinia pestis KIM
cauaaaauagcccagu

SEQ ID NO: 2294086 - RNA, 15 nt, Yersinia pestis KIM
cauaaagauagccac

SEQ ID NO: 2294087 - RNA, 16 nt, Yersinia pestis KIM
cagguucggcgcaauc

SEQ ID NO: 2294088 - RNA, 15 nt, Yersinia pestis KIM
cagucaauugagaau

SEQ ID NO: 2294089 - RNA, 19 nt, Yersinia pestis KIM
caguaagguauugacacaa

SEQ ID NO: 2294090 - RNA, 22 nt, Yersinia pestis KIM
caguaaagauuauguagauccc

SEQ ID NO: 2294091 - RNA, 16 nt, Yersinia pestis KIM
caguaaaaccagcagc

SEQ ID NO: 2294092 - RNA, 19 nt, Yersinia pestis KIM
caguaacggggcgcacuga

SEQ ID NO: 2294093 - RNA, 20 nt, Yersinia pestis KIM
caguaagcuguugaccugaa

SEQ ID NO: 2294094 - RNA, 17 nt, Yersinia pestis KIM
cagucugaaacgccagc

SEQ ID NO: 2294095 - RNA, 16 nt, Yersinia pestis KIM
cagucuuuuucccaau

SEQ ID NO: 2294096 - RNA, 23 nt, Yersinia pestis KIM
cagugacccuuaucggauuacuu

SEQ ID NO: 2294097 - RNA, 14 nt, Yersinia pestis KIM
caggcgcuacgcaa

SEQ ID NO: 2294098 - RNA, 18 nt, Yersinia pestis KIM
caggccgguauucagcca

SEQ ID NO: 2294099 - RNA, 14 nt, Yersinia pestis KIM
caggccccuucugg

SEQ ID NO: 2294100 - RNA, 15 nt, Yersinia pestis KIM
caggcucagcacaaa

SEQ ID NO: 2294101 - RNA, 13 nt, Yersinia pestis KIM
caggcugcaccca

SEQ ID NO: 2294102 - RNA, 14 nt, Yersinia pestis KIM
caggcuaacaacua

SEQ ID NO: 2294103 - RNA, 23 nt, Yersinia pestis KIM
cagggcuaauuacuucgcuuuac

SEQ ID NO: 2294104 - RNA, 13 nt, Yersinia pestis KIM
caggauuucaaua

SEQ ID NO: 2294105 - RNA, 22 nt, Yersinia pestis KIM
cagcuucuucugggucuaucag

SEQ ID NO: 2294106 - RNA, 14 nt, Yersinia pestis KIM
cagcucucugagcc

SEQ ID NO: 2294107 - RNA, 16 nt, Yersinia pestis KIM
cagcucauuaaacugu

SEQ ID NO: 2294108 - RNA, 17 nt, Yersinia pestis KIM
cagcgugauuagcagua

SEQ ID NO: 2294109 - RNA, 13 nt, Yersinia pestis KIM
cagcgcgcagcca

SEQ ID NO: 2294110 - RNA, 15 nt, Yersinia pestis KIM
cagcguagacaauga

SEQ ID NO: 2294111 - RNA, 22 nt, Yersinia pestis KIM
cagcggucgguauucagccgcc

SEQ ID NO: 2294112 - RNA, 18 nt, Yersinia pestis KIM
cacgcguggauagcggcu

SEQ ID NO: 2294113 - RNA, 13 nt, Yersinia pestis KIM
cacggcaggcggu

SEQ ID NO: 2294114 - RNA, 14 nt, Yersinia pestis KIM
cacgcugugucaau

SEQ ID NO: 2294115 - RNA, 21 nt, Yersinia pestis KIM
cacggcgagaccuacucgccg

SEQ ID NO: 2294116 - RNA, 18 nt, Yersinia pestis KIM
cacuaaaccauucagcca

SEQ ID NO: 2294117 - RNA, 19 nt, Yersinia pestis KIM
cacuaaagcggaauuugcc

SEQ ID NO: 2294118 - RNA, 21 nt, Yersinia pestis KIM
cacuaaggucaucaaggugcc

SEQ ID NO: 2294119 - RNA, 22 nt, Yersinia pestis KIM
cacuagagcguuacacaucagg

SEQ ID NO: 2294120 - RNA, 18 nt, Yersinia pestis KIM
cacuauaauuucucucaa

SEQ ID NO: 2294121 - RNA, 21 nt, Yersinia pestis KIM
cacuauucuccaacaacugcc

SEQ ID NO: 2294122 - RNA, 14 nt, Yersinia pestis KIM
cacuauuucaggca

SEQ ID NO: 2294123 - RNA, 22 nt, Yersinia pestis KIM
cacuauuucaggcauaucacua

SEQ ID NO: 2294124 - RNA, 19 nt, Yersinia pestis KIM
cacucagcgacuccuggca

SEQ ID NO: 2294125 - RNA, 19 nt, Yersinia pestis KIM
cacucaagcguacaucagg

SEQ ID NO: 2294126 - RNA, 18 nt, Yersinia pestis KIM
cagacgccccgaaccauu

SEQ ID NO: 2294127 - RNA, 13 nt, Yersinia pestis KIM
cacuccauuaauu

SEQ ID NO: 2294128 - RNA, 23 nt, Yersinia pestis KIM
cacucauugccuggcccaucuau

SEQ ID NO: 2294129 - RNA, 18 nt, Yersinia pestis KIM
cacuccacuaugcccagu

SEQ ID NO: 2294130 - RNA, 20 nt, Yersinia pestis KIM
cacuucuggggucaucaacg

SEQ ID NO: 2294131 - RNA, 16 nt, Yersinia pestis KIM
cagacaaccaauacac

SEQ ID NO: 2294132 - RNA, 12 nt, Yersinia pestis KIM
cagacaaccauu

SEQ ID NO: 2294133 - RNA, 16 nt, Yersinia pestis KIM
cagaaaguaaucuuug

SEQ ID NO: 2294134 - RNA, 14 nt, Yersinia pestis KIM
cagaaaguuguuca

SEQ ID NO: 2294135 - RNA, 15 nt, Yersinia pestis KIM
cagaaaucaaugugc

SEQ ID NO: 2294136 - RNA, 13 nt, Yersinia pestis KIM
cagaugagaaucu

SEQ ID NO: 2294137 - RNA, 18 nt, Yersinia pestis KIM
cagauuggcuugcuugau

SEQ ID NO: 2294138 - RNA, 15 nt, Yersinia pestis KIM
cagcaacagcgaccg

SEQ ID NO: 2294139 - RNA, 22 nt, Yersinia pestis KIM
cagcaacaggguauuggcuaac

SEQ ID NO: 2294140 - RNA, 14 nt, Yersinia pestis KIM
cagcaaaucacauu

SEQ ID NO: 2294141 - RNA, 21 nt, Yersinia pestis KIM
cagcaaaucuugugaugcaua

SEQ ID NO: 2294142 - RNA, 21 nt, Yersinia pestis KIM
cagcaaacaucgguaaaucgc

SEQ ID NO: 2294143 - RNA, 19 nt, Yersinia pestis KIM
cagacucuuauauaaaucc

SEQ ID NO: 2294144 - RNA, 14 nt, Yersinia pestis KIM
cagacuaaugacaa

SEQ ID NO: 2294145 - RNA, 21 nt, Yersinia pestis KIM
cagacguacauauaucacuau

SEQ ID NO: 2294146 - RNA, 14 nt, Yersinia pestis KIM
cagagagauaaucu

SEQ ID NO: 2294147 - RNA, 14 nt, Yersinia pestis KIM
cagagauaaucaga

SEQ ID NO: 2294148 - RNA, 15 nt, Yersinia pestis KIM
cagagagaaaggcgg

SEQ ID NO: 2294149 - RNA, 13 nt, Yersinia pestis KIM
cagccguuuacga

SEQ ID NO: 2294150 - RNA, 20 nt, Yersinia pestis KIM
cagccgugucuuuucuggca

SEQ ID NO: 2294151 - RNA, 19 nt, Yersinia pestis KIM
cagccgggaugaucaacag

SEQ ID NO: 2294152 - RNA, 14 nt, Yersinia pestis KIM
cagcgaccaaaugg

SEQ ID NO: 2294153 - RNA, 15 nt, Yersinia pestis KIM
cagcgccaagcuuuc

SEQ ID NO: 2294154 - RNA, 20 nt, Yersinia pestis KIM
cagcaauaaaccacugguua

SEQ ID NO: 2294155 - RNA, 17 nt, Yersinia pestis KIM
cagcaauaaccaacggg

SEQ ID NO: 2294156 - RNA, 17 nt, Yersinia pestis KIM
cagcaagugagcaaauc

SEQ ID NO: 2294157 - RNA, 18 nt, Yersinia pestis KIM
cagcaaggcgggcaaauu

SEQ ID NO: 2294158 - RNA, 17 nt, Yersinia pestis KIM
cagcaagaacaauccau

SEQ ID NO: 2294159 - RNA, 12 nt, Yersinia pestis KIM
cagcaagccaau

SEQ ID NO: 2294160 - RNA, 16 nt, Yersinia pestis KIM
cagcagucugagggcc

SEQ ID NO: 2294161 - RNA, 19 nt, Yersinia pestis KIM
cagcccuuauucaaagaau

SEQ ID NO: 2294162 - RNA, 13 nt, Yersinia pestis KIM
cagccaccagcca

SEQ ID NO: 2294163 - RNA, 23 nt, Yersinia pestis KIM
cagcauguaggaggagguuuccu

SEQ ID NO: 2294164 - RNA, 16 nt, Yersinia pestis KIM
cagcauaaccagugcc

SEQ ID NO: 2294165 - RNA, 19 nt, Yersinia pestis KIM
cccggcaucccaccuucag

SEQ ID NO: 2294166 - RNA, 17 nt, Yersinia pestis KIM
ccgaagcucaagcuggc

SEQ ID NO: 2294167 - RNA, 12 nt, Yersinia pestis KIM
cccuagcgcaaa

SEQ ID NO: 2294168 - RNA, 18 nt, Yersinia pestis KIM
cccuaccguaucaacgua

SEQ ID NO: 2294169 - RNA, 16 nt, Yersinia pestis KIM
cccuaaaaucauugac

SEQ ID NO: 2294170 - RNA, 16 nt, Yersinia pestis KIM
cccugauccacuacuu

SEQ ID NO: 2294171 - RNA, 16 nt, Yersinia pestis KIM
cccugcggccauccag

SEQ ID NO: 2294172 - RNA, 18 nt, Yersinia pestis KIM
ccagugacuccccuguaa

SEQ ID NO: 2294173 - RNA, 22 nt, Yersinia pestis KIM
ccaguuaaagaauacagccagc

SEQ ID NO: 2294174 - RNA, 22 nt, Yersinia pestis KIM
ccaguugggauguucagcucaa

SEQ ID NO: 2294175 - RNA, 16 nt, Yersinia pestis KIM
ccaguaaacagccagc

SEQ ID NO: 2294176 - RNA, 17 nt, Yersinia pestis KIM
ccaucgcuaaucauauc

SEQ ID NO: 2294177 - RNA, 19 nt, Yersinia pestis KIM
ccaugacaaaauacgguuc

SEQ ID NO: 2294178 - RNA, 13 nt, Yersinia pestis KIM
ccauuaccguaac

SEQ ID NO: 2294179 - RNA, 17 nt, Yersinia pestis KIM
ccauaccaggccacggc

SEQ ID NO: 2294180 - RNA, 18 nt, Yersinia pestis KIM
ccauacagugucaguaug

SEQ ID NO: 2294181 - RNA, 20 nt, Yersinia pestis KIM
ccaucauuacgugguuuggc

SEQ ID NO: 2294182 - RNA, 15 nt, Yersinia pestis KIM
ccauccuuggcgcgg

SEQ ID NO: 2294183 - RNA, 17 nt, Yersinia pestis KIM
cccagcacaaugcauuc

SEQ ID NO: 2294184 - RNA, 17 nt, Yersinia pestis KIM
cccaccucuuaagccag

SEQ ID NO: 2294185 - RNA, 15 nt, Yersinia pestis KIM
ccauucugaaucgcu

SEQ ID NO: 2294186 - RNA, 19 nt, Yersinia pestis KIM
cccagucacuacagcauuu

SEQ ID NO: 2294187 - RNA, 22 nt, Yersinia pestis KIM
cccagugcggaagcgccgacac

SEQ ID NO: 2294188 - RNA, 16 nt, Yersinia pestis KIM
cccccuguaacgcuaa

SEQ ID NO: 2294189 - RNA, 12 nt, Yersinia pestis KIM
cccaucgccaau

SEQ ID NO: 2294190 - RNA, 15 nt, Yersinia pestis KIM
ccccaacucaucggc

SEQ ID NO: 2294191 - RNA, 17 nt, Yersinia pestis KIM
ccacggauauccaacgg

SEQ ID NO: 2294192 - RNA, 12 nt, Yersinia pestis KIM
ccacgcuuuagc

SEQ ID NO: 2294193 - RNA, 18 nt, Yersinia pestis KIM
ccagaaacggcaucugcc

SEQ ID NO: 2294194 - RNA, 19 nt, Yersinia pestis KIM
ccacuugcuuggauuccgu

SEQ ID NO: 2294195 - RNA, 18 nt, Yersinia pestis KIM
ccacuucuuucacuaaug

SEQ ID NO: 2294196 - RNA, 19 nt, Yersinia pestis KIM
ccagcaauuggccuuccau

SEQ ID NO: 2294197 - RNA, 18 nt, Yersinia pestis KIM
ccagagcgcggcuucagc

SEQ ID NO: 2294198 - RNA, 14 nt, Yersinia pestis KIM
ccagcggcguauca

SEQ ID NO: 2294199 - RNA, 13 nt, Yersinia pestis KIM
ccagcgcggcgaa

SEQ ID NO: 2294200 - RNA, 19 nt, Yersinia pestis KIM
caugcugcccgcacacuga

SEQ ID NO: 2294201 - RNA, 19 nt, Yersinia pestis KIM
cauguggugacuacggcua

SEQ ID NO: 2294202 - RNA, 19 nt, Yersinia pestis KIM
cauguucacaucggucaau

SEQ ID NO: 2294203 - RNA, 22 nt, Yersinia pestis KIM
cauuauauuauuuaucaaucag

SEQ ID NO: 2294204 - RNA, 14 nt, Yersinia pestis KIM
cauuauccguuugc

SEQ ID NO: 2294205 - RNA, 21 nt, Yersinia pestis KIM
cauuagcguugccgccgggca

SEQ ID NO: 2294206 - RNA, 17 nt, Yersinia pestis KIM
cauuauuuauagguaua

SEQ ID NO: 2294207 - RNA, 19 nt, Yersinia pestis KIM
cauuauucuaggcaugaau

SEQ ID NO: 2294208 - RNA, 17 nt, Yersinia pestis KIM
cauuaauuaauaagccc

SEQ ID NO: 2294209 - RNA, 14 nt, Yersinia pestis KIM
cauuacauccuuag

SEQ ID NO: 2294210 - RNA, 16 nt, Yersinia pestis KIM
cauuagcccaacggcu

SEQ ID NO: 2294211 - RNA, 21 nt, Yersinia pestis KIM
cauuacggcgcagggcgauau

SEQ ID NO: 2294212 - RNA, 22 nt, Yersinia pestis KIM
cauguugugugugaagugugca

SEQ ID NO: 2294213 - RNA, 12 nt, Yersinia pestis KIM
cauguugaccaa

SEQ ID NO: 2294214 - RNA, 20 nt, Yersinia pestis KIM
ccaacaggcggguucuucag

SEQ ID NO: 2294215 - RNA, 19 nt, Yersinia pestis KIM
ccaacaauauucgcagcca

SEQ ID NO: 2294216 - RNA, 22 nt, Yersinia pestis KIM
ccaacaacugccaaauuuggcc

SEQ ID NO: 2294217 - RNA, 19 nt, Yersinia pestis KIM
cauuuuuaaguggcaucag

SEQ ID NO: 2294218 - RNA, 14 nt, Yersinia pestis KIM
cauugagacgagua

SEQ ID NO: 2294219 - RNA, 20 nt, Yersinia pestis KIM
cauugagcgccacaucggcg

SEQ ID NO: 2294220 - RNA, 19 nt, Yersinia pestis KIM
cauuuaucgccaagccagu

SEQ ID NO: 2294221 - RNA, 14 nt, Yersinia pestis KIM
cauuuaucuaaaac

SEQ ID NO: 2294222 - RNA, 16 nt, Yersinia pestis KIM
cauuuagcacuguuca

SEQ ID NO: 2294223 - RNA, 19 nt, Yersinia pestis KIM
cauuucaauucguucaaau

SEQ ID NO: 2294224 - RNA, 21 nt, Yersinia pestis KIM
cauuucccugcggccauccag

SEQ ID NO: 2294225 - RNA, 15 nt, Yersinia pestis KIM
ccaauguaugaccgg

SEQ ID NO: 2294226 - RNA, 17 nt, Yersinia pestis KIM
ccaauggccaccauuaa

SEQ ID NO: 2294227 - RNA, 12 nt, Yersinia pestis KIM
ccaaccaugcug

SEQ ID NO: 2294228 - RNA, 14 nt, Yersinia pestis KIM
ccaaccaaccaugc

SEQ ID NO: 2294229 - RNA, 15 nt, Yersinia pestis KIM
ccaaggauggcgcgg

SEQ ID NO: 2294230 - RNA, 18 nt, Yersinia pestis KIM
ccaaucauucugucauca

SEQ ID NO: 2294231 - RNA, 20 nt, Yersinia pestis KIM
ccaaucagaacuauacgcgg

SEQ ID NO: 2294232 - RNA, 17 nt, Yersinia pestis KIM
ccaauagcgaucagcaa

SEQ ID NO: 2294233 - RNA, 17 nt, Yersinia pestis KIM
ccaauauugauccaccg

SEQ ID NO: 2294234 - RNA, 17 nt, Yersinia pestis KIM
ccaauagcugugcgcgg

SEQ ID NO: 2294235 - RNA, 13 nt, Yersinia pestis KIM
aucacugaaagug

SEQ ID NO: 2294236 - RNA, 14 nt, Yersinia pestis KIM
aucacuauuucagg

SEQ ID NO: 2294237 - RNA, 14 nt, Yersinia pestis KIM
aucacuuucccgcg

SEQ ID NO: 2294238 - RNA, 21 nt, Yersinia pestis KIM
aucacuuuuaugacggcaucg

SEQ ID NO: 2294239 - RNA, 16 nt, Yersinia pestis KIM
aucagacggcagcaac

SEQ ID NO: 2294240 - RNA, 22 nt, Yersinia pestis KIM
aucacccgauacaggcucugaa

SEQ ID NO: 2294241 - RNA, 15 nt, Yersinia pestis KIM
aucaccauucaagau

SEQ ID NO: 2294242 - RNA, 14 nt, Yersinia pestis KIM
aucaccaucauuac

SEQ ID NO: 2294243 - RNA, 21 nt, Yersinia pestis KIM
aucaccgccggauuucaaucc

SEQ ID NO: 2294244 - RNA, 22 nt, Yersinia pestis KIM
aucacaggccacugcauacggc

SEQ ID NO: 2294245 - RNA, 20 nt, Yersinia pestis KIM
aucaccuuggaaaacagcaa

SEQ ID NO: 2294246 - RNA, 20 nt, Yersinia pestis KIM
aucacggauaucaauaaccu

SEQ ID NO: 2294247 - RNA, 23 nt, Yersinia pestis KIM
auauguagcagcaccauacagca

SEQ ID NO: 2294248 - RNA, 13 nt, Yersinia pestis KIM
auaugcuacccgc

SEQ ID NO: 2294249 - RNA, 13 nt, Yersinia pestis KIM
auaugauggcauc

SEQ ID NO: 2294250 - RNA, 22 nt, Yersinia pestis KIM
auauuaaaaaagggagcuuugc

SEQ ID NO: 2294251 - RNA, 16 nt, Yersinia pestis KIM
auauuagcaauuggcc

SEQ ID NO: 2294252 - RNA, 14 nt, Yersinia pestis KIM
auauuacgcagcca

SEQ ID NO: 2294253 - RNA, 12 nt, Yersinia pestis KIM
auauuaccgcug

SEQ ID NO: 2294254 - RNA, 22 nt, Yersinia pestis KIM
auauuuccguggguuauagcca

SEQ ID NO: 2294255 - RNA, 12 nt, Yersinia pestis KIM
auagccacuaac

SEQ ID NO: 2294256 - RNA, 18 nt, Yersinia pestis KIM
auagccacgucugcggau

SEQ ID NO: 2294257 - RNA, 16 nt, Yersinia pestis KIM
auagccgaagaaugua

SEQ ID NO: 2294258 - RNA, 13 nt, Yersinia pestis KIM
auagcccggugcc

SEQ ID NO: 2294259 - RNA, 21 nt, Yersinia pestis KIM
auagccuugauucagcucauc

SEQ ID NO: 2294260 - RNA, 23 nt, Yersinia pestis KIM
auagccuaggccagcacuaagug

SEQ ID NO: 2294261 - RNA, 14 nt, Yersinia pestis KIM
auagcgaucagcaa

SEQ ID NO: 2294262 - RNA, 13 nt, Yersinia pestis KIM
auauccaccugau

SEQ ID NO: 2294263 - RNA, 13 nt, Yersinia pestis KIM
aucaauaccaaua

SEQ ID NO: 2294264 - RNA, 13 nt, Yersinia pestis KIM
aucaauacugcaa

SEQ ID NO: 2294265 - RNA, 18 nt, Yersinia pestis KIM
aucaauaggucagugguu

SEQ ID NO: 2294266 - RNA, 14 nt, Yersinia pestis KIM
aucaauauaacgcc

SEQ ID NO: 2294267 - RNA, 16 nt, Yersinia pestis KIM
aucaaucagcggagcu

SEQ ID NO: 2294268 - RNA, 14 nt, Yersinia pestis KIM
aucaaucagcugau

SEQ ID NO: 2294269 - RNA, 18 nt, Yersinia pestis KIM
aucaaugaaaauauccga

SEQ ID NO: 2294270 - RNA, 19 nt, Yersinia pestis KIM
aucaauuggcagcggcaaa

SEQ ID NO: 2294271 - RNA, 15 nt, Yersinia pestis KIM
aucaauuggcccuuu

SEQ ID NO: 2294272 - RNA, 17 nt, Yersinia pestis KIM
aucaauuccauaucggc

SEQ ID NO: 2294273 - RNA, 21 nt, Yersinia pestis KIM
aucaagucuugaagagugacc

SEQ ID NO: 2294274 - RNA, 19 nt, Yersinia pestis KIM
aucaaacagcacaucgcca

SEQ ID NO: 2294275 - RNA, 20 nt, Yersinia pestis KIM
aucaaaggcgaccaaugggg

SEQ ID NO: 2294276 - RNA, 18 nt, Yersinia pestis KIM
auauuugcugucugggug

SEQ ID NO: 2294277 - RNA, 21 nt, Yersinia pestis KIM
aucaacacauaaaaucagcau

SEQ ID NO: 2294278 - RNA, 18 nt, Yersinia pestis KIM
aucaacagugaggugaua

SEQ ID NO: 2294279 - RNA, 16 nt, Yersinia pestis KIM
aucaaaugucagcguu

SEQ ID NO: 2294280 - RNA, 15 nt, Yersinia pestis KIM
aucaacaugggcaag

SEQ ID NO: 2294281 - RNA, 15 nt, Yersinia pestis KIM
auagcaacaucgacc

SEQ ID NO: 2294282 - RNA, 20 nt, Yersinia pestis KIM
auagcaagcacggcaggcgg

SEQ ID NO: 2294283 - RNA, 20 nt, Yersinia pestis KIM
auagcaccgagcaugcuaac

SEQ ID NO: 2294284 - RNA, 15 nt, Yersinia pestis KIM
auagcaucuggccag

SEQ ID NO: 2294285 - RNA, 18 nt, Yersinia pestis KIM
auacuguuaacucgccaa

SEQ ID NO: 2294286 - RNA, 22 nt, Yersinia pestis KIM
auacugccaaucgcucugcguu

SEQ ID NO: 2294287 - RNA, 18 nt, Yersinia pestis KIM
auacucuguuaccaaugg

SEQ ID NO: 2294288 - RNA, 15 nt, Yersinia pestis KIM
auaccgacaucaaca

SEQ ID NO: 2294289 - RNA, 12 nt, Yersinia pestis KIM
auacccugcacc

SEQ ID NO: 2294290 - RNA, 13 nt, Yersinia pestis KIM
auacaggugucau

SEQ ID NO: 2294291 - RNA, 15 nt, Yersinia pestis KIM
auaccaugccaucaa

SEQ ID NO: 2294292 - RNA, 14 nt, Yersinia pestis KIM
auacguuggcggcu

SEQ ID NO: 2294293 - RNA, 16 nt, Yersinia pestis KIM
auaauuaauuauucaa

SEQ ID NO: 2294294 - RNA, 18 nt, Yersinia pestis KIM
auaauggaugaauaucca

SEQ ID NO: 2294295 - RNA, 12 nt, Yersinia pestis KIM
auaauucagacg

SEQ ID NO: 2294296 - RNA, 22 nt, Yersinia pestis KIM
auaauuaauuucacuggccuau

SEQ ID NO: 2294297 - RNA, 17 nt, Yersinia pestis KIM
auacacuggcagugcca

SEQ ID NO: 2294298 - RNA, 12 nt, Yersinia pestis KIM
auaacaauggcc

SEQ ID NO: 2294299 - RNA, 23 nt, Yersinia pestis KIM
auaaauuuaggugccaucuggcu

SEQ ID NO: 2294300 - RNA, 13 nt, Yersinia pestis KIM
auaaauuuaucga

SEQ ID NO: 2294301 - RNA, 18 nt, Yersinia pestis KIM
auaaucucagcaucggca

SEQ ID NO: 2294302 - RNA, 13 nt, Yersinia pestis KIM
auaaggcucuguu

SEQ ID NO: 2294303 - RNA, 19 nt, Yersinia pestis KIM
auaaucacugaggccaaau

SEQ ID NO: 2294304 - RNA, 12 nt, Yersinia pestis KIM
auaaaaagccag

SEQ ID NO: 2294305 - RNA, 14 nt, Yersinia pestis KIM
auaaaauucagcca

SEQ ID NO: 2294306 - RNA, 13 nt, Yersinia pestis KIM
auaaaauccacua

SEQ ID NO: 2294307 - RNA, 15 nt, Yersinia pestis KIM
auaaacccuacagca

SEQ ID NO: 2294308 - RNA, 20 nt, Yersinia pestis KIM
aguugcaguuggaucugcac

SEQ ID NO: 2294309 - RNA, 16 nt, Yersinia pestis KIM
aguucuucgcaaugau

SEQ ID NO: 2294310 - RNA, 19 nt, Yersinia pestis KIM
aguucgucgcgaauagcca

SEQ ID NO: 2294311 - RNA, 20 nt, Yersinia pestis KIM
aguuccagccccaaacacuu

SEQ ID NO: 2294312 - RNA, 15 nt, Yersinia pestis KIM
aguguccacauagcu

SEQ ID NO: 2294313 - RNA, 14 nt, Yersinia pestis KIM
aguguaaaaagcga

SEQ ID NO: 2294314 - RNA, 19 nt, Yersinia pestis KIM
aggucgaugaacugcacgu

SEQ ID NO: 2294315 - RNA, 22 nt, Yersinia pestis KIM
aggggugauguugacguucagg

SEQ ID NO: 2294316 - RNA, 21 nt, Yersinia pestis KIM
agguaccccauaaaucccgag

SEQ ID NO: 2294317 - RNA, 23 nt, Yersinia pestis KIM
aguaaagcccagcaggcugugau

SEQ ID NO: 2294318 - RNA, 12 nt, Yersinia pestis KIM
aguaaauagcaa

SEQ ID NO: 2294319 - RNA, 13 nt, Yersinia pestis KIM
aggugucaucaag

SEQ ID NO: 2294320 - RNA, 15 nt, Yersinia pestis KIM
agucaguucauuaca

SEQ ID NO: 2294321 - RNA, 15 nt, Yersinia pestis KIM
aguaugguuaaucua

SEQ ID NO: 2294322 - RNA, 17 nt, Yersinia pestis KIM
aguccaagacagaacuu

SEQ ID NO: 2294323 - RNA, 18 nt, Yersinia pestis KIM
aguacagcacucaguaca

SEQ ID NO: 2294324 - RNA, 22 nt, Yersinia pestis KIM
aguaauuuccuuggcagcaaua

SEQ ID NO: 2294325 - RNA, 21 nt, Yersinia pestis KIM
aggcucacugucuuuaaaagg

SEQ ID NO: 2294326 - RNA, 21 nt, Yersinia pestis KIM
aggcugcguaacgguucacgc

SEQ ID NO: 2294327 - RNA, 15 nt, Yersinia pestis KIM
agggaauaaugguau

SEQ ID NO: 2294328 - RNA, 20 nt, Yersinia pestis KIM
aggcuaauacaugcuggcgg

SEQ ID NO: 2294329 - RNA, 14 nt, Yersinia pestis KIM
aggcggugaacagu

SEQ ID NO: 2294330 - RNA, 20 nt, Yersinia pestis KIM
aggccuagcccaguaccgcu

SEQ ID NO: 2294331 - RNA, 16 nt, Yersinia pestis KIM
aggauggcccaagcca

SEQ ID NO: 2294332 - RNA, 13 nt, Yersinia pestis KIM
aggcauuaucuga

SEQ ID NO: 2294333 - RNA, 12 nt, Yersinia pestis KIM
aggauugaccaa

SEQ ID NO: 2294334 - RNA, 23 nt, Yersinia pestis KIM
aggauuggagucaugaggcagug

SEQ ID NO: 2294335 - RNA, 15 nt, Yersinia pestis KIM
agcuaaccuuaacua

SEQ ID NO: 2294336 - RNA, 22 nt, Yersinia pestis KIM
agcuaacaccgcuguagcguca

SEQ ID NO: 2294337 - RNA, 22 nt, Yersinia pestis KIM
agcuaccggaaugaguugcccu

SEQ ID NO: 2294338 - RNA, 22 nt, Yersinia pestis KIM
agcguugacuuucuaagcugcc

SEQ ID NO: 2294339 - RNA, 15 nt, Yersinia pestis KIM
agcucugggcugaug

SEQ ID NO: 2294340 - RNA, 15 nt, Yersinia pestis KIM
agcggguuaccagua

SEQ ID NO: 2294341 - RNA, 21 nt, Yersinia pestis KIM
agcguggaauuaauaucccac

SEQ ID NO: 2294342 - RNA, 14 nt, Yersinia pestis KIM
agcguucaucgccc

SEQ ID NO: 2294343 - RNA, 18 nt, Yersinia pestis KIM
agcggcgauuucaucagc

SEQ ID NO: 2294344 - RNA, 14 nt, Yersinia pestis KIM
agcggcgauuaucg

SEQ ID NO: 2294345 - RNA, 19 nt, Yersinia pestis KIM
agcgauagauccacuccag

SEQ ID NO: 2294346 - RNA, 20 nt, Yersinia pestis KIM
agcgauagauccacuccagu

SEQ ID NO: 2294347 - RNA, 20 nt, Yersinia pestis KIM
agcgauaguuaaauuauccc

SEQ ID NO: 2294348 - RNA, 14 nt, Yersinia pestis KIM
agcgcacacccgau

SEQ ID NO: 2294349 - RNA, 13 nt, Yersinia pestis KIM
agcgagggccuuu

SEQ ID NO: 2294350 - RNA, 12 nt, Yersinia pestis KIM
agcgcacugcau

SEQ ID NO: 2294351 - RNA, 18 nt, Yersinia pestis KIM
agcgcacugcaugccauu

SEQ ID NO: 2294352 - RNA, 15 nt, Yersinia pestis KIM
agccuugcauccggu

SEQ ID NO: 2294353 - RNA, 18 nt, Yersinia pestis KIM
agcgcccggcugaccugu

SEQ ID NO: 2294354 - RNA, 20 nt, Yersinia pestis KIM
agcccacugacacugauaga

SEQ ID NO: 2294355 - RNA, 14 nt, Yersinia pestis KIM
agcccacugacacu

SEQ ID NO: 2294356 - RNA, 16 nt, Yersinia pestis KIM
agccauuauuggcugg

SEQ ID NO: 2294357 - RNA, 20 nt, Yersinia pestis KIM
agcccgauggggagagcguc

SEQ ID NO: 2294358 - RNA, 14 nt, Yersinia pestis KIM
agccccuagcaccg

SEQ ID NO: 2294359 - RNA, 23 nt, Yersinia pestis KIM
agccgcccucucuagauuaaccu

SEQ ID NO: 2294360 - RNA, 17 nt, Yersinia pestis KIM
agccagaaauagcacca

SEQ ID NO: 2294361 - RNA, 18 nt, Yersinia pestis KIM
agccacgucugcggauca

SEQ ID NO: 2294362 - RNA, 20 nt, Yersinia pestis KIM
agccagccaauggccaccau

SEQ ID NO: 2294363 - RNA, 14 nt, Yersinia pestis KIM
agccaauguaugac

SEQ ID NO: 2294364 - RNA, 12 nt, Yersinia pestis KIM
agccaucgccau

SEQ ID NO: 2294365 - RNA, 14 nt, Yersinia pestis KIM
agccagcgucauca

SEQ ID NO: 2294366 - RNA, 17 nt, Yersinia pestis KIM
agcagucugauauccgg

SEQ ID NO: 2294367 - RNA, 20 nt, Yersinia pestis KIM
agcagucugagggccacuuc

SEQ ID NO: 2294368 - RNA, 14 nt, Yersinia pestis KIM
agcaugaauggcuu

SEQ ID NO: 2294369 - RNA, 14 nt, Yersinia pestis KIM
agcaggcugcaccc

SEQ ID NO: 2294370 - RNA, 18 nt, Yersinia pestis KIM
agagaucccgugccagau

SEQ ID NO: 2294371 - RNA, 15 nt, Yersinia pestis KIM
agagauguugggccg

SEQ ID NO: 2294372 - RNA, 17 nt, Yersinia pestis KIM
agaggacucugcgcuca

SEQ ID NO: 2294373 - RNA, 16 nt, Yersinia pestis KIM
agagcucuucugccag

SEQ ID NO: 2294374 - RNA, 20 nt, Yersinia pestis KIM
agaguacuaacgucaacaga

SEQ ID NO: 2294375 - RNA, 14 nt, Yersinia pestis KIM
agaaaaucaggaua

SEQ ID NO: 2294376 - RNA, 18 nt, Yersinia pestis KIM
agaaacuuugcuuugacu

SEQ ID NO: 2294377 - RNA, 22 nt, Yersinia pestis KIM
agaaaggcuaucacgauaauca

SEQ ID NO: 2294378 - RNA, 19 nt, Yersinia pestis KIM
agacuaaccucugcaaugc

SEQ ID NO: 2294379 - RNA, 15 nt, Yersinia pestis KIM
agaucgcgucaucgg

SEQ ID NO: 2294380 - RNA, 16 nt, Yersinia pestis KIM
agcacguaaaucgguu

SEQ ID NO: 2294381 - RNA, 18 nt, Yersinia pestis KIM
agcacuauccccaauuca

SEQ ID NO: 2294382 - RNA, 23 nt, Yersinia pestis KIM
agcacuacguguuuuucaucugu

SEQ ID NO: 2294383 - RNA, 19 nt, Yersinia pestis KIM
agcacucgguggcauaaac

SEQ ID NO: 2294384 - RNA, 15 nt, Yersinia pestis KIM
agcaaccgucaccgu

SEQ ID NO: 2294385 - RNA, 13 nt, Yersinia pestis KIM
agcaaaucccgau

SEQ ID NO: 2294386 - RNA, 17 nt, Yersinia pestis KIM
agauuaaccuuaucacc

SEQ ID NO: 2294387 - RNA, 18 nt, Yersinia pestis KIM
auccgaccaccacugcau

SEQ ID NO: 2294388 - RNA, 13 nt, Yersinia pestis KIM
auccgcaggaagc

SEQ ID NO: 2294389 - RNA, 21 nt, Yersinia pestis KIM
auccggcgggcaauauaggcg

SEQ ID NO: 2294390 - RNA, 15 nt, Yersinia pestis KIM
auccuacauucagua

SEQ ID NO: 2294391 - RNA, 13 nt, Yersinia pestis KIM
auccucaccguuc

SEQ ID NO: 2294392 - RNA, 21 nt, Yersinia pestis KIM
auccguuuucacccaaccggg

SEQ ID NO: 2294393 - RNA, 13 nt, Yersinia pestis KIM
auccucauugagc

SEQ ID NO: 2294394 - RNA, 17 nt, Yersinia pestis KIM
auccuucaagaugcagg

SEQ ID NO: 2294395 - RNA, 19 nt, Yersinia pestis KIM
auccugugccaacaucgcg

SEQ ID NO: 2294396 - RNA, 15 nt, Yersinia pestis KIM
auccuugaucgccaa

SEQ ID NO: 2294397 - RNA, 19 nt, Yersinia pestis KIM
aucgaacccgcuaacaugc

SEQ ID NO: 2294398 - RNA, 14 nt, Yersinia pestis KIM
auccugaauggcaa

SEQ ID NO: 2294399 - RNA, 14 nt, Yersinia pestis KIM
aucggcaacgucac

SEQ ID NO: 2294400 - RNA, 18 nt, Yersinia pestis KIM
aucgcgcuucaggucagg

SEQ ID NO: 2294401 - RNA, 17 nt, Yersinia pestis KIM
aucgcugugguaucaaa

SEQ ID NO: 2294402 - RNA, 13 nt, Yersinia pestis KIM
aucggaguguaaa

SEQ ID NO: 2294403 - RNA, 22 nt, Yersinia pestis KIM
aucgcucuugagggugaccauc

SEQ ID NO: 2294404 - RNA, 15 nt, Yersinia pestis KIM
aucugcugaccauua

SEQ ID NO: 2294405 - RNA, 15 nt, Yersinia pestis KIM
aucucgguaaugcac

SEQ ID NO: 2294406 - RNA, 23 nt, Yersinia pestis KIM
aucuggucaucauguagccauug

SEQ ID NO: 2294407 - RNA, 20 nt, Yersinia pestis KIM
aucuugaaggauggcggaua

SEQ ID NO: 2294408 - RNA, 19 nt, Yersinia pestis KIM
aucuugcugaaaacaauau

SEQ ID NO: 2294409 - RNA, 17 nt, Yersinia pestis KIM
aucuuccgucaguugcc

SEQ ID NO: 2294410 - RNA, 12 nt, Yersinia pestis KIM
aucuuaccggcg

SEQ ID NO: 2294411 - RNA, 14 nt, Yersinia pestis KIM
aucuaccugaaugc

SEQ ID NO: 2294412 - RNA, 15 nt, Yersinia pestis KIM
aucuacuuuauucaa

SEQ ID NO: 2294413 - RNA, 16 nt, Yersinia pestis KIM
aucucgauauuaaccc

SEQ ID NO: 2294414 - RNA, 22 nt, Yersinia pestis KIM
aucggcgucaagguacccauua

SEQ ID NO: 2294415 - RNA, 23 nt, Yersinia pestis KIM
augcaguaacgggucucaaugca

SEQ ID NO: 2294416 - RNA, 16 nt, Yersinia pestis KIM
augcauaagcacgaau

SEQ ID NO: 2294417 - RNA, 15 nt, Yersinia pestis KIM
augcagcauuucagg

SEQ ID NO: 2294418 - RNA, 19 nt, Yersinia pestis KIM
augauuaacggauacccuu

SEQ ID NO: 2294419 - RNA, 19 nt, Yersinia pestis KIM
augauggcggugcuguauu

SEQ ID NO: 2294420 - RNA, 16 nt, Yersinia pestis KIM
augauauuuaucgauu

SEQ ID NO: 2294421 - RNA, 14 nt, Yersinia pestis KIM
augauccggcgaug

SEQ ID NO: 2294422 - RNA, 14 nt, Yersinia pestis KIM
augagucgcuggua

SEQ ID NO: 2294423 - RNA, 15 nt, Yersinia pestis KIM
augaauauuauucag

SEQ ID NO: 2294424 - RNA, 19 nt, Yersinia pestis KIM
augaauaauaucggcggca

SEQ ID NO: 2294425 - RNA, 14 nt, Yersinia pestis KIM
augacccaacguca

SEQ ID NO: 2294426 - RNA, 17 nt, Yersinia pestis KIM
augaccgccagugccgc

SEQ ID NO: 2294427 - RNA, 16 nt, Yersinia pestis KIM
aucuuuccagccaaua

SEQ ID NO: 2294428 - RNA, 20 nt, Yersinia pestis KIM
aucuuuggcguuaaucaagc

SEQ ID NO: 2294429 - RNA, 20 nt, Yersinia pestis KIM
augggguaaucccgaaucaa

SEQ ID NO: 2294430 - RNA, 14 nt, Yersinia pestis KIM
augggucguugaua

SEQ ID NO: 2294431 - RNA, 18 nt, Yersinia pestis KIM
augguacaacugcggcgu

SEQ ID NO: 2294432 - RNA, 14 nt, Yersinia pestis KIM
augguuggcuauca

SEQ ID NO: 2294433 - RNA, 17 nt, Yersinia pestis KIM
augguuuuucaguuggg

SEQ ID NO: 2294434 - RNA, 19 nt, Yersinia pestis KIM
auggggccaccuaauccaa

SEQ ID NO: 2294435 - RNA, 16 nt, Yersinia pestis KIM
auggggaucauguggg

SEQ ID NO: 2294436 - RNA, 13 nt, Yersinia pestis KIM
augugaagagcgg

SEQ ID NO: 2294437 - RNA, 20 nt, Yersinia pestis KIM
augucuaaugacagacgcgg

SEQ ID NO: 2294438 - RNA, 22 nt, Yersinia pestis KIM
auguugcaucgcacugauagcc

SEQ ID NO: 2294439 - RNA, 12 nt, Yersinia pestis KIM
auguugacguuc

SEQ ID NO: 2294440 - RNA, 13 nt, Yersinia pestis KIM
auguggcuguauu

SEQ ID NO: 2294441 - RNA, 21 nt, Yersinia pestis KIM
augcugcacaucaacggacag

SEQ ID NO: 2294442 - RNA, 16 nt, Yersinia pestis KIM
augcugcccgcacacu

SEQ ID NO: 2294443 - RNA, 14 nt, Yersinia pestis KIM
augcauuagugagc

SEQ ID NO: 2294444 - RNA, 24 nt, Yersinia pestis KIM
augccaaauaucuuucagcaccau

SEQ ID NO: 2294445 - RNA, 18 nt, Yersinia pestis KIM
augcgcagaaaaccacuu

SEQ ID NO: 2294446 - RNA, 19 nt, Yersinia pestis KIM
augcggcauaacugaauac

SEQ ID NO: 2294447 - RNA, 21 nt, Yersinia pestis KIM
auggauuaucgccuggcuuga

SEQ ID NO: 2294448 - RNA, 16 nt, Yersinia pestis KIM
auggauacacggcugc

SEQ ID NO: 2294449 - RNA, 20 nt, Yersinia pestis KIM
auggacuuacccuacccauu

SEQ ID NO: 2294450 - RNA, 16 nt, Yersinia pestis KIM
auggaugaccaaugga

SEQ ID NO: 2294451 - RNA, 13 nt, Yersinia pestis KIM
auggaagauaucu

SEQ ID NO: 2294452 - RNA, 22 nt, Yersinia pestis KIM
auucccgucagguucaauuccc

SEQ ID NO: 2294453 - RNA, 12 nt, Yersinia pestis KIM
auuaucuucuau

SEQ ID NO: 2294454 - RNA, 14 nt, Yersinia pestis KIM
auuauuauaagugc

SEQ ID NO: 2294455 - RNA, 13 nt, Yersinia pestis KIM
auucaccaccauu

SEQ ID NO: 2294456 - RNA, 19 nt, Yersinia pestis KIM
auuccucaucgaaauuccc

SEQ ID NO: 2294457 - RNA, 18 nt, Yersinia pestis KIM
auucgauagaaacaucag

SEQ ID NO: 2294458 - RNA, 17 nt, Yersinia pestis KIM
auucgggugagugaaca

SEQ ID NO: 2294459 - RNA, 17 nt, Yersinia pestis KIM
auucgggugagugaacg

SEQ ID NO: 2294460 - RNA, 19 nt, Yersinia pestis KIM
auucgcugaacaauugcca

SEQ ID NO: 2294461 - RNA, 18 nt, Yersinia pestis KIM
auugguuuuaauaaccau

SEQ ID NO: 2294462 - RNA, 12 nt, Yersinia pestis KIM
auugcgaauauu

SEQ ID NO: 2294463 - RNA, 14 nt, Yersinia pestis KIM
auugcguuauaucu

SEQ ID NO: 2294464 - RNA, 15 nt, Yersinia pestis KIM
auugcuaucuguuau

SEQ ID NO: 2294465 - RNA, 14 nt, Yersinia pestis KIM
auugcugcuguuau

SEQ ID NO: 2294466 - RNA, 21 nt, Yersinia pestis KIM
auugcaacaacgccagauaac

SEQ ID NO: 2294467 - RNA, 19 nt, Yersinia pestis KIM
auugauuuguaauaacgau

SEQ ID NO: 2294468 - RNA, 18 nt, Yersinia pestis KIM
auugcaggccgcuuuauu

SEQ ID NO: 2294469 - RNA, 21 nt, Yersinia pestis KIM
auugcaggccgcuuuauucag

SEQ ID NO: 2294470 - RNA, 19 nt, Yersinia pestis KIM
auugccccacauuacuggc

SEQ ID NO: 2294471 - RNA, 14 nt, Yersinia pestis KIM
auugccagugaacc

SEQ ID NO: 2294472 - RNA, 15 nt, Yersinia pestis KIM
auugcauuuuacagg

SEQ ID NO: 2294473 - RNA, 12 nt, Yersinia pestis KIM
auucuuagccag

SEQ ID NO: 2294474 - RNA, 18 nt, Yersinia pestis KIM
auugaggguugucagcag

SEQ ID NO: 2294475 - RNA, 16 nt, Yersinia pestis KIM
auugacaaagugccug

SEQ ID NO: 2294476 - RNA, 19 nt, Yersinia pestis KIM
caccgccuaucgugaacag

SEQ ID NO: 2294477 - RNA, 18 nt, Yersinia pestis KIM
caccgcuggaagccgcca

SEQ ID NO: 2294478 - RNA, 18 nt, Yersinia pestis KIM
caccgcuggucgggugca

SEQ ID NO: 2294479 - RNA, 14 nt, Yersinia pestis KIM
caccguaucugcca

SEQ ID NO: 2294480 - RNA, 14 nt, Yersinia pestis KIM
caccgucaccaaau

SEQ ID NO: 2294481 - RNA, 21 nt, Yersinia pestis KIM
caccacacuggaugcgacgca

SEQ ID NO: 2294482 - RNA, 12 nt, Yersinia pestis KIM
caccacaucuug

SEQ ID NO: 2294483 - RNA, 19 nt, Yersinia pestis KIM
cacacuggcggacaucuua

SEQ ID NO: 2294484 - RNA, 13 nt, Yersinia pestis KIM
caccagauugccg

SEQ ID NO: 2294485 - RNA, 18 nt, Yersinia pestis KIM
cacccauacauaccagca

SEQ ID NO: 2294486 - RNA, 23 nt, Yersinia pestis KIM
cacccccauaaccauugaaacca

SEQ ID NO: 2294487 - RNA, 22 nt, Yersinia pestis KIM
caaaccgggguucgcaaugaac

SEQ ID NO: 2294488 - RNA, 18 nt, Yersinia pestis KIM
caaaccucuggcgcaaga

SEQ ID NO: 2294489 - RNA, 12 nt, Yersinia pestis KIM
caaacugauaaa

SEQ ID NO: 2294490 - RNA, 12 nt, Yersinia pestis KIM
caaacucagcca

SEQ ID NO: 2294491 - RNA, 14 nt, Yersinia pestis KIM
caaacucagcgaau

SEQ ID NO: 2294492 - RNA, 18 nt, Yersinia pestis KIM
auuuaaauaagauccaga

SEQ ID NO: 2294493 - RNA, 20 nt, Yersinia pestis KIM
auuguggggccuuuauucau

SEQ ID NO: 2294494 - RNA, 18 nt, Yersinia pestis KIM
caaaauucgugcucauca

SEQ ID NO: 2294495 - RNA, 18 nt, Yersinia pestis KIM
caaaccccgaugacgcga

SEQ ID NO: 2294496 - RNA, 20 nt, Yersinia pestis KIM
caaaucugcucccggcgcua

SEQ ID NO: 2294497 - RNA, 20 nt, Yersinia pestis KIM
caaauauuaccguuaucaaa

SEQ ID NO: 2294498 - RNA, 14 nt, Yersinia pestis KIM
caaauaucggccau

SEQ ID NO: 2294499 - RNA, 15 nt, Yersinia pestis KIM
caaauucgugaucaa

SEQ ID NO: 2294500 - RNA, 15 nt, Yersinia pestis KIM
caaauuccgcuucuc

SEQ ID NO: 2294501 - RNA, 17 nt, Yersinia pestis KIM
caaauucagguugauca

SEQ ID NO: 2294502 - RNA, 20 nt, Yersinia pestis KIM
caacaacuccuucucgaugc

SEQ ID NO: 2294503 - RNA, 21 nt, Yersinia pestis KIM
caacgcguacgggacggguug

SEQ ID NO: 2294504 - RNA, 16 nt, Yersinia pestis KIM
caacucaucggcguua

SEQ ID NO: 2294505 - RNA, 23 nt, Yersinia pestis KIM
caacguccagaacaauaccgcca

SEQ ID NO: 2294506 - RNA, 21 nt, Yersinia pestis KIM
caaccgcuugcauacgcuuaa

SEQ ID NO: 2294507 - RNA, 12 nt, Yersinia pestis KIM
caaccucagccu

SEQ ID NO: 2294508 - RNA, 16 nt, Yersinia pestis KIM
caaccccaucagcaua

SEQ ID NO: 2294509 - RNA, 17 nt, Yersinia pestis KIM
caaccauugacuagcca

SEQ ID NO: 2294510 - RNA, 19 nt, Yersinia pestis KIM
caaccauccgcccaauacg

SEQ ID NO: 2294511 - RNA, 19 nt, Yersinia pestis KIM
caaccaccuuuaccaugcu

SEQ ID NO: 2294512 - RNA, 23 nt, Yersinia pestis KIM
caauguguugaauauccaauggu

SEQ ID NO: 2294513 - RNA, 19 nt, Yersinia pestis KIM
caaugucaggaaaugcaga

SEQ ID NO: 2294514 - RNA, 21 nt, Yersinia pestis KIM
caauuuaucagacaaucugug

SEQ ID NO: 2294515 - RNA, 18 nt, Yersinia pestis KIM
cacaacgcaucaguaaug

SEQ ID NO: 2294516 - RNA, 20 nt, Yersinia pestis KIM
caauuugucguuuacuggcu

SEQ ID NO: 2294517 - RNA, 20 nt, Yersinia pestis KIM
cacaacggaaggcccagccg

SEQ ID NO: 2294518 - RNA, 12 nt, Yersinia pestis KIM
cacacaauacau

SEQ ID NO: 2294519 - RNA, 20 nt, Yersinia pestis KIM
caaucuggggguaacgccgc

SEQ ID NO: 2294520 - RNA, 22 nt, Yersinia pestis KIM
caaugccgauccacggguauua

SEQ ID NO: 2294521 - RNA, 14 nt, Yersinia pestis KIM
caaucucaucaauc

SEQ ID NO: 2294522 - RNA, 16 nt, Yersinia pestis KIM
caauccuacauucagu

SEQ ID NO: 2294523 - RNA, 16 nt, Yersinia pestis KIM
caaucgaugagcuggu

SEQ ID NO: 2294524 - RNA, 13 nt, Yersinia pestis KIM
caaucaccccaga

SEQ ID NO: 2294525 - RNA, 23 nt, Yersinia pestis KIM
caaggaaaccaccuaauacagca

SEQ ID NO: 2294526 - RNA, 15 nt, Yersinia pestis KIM
caaguaaaagucagc

SEQ ID NO: 2294527 - RNA, 11 nt, Yersinia pestis KIM
caagguuuccc

SEQ ID NO: 2294528 - RNA, 21 nt, Yersinia pestis KIM
caaggcuuuaauaucuuuaaa

SEQ ID NO: 2294529 - RNA, 19 nt, Yersinia pestis KIM
caauacuggccaugugugu

SEQ ID NO: 2294530 - RNA, 18 nt, Yersinia pestis KIM
caauagaaaaacacuggc

SEQ ID NO: 2294531 - RNA, 20 nt, Yersinia pestis KIM
caauaugaaggccauaaucu

SEQ ID NO: 2294532 - RNA, 22 nt, Yersinia pestis KIM
caauauugcauaaaugacgagc

SEQ ID NO: 2294533 - RNA, 23 nt, Yersinia pestis KIM
caauaggucagugguuuuaucaa

SEQ ID NO: 2294534 - RNA, 18 nt, Yersinia pestis KIM
caauauaauaaugcugcc

SEQ ID NO: 2294535 - RNA, 13 nt, Yersinia pestis KIM
caauaauucagau

SEQ ID NO: 2294536 - RNA, 13 nt, Yersinia pestis KIM
caauaauaagccg

SEQ ID NO: 2294537 - RNA, 12 nt, Yersinia pestis KIM
caauaagccaga

SEQ ID NO: 2294538 - RNA, 16 nt, Yersinia pestis KIM
caauaacaaacacauc

SEQ ID NO: 2294539 - RNA, 15 nt, Yersinia pestis KIM
caauaaccucagccu

SEQ ID NO: 2294540 - RNA, 18 nt, Yersinia pestis KIM
caauaaaggcaagauuuc

SEQ ID NO: 2294541 - RNA, 21 nt, Yersinia pestis KIM
caauaaauauccuccggcaua

SEQ ID NO: 2294542 - RNA, 18 nt, Yersinia pestis KIM
caauaaacgcucggcacc

SEQ ID NO: 2294543 - RNA, 15 nt, Yersinia pestis KIM
caauaaaaacgccuc

SEQ ID NO: 2294544 - RNA, 15 nt, Yersinia pestis KIM
caaguuucacuuuca

SEQ ID NO: 2294545 - RNA, 13 nt, Yersinia pestis KIM
caauaaaacucac

SEQ ID NO: 2294546 - RNA, 12 nt, Yersinia pestis KIM
caaguucaagca

SEQ ID NO: 2294547 - RNA, 20 nt, Yersinia pestis KIM
ugcgcaaauccugaauggca

SEQ ID NO: 2294548 - RNA, 17 nt, Yersinia pestis KIM
aauaguacuugccacaa

SEQ ID NO: 2294549 - RNA, 19 nt, Yersinia pestis KIM
ugccgcgcccccagccauu

SEQ ID NO: 2294550 - RNA, 19 nt, Yersinia pestis KIM
ugccguuauagaucuccug

SEQ ID NO: 2294551 - RNA, 12 nt, Yersinia pestis KIM
aauagauaacaa

SEQ ID NO: 2294552 - RNA, 15 nt, Yersinia pestis KIM
aauagaucccauacc

SEQ ID NO: 2294553 - RNA, 18 nt, Yersinia pestis KIM
ugccguuuaaaucgggca

SEQ ID NO: 2294554 - RNA, 18 nt, Yersinia pestis KIM
ugccugacgcggugacaa

SEQ ID NO: 2294555 - RNA, 20 nt, Yersinia pestis KIM
ugcgcuccacgccccaacgg

SEQ ID NO: 2294556 - RNA, 23 nt, Yersinia pestis KIM
ugcggaauucaggccuugauggc

SEQ ID NO: 2294557 - RNA, 20 nt, Yersinia pestis KIM
ugcgcaucaaugauucgcug

SEQ ID NO: 2294558 - RNA, 15 nt, Yersinia pestis KIM
ugcgcaucagccagc

SEQ ID NO: 2294559 - RNA, 13 nt, Yersinia pestis KIM
ugcuggcgcaacu

SEQ ID NO: 2294560 - RNA, 20 nt, Yersinia pestis KIM
ugcugcgaagaucacucaug

SEQ ID NO: 2294561 - RNA, 13 nt, Yersinia pestis KIM
ugcucaacugcuc

SEQ ID NO: 2294562 - RNA, 18 nt, Yersinia pestis KIM
ugcucagauacaucaaug

SEQ ID NO: 2294563 - RNA, 23 nt, Yersinia pestis KIM
ugcuaagggaguauacggucaaa

SEQ ID NO: 2294564 - RNA, 19 nt, Yersinia pestis KIM
ugcuaccuguaacauuacu

SEQ ID NO: 2294565 - RNA, 15 nt, Yersinia pestis KIM
ugcuagugaaccgua

SEQ ID NO: 2294566 - RNA, 14 nt, Yersinia pestis KIM
aauaucaggcacug

SEQ ID NO: 2294567 - RNA, 16 nt, Yersinia pestis KIM
ugcgucaguucaagca

SEQ ID NO: 2294568 - RNA, 14 nt, Yersinia pestis KIM
ugcgucauaccauu

SEQ ID NO: 2294569 - RNA, 15 nt, Yersinia pestis KIM
uggauuacuuacggc

SEQ ID NO: 2294570 - RNA, 13 nt, Yersinia pestis KIM
uggauucaccaag

SEQ ID NO: 2294571 - RNA, 16 nt, Yersinia pestis KIM
uggauguauuuacggc

SEQ ID NO: 2294572 - RNA, 16 nt, Yersinia pestis KIM
uggauagcuucaggaa

SEQ ID NO: 2294573 - RNA, 17 nt, Yersinia pestis KIM
uggauaaggugaugaau

SEQ ID NO: 2294574 - RNA, 14 nt, Yersinia pestis KIM
ugcuguaaugccug

SEQ ID NO: 2294575 - RNA, 15 nt, Yersinia pestis KIM
uggcauacagcucau

SEQ ID NO: 2294576 - RNA, 21 nt, Yersinia pestis KIM
uggcagugacauuaccugcgc

SEQ ID NO: 2294577 - RNA, 14 nt, Yersinia pestis KIM
uggccucgaagagg

SEQ ID NO: 2294578 - RNA, 20 nt, Yersinia pestis KIM
ugggaauuaagaagccucau

SEQ ID NO: 2294579 - RNA, 22 nt, Yersinia pestis KIM
ugggaauuaagaagccucauga

SEQ ID NO: 2294580 - RNA, 17 nt, Yersinia pestis KIM
uggcuugcuugauggca

SEQ ID NO: 2294581 - RNA, 16 nt, Yersinia pestis KIM
uggcugcgagauggcg

SEQ ID NO: 2294582 - RNA, 14 nt, Yersinia pestis KIM
ugggauaugccgua

SEQ ID NO: 2294583 - RNA, 19 nt, Yersinia pestis KIM
ugggcaucaacgcccagcu

SEQ ID NO: 2294584 - RNA, 14 nt, Yersinia pestis KIM
uggcguaaccgccg

SEQ ID NO: 2294585 - RNA, 16 nt, Yersinia pestis KIM
uggcugagauuuagau

SEQ ID NO: 2294586 - RNA, 14 nt, Yersinia pestis KIM
uggcguuuauuuac

SEQ ID NO: 2294587 - RNA, 22 nt, Yersinia pestis KIM
uggcguugacagacaacgggcg

SEQ ID NO: 2294588 - RNA, 19 nt, Yersinia pestis KIM
ugggcauuggauaauuugc

SEQ ID NO: 2294589 - RNA, 14 nt, Yersinia pestis KIM
ugggccugccaugu

SEQ ID NO: 2294590 - RNA, 21 nt, Yersinia pestis KIM
uggguaaaccaaucaagcaua

SEQ ID NO: 2294591 - RNA, 18 nt, Yersinia pestis KIM
uggguaauucauuauuac

SEQ ID NO: 2294592 - RNA, 21 nt, Yersinia pestis KIM
ugguaaucgucccacaugaac

SEQ ID NO: 2294593 - RNA, 14 nt, Yersinia pestis KIM
ugguacugaccgua

SEQ ID NO: 2294594 - RNA, 17 nt, Yersinia pestis KIM
uggucagcacaaacagc

SEQ ID NO: 2294595 - RNA, 18 nt, Yersinia pestis KIM
uggugagcgccaugcgcu

SEQ ID NO: 2294596 - RNA, 23 nt, Yersinia pestis KIM
uggucgcuuuuuacugaccgcua

SEQ ID NO: 2294597 - RNA, 21 nt, Yersinia pestis KIM
aaucaacgcucaaucacgaca

SEQ ID NO: 2294598 - RNA, 15 nt, Yersinia pestis KIM
aaucaaucaauugcc

SEQ ID NO: 2294599 - RNA, 18 nt, Yersinia pestis KIM
uggugauaacugccauac

SEQ ID NO: 2294600 - RNA, 16 nt, Yersinia pestis KIM
ugguucgagacaacgu

SEQ ID NO: 2294601 - RNA, 13 nt, Yersinia pestis KIM
ugguucgggcaau

SEQ ID NO: 2294602 - RNA, 20 nt, Yersinia pestis KIM
ugguuauccuauucagcagc

SEQ ID NO: 2294603 - RNA, 18 nt, Yersinia pestis KIM
uguaaauguacagucauu

SEQ ID NO: 2294604 - RNA, 20 nt, Yersinia pestis KIM
uguaacacacagcagacagc

SEQ ID NO: 2294605 - RNA, 11 nt, Yersinia pestis KIM
uguaaccgccu

SEQ ID NO: 2294606 - RNA, 21 nt, Yersinia pestis KIM
uguauuacggccccagcccag

SEQ ID NO: 2294607 - RNA, 16 nt, Yersinia pestis KIM
uuguuacgccuucagc

SEQ ID NO: 2294608 - RNA, 14 nt, Yersinia pestis KIM
uuguucgugaaagc

SEQ ID NO: 2294609 - RNA, 18 nt, Yersinia pestis KIM
uuguucaggcagauaaau

SEQ ID NO: 2294610 - RNA, 20 nt, Yersinia pestis KIM
uuguauacuguuuauuaaug

SEQ ID NO: 2294611 - RNA, 17 nt, Yersinia pestis KIM
uuuacuggcugccuacc

SEQ ID NO: 2294612 - RNA, 16 nt, Yersinia pestis KIM
uuuacucgccuuucac

SEQ ID NO: 2294613 - RNA, 16 nt, Yersinia pestis KIM
uuuaauaugugacaau

SEQ ID NO: 2294614 - RNA, 20 nt, Yersinia pestis KIM
uuuaauggcauacuccgcug

SEQ ID NO: 2294615 - RNA, 23 nt, Yersinia pestis KIM
uuuagacaagcgcaguagcggcu

SEQ ID NO: 2294616 - RNA, 17 nt, Yersinia pestis KIM
uuuagaggcugauaacc

SEQ ID NO: 2294617 - RNA, 15 nt, Yersinia pestis KIM
uuuaggccuauaacc

SEQ ID NO: 2294618 - RNA, 15 nt, Yersinia pestis KIM
uuuaggaaagcccaa

SEQ ID NO: 2294619 - RNA, 18 nt, Yersinia pestis KIM
uuuauaaaaccacugacc

SEQ ID NO: 2294620 - RNA, 20 nt, Yersinia pestis KIM
uuuaguugcuauuuccccgc

SEQ ID NO: 2294621 - RNA, 14 nt, Yersinia pestis KIM
uuuauggcgaugau

SEQ ID NO: 2294622 - RNA, 16 nt, Yersinia pestis KIM
uuuauccacuuggcua

SEQ ID NO: 2294623 - RNA, 18 nt, Yersinia pestis KIM
uuucagacugcugacaac

SEQ ID NO: 2294624 - RNA, 15 nt, Yersinia pestis KIM
uuucagacugcugac

SEQ ID NO: 2294625 - RNA, 19 nt, Yersinia pestis KIM
uuucaucccauauuccggu

SEQ ID NO: 2294626 - RNA, 23 nt, Yersinia pestis KIM
uuucgacgguuuuuuggcugaua

SEQ ID NO: 2294627 - RNA, 14 nt, Yersinia pestis KIM
uugcggcaauggcu

SEQ ID NO: 2294628 - RNA, 16 nt, Yersinia pestis KIM
uugcgcgccuguuuac

SEQ ID NO: 2294629 - RNA, 15 nt, Yersinia pestis KIM
uugcuggcgcugauc

SEQ ID NO: 2294630 - RNA, 20 nt, Yersinia pestis KIM
uugcggcguuucucagacug

SEQ ID NO: 2294631 - RNA, 14 nt, Yersinia pestis KIM
uugcuaauuugcgg

SEQ ID NO: 2294632 - RNA, 19 nt, Yersinia pestis KIM
uugcuacuggccuggcuga

SEQ ID NO: 2294633 - RNA, 14 nt, Yersinia pestis KIM
uugcuucugaacga

SEQ ID NO: 2294634 - RNA, 14 nt, Yersinia pestis KIM
uugcuuaucgucaa

SEQ ID NO: 2294635 - RNA, 22 nt, Yersinia pestis KIM
uugcuuaagcacuaaaucgcag

SEQ ID NO: 2294636 - RNA, 12 nt, Yersinia pestis KIM
uugcuucaucca

SEQ ID NO: 2294637 - RNA, 23 nt, Yersinia pestis KIM
uuggaauagcuguaaaauaccaa

SEQ ID NO: 2294638 - RNA, 14 nt, Yersinia pestis KIM
uuggacaucugcuu

SEQ ID NO: 2294639 - RNA, 18 nt, Yersinia pestis KIM
uuggauauagagauaaaa

SEQ ID NO: 2294640 - RNA, 18 nt, Yersinia pestis KIM
uuggcuaaaccacggcgu

SEQ ID NO: 2294641 - RNA, 18 nt, Yersinia pestis KIM
uuggcuugcuugauggca

SEQ ID NO: 2294642 - RNA, 22 nt, Yersinia pestis KIM
aaucugcaaugucauuaauugg

SEQ ID NO: 2294643 - RNA, 18 nt, Yersinia pestis KIM
aaucugcaguagagcggu

SEQ ID NO: 2294644 - RNA, 19 nt, Yersinia pestis KIM
aaugcaucgcaucagacgg

SEQ ID NO: 2294645 - RNA, 20 nt, Yersinia pestis KIM
aaugcccuuuugugcaucca

SEQ ID NO: 2294646 - RNA, 15 nt, Yersinia pestis KIM
aaugauucauugagu

SEQ ID NO: 2294647 - RNA, 17 nt, Yersinia pestis KIM
aaugauuaacggauacc

SEQ ID NO: 2294648 - RNA, 19 nt, Yersinia pestis KIM
aaucuuccagcggcaaaua

SEQ ID NO: 2294649 - RNA, 19 nt, Yersinia pestis KIM
aaucugggguuccaggccc

SEQ ID NO: 2294650 - RNA, 14 nt, Yersinia pestis KIM
uuuuauugacggcu

SEQ ID NO: 2294651 - RNA, 13 nt, Yersinia pestis KIM
uuuuauugccuac

SEQ ID NO: 2294652 - RNA, 14 nt, Yersinia pestis KIM
uuuguugcuacugg

SEQ ID NO: 2294653 - RNA, 16 nt, Yersinia pestis KIM
uuuguuagcaauuuga

SEQ ID NO: 2294654 - RNA, 12 nt, Yersinia pestis KIM
uuuucauccuaa

SEQ ID NO: 2294655 - RNA, 15 nt, Yersinia pestis KIM
aauucaucagcgcug

SEQ ID NO: 2294656 - RNA, 19 nt, Yersinia pestis KIM
aauuccauaauaagugaac

SEQ ID NO: 2294657 - RNA, 21 nt, Yersinia pestis KIM
aauuccauuuaagccaauaau

SEQ ID NO: 2294658 - RNA, 16 nt, Yersinia pestis KIM
aauucccgcgccguga

SEQ ID NO: 2294659 - RNA, 19 nt, Yersinia pestis KIM
aauuaucugaauagcgcug

SEQ ID NO: 2294660 - RNA, 14 nt, Yersinia pestis KIM
aauuaucuuaucca

SEQ ID NO: 2294661 - RNA, 21 nt, Yersinia pestis KIM
aauuagguaacuuuccaucca

SEQ ID NO: 2294662 - RNA, 13 nt, Yersinia pestis KIM
aauugccuuugcg

SEQ ID NO: 2294663 - RNA, 21 nt, Yersinia pestis KIM
aauuggcucuggaaaucacgu

SEQ ID NO: 2294664 - RNA, 16 nt, Yersinia pestis KIM
aauugaccagcgaauc

SEQ ID NO: 2294665 - RNA, 15 nt, Yersinia pestis KIM
aauugacgccacuua

SEQ ID NO: 2294666 - RNA, 18 nt, Yersinia pestis KIM
aauugacuuuuuuaucgc

SEQ ID NO: 2294667 - RNA, 16 nt, Yersinia pestis KIM
aauuuaauuaguuuau

SEQ ID NO: 2294668 - RNA, 21 nt, Yersinia pestis KIM
aauuucuacgccgucaucauc

SEQ ID NO: 2294669 - RNA, 15 nt, Yersinia pestis KIM
uguuuuuuagcauca

SEQ ID NO: 2294670 - RNA, 12 nt, Yersinia pestis KIM
uuaaggacucuu

SEQ ID NO: 2294671 - RNA, 21 nt, Yersinia pestis KIM
uuaagcuauugguuauugauu

SEQ ID NO: 2294672 - RNA, 14 nt, Yersinia pestis KIM
uuaaggaacgggua

SEQ ID NO: 2294673 - RNA, 16 nt, Yersinia pestis KIM
uuaaggaacggguaau

SEQ ID NO: 2294674 - RNA, 21 nt, Yersinia pestis KIM
uuaagccaauaauauaaucag

SEQ ID NO: 2294675 - RNA, 19 nt, Yersinia pestis KIM
uuaagaccccugcgauaau

SEQ ID NO: 2294676 - RNA, 19 nt, Yersinia pestis KIM
uuaacuuuucuucauugcu

SEQ ID NO: 2294677 - RNA, 17 nt, Yersinia pestis KIM
uuaacuauuugaugcua

SEQ ID NO: 2294678 - RNA, 19 nt, Yersinia pestis KIM
uuaauaaauuauaaugaug

SEQ ID NO: 2294679 - RNA, 21 nt, Yersinia pestis KIM
uuaccgaggcucgacgggaac

SEQ ID NO: 2294680 - RNA, 14 nt, Yersinia pestis KIM
uguugcgccauaau

SEQ ID NO: 2294681 - RNA, 15 nt, Yersinia pestis KIM
uguuguggcagcguu

SEQ ID NO: 2294682 - RNA, 22 nt, Yersinia pestis KIM
uguuggucaccacuugcagguu

SEQ ID NO: 2294683 - RNA, 22 nt, Yersinia pestis KIM
uguguaguugaaguucacaccg

SEQ ID NO: 2294684 - RNA, 18 nt, Yersinia pestis KIM
uguuaacgcgccggaauu

SEQ ID NO: 2294685 - RNA, 21 nt, Yersinia pestis KIM
uuacugcgauauuguuggcga

SEQ ID NO: 2294686 - RNA, 21 nt, Yersinia pestis KIM
uuacugcaucuauugugucaa

SEQ ID NO: 2294687 - RNA, 23 nt, Yersinia pestis KIM
uuaccugcgcgaccccaagcggu

SEQ ID NO: 2294688 - RNA, 14 nt, Yersinia pestis KIM
uuaccuugugcggu

SEQ ID NO: 2294689 - RNA, 18 nt, Yersinia pestis KIM
uuacuguaagauaauucg

SEQ ID NO: 2294690 - RNA, 18 nt, Yersinia pestis KIM
uuacuugauggcuguuuu

SEQ ID NO: 2294691 - RNA, 13 nt, Yersinia pestis KIM
uuauaugaaucag

SEQ ID NO: 2294692 - RNA, 22 nt, Yersinia pestis KIM
uuauaugcuugacugcguucug

SEQ ID NO: 2294693 - RNA, 16 nt, Yersinia pestis KIM
uuauguaguuaaucua

SEQ ID NO: 2294694 - RNA, 17 nt, Yersinia pestis KIM
uuauucugcucccaugu

SEQ ID NO: 2294695 - RNA, 17 nt, Yersinia pestis KIM
uuaucgcuguuuacuga

SEQ ID NO: 2294696 - RNA, 14 nt, Yersinia pestis KIM
uuaucuagcgucca

SEQ ID NO: 2294697 - RNA, 17 nt, Yersinia pestis KIM
uuaucuagcguccaugu

SEQ ID NO: 2294698 - RNA, 13 nt, Yersinia pestis KIM
uuaugacggcauc

SEQ ID NO: 2294699 - RNA, 16 nt, Yersinia pestis KIM
uuaucuccgccauuga

SEQ ID NO: 2294700 - RNA, 21 nt, Yersinia pestis KIM
uucagcccccucaauaccggu

SEQ ID NO: 2294701 - RNA, 20 nt, Yersinia pestis KIM
uucagccaccagauuacgcg

SEQ ID NO: 2294702 - RNA, 12 nt, Yersinia pestis KIM
uucaaucacugc

SEQ ID NO: 2294703 - RNA, 14 nt, Yersinia pestis KIM
uucaacauccaguu

SEQ ID NO: 2294704 - RNA, 23 nt, Yersinia pestis KIM
uucaacgcugcccgucaauauca

SEQ ID NO: 2294705 - RNA, 14 nt, Yersinia pestis KIM
uucgcugauuaaug

SEQ ID NO: 2294706 - RNA, 17 nt, Yersinia pestis KIM
uucgcugcuaaacaggg

SEQ ID NO: 2294707 - RNA, 15 nt, Yersinia pestis KIM
uucgagcaccgcgcu

SEQ ID NO: 2294708 - RNA, 14 nt, Yersinia pestis KIM
uucccgcaggcggc

SEQ ID NO: 2294709 - RNA, 17 nt, Yersinia pestis KIM
uuccggacggagaaucg

SEQ ID NO: 2294710 - RNA, 20 nt, Yersinia pestis KIM
uucaguuuauuuaagcugaa

SEQ ID NO: 2294711 - RNA, 18 nt, Yersinia pestis KIM
uucaguuuuuaggucaau

SEQ ID NO: 2294712 - RNA, 21 nt, Yersinia pestis KIM
uucaguuggccaccauucgcc

SEQ ID NO: 2294713 - RNA, 18 nt, Yersinia pestis KIM
uucauagguagaauagca

SEQ ID NO: 2294714 - RNA, 19 nt, Yersinia pestis KIM
uucauaucgauaccgauaa

SEQ ID NO: 2294715 - RNA, 21 nt, Yersinia pestis KIM
uuccgucccaagaaaagcacc

SEQ ID NO: 2294716 - RNA, 16 nt, Yersinia pestis KIM
uugaccuuagauaaau

SEQ ID NO: 2294717 - RNA, 15 nt, Yersinia pestis KIM
uugaccggucacacc

SEQ ID NO: 2294718 - RNA, 13 nt, Yersinia pestis KIM
uugaacggugagg

SEQ ID NO: 2294719 - RNA, 21 nt, Yersinia pestis KIM
uugaacggugaggauaggcag

SEQ ID NO: 2294720 - RNA, 20 nt, Yersinia pestis KIM
uugauaugcuucacaucaua

SEQ ID NO: 2294721 - RNA, 16 nt, Yersinia pestis KIM
uugauaguuaccaugg

SEQ ID NO: 2294722 - RNA, 13 nt, Yersinia pestis KIM
uugauaauggcau

SEQ ID NO: 2294723 - RNA, 17 nt, Yersinia pestis KIM
uugauacaguaauuaag

SEQ ID NO: 2294724 - RNA, 17 nt, Yersinia pestis KIM
uugaguaaguucgucag

SEQ ID NO: 2294725 - RNA, 13 nt, Yersinia pestis KIM
uugagucucuggc

SEQ ID NO: 2294726 - RNA, 17 nt, Yersinia pestis KIM
uugagauuaauccaugu

SEQ ID NO: 2294727 - RNA, 14 nt, Yersinia pestis KIM
uugagcauauucag

SEQ ID NO: 2294728 - RNA, 13 nt, Yersinia pestis KIM
uucgguaaucaau

SEQ ID NO: 2294729 - RNA, 15 nt, Yersinia pestis KIM
uucuccacaccaacg

SEQ ID NO: 2294730 - RNA, 17 nt, Yersinia pestis KIM
uucucuacaucauaacg

SEQ ID NO: 2294731 - RNA, 13 nt, Yersinia pestis KIM
uucuauaaugaug

SEQ ID NO: 2294732 - RNA, 12 nt, Yersinia pestis KIM
uugaaauaccac

SEQ ID NO: 2294733 - RNA, 16 nt, Yersinia pestis KIM
uugaaauaacugccag

SEQ ID NO: 2294734 - RNA, 20 nt, Yersinia pestis KIM
uugaaauguccacuguacag

SEQ ID NO: 2294735 - RNA, 16 nt, Yersinia pestis KIM
uucuuuggcaucaaug

SEQ ID NO: 2294736 - RNA, 16 nt, Yersinia pestis KIM
accguacauuaaauga

SEQ ID NO: 2294737 - RNA, 14 nt, Yersinia pestis KIM
accguaaccacauu

SEQ ID NO: 2294738 - RNA, 22 nt, Yersinia pestis KIM
accguaacgggccgcauucacc

SEQ ID NO: 2294739 - RNA, 18 nt, Yersinia pestis KIM
accggcggggaaauagca

SEQ ID NO: 2294740 - RNA, 21 nt, Yersinia pestis KIM
accgcuguaaacuggcagaua

SEQ ID NO: 2294741 - RNA, 22 nt, Yersinia pestis KIM
accgcacacugacagcaacgac

SEQ ID NO: 2294742 - RNA, 15 nt, Yersinia pestis KIM
accgccagcugaccc

SEQ ID NO: 2294743 - RNA, 20 nt, Yersinia pestis KIM
acccaaugccauagcugcug

SEQ ID NO: 2294744 - RNA, 18 nt, Yersinia pestis KIM
acccaauauucgccagau

SEQ ID NO: 2294745 - RNA, 13 nt, Yersinia pestis KIM
acccacaccgcag

SEQ ID NO: 2294746 - RNA, 18 nt, Yersinia pestis KIM
acccaaccccaucagcau

SEQ ID NO: 2294747 - RNA, 21 nt, Yersinia pestis KIM
acccgcaguuugagaaacuga

SEQ ID NO: 2294748 - RNA, 16 nt, Yersinia pestis KIM
acccgucaccacaaag

SEQ ID NO: 2294749 - RNA, 22 nt, Yersinia pestis KIM
acccuauuuuugccaaugcugc

SEQ ID NO: 2294750 - RNA, 20 nt, Yersinia pestis KIM
accagucugcauacagaucg

SEQ ID NO: 2294751 - RNA, 19 nt, Yersinia pestis KIM
accaucgacuggccgauau

SEQ ID NO: 2294752 - RNA, 14 nt, Yersinia pestis KIM
accauaacugcugc

SEQ ID NO: 2294753 - RNA, 14 nt, Yersinia pestis KIM
accaugaugacaau

SEQ ID NO: 2294754 - RNA, 18 nt, Yersinia pestis KIM
accaugagaaugcgacau

SEQ ID NO: 2294755 - RNA, 14 nt, Yersinia pestis KIM
accacgagugacgg

SEQ ID NO: 2294756 - RNA, 15 nt, Yersinia pestis KIM
acauucaagccuaau

SEQ ID NO: 2294757 - RNA, 20 nt, Yersinia pestis KIM
accaaugccccggauugcug

SEQ ID NO: 2294758 - RNA, 13 nt, Yersinia pestis KIM
accaccacugcau

SEQ ID NO: 2294759 - RNA, 18 nt, Yersinia pestis KIM
accacaaaggucagcaug

SEQ ID NO: 2294760 - RNA, 21 nt, Yersinia pestis KIM
accagaauuugcagaucggca

SEQ ID NO: 2294761 - RNA, 20 nt, Yersinia pestis KIM
acagauauauccaggcacug

SEQ ID NO: 2294762 - RNA, 19 nt, Yersinia pestis KIM
acagaucagcgugacguua

SEQ ID NO: 2294763 - RNA, 15 nt, Yersinia pestis KIM
acagagagauaaucu

SEQ ID NO: 2294764 - RNA, 19 nt, Yersinia pestis KIM
acagcaucaacauggaugu

SEQ ID NO: 2294765 - RNA, 14 nt, Yersinia pestis KIM
acagcccgguauca

SEQ ID NO: 2294766 - RNA, 15 nt, Yersinia pestis KIM
acaccggcugcaaua

SEQ ID NO: 2294767 - RNA, 17 nt, Yersinia pestis KIM
acaccuccaaaugucag

SEQ ID NO: 2294768 - RNA, 23 nt, Yersinia pestis KIM
aauuucuugaggugcuugaacaa

SEQ ID NO: 2294769 - RNA, 14 nt, Yersinia pestis KIM
aauuucuugucacc

SEQ ID NO: 2294770 - RNA, 12 nt, Yersinia pestis KIM
aauuugcugcuc

SEQ ID NO: 2294771 - RNA, 15 nt, Yersinia pestis KIM
acacauaaaaucagc

SEQ ID NO: 2294772 - RNA, 22 nt, Yersinia pestis KIM
acacagguucccaucccuuuga

SEQ ID NO: 2294773 - RNA, 14 nt, Yersinia pestis KIM
acaggcaauuaucc

SEQ ID NO: 2294774 - RNA, 14 nt, Yersinia pestis KIM
acauccaauucagu

SEQ ID NO: 2294775 - RNA, 15 nt, Yersinia pestis KIM
acgcucuaacgucag

SEQ ID NO: 2294776 - RNA, 16 nt, Yersinia pestis KIM
acgcucuaacgucaga

SEQ ID NO: 2294777 - RNA, 12 nt, Yersinia pestis KIM
acgcucaucaac

SEQ ID NO: 2294778 - RNA, 16 nt, Yersinia pestis KIM
acgcucaucaaccggg

SEQ ID NO: 2294779 - RNA, 23 nt, Yersinia pestis KIM
acgcucaucaaccgggauaucaa

SEQ ID NO: 2294780 - RNA, 21 nt, Yersinia pestis KIM
acgcucauaccaugccaucaa

SEQ ID NO: 2294781 - RNA, 18 nt, Yersinia pestis KIM
acgcguucaccgcuggca

SEQ ID NO: 2294782 - RNA, 16 nt, Yersinia pestis KIM
acgcgucugcuggcgu

SEQ ID NO: 2294783 - RNA, 13 nt, Yersinia pestis KIM
accuucuuaauga

SEQ ID NO: 2294784 - RNA, 19 nt, Yersinia pestis KIM
accugugcaccacacagcg

SEQ ID NO: 2294785 - RNA, 14 nt, Yersinia pestis KIM
accguuguguauca

SEQ ID NO: 2294786 - RNA, 15 nt, Yersinia pestis KIM
accuaaugcaauggc

SEQ ID NO: 2294787 - RNA, 19 nt, Yersinia pestis KIM
acgauaacgcucuuguagc

SEQ ID NO: 2294788 - RNA, 23 nt, Yersinia pestis KIM
acgaguuuucccugcgccagcag

SEQ ID NO: 2294789 - RNA, 12 nt, Yersinia pestis KIM
acgaguauuccc

SEQ ID NO: 2294790 - RNA, 23 nt, Yersinia pestis KIM
acgacagcagcaggccauauucc

SEQ ID NO: 2294791 - RNA, 12 nt, Yersinia pestis KIM
acgccaucaaua

SEQ ID NO: 2294792 - RNA, 22 nt, Yersinia pestis KIM
acgccagauagcaucauccagc

SEQ ID NO: 2294793 - RNA, 21 nt, Yersinia pestis KIM
acgcagcuuuuucucacgaag

SEQ ID NO: 2294794 - RNA, 13 nt, Yersinia pestis KIM
acgaucacugcuu

SEQ ID NO: 2294795 - RNA, 16 nt, Yersinia pestis KIM
acgaucagaacguuaa

SEQ ID NO: 2294796 - RNA, 23 nt, Yersinia pestis KIM
acgaugccgauaaagauggcauu

SEQ ID NO: 2294797 - RNA, 16 nt, Yersinia pestis KIM
acgauuuucuuucacc

SEQ ID NO: 2294798 - RNA, 18 nt, Yersinia pestis KIM
acgcaaagggcaacaaua

SEQ ID NO: 2294799 - RNA, 12 nt, Yersinia pestis KIM
acggcucaucac

SEQ ID NO: 2294800 - RNA, 20 nt, Yersinia pestis KIM
acgggcaaugguagccaauc

SEQ ID NO: 2294801 - RNA, 14 nt, Yersinia pestis KIM
acggagcguacacg

SEQ ID NO: 2294802 - RNA, 19 nt, Yersinia pestis KIM
acggcguuugacaauauca

SEQ ID NO: 2294803 - RNA, 16 nt, Yersinia pestis KIM
acguacauauaucacu

SEQ ID NO: 2294804 - RNA, 17 nt, Yersinia pestis KIM
acgguuucaacuucaac

SEQ ID NO: 2294805 - RNA, 22 nt, Yersinia pestis KIM
acgguuuaucccccucguuaga

SEQ ID NO: 2294806 - RNA, 16 nt, Yersinia pestis KIM
acgucccuaaagccau

SEQ ID NO: 2294807 - RNA, 15 nt, Yersinia pestis KIM
acuaauaucaacaga

SEQ ID NO: 2294808 - RNA, 19 nt, Yersinia pestis KIM
acguuaucaauacugcaaa

SEQ ID NO: 2294809 - RNA, 18 nt, Yersinia pestis KIM
acuugccacaacugaaug

SEQ ID NO: 2294810 - RNA, 16 nt, Yersinia pestis KIM
acuugcaacauuaucc

SEQ ID NO: 2294811 - RNA, 18 nt, Yersinia pestis KIM
acuuggcuaauugucaca

SEQ ID NO: 2294812 - RNA, 20 nt, Yersinia pestis KIM
acuugaauuaugacggguau

SEQ ID NO: 2294813 - RNA, 13 nt, Yersinia pestis KIM
agaaaagcagacu

SEQ ID NO: 2294814 - RNA, 15 nt, Yersinia pestis KIM
acuucacuucagaac

SEQ ID NO: 2294815 - RNA, 18 nt, Yersinia pestis KIM
acuucgccuuaucagcga

SEQ ID NO: 2294816 - RNA, 21 nt, Yersinia pestis KIM
acuuaacgguaugacggguau

SEQ ID NO: 2294817 - RNA, 19 nt, Yersinia pestis KIM
acuuaaauaacucagugac

SEQ ID NO: 2294818 - RNA, 19 nt, Yersinia pestis KIM
acuuacucucuccgcaaug

SEQ ID NO: 2294819 - RNA, 22 nt, Yersinia pestis KIM
acuuaauucccguuguuuaucc

SEQ ID NO: 2294820 - RNA, 17 nt, Yersinia pestis KIM
acugucaaaauccggau

SEQ ID NO: 2294821 - RNA, 18 nt, Yersinia pestis KIM
acugucaaaaagcaccuu

SEQ ID NO: 2294822 - RNA, 13 nt, Yersinia pestis KIM
acugucugagcaa

SEQ ID NO: 2294823 - RNA, 22 nt, Yersinia pestis KIM
acugugauaaccaacaguuauu

SEQ ID NO: 2294824 - RNA, 22 nt, Yersinia pestis KIM
acuguugcgggcaucagcccau

SEQ ID NO: 2294825 - RNA, 22 nt, Yersinia pestis KIM
acucaagauugccgcaaggcca

SEQ ID NO: 2294826 - RNA, 15 nt, Yersinia pestis KIM
acucaccgccagcaa

SEQ ID NO: 2294827 - RNA, 17 nt, Yersinia pestis KIM
acugacaaaaacagcac

SEQ ID NO: 2294828 - RNA, 17 nt, Yersinia pestis KIM
acugacagcggucggua

SEQ ID NO: 2294829 - RNA, 19 nt, Yersinia pestis KIM
acugagcaaacagugcaca

SEQ ID NO: 2294830 - RNA, 13 nt, Yersinia pestis KIM
acugauagauuca

SEQ ID NO: 2294831 - RNA, 20 nt, Yersinia pestis KIM
acucugguccagaucggcaa

SEQ ID NO: 2294832 - RNA, 19 nt, Yersinia pestis KIM
acugcucaacugcucaacu

SEQ ID NO: 2294833 - RNA, 16 nt, Yersinia pestis KIM
acugcgcgcugaacgu

SEQ ID NO: 2294834 - RNA, 19 nt, Yersinia pestis KIM
acugcauugagacccguua

SEQ ID NO: 2294835 - RNA, 14 nt, Yersinia pestis KIM
acuggcugaaguua

SEQ ID NO: 2294836 - RNA, 13 nt, Yersinia pestis KIM
acuggcgggcaca

SEQ ID NO: 2294837 - RNA, 23 nt, Yersinia pestis KIM
guguccgcgccauaaaagauaac

SEQ ID NO: 2294838 - RNA, 14 nt, Yersinia pestis KIM
guguggcagucacu

SEQ ID NO: 2294839 - RNA, 15 nt, Yersinia pestis KIM
guggcauguucagca

SEQ ID NO: 2294840 - RNA, 15 nt, Yersinia pestis KIM
guggcagucacugcu

SEQ ID NO: 2294841 - RNA, 20 nt, Yersinia pestis KIM
guggucagcaucucauucug

SEQ ID NO: 2294842 - RNA, 15 nt, Yersinia pestis KIM
guucaccccucaccc

SEQ ID NO: 2294843 - RNA, 20 nt, Yersinia pestis KIM
guucagagauaaucagaggu

SEQ ID NO: 2294844 - RNA, 17 nt, Yersinia pestis KIM
guuauaacagcuuaccg

SEQ ID NO: 2294845 - RNA, 14 nt, Yersinia pestis KIM
guuaguucagacgu

SEQ ID NO: 2294846 - RNA, 21 nt, Yersinia pestis KIM
guuauauaaauggcuguuaua

SEQ ID NO: 2294847 - RNA, 17 nt, Yersinia pestis KIM
guuauccgauugaagag

SEQ ID NO: 2294848 - RNA, 20 nt, Yersinia pestis KIM
guuaucauugcuccuguaua

SEQ ID NO: 2294849 - RNA, 14 nt, Yersinia pestis KIM
guuaguggcuuuaa

SEQ ID NO: 2294850 - RNA, 15 nt, Yersinia pestis KIM
guguuuugcuaaccg

SEQ ID NO: 2294851 - RNA, 17 nt, Yersinia pestis KIM
guguuuuucccuaccgu

SEQ ID NO: 2294852 - RNA, 16 nt, Yersinia pestis KIM
guguuuauaccaaagg

SEQ ID NO: 2294853 - RNA, 14 nt, Yersinia pestis KIM
guucaguaguggcu

SEQ ID NO: 2294854 - RNA, 20 nt, Yersinia pestis KIM
guucauaaauuaaaacugaa

SEQ ID NO: 2294855 - RNA, 11 nt, Yersinia pestis KIM
guucaucuucg

SEQ ID NO: 2294856 - RNA, 14 nt, Yersinia pestis KIM
gugcggcagugaac

SEQ ID NO: 2294857 - RNA, 17 nt, Yersinia pestis KIM
gugcgggaaucuugauu

SEQ ID NO: 2294858 - RNA, 19 nt, Yersinia pestis KIM
gugcgggaaucuugauuag

SEQ ID NO: 2294859 - RNA, 14 nt, Yersinia pestis KIM
guggacacgccguu

SEQ ID NO: 2294860 - RNA, 16 nt, Yersinia pestis KIM
gugcccggcaccuuca

SEQ ID NO: 2294861 - RNA, 23 nt, Yersinia pestis KIM
uaaaccgcuauaucaucagcaga

SEQ ID NO: 2294862 - RNA, 18 nt, Yersinia pestis KIM
uaaaccggcacaggcgcu

SEQ ID NO: 2294863 - RNA, 16 nt, Yersinia pestis KIM
uaacagccggccauuc

SEQ ID NO: 2294864 - RNA, 13 nt, Yersinia pestis KIM
uaaacgcccagcu

SEQ ID NO: 2294865 - RNA, 21 nt, Yersinia pestis KIM
uaaccaauguugggguagcca

SEQ ID NO: 2294866 - RNA, 19 nt, Yersinia pestis KIM
uaaccagugccgcccagcg

SEQ ID NO: 2294867 - RNA, 18 nt, Yersinia pestis KIM
uaacccaaugcuccgcaa

SEQ ID NO: 2294868 - RNA, 16 nt, Yersinia pestis KIM
uaaccauugguuaccc

SEQ ID NO: 2294869 - RNA, 19 nt, Yersinia pestis KIM
uaacggaaaaucaucgcuc

SEQ ID NO: 2294870 - RNA, 17 nt, Yersinia pestis KIM
uaacggaauucagaacg

SEQ ID NO: 2294871 - RNA, 21 nt, Yersinia pestis KIM
uaacgguuuaccggggcgauc

SEQ ID NO: 2294872 - RNA, 17 nt, Yersinia pestis KIM
uaacgccaccaaugcau

SEQ ID NO: 2294873 - RNA, 21 nt, Yersinia pestis KIM
uaacccuaccuaggccagcac

SEQ ID NO: 2294874 - RNA, 20 nt, Yersinia pestis KIM
uaaccgauguagccuaugga

SEQ ID NO: 2294875 - RNA, 20 nt, Yersinia pestis KIM
uaaccgaguuuuuugcgcca

SEQ ID NO: 2294876 - RNA, 21 nt, Yersinia pestis KIM
uaauagccucugucucuggua

SEQ ID NO: 2294877 - RNA, 20 nt, Yersinia pestis KIM
uaagcggaguuggcuagcau

SEQ ID NO: 2294878 - RNA, 22 nt, Yersinia pestis KIM
uaagccggucuuuuuacaagca

SEQ ID NO: 2294879 - RNA, 21 nt, Yersinia pestis KIM
uaagccuaauggugcuauuuc

SEQ ID NO: 2294880 - RNA, 14 nt, Yersinia pestis KIM
uaacugaucaauau

SEQ ID NO: 2294881 - RNA, 16 nt, Yersinia pestis KIM
uaacucgcgauaacgg

SEQ ID NO: 2294882 - RNA, 16 nt, Yersinia pestis KIM
uacaaccacugaacac

SEQ ID NO: 2294883 - RNA, 18 nt, Yersinia pestis KIM
uacacccgcuugcaaccu

SEQ ID NO: 2294884 - RNA, 18 nt, Yersinia pestis KIM
uaauguuucuauccgaaa

SEQ ID NO: 2294885 - RNA, 18 nt, Yersinia pestis KIM
uaaugguuguuaauuaag

SEQ ID NO: 2294886 - RNA, 16 nt, Yersinia pestis KIM
uaaucagacugcugac

SEQ ID NO: 2294887 - RNA, 21 nt, Yersinia pestis KIM
uaaucauauccauaaccgaug

SEQ ID NO: 2294888 - RNA, 22 nt, Yersinia pestis KIM
uaauuaacagcaucacugucua

SEQ ID NO: 2294889 - RNA, 13 nt, Yersinia pestis KIM
uaauuucacgcug

SEQ ID NO: 2294890 - RNA, 14 nt, Yersinia pestis KIM
uacagcaaauaccg

SEQ ID NO: 2294891 - RNA, 17 nt, Yersinia pestis KIM
uacaggccccaauccac

SEQ ID NO: 2294892 - RNA, 21 nt, Yersinia pestis KIM
uacaggccgcuuccgauaacc

SEQ ID NO: 2294893 - RNA, 13 nt, Yersinia pestis KIM
uacaggcgcaacu

SEQ ID NO: 2294894 - RNA, 21 nt, Yersinia pestis KIM
uacagguguaccgcuucgcgc

SEQ ID NO: 2294895 - RNA, 15 nt, Yersinia pestis KIM
uacauaaaaauagcu

SEQ ID NO: 2294896 - RNA, 18 nt, Yersinia pestis KIM
uaccaauggugcccauca

SEQ ID NO: 2294897 - RNA, 21 nt, Yersinia pestis KIM
uaccaauaagcuguaaugcau

SEQ ID NO: 2294898 - RNA, 22 nt, Yersinia pestis KIM
uaccaauaagcuguaaugcauc

SEQ ID NO: 2294899 - RNA, 18 nt, Yersinia pestis KIM
uaccaaccgcuuuaucgc

SEQ ID NO: 2294900 - RNA, 22 nt, Yersinia pestis KIM
uacaucgaguugaugcaauggc

SEQ ID NO: 2294901 - RNA, 19 nt, Yersinia pestis KIM
uacaugauugaaaaacaga

SEQ ID NO: 2294902 - RNA, 16 nt, Yersinia pestis KIM
uacaucuuuauaguuc

SEQ ID NO: 2294903 - RNA, 13 nt, Yersinia pestis KIM
uacauuucaucuu

SEQ ID NO: 2294904 - RNA, 21 nt, Yersinia pestis KIM
guuucgccaaaucuucggcuu

SEQ ID NO: 2294905 - RNA, 15 nt, Yersinia pestis KIM
guugguuagagcacg

SEQ ID NO: 2294906 - RNA, 15 nt, Yersinia pestis KIM
guuggucagugcgcu

SEQ ID NO: 2294907 - RNA, 15 nt, Yersinia pestis KIM
guuucuuuagcuaca

SEQ ID NO: 2294908 - RNA, 13 nt, Yersinia pestis KIM
guuuggcugccau

SEQ ID NO: 2294909 - RNA, 20 nt, Yersinia pestis KIM
guuugucagcagucugacac

SEQ ID NO: 2294910 - RNA, 16 nt, Yersinia pestis KIM
guuugcuacuggccug

SEQ ID NO: 2294911 - RNA, 19 nt, Yersinia pestis KIM
guuuuuuacgguggcacug

SEQ ID NO: 2294912 - RNA, 20 nt, Yersinia pestis KIM
guuuuggcgagauggucaug

SEQ ID NO: 2294913 - RNA, 17 nt, Yersinia pestis KIM
uaaaaaaucuauugauu

SEQ ID NO: 2294914 - RNA, 23 nt, Yersinia pestis KIM
uaaaaacccucuucaaucggaua

SEQ ID NO: 2294915 - RNA, 20 nt, Yersinia pestis KIM
uaaaaagaucugcauugauu

SEQ ID NO: 2294916 - RNA, 15 nt, Yersinia pestis KIM
uaaaaauaaucaaug

SEQ ID NO: 2294917 - RNA, 22 nt, Yersinia pestis KIM
uaaaauagguguuuuucgucau

SEQ ID NO: 2294918 - RNA, 13 nt, Yersinia pestis KIM
uaaaauauugaua

SEQ ID NO: 2294919 - RNA, 22 nt, Yersinia pestis KIM
guugcaaacggauaauguugca

SEQ ID NO: 2294920 - RNA, 20 nt, Yersinia pestis KIM
guugauugcaggccgcuuua

SEQ ID NO: 2294921 - RNA, 16 nt, Yersinia pestis KIM
guugauauaccgauua

SEQ ID NO: 2294922 - RNA, 13 nt, Yersinia pestis KIM
ucacggacagcaa

SEQ ID NO: 2294923 - RNA, 15 nt, Yersinia pestis KIM
ucacgcaaugcggua

SEQ ID NO: 2294924 - RNA, 18 nt, Yersinia pestis KIM
ucacgcggguuaucacau

SEQ ID NO: 2294925 - RNA, 17 nt, Yersinia pestis KIM
ucaccuuggauggcgaa

SEQ ID NO: 2294926 - RNA, 16 nt, Yersinia pestis KIM
ucacaccaguuacuuu

SEQ ID NO: 2294927 - RNA, 21 nt, Yersinia pestis KIM
aauaacgucaauaccgugaga

SEQ ID NO: 2294928 - RNA, 13 nt, Yersinia pestis KIM
aauaacgccacaa

SEQ ID NO: 2294929 - RNA, 18 nt, Yersinia pestis KIM
aauaacggaaaaucaucg

SEQ ID NO: 2294930 - RNA, 14 nt, Yersinia pestis KIM
aauaacgccugcaa

SEQ ID NO: 2294931 - RNA, 22 nt, Yersinia pestis KIM
aauaaccgagcgugaagagcga

SEQ ID NO: 2294932 - RNA, 16 nt, Yersinia pestis KIM
ucacuaaaacugaagc

SEQ ID NO: 2294933 - RNA, 18 nt, Yersinia pestis KIM
ucacuuuuauauccgcca

SEQ ID NO: 2294934 - RNA, 15 nt, Yersinia pestis KIM
ucacuuugacuuaaa

SEQ ID NO: 2294935 - RNA, 16 nt, Yersinia pestis KIM
aauaauaucaaugaug

SEQ ID NO: 2294936 - RNA, 14 nt, Yersinia pestis KIM
aauaauaucaauga

SEQ ID NO: 2294937 - RNA, 19 nt, Yersinia pestis KIM
aauaaguugauaacgccgg

SEQ ID NO: 2294938 - RNA, 15 nt, Yersinia pestis KIM
aauaaggaauaacuu

SEQ ID NO: 2294939 - RNA, 17 nt, Yersinia pestis KIM
ucagcuucaggccaagc

SEQ ID NO: 2294940 - RNA, 13 nt, Yersinia pestis KIM
ucagcugcuuuau

SEQ ID NO: 2294941 - RNA, 13 nt, Yersinia pestis KIM
ucagccuucaggg

SEQ ID NO: 2294942 - RNA, 17 nt, Yersinia pestis KIM
ucagccucauucaugag

SEQ ID NO: 2294943 - RNA, 17 nt, Yersinia pestis KIM
ucagcgacuccuggcaa

SEQ ID NO: 2294944 - RNA, 19 nt, Yersinia pestis KIM
ucagccuuuuuugcuuaaa

SEQ ID NO: 2294945 - RNA, 20 nt, Yersinia pestis KIM
ucagcccccucaauaccggu

SEQ ID NO: 2294946 - RNA, 17 nt, Yersinia pestis KIM
ucagaugaauccagcca

SEQ ID NO: 2294947 - RNA, 18 nt, Yersinia pestis KIM
ucagauaaaaagccaguc

SEQ ID NO: 2294948 - RNA, 14 nt, Yersinia pestis KIM
uccagccaugcgac

SEQ ID NO: 2294949 - RNA, 12 nt, Yersinia pestis KIM
uccaaugucagu

SEQ ID NO: 2294950 - RNA, 19 nt, Yersinia pestis KIM
uccacacguguacucauau

SEQ ID NO: 2294951 - RNA, 20 nt, Yersinia pestis KIM
uccacuacucguaacgacga

SEQ ID NO: 2294952 - RNA, 15 nt, Yersinia pestis KIM
uccacuuuucagaua

SEQ ID NO: 2294953 - RNA, 16 nt, Yersinia pestis KIM
uccacuugaucggcgu

SEQ ID NO: 2294954 - RNA, 15 nt, Yersinia pestis KIM
uccaguugccagcag

SEQ ID NO: 2294955 - RNA, 20 nt, Yersinia pestis KIM
uccagcguaaacaguagcag

SEQ ID NO: 2294956 - RNA, 21 nt, Yersinia pestis KIM
uccauccccaacucuuucaac

SEQ ID NO: 2294957 - RNA, 21 nt, Yersinia pestis KIM
ucaucgucggcccggccaggc

SEQ ID NO: 2294958 - RNA, 14 nt, Yersinia pestis KIM
ucaucucauccuca

SEQ ID NO: 2294959 - RNA, 21 nt, Yersinia pestis KIM
ucauacucagucaucgcuaac

SEQ ID NO: 2294960 - RNA, 18 nt, Yersinia pestis KIM
ucauauaagcaauaccga

SEQ ID NO: 2294961 - RNA, 13 nt, Yersinia pestis KIM
ucauauaagcggc

SEQ ID NO: 2294962 - RNA, 17 nt, Yersinia pestis KIM
ucauauaaucauacugu

SEQ ID NO: 2294963 - RNA, 15 nt, Yersinia pestis KIM
ucaguugcaguugga

SEQ ID NO: 2294964 - RNA, 22 nt, Yersinia pestis KIM
ucaggcauuacagacuggccaa

SEQ ID NO: 2294965 - RNA, 19 nt, Yersinia pestis KIM
ucaucuugggcgggaucuc

SEQ ID NO: 2294966 - RNA, 15 nt, Yersinia pestis KIM
ucaugguagagcugu

SEQ ID NO: 2294967 - RNA, 13 nt, Yersinia pestis KIM
ucauuacaucauc

SEQ ID NO: 2294968 - RNA, 21 nt, Yersinia pestis KIM
ucauuaccgcacacuacagcc

SEQ ID NO: 2294969 - RNA, 22 nt, Yersinia pestis KIM
ucauuaaggagugccaucauau

SEQ ID NO: 2294970 - RNA, 13 nt, Yersinia pestis KIM
ucauucuuaucgu

SEQ ID NO: 2294971 - RNA, 19 nt, Yersinia pestis KIM
uccaaucauucugucauca

SEQ ID NO: 2294972 - RNA, 14 nt, Yersinia pestis KIM
uccaagaaugcaga

SEQ ID NO: 2294973 - RNA, 14 nt, Yersinia pestis KIM
ucauuuuacgccug

SEQ ID NO: 2294974 - RNA, 17 nt, Yersinia pestis KIM
ucauuguagauggccau

SEQ ID NO: 2294975 - RNA, 15 nt, Yersinia pestis KIM
ucauuguccucaaga

SEQ ID NO: 2294976 - RNA, 20 nt, Yersinia pestis KIM
ucauuggcguuacagcaagg

SEQ ID NO: 2294977 - RNA, 22 nt, Yersinia pestis KIM
ucauuugaccuccguaggccaa

SEQ ID NO: 2294978 - RNA, 19 nt, Yersinia pestis KIM
uacguaaucccagaaacgg

SEQ ID NO: 2294979 - RNA, 22 nt, Yersinia pestis KIM
uacuaugauagauuaaucgaaa

SEQ ID NO: 2294980 - RNA, 20 nt, Yersinia pestis KIM
uacuaugauagauuaaucga

SEQ ID NO: 2294981 - RNA, 23 nt, Yersinia pestis KIM
uacugacacuuucgauagucagc

SEQ ID NO: 2294982 - RNA, 13 nt, Yersinia pestis KIM
uacugagaaucac

SEQ ID NO: 2294983 - RNA, 20 nt, Yersinia pestis KIM
uacugcaagccguaauucag

SEQ ID NO: 2294984 - RNA, 15 nt, Yersinia pestis KIM
uacugcuuaccuugu

SEQ ID NO: 2294985 - RNA, 16 nt, Yersinia pestis KIM
uacuucuuuuuaacga

SEQ ID NO: 2294986 - RNA, 14 nt, Yersinia pestis KIM
uacugcucgcccaa

SEQ ID NO: 2294987 - RNA, 13 nt, Yersinia pestis KIM
uacuuuugcuaac

SEQ ID NO: 2294988 - RNA, 21 nt, Yersinia pestis KIM
uagcaaaacgaguaaauagca

SEQ ID NO: 2294989 - RNA, 17 nt, Yersinia pestis KIM
uagacgcgggauauaag

SEQ ID NO: 2294990 - RNA, 17 nt, Yersinia pestis KIM
uacgggcggcauaaucc

SEQ ID NO: 2294991 - RNA, 21 nt, Yersinia pestis KIM
uacggcggcuacugguagcag

SEQ ID NO: 2294992 - RNA, 18 nt, Yersinia pestis KIM
uacggccccagcccagca

SEQ ID NO: 2294993 - RNA, 13 nt, Yersinia pestis KIM
uacgcaauaccga

SEQ ID NO: 2294994 - RNA, 14 nt, Yersinia pestis KIM
uacgcaaaaucagu

SEQ ID NO: 2294995 - RNA, 14 nt, Yersinia pestis KIM
uacgaccgucacca

SEQ ID NO: 2294996 - RNA, 13 nt, Yersinia pestis KIM
uacgacgcccgca

SEQ ID NO: 2294997 - RNA, 19 nt, Yersinia pestis KIM
uaccuuuaaaacuggucag

SEQ ID NO: 2294998 - RNA, 17 nt, Yersinia pestis KIM
uaccagccgcgcccuaa

SEQ ID NO: 2294999 - RNA, 14 nt, Yersinia pestis KIM
uaccaggaagcggc

SEQ ID NO: 2295000 - RNA, 23 nt, Yersinia pestis KIM
uagcaaucucugcaguacagaua

SEQ ID NO: 2295001 - RNA, 12 nt, Yersinia pestis KIM
uagcaauuugag

SEQ ID NO: 2295002 - RNA, 15 nt, Yersinia pestis KIM
uagcuaacaccgcug

SEQ ID NO: 2295003 - RNA, 15 nt, Yersinia pestis KIM
uagcgcuucagugau

SEQ ID NO: 2295004 - RNA, 14 nt, Yersinia pestis KIM
uagcuaaccuuaac

SEQ ID NO: 2295005 - RNA, 23 nt, Yersinia pestis KIM
uagcucugaggcuuggguaucug

SEQ ID NO: 2295006 - RNA, 16 nt, Yersinia pestis KIM
uaggcuauugacaaag

SEQ ID NO: 2295007 - RNA, 22 nt, Yersinia pestis KIM
uaggcguagguuucagccucug

SEQ ID NO: 2295008 - RNA, 22 nt, Yersinia pestis KIM
uaggcccacaaucaagcccgca

SEQ ID NO: 2295009 - RNA, 12 nt, Yersinia pestis KIM
uaggccgcauuu

SEQ ID NO: 2295010 - RNA, 13 nt, Yersinia pestis KIM
uaggcaucugcca

SEQ ID NO: 2295011 - RNA, 14 nt, Yersinia pestis KIM
aauaaaaaacugac

SEQ ID NO: 2295012 - RNA, 18 nt, Yersinia pestis KIM
aauaaauauucgguaaug

SEQ ID NO: 2295013 - RNA, 12 nt, Yersinia pestis KIM
aauaaauucagg

SEQ ID NO: 2295014 - RNA, 22 nt, Yersinia pestis KIM
aauaaagaguccccauaagcgg

SEQ ID NO: 2295015 - RNA, 19 nt, Yersinia pestis KIM
aauaaauaaaaacgcagau

SEQ ID NO: 2295016 - RNA, 16 nt, Yersinia pestis KIM
uaucuguccgcuuaua

SEQ ID NO: 2295017 - RNA, 20 nt, Yersinia pestis KIM
uaucuagcguccauguaucc

SEQ ID NO: 2295018 - RNA, 16 nt, Yersinia pestis KIM
uauuaugguuauaugc

SEQ ID NO: 2295019 - RNA, 16 nt, Yersinia pestis KIM
uauuauaaaauucgcu

SEQ ID NO: 2295020 - RNA, 16 nt, Yersinia pestis KIM
uauuaucaucaccauc

SEQ ID NO: 2295021 - RNA, 16 nt, Yersinia pestis KIM
uauaccggggccauca

SEQ ID NO: 2295022 - RNA, 15 nt, Yersinia pestis KIM
uauaccaacucugaa

SEQ ID NO: 2295023 - RNA, 23 nt, Yersinia pestis KIM
uauacauacccgucauaccguua

SEQ ID NO: 2295024 - RNA, 18 nt, Yersinia pestis KIM
uauaucaaggcggcagag

SEQ ID NO: 2295025 - RNA, 23 nt, Yersinia pestis KIM
uauccauauuaaaugcauuauaa

SEQ ID NO: 2295026 - RNA, 19 nt, Yersinia pestis KIM
uauccucaccguucaagau

SEQ ID NO: 2295027 - RNA, 17 nt, Yersinia pestis KIM
uaucacugagaaccgau

SEQ ID NO: 2295028 - RNA, 16 nt, Yersinia pestis KIM
uauauucuggcaccug

SEQ ID NO: 2295029 - RNA, 14 nt, Yersinia pestis KIM
uauauuucaagcua

SEQ ID NO: 2295030 - RNA, 17 nt, Yersinia pestis KIM
uauauuuggcuuucagc

SEQ ID NO: 2295031 - RNA, 16 nt, Yersinia pestis KIM
uaucacgauaaucaau

SEQ ID NO: 2295032 - RNA, 21 nt, Yersinia pestis KIM
ucaauacccugccaccuuggc

SEQ ID NO: 2295033 - RNA, 16 nt, Yersinia pestis KIM
ucaauaagaaugacuu

SEQ ID NO: 2295034 - RNA, 16 nt, Yersinia pestis KIM
ucaauaaaacucacuu

SEQ ID NO: 2295035 - RNA, 18 nt, Yersinia pestis KIM
ucaaugugguaacccgca

SEQ ID NO: 2295036 - RNA, 11 nt, Yersinia pestis KIM
ucaauucaaua

SEQ ID NO: 2295037 - RNA, 19 nt, Yersinia pestis KIM
ucaauuccauaucggcaaa

SEQ ID NO: 2295038 - RNA, 16 nt, Yersinia pestis KIM
ucaaucucaucaaucg

SEQ ID NO: 2295039 - RNA, 16 nt, Yersinia pestis KIM
ucaauaggucaguggu

SEQ ID NO: 2295040 - RNA, 12 nt, Yersinia pestis KIM
ucaauauccgca

SEQ ID NO: 2295041 - RNA, 19 nt, Yersinia pestis KIM
uauugugcuccugaugacu

SEQ ID NO: 2295042 - RNA, 16 nt, Yersinia pestis KIM
uauugauccaccguuu

SEQ ID NO: 2295043 - RNA, 17 nt, Yersinia pestis KIM
uauucaaagaauaacug

SEQ ID NO: 2295044 - RNA, 20 nt, Yersinia pestis KIM
uauucaacgccaauaccggu

SEQ ID NO: 2295045 - RNA, 15 nt, Yersinia pestis KIM
ucaaacucagcauca

SEQ ID NO: 2295046 - RNA, 21 nt, Yersinia pestis KIM
ucaaauacggcaccaauggcu

SEQ ID NO: 2295047 - RNA, 14 nt, Yersinia pestis KIM
ucaacuuaauuuac

SEQ ID NO: 2295048 - RNA, 15 nt, Yersinia pestis KIM
ucaacgacagcagca

SEQ ID NO: 2295049 - RNA, 15 nt, Yersinia pestis KIM
ucaacgaccaguaag

SEQ ID NO: 2295050 - RNA, 17 nt, Yersinia pestis KIM
ucccgaugagucuauuu

SEQ ID NO: 2295051 - RNA, 14 nt, Yersinia pestis KIM
ucccacaugaacuc

SEQ ID NO: 2295052 - RNA, 16 nt, Yersinia pestis KIM
ucccacgcagauacug

SEQ ID NO: 2295053 - RNA, 19 nt, Yersinia pestis KIM
uccgucaucgaacccgcua

SEQ ID NO: 2295054 - RNA, 12 nt, Yersinia pestis KIM
uccguuaaccca

SEQ ID NO: 2295055 - RNA, 17 nt, Yersinia pestis KIM
uccgucguuugcuccau

SEQ ID NO: 2295056 - RNA, 14 nt, Yersinia pestis KIM
uccuccgacauagc

SEQ ID NO: 2295057 - RNA, 19 nt, Yersinia pestis KIM
uccgcuucucagucgcgau

SEQ ID NO: 2295058 - RNA, 18 nt, Yersinia pestis KIM
uccgcgcaaccuggccaa

SEQ ID NO: 2295059 - RNA, 12 nt, Yersinia pestis KIM
uccuuaccacug

SEQ ID NO: 2295060 - RNA, 23 nt, Yersinia pestis KIM
uccuuauuuuccgcguuaccguu

SEQ ID NO: 2295061 - RNA, 17 nt, Yersinia pestis KIM
ucgauuuaauggguaaa

SEQ ID NO: 2295062 - RNA, 13 nt, Yersinia pestis KIM
ucgauuucugcau

SEQ ID NO: 2295063 - RNA, 15 nt, Yersinia pestis KIM
ucgccgcaaggcaaa

SEQ ID NO: 2295064 - RNA, 16 nt, Yersinia pestis KIM
ucgccgguaauaccga

SEQ ID NO: 2295065 - RNA, 16 nt, Yersinia pestis KIM
ucgccaucgucucugc

SEQ ID NO: 2295066 - RNA, 17 nt, Yersinia pestis KIM
ucgcacugauagccaac

SEQ ID NO: 2295067 - RNA, 18 nt, Yersinia pestis KIM
ucgcgacucaagccucua

SEQ ID NO: 2295068 - RNA, 19 nt, Yersinia pestis KIM
ucgcgauaaaauucagcca

SEQ ID NO: 2295069 - RNA, 24 nt, Yersinia pestis KIM
ucgccguauuuguauuuacucguu

SEQ ID NO: 2295070 - RNA, 15 nt, Yersinia pestis KIM
ucgcgcccugccaua

SEQ ID NO: 2295071 - RNA, 17 nt, Yersinia pestis KIM
ucggcauacuccuuaau

SEQ ID NO: 2295072 - RNA, 20 nt, Yersinia pestis KIM
ucggcagcggagaaucgcug

SEQ ID NO: 2295073 - RNA, 19 nt, Yersinia pestis KIM
ucggaucagcgccugcugu

SEQ ID NO: 2295074 - RNA, 14 nt, Yersinia pestis KIM
ucguuuguaccugu

SEQ ID NO: 2295075 - RNA, 20 nt, Yersinia pestis KIM
ucguuucccccuguaaaaca

SEQ ID NO: 2295076 - RNA, 17 nt, Yersinia pestis KIM
ucguuauauaaauggcu

SEQ ID NO: 2295077 - RNA, 14 nt, Yersinia pestis KIM
ucguuauuuaccgu

SEQ ID NO: 2295078 - RNA, 19 nt, Yersinia pestis KIM
ucgucggcccggccaggcu

SEQ ID NO: 2295079 - RNA, 18 nt, Yersinia pestis KIM
ucuaucucaucuuaauca

SEQ ID NO: 2295080 - RNA, 23 nt, Yersinia pestis KIM
ucuauuuauuuauaaaaccacug

SEQ ID NO: 2295081 - RNA, 23 nt, Yersinia pestis KIM
ucuaaaaggauagggagccaaua

SEQ ID NO: 2295082 - RNA, 17 nt, Yersinia pestis KIM
ucuacccuggcggcaaa

SEQ ID NO: 2295083 - RNA, 16 nt, Yersinia pestis KIM
ucguacacuuuagcca

SEQ ID NO: 2295084 - RNA, 23 nt, Yersinia pestis KIM
ucuggcuuaaucgccagcaaauc

SEQ ID NO: 2295085 - RNA, 15 nt, Yersinia pestis KIM
ucugcucaauagccg

SEQ ID NO: 2295086 - RNA, 20 nt, Yersinia pestis KIM
aauacgguucaaaucaguuc

SEQ ID NO: 2295087 - RNA, 16 nt, Yersinia pestis KIM
ucuguaaaaaucaccu

SEQ ID NO: 2295088 - RNA, 17 nt, Yersinia pestis KIM
aauacggcguuugacaa

SEQ ID NO: 2295089 - RNA, 15 nt, Yersinia pestis KIM
ucuucuucucagaua

SEQ ID NO: 2295090 - RNA, 18 nt, Yersinia pestis KIM
ucuugaccgauaccgguu

SEQ ID NO: 2295091 - RNA, 17 nt, Yersinia pestis KIM
ugaaaagugauccacuu

SEQ ID NO: 2295092 - RNA, 22 nt, Yersinia pestis KIM
ucuuuaucaauuuauacccguu

SEQ ID NO: 2295093 - RNA, 18 nt, Yersinia pestis KIM
ucuuuacgcucugccugu

SEQ ID NO: 2295094 - RNA, 19 nt, Yersinia pestis KIM
ugaaguacggugccagcag

SEQ ID NO: 2295095 - RNA, 18 nt, Yersinia pestis KIM
ugaaguuuaccgcaugaa

SEQ ID NO: 2295096 - RNA, 13 nt, Yersinia pestis KIM
ugaauauccgccg

SEQ ID NO: 2295097 - RNA, 23 nt, Yersinia pestis KIM
ugacacauaccuucgguaaucaa

SEQ ID NO: 2295098 - RNA, 19 nt, Yersinia pestis KIM
ugaauggcaacgcgcagug

SEQ ID NO: 2295099 - RNA, 19 nt, Yersinia pestis KIM
ugaaugaguuucaagucaa

SEQ ID NO: 2295100 - RNA, 19 nt, Yersinia pestis KIM
ugaauccggauccagcgcu

SEQ ID NO: 2295101 - RNA, 16 nt, Yersinia pestis KIM
ugaccagaacgcaacg

SEQ ID NO: 2295102 - RNA, 10 nt, Yersinia pestis KIM
ugacaucauc

SEQ ID NO: 2295103 - RNA, 21 nt, Yersinia pestis KIM
ugacauaaacacgcaaucaga

SEQ ID NO: 2295104 - RNA, 21 nt, Yersinia pestis KIM
ugccgaugagcuucuucaaaa

SEQ ID NO: 2295105 - RNA, 17 nt, Yersinia pestis KIM
ugccgcagauaaaucug

SEQ ID NO: 2295106 - RNA, 20 nt, Yersinia pestis KIM
ugccauaaccgcuaaggcca

SEQ ID NO: 2295107 - RNA, 22 nt, Yersinia pestis KIM
ugccauaagugaacaugaugaa

SEQ ID NO: 2295108 - RNA, 23 nt, Yersinia pestis KIM
ugccauauuacucucuauugauc

SEQ ID NO: 2295109 - RNA, 21 nt, Yersinia pestis KIM
ugccccgaagcucaagcuggu

SEQ ID NO: 2295110 - RNA, 19 nt, Yersinia pestis KIM
ugccaauauguuagcagca

SEQ ID NO: 2295111 - RNA, 14 nt, Yersinia pestis KIM
ugccaaccaaucgg

SEQ ID NO: 2295112 - RNA, 19 nt, Yersinia pestis KIM
ugccaaacccauuaccggu

SEQ ID NO: 2295113 - RNA, 22 nt, Yersinia pestis KIM
ugccaacggacggaauccaaca

SEQ ID NO: 2295114 - RNA, 22 nt, Yersinia pestis KIM
ugagggugaugacaaugcguua

SEQ ID NO: 2295115 - RNA, 17 nt, Yersinia pestis KIM
ugaggucagugcugcau

SEQ ID NO: 2295116 - RNA, 20 nt, Yersinia pestis KIM
ugagguggcacccagugacc

SEQ ID NO: 2295117 - RNA, 23 nt, Yersinia pestis KIM
ugagucguaaaauuuuggcaacc

SEQ ID NO: 2295118 - RNA, 13 nt, Yersinia pestis KIM
ugaguaucgauaa

SEQ ID NO: 2295119 - RNA, 17 nt, Yersinia pestis KIM
ugaguaauauuauucaa

SEQ ID NO: 2295120 - RNA, 15 nt, Yersinia pestis KIM
ugagcugaucugcca

SEQ ID NO: 2295121 - RNA, 18 nt, Yersinia pestis KIM
ugagcaaauuuaucagua

SEQ ID NO: 2295122 - RNA, 18 nt, Yersinia pestis KIM
ugagcaucacuucauaca

SEQ ID NO: 2295123 - RNA, 20 nt, Yersinia pestis KIM
ugacuuauaagugcgggaaa

SEQ ID NO: 2295124 - RNA, 16 nt, Yersinia pestis KIM
ugauuggacgauaacg

SEQ ID NO: 2295125 - RNA, 12 nt, Yersinia pestis KIM
ugauuucaaacg

SEQ ID NO: 2295126 - RNA, 18 nt, Yersinia pestis KIM
ugauuguuuuuauuacag

SEQ ID NO: 2295127 - RNA, 18 nt, Yersinia pestis KIM
ugauucgucugccauugc

SEQ ID NO: 2295128 - RNA, 13 nt, Yersinia pestis KIM
ugauucgggcaaa

SEQ ID NO: 2295129 - RNA, 16 nt, Yersinia pestis KIM
ugauuccuaagcaaau

SEQ ID NO: 2295130 - RNA, 16 nt, Yersinia pestis KIM
ugauuacguuccacug

SEQ ID NO: 2295131 - RNA, 18 nt, Yersinia pestis KIM
ugaucaugcucaccaugu

SEQ ID NO: 2295132 - RNA, 23 nt, Yersinia pestis KIM
ugaucccacugcccgaacggcag

SEQ ID NO: 2295133 - RNA, 18 nt, Yersinia pestis KIM
ugcaaccgcugaaguggc

SEQ ID NO: 2295134 - RNA, 17 nt, Yersinia pestis KIM
ugcaaacauugucuggu

SEQ ID NO: 2295135 - RNA, 15 nt, Yersinia pestis KIM
ugcaaauguucaaca

SEQ ID NO: 2295136 - RNA, 21 nt, Yersinia pestis KIM
ugcaaauuuccagauggcggu

SEQ ID NO: 2295137 - RNA, 11 nt, Yersinia pestis KIM
ugcacaucauu

SEQ ID NO: 2295138 - RNA, 19 nt, Yersinia pestis KIM
ugcaauccgcugacauugc

SEQ ID NO: 2295139 - RNA, 16 nt, Yersinia pestis KIM
ugcaauaaauucaaaa

SEQ ID NO: 2295140 - RNA, 17 nt, Yersinia pestis KIM
ccgcuaaggccaaugga

SEQ ID NO: 2295141 - RNA, 19 nt, Yersinia pestis KIM
ccgcuacaggcgcaacugc

SEQ ID NO: 2295142 - RNA, 16 nt, Yersinia pestis KIM
ccgcuaaaucaucaaa

SEQ ID NO: 2295143 - RNA, 18 nt, Yersinia pestis KIM
ccgcagggguaucagugu

SEQ ID NO: 2295144 - RNA, 22 nt, Yersinia pestis KIM
ccgccagcaauaagccacgcug

SEQ ID NO: 2295145 - RNA, 22 nt, Yersinia pestis KIM
aaaugccauuuauugcggcuua

SEQ ID NO: 2295146 - RNA, 14 nt, Yersinia pestis KIM
ccgccugcguauug

SEQ ID NO: 2295147 - RNA, 22 nt, Yersinia pestis KIM
ccgguaucaccuuuuuccgcug

SEQ ID NO: 2295148 - RNA, 13 nt, Yersinia pestis KIM
aaauuuagccgca

SEQ ID NO: 2295149 - RNA, 20 nt, Yersinia pestis KIM
aaauuuggccuuucucggug

SEQ ID NO: 2295150 - RNA, 20 nt, Yersinia pestis KIM
aaauugucugggauacgcgc

SEQ ID NO: 2295151 - RNA, 14 nt, Yersinia pestis KIM
ccgucauccagcac

SEQ ID NO: 2295152 - RNA, 20 nt, Yersinia pestis KIM
ccgucaccacaaaggucagc

SEQ ID NO: 2295153 - RNA, 23 nt, Yersinia pestis KIM
ccguaucaacgauguaaacgaau

SEQ ID NO: 2295154 - RNA, 18 nt, Yersinia pestis KIM
ccggugagcacgauuacc

SEQ ID NO: 2295155 - RNA, 21 nt, Yersinia pestis KIM
ccggugcugauguugucaccu

SEQ ID NO: 2295156 - RNA, 20 nt, Yersinia pestis KIM
ccgugauauugggccggaga

SEQ ID NO: 2295157 - RNA, 22 nt, Yersinia pestis KIM
ccugcuguuaguaacuguaagg

SEQ ID NO: 2295158 - RNA, 13 nt, Yersinia pestis KIM
ccugcccaugcuc

SEQ ID NO: 2295159 - RNA, 19 nt, Yersinia pestis KIM
ccugccgugcuugcuauua

SEQ ID NO: 2295160 - RNA, 14 nt, Yersinia pestis KIM
ccugacaaacggcg

SEQ ID NO: 2295161 - RNA, 21 nt, Yersinia pestis KIM
ccugacucccugacucccuga

SEQ ID NO: 2295162 - RNA, 20 nt, Yersinia pestis KIM
ccucguuguuguaugacaag

SEQ ID NO: 2295163 - RNA, 21 nt, Yersinia pestis KIM
ccucuagcuguauugcccgau

SEQ ID NO: 2295164 - RNA, 11 nt, Yersinia pestis KIM
ccucuucaggu

SEQ ID NO: 2295165 - RNA, 16 nt, Yersinia pestis KIM
ccugauugguuauccu

SEQ ID NO: 2295166 - RNA, 14 nt, Yersinia pestis KIM
ccugcaccgguguu

SEQ ID NO: 2295167 - RNA, 12 nt, Yersinia pestis KIM
ccucacgggcuu

SEQ ID NO: 2295168 - RNA, 16 nt, Yersinia pestis KIM
ccucaccagcaucuug

SEQ ID NO: 2295169 - RNA, 17 nt, Yersinia pestis KIM
ccucacguacugcaugu

SEQ ID NO: 2295170 - RNA, 21 nt, Yersinia pestis KIM
ccucggugucaguacgcuggc

SEQ ID NO: 2295171 - RNA, 21 nt, Yersinia pestis KIM
cgcacuuaaugccgcugauca

SEQ ID NO: 2295172 - RNA, 20 nt, Yersinia pestis KIM
cgcacugugagcggcaucca

SEQ ID NO: 2295173 - RNA, 16 nt, Yersinia pestis KIM
cgcacuugcggcaaug

SEQ ID NO: 2295174 - RNA, 19 nt, Yersinia pestis KIM
cgcagaauuaaccguuaac

SEQ ID NO: 2295175 - RNA, 15 nt, Yersinia pestis KIM
cgcagcggcuagcag

SEQ ID NO: 2295176 - RNA, 11 nt, Yersinia pestis KIM
cgauauugaua

SEQ ID NO: 2295177 - RNA, 17 nt, Yersinia pestis KIM
cgaucaaaaucacuucu

SEQ ID NO: 2295178 - RNA, 23 nt, Yersinia pestis KIM
cgaugaacugacacacaccagug

SEQ ID NO: 2295179 - RNA, 14 nt, Yersinia pestis KIM
cgauguggauaauu

SEQ ID NO: 2295180 - RNA, 19 nt, Yersinia pestis KIM
cgcaaccauccgcccaaua

SEQ ID NO: 2295181 - RNA, 15 nt, Yersinia pestis KIM
cgcaaccaccuuuac

SEQ ID NO: 2295182 - RNA, 14 nt, Yersinia pestis KIM
cgauuaccugcaua

SEQ ID NO: 2295183 - RNA, 22 nt, Yersinia pestis KIM
cgccaaauacaaaccguuugcc

SEQ ID NO: 2295184 - RNA, 20 nt, Yersinia pestis KIM
cgccaauacccguucaacag

SEQ ID NO: 2295185 - RNA, 13 nt, Yersinia pestis KIM
cgcauuccaucag

SEQ ID NO: 2295186 - RNA, 20 nt, Yersinia pestis KIM
cgccaaaauaaacaucaaug

SEQ ID NO: 2295187 - RNA, 21 nt, Yersinia pestis KIM
cgccagcaauaagccacgcug

SEQ ID NO: 2295188 - RNA, 16 nt, Yersinia pestis KIM
cgccacuuaucccaac

SEQ ID NO: 2295189 - RNA, 13 nt, Yersinia pestis KIM
cgccaguguugcc

SEQ ID NO: 2295190 - RNA, 18 nt, Yersinia pestis KIM
cgccaguugggauguuca

SEQ ID NO: 2295191 - RNA, 11 nt, Yersinia pestis KIM
cgaguaauacc

SEQ ID NO: 2295192 - RNA, 19 nt, Yersinia pestis KIM
cgauaaacaucaugacaaa

SEQ ID NO: 2295193 - RNA, 15 nt, Yersinia pestis KIM
cgaguucucaccaag

SEQ ID NO: 2295194 - RNA, 20 nt, Yersinia pestis KIM
cgauaaacuucacaaugcac

SEQ ID NO: 2295195 - RNA, 22 nt, Yersinia pestis KIM
cgauaucugcguuuucugcaua

SEQ ID NO: 2295196 - RNA, 13 nt, Yersinia pestis KIM
cgauaucugcaua

SEQ ID NO: 2295197 - RNA, 17 nt, Yersinia pestis KIM
cgagccuacauggaugu

SEQ ID NO: 2295198 - RNA, 17 nt, Yersinia pestis KIM
cgagaaagucuuaaucu

SEQ ID NO: 2295199 - RNA, 19 nt, Yersinia pestis KIM
aacacauuaauuuaucugc

SEQ ID NO: 2295200 - RNA, 23 nt, Yersinia pestis KIM
aacacagagguagacguaucaug

SEQ ID NO: 2295201 - RNA, 17 nt, Yersinia pestis KIM
cgaaggguaucagcgac

SEQ ID NO: 2295202 - RNA, 17 nt, Yersinia pestis KIM
cgaaggcacccaugcuc

SEQ ID NO: 2295203 - RNA, 14 nt, Yersinia pestis KIM
cgaagauaaccggc

SEQ ID NO: 2295204 - RNA, 19 nt, Yersinia pestis KIM
cgacaccaagaggcugcgu

SEQ ID NO: 2295205 - RNA, 13 nt, Yersinia pestis KIM
aacaaagccgcuu

SEQ ID NO: 2295206 - RNA, 15 nt, Yersinia pestis KIM
aacaaaggcgccaag

SEQ ID NO: 2295207 - RNA, 19 nt, Yersinia pestis KIM
aacaacgccgcucaauuaa

SEQ ID NO: 2295208 - RNA, 16 nt, Yersinia pestis KIM
cgacgaggguaauaau

SEQ ID NO: 2295209 - RNA, 18 nt, Yersinia pestis KIM
cggcucuauuucaugauu

SEQ ID NO: 2295210 - RNA, 15 nt, Yersinia pestis KIM
cggcuguaaccgccu

SEQ ID NO: 2295211 - RNA, 16 nt, Yersinia pestis KIM
cggcuagcguuaugcu

SEQ ID NO: 2295212 - RNA, 13 nt, Yersinia pestis KIM
cggcuaggcucag

SEQ ID NO: 2295213 - RNA, 23 nt, Yersinia pestis KIM
cgggcgaaggucaauugcggcca

SEQ ID NO: 2295214 - RNA, 22 nt, Yersinia pestis KIM
cgggcacccgauaugcccguua

SEQ ID NO: 2295215 - RNA, 23 nt, Yersinia pestis KIM
cgggaucugaugaugguuaaccc

SEQ ID NO: 2295216 - RNA, 21 nt, Yersinia pestis KIM
cgggaucgagaguugcucacc

SEQ ID NO: 2295217 - RNA, 22 nt, Yersinia pestis KIM
cgggcaaauggguguuauuuac

SEQ ID NO: 2295218 - RNA, 15 nt, Yersinia pestis KIM
cggguucuaaauccu

SEQ ID NO: 2295219 - RNA, 17 nt, Yersinia pestis KIM
cggguuaacucuucaac

SEQ ID NO: 2295220 - RNA, 22 nt, Yersinia pestis KIM
aaccagugccgcccagcgacgc

SEQ ID NO: 2295221 - RNA, 12 nt, Yersinia pestis KIM
aaccaguucugg

SEQ ID NO: 2295222 - RNA, 20 nt, Yersinia pestis KIM
aaccaccuaauacagcacca

SEQ ID NO: 2295223 - RNA, 19 nt, Yersinia pestis KIM
aaccacugaccuauugaua

SEQ ID NO: 2295224 - RNA, 15 nt, Yersinia pestis KIM
aaccacgguaucaau

SEQ ID NO: 2295225 - RNA, 21 nt, Yersinia pestis KIM
aaccacugaccuauugauaaa

SEQ ID NO: 2295226 - RNA, 14 nt, Yersinia pestis KIM
aaccaaccgccaau

SEQ ID NO: 2295227 - RNA, 12 nt, Yersinia pestis KIM
aacauugucacc

SEQ ID NO: 2295228 - RNA, 22 nt, Yersinia pestis KIM
aacauuuaucuaucuguucacc

SEQ ID NO: 2295229 - RNA, 21 nt, Yersinia pestis KIM
cggucaauugagucucuggcc

SEQ ID NO: 2295230 - RNA, 14 nt, Yersinia pestis KIM
cgguauucagccaa

SEQ ID NO: 2295231 - RNA, 13 nt, Yersinia pestis KIM
cggucaacgauug

SEQ ID NO: 2295232 - RNA, 18 nt, Yersinia pestis KIM
cgguagugacucaucaaa

SEQ ID NO: 2295233 - RNA, 15 nt, Yersinia pestis KIM
cgguacgcaggccuu

SEQ ID NO: 2295234 - RNA, 20 nt, Yersinia pestis KIM
cgguagcgauaaacguucaa

SEQ ID NO: 2295235 - RNA, 17 nt, Yersinia pestis KIM
cgguaacauauaaacca

SEQ ID NO: 2295236 - RNA, 16 nt, Yersinia pestis KIM
cgguaauacucuggcc

SEQ ID NO: 2295237 - RNA, 20 nt, Yersinia pestis KIM
cgguaauaaacggcguugau

SEQ ID NO: 2295238 - RNA, 17 nt, Yersinia pestis KIM
cggguuuugcaucaagc

SEQ ID NO: 2295239 - RNA, 23 nt, Yersinia pestis KIM
cggguuuuuaacuuuaucagucu

SEQ ID NO: 2295240 - RNA, 17 nt, Yersinia pestis KIM
cggguuuuuuuacauau

SEQ ID NO: 2295241 - RNA, 15 nt, Yersinia pestis KIM
aaccauuguggcuaa

SEQ ID NO: 2295242 - RNA, 13 nt, Yersinia pestis KIM
aaccaugagaaua

SEQ ID NO: 2295243 - RNA, 15 nt, Yersinia pestis KIM
cggcggaucaagcgc

SEQ ID NO: 2295244 - RNA, 24 nt, Yersinia pestis KIM
cggcgcuccaguucgacuaacuga

SEQ ID NO: 2295245 - RNA, 12 nt, Yersinia pestis KIM
cggcgaaacuga

SEQ ID NO: 2295246 - RNA, 21 nt, Yersinia pestis KIM
aacaggcgcaucgcgaucuga

SEQ ID NO: 2295247 - RNA, 20 nt, Yersinia pestis KIM
aacagugccaacagcgagau

SEQ ID NO: 2295248 - RNA, 21 nt, Yersinia pestis KIM
aacaucgguaaaucgcccaau

SEQ ID NO: 2295249 - RNA, 19 nt, Yersinia pestis KIM
aacauccagauauggcauu

SEQ ID NO: 2295250 - RNA, 20 nt, Yersinia pestis KIM
cgcgaauaucaggcacugua

SEQ ID NO: 2295251 - RNA, 23 nt, Yersinia pestis KIM
cgccuugcccugcaauaccgccg

SEQ ID NO: 2295252 - RNA, 19 nt, Yersinia pestis KIM
cgccuuccuuuuauuuaga

SEQ ID NO: 2295253 - RNA, 17 nt, Yersinia pestis KIM
cgcgaguaacgcacuga

SEQ ID NO: 2295254 - RNA, 14 nt, Yersinia pestis KIM
cgcgcagcaagcug

SEQ ID NO: 2295255 - RNA, 16 nt, Yersinia pestis KIM
cgcgcagccaacggag

SEQ ID NO: 2295256 - RNA, 23 nt, Yersinia pestis KIM
cgcgguaacuaacaucagcgauu

SEQ ID NO: 2295257 - RNA, 20 nt, Yersinia pestis KIM
cgcgguaacuaacaucagcg

SEQ ID NO: 2295258 - RNA, 16 nt, Yersinia pestis KIM
cgcgugcgcaucaaug

SEQ ID NO: 2295259 - RNA, 18 nt, Yersinia pestis KIM
cgcuaaucauauccauaa

SEQ ID NO: 2295260 - RNA, 20 nt, Yersinia pestis KIM
cgcuaauauuuucagcccua

SEQ ID NO: 2295261 - RNA, 13 nt, Yersinia pestis KIM
cgcuaagccauua

SEQ ID NO: 2295262 - RNA, 15 nt, Yersinia pestis KIM
cgcuaaaucaucaaa

SEQ ID NO: 2295263 - RNA, 14 nt, Yersinia pestis KIM
cgcggauccguaac

SEQ ID NO: 2295264 - RNA, 14 nt, Yersinia pestis KIM
cgcggaugauacga

SEQ ID NO: 2295265 - RNA, 12 nt, Yersinia pestis KIM
aacagcaggccg

SEQ ID NO: 2295266 - RNA, 12 nt, Yersinia pestis KIM
cgcggccugcug

SEQ ID NO: 2295267 - RNA, 14 nt, Yersinia pestis KIM
cgcugauaaccagc

SEQ ID NO: 2295268 - RNA, 20 nt, Yersinia pestis KIM
cgcugauaacuuccuuugcc

SEQ ID NO: 2295269 - RNA, 17 nt, Yersinia pestis KIM
cgcugaucaucaucaau

SEQ ID NO: 2295270 - RNA, 13 nt, Yersinia pestis KIM
cgcugcaucagca

SEQ ID NO: 2295271 - RNA, 21 nt, Yersinia pestis KIM
cgcugcuuuuacgcaaguaaa

SEQ ID NO: 2295272 - RNA, 13 nt, Yersinia pestis KIM
cgcuggaagccgc

SEQ ID NO: 2295273 - RNA, 21 nt, Yersinia pestis KIM
cgcuggaagccgccaaguugg

SEQ ID NO: 2295274 - RNA, 16 nt, Yersinia pestis KIM
cgcugugccuggauca

SEQ ID NO: 2295275 - RNA, 17 nt, Yersinia pestis KIM
cgcugugcaacaucagg

SEQ ID NO: 2295276 - RNA, 20 nt, Yersinia pestis KIM
cgcuguuacucaguucagcc

SEQ ID NO: 2295277 - RNA, 19 nt, Yersinia pestis KIM
cgcuguuucucuucaucgc

SEQ ID NO: 2295278 - RNA, 15 nt, Yersinia pestis KIM
cgcuuaucccuccau

SEQ ID NO: 2295279 - RNA, 20 nt, Yersinia pestis KIM
cgcuuaucccuccaucaagc

SEQ ID NO: 2295280 - RNA, 21 nt, Yersinia pestis KIM
cggaauaugcugugguucaau

SEQ ID NO: 2295281 - RNA, 19 nt, Yersinia pestis KIM
cgcuuuacucuucugccua

SEQ ID NO: 2295282 - RNA, 19 nt, Yersinia pestis KIM
cgcuuuacuccucugccua

SEQ ID NO: 2295283 - RNA, 12 nt, Yersinia pestis KIM
cgcuuuaucgcc

SEQ ID NO: 2295284 - RNA, 19 nt, Yersinia pestis KIM
cgcuuucuguucaucaaua

SEQ ID NO: 2295285 - RNA, 19 nt, Yersinia pestis KIM
cgcuuuacuccccugccua

SEQ ID NO: 2295286 - RNA, 17 nt, Yersinia pestis KIM
cgcuugggcgauaucca

SEQ ID NO: 2295287 - RNA, 22 nt, Yersinia pestis KIM
cgcuuuucgcuaucaauuaaug

SEQ ID NO: 2295288 - RNA, 17 nt, Yersinia pestis KIM
ccgaagcucaagcuggu

SEQ ID NO: 2295289 - RNA, 17 nt, Yersinia pestis KIM
cccuugaguauccaaua

SEQ ID NO: 2295290 - RNA, 19 nt, Yersinia pestis KIM
cccuucgauauuacaguuu

SEQ ID NO: 2295291 - RNA, 12 nt, Yersinia pestis KIM
cccuuuagcguc

SEQ ID NO: 2295292 - RNA, 16 nt, Yersinia pestis KIM
cccuggagcaagauuu

SEQ ID NO: 2295293 - RNA, 17 nt, Yersinia pestis KIM
cccggcugaccuguugu

SEQ ID NO: 2295294 - RNA, 21 nt, Yersinia pestis KIM
cccggugaucaucgcaccaua

SEQ ID NO: 2295295 - RNA, 13 nt, Yersinia pestis KIM
aaaugacaaugaa

SEQ ID NO: 2295296 - RNA, 13 nt, Yersinia pestis KIM
cccggaccagccg

SEQ ID NO: 2295297 - RNA, 15 nt, Yersinia pestis KIM
cccggaagguuucca

SEQ ID NO: 2295298 - RNA, 13 nt, Yersinia pestis KIM
ccccuucaggcca

SEQ ID NO: 2295299 - RNA, 17 nt, Yersinia pestis KIM
ccccgcucgacucucaa

SEQ ID NO: 2295300 - RNA, 15 nt, Yersinia pestis KIM
cccaguagcacaaug

SEQ ID NO: 2295301 - RNA, 14 nt, Yersinia pestis KIM
cccaguuacuaccu

SEQ ID NO: 2295302 - RNA, 14 nt, Yersinia pestis KIM
cccauuuaucgcca

SEQ ID NO: 2295303 - RNA, 12 nt, Yersinia pestis KIM
cccaggcugugg

SEQ ID NO: 2295304 - RNA, 20 nt, Yersinia pestis KIM
cccagcaggcugugaucugc

SEQ ID NO: 2295305 - RNA, 19 nt, Yersinia pestis KIM
aaauccugaauaauacugu

SEQ ID NO: 2295306 - RNA, 19 nt, Yersinia pestis KIM
aaaucgccaaacugcucau

SEQ ID NO: 2295307 - RNA, 16 nt, Yersinia pestis KIM
aaaucgccaaacugcu

SEQ ID NO: 2295308 - RNA, 14 nt, Yersinia pestis KIM
ccauuaauuggccg

SEQ ID NO: 2295309 - RNA, 20 nt, Yersinia pestis KIM
ccauuaauagacgaauggcc

SEQ ID NO: 2295310 - RNA, 22 nt, Yersinia pestis KIM
ccauuaaacguuugggauaacu

SEQ ID NO: 2295311 - RNA, 12 nt, Yersinia pestis KIM
ccauucagccac

SEQ ID NO: 2295312 - RNA, 22 nt, Yersinia pestis KIM
ccauugcucaaacucagcauca

SEQ ID NO: 2295313 - RNA, 20 nt, Yersinia pestis KIM
ccauuguauugcucagggcc

SEQ ID NO: 2295314 - RNA, 19 nt, Yersinia pestis KIM
ccauugauuggcuccuaua

SEQ ID NO: 2295315 - RNA, 12 nt, Yersinia pestis KIM
cccaccauaaug

SEQ ID NO: 2295316 - RNA, 13 nt, Yersinia pestis KIM
ccauuuagcuggc

SEQ ID NO: 2295317 - RNA, 23 nt, Yersinia pestis KIM
ccagcguuggcagaaagugaccc

SEQ ID NO: 2295318 - RNA, 19 nt, Yersinia pestis KIM
ccagccaguugaucggcca

SEQ ID NO: 2295319 - RNA, 18 nt, Yersinia pestis KIM
ccagcccauccuguucaa

SEQ ID NO: 2295320 - RNA, 17 nt, Yersinia pestis KIM
ccagccccaauccgccu

SEQ ID NO: 2295321 - RNA, 13 nt, Yersinia pestis KIM
ccagccaccgcac

SEQ ID NO: 2295322 - RNA, 14 nt, Yersinia pestis KIM
ccagccaacuggcg

SEQ ID NO: 2295323 - RNA, 17 nt, Yersinia pestis KIM
aaauccgacugauagca

SEQ ID NO: 2295324 - RNA, 14 nt, Yersinia pestis KIM
aaauccccauucca

SEQ ID NO: 2295325 - RNA, 20 nt, Yersinia pestis KIM
aaauccagaucagcgccuga

SEQ ID NO: 2295326 - RNA, 22 nt, Yersinia pestis KIM
aaaucacguucauccgcagcaa

SEQ ID NO: 2295327 - RNA, 17 nt, Yersinia pestis KIM
ccagaagcauauggaug

SEQ ID NO: 2295328 - RNA, 16 nt, Yersinia pestis KIM
ccacuuaguggcauug

SEQ ID NO: 2295329 - RNA, 16 nt, Yersinia pestis KIM
ccagaaccucaacauu

SEQ ID NO: 2295330 - RNA, 17 nt, Yersinia pestis KIM
aaauaagaucaauaugu

SEQ ID NO: 2295331 - RNA, 14 nt, Yersinia pestis KIM
aaauaagccagugc

SEQ ID NO: 2295332 - RNA, 19 nt, Yersinia pestis KIM
aaaggcggugauaaacccu

SEQ ID NO: 2295333 - RNA, 14 nt, Yersinia pestis KIM
aaauaaccucuaau

SEQ ID NO: 2295334 - RNA, 14 nt, Yersinia pestis KIM
ccacgcugugucaa

SEQ ID NO: 2295335 - RNA, 14 nt, Yersinia pestis KIM
ccacgccccaacgg

SEQ ID NO: 2295336 - RNA, 19 nt, Yersinia pestis KIM
ccacgcccaacucuuuagc

SEQ ID NO: 2295337 - RNA, 20 nt, Yersinia pestis KIM
aaagucaucccgcaauggcg

SEQ ID NO: 2295338 - RNA, 18 nt, Yersinia pestis KIM
ccaagaaaagcaccgcag

SEQ ID NO: 2295339 - RNA, 16 nt, Yersinia pestis KIM
ccaagaaaagcaccgc

SEQ ID NO: 2295340 - RNA, 16 nt, Yersinia pestis KIM
ccaacgcccugcaucu

SEQ ID NO: 2295341 - RNA, 15 nt, Yersinia pestis KIM
ccaaagauggcgcgg

SEQ ID NO: 2295342 - RNA, 19 nt, Yersinia pestis KIM
ccaaagggagccauugcaa

SEQ ID NO: 2295343 - RNA, 14 nt, Yersinia pestis KIM
ccaaagucauuggc

SEQ ID NO: 2295344 - RNA, 17 nt, Yersinia pestis KIM
ccaaauagugauuagca

SEQ ID NO: 2295345 - RNA, 23 nt, Yersinia pestis KIM
ccaaauaaauauccuccggcaua

SEQ ID NO: 2295346 - RNA, 15 nt, Yersinia pestis KIM
ccaaucuccaaugac

SEQ ID NO: 2295347 - RNA, 16 nt, Yersinia pestis KIM
ccaauccaugccagcc

SEQ ID NO: 2295348 - RNA, 20 nt, Yersinia pestis KIM
ccaaucauucugucaucaag

SEQ ID NO: 2295349 - RNA, 16 nt, Yersinia pestis KIM
aaagccgucaguuccu

SEQ ID NO: 2295350 - RNA, 20 nt, Yersinia pestis KIM
aaagcgcccuucggacggcu

SEQ ID NO: 2295351 - RNA, 19 nt, Yersinia pestis KIM
aaagcgccugugggcggcu

SEQ ID NO: 2295352 - RNA, 17 nt, Yersinia pestis KIM
aaagcgguaaauggcga

SEQ ID NO: 2295353 - RNA, 14 nt, Yersinia pestis KIM
ccaaugaugacuug

SEQ ID NO: 2295354 - RNA, 20 nt, Yersinia pestis KIM
ccaccaauagcgaucagcaa

SEQ ID NO: 2295355 - RNA, 15 nt, Yersinia pestis KIM
ccaccaauuucaucg

SEQ ID NO: 2295356 - RNA, 21 nt, Yersinia pestis KIM
ccacacugagcaccgcaggaa

SEQ ID NO: 2295357 - RNA, 21 nt, Yersinia pestis KIM
ccacaccuuaucacucgggau

SEQ ID NO: 2295358 - RNA, 17 nt, Yersinia pestis KIM
ccaccaucacuuccagc

SEQ ID NO: 2295359 - RNA, 19 nt, Yersinia pestis KIM
ccaccaucacuuccagcgc

SEQ ID NO: 2295360 - RNA, 17 nt, Yersinia pestis KIM
aaagcuuacuguucacc

SEQ ID NO: 2295361 - RNA, 16 nt, Yersinia pestis KIM
cagcgaagugccgcca

SEQ ID NO: 2295362 - RNA, 20 nt, Yersinia pestis KIM
cagcgcagguggauccguca

SEQ ID NO: 2295363 - RNA, 20 nt, Yersinia pestis KIM
cagcgcacugaauaacgcgg

SEQ ID NO: 2295364 - RNA, 18 nt, Yersinia pestis KIM
cagccaacuggcgcaaca

SEQ ID NO: 2295365 - RNA, 14 nt, Yersinia pestis KIM
cagcggccaugacg

SEQ ID NO: 2295366 - RNA, 17 nt, Yersinia pestis KIM
cagcgugaguaucgaua

SEQ ID NO: 2295367 - RNA, 15 nt, Yersinia pestis KIM
cagacaacugacaac

SEQ ID NO: 2295368 - RNA, 19 nt, Yersinia pestis KIM
cagacauuuuucuauuucu

SEQ ID NO: 2295369 - RNA, 19 nt, Yersinia pestis KIM
aaagaucugcauugauuaa

SEQ ID NO: 2295370 - RNA, 20 nt, Yersinia pestis KIM
cagagauaaacccuaauccc

SEQ ID NO: 2295371 - RNA, 13 nt, Yersinia pestis KIM
cagauaugaucaa

SEQ ID NO: 2295372 - RNA, 20 nt, Yersinia pestis KIM
cagauaguuacccacauuca

SEQ ID NO: 2295373 - RNA, 20 nt, Yersinia pestis KIM
cagaucaagaaaacgcacgc

SEQ ID NO: 2295374 - RNA, 18 nt, Yersinia pestis KIM
cagaguccucucaccaag

SEQ ID NO: 2295375 - RNA, 16 nt, Yersinia pestis KIM
cagaggggugccguuc

SEQ ID NO: 2295376 - RNA, 18 nt, Yersinia pestis KIM
cagaucguaaagacgccg

SEQ ID NO: 2295377 - RNA, 15 nt, Yersinia pestis KIM
cacugaugagcuggc

SEQ ID NO: 2295378 - RNA, 15 nt, Yersinia pestis KIM
cacugauaccgauau

SEQ ID NO: 2295379 - RNA, 14 nt, Yersinia pestis KIM
cacugcuccagcca

SEQ ID NO: 2295380 - RNA, 21 nt, Yersinia pestis KIM
cacugauucucuucaccuuca

SEQ ID NO: 2295381 - RNA, 14 nt, Yersinia pestis KIM
cacuauuucagaca

SEQ ID NO: 2295382 - RNA, 20 nt, Yersinia pestis KIM
cacuauucuccaacaacugc

SEQ ID NO: 2295383 - RNA, 22 nt, Yersinia pestis KIM
cacucaggguuagggaugagug

SEQ ID NO: 2295384 - RNA, 18 nt, Yersinia pestis KIM
cacguuuaauucaaaguu

SEQ ID NO: 2295385 - RNA, 16 nt, Yersinia pestis KIM
cacuuggccccaucau

SEQ ID NO: 2295386 - RNA, 13 nt, Yersinia pestis KIM
cagcaucaucaaa

SEQ ID NO: 2295387 - RNA, 19 nt, Yersinia pestis KIM
cagcauuguuggcggugac

SEQ ID NO: 2295388 - RNA, 12 nt, Yersinia pestis KIM
cagcaaaucauu

SEQ ID NO: 2295389 - RNA, 18 nt, Yersinia pestis KIM
cagaugacgggcgacccg

SEQ ID NO: 2295390 - RNA, 15 nt, Yersinia pestis KIM
cagcaccauuaucuu

SEQ ID NO: 2295391 - RNA, 15 nt, Yersinia pestis KIM
caggcagauaaaucc

SEQ ID NO: 2295392 - RNA, 21 nt, Yersinia pestis KIM
caggccccaauccaccacuga

SEQ ID NO: 2295393 - RNA, 15 nt, Yersinia pestis KIM
caggcauaucacuau

SEQ ID NO: 2295394 - RNA, 14 nt, Yersinia pestis KIM
cagggcagccaauu

SEQ ID NO: 2295395 - RNA, 16 nt, Yersinia pestis KIM
caggcgcaacugccau

SEQ ID NO: 2295396 - RNA, 23 nt, Yersinia pestis KIM
caggccuagcccaguaccgcugg

SEQ ID NO: 2295397 - RNA, 22 nt, Yersinia pestis KIM
caggguauuccacccgcacaau

SEQ ID NO: 2295398 - RNA, 19 nt, Yersinia pestis KIM
cagggugaaagcccaacug

SEQ ID NO: 2295399 - RNA, 17 nt, Yersinia pestis KIM
caggguuagccgacugg

SEQ ID NO: 2295400 - RNA, 21 nt, Yersinia pestis KIM
cagguagaucaaacauaaccu

SEQ ID NO: 2295401 - RNA, 14 nt, Yersinia pestis KIM
caggguaauaaccg

SEQ ID NO: 2295402 - RNA, 21 nt, Yersinia pestis KIM
caguacgacgacggauauucu

SEQ ID NO: 2295403 - RNA, 16 nt, Yersinia pestis KIM
caguaccgcuggugcu

SEQ ID NO: 2295404 - RNA, 20 nt, Yersinia pestis KIM
caguaccugcuaaccgaaga

SEQ ID NO: 2295405 - RNA, 23 nt, Yersinia pestis KIM
caguaucuuuccagccaauacag

SEQ ID NO: 2295406 - RNA, 22 nt, Yersinia pestis KIM
cagucuaaacgccgcgucaaua

SEQ ID NO: 2295407 - RNA, 15 nt, Yersinia pestis KIM
cagucuaaacgccgc

SEQ ID NO: 2295408 - RNA, 16 nt, Yersinia pestis KIM
cagucugaggcccgcu

SEQ ID NO: 2295409 - RNA, 19 nt, Yersinia pestis KIM
cagucugagccucaugaau

SEQ ID NO: 2295410 - RNA, 21 nt, Yersinia pestis KIM
cagugaugcugcacaucaacg

SEQ ID NO: 2295411 - RNA, 20 nt, Yersinia pestis KIM
caguauucugcuuccaggau

SEQ ID NO: 2295412 - RNA, 12 nt, Yersinia pestis KIM
cagucaauacac

SEQ ID NO: 2295413 - RNA, 19 nt, Yersinia pestis KIM
cagucaucgccuucuggca

SEQ ID NO: 2295414 - RNA, 16 nt, Yersinia pestis KIM
caugaugacaaugcgu

SEQ ID NO: 2295415 - RNA, 13 nt, Yersinia pestis KIM
caugcagcccgac

SEQ ID NO: 2295416 - RNA, 19 nt, Yersinia pestis KIM
caucuucuucaucccaauc

SEQ ID NO: 2295417 - RNA, 15 nt, Yersinia pestis KIM
caucuugcaacaacg

SEQ ID NO: 2295418 - RNA, 23 nt, Yersinia pestis KIM
caugaaugaggcugagguuauug

SEQ ID NO: 2295419 - RNA, 22 nt, Yersinia pestis KIM
caucgcuugauaacacauuauu

SEQ ID NO: 2295420 - RNA, 18 nt, Yersinia pestis KIM
caucgggcauucacugcu

SEQ ID NO: 2295421 - RNA, 15 nt, Yersinia pestis KIM
caucugaaagcuuca

SEQ ID NO: 2295422 - RNA, 18 nt, Yersinia pestis KIM
caucuaugggcuucgcca

SEQ ID NO: 2295423 - RNA, 15 nt, Yersinia pestis KIM
caucgucagccccug

SEQ ID NO: 2295424 - RNA, 15 nt, Yersinia pestis KIM
caucguccuguaagg

SEQ ID NO: 2295425 - RNA, 17 nt, Yersinia pestis KIM
caucuacaacaucaucg

SEQ ID NO: 2295426 - RNA, 24 nt, Yersinia pestis KIM
caucgucucugcauuacaacuuga

SEQ ID NO: 2295427 - RNA, 18 nt, Yersinia pestis KIM
caucccuaaaaucauuga

SEQ ID NO: 2295428 - RNA, 13 nt, Yersinia pestis KIM
cauccaucauugc

SEQ ID NO: 2295429 - RNA, 11 nt, Yersinia pestis KIM
caucagcgccc

SEQ ID NO: 2295430 - RNA, 14 nt, Yersinia pestis KIM
caucgccaguguug

SEQ ID NO: 2295431 - RNA, 15 nt, Yersinia pestis KIM
caucgcucaucgcca

SEQ ID NO: 2295432 - RNA, 18 nt, Yersinia pestis KIM
caucacgauagccaguga

SEQ ID NO: 2295433 - RNA, 20 nt, Yersinia pestis KIM
caucacggcggcccggugca

SEQ ID NO: 2295434 - RNA, 20 nt, Yersinia pestis KIM
caucagacaggauaaucauc

SEQ ID NO: 2295435 - RNA, 15 nt, Yersinia pestis KIM
cauauuaaaugcauu

SEQ ID NO: 2295436 - RNA, 21 nt, Yersinia pestis KIM
cauagcccggcucauccgcca

SEQ ID NO: 2295437 - RNA, 17 nt, Yersinia pestis KIM
caucaaucgagaagaau

SEQ ID NO: 2295438 - RNA, 17 nt, Yersinia pestis KIM
cauauucacuauagacu

SEQ ID NO: 2295439 - RNA, 13 nt, Yersinia pestis KIM
caucaaaccggcu

SEQ ID NO: 2295440 - RNA, 13 nt, Yersinia pestis KIM
caucaaaaccgau

SEQ ID NO: 2295441 - RNA, 16 nt, Yersinia pestis KIM
cagugcuucaucacug

SEQ ID NO: 2295442 - RNA, 18 nt, Yersinia pestis KIM
cagugugcgcaucagcca

SEQ ID NO: 2295443 - RNA, 22 nt, Yersinia pestis KIM
caguguuuucuccacaccaacg

SEQ ID NO: 2295444 - RNA, 22 nt, Yersinia pestis KIM
cauaauggacgaacagugccaa

SEQ ID NO: 2295445 - RNA, 15 nt, Yersinia pestis KIM
cauaacugaauacuu

SEQ ID NO: 2295446 - RNA, 21 nt, Yersinia pestis KIM
cauacuccauuuuuuugaugc

SEQ ID NO: 2295447 - RNA, 16 nt, Yersinia pestis KIM
cauacucaggcccuga

SEQ ID NO: 2295448 - RNA, 18 nt, Yersinia pestis KIM
cauacucaggcccugaga

SEQ ID NO: 2295449 - RNA, 11 nt, Yersinia pestis KIM
cauagaauacc

SEQ ID NO: 2295450 - RNA, 13 nt, Yersinia pestis KIM
cauacuuugccuu

SEQ ID NO: 2295451 - RNA, 18 nt, Yersinia pestis KIM
cauaccggguucaaggaa

SEQ ID NO: 2295452 - RNA, 13 nt, Yersinia pestis KIM
aggcuuucaagac

SEQ ID NO: 2295453 - RNA, 20 nt, Yersinia pestis KIM
aggcuuucacggugcgucag

SEQ ID NO: 2295454 - RNA, 17 nt, Yersinia pestis KIM
aggcuugaaguucucau

SEQ ID NO: 2295455 - RNA, 21 nt, Yersinia pestis KIM
aggcuugaaguucucaucaaa

SEQ ID NO: 2295456 - RNA, 21 nt, Yersinia pestis KIM
aggcuuggguaucuggagcca

SEQ ID NO: 2295457 - RNA, 15 nt, Yersinia pestis KIM
agggaguucaucaaa

SEQ ID NO: 2295458 - RNA, 17 nt, Yersinia pestis KIM
agggaaucacgcguuca

SEQ ID NO: 2295459 - RNA, 16 nt, Yersinia pestis KIM
aggcugauuaauauca

SEQ ID NO: 2295460 - RNA, 16 nt, Yersinia pestis KIM
aggcugaugccaucaa

SEQ ID NO: 2295461 - RNA, 18 nt, Yersinia pestis KIM
agggccacuucgguggcc

SEQ ID NO: 2295462 - RNA, 21 nt, Yersinia pestis KIM
agggcgcuuguuuuacaauua

SEQ ID NO: 2295463 - RNA, 20 nt, Yersinia pestis KIM
aggguaaucagaaguucaga

SEQ ID NO: 2295464 - RNA, 20 nt, Yersinia pestis KIM
agguucaauaauuauaccua

SEQ ID NO: 2295465 - RNA, 14 nt, Yersinia pestis KIM
agguuaacugcagu

SEQ ID NO: 2295466 - RNA, 22 nt, Yersinia pestis KIM
aguacaucaauagugcgaucaa

SEQ ID NO: 2295467 - RNA, 15 nt, Yersinia pestis KIM
aguaaucgccaggcg

SEQ ID NO: 2295468 - RNA, 18 nt, Yersinia pestis KIM
aguaaucaggcauuacag

SEQ ID NO: 2295469 - RNA, 17 nt, Yersinia pestis KIM
agucauccaaacggaau

SEQ ID NO: 2295470 - RNA, 20 nt, Yersinia pestis KIM
agucauuggcguuacagcaa

SEQ ID NO: 2295471 - RNA, 20 nt, Yersinia pestis KIM
agucauugguguuacagcaa

SEQ ID NO: 2295472 - RNA, 22 nt, Yersinia pestis KIM
aggugcguuaucuucacguaca

SEQ ID NO: 2295473 - RNA, 18 nt, Yersinia pestis KIM
agucgcuccucagccuuu

SEQ ID NO: 2295474 - RNA, 15 nt, Yersinia pestis KIM
agugaugacuagcga

SEQ ID NO: 2295475 - RNA, 22 nt, Yersinia pestis KIM
aguuaauacgccauccgcaccu

SEQ ID NO: 2295476 - RNA, 19 nt, Yersinia pestis KIM
aguuaccuugugucaccau

SEQ ID NO: 2295477 - RNA, 20 nt, Yersinia pestis KIM
aguguuuuucucagcauaau

SEQ ID NO: 2295478 - RNA, 21 nt, Yersinia pestis KIM
aguuaaacgguaaccauccau

SEQ ID NO: 2295479 - RNA, 15 nt, Yersinia pestis KIM
aguguugcgguuauu

SEQ ID NO: 2295480 - RNA, 17 nt, Yersinia pestis KIM
agugugugguauucacg

SEQ ID NO: 2295481 - RNA, 22 nt, Yersinia pestis KIM
aguguucggggguugucagcag

SEQ ID NO: 2295482 - RNA, 22 nt, Yersinia pestis KIM
auaaaaucaccgccggauuuca

SEQ ID NO: 2295483 - RNA, 22 nt, Yersinia pestis KIM
auaaaauagcccagugcggaag

SEQ ID NO: 2295484 - RNA, 20 nt, Yersinia pestis KIM
auaaacgccagucagcuagc

SEQ ID NO: 2295485 - RNA, 14 nt, Yersinia pestis KIM
auaaagauacccgc

SEQ ID NO: 2295486 - RNA, 21 nt, Yersinia pestis KIM
auaaagcaucagacugcucuu

SEQ ID NO: 2295487 - RNA, 17 nt, Yersinia pestis KIM
auaaagcccauacccgc

SEQ ID NO: 2295488 - RNA, 12 nt, Yersinia pestis KIM
auaaaaacuauc

SEQ ID NO: 2295489 - RNA, 13 nt, Yersinia pestis KIM
auaaaaauagccu

SEQ ID NO: 2295490 - RNA, 23 nt, Yersinia pestis KIM
auaaaaggauggcccaagccauc

SEQ ID NO: 2295491 - RNA, 23 nt, Yersinia pestis KIM
aguuguagggugccaacgcaauu

SEQ ID NO: 2295492 - RNA, 21 nt, Yersinia pestis KIM
aguucacaccguauagcaucg

SEQ ID NO: 2295493 - RNA, 21 nt, Yersinia pestis KIM
aguucaagaaccgaaauauca

SEQ ID NO: 2295494 - RNA, 19 nt, Yersinia pestis KIM
auaacaaacacauccagga

SEQ ID NO: 2295495 - RNA, 15 nt, Yersinia pestis KIM
auaaucagccugcug

SEQ ID NO: 2295496 - RNA, 16 nt, Yersinia pestis KIM
auaaucaacggcacca

SEQ ID NO: 2295497 - RNA, 13 nt, Yersinia pestis KIM
auaauggcagccc

SEQ ID NO: 2295498 - RNA, 16 nt, Yersinia pestis KIM
auaauggugggccgug

SEQ ID NO: 2295499 - RNA, 22 nt, Yersinia pestis KIM
auaauggugggccgugcgggau

SEQ ID NO: 2295500 - RNA, 22 nt, Yersinia pestis KIM
auaauggugggucgugcgggau

SEQ ID NO: 2295501 - RNA, 15 nt, Yersinia pestis KIM
auaaucucuaacggc

SEQ ID NO: 2295502 - RNA, 22 nt, Yersinia pestis KIM
auaauuaaggggcuuugcgcaa

SEQ ID NO: 2295503 - RNA, 16 nt, Yersinia pestis KIM
auccgaccacugacaa

SEQ ID NO: 2295504 - RNA, 21 nt, Yersinia pestis KIM
auccgccugagauuaaccgcg

SEQ ID NO: 2295505 - RNA, 22 nt, Yersinia pestis KIM
auccggccauuuuuuaccauua

SEQ ID NO: 2295506 - RNA, 23 nt, Yersinia pestis KIM
auccggauuaaauucuaccuggc

SEQ ID NO: 2295507 - RNA, 16 nt, Yersinia pestis KIM
auccucaccguucaag

SEQ ID NO: 2295508 - RNA, 13 nt, Yersinia pestis KIM
auccucaccguuu

SEQ ID NO: 2295509 - RNA, 14 nt, Yersinia pestis KIM
auccucaucacugc

SEQ ID NO: 2295510 - RNA, 17 nt, Yersinia pestis KIM
auccguagacauuaucc

SEQ ID NO: 2295511 - RNA, 18 nt, Yersinia pestis KIM
auccuggcccgccagcau

SEQ ID NO: 2295512 - RNA, 15 nt, Yersinia pestis KIM
auccuucauuucagg

SEQ ID NO: 2295513 - RNA, 21 nt, Yersinia pestis KIM
auccuuuggauuuaaugcugu

SEQ ID NO: 2295514 - RNA, 16 nt, Yersinia pestis KIM
aucgaaaagcgccuuu

SEQ ID NO: 2295515 - RNA, 21 nt, Yersinia pestis KIM
auccaccagcgggcggcagau

SEQ ID NO: 2295516 - RNA, 22 nt, Yersinia pestis KIM
auccaccguuuuacucaggauu

SEQ ID NO: 2295517 - RNA, 18 nt, Yersinia pestis KIM
auccaaaugcccauuagu

SEQ ID NO: 2295518 - RNA, 21 nt, Yersinia pestis KIM
aucauugcaaucguaccuggc

SEQ ID NO: 2295519 - RNA, 17 nt, Yersinia pestis KIM
aucauuaagaugcaucc

SEQ ID NO: 2295520 - RNA, 15 nt, Yersinia pestis KIM
auccagcgcgccugu

SEQ ID NO: 2295521 - RNA, 23 nt, Yersinia pestis KIM
auccccuuugacagcaucugcaa

SEQ ID NO: 2295522 - RNA, 22 nt, Yersinia pestis KIM
aucccgaaucaagcuacgccaa

SEQ ID NO: 2295523 - RNA, 18 nt, Yersinia pestis KIM
auccccacuuguaccugu

SEQ ID NO: 2295524 - RNA, 15 nt, Yersinia pestis KIM
aucccacucuguagc

SEQ ID NO: 2295525 - RNA, 12 nt, Yersinia pestis KIM
aucccagcacag

SEQ ID NO: 2295526 - RNA, 20 nt, Yersinia pestis KIM
auccccacauugaccagauu

SEQ ID NO: 2295527 - RNA, 20 nt, Yersinia pestis KIM
aucccaauauugacaggauc

SEQ ID NO: 2295528 - RNA, 17 nt, Yersinia pestis KIM
aucagaccuuuacagga

SEQ ID NO: 2295529 - RNA, 15 nt, Yersinia pestis KIM
aucagaccauggccu

SEQ ID NO: 2295530 - RNA, 13 nt, Yersinia pestis KIM
aucacuuauugga

SEQ ID NO: 2295531 - RNA, 18 nt, Yersinia pestis KIM
aucaauaccuuacugcau

SEQ ID NO: 2295532 - RNA, 16 nt, Yersinia pestis KIM
aucaaucucuucaugg

SEQ ID NO: 2295533 - RNA, 19 nt, Yersinia pestis KIM
aucaauacccugccaccuu

SEQ ID NO: 2295534 - RNA, 12 nt, Yersinia pestis KIM
aucaauaccgug

SEQ ID NO: 2295535 - RNA, 21 nt, Yersinia pestis KIM
aucaaggcggcagagccaauc

SEQ ID NO: 2295536 - RNA, 15 nt, Yersinia pestis KIM
aucaucaccauucaa

SEQ ID NO: 2295537 - RNA, 17 nt, Yersinia pestis KIM
aucauauaagcggcaaa

SEQ ID NO: 2295538 - RNA, 18 nt, Yersinia pestis KIM
aucaucgcucaucgccaa

SEQ ID NO: 2295539 - RNA, 14 nt, Yersinia pestis KIM
aucaucguaguaau

SEQ ID NO: 2295540 - RNA, 11 nt, Yersinia pestis KIM
aucaugauuuc

SEQ ID NO: 2295541 - RNA, 20 nt, Yersinia pestis KIM
aucaguggcgguucgagcgg

SEQ ID NO: 2295542 - RNA, 21 nt, Yersinia pestis KIM
aucaguauuauaaaauucgcu

SEQ ID NO: 2295543 - RNA, 13 nt, Yersinia pestis KIM
aucaguagcaucc

SEQ ID NO: 2295544 - RNA, 16 nt, Yersinia pestis KIM
aucagcgguugaaaag

SEQ ID NO: 2295545 - RNA, 17 nt, Yersinia pestis KIM
auagugauuuuuuucac

SEQ ID NO: 2295546 - RNA, 21 nt, Yersinia pestis KIM
auagucaucuuuccagcgaac

SEQ ID NO: 2295547 - RNA, 14 nt, Yersinia pestis KIM
auaucaauauccgc

SEQ ID NO: 2295548 - RNA, 14 nt, Yersinia pestis KIM
auagcuaucacgac

SEQ ID NO: 2295549 - RNA, 18 nt, Yersinia pestis KIM
auagcugcgauaauccgc

SEQ ID NO: 2295550 - RNA, 19 nt, Yersinia pestis KIM
auaccauaaggccaggcaa

SEQ ID NO: 2295551 - RNA, 20 nt, Yersinia pestis KIM
auaccaggccacggccgccu

SEQ ID NO: 2295552 - RNA, 18 nt, Yersinia pestis KIM
auauucccccugagucaa

SEQ ID NO: 2295553 - RNA, 21 nt, Yersinia pestis KIM
auauucccugcguugcgaaau

SEQ ID NO: 2295554 - RNA, 21 nt, Yersinia pestis KIM
auauucauagguagaauagca

SEQ ID NO: 2295555 - RNA, 21 nt, Yersinia pestis KIM
auauugcggaguaacacuuca

SEQ ID NO: 2295556 - RNA, 14 nt, Yersinia pestis KIM
auauucgucucauc

SEQ ID NO: 2295557 - RNA, 16 nt, Yersinia pestis KIM
auauucuuagccagug

SEQ ID NO: 2295558 - RNA, 23 nt, Yersinia pestis KIM
auauuucuccccacuucaucauc

SEQ ID NO: 2295559 - RNA, 15 nt, Yersinia pestis KIM
aucaaccaagacaua

SEQ ID NO: 2295560 - RNA, 17 nt, Yersinia pestis KIM
aucaacauuaucucgcc

SEQ ID NO: 2295561 - RNA, 21 nt, Yersinia pestis KIM
agcgaucaccucuugcauacu

SEQ ID NO: 2295562 - RNA, 13 nt, Yersinia pestis KIM
agcgauaacagau

SEQ ID NO: 2295563 - RNA, 15 nt, Yersinia pestis KIM
agccuacgagagauc

SEQ ID NO: 2295564 - RNA, 18 nt, Yersinia pestis KIM
agccuaaggccaucaaua

SEQ ID NO: 2295565 - RNA, 11 nt, Yersinia pestis KIM
agccuuucagc

SEQ ID NO: 2295566 - RNA, 13 nt, Yersinia pestis KIM
agccgcgccaucc

SEQ ID NO: 2295567 - RNA, 13 nt, Yersinia pestis KIM
agcccccucaaua

SEQ ID NO: 2295568 - RNA, 16 nt, Yersinia pestis KIM
agcaguugcugcucug

SEQ ID NO: 2295569 - RNA, 21 nt, Yersinia pestis KIM
agcauaccgguuugggcauca

SEQ ID NO: 2295570 - RNA, 15 nt, Yersinia pestis KIM
agcauaccaauaccg

SEQ ID NO: 2295571 - RNA, 18 nt, Yersinia pestis KIM
agauugcuacugaagguu

SEQ ID NO: 2295572 - RNA, 13 nt, Yersinia pestis KIM
agccagugacucc

SEQ ID NO: 2295573 - RNA, 16 nt, Yersinia pestis KIM
agccagccuuaacugc

SEQ ID NO: 2295574 - RNA, 14 nt, Yersinia pestis KIM
agccacuacugaac

SEQ ID NO: 2295575 - RNA, 14 nt, Yersinia pestis KIM
agccaaaacagccu

SEQ ID NO: 2295576 - RNA, 14 nt, Yersinia pestis KIM
agcggcaaauagag

SEQ ID NO: 2295577 - RNA, 21 nt, Yersinia pestis KIM
agcggcaaauagagcaccaaa

SEQ ID NO: 2295578 - RNA, 23 nt, Yersinia pestis KIM
agcgggaauacguugagauaauc

SEQ ID NO: 2295579 - RNA, 15 nt, Yersinia pestis KIM
agcgggcggcagaua

SEQ ID NO: 2295580 - RNA, 20 nt, Yersinia pestis KIM
agcguaggcaacuaagcugc

SEQ ID NO: 2295581 - RNA, 15 nt, Yersinia pestis KIM
agcguagacaaugac

SEQ ID NO: 2295582 - RNA, 15 nt, Yersinia pestis KIM
agcguacucaaugcu

SEQ ID NO: 2295583 - RNA, 20 nt, Yersinia pestis KIM
agcguagguaacuaagcugc

SEQ ID NO: 2295584 - RNA, 20 nt, Yersinia pestis KIM
agcgugguauaaauggcacu

SEQ ID NO: 2295585 - RNA, 22 nt, Yersinia pestis KIM
agcuaaucauugcaaugcuacc

SEQ ID NO: 2295586 - RNA, 13 nt, Yersinia pestis KIM
agcuacagcucag

SEQ ID NO: 2295587 - RNA, 14 nt, Yersinia pestis KIM
aaacggcgguuaau

SEQ ID NO: 2295588 - RNA, 19 nt, Yersinia pestis KIM
aaacggugcuggugggccu

SEQ ID NO: 2295589 - RNA, 12 nt, Yersinia pestis KIM
aaacgucacuuc

SEQ ID NO: 2295590 - RNA, 20 nt, Yersinia pestis KIM
aaacggugugcaucacguuu

SEQ ID NO: 2295591 - RNA, 20 nt, Yersinia pestis KIM
aggagauuucagacugcuga

SEQ ID NO: 2295592 - RNA, 19 nt, Yersinia pestis KIM
aggcauuuuuguugaaggc

SEQ ID NO: 2295593 - RNA, 23 nt, Yersinia pestis KIM
aggcccugguugcagcacgccag

SEQ ID NO: 2295594 - RNA, 23 nt, Yersinia pestis KIM
aggccauuuuacugucggcgauc

SEQ ID NO: 2295595 - RNA, 13 nt, Yersinia pestis KIM
agcuuuucacgag

SEQ ID NO: 2295596 - RNA, 13 nt, Yersinia pestis KIM
aggaaacuccagu

SEQ ID NO: 2295597 - RNA, 21 nt, Yersinia pestis KIM
aggaaggcgguuaucuggaau

SEQ ID NO: 2295598 - RNA, 14 nt, Yersinia pestis KIM
agcuguuugcaccu

SEQ ID NO: 2295599 - RNA, 22 nt, Yersinia pestis KIM
agcuguaaauagcuugcggcca

SEQ ID NO: 2295600 - RNA, 14 nt, Yersinia pestis KIM
caccgcccccaaua

SEQ ID NO: 2295601 - RNA, 24 nt, Yersinia pestis KIM
caccgccggauuucaauccgacca

SEQ ID NO: 2295602 - RNA, 23 nt, Yersinia pestis KIM
caccugaguaauauuauucaauu

SEQ ID NO: 2295603 - RNA, 15 nt, Yersinia pestis KIM
caccguaucugccaa

SEQ ID NO: 2295604 - RNA, 17 nt, Yersinia pestis KIM
cacgcauuccaucagcc

SEQ ID NO: 2295605 - RNA, 20 nt, Yersinia pestis KIM
cacgcauuccaucagccaac

SEQ ID NO: 2295606 - RNA, 14 nt, Yersinia pestis KIM
caccuuauccaaua

SEQ ID NO: 2295607 - RNA, 15 nt, Yersinia pestis KIM
cacgaaaaaauggca

SEQ ID NO: 2295608 - RNA, 17 nt, Yersinia pestis KIM
cacgaaccuucucugca

SEQ ID NO: 2295609 - RNA, 12 nt, Yersinia pestis KIM
cacgaucagcuc

SEQ ID NO: 2295610 - RNA, 18 nt, Yersinia pestis KIM
cacagagcgggaacgcca

SEQ ID NO: 2295611 - RNA, 20 nt, Yersinia pestis KIM
cacacguguacucauauugu

SEQ ID NO: 2295612 - RNA, 15 nt, Yersinia pestis KIM
cacacucagacaauc

SEQ ID NO: 2295613 - RNA, 18 nt, Yersinia pestis KIM
cacagucauuugaacgug

SEQ ID NO: 2295614 - RNA, 15 nt, Yersinia pestis KIM
caccacacuggaugc

SEQ ID NO: 2295615 - RNA, 18 nt, Yersinia pestis KIM
caccaauagcgaucagca

SEQ ID NO: 2295616 - RNA, 15 nt, Yersinia pestis KIM
caccaagacugaagu

SEQ ID NO: 2295617 - RNA, 19 nt, Yersinia pestis KIM
caccaagaggaaaugccgc

SEQ ID NO: 2295618 - RNA, 17 nt, Yersinia pestis KIM
caccaguaaacgccaau

SEQ ID NO: 2295619 - RNA, 16 nt, Yersinia pestis KIM
caccagacaccugaua

SEQ ID NO: 2295620 - RNA, 15 nt, Yersinia pestis KIM
caccagaaucaucag

SEQ ID NO: 2295621 - RNA, 14 nt, Yersinia pestis KIM
caccagauggcgau

SEQ ID NO: 2295622 - RNA, 12 nt, Yersinia pestis KIM
cacaauaagccc

SEQ ID NO: 2295623 - RNA, 19 nt, Yersinia pestis KIM
cacaauagaugcaguaacg

SEQ ID NO: 2295624 - RNA, 23 nt, Yersinia pestis KIM
cacaauagcuaccccuucaguca

SEQ ID NO: 2295625 - RNA, 21 nt, Yersinia pestis KIM
cacaauaauuaggaauaucaa

SEQ ID NO: 2295626 - RNA, 20 nt, Yersinia pestis KIM
cacaaucucuggcaacggca

SEQ ID NO: 2295627 - RNA, 19 nt, Yersinia pestis KIM
cacaaucuugcagcgauca

SEQ ID NO: 2295628 - RNA, 20 nt, Yersinia pestis KIM
caauggugcccaucacaucg

SEQ ID NO: 2295629 - RNA, 15 nt, Yersinia pestis KIM
cacaaaugcugugcc

SEQ ID NO: 2295630 - RNA, 16 nt, Yersinia pestis KIM
caauuucucggccaac

SEQ ID NO: 2295631 - RNA, 14 nt, Yersinia pestis KIM
cacaacgcauuacc

SEQ ID NO: 2295632 - RNA, 15 nt, Yersinia pestis KIM
caauaauuucacuau

SEQ ID NO: 2295633 - RNA, 18 nt, Yersinia pestis KIM
caauaauuuuuacgauau

SEQ ID NO: 2295634 - RNA, 12 nt, Yersinia pestis KIM
caauaauucaga

SEQ ID NO: 2295635 - RNA, 13 nt, Yersinia pestis KIM
caauacccauggu

SEQ ID NO: 2295636 - RNA, 16 nt, Yersinia pestis KIM
caauggucaugcacag

SEQ ID NO: 2295637 - RNA, 17 nt, Yersinia pestis KIM
caaugagugauauccgc

SEQ ID NO: 2295638 - RNA, 21 nt, Yersinia pestis KIM
caaugaaauauggugauaacu

SEQ ID NO: 2295639 - RNA, 13 nt, Yersinia pestis KIM
caaugaauaccca

SEQ ID NO: 2295640 - RNA, 19 nt, Yersinia pestis KIM
caaugacuuaacugaaagc

SEQ ID NO: 2295641 - RNA, 23 nt, Yersinia pestis KIM
caagccagcgaggcuucucagca

SEQ ID NO: 2295642 - RNA, 15 nt, Yersinia pestis KIM
caacuuggcaccuaa

SEQ ID NO: 2295643 - RNA, 19 nt, Yersinia pestis KIM
caacuuuuuucauccuaaa

SEQ ID NO: 2295644 - RNA, 18 nt, Yersinia pestis KIM
caacuuuuauuggcauua

SEQ ID NO: 2295645 - RNA, 23 nt, Yersinia pestis KIM
caagaugccuauuugcagaaagu

SEQ ID NO: 2295646 - RNA, 14 nt, Yersinia pestis KIM
caagcggcagcgcu

SEQ ID NO: 2295647 - RNA, 20 nt, Yersinia pestis KIM
caagcgcguuagccuacugg

SEQ ID NO: 2295648 - RNA, 17 nt, Yersinia pestis KIM
caagcgcaguagcggcu

SEQ ID NO: 2295649 - RNA, 17 nt, Yersinia pestis KIM
caaggguauaacucauc

SEQ ID NO: 2295650 - RNA, 14 nt, Yersinia pestis KIM
caauaauaagccgc

SEQ ID NO: 2295651 - RNA, 14 nt, Yersinia pestis KIM
caauaagcuguaau

SEQ ID NO: 2295652 - RNA, 20 nt, Yersinia pestis KIM
caauaacaccgucuuugacc

SEQ ID NO: 2295653 - RNA, 19 nt, Yersinia pestis KIM
caauaaaagguaggccaga

SEQ ID NO: 2295654 - RNA, 16 nt, Yersinia pestis KIM
caauaaaauaagcagg

SEQ ID NO: 2295655 - RNA, 13 nt, Yersinia pestis KIM
caaguucaagcag

SEQ ID NO: 2295656 - RNA, 19 nt, Yersinia pestis KIM
caaaaaaagggcgcugaca

SEQ ID NO: 2295657 - RNA, 23 nt, Yersinia pestis KIM
caaaaaaaccaccaaaauagcgg

SEQ ID NO: 2295658 - RNA, 17 nt, Yersinia pestis KIM
auuuuuuuccaggucaa

SEQ ID NO: 2295659 - RNA, 20 nt, Yersinia pestis KIM
auuuuugccaaugcugcugu

SEQ ID NO: 2295660 - RNA, 19 nt, Yersinia pestis KIM
auuuuuacggcuugccggu

SEQ ID NO: 2295661 - RNA, 20 nt, Yersinia pestis KIM
caaaagccccagugcgcaaa

SEQ ID NO: 2295662 - RNA, 23 nt, Yersinia pestis KIM
caaaauaaauauccuccggcaua

SEQ ID NO: 2295663 - RNA, 11 nt, Yersinia pestis KIM
caaaacucaug

SEQ ID NO: 2295664 - RNA, 15 nt, Yersinia pestis KIM
caaaaaaccggcucc

SEQ ID NO: 2295665 - RNA, 17 nt, Yersinia pestis KIM
caaaaaacugcggcaau

SEQ ID NO: 2295666 - RNA, 16 nt, Yersinia pestis KIM
caaaaagccagcgaug

SEQ ID NO: 2295667 - RNA, 16 nt, Yersinia pestis KIM
auuuucggguaucugu

SEQ ID NO: 2295668 - RNA, 12 nt, Yersinia pestis KIM
auuuucggguau

SEQ ID NO: 2295669 - RNA, 22 nt, Yersinia pestis KIM
auuuucguggaaaucgggugau

SEQ ID NO: 2295670 - RNA, 16 nt, Yersinia pestis KIM
auuuuaggugcaguuu

SEQ ID NO: 2295671 - RNA, 18 nt, Yersinia pestis KIM
auuucugcuucuacccug

SEQ ID NO: 2295672 - RNA, 20 nt, Yersinia pestis KIM
auuucuugaugucggguggu

SEQ ID NO: 2295673 - RNA, 14 nt, Yersinia pestis KIM
caaacggauaaugu

SEQ ID NO: 2295674 - RNA, 17 nt, Yersinia pestis KIM
caaacuuaaagcccagg

SEQ ID NO: 2295675 - RNA, 17 nt, Yersinia pestis KIM
caaaccgggguucgcaa

SEQ ID NO: 2295676 - RNA, 14 nt, Yersinia pestis KIM
caaaccgaauacca

SEQ ID NO: 2295677 - RNA, 16 nt, Yersinia pestis KIM
caaaccccgauaacgc

SEQ ID NO: 2295678 - RNA, 14 nt, Yersinia pestis KIM
caaaaucguuaccg

SEQ ID NO: 2295679 - RNA, 15 nt, Yersinia pestis KIM
caaaaucaccuggcc

SEQ ID NO: 2295680 - RNA, 21 nt, Yersinia pestis KIM
caaacauggcggcagcacaga

SEQ ID NO: 2295681 - RNA, 14 nt, Yersinia pestis KIM
caaauucaccagca

SEQ ID NO: 2295682 - RNA, 20 nt, Yersinia pestis KIM
caaauuugacauuuccuugu

SEQ ID NO: 2295683 - RNA, 16 nt, Yersinia pestis KIM
auugcccgguaacaua

SEQ ID NO: 2295684 - RNA, 18 nt, Yersinia pestis KIM
auucguggugaugaugac

SEQ ID NO: 2295685 - RNA, 16 nt, Yersinia pestis KIM
auugcgcuaacagcgu

SEQ ID NO: 2295686 - RNA, 21 nt, Yersinia pestis KIM
auugcguaauuacccaagauc

SEQ ID NO: 2295687 - RNA, 16 nt, Yersinia pestis KIM
auugcggcuuagccac

SEQ ID NO: 2295688 - RNA, 18 nt, Yersinia pestis KIM
auugcggcuuagccacug

SEQ ID NO: 2295689 - RNA, 16 nt, Yersinia pestis KIM
auuucccguugauauc

SEQ ID NO: 2295690 - RNA, 19 nt, Yersinia pestis KIM
auuucagcugcuuuaucgu

SEQ ID NO: 2295691 - RNA, 14 nt, Yersinia pestis KIM
auuucauaccgcug

SEQ ID NO: 2295692 - RNA, 17 nt, Yersinia pestis KIM
auuucgccuuucauaca

SEQ ID NO: 2295693 - RNA, 16 nt, Yersinia pestis KIM
auuucgacaacgccaa

SEQ ID NO: 2295694 - RNA, 23 nt, Yersinia pestis KIM
auuucgaaaacucaaagauuuca

SEQ ID NO: 2295695 - RNA, 16 nt, Yersinia pestis KIM
auuucuccauugcggu

SEQ ID NO: 2295696 - RNA, 19 nt, Yersinia pestis KIM
auuuaucgccaagccagua

SEQ ID NO: 2295697 - RNA, 19 nt, Yersinia pestis KIM
auuuaucgauuuaguauca

SEQ ID NO: 2295698 - RNA, 16 nt, Yersinia pestis KIM
auuuauauaaggucaa

SEQ ID NO: 2295699 - RNA, 20 nt, Yersinia pestis KIM
auuacacacccucaacucaa

SEQ ID NO: 2295700 - RNA, 13 nt, Yersinia pestis KIM
auuaccgcacacu

SEQ ID NO: 2295701 - RNA, 16 nt, Yersinia pestis KIM
auuaccauuacuucua

SEQ ID NO: 2295702 - RNA, 18 nt, Yersinia pestis KIM
auuaaucuauuaauaucg

SEQ ID NO: 2295703 - RNA, 17 nt, Yersinia pestis KIM
auuagcaguaacgucca

SEQ ID NO: 2295704 - RNA, 15 nt, Yersinia pestis KIM
auuagcauuaccggu

SEQ ID NO: 2295705 - RNA, 20 nt, Yersinia pestis KIM
auuagagguuauugacaaag

SEQ ID NO: 2295706 - RNA, 13 nt, Yersinia pestis KIM
auuacugcgauau

SEQ ID NO: 2295707 - RNA, 15 nt, Yersinia pestis KIM
auuacuucgcuuuac

SEQ ID NO: 2295708 - RNA, 16 nt, Yersinia pestis KIM
auuauuaaacuugcuc

SEQ ID NO: 2295709 - RNA, 11 nt, Yersinia pestis KIM
aaacugaccga

SEQ ID NO: 2295710 - RNA, 15 nt, Yersinia pestis KIM
aaacugaugccggua

SEQ ID NO: 2295711 - RNA, 19 nt, Yersinia pestis KIM
auucccguuguuuauccgu

SEQ ID NO: 2295712 - RNA, 23 nt, Yersinia pestis KIM
auuccgccaguggcuuugcacca

SEQ ID NO: 2295713 - RNA, 13 nt, Yersinia pestis KIM
auuccgcgccugg

SEQ ID NO: 2295714 - RNA, 19 nt, Yersinia pestis KIM
auucagacgacgugcagcg

SEQ ID NO: 2295715 - RNA, 22 nt, Yersinia pestis KIM
auucagagcacugugcgccauu

SEQ ID NO: 2295716 - RNA, 15 nt, Yersinia pestis KIM
auucacgcaaggcca

SEQ ID NO: 2295717 - RNA, 13 nt, Yersinia pestis KIM
auucacugcuaac

SEQ ID NO: 2295718 - RNA, 17 nt, Yersinia pestis KIM
aaacuaccgaucaucag

SEQ ID NO: 2295719 - RNA, 20 nt, Yersinia pestis KIM
augaaaaacagauauacggc

SEQ ID NO: 2295720 - RNA, 17 nt, Yersinia pestis KIM
aucuugugucaguauca

SEQ ID NO: 2295721 - RNA, 20 nt, Yersinia pestis KIM
aucugggugagagguugcaa

SEQ ID NO: 2295722 - RNA, 17 nt, Yersinia pestis KIM
aucugguacuccugcuc

SEQ ID NO: 2295723 - RNA, 22 nt, Yersinia pestis KIM
augacagacgcgguuaacgacg

SEQ ID NO: 2295724 - RNA, 13 nt, Yersinia pestis KIM
augacaguauuug

SEQ ID NO: 2295725 - RNA, 19 nt, Yersinia pestis KIM
augacaucccagcacaaug

SEQ ID NO: 2295726 - RNA, 14 nt, Yersinia pestis KIM
augacauucagcgu

SEQ ID NO: 2295727 - RNA, 22 nt, Yersinia pestis KIM
augacaucgacggcagugacga

SEQ ID NO: 2295728 - RNA, 22 nt, Yersinia pestis KIM
augaacguguuagguaauacca

SEQ ID NO: 2295729 - RNA, 14 nt, Yersinia pestis KIM
augacacaauuccc

SEQ ID NO: 2295730 - RNA, 17 nt, Yersinia pestis KIM
augacaaaaauaagcgu

SEQ ID NO: 2295731 - RNA, 20 nt, Yersinia pestis KIM
augcaaaaaaagacacuaac

SEQ ID NO: 2295732 - RNA, 14 nt, Yersinia pestis KIM
augauuacaucacu

SEQ ID NO: 2295733 - RNA, 19 nt, Yersinia pestis KIM
augagggaugaaaagagcu

SEQ ID NO: 2295734 - RNA, 16 nt, Yersinia pestis KIM
augauguggcugcugu

SEQ ID NO: 2295735 - RNA, 14 nt, Yersinia pestis KIM
augagccacacauu

SEQ ID NO: 2295736 - RNA, 16 nt, Yersinia pestis KIM
augagaaccaguucug

SEQ ID NO: 2295737 - RNA, 21 nt, Yersinia pestis KIM
augacgggaauauuuacacgg

SEQ ID NO: 2295738 - RNA, 19 nt, Yersinia pestis KIM
augcagcaucccaaugaau

SEQ ID NO: 2295739 - RNA, 18 nt, Yersinia pestis KIM
augcagggaagcuggccu

SEQ ID NO: 2295740 - RNA, 23 nt, Yersinia pestis KIM
aucucggcguaaacaaucgucuu

SEQ ID NO: 2295741 - RNA, 22 nt, Yersinia pestis KIM
aucugcacuguaauugcgucag

SEQ ID NO: 2295742 - RNA, 15 nt, Yersinia pestis KIM
aucugcauaccugga

SEQ ID NO: 2295743 - RNA, 18 nt, Yersinia pestis KIM
aucucuucgccuuugaug

SEQ ID NO: 2295744 - RNA, 19 nt, Yersinia pestis KIM
aucucuggcaacggcacau

SEQ ID NO: 2295745 - RNA, 19 nt, Yersinia pestis KIM
aucucugccguaccaaugu

SEQ ID NO: 2295746 - RNA, 15 nt, Yersinia pestis KIM
aucgguugccaaguc

SEQ ID NO: 2295747 - RNA, 22 nt, Yersinia pestis KIM
aucgggccacugagcaaacagu

SEQ ID NO: 2295748 - RNA, 13 nt, Yersinia pestis KIM
aucgacaauggcu

SEQ ID NO: 2295749 - RNA, 16 nt, Yersinia pestis KIM
augcccagcguuggca

SEQ ID NO: 2295750 - RNA, 16 nt, Yersinia pestis KIM
augccacuucgcuacg

SEQ ID NO: 2295751 - RNA, 14 nt, Yersinia pestis KIM
augccaaacccauu

SEQ ID NO: 2295752 - RNA, 19 nt, Yersinia pestis KIM
augcccugagauuauuggc

SEQ ID NO: 2295753 - RNA, 19 nt, Yersinia pestis KIM
augucaugcaauuacugca

SEQ ID NO: 2295754 - RNA, 21 nt, Yersinia pestis KIM
augucaguggcgguucgcuga

SEQ ID NO: 2295755 - RNA, 24 nt, Yersinia pestis KIM
auguaacggucauaaucagggaug

SEQ ID NO: 2295756 - RNA, 20 nt, Yersinia pestis KIM
auggcgguauagaccaauuc

SEQ ID NO: 2295757 - RNA, 14 nt, Yersinia pestis KIM
augggggauuaucg

SEQ ID NO: 2295758 - RNA, 15 nt, Yersinia pestis KIM
auggguguuauuuac

SEQ ID NO: 2295759 - RNA, 18 nt, Yersinia pestis KIM
augcucuuuuuaugcagg

SEQ ID NO: 2295760 - RNA, 17 nt, Yersinia pestis KIM
augcucuucuucacuga

SEQ ID NO: 2295761 - RNA, 16 nt, Yersinia pestis KIM
augcugaugcaauaac

SEQ ID NO: 2295762 - RNA, 14 nt, Yersinia pestis KIM
auggauaaugcuga

SEQ ID NO: 2295763 - RNA, 17 nt, Yersinia pestis KIM
auggaugaauauccacc

SEQ ID NO: 2295764 - RNA, 13 nt, Yersinia pestis KIM
auggauauuuucc

SEQ ID NO: 2295765 - RNA, 14 nt, Yersinia pestis KIM
ggccgguuaauuga

SEQ ID NO: 2295766 - RNA, 18 nt, Yersinia pestis KIM
ggccgagacaccauguug

SEQ ID NO: 2295767 - RNA, 19 nt, Yersinia pestis KIM
ggccgacucugcaugauag

SEQ ID NO: 2295768 - RNA, 22 nt, Yersinia pestis KIM
ggcaucuaccuguguugcgcca

SEQ ID NO: 2295769 - RNA, 17 nt, Yersinia pestis KIM
ggcaugaccaaaggcua

SEQ ID NO: 2295770 - RNA, 12 nt, Yersinia pestis KIM
ggcauacugaca

SEQ ID NO: 2295771 - RNA, 15 nt, Yersinia pestis KIM
ggcaacgacugggua

SEQ ID NO: 2295772 - RNA, 19 nt, Yersinia pestis KIM
ggcaaacucagccaucagu

SEQ ID NO: 2295773 - RNA, 19 nt, Yersinia pestis KIM
ggcaaaacucaggugagua

SEQ ID NO: 2295774 - RNA, 24 nt, Yersinia pestis KIM
ggcaacuucccggcgauucuccac

SEQ ID NO: 2295775 - RNA, 21 nt, Yersinia pestis KIM
ggcaagcaagcaaagcccgau

SEQ ID NO: 2295776 - RNA, 16 nt, Yersinia pestis KIM
ggcacauacuaauaga

SEQ ID NO: 2295777 - RNA, 17 nt, Yersinia pestis KIM
ggcacagcgagauaaac

SEQ ID NO: 2295778 - RNA, 22 nt, Yersinia pestis KIM
ggcaauggcucaggcucaucac

SEQ ID NO: 2295779 - RNA, 14 nt, Yersinia pestis KIM
ggcaccaauggcua

SEQ ID NO: 2295780 - RNA, 23 nt, Yersinia pestis KIM
ggcacgcuuaaucuuuuuaacca

SEQ ID NO: 2295781 - RNA, 15 nt, Yersinia pestis KIM
ggaugaugaucaccg

SEQ ID NO: 2295782 - RNA, 23 nt, Yersinia pestis KIM
ggaucugaucaaucucaucaauc

SEQ ID NO: 2295783 - RNA, 19 nt, Yersinia pestis KIM
ggauguagucccccuccgg

SEQ ID NO: 2295784 - RNA, 15 nt, Yersinia pestis KIM
ggauggucauccaca

SEQ ID NO: 2295785 - RNA, 22 nt, Yersinia pestis KIM
ggauuaaauucuaccuggcuca

SEQ ID NO: 2295786 - RNA, 16 nt, Yersinia pestis KIM
ggcguggcacaccgcu

SEQ ID NO: 2295787 - RNA, 22 nt, Yersinia pestis KIM
ggcuaaaagggaguucaucaaa

SEQ ID NO: 2295788 - RNA, 16 nt, Yersinia pestis KIM
ggcguuuucugcgcca

SEQ ID NO: 2295789 - RNA, 12 nt, Yersinia pestis KIM
ggcguugaugac

SEQ ID NO: 2295790 - RNA, 18 nt, Yersinia pestis KIM
ggcuacugcgcuuaccgu

SEQ ID NO: 2295791 - RNA, 16 nt, Yersinia pestis KIM
ggcuauuuuuaugcag

SEQ ID NO: 2295792 - RNA, 18 nt, Yersinia pestis KIM
ggcucgcccacggcacau

SEQ ID NO: 2295793 - RNA, 17 nt, Yersinia pestis KIM
ggcucuggcaauggcua

SEQ ID NO: 2295794 - RNA, 22 nt, Yersinia pestis KIM
ggcucgugaucagcagacucaa

SEQ ID NO: 2295795 - RNA, 14 nt, Yersinia pestis KIM
ggcugaagacccaa

SEQ ID NO: 2295796 - RNA, 15 nt, Yersinia pestis KIM
ggcugaacccugacg

SEQ ID NO: 2295797 - RNA, 11 nt, Yersinia pestis KIM
ggcugcgacgc

SEQ ID NO: 2295798 - RNA, 17 nt, Yersinia pestis KIM
ggcugcugcagccggga

SEQ ID NO: 2295799 - RNA, 17 nt, Yersinia pestis KIM
ggcugcaauaagccaga

SEQ ID NO: 2295800 - RNA, 21 nt, Yersinia pestis KIM
ggcuggaaaaaauaauggcca

SEQ ID NO: 2295801 - RNA, 19 nt, Yersinia pestis KIM
ggcuuuaacccggcgacga

SEQ ID NO: 2295802 - RNA, 23 nt, Yersinia pestis KIM
ggcgcuguugcauguaacgguca

SEQ ID NO: 2295803 - RNA, 17 nt, Yersinia pestis KIM
ggcgcuuaacugcacga

SEQ ID NO: 2295804 - RNA, 22 nt, Yersinia pestis KIM
ggcgauaguaauuuuuagccgc

SEQ ID NO: 2295805 - RNA, 16 nt, Yersinia pestis KIM
ggcgauuuaauguauu

SEQ ID NO: 2295806 - RNA, 16 nt, Yersinia pestis KIM
ggcgcacucauccucu

SEQ ID NO: 2295807 - RNA, 23 nt, Yersinia pestis KIM
ggucagcgguaucccacuggacg

SEQ ID NO: 2295808 - RNA, 17 nt, Yersinia pestis KIM
ggucauuguagauggcc

SEQ ID NO: 2295809 - RNA, 19 nt, Yersinia pestis KIM
ggugacuuacgucuuuaaa

SEQ ID NO: 2295810 - RNA, 15 nt, Yersinia pestis KIM
ggugagggagucagg

SEQ ID NO: 2295811 - RNA, 16 nt, Yersinia pestis KIM
ggugagugagcgcagg

SEQ ID NO: 2295812 - RNA, 14 nt, Yersinia pestis KIM
ggguaacgccauag

SEQ ID NO: 2295813 - RNA, 22 nt, Yersinia pestis KIM
ggguaacgccauagggacugcc

SEQ ID NO: 2295814 - RNA, 14 nt, Yersinia pestis KIM
ggguaaagcgucag

SEQ ID NO: 2295815 - RNA, 23 nt, Yersinia pestis KIM
ggguauuccauagccaggcagcc

SEQ ID NO: 2295816 - RNA, 20 nt, Yersinia pestis KIM
ggguauauggauuaucgccu

SEQ ID NO: 2295817 - RNA, 21 nt, Yersinia pestis KIM
ggguauauugcccgguaacau

SEQ ID NO: 2295818 - RNA, 23 nt, Yersinia pestis KIM
gguacuccucgccgguaauaccg

SEQ ID NO: 2295819 - RNA, 14 nt, Yersinia pestis KIM
gguacaaaggcaau

SEQ ID NO: 2295820 - RNA, 14 nt, Yersinia pestis KIM
gguuggcagcucag

SEQ ID NO: 2295821 - RNA, 19 nt, Yersinia pestis KIM
gguugccaaagcugcgcca

SEQ ID NO: 2295822 - RNA, 21 nt, Yersinia pestis KIM
gguucuuucauucauuucaac

SEQ ID NO: 2295823 - RNA, 19 nt, Yersinia pestis KIM
gguucccaacggcagaagu

SEQ ID NO: 2295824 - RNA, 17 nt, Yersinia pestis KIM
gguuagauuacagccua

SEQ ID NO: 2295825 - RNA, 23 nt, Yersinia pestis KIM
gguuaaccagaagaacagcccuc

SEQ ID NO: 2295826 - RNA, 14 nt, Yersinia pestis KIM
gguuaaucaguggc

SEQ ID NO: 2295827 - RNA, 12 nt, Yersinia pestis KIM
gguguuggcgau

SEQ ID NO: 2295828 - RNA, 15 nt, Yersinia pestis KIM
ggugcuguauuuaac

SEQ ID NO: 2295829 - RNA, 14 nt, Yersinia pestis KIM
guaaugucaugaau

SEQ ID NO: 2295830 - RNA, 22 nt, Yersinia pestis KIM
guaaugauacugcccgucguua

SEQ ID NO: 2295831 - RNA, 21 nt, Yersinia pestis KIM
guaaugacucuggcagugagg

SEQ ID NO: 2295832 - RNA, 16 nt, Yersinia pestis KIM
guaaacaccggcaaua

SEQ ID NO: 2295833 - RNA, 18 nt, Yersinia pestis KIM
guaaacgguugcuguaau

SEQ ID NO: 2295834 - RNA, 23 nt, Yersinia pestis KIM
guaaacuucggauuaccggcacu

SEQ ID NO: 2295835 - RNA, 22 nt, Yersinia pestis KIM
guacgugacggcggcgagcacu

SEQ ID NO: 2295836 - RNA, 22 nt, Yersinia pestis KIM
guagaucccgugugauuuccau

SEQ ID NO: 2295837 - RNA, 15 nt, Yersinia pestis KIM
guagacauggcaacg

SEQ ID NO: 2295838 - RNA, 13 nt, Yersinia pestis KIM
guacuuggucacu

SEQ ID NO: 2295839 - RNA, 18 nt, Yersinia pestis KIM
gucucgccgacaacuuca

SEQ ID NO: 2295840 - RNA, 15 nt, Yersinia pestis KIM
gucugagccucauga

SEQ ID NO: 2295841 - RNA, 16 nt, Yersinia pestis KIM
gucugaggcccgcuag

SEQ ID NO: 2295842 - RNA, 15 nt, Yersinia pestis KIM
gucuaggauugccgg

SEQ ID NO: 2295843 - RNA, 23 nt, Yersinia pestis KIM
gucuagcgacggagagucagcaa

SEQ ID NO: 2295844 - RNA, 15 nt, Yersinia pestis KIM
gucuguuaauccuaa

SEQ ID NO: 2295845 - RNA, 19 nt, Yersinia pestis KIM
gucuuacuauguccgcaua

SEQ ID NO: 2295846 - RNA, 15 nt, Yersinia pestis KIM
gucuuaaucuuuaau

SEQ ID NO: 2295847 - RNA, 18 nt, Yersinia pestis KIM
gugaccaccgcagcaacc

SEQ ID NO: 2295848 - RNA, 14 nt, Yersinia pestis KIM
gugaaucgccguua

SEQ ID NO: 2295849 - RNA, 18 nt, Yersinia pestis KIM
gucgucucuugcaaugaa

SEQ ID NO: 2295850 - RNA, 19 nt, Yersinia pestis KIM
gucguuauauaaauggcug

SEQ ID NO: 2295851 - RNA, 18 nt, Yersinia pestis KIM
guccgcauauucucgccc

SEQ ID NO: 2295852 - RNA, 20 nt, Yersinia pestis KIM
guccaugucgauugggccac

SEQ ID NO: 2295853 - RNA, 19 nt, Yersinia pestis KIM
gucaucgucggcccggcca

SEQ ID NO: 2295854 - RNA, 19 nt, Yersinia pestis KIM
gucagugcgguaaccagca

SEQ ID NO: 2295855 - RNA, 18 nt, Yersinia pestis KIM
gucauggucucacugcgg

SEQ ID NO: 2295856 - RNA, 21 nt, Yersinia pestis KIM
guauccuuacuuugcgaucaa

SEQ ID NO: 2295857 - RNA, 18 nt, Yersinia pestis KIM
gucagguuaauaccugca

SEQ ID NO: 2295858 - RNA, 19 nt, Yersinia pestis KIM
gucauugguguuacagcaa

SEQ ID NO: 2295859 - RNA, 16 nt, Yersinia pestis KIM
gucauuaauuaagcua

SEQ ID NO: 2295860 - RNA, 16 nt, Yersinia pestis KIM
gucgauggucauuugu

SEQ ID NO: 2295861 - RNA, 22 nt, Yersinia pestis KIM
gcgcuauuccgcgccugggcua

SEQ ID NO: 2295862 - RNA, 24 nt, Yersinia pestis KIM
gcgcgucaucaacguuaaucgcca

SEQ ID NO: 2295863 - RNA, 18 nt, Yersinia pestis KIM
gcgcaggauuucaauaua

SEQ ID NO: 2295864 - RNA, 13 nt, Yersinia pestis KIM
gcgcagccaacgg

SEQ ID NO: 2295865 - RNA, 17 nt, Yersinia pestis KIM
gcgauagagauagccaa

SEQ ID NO: 2295866 - RNA, 21 nt, Yersinia pestis KIM
gcgauaaaaaauaaaguccag

SEQ ID NO: 2295867 - RNA, 15 nt, Yersinia pestis KIM
gcgauagcuucagca

SEQ ID NO: 2295868 - RNA, 18 nt, Yersinia pestis KIM
gcgauauccaccugauca

SEQ ID NO: 2295869 - RNA, 22 nt, Yersinia pestis KIM
gccguaaugacucgauaaccca

SEQ ID NO: 2295870 - RNA, 17 nt, Yersinia pestis KIM
gccguaaauacauccau

SEQ ID NO: 2295871 - RNA, 13 nt, Yersinia pestis KIM
gccggcuacuggu

SEQ ID NO: 2295872 - RNA, 12 nt, Yersinia pestis KIM
gccguggcgaag

SEQ ID NO: 2295873 - RNA, 20 nt, Yersinia pestis KIM
gccuaaaaugaauaacgccg

SEQ ID NO: 2295874 - RNA, 21 nt, Yersinia pestis KIM
gccuaaauaccgcuugccgau

SEQ ID NO: 2295875 - RNA, 15 nt, Yersinia pestis KIM
gccuaacaacugccg

SEQ ID NO: 2295876 - RNA, 16 nt, Yersinia pestis KIM
aagcccccguaucaug

SEQ ID NO: 2295877 - RNA, 18 nt, Yersinia pestis KIM
gcgaccggccgcuugcca

SEQ ID NO: 2295878 - RNA, 17 nt, Yersinia pestis KIM
gcgaggccgcugcaagc

SEQ ID NO: 2295879 - RNA, 14 nt, Yersinia pestis KIM
gccuuauucgccag

SEQ ID NO: 2295880 - RNA, 14 nt, Yersinia pestis KIM
gccugugcauugag

SEQ ID NO: 2295881 - RNA, 17 nt, Yersinia pestis KIM
gccuuuucuuccgccag

SEQ ID NO: 2295882 - RNA, 14 nt, Yersinia pestis KIM
gccuuucugggcug

SEQ ID NO: 2295883 - RNA, 21 nt, Yersinia pestis KIM
gccuuucugggcugcauagcg

SEQ ID NO: 2295884 - RNA, 19 nt, Yersinia pestis KIM
gccuuucagcgcugcgccc

SEQ ID NO: 2295885 - RNA, 22 nt, Yersinia pestis KIM
gccuuucggcaauauaaagcca

SEQ ID NO: 2295886 - RNA, 24 nt, Yersinia pestis KIM
gcgaaggugugcucacaaucuucu

SEQ ID NO: 2295887 - RNA, 16 nt, Yersinia pestis KIM
gcgaaccgaguguaau

SEQ ID NO: 2295888 - RNA, 19 nt, Yersinia pestis KIM
gcguuaucuuuuauuuaug

SEQ ID NO: 2295889 - RNA, 21 nt, Yersinia pestis KIM
gcgugauauccccaccguggc

SEQ ID NO: 2295890 - RNA, 14 nt, Yersinia pestis KIM
gcgucuucugugau

SEQ ID NO: 2295891 - RNA, 18 nt, Yersinia pestis KIM
gcgguugccaagcuacgg

SEQ ID NO: 2295892 - RNA, 21 nt, Yersinia pestis KIM
gcguacaucagggugaccgca

SEQ ID NO: 2295893 - RNA, 16 nt, Yersinia pestis KIM
aagcguccgcgccaag

SEQ ID NO: 2295894 - RNA, 17 nt, Yersinia pestis KIM
aagcgguuaucaccuuc

SEQ ID NO: 2295895 - RNA, 21 nt, Yersinia pestis KIM
aagcuaauagaucagccaaau

SEQ ID NO: 2295896 - RNA, 21 nt, Yersinia pestis KIM
aagcuacggccuguaccacca

SEQ ID NO: 2295897 - RNA, 19 nt, Yersinia pestis KIM
aagcgggcuuuaauagcca

SEQ ID NO: 2295898 - RNA, 21 nt, Yersinia pestis KIM
gcggccauguuggucaagcgg

SEQ ID NO: 2295899 - RNA, 20 nt, Yersinia pestis KIM
aagcgcguuagccuacuggc

SEQ ID NO: 2295900 - RNA, 21 nt, Yersinia pestis KIM
gcggcauaaauucuagcaaca

SEQ ID NO: 2295901 - RNA, 19 nt, Yersinia pestis KIM
aagcgaugcucaauacuaa

SEQ ID NO: 2295902 - RNA, 23 nt, Yersinia pestis KIM
aagcgccguaaaaagcagcaaac

SEQ ID NO: 2295903 - RNA, 14 nt, Yersinia pestis KIM
aagcgccuuuuauu

SEQ ID NO: 2295904 - RNA, 13 nt, Yersinia pestis KIM
gcucaucacggcg

SEQ ID NO: 2295905 - RNA, 17 nt, Yersinia pestis KIM
gcucagauacaucaaug

SEQ ID NO: 2295906 - RNA, 15 nt, Yersinia pestis KIM
gcugcaauaagccag

SEQ ID NO: 2295907 - RNA, 15 nt, Yersinia pestis KIM
gcugcaugugcguug

SEQ ID NO: 2295908 - RNA, 17 nt, Yersinia pestis KIM
gcucguuggccggaugc

SEQ ID NO: 2295909 - RNA, 12 nt, Yersinia pestis KIM
gcucggcuuuac

SEQ ID NO: 2295910 - RNA, 16 nt, Yersinia pestis KIM
gcugaaaucgaucaua

SEQ ID NO: 2295911 - RNA, 21 nt, Yersinia pestis KIM
gcugacaaaguuaaaugaagg

SEQ ID NO: 2295912 - RNA, 22 nt, Yersinia pestis KIM
gcugagugaagacaucgccaga

SEQ ID NO: 2295913 - RNA, 15 nt, Yersinia pestis KIM
gcugauaugaaaaau

SEQ ID NO: 2295914 - RNA, 17 nt, Yersinia pestis KIM
gcugaguaaagcccagc

SEQ ID NO: 2295915 - RNA, 22 nt, Yersinia pestis KIM
gcuuaucccuccaucaagccac

SEQ ID NO: 2295916 - RNA, 20 nt, Yersinia pestis KIM
gcuuauccccugagaaacau

SEQ ID NO: 2295917 - RNA, 18 nt, Yersinia pestis KIM
gcuucaaaaucaccuggc

SEQ ID NO: 2295918 - RNA, 21 nt, Yersinia pestis KIM
gcuuauugugccccaacauug

SEQ ID NO: 2295919 - RNA, 13 nt, Yersinia pestis KIM
gcuguuacccaug

SEQ ID NO: 2295920 - RNA, 16 nt, Yersinia pestis KIM
gcuuaacugcacgacg

SEQ ID NO: 2295921 - RNA, 18 nt, Yersinia pestis KIM
gcuuaaucuuuuuaacca

SEQ ID NO: 2295922 - RNA, 13 nt, Yersinia pestis KIM
gcuuaaucgccag

SEQ ID NO: 2295923 - RNA, 18 nt, Yersinia pestis KIM
gcuuaacucgccacucac

SEQ ID NO: 2295924 - RNA, 17 nt, Yersinia pestis KIM
gcuguaggugucaccaa

SEQ ID NO: 2295925 - RNA, 16 nt, Yersinia pestis KIM
gcuuccaucaggaagu

SEQ ID NO: 2295926 - RNA, 16 nt, Yersinia pestis KIM
gcuuccaauauugagc

SEQ ID NO: 2295927 - RNA, 23 nt, Yersinia pestis KIM
gcuugaucacaaucgcauugacg

SEQ ID NO: 2295928 - RNA, 13 nt, Yersinia pestis KIM
ggaaaaaucagua

SEQ ID NO: 2295929 - RNA, 13 nt, Yersinia pestis KIM
gcuuucgaucauc

SEQ ID NO: 2295930 - RNA, 15 nt, Yersinia pestis KIM
gcuugcggaucagcg

SEQ ID NO: 2295931 - RNA, 14 nt, Yersinia pestis KIM
gcuuucaucgauug

SEQ ID NO: 2295932 - RNA, 15 nt, Yersinia pestis KIM
gcuuuaucguagcca

SEQ ID NO: 2295933 - RNA, 14 nt, Yersinia pestis KIM
gcuugugcgccaac

SEQ ID NO: 2295934 - RNA, 21 nt, Yersinia pestis KIM
gccgcuauuggcgagcaugac

SEQ ID NO: 2295935 - RNA, 19 nt, Yersinia pestis KIM
gccgccgauaacauuauug

SEQ ID NO: 2295936 - RNA, 12 nt, Yersinia pestis KIM
gcccgcuaucac

SEQ ID NO: 2295937 - RNA, 15 nt, Yersinia pestis KIM
gcccugcaucuugaa

SEQ ID NO: 2295938 - RNA, 17 nt, Yersinia pestis KIM
gcccuguaaagccagua

SEQ ID NO: 2295939 - RNA, 18 nt, Yersinia pestis KIM
gcccuuuuugguuuucua

SEQ ID NO: 2295940 - RNA, 15 nt, Yersinia pestis KIM
gcccuugaccucauu

SEQ ID NO: 2295941 - RNA, 13 nt, Yersinia pestis KIM
aagauagccggau

SEQ ID NO: 2295942 - RNA, 19 nt, Yersinia pestis KIM
aagcacgaucagcucuggc

SEQ ID NO: 2295943 - RNA, 20 nt, Yersinia pestis KIM
aagcaaccuuguuuuaucgc

SEQ ID NO: 2295944 - RNA, 22 nt, Yersinia pestis KIM
aagauuuuuagcgugccgcagu

SEQ ID NO: 2295945 - RNA, 15 nt, Yersinia pestis KIM
gcccagaaacauugc

SEQ ID NO: 2295946 - RNA, 20 nt, Yersinia pestis KIM
gcccacauaaagauagccac

SEQ ID NO: 2295947 - RNA, 23 nt, Yersinia pestis KIM
gcccaacgucauuuccguuaacc

SEQ ID NO: 2295948 - RNA, 15 nt, Yersinia pestis KIM
gcccaagccauccuu

SEQ ID NO: 2295949 - RNA, 14 nt, Yersinia pestis KIM
gcccaagccauccu

SEQ ID NO: 2295950 - RNA, 17 nt, Yersinia pestis KIM
gcccacaccaaucagcu

SEQ ID NO: 2295951 - RNA, 13 nt, Yersinia pestis KIM
gcccaaugucagg

SEQ ID NO: 2295952 - RNA, 22 nt, Yersinia pestis KIM
gccauugccgaaccugcauguu

SEQ ID NO: 2295953 - RNA, 22 nt, Yersinia pestis KIM
gccauuuauugcggcuuagcca

SEQ ID NO: 2295954 - RNA, 16 nt, Yersinia pestis KIM
gcccgccccaauagau

SEQ ID NO: 2295955 - RNA, 16 nt, Yersinia pestis KIM
gcccgccggguaaaug

SEQ ID NO: 2295956 - RNA, 19 nt, Yersinia pestis KIM
gcccgccagguauuacagg

SEQ ID NO: 2295957 - RNA, 19 nt, Yersinia pestis KIM
gcccauauagcggcguuca

SEQ ID NO: 2295958 - RNA, 20 nt, Yersinia pestis KIM
gcccauaaacccgauuccau

SEQ ID NO: 2295959 - RNA, 12 nt, Yersinia pestis KIM
gcccaucagcau

SEQ ID NO: 2295960 - RNA, 14 nt, Yersinia pestis KIM
aagagagccauaau

SEQ ID NO: 2295961 - RNA, 22 nt, Yersinia pestis KIM
gcccccuagugaugggggcaau

SEQ ID NO: 2295962 - RNA, 21 nt, Yersinia pestis KIM
gccagauucgcaaagcgggcc

SEQ ID NO: 2295963 - RNA, 20 nt, Yersinia pestis KIM
gccagauucgcaaagcgggc

SEQ ID NO: 2295964 - RNA, 15 nt, Yersinia pestis KIM
gccacuucgcuacgc

SEQ ID NO: 2295965 - RNA, 17 nt, Yersinia pestis KIM
gccagcaccgguauccc

SEQ ID NO: 2295966 - RNA, 23 nt, Yersinia pestis KIM
gccagcauucaggcuuuuuucua

SEQ ID NO: 2295967 - RNA, 18 nt, Yersinia pestis KIM
gccaguaaacagccagca

SEQ ID NO: 2295968 - RNA, 14 nt, Yersinia pestis KIM
gccaguaaacgcag

SEQ ID NO: 2295969 - RNA, 21 nt, Yersinia pestis KIM
gccagggcguuuaccauccag

SEQ ID NO: 2295970 - RNA, 14 nt, Yersinia pestis KIM
gccacuagccauua

SEQ ID NO: 2295971 - RNA, 16 nt, Yersinia pestis KIM
gccaaugcugcuguca

SEQ ID NO: 2295972 - RNA, 15 nt, Yersinia pestis KIM
gccaagguucgaaaa

SEQ ID NO: 2295973 - RNA, 21 nt, Yersinia pestis KIM
gccaauuucaguaaucguuua

SEQ ID NO: 2295974 - RNA, 16 nt, Yersinia pestis KIM
gcagucugagggccac

SEQ ID NO: 2295975 - RNA, 21 nt, Yersinia pestis KIM
gcagugaaaagguuaacugca

SEQ ID NO: 2295976 - RNA, 15 nt, Yersinia pestis KIM
gaugcgacaauuucc

SEQ ID NO: 2295977 - RNA, 20 nt, Yersinia pestis KIM
gaugccaaucaaaaaaccgg

SEQ ID NO: 2295978 - RNA, 16 nt, Yersinia pestis KIM
gaugccaucaauacca

SEQ ID NO: 2295979 - RNA, 18 nt, Yersinia pestis KIM
aacuuacaggcugccugc

SEQ ID NO: 2295980 - RNA, 21 nt, Yersinia pestis KIM
aacuguggcaugacugaugcg

SEQ ID NO: 2295981 - RNA, 11 nt, Yersinia pestis KIM
gaugaucaugc

SEQ ID NO: 2295982 - RNA, 16 nt, Yersinia pestis KIM
gaugauugcaucauca

SEQ ID NO: 2295983 - RNA, 21 nt, Yersinia pestis KIM
gaugauuguuuuauggcgaug

SEQ ID NO: 2295984 - RNA, 22 nt, Yersinia pestis KIM
gaucucuuuauauucaauauca

SEQ ID NO: 2295985 - RNA, 20 nt, Yersinia pestis KIM
gaucugcacaccacacugga

SEQ ID NO: 2295986 - RNA, 21 nt, Yersinia pestis KIM
aacugcucaacugcucaacug

SEQ ID NO: 2295987 - RNA, 18 nt, Yersinia pestis KIM
aacugcucacuggaguua

SEQ ID NO: 2295988 - RNA, 15 nt, Yersinia pestis KIM
aacuuccuuugcccu

SEQ ID NO: 2295989 - RNA, 17 nt, Yersinia pestis KIM
aacuucgcacgcccauc

SEQ ID NO: 2295990 - RNA, 19 nt, Yersinia pestis KIM
aacuucaguuacucacuug

SEQ ID NO: 2295991 - RNA, 18 nt, Yersinia pestis KIM
gaugcugcacaucaacgg

SEQ ID NO: 2295992 - RNA, 13 nt, Yersinia pestis KIM
gaugcugaggaua

SEQ ID NO: 2295993 - RNA, 21 nt, Yersinia pestis KIM
gauugcagaccaaucaauaca

SEQ ID NO: 2295994 - RNA, 19 nt, Yersinia pestis KIM
gauucggauaaccgcauuc

SEQ ID NO: 2295995 - RNA, 14 nt, Yersinia pestis KIM
gauguuaacuggcu

SEQ ID NO: 2295996 - RNA, 19 nt, Yersinia pestis KIM
gauuaauaucaaaacugau

SEQ ID NO: 2295997 - RNA, 21 nt, Yersinia pestis KIM
gauuaacccuuucgaguuuau

SEQ ID NO: 2295998 - RNA, 18 nt, Yersinia pestis KIM
gauuaaauucuaccuggc

SEQ ID NO: 2295999 - RNA, 20 nt, Yersinia pestis KIM
gcaaaguuauugaccaauau

SEQ ID NO: 2296000 - RNA, 19 nt, Yersinia pestis KIM
gcaacagcgcucauagcaa

SEQ ID NO: 2296001 - RNA, 16 nt, Yersinia pestis KIM
gauuuauuucucugau

SEQ ID NO: 2296002 - RNA, 17 nt, Yersinia pestis KIM
gauuucagacugcugac

SEQ ID NO: 2296003 - RNA, 20 nt, Yersinia pestis KIM
gauuucagacugcugacaac

SEQ ID NO: 2296004 - RNA, 19 nt, Yersinia pestis KIM
gauuuugauugcugacaaa

SEQ ID NO: 2296005 - RNA, 13 nt, Yersinia pestis KIM
aacucguuaucuu

SEQ ID NO: 2296006 - RNA, 20 nt, Yersinia pestis KIM
aacugaauacuuugcggcuc

SEQ ID NO: 2296007 - RNA, 16 nt, Yersinia pestis KIM
aacugaaaaguuucag

SEQ ID NO: 2296008 - RNA, 13 nt, Yersinia pestis KIM
aacugaucaauau

SEQ ID NO: 2296009 - RNA, 15 nt, Yersinia pestis KIM
aacugacugaaguua

SEQ ID NO: 2296010 - RNA, 22 nt, Yersinia pestis KIM
aacugaccgaugucaucaccgu

SEQ ID NO: 2296011 - RNA, 20 nt, Yersinia pestis KIM
gagguuuuucauaugcgccu

SEQ ID NO: 2296012 - RNA, 12 nt, Yersinia pestis KIM
gagguugaugag

SEQ ID NO: 2296013 - RNA, 17 nt, Yersinia pestis KIM
gagguagacguaucaug

SEQ ID NO: 2296014 - RNA, 23 nt, Yersinia pestis KIM
gagcucucacugcuccagccaac

SEQ ID NO: 2296015 - RNA, 20 nt, Yersinia pestis KIM
gauccucaucacugccguca

SEQ ID NO: 2296016 - RNA, 14 nt, Yersinia pestis KIM
gaucaguucaguau

SEQ ID NO: 2296017 - RNA, 19 nt, Yersinia pestis KIM
gaucaucaagccaauggcc

SEQ ID NO: 2296018 - RNA, 17 nt, Yersinia pestis KIM
gauacguugcaggucaa

SEQ ID NO: 2296019 - RNA, 15 nt, Yersinia pestis KIM
gauacaucucggcuu

SEQ ID NO: 2296020 - RNA, 22 nt, Yersinia pestis KIM
gagucgcaaaacuucacuuucu

SEQ ID NO: 2296021 - RNA, 17 nt, Yersinia pestis KIM
gaucaccagcaaaggcc

SEQ ID NO: 2296022 - RNA, 16 nt, Yersinia pestis KIM
gaucaaucucaucaau

SEQ ID NO: 2296023 - RNA, 19 nt, Yersinia pestis KIM
gaucacaaccccaccucuu

SEQ ID NO: 2296024 - RNA, 22 nt, Yersinia pestis KIM
gaucaauaaacgcuuuugcugc

SEQ ID NO: 2296025 - RNA, 18 nt, Yersinia pestis KIM
gaucaaacggauaaucgc

SEQ ID NO: 2296026 - RNA, 20 nt, Yersinia pestis KIM
gaucaaacauaaccugcaac

SEQ ID NO: 2296027 - RNA, 16 nt, Yersinia pestis KIM
gauauuguuggcgaua

SEQ ID NO: 2296028 - RNA, 20 nt, Yersinia pestis KIM
gauauugagaaucagugguc

SEQ ID NO: 2296029 - RNA, 13 nt, Yersinia pestis KIM
gauauuaacuggu

SEQ ID NO: 2296030 - RNA, 22 nt, Yersinia pestis KIM
gauaguuaccauggcaggucuc

SEQ ID NO: 2296031 - RNA, 23 nt, Yersinia pestis KIM
gcagggaauggauuaucggcggc

SEQ ID NO: 2296032 - RNA, 13 nt, Yersinia pestis KIM
gcagggaaccugg

SEQ ID NO: 2296033 - RNA, 18 nt, Yersinia pestis KIM
gcaggcggcgauacaacg

SEQ ID NO: 2296034 - RNA, 14 nt, Yersinia pestis KIM
gcaguaacgccaua

SEQ ID NO: 2296035 - RNA, 16 nt, Yersinia pestis KIM
aagaaacugccagcua

SEQ ID NO: 2296036 - RNA, 19 nt, Yersinia pestis KIM
gcagcccccuuauggcaca

SEQ ID NO: 2296037 - RNA, 21 nt, Yersinia pestis KIM
gcagcgcuggugcuggugaau

SEQ ID NO: 2296038 - RNA, 19 nt, Yersinia pestis KIM
gcagcucaaaaucuucggc

SEQ ID NO: 2296039 - RNA, 11 nt, Yersinia pestis KIM
gcacaucaaua

SEQ ID NO: 2296040 - RNA, 22 nt, Yersinia pestis KIM
gcaccaaucauuacaucaucuu

SEQ ID NO: 2296041 - RNA, 13 nt, Yersinia pestis KIM
gcaccacggucag

SEQ ID NO: 2296042 - RNA, 19 nt, Yersinia pestis KIM
gcaauucggccauauacgc

SEQ ID NO: 2296043 - RNA, 14 nt, Yersinia pestis KIM
gcaauucgcuuaug

SEQ ID NO: 2296044 - RNA, 13 nt, Yersinia pestis KIM
gcacccaauggca

SEQ ID NO: 2296045 - RNA, 16 nt, Yersinia pestis KIM
gcacccaauggcaaca

SEQ ID NO: 2296046 - RNA, 18 nt, Yersinia pestis KIM
aacuuuucuucauugcug

SEQ ID NO: 2296047 - RNA, 23 nt, Yersinia pestis KIM
aacuuugcuuugacuaauacugc

SEQ ID NO: 2296048 - RNA, 15 nt, Yersinia pestis KIM
gcagcacaccggcca

SEQ ID NO: 2296049 - RNA, 13 nt, Yersinia pestis KIM
gcagaaccuuguu

SEQ ID NO: 2296050 - RNA, 21 nt, Yersinia pestis KIM
gcacuuggccccaucaucucu

SEQ ID NO: 2296051 - RNA, 19 nt, Yersinia pestis KIM
gcacuuguuuugccaguuu

SEQ ID NO: 2296052 - RNA, 13 nt, Yersinia pestis KIM
gcacuucaccugg

SEQ ID NO: 2296053 - RNA, 16 nt, Yersinia pestis KIM
gcacugagucgucugu

SEQ ID NO: 2296054 - RNA, 14 nt, Yersinia pestis KIM
gcacucuguaacug

SEQ ID NO: 2296055 - RNA, 19 nt, Yersinia pestis KIM
gcacgguaguucaaguucu

SEQ ID NO: 2296056 - RNA, 19 nt, Yersinia pestis KIM
gcacgauccgcccauugcg

SEQ ID NO: 2296057 - RNA, 18 nt, Yersinia pestis KIM
cgucauggucucacugcg

SEQ ID NO: 2296058 - RNA, 22 nt, Yersinia pestis KIM
cguccaggcuuucacggugcgu

SEQ ID NO: 2296059 - RNA, 20 nt, Yersinia pestis KIM
cgguuauaaaacagccacga

SEQ ID NO: 2296060 - RNA, 17 nt, Yersinia pestis KIM
cgguuauucguggugau

SEQ ID NO: 2296061 - RNA, 14 nt, Yersinia pestis KIM
cgguuacaccaaua

SEQ ID NO: 2296062 - RNA, 18 nt, Yersinia pestis KIM
cgguuaccguauccacuu

SEQ ID NO: 2296063 - RNA, 23 nt, Yersinia pestis KIM
cgguuuccugcggggaucgggcu

SEQ ID NO: 2296064 - RNA, 16 nt, Yersinia pestis KIM
cgguuugggcaucaac

SEQ ID NO: 2296065 - RNA, 22 nt, Yersinia pestis KIM
cgguuugaaccgccugaggccu

SEQ ID NO: 2296066 - RNA, 22 nt, Yersinia pestis KIM
cgguucgucaugaugcucaccg

SEQ ID NO: 2296067 - RNA, 18 nt, Yersinia pestis KIM
cguacuggcgcgcuuugg

SEQ ID NO: 2296068 - RNA, 18 nt, Yersinia pestis KIM
cguaauucccaccacuug

SEQ ID NO: 2296069 - RNA, 13 nt, Yersinia pestis KIM
cguaacuguugca

SEQ ID NO: 2296070 - RNA, 14 nt, Yersinia pestis KIM
cguauccgcuuuga

SEQ ID NO: 2296071 - RNA, 14 nt, Yersinia pestis KIM
cguaucguccugcu

SEQ ID NO: 2296072 - RNA, 21 nt, Yersinia pestis KIM
aacccgcugcguacggacggu

SEQ ID NO: 2296073 - RNA, 13 nt, Yersinia pestis KIM
aacccgcugaugc

SEQ ID NO: 2296074 - RNA, 20 nt, Yersinia pestis KIM
aacccccgcgaacagcagaa

SEQ ID NO: 2296075 - RNA, 14 nt, Yersinia pestis KIM
aacccaucaagcgg

SEQ ID NO: 2296076 - RNA, 22 nt, Yersinia pestis KIM
cgugccaaaaugccuaccguua

SEQ ID NO: 2296077 - RNA, 17 nt, Yersinia pestis KIM
cgugcauaaaacgauuu

SEQ ID NO: 2296078 - RNA, 18 nt, Yersinia pestis KIM
cgugagcaaucuggcggc

SEQ ID NO: 2296079 - RNA, 16 nt, Yersinia pestis KIM
cgugagcagcaccggu

SEQ ID NO: 2296080 - RNA, 13 nt, Yersinia pestis KIM
cgucuugaucaac

SEQ ID NO: 2296081 - RNA, 21 nt, Yersinia pestis KIM
aacccugcguaaauuacguuc

SEQ ID NO: 2296082 - RNA, 22 nt, Yersinia pestis KIM
aacccuuucgaguuuauauugc

SEQ ID NO: 2296083 - RNA, 15 nt, Yersinia pestis KIM
cgugacauacuuugc

SEQ ID NO: 2296084 - RNA, 19 nt, Yersinia pestis KIM
cgucguuauuuaccguaac

SEQ ID NO: 2296085 - RNA, 12 nt, Yersinia pestis KIM
cguucccuguau

SEQ ID NO: 2296086 - RNA, 21 nt, Yersinia pestis KIM
cguucguagccacgaucgaug

SEQ ID NO: 2296087 - RNA, 17 nt, Yersinia pestis KIM
cguugcccugagaauca

SEQ ID NO: 2296088 - RNA, 18 nt, Yersinia pestis KIM
cguugccccaucagcacu

SEQ ID NO: 2296089 - RNA, 21 nt, Yersinia pestis KIM
cguggugggcgguaguauuug

SEQ ID NO: 2296090 - RNA, 16 nt, Yersinia pestis KIM
cguuacacaucaggcu

SEQ ID NO: 2296091 - RNA, 13 nt, Yersinia pestis KIM
cguuacagcaagg

SEQ ID NO: 2296092 - RNA, 16 nt, Yersinia pestis KIM
cguucaacaguaucaa

SEQ ID NO: 2296093 - RNA, 20 nt, Yersinia pestis KIM
cguucaaccuuuuccgccau

SEQ ID NO: 2296094 - RNA, 16 nt, Yersinia pestis KIM
cgugcugcuuccugcu

SEQ ID NO: 2296095 - RNA, 23 nt, Yersinia pestis KIM
aaccgcccgacuugcugaaucaa

SEQ ID NO: 2296096 - RNA, 19 nt, Yersinia pestis KIM
aaccgcccucuugaacggu

SEQ ID NO: 2296097 - RNA, 21 nt, Yersinia pestis KIM
cguggcgcgccacuucuuuca

SEQ ID NO: 2296098 - RNA, 21 nt, Yersinia pestis KIM
cuaucaccccguuacggcugg

SEQ ID NO: 2296099 - RNA, 24 nt, Yersinia pestis KIM
cuaucgaguugauauaccgauuac

SEQ ID NO: 2296100 - RNA, 14 nt, Yersinia pestis KIM
cuaucucagugagg

SEQ ID NO: 2296101 - RNA, 21 nt, Yersinia pestis KIM
cuauuaauauaccaacucuga

SEQ ID NO: 2296102 - RNA, 18 nt, Yersinia pestis KIM
cucaacugcucaacugcu

SEQ ID NO: 2296103 - RNA, 11 nt, Yersinia pestis KIM
cucaacggcac

SEQ ID NO: 2296104 - RNA, 21 nt, Yersinia pestis KIM
cuauuuuuauuucuccuuacu

SEQ ID NO: 2296105 - RNA, 19 nt, Yersinia pestis KIM
cucaacaguacugccaacc

SEQ ID NO: 2296106 - RNA, 22 nt, Yersinia pestis KIM
cucaaagaccacaucaaccuga

SEQ ID NO: 2296107 - RNA, 16 nt, Yersinia pestis KIM
cuauugugucaauacc

SEQ ID NO: 2296108 - RNA, 14 nt, Yersinia pestis KIM
cuauuuauuaaucu

SEQ ID NO: 2296109 - RNA, 15 nt, Yersinia pestis KIM
cuccaguugccagca

SEQ ID NO: 2296110 - RNA, 20 nt, Yersinia pestis KIM
cuccaguaaaucuacuuuau

SEQ ID NO: 2296111 - RNA, 19 nt, Yersinia pestis KIM
cucauugagcauaucaauc

SEQ ID NO: 2296112 - RNA, 21 nt, Yersinia pestis KIM
cucacccugcgugguauaccc

SEQ ID NO: 2296113 - RNA, 19 nt, Yersinia pestis KIM
cucaccgcccccaauaagg

SEQ ID NO: 2296114 - RNA, 16 nt, Yersinia pestis KIM
cucaccgccgaguucg

SEQ ID NO: 2296115 - RNA, 18 nt, Yersinia pestis KIM
cucaccguauacgcugaa

SEQ ID NO: 2296116 - RNA, 14 nt, Yersinia pestis KIM
cucaccacugaguu

SEQ ID NO: 2296117 - RNA, 19 nt, Yersinia pestis KIM
cucacucaccgccagcaau

SEQ ID NO: 2296118 - RNA, 14 nt, Yersinia pestis KIM
cucacucagcgacu

SEQ ID NO: 2296119 - RNA, 23 nt, Yersinia pestis KIM
cucacugucuuugacaucuaucg

SEQ ID NO: 2296120 - RNA, 19 nt, Yersinia pestis KIM
cugaugcgguagugaugca

SEQ ID NO: 2296121 - RNA, 15 nt, Yersinia pestis KIM
cugcaacgcggaaua

SEQ ID NO: 2296122 - RNA, 21 nt, Yersinia pestis KIM
cugcaccccaaauguuggaua

SEQ ID NO: 2296123 - RNA, 23 nt, Yersinia pestis KIM
cugcaauaagccagauaucacuc

SEQ ID NO: 2296124 - RNA, 16 nt, Yersinia pestis KIM
cugcaauucggcuaau

SEQ ID NO: 2296125 - RNA, 21 nt, Yersinia pestis KIM
cugcacggaucacgcuguuca

SEQ ID NO: 2296126 - RNA, 19 nt, Yersinia pestis KIM
cugccagaaucgccugcac

SEQ ID NO: 2296127 - RNA, 16 nt, Yersinia pestis KIM
cugccagaaucagccc

SEQ ID NO: 2296128 - RNA, 23 nt, Yersinia pestis KIM
cugcccagcggccaugacgguca

SEQ ID NO: 2296129 - RNA, 20 nt, Yersinia pestis KIM
cugccccgaagcucaagcug

SEQ ID NO: 2296130 - RNA, 22 nt, Yersinia pestis KIM
cugcaucacguauuagcgguga

SEQ ID NO: 2296131 - RNA, 21 nt, Yersinia pestis KIM
cugccacagacuuucuuuaau

SEQ ID NO: 2296132 - RNA, 15 nt, Yersinia pestis KIM
cugcaguagagcggu

SEQ ID NO: 2296133 - RNA, 14 nt, Yersinia pestis KIM
cugaccuauugaua

SEQ ID NO: 2296134 - RNA, 15 nt, Yersinia pestis KIM
cugaccgcagccuuc

SEQ ID NO: 2296135 - RNA, 13 nt, Yersinia pestis KIM
cugacgucagauc

SEQ ID NO: 2296136 - RNA, 13 nt, Yersinia pestis KIM
cugacugcuggca

SEQ ID NO: 2296137 - RNA, 21 nt, Yersinia pestis KIM
cugacuaacucuucuggcaaa

SEQ ID NO: 2296138 - RNA, 15 nt, Yersinia pestis KIM
cugaggcguggcaca

SEQ ID NO: 2296139 - RNA, 18 nt, Yersinia pestis KIM
cugaggccuuauucgcca

SEQ ID NO: 2296140 - RNA, 20 nt, Yersinia pestis KIM
cugagcuuauagaacggcag

SEQ ID NO: 2296141 - RNA, 15 nt, Yersinia pestis KIM
cugagcgaacugaau

SEQ ID NO: 2296142 - RNA, 20 nt, Yersinia pestis KIM
cugagugaagacaucgccag

SEQ ID NO: 2296143 - RNA, 19 nt, Yersinia pestis KIM
cugagggugauaucgucag

SEQ ID NO: 2296144 - RNA, 16 nt, Yersinia pestis KIM
cugauagcagaaaccc

SEQ ID NO: 2296145 - RNA, 22 nt, Yersinia pestis KIM
cugauagcgcacugucugagca

SEQ ID NO: 2296146 - RNA, 16 nt, Yersinia pestis KIM
cugaagccagcaccgg

SEQ ID NO: 2296147 - RNA, 13 nt, Yersinia pestis KIM
cugaagccagcac

SEQ ID NO: 2296148 - RNA, 21 nt, Yersinia pestis KIM
cugaaggguauugaagauacc

SEQ ID NO: 2296149 - RNA, 18 nt, Yersinia pestis KIM
cugaacguauauuggccu

SEQ ID NO: 2296150 - RNA, 21 nt, Yersinia pestis KIM
cugaaucgcugccauaugcau

SEQ ID NO: 2296151 - RNA, 19 nt, Yersinia pestis KIM
cugaauggaucacaucaca

SEQ ID NO: 2296152 - RNA, 15 nt, Yersinia pestis KIM
cugaauuggaagagc

SEQ ID NO: 2296153 - RNA, 20 nt, Yersinia pestis KIM
cugaauugcuuauccagccg

SEQ ID NO: 2296154 - RNA, 15 nt, Yersinia pestis KIM
cugacaccggauaug

SEQ ID NO: 2296155 - RNA, 22 nt, Yersinia pestis KIM
cucugccccuaagaaucggcca

SEQ ID NO: 2296156 - RNA, 18 nt, Yersinia pestis KIM
cucucaucugaacuauug

SEQ ID NO: 2296157 - RNA, 19 nt, Yersinia pestis KIM
cugaaaaaggcaccagcgc

SEQ ID NO: 2296158 - RNA, 16 nt, Yersinia pestis KIM
cucuggcaauggcuag

SEQ ID NO: 2296159 - RNA, 14 nt, Yersinia pestis KIM
cucuguauuuucaa

SEQ ID NO: 2296160 - RNA, 22 nt, Yersinia pestis KIM
cucuguagagaaauucauaccu

SEQ ID NO: 2296161 - RNA, 23 nt, Yersinia pestis KIM
cucuucaccaaaggaagccgagc

SEQ ID NO: 2296162 - RNA, 13 nt, Yersinia pestis KIM
cucuucaucaguc

SEQ ID NO: 2296163 - RNA, 23 nt, Yersinia pestis KIM
gacgcuguauacggacaaugcca

SEQ ID NO: 2296164 - RNA, 16 nt, Yersinia pestis KIM
gacgcgaucugaaacg

SEQ ID NO: 2296165 - RNA, 16 nt, Yersinia pestis KIM
gacggucagccaacga

SEQ ID NO: 2296166 - RNA, 18 nt, Yersinia pestis KIM
aacgucuuaugccauaac

SEQ ID NO: 2296167 - RNA, 16 nt, Yersinia pestis KIM
aacguccaacugacgc

SEQ ID NO: 2296168 - RNA, 15 nt, Yersinia pestis KIM
gaccuuaauaccgug

SEQ ID NO: 2296169 - RNA, 18 nt, Yersinia pestis KIM
gaccuucaucucugacac

SEQ ID NO: 2296170 - RNA, 15 nt, Yersinia pestis KIM
gacgaaugagcagua

SEQ ID NO: 2296171 - RNA, 18 nt, Yersinia pestis KIM
aacggcaguuaacgacgc

SEQ ID NO: 2296172 - RNA, 20 nt, Yersinia pestis KIM
aacggcaucugccaccgcuc

SEQ ID NO: 2296173 - RNA, 16 nt, Yersinia pestis KIM
aacggcaguuaacgac

SEQ ID NO: 2296174 - RNA, 21 nt, Yersinia pestis KIM
aacguauugguaacgcagaaa

SEQ ID NO: 2296175 - RNA, 15 nt, Yersinia pestis KIM
gacaaugaucgucaa

SEQ ID NO: 2296176 - RNA, 12 nt, Yersinia pestis KIM
gacaacgcuauu

SEQ ID NO: 2296177 - RNA, 18 nt, Yersinia pestis KIM
gaauuuuucccugcugau

SEQ ID NO: 2296178 - RNA, 14 nt, Yersinia pestis KIM
gacaaaauacgguu

SEQ ID NO: 2296179 - RNA, 15 nt, Yersinia pestis KIM
gaauggaucacauca

SEQ ID NO: 2296180 - RNA, 20 nt, Yersinia pestis KIM
gaauaaaaaagcccggucac

SEQ ID NO: 2296181 - RNA, 17 nt, Yersinia pestis KIM
gaauaaauauccuccgg

SEQ ID NO: 2296182 - RNA, 15 nt, Yersinia pestis KIM
gaaguucucaucaaa

SEQ ID NO: 2296183 - RNA, 21 nt, Yersinia pestis KIM
gaauaaugguauuugaaauau

SEQ ID NO: 2296184 - RNA, 12 nt, Yersinia pestis KIM
gacaaugcguua

SEQ ID NO: 2296185 - RNA, 22 nt, Yersinia pestis KIM
gacauauuguccaacaucuccg

SEQ ID NO: 2296186 - RNA, 17 nt, Yersinia pestis KIM
aacgaccaguaagugau

SEQ ID NO: 2296187 - RNA, 17 nt, Yersinia pestis KIM
aacgacauuucguuuaa

SEQ ID NO: 2296188 - RNA, 17 nt, Yersinia pestis KIM
gacauaagaugaccacc

SEQ ID NO: 2296189 - RNA, 21 nt, Yersinia pestis KIM
gacauaaacacgcaaucagau

SEQ ID NO: 2296190 - RNA, 17 nt, Yersinia pestis KIM
gacccaauauucgccag

SEQ ID NO: 2296191 - RNA, 18 nt, Yersinia pestis KIM
aacgcguaccugcuuauu

SEQ ID NO: 2296192 - RNA, 23 nt, Yersinia pestis KIM
aacggaaaugauaucugaaucag

SEQ ID NO: 2296193 - RNA, 18 nt, Yersinia pestis KIM
aacgcuugcgccaaaucc

SEQ ID NO: 2296194 - RNA, 16 nt, Yersinia pestis KIM
aacgcucggcaccgau

SEQ ID NO: 2296195 - RNA, 22 nt, Yersinia pestis KIM
aacggaggggcuacacgguaau

SEQ ID NO: 2296196 - RNA, 16 nt, Yersinia pestis KIM
cuuaacugcauagcua

SEQ ID NO: 2296197 - RNA, 21 nt, Yersinia pestis KIM
aaccggcauucuucgccgcau

SEQ ID NO: 2296198 - RNA, 13 nt, Yersinia pestis KIM
cuguuaccaaugg

SEQ ID NO: 2296199 - RNA, 20 nt, Yersinia pestis KIM
cuguuaccgcgcuugcauca

SEQ ID NO: 2296200 - RNA, 12 nt, Yersinia pestis KIM
cugugauaacca

SEQ ID NO: 2296201 - RNA, 14 nt, Yersinia pestis KIM
cugugcaaauggcu

SEQ ID NO: 2296202 - RNA, 21 nt, Yersinia pestis KIM
cugucgggaacacuuugcgcu

SEQ ID NO: 2296203 - RNA, 18 nt, Yersinia pestis KIM
cugucggaagagauagag

SEQ ID NO: 2296204 - RNA, 13 nt, Yersinia pestis KIM
cuguauugaugca

SEQ ID NO: 2296205 - RNA, 18 nt, Yersinia pestis KIM
cuguauuguugcucaaca

SEQ ID NO: 2296206 - RNA, 16 nt, Yersinia pestis KIM
cugucaaucgaugagc

SEQ ID NO: 2296207 - RNA, 17 nt, Yersinia pestis KIM
cugguccagaucggcaa

SEQ ID NO: 2296208 - RNA, 13 nt, Yersinia pestis KIM
cuuccgccagcag

SEQ ID NO: 2296209 - RNA, 22 nt, Yersinia pestis KIM
cuucgccauagguacuuuguca

SEQ ID NO: 2296210 - RNA, 13 nt, Yersinia pestis KIM
cuucaaucaggug

SEQ ID NO: 2296211 - RNA, 18 nt, Yersinia pestis KIM
cuuauggucgguuuccgc

SEQ ID NO: 2296212 - RNA, 13 nt, Yersinia pestis KIM
cuucaucuaaaua

SEQ ID NO: 2296213 - RNA, 13 nt, Yersinia pestis KIM
cugggcgauccaa

SEQ ID NO: 2296214 - RNA, 24 nt, Yersinia pestis KIM
cuggcguugccgugcugucagcca

SEQ ID NO: 2296215 - RNA, 16 nt, Yersinia pestis KIM
cuggcgcagaguaucc

SEQ ID NO: 2296216 - RNA, 17 nt, Yersinia pestis KIM
cuggccgggauucaaac

SEQ ID NO: 2296217 - RNA, 14 nt, Yersinia pestis KIM
gaacgcucuguuga

SEQ ID NO: 2296218 - RNA, 18 nt, Yersinia pestis KIM
gaacuaacacuaucuccg

SEQ ID NO: 2296219 - RNA, 19 nt, Yersinia pestis KIM
gaacagccuaacgggugac

SEQ ID NO: 2296220 - RNA, 14 nt, Yersinia pestis KIM
gaaccguacagaua

SEQ ID NO: 2296221 - RNA, 13 nt, Yersinia pestis KIM
gaaacuaacgcgu

SEQ ID NO: 2296222 - RNA, 24 nt, Yersinia pestis KIM
gaaaccgcuguuuuaaucgguggc

SEQ ID NO: 2296223 - RNA, 20 nt, Yersinia pestis KIM
aacgaaacacacuucgccgg

SEQ ID NO: 2296224 - RNA, 13 nt, Yersinia pestis KIM
aacgaaacacacu

SEQ ID NO: 2296225 - RNA, 14 nt, Yersinia pestis KIM
aaccugguuaucgg

SEQ ID NO: 2296226 - RNA, 14 nt, Yersinia pestis KIM
aaccuugcgccaag

SEQ ID NO: 2296227 - RNA, 16 nt, Yersinia pestis KIM
gaaaccauugguaaua

SEQ ID NO: 2296228 - RNA, 20 nt, Yersinia pestis KIM
gaaacaaaaccuaacgccaa

SEQ ID NO: 2296229 - RNA, 20 nt, Yersinia pestis KIM
gaaaaugcggcggcugacca

SEQ ID NO: 2296230 - RNA, 22 nt, Yersinia pestis KIM
aaccucaaaaggauggcccaag

SEQ ID NO: 2296231 - RNA, 15 nt, Yersinia pestis KIM
aaccucaaaucgaua

SEQ ID NO: 2296232 - RNA, 11 nt, Yersinia pestis KIM
aaccuggccaa

SEQ ID NO: 2296233 - RNA, 14 nt, Yersinia pestis KIM
aaccugagcaccag

SEQ ID NO: 2296234 - RNA, 20 nt, Yersinia pestis KIM
aaccugaccguuaucaucga

SEQ ID NO: 2296235 - RNA, 20 nt, Yersinia pestis KIM
aaccugcaauaaccagaaua

SEQ ID NO: 2296236 - RNA, 16 nt, Yersinia pestis KIM
gaaaagguaaacagac

SEQ ID NO: 2296237 - RNA, 16 nt, Yersinia pestis KIM
aaccguuucaggagau

SEQ ID NO: 2296238 - RNA, 16 nt, Yersinia pestis KIM
gaaaauaccgcgauca

SEQ ID NO: 2296239 - RNA, 22 nt, Yersinia pestis KIM
cuugggcuucacauccaauggc

SEQ ID NO: 2296240 - RNA, 22 nt, Yersinia pestis KIM
cuugcugguauucaucagcaau

SEQ ID NO: 2296241 - RNA, 18 nt, Yersinia pestis KIM
cuuggacaucugcuuuac

SEQ ID NO: 2296242 - RNA, 22 nt, Yersinia pestis KIM
cuucguugccccaucagcacuc

SEQ ID NO: 2296243 - RNA, 13 nt, Yersinia pestis KIM
cuucguagccauu

SEQ ID NO: 2296244 - RNA, 17 nt, Yersinia pestis KIM
cuuucauacaucauuug

SEQ ID NO: 2296245 - RNA, 14 nt, Yersinia pestis KIM
cuuuauucaauacu

SEQ ID NO: 2296246 - RNA, 20 nt, Yersinia pestis KIM
cuuuacucuucugcccaucc

SEQ ID NO: 2296247 - RNA, 18 nt, Yersinia pestis KIM
cuuuagccagucaccgcu

SEQ ID NO: 2296248 - RNA, 21 nt, Yersinia pestis KIM
cuuuugacuggucacucgaug

SEQ ID NO: 2296249 - RNA, 15 nt, Yersinia pestis KIM
cuuuucugccuaucu

SEQ ID NO: 2296250 - RNA, 15 nt, Yersinia pestis KIM
cuuuucuucauugcu

SEQ ID NO: 2296251 - RNA, 16 nt, Yersinia pestis KIM
cuuuucuucuuugaca

SEQ ID NO: 2296252 - RNA, 19 nt, Yersinia pestis KIM
cuuuuaugacggcaucgag

SEQ ID NO: 2296253 - RNA, 20 nt, Yersinia pestis KIM
cuuuucacuccggcaucauc

SEQ ID NO: 2296254 - RNA, 14 nt, Yersinia pestis KIM
gaaaaaacguuacu

SEQ ID NO: 2296255 - RNA, 22 nt, Yersinia pestis KIM
gaaaaagggccaugccuguuga

SEQ ID NO: 2296256 - RNA, 21 nt, Yersinia pestis KIM
accggggauccauaggauccc

SEQ ID NO: 2296257 - RNA, 21 nt, Yersinia pestis KIM
accgggggcguauuaucggau

SEQ ID NO: 2296258 - RNA, 18 nt, Yersinia pestis KIM
accgggguucgcaaugaa

SEQ ID NO: 2296259 - RNA, 15 nt, Yersinia pestis KIM
accggggugaucaac

SEQ ID NO: 2296260 - RNA, 22 nt, Yersinia pestis KIM
accgggcuuuuuuucggcaucu

SEQ ID NO: 2296261 - RNA, 22 nt, Yersinia pestis KIM
accgugaacgauaacggcggua

SEQ ID NO: 2296262 - RNA, 13 nt, Yersinia pestis KIM
accgucaccuuua

SEQ ID NO: 2296263 - RNA, 17 nt, Yersinia pestis KIM
accuaacacuuuaucga

SEQ ID NO: 2296264 - RNA, 16 nt, Yersinia pestis KIM
accuaaaccuuucaga

SEQ ID NO: 2296265 - RNA, 16 nt, Yersinia pestis KIM
accuaacgccaaaaug

SEQ ID NO: 2296266 - RNA, 22 nt, Yersinia pestis KIM
accuaaccaaacauugucaccu

SEQ ID NO: 2296267 - RNA, 14 nt, Yersinia pestis KIM
accuccguaggcca

SEQ ID NO: 2296268 - RNA, 18 nt, Yersinia pestis KIM
accucauuauuaaacuga

SEQ ID NO: 2296269 - RNA, 17 nt, Yersinia pestis KIM
accguucagaucacaac

SEQ ID NO: 2296270 - RNA, 14 nt, Yersinia pestis KIM
accucguuggcuac

SEQ ID NO: 2296271 - RNA, 16 nt, Yersinia pestis KIM
acgaccgucaccaaau

SEQ ID NO: 2296272 - RNA, 17 nt, Yersinia pestis KIM
acgaaugagcaguaaua

SEQ ID NO: 2296273 - RNA, 22 nt, Yersinia pestis KIM
accuuuaccaugcucauguuca

SEQ ID NO: 2296274 - RNA, 16 nt, Yersinia pestis KIM
accugcaaugccuaaa

SEQ ID NO: 2296275 - RNA, 17 nt, Yersinia pestis KIM
acgagggcucaaucucu

SEQ ID NO: 2296276 - RNA, 18 nt, Yersinia pestis KIM
acgacuucgucaucguaa

SEQ ID NO: 2296277 - RNA, 16 nt, Yersinia pestis KIM
acgacgugcagcgcgc

SEQ ID NO: 2296278 - RNA, 13 nt, Yersinia pestis KIM
aaacaaauacacc

SEQ ID NO: 2296279 - RNA, 22 nt, Yersinia pestis KIM
acgcaauuagguugcagcuaaa

SEQ ID NO: 2296280 - RNA, 18 nt, Yersinia pestis KIM
acgcaccauccagcaaau

SEQ ID NO: 2296281 - RNA, 23 nt, Yersinia pestis KIM
acgaucgauaguaacaccagcau

SEQ ID NO: 2296282 - RNA, 15 nt, Yersinia pestis KIM
acgauaacuuuuggc

SEQ ID NO: 2296283 - RNA, 16 nt, Yersinia pestis KIM
accgcugauaaccagc

SEQ ID NO: 2296284 - RNA, 22 nt, Yersinia pestis KIM
accgcugcagcuuuagcggcga

SEQ ID NO: 2296285 - RNA, 22 nt, Yersinia pestis KIM
accgcuggucgggugcaggcca

SEQ ID NO: 2296286 - RNA, 20 nt, Yersinia pestis KIM
accgcuguaaacuggcagau

SEQ ID NO: 2296287 - RNA, 22 nt, Yersinia pestis KIM
accgcuggaagccgccaaguug

SEQ ID NO: 2296288 - RNA, 16 nt, Yersinia pestis KIM
accgcuuuacgcacau

SEQ ID NO: 2296289 - RNA, 18 nt, Yersinia pestis KIM
accgccggauuucaaucc

SEQ ID NO: 2296290 - RNA, 12 nt, Yersinia pestis KIM
acccgcuggcga

SEQ ID NO: 2296291 - RNA, 14 nt, Yersinia pestis KIM
accgaacacgaucc

SEQ ID NO: 2296292 - RNA, 20 nt, Yersinia pestis KIM
accgcacuugcggcaauggc

SEQ ID NO: 2296293 - RNA, 12 nt, Yersinia pestis KIM
accgcaaccggg

SEQ ID NO: 2296294 - RNA, 13 nt, Yersinia pestis KIM
accgcagaaccuu

SEQ ID NO: 2296295 - RNA, 14 nt, Yersinia pestis KIM
accccccauugcca

SEQ ID NO: 2296296 - RNA, 23 nt, Yersinia pestis KIM
accauggcggcucgccugauagc

SEQ ID NO: 2296297 - RNA, 18 nt, Yersinia pestis KIM
aaaauuccaccauucuca

SEQ ID NO: 2296298 - RNA, 20 nt, Yersinia pestis KIM
aaaauuaagacauugcgcaa

SEQ ID NO: 2296299 - RNA, 15 nt, Yersinia pestis KIM
acccgauacaggcuc

SEQ ID NO: 2296300 - RNA, 15 nt, Yersinia pestis KIM
acccgauuucaacgc

SEQ ID NO: 2296301 - RNA, 17 nt, Yersinia pestis KIM
acccgcuauauguaaug

SEQ ID NO: 2296302 - RNA, 14 nt, Yersinia pestis KIM
acaguuacgucagg

SEQ ID NO: 2296303 - RNA, 17 nt, Yersinia pestis KIM
acauaaaaucaauaucg

SEQ ID NO: 2296304 - RNA, 19 nt, Yersinia pestis KIM
aaaaucgcgaccagcagaa

SEQ ID NO: 2296305 - RNA, 15 nt, Yersinia pestis KIM
accauaacaauggcc

SEQ ID NO: 2296306 - RNA, 13 nt, Yersinia pestis KIM
accauacagcagu

SEQ ID NO: 2296307 - RNA, 21 nt, Yersinia pestis KIM
aaaauacugccaaucgcucug

SEQ ID NO: 2296308 - RNA, 19 nt, Yersinia pestis KIM
acgcucauccaacguaaac

SEQ ID NO: 2296309 - RNA, 18 nt, Yersinia pestis KIM
acgcucaccaucgccuuu

SEQ ID NO: 2296310 - RNA, 13 nt, Yersinia pestis KIM
aaacagccagcau

SEQ ID NO: 2296311 - RNA, 14 nt, Yersinia pestis KIM
aaacagagcaccgg

SEQ ID NO: 2296312 - RNA, 21 nt, Yersinia pestis KIM
aaacaggguugagccaauuaa

SEQ ID NO: 2296313 - RNA, 12 nt, Yersinia pestis KIM
acggauaucaac

SEQ ID NO: 2296314 - RNA, 24 nt, Yersinia pestis KIM
acggaucagugugggcuggugcgg

SEQ ID NO: 2296315 - RNA, 22 nt, Yersinia pestis KIM
acggcaccggguauugaccacu

SEQ ID NO: 2296316 - RNA, 13 nt, Yersinia pestis KIM
acggagcuaucac

SEQ ID NO: 2296317 - RNA, 15 nt, Yersinia pestis KIM
acggcguaagccuuc

SEQ ID NO: 2296318 - RNA, 18 nt, Yersinia pestis KIM
acggucauucacuguggc

SEQ ID NO: 2296319 - RNA, 13 nt, Yersinia pestis KIM
acgguagcaauac

SEQ ID NO: 2296320 - RNA, 17 nt, Yersinia pestis KIM
acgggcugcugcagccg

SEQ ID NO: 2296321 - RNA, 18 nt, Yersinia pestis KIM
acgguaccgcaggucaga

SEQ ID NO: 2296322 - RNA, 14 nt, Yersinia pestis KIM
acgugccaaaaugc

SEQ ID NO: 2296323 - RNA, 18 nt, Yersinia pestis KIM
acuaacacgacuuuuggc

SEQ ID NO: 2296324 - RNA, 22 nt, Yersinia pestis KIM
acuaaaucaaaaggaacguggc

SEQ ID NO: 2296325 - RNA, 19 nt, Yersinia pestis KIM
acuaaccucugcaaugccc

SEQ ID NO: 2296326 - RNA, 14 nt, Yersinia pestis KIM
acuaacaucagcga

SEQ ID NO: 2296327 - RNA, 15 nt, Yersinia pestis KIM
acuaaccaagccauc

SEQ ID NO: 2296328 - RNA, 12 nt, Yersinia pestis KIM
acuaauuucuaa

SEQ ID NO: 2296329 - RNA, 16 nt, Yersinia pestis KIM
acuacacacagcaaua

SEQ ID NO: 2296330 - RNA, 14 nt, Yersinia pestis KIM
acuaaaauaucacu

SEQ ID NO: 2296331 - RNA, 16 nt, Yersinia pestis KIM
acguuccaacaucucg

SEQ ID NO: 2296332 - RNA, 14 nt, Yersinia pestis KIM
acguuaacugcagu

SEQ ID NO: 2296333 - RNA, 20 nt, Yersinia pestis KIM
agagcauagacgaaggcacg

SEQ ID NO: 2296334 - RNA, 20 nt, Yersinia pestis KIM
agagcaaagucccggcuagg

SEQ ID NO: 2296335 - RNA, 22 nt, Yersinia pestis KIM
agacuucagcccauggcugaaa

SEQ ID NO: 2296336 - RNA, 19 nt, Yersinia pestis KIM
agacugaaaugacauugcg

SEQ ID NO: 2296337 - RNA, 15 nt, Yersinia pestis KIM
agagaacaggcagau

SEQ ID NO: 2296338 - RNA, 13 nt, Yersinia pestis KIM
agacgcgguuaac

SEQ ID NO: 2296339 - RNA, 15 nt, Yersinia pestis KIM
agacccccaaugagu

SEQ ID NO: 2296340 - RNA, 19 nt, Yersinia pestis KIM
agaccagauaaucgccaau

SEQ ID NO: 2296341 - RNA, 13 nt, Yersinia pestis KIM
agacaaaaauaga

SEQ ID NO: 2296342 - RNA, 21 nt, Yersinia pestis KIM
agacauaucuugaaccaauuu

SEQ ID NO: 2296343 - RNA, 16 nt, Yersinia pestis KIM
agacaggauaagcagg

SEQ ID NO: 2296344 - RNA, 13 nt, Yersinia pestis KIM
agacgaaggcacg

SEQ ID NO: 2296345 - RNA, 18 nt, Yersinia pestis KIM
agaugggccaggcaauga

SEQ ID NO: 2296346 - RNA, 17 nt, Yersinia pestis KIM
agauggccagauucacc

SEQ ID NO: 2296347 - RNA, 13 nt, Yersinia pestis KIM
agagucgcuuugg

SEQ ID NO: 2296348 - RNA, 16 nt, Yersinia pestis KIM
agagugaaauauaccg

SEQ ID NO: 2296349 - RNA, 12 nt, Yersinia pestis KIM
agagugcuggca

SEQ ID NO: 2296350 - RNA, 20 nt, Yersinia pestis KIM
agauaauagaggguaaccgc

SEQ ID NO: 2296351 - RNA, 23 nt, Yersinia pestis KIM
agauaagaagggguuauucgcgc

SEQ ID NO: 2296352 - RNA, 18 nt, Yersinia pestis KIM
agagcggucgacaaaaug

SEQ ID NO: 2296353 - RNA, 11 nt, Yersinia pestis KIM
agaucagugcc

SEQ ID NO: 2296354 - RNA, 14 nt, Yersinia pestis KIM
agaucaaacauaac

SEQ ID NO: 2296355 - RNA, 16 nt, Yersinia pestis KIM
agauaccgcaaccauu

SEQ ID NO: 2296356 - RNA, 18 nt, Yersinia pestis KIM
agauacccauagcgcauu

SEQ ID NO: 2296357 - RNA, 13 nt, Yersinia pestis KIM
agauacaucaaug

SEQ ID NO: 2296358 - RNA, 14 nt, Yersinia pestis KIM
agauacaucaaugg

SEQ ID NO: 2296359 - RNA, 14 nt, Yersinia pestis KIM
agauacucggcaaa

SEQ ID NO: 2296360 - RNA, 18 nt, Yersinia pestis KIM
acugguaauaaugcuguc

SEQ ID NO: 2296361 - RNA, 18 nt, Yersinia pestis KIM
acuuaacaaucagugcaa

SEQ ID NO: 2296362 - RNA, 15 nt, Yersinia pestis KIM
acuuaacuacugcaa

SEQ ID NO: 2296363 - RNA, 23 nt, Yersinia pestis KIM
acuuaccccuugcgaucaauugg

SEQ ID NO: 2296364 - RNA, 16 nt, Yersinia pestis KIM
acuuacaauaaucugg

SEQ ID NO: 2296365 - RNA, 17 nt, Yersinia pestis KIM
acugguaugcgggaaca

SEQ ID NO: 2296366 - RNA, 16 nt, Yersinia pestis KIM
acugccauaauccaga

SEQ ID NO: 2296367 - RNA, 19 nt, Yersinia pestis KIM
acugauaugggaacgucug

SEQ ID NO: 2296368 - RNA, 20 nt, Yersinia pestis KIM
acugauaucuucacucagcg

SEQ ID NO: 2296369 - RNA, 17 nt, Yersinia pestis KIM
acugauucucuucaccu

SEQ ID NO: 2296370 - RNA, 20 nt, Yersinia pestis KIM
acugaaucccagaaccucaa

SEQ ID NO: 2296371 - RNA, 16 nt, Yersinia pestis KIM
acugaaugugaagagc

SEQ ID NO: 2296372 - RNA, 15 nt, Yersinia pestis KIM
acugacagcggucgg

SEQ ID NO: 2296373 - RNA, 18 nt, Yersinia pestis KIM
acugauacccgccaguuu

SEQ ID NO: 2296374 - RNA, 14 nt, Yersinia pestis KIM
acugaccuauugau

SEQ ID NO: 2296375 - RNA, 15 nt, Yersinia pestis KIM
acuaucccacucugu

SEQ ID NO: 2296376 - RNA, 16 nt, Yersinia pestis KIM
agaaauagcaccauua

SEQ ID NO: 2296377 - RNA, 20 nt, Yersinia pestis KIM
agaacaacccauuuccuuau

SEQ ID NO: 2296378 - RNA, 14 nt, Yersinia pestis KIM
agaacaggcagcaa

SEQ ID NO: 2296379 - RNA, 20 nt, Yersinia pestis KIM
agaacccccgcgaacagcag

SEQ ID NO: 2296380 - RNA, 19 nt, Yersinia pestis KIM
agaauagagaaaucaaagu

SEQ ID NO: 2296381 - RNA, 18 nt, Yersinia pestis KIM
agaauagaccugaugacc

SEQ ID NO: 2296382 - RNA, 21 nt, Yersinia pestis KIM
agaaucccgguugauaucggc

SEQ ID NO: 2296383 - RNA, 21 nt, Yersinia pestis KIM
agaaugaaaggcggugaacag

SEQ ID NO: 2296384 - RNA, 16 nt, Yersinia pestis KIM
agaaugcagauaucag

SEQ ID NO: 2296385 - RNA, 16 nt, Yersinia pestis KIM
aacuggcgcaauguca

SEQ ID NO: 2296386 - RNA, 22 nt, Yersinia pestis KIM
aacuggcgcaaugucaccugaa

SEQ ID NO: 2296387 - RNA, 20 nt, Yersinia pestis KIM
aacuggcccagcuuuaucgg

SEQ ID NO: 2296388 - RNA, 16 nt, Yersinia pestis KIM
aacuguaaauaucaua

SEQ ID NO: 2296389 - RNA, 20 nt, Yersinia pestis KIM
aacuuacaugaguaagugau

SEQ ID NO: 2296390 - RNA, 22 nt, Yersinia pestis KIM
aacuuggacaucugcuuuacug

SEQ ID NO: 2296391 - RNA, 14 nt, Yersinia pestis KIM
aacuugaucagcgc

SEQ ID NO: 2296392 - RNA, 12 nt, Yersinia pestis KIM
aacuugccgcgg

SEQ ID NO: 2296393 - RNA, 16 nt, Yersinia pestis KIM
aacuuagcgccauaac

SEQ ID NO: 2296394 - RNA, 19 nt, Yersinia pestis KIM
aagaacggccugccagaac

SEQ ID NO: 2296395 - RNA, 19 nt, Yersinia pestis KIM
aagaaucagcgguugaaaa

SEQ ID NO: 2296396 - RNA, 19 nt, Yersinia pestis KIM
aagacaauuauagccaaau

SEQ ID NO: 2296397 - RNA, 20 nt, Yersinia pestis KIM
aacugccauggaauuuaugc

SEQ ID NO: 2296398 - RNA, 12 nt, Yersinia pestis KIM
aacugccgccau

SEQ ID NO: 2296399 - RNA, 13 nt, Yersinia pestis KIM
aacucgcgauaac

SEQ ID NO: 2296400 - RNA, 17 nt, Yersinia pestis KIM
aacucgguuuuaaucgc

SEQ ID NO: 2296401 - RNA, 20 nt, Yersinia pestis KIM
aacuccuuuguuauuucugg

SEQ ID NO: 2296402 - RNA, 19 nt, Yersinia pestis KIM
aacucaccuaaaucauaca

SEQ ID NO: 2296403 - RNA, 16 nt, Yersinia pestis KIM
aacucaccuuuaucgc

SEQ ID NO: 2296404 - RNA, 20 nt, Yersinia pestis KIM
aacucagccauugcuuugcg

SEQ ID NO: 2296405 - RNA, 11 nt, Yersinia pestis KIM
aacucaagcgu

SEQ ID NO: 2296406 - RNA, 13 nt, Yersinia pestis KIM
aacuauucauccc

SEQ ID NO: 2296407 - RNA, 15 nt, Yersinia pestis KIM
aacgcggaauagccg

SEQ ID NO: 2296408 - RNA, 22 nt, Yersinia pestis KIM
aacgcucaucaaccgggauauc

SEQ ID NO: 2296409 - RNA, 23 nt, Yersinia pestis KIM
aacgcucauaccaugccaucaau

SEQ ID NO: 2296410 - RNA, 15 nt, Yersinia pestis KIM
aacgcugaccauggc

SEQ ID NO: 2296411 - RNA, 16 nt, Yersinia pestis KIM
aacgcucaaucacgac

SEQ ID NO: 2296412 - RNA, 22 nt, Yersinia pestis KIM
aacgcccugccgggcaaugugu

SEQ ID NO: 2296413 - RNA, 20 nt, Yersinia pestis KIM
aacgacguuaucaauacugc

SEQ ID NO: 2296414 - RNA, 18 nt, Yersinia pestis KIM
aacgacguucucacuugg

SEQ ID NO: 2296415 - RNA, 18 nt, Yersinia pestis KIM
aaccgcuguuuuaaucgg

SEQ ID NO: 2296416 - RNA, 21 nt, Yersinia pestis KIM
aacacgcuauccgcgccgagc

SEQ ID NO: 2296417 - RNA, 14 nt, Yersinia pestis KIM
aacacgauccgcuu

SEQ ID NO: 2296418 - RNA, 16 nt, Yersinia pestis KIM
aacacgaccugugcac

SEQ ID NO: 2296419 - RNA, 20 nt, Yersinia pestis KIM
aaccgucaccguguucaugg

SEQ ID NO: 2296420 - RNA, 18 nt, Yersinia pestis KIM
aaccguagucgcaccaag

SEQ ID NO: 2296421 - RNA, 15 nt, Yersinia pestis KIM
aaccuaacgccaaaa

SEQ ID NO: 2296422 - RNA, 19 nt, Yersinia pestis KIM
aaccguuuuuucaacuggc

SEQ ID NO: 2296423 - RNA, 15 nt, Yersinia pestis KIM
aaccucagccucauu

SEQ ID NO: 2296424 - RNA, 18 nt, Yersinia pestis KIM
aaggcuaaaccggcacag

SEQ ID NO: 2296425 - RNA, 15 nt, Yersinia pestis KIM
aaggcgaccaauggg

SEQ ID NO: 2296426 - RNA, 22 nt, Yersinia pestis KIM
aaggcauccccggcaccaacgc

SEQ ID NO: 2296427 - RNA, 22 nt, Yersinia pestis KIM
aaggcccauuugucgcgccuga

SEQ ID NO: 2296428 - RNA, 21 nt, Yersinia pestis KIM
aagcguacugcgguuaaucgg

SEQ ID NO: 2296429 - RNA, 11 nt, Yersinia pestis KIM
aagcgguuaag

SEQ ID NO: 2296430 - RNA, 21 nt, Yersinia pestis KIM
aagcgcacaucggugagucac

SEQ ID NO: 2296431 - RNA, 20 nt, Yersinia pestis KIM
aagagauagauuuuaaugaa

SEQ ID NO: 2296432 - RNA, 18 nt, Yersinia pestis KIM
aagcauugagcgccacau

SEQ ID NO: 2296433 - RNA, 15 nt, Yersinia pestis KIM
aagccagauaucacu

SEQ ID NO: 2296434 - RNA, 15 nt, Yersinia pestis KIM
aagugauucggguga

SEQ ID NO: 2296435 - RNA, 23 nt, Yersinia pestis KIM
aaguggggauggugagcucaucu

SEQ ID NO: 2296436 - RNA, 12 nt, Yersinia pestis KIM
aauaaucaauga

SEQ ID NO: 2296437 - RNA, 13 nt, Yersinia pestis KIM
aauaaucaaugac

SEQ ID NO: 2296438 - RNA, 16 nt, Yersinia pestis KIM
aauaaagggccugcaa

SEQ ID NO: 2296439 - RNA, 22 nt, Yersinia pestis KIM
aauaaaguaaaagccagucagg

SEQ ID NO: 2296440 - RNA, 23 nt, Yersinia pestis KIM
aauaaauagagugaaguaucacc

SEQ ID NO: 2296441 - RNA, 22 nt, Yersinia pestis KIM
aaguucggagauuucgguuaau

SEQ ID NO: 2296442 - RNA, 18 nt, Yersinia pestis KIM
aauauugcacaauagcua

SEQ ID NO: 2296443 - RNA, 18 nt, Yersinia pestis KIM
aauauucgcagccaaaau

SEQ ID NO: 2296444 - RNA, 22 nt, Yersinia pestis KIM
aauauucaccaucugccugcaa

SEQ ID NO: 2296445 - RNA, 15 nt, Yersinia pestis KIM
aauauguucuucuug

SEQ ID NO: 2296446 - RNA, 23 nt, Yersinia pestis KIM
aauaugccaaaucucaucggcau

SEQ ID NO: 2296447 - RNA, 14 nt, Yersinia pestis KIM
aaucaagcccgcaa

SEQ ID NO: 2296448 - RNA, 14 nt, Yersinia pestis KIM
aaucaaucuaaugg

SEQ ID NO: 2296449 - RNA, 12 nt, Yersinia pestis KIM
aauauaaugcug

SEQ ID NO: 2296450 - RNA, 14 nt, Yersinia pestis KIM
aauacuucaggcca

SEQ ID NO: 2296451 - RNA, 15 nt, Yersinia pestis KIM
aauacuucaggccaa

SEQ ID NO: 2296452 - RNA, 17 nt, Yersinia pestis KIM
aauacuuaacaaucagu

SEQ ID NO: 2296453 - RNA, 16 nt, Yersinia pestis KIM
aauacugccuaacugg

SEQ ID NO: 2296454 - RNA, 11 nt, Yersinia pestis KIM
aauaauucagg

SEQ ID NO: 2296455 - RNA, 15 nt, Yersinia pestis KIM
aauacggccagucaa

SEQ ID NO: 2296456 - RNA, 20 nt, Yersinia pestis KIM
aauacucuguuaccaauggu

SEQ ID NO: 2296457 - RNA, 20 nt, Yersinia pestis KIM
aauauauucucuuaucgauu

SEQ ID NO: 2296458 - RNA, 19 nt, Yersinia pestis KIM
aauaucacugauaucggua

SEQ ID NO: 2296459 - RNA, 13 nt, Yersinia pestis KIM
aauauccaauggu

SEQ ID NO: 2296460 - RNA, 17 nt, Yersinia pestis KIM
acagcagugaucucaac

SEQ ID NO: 2296461 - RNA, 18 nt, Yersinia pestis KIM
acaggccuaaugccgcgc

SEQ ID NO: 2296462 - RNA, 14 nt, Yersinia pestis KIM
acaggcgaguuggc

SEQ ID NO: 2296463 - RNA, 19 nt, Yersinia pestis KIM
acagaaaucaaugugccgu

SEQ ID NO: 2296464 - RNA, 16 nt, Yersinia pestis KIM
acacugucgcauaaga

SEQ ID NO: 2296465 - RNA, 17 nt, Yersinia pestis KIM
acacuggugcucacuga

SEQ ID NO: 2296466 - RNA, 13 nt, Yersinia pestis KIM
acacugguugaaa

SEQ ID NO: 2296467 - RNA, 22 nt, Yersinia pestis KIM
acacuggcggacaucuuacuga

SEQ ID NO: 2296468 - RNA, 12 nt, Yersinia pestis KIM
acacuuauuggu

SEQ ID NO: 2296469 - RNA, 15 nt, Yersinia pestis KIM
acagcacuaucccca

SEQ ID NO: 2296470 - RNA, 13 nt, Yersinia pestis KIM
acagcaacgacgc

SEQ ID NO: 2296471 - RNA, 14 nt, Yersinia pestis KIM
acagacacagcaac

SEQ ID NO: 2296472 - RNA, 21 nt, Yersinia pestis KIM
acagagcaaaaagccagcgau

SEQ ID NO: 2296473 - RNA, 19 nt, Yersinia pestis KIM
acagagguagacguaucau

SEQ ID NO: 2296474 - RNA, 20 nt, Yersinia pestis KIM
acaccgcuacaggcgcaacu

SEQ ID NO: 2296475 - RNA, 14 nt, Yersinia pestis KIM
acaccauaaucgca

SEQ ID NO: 2296476 - RNA, 19 nt, Yersinia pestis KIM
acaccauuuggacugaaua

SEQ ID NO: 2296477 - RNA, 17 nt, Yersinia pestis KIM
acaccuucaaucauuga

SEQ ID NO: 2296478 - RNA, 20 nt, Yersinia pestis KIM
acaccggggauccauaggau

SEQ ID NO: 2296479 - RNA, 17 nt, Yersinia pestis KIM
aaaauacgcaugauccc

SEQ ID NO: 2296480 - RNA, 15 nt, Yersinia pestis KIM
aaaauacauaucaac

SEQ ID NO: 2296481 - RNA, 17 nt, Yersinia pestis KIM
aauugccgcgucuguua

SEQ ID NO: 2296482 - RNA, 22 nt, Yersinia pestis KIM
aauucgcuucgcuccggucaac

SEQ ID NO: 2296483 - RNA, 14 nt, Yersinia pestis KIM
aauuuaacuuucau

SEQ ID NO: 2296484 - RNA, 17 nt, Yersinia pestis KIM
aauggcggcgcgauaau

SEQ ID NO: 2296485 - RNA, 13 nt, Yersinia pestis KIM
aauggguguuauu

SEQ ID NO: 2296486 - RNA, 18 nt, Yersinia pestis KIM
aauguucgcugacagagu

SEQ ID NO: 2296487 - RNA, 19 nt, Yersinia pestis KIM
aauuccgcccugaauaucg

SEQ ID NO: 2296488 - RNA, 17 nt, Yersinia pestis KIM
aauuaagaagccucaug

SEQ ID NO: 2296489 - RNA, 20 nt, Yersinia pestis KIM
aauuaagcuauugguuauug

SEQ ID NO: 2296490 - RNA, 15 nt, Yersinia pestis KIM
aaugaauucauugau

SEQ ID NO: 2296491 - RNA, 19 nt, Yersinia pestis KIM
aaugaaggcucauagucgg

SEQ ID NO: 2296492 - RNA, 15 nt, Yersinia pestis KIM
aaugaacaaauaucg

SEQ ID NO: 2296493 - RNA, 20 nt, Yersinia pestis KIM
aaugaacacgacgccauaaa

SEQ ID NO: 2296494 - RNA, 19 nt, Yersinia pestis KIM
aaugacagcaucaauaucg

SEQ ID NO: 2296495 - RNA, 17 nt, Yersinia pestis KIM
aaucacgcagcaggcca

SEQ ID NO: 2296496 - RNA, 14 nt, Yersinia pestis KIM
aaucuugguuaaua

SEQ ID NO: 2296497 - RNA, 20 nt, Yersinia pestis KIM
aaugcucggcgucagccgcg

SEQ ID NO: 2296498 - RNA, 15 nt, Yersinia pestis KIM
aauggcgcaauagca

SEQ ID NO: 2296499 - RNA, 14 nt, Yersinia pestis KIM
aaugccgauaagcc

SEQ ID NO: 2296500 - RNA, 17 nt, Yersinia pestis KIM
aaugccccacuucacgc

SEQ ID NO: 2296501 - RNA, 15 nt, Yersinia pestis KIM
acacagcguagacaa

SEQ ID NO: 2296502 - RNA, 13 nt, Yersinia pestis KIM
acaauucacccau

SEQ ID NO: 2296503 - RNA, 18 nt, Yersinia pestis KIM
acaauuacgcacugccug

SEQ ID NO: 2296504 - RNA, 23 nt, Yersinia pestis KIM
acaaucucuggcaacggcacauc

SEQ ID NO: 2296505 - RNA, 21 nt, Yersinia pestis KIM
acaagucagugauucggguga

SEQ ID NO: 2296506 - RNA, 20 nt, Yersinia pestis KIM
acaagcgcaguagcggcuca

SEQ ID NO: 2296507 - RNA, 21 nt, Yersinia pestis KIM
acaagauaaauaccgccaaau

SEQ ID NO: 2296508 - RNA, 15 nt, Yersinia pestis KIM
acaacaaaggcgcca

SEQ ID NO: 2296509 - RNA, 17 nt, Yersinia pestis KIM
acaacaacggugaacag

SEQ ID NO: 2296510 - RNA, 15 nt, Yersinia pestis KIM
acaaauuugacauuu

SEQ ID NO: 2296511 - RNA, 16 nt, Yersinia pestis KIM
acaacacgcuauccgc

SEQ ID NO: 2296512 - RNA, 14 nt, Yersinia pestis KIM
aauuuuuagccgca

SEQ ID NO: 2296513 - RNA, 12 nt, Yersinia pestis KIM
aaaccgcuuauc

SEQ ID NO: 2296514 - RNA, 13 nt, Yersinia pestis KIM
aaacccggcauca

SEQ ID NO: 2296515 - RNA, 16 nt, Yersinia pestis KIM
aaaccacugaccuauu

SEQ ID NO: 2296516 - RNA, 21 nt, Yersinia pestis KIM
aaaccuggcucaguucaaggu

SEQ ID NO: 2296517 - RNA, 13 nt, Yersinia pestis KIM
aaaccgugauugg

SEQ ID NO: 2296518 - RNA, 21 nt, Yersinia pestis KIM
aaacacuuauuugaaauacuu

SEQ ID NO: 2296519 - RNA, 23 nt, Yersinia pestis KIM
aaacagugcacaucaauaccugu

SEQ ID NO: 2296520 - RNA, 16 nt, Yersinia pestis KIM
aaacauugucaccuaa

SEQ ID NO: 2296521 - RNA, 20 nt, Yersinia pestis KIM
aaacauccuaaaaagcgcga

SEQ ID NO: 2296522 - RNA, 11 nt, Yersinia pestis KIM
aaagccgacau

SEQ ID NO: 2296523 - RNA, 16 nt, Yersinia pestis KIM
aaaggucccuuugaca

SEQ ID NO: 2296524 - RNA, 13 nt, Yersinia pestis KIM
aaagggggcggcu

SEQ ID NO: 2296525 - RNA, 15 nt, Yersinia pestis KIM
aaaguaaucaggcau

SEQ ID NO: 2296526 - RNA, 17 nt, Yersinia pestis KIM
aaaccuuuauguaacac

SEQ ID NO: 2296527 - RNA, 17 nt, Yersinia pestis KIM
aaacgccgcgucaauaa

SEQ ID NO: 2296528 - RNA, 14 nt, Yersinia pestis KIM
aaacgcugggcgau

SEQ ID NO: 2296529 - RNA, 14 nt, Yersinia pestis KIM
aaacgcuugucacc

SEQ ID NO: 2296530 - RNA, 19 nt, Yersinia pestis KIM
aaagcaucagacugcucuu

SEQ ID NO: 2296531 - RNA, 17 nt, Yersinia pestis KIM
aaagcaucaaucaucug

SEQ ID NO: 2296532 - RNA, 20 nt, Yersinia pestis KIM
aaaugcccgucgggauaucu

SEQ ID NO: 2296533 - RNA, 12 nt, Yersinia pestis KIM
aaaugccagaau

SEQ ID NO: 2296534 - RNA, 16 nt, Yersinia pestis KIM
aaaugccguacaacaa

SEQ ID NO: 2296535 - RNA, 16 nt, Yersinia pestis KIM
aaaugaucaucagcag

SEQ ID NO: 2296536 - RNA, 16 nt, Yersinia pestis KIM
aaaacacuggcagcca

SEQ ID NO: 2296537 - RNA, 21 nt, Yersinia pestis KIM
aaaacagccuaaggccaucaa

SEQ ID NO: 2296538 - RNA, 19 nt, Yersinia pestis KIM
aaauaaucggcaaaccgaa

SEQ ID NO: 2296539 - RNA, 21 nt, Yersinia pestis KIM
aaauaaccgagcgugaagagc

SEQ ID NO: 2296540 - RNA, 13 nt, Yersinia pestis KIM
aaauaaggcgcug

SEQ ID NO: 2296541 - RNA, 15 nt, Yersinia pestis KIM
aaaacuucaucgaua

SEQ ID NO: 2296542 - RNA, 15 nt, Yersinia pestis KIM
aacacacuuagcuaa

SEQ ID NO: 2296543 - RNA, 17 nt, Yersinia pestis KIM
aacacccaacucaacgg

SEQ ID NO: 2296544 - RNA, 16 nt, Yersinia pestis KIM
aaaacgcuggccagca

SEQ ID NO: 2296545 - RNA, 19 nt, Yersinia pestis KIM
aaaacgcgacggucagcca

SEQ ID NO: 2296546 - RNA, 22 nt, Yersinia pestis KIM
aaaaccauccccagaacagcua

SEQ ID NO: 2296547 - RNA, 23 nt, Yersinia pestis KIM
aaaaccccguacaugaauaaugu

SEQ ID NO: 2296548 - RNA, 13 nt, Yersinia pestis KIM
aaaaagccagcga

SEQ ID NO: 2296549 - RNA, 17 nt, Yersinia pestis KIM
aaaaacacgguugaaaa

SEQ ID NO: 2296550 - RNA, 13 nt, Yersinia pestis KIM
aaaaaacagacua

SEQ ID NO: 2296551 - RNA, 18 nt, Yersinia pestis KIM
aaaauuauugccgcagau

SEQ ID NO: 2296552 - RNA, 15 nt, Yersinia pestis KIM
aaaaucgcacugagu

SEQ ID NO: 2296553 - RNA, 14 nt, Yersinia pestis KIM
aaaaucauugacgu

SEQ ID NO: 2296554 - RNA, 18 nt, Yersinia pestis KIM
aaaaguggcuaucugaaa

SEQ ID NO: 2296555 - RNA, 21 nt, Yersinia pestis KIM
uuuuuugggaugaaaaauaca

SEQ ID NO: 2296556 - RNA, 23 nt, Yersinia pestis KIM
uuuuucaucaauuggcagcggca

SEQ ID NO: 2296557 - RNA, 15 nt, Yersinia pestis KIM
uuuucucuuucuucu

SEQ ID NO: 2296558 - RNA, 14 nt, Yersinia pestis KIM
uuuucugccuaucu

SEQ ID NO: 2296559 - RNA, 14 nt, Yersinia pestis KIM
uuuucuuucaggcu

SEQ ID NO: 2296560 - RNA, 16 nt, Yersinia pestis KIM
uuuugaggaaauuuca

SEQ ID NO: 2296561 - RNA, 20 nt, Yersinia pestis KIM
uuuugagcucagccaggcag

SEQ ID NO: 2296562 - RNA, 23 nt, Yersinia pestis KIM
uuuugacacgggaucaacauggu

SEQ ID NO: 2296563 - RNA, 17 nt, Yersinia pestis KIM
uuuugacaacguguccg

SEQ ID NO: 2296564 - RNA, 18 nt, Yersinia pestis KIM
uuuugccacauuucccuu

SEQ ID NO: 2296565 - RNA, 18 nt, Yersinia pestis KIM
uuuugcccgcgcuuccag

SEQ ID NO: 2296566 - RNA, 23 nt, Yersinia pestis KIM
uuuugccaaugcugcugucagua

SEQ ID NO: 2296567 - RNA, 15 nt, Yersinia pestis KIM
uuuucaguuuuaauu

SEQ ID NO: 2296568 - RNA, 21 nt, Yersinia pestis KIM
uuuucaggcuaaugcgcucug

SEQ ID NO: 2296569 - RNA, 18 nt, Yersinia pestis KIM
uuuuccgccaugagaacc

SEQ ID NO: 2296570 - RNA, 15 nt, Yersinia pestis KIM
uuuucgaacuuaacu

SEQ ID NO: 2296571 - RNA, 21 nt, Yersinia pestis KIM
uuuucgaacuuaacuacugca

SEQ ID NO: 2296572 - RNA, 18 nt, Yersinia pestis KIM
uuuaccugcucaacugcu

SEQ ID NO: 2296573 - RNA, 22 nt, Yersinia pestis KIM
uuuaccuguuucgauccagcua

SEQ ID NO: 2296574 - RNA, 23 nt, Yersinia pestis KIM
uuuucacuccggcaucauccuca

SEQ ID NO: 2296575 - RNA, 23 nt, Yersinia pestis KIM
uuuugcgccacaacccaauaaua

SEQ ID NO: 2296576 - RNA, 22 nt, Yersinia pestis KIM
uuuugccggggagucgcuccuc

SEQ ID NO: 2296577 - RNA, 15 nt, Yersinia pestis KIM
uuuugcuuaaaacag

SEQ ID NO: 2296578 - RNA, 15 nt, Yersinia pestis KIM
uuuuggccgcuacug

SEQ ID NO: 2296579 - RNA, 22 nt, Yersinia pestis KIM
uuuuggccgggauuugcucaga

SEQ ID NO: 2296580 - RNA, 12 nt, Yersinia pestis KIM
uuuuggaaugcu

SEQ ID NO: 2296581 - RNA, 15 nt, Yersinia pestis KIM
uuuuguuacccacua

SEQ ID NO: 2296582 - RNA, 14 nt, Yersinia pestis KIM
uuuuguuuccccua

SEQ ID NO: 2296583 - RNA, 13 nt, Yersinia pestis KIM
uuuuguauuuaaa

SEQ ID NO: 2296584 - RNA, 22 nt, Yersinia pestis KIM
uuuuuauagacacggugaccaa

SEQ ID NO: 2296585 - RNA, 14 nt, Yersinia pestis KIM
uuuuuauaauuaau

SEQ ID NO: 2296586 - RNA, 16 nt, Yersinia pestis KIM
uuuuuauaaucgauac

SEQ ID NO: 2296587 - RNA, 14 nt, Yersinia pestis KIM
uuuuuauaaacacu

SEQ ID NO: 2296588 - RNA, 12 nt, Yersinia pestis KIM
uuuuuaucccua

SEQ ID NO: 2296589 - RNA, 13 nt, Yersinia pestis KIM
uuuuuaucccccu

SEQ ID NO: 2296590 - RNA, 16 nt, Yersinia pestis KIM
uuuuucagcuucuucu

SEQ ID NO: 2296591 - RNA, 15 nt, Yersinia pestis KIM
uuuuuaaagaaaaaa

SEQ ID NO: 2296592 - RNA, 22 nt, Yersinia pestis KIM
uuuuuaccgaguuggauauaca

SEQ ID NO: 2296593 - RNA, 14 nt, Yersinia pestis KIM
uuuuuagcuucgcu

SEQ ID NO: 2296594 - RNA, 13 nt, Yersinia pestis KIM
uuuuuaauuuaaa

SEQ ID NO: 2296595 - RNA, 13 nt, Yersinia pestis KIM
uucguguauauca

SEQ ID NO: 2296596 - RNA, 16 nt, Yersinia pestis KIM
uucguuagcucuucac

SEQ ID NO: 2296597 - RNA, 22 nt, Yersinia pestis KIM
uucguggaaaucgggugauaaa

SEQ ID NO: 2296598 - RNA, 23 nt, Yersinia pestis KIM
uucguggugggcgguaguauuug

SEQ ID NO: 2296599 - RNA, 11 nt, Yersinia pestis KIM
uucgugaaagc

SEQ ID NO: 2296600 - RNA, 14 nt, Yersinia pestis KIM
uucgucucaucaau

SEQ ID NO: 2296601 - RNA, 23 nt, Yersinia pestis KIM
uucgucgggggugccguagguaa

SEQ ID NO: 2296602 - RNA, 19 nt, Yersinia pestis KIM
uucggcaggcagaaauaau

SEQ ID NO: 2296603 - RNA, 13 nt, Yersinia pestis KIM
uucggccacccgc

SEQ ID NO: 2296604 - RNA, 22 nt, Yersinia pestis KIM
uucggauaaauacaggcucuau

SEQ ID NO: 2296605 - RNA, 21 nt, Yersinia pestis KIM
uucggauaaccgcauucccug

SEQ ID NO: 2296606 - RNA, 24 nt, Yersinia pestis KIM
uucuaguauucaggaaugcucuuu

SEQ ID NO: 2296607 - RNA, 20 nt, Yersinia pestis KIM
uucuaggugcucugccuuau

SEQ ID NO: 2296608 - RNA, 15 nt, Yersinia pestis KIM
uucuagcaacauggu

SEQ ID NO: 2296609 - RNA, 14 nt, Yersinia pestis KIM
uucuaauuauuaaa

SEQ ID NO: 2296610 - RNA, 16 nt, Yersinia pestis KIM
uucuacugaauaaaca

SEQ ID NO: 2296611 - RNA, 19 nt, Yersinia pestis KIM
uucuacugaauaaacacca

SEQ ID NO: 2296612 - RNA, 16 nt, Yersinia pestis KIM
uucuacugcguccuuu

SEQ ID NO: 2296613 - RNA, 13 nt, Yersinia pestis KIM
uucuccaacaacu

SEQ ID NO: 2296614 - RNA, 18 nt, Yersinia pestis KIM
uucuccugcgguggccag

SEQ ID NO: 2296615 - RNA, 23 nt, Yersinia pestis KIM
uucuccugcgguggccagagcau

SEQ ID NO: 2296616 - RNA, 14 nt, Yersinia pestis KIM
uucucauuaauaau

SEQ ID NO: 2296617 - RNA, 13 nt, Yersinia pestis KIM
uucucagcaaggu

SEQ ID NO: 2296618 - RNA, 18 nt, Yersinia pestis KIM
uucuuccaagaaugcaga

SEQ ID NO: 2296619 - RNA, 15 nt, Yersinia pestis KIM
uucuucauugcugcu

SEQ ID NO: 2296620 - RNA, 21 nt, Yersinia pestis KIM
uucuucacugagcagguuaaa

SEQ ID NO: 2296621 - RNA, 22 nt, Yersinia pestis KIM
uucuugauggucaauaaugucc

SEQ ID NO: 2296622 - RNA, 17 nt, Yersinia pestis KIM
uucuuacuaaaauauca

SEQ ID NO: 2296623 - RNA, 18 nt, Yersinia pestis KIM
uucuuacuaaaauaucac

SEQ ID NO: 2296624 - RNA, 14 nt, Yersinia pestis KIM
uucuuacuguuuuc

SEQ ID NO: 2296625 - RNA, 15 nt, Yersinia pestis KIM
uucuuagccagugac

SEQ ID NO: 2296626 - RNA, 18 nt, Yersinia pestis KIM
uucuuagccagugacucc

SEQ ID NO: 2296627 - RNA, 18 nt, Yersinia pestis KIM
uucuuaggauaaccaauu

SEQ ID NO: 2296628 - RNA, 18 nt, Yersinia pestis KIM
uucugaacaaaauaguca

SEQ ID NO: 2296629 - RNA, 17 nt, Yersinia pestis KIM
uucugaacgaccagaau

SEQ ID NO: 2296630 - RNA, 14 nt, Yersinia pestis KIM
uucugaagaugcca

SEQ ID NO: 2296631 - RNA, 23 nt, Yersinia pestis KIM
uucugaaucgcugccauaugcau

SEQ ID NO: 2296632 - RNA, 10 nt, Yersinia pestis KIM
uucuggcagg

SEQ ID NO: 2296633 - RNA, 13 nt, Yersinia pestis KIM
uucuggauuugau

SEQ ID NO: 2296634 - RNA, 18 nt, Yersinia pestis KIM
uucuggguacaacacaaa

SEQ ID NO: 2296635 - RNA, 21 nt, Yersinia pestis KIM
uucuggguacaacacaaaaac

SEQ ID NO: 2296636 - RNA, 15 nt, Yersinia pestis KIM
uucuggugagcauca

SEQ ID NO: 2296637 - RNA, 14 nt, Yersinia pestis KIM
uucugauaaaacag

SEQ ID NO: 2296638 - RNA, 23 nt, Yersinia pestis KIM
uucugacgggacaaucuguuccu

SEQ ID NO: 2296639 - RNA, 18 nt, Yersinia pestis KIM
uugauuuguuaaaacagu

SEQ ID NO: 2296640 - RNA, 16 nt, Yersinia pestis KIM
uugauuuucauuucau

SEQ ID NO: 2296641 - RNA, 17 nt, Yersinia pestis KIM
uugcaauugggguaaau

SEQ ID NO: 2296642 - RNA, 21 nt, Yersinia pestis KIM
uugcaauuaauuggcccauaa

SEQ ID NO: 2296643 - RNA, 12 nt, Yersinia pestis KIM
uugcagcggaac

SEQ ID NO: 2296644 - RNA, 14 nt, Yersinia pestis KIM
uugaugaguaaaca

SEQ ID NO: 2296645 - RNA, 16 nt, Yersinia pestis KIM
uugaugaguaaacaga

SEQ ID NO: 2296646 - RNA, 15 nt, Yersinia pestis KIM
uugaugcauauguag

SEQ ID NO: 2296647 - RNA, 16 nt, Yersinia pestis KIM
uugaugauuugaccga

SEQ ID NO: 2296648 - RNA, 17 nt, Yersinia pestis KIM
uugaugcaaaaccguac

SEQ ID NO: 2296649 - RNA, 13 nt, Yersinia pestis KIM
uugauugauaacg

SEQ ID NO: 2296650 - RNA, 13 nt, Yersinia pestis KIM
uugauugcaaaac

SEQ ID NO: 2296651 - RNA, 16 nt, Yersinia pestis KIM
uugauugcaaaacaua

SEQ ID NO: 2296652 - RNA, 17 nt, Yersinia pestis KIM
uugauugcugacaaacc

SEQ ID NO: 2296653 - RNA, 14 nt, Yersinia pestis KIM
uugaugccaaggcc

SEQ ID NO: 2296654 - RNA, 18 nt, Yersinia pestis KIM
uugauaaaaaucuuuuaa

SEQ ID NO: 2296655 - RNA, 18 nt, Yersinia pestis KIM
uugauaucuucggcggcu

SEQ ID NO: 2296656 - RNA, 21 nt, Yersinia pestis KIM
uugaucggauagcuuagccca

SEQ ID NO: 2296657 - RNA, 18 nt, Yersinia pestis KIM
uugaucaaacgaaacuaa

SEQ ID NO: 2296658 - RNA, 14 nt, Yersinia pestis KIM
uugaguauacuaaa

SEQ ID NO: 2296659 - RNA, 19 nt, Yersinia pestis KIM
uugaguaagacaacuuauu

SEQ ID NO: 2296660 - RNA, 20 nt, Yersinia pestis KIM
uugagaaguuauucauugcc

SEQ ID NO: 2296661 - RNA, 22 nt, Yersinia pestis KIM
uugagccaccgagguuaucagc

SEQ ID NO: 2296662 - RNA, 15 nt, Yersinia pestis KIM
uugagcuauuucuug

SEQ ID NO: 2296663 - RNA, 23 nt, Yersinia pestis KIM
uugagcggugaauacguucaaau

SEQ ID NO: 2296664 - RNA, 16 nt, Yersinia pestis KIM
uucuuucuucagcggu

SEQ ID NO: 2296665 - RNA, 11 nt, Yersinia pestis KIM
uucuuucuuca

SEQ ID NO: 2296666 - RNA, 23 nt, Yersinia pestis KIM
uucuuguaaaucuugagcuauuu

SEQ ID NO: 2296667 - RNA, 11 nt, Yersinia pestis KIM
uugaaccauaa

SEQ ID NO: 2296668 - RNA, 18 nt, Yersinia pestis KIM
uugaaccgcuaucugcug

SEQ ID NO: 2296669 - RNA, 20 nt, Yersinia pestis KIM
uugaacgacaugugaguggu

SEQ ID NO: 2296670 - RNA, 20 nt, Yersinia pestis KIM
uugaaccaauuuuucuguau

SEQ ID NO: 2296671 - RNA, 17 nt, Yersinia pestis KIM
uugaacauucaucuuuu

SEQ ID NO: 2296672 - RNA, 19 nt, Yersinia pestis KIM
uugaaaguuuauaugcuug

SEQ ID NO: 2296673 - RNA, 22 nt, Yersinia pestis KIM
uugaaauaagaggcaaagguaa

SEQ ID NO: 2296674 - RNA, 22 nt, Yersinia pestis KIM
uugaccgcuguuugauuaaaac

SEQ ID NO: 2296675 - RNA, 17 nt, Yersinia pestis KIM
uugacuuuaaaaaaauu

SEQ ID NO: 2296676 - RNA, 16 nt, Yersinia pestis KIM
uugaacggugaggaua

SEQ ID NO: 2296677 - RNA, 20 nt, Yersinia pestis KIM
uugaacggugaggauaggca

SEQ ID NO: 2296678 - RNA, 15 nt, Yersinia pestis KIM
uugaacgugccccaa

SEQ ID NO: 2296679 - RNA, 22 nt, Yersinia pestis KIM
uugaacuguggcaugacugaug

SEQ ID NO: 2296680 - RNA, 19 nt, Yersinia pestis KIM
uugaauucaagaaggccgu

SEQ ID NO: 2296681 - RNA, 14 nt, Yersinia pestis KIM
uugaauuaaauuuu

SEQ ID NO: 2296682 - RNA, 16 nt, Yersinia pestis KIM
uugaauuaaauuuuau

SEQ ID NO: 2296683 - RNA, 22 nt, Yersinia pestis KIM
uugaauucaccaaauugcagaa

SEQ ID NO: 2296684 - RNA, 14 nt, Yersinia pestis KIM
uuguugcucaacau

SEQ ID NO: 2296685 - RNA, 21 nt, Yersinia pestis KIM
uuguugccuuucuguaacuca

SEQ ID NO: 2296686 - RNA, 16 nt, Yersinia pestis KIM
uuguuucaauaaaucc

SEQ ID NO: 2296687 - RNA, 21 nt, Yersinia pestis KIM
uuguuucaauaaaucccgcuu

SEQ ID NO: 2296688 - RNA, 12 nt, Yersinia pestis KIM
uuguugcaauac

SEQ ID NO: 2296689 - RNA, 12 nt, Yersinia pestis KIM
uuguuauuacug

SEQ ID NO: 2296690 - RNA, 13 nt, Yersinia pestis KIM
uuguuauuacuaa

SEQ ID NO: 2296691 - RNA, 17 nt, Yersinia pestis KIM
uuguucacggcuuugcu

SEQ ID NO: 2296692 - RNA, 15 nt, Yersinia pestis KIM
uuguucagagauaau

SEQ ID NO: 2296693 - RNA, 16 nt, Yersinia pestis KIM
uuguucaggcagauaa

SEQ ID NO: 2296694 - RNA, 16 nt, Yersinia pestis KIM
uuguuaucaucaccac

SEQ ID NO: 2296695 - RNA, 16 nt, Yersinia pestis KIM
uuguuaucgaacaucu

SEQ ID NO: 2296696 - RNA, 12 nt, Yersinia pestis KIM
uugugugaguug

SEQ ID NO: 2296697 - RNA, 16 nt, Yersinia pestis KIM
uuguguaucccccuca

SEQ ID NO: 2296698 - RNA, 22 nt, Yersinia pestis KIM
uugugucaauaccuuacuguau

SEQ ID NO: 2296699 - RNA, 20 nt, Yersinia pestis KIM
uugugagugacaugcuuaau

SEQ ID NO: 2296700 - RNA, 16 nt, Yersinia pestis KIM
uugucuuuaauaaaau

SEQ ID NO: 2296701 - RNA, 22 nt, Yersinia pestis KIM
uugucuucuuuugggauaaaau

SEQ ID NO: 2296702 - RNA, 11 nt, Yersinia pestis KIM
uuguauuuugu

SEQ ID NO: 2296703 - RNA, 22 nt, Yersinia pestis KIM
uugucaauaaccucagccucau

SEQ ID NO: 2296704 - RNA, 24 nt, Yersinia pestis KIM
uugucaauaaccucuaaucuccuc

SEQ ID NO: 2296705 - RNA, 19 nt, Yersinia pestis KIM
uuguauugauaaaaauauc

SEQ ID NO: 2296706 - RNA, 15 nt, Yersinia pestis KIM
uuguaacucaauaau

SEQ ID NO: 2296707 - RNA, 16 nt, Yersinia pestis KIM
uuuaagcugucuaaau

SEQ ID NO: 2296708 - RNA, 17 nt, Yersinia pestis KIM
uuuaagcugucuaaauu

SEQ ID NO: 2296709 - RNA, 19 nt, Yersinia pestis KIM
uuuaagcugucuaaauugc

SEQ ID NO: 2296710 - RNA, 18 nt, Yersinia pestis KIM
uuuaagcgccuuaagaga

SEQ ID NO: 2296711 - RNA, 14 nt, Yersinia pestis KIM
uuuaagcugaaauu

SEQ ID NO: 2296712 - RNA, 18 nt, Yersinia pestis KIM
uuuaauaugacuagauau

SEQ ID NO: 2296713 - RNA, 19 nt, Yersinia pestis KIM
uuuaauagccaaaauaauu

SEQ ID NO: 2296714 - RNA, 18 nt, Yersinia pestis KIM
uuuaaugcuguuuuguca

SEQ ID NO: 2296715 - RNA, 18 nt, Yersinia pestis KIM
uuuaauccacuuuucaga

SEQ ID NO: 2296716 - RNA, 21 nt, Yersinia pestis KIM
uuuaaugaguuggcauucuag

SEQ ID NO: 2296717 - RNA, 14 nt, Yersinia pestis KIM
uuuaaugaaaacua

SEQ ID NO: 2296718 - RNA, 19 nt, Yersinia pestis KIM
uuuaccgcagggcguucag

SEQ ID NO: 2296719 - RNA, 19 nt, Yersinia pestis KIM
uuuacaugauugaaaaaca

SEQ ID NO: 2296720 - RNA, 23 nt, Yersinia pestis KIM
uuuaccacgucuaauugcugccc

SEQ ID NO: 2296721 - RNA, 17 nt, Yersinia pestis KIM
uuuaaagaagaauccac

SEQ ID NO: 2296722 - RNA, 18 nt, Yersinia pestis KIM
uuuaaacacucaauaagu

SEQ ID NO: 2296723 - RNA, 13 nt, Yersinia pestis KIM
uuuaaaaaauauc

SEQ ID NO: 2296724 - RNA, 15 nt, Yersinia pestis KIM
uuguuuguaaauuuu

SEQ ID NO: 2296725 - RNA, 20 nt, Yersinia pestis KIM
uuguuugaauuuuagucaaa

SEQ ID NO: 2296726 - RNA, 22 nt, Yersinia pestis KIM
uuuaaauucaauccauugaucu

SEQ ID NO: 2296727 - RNA, 21 nt, Yersinia pestis KIM
uuuaaauuacgguuuaccacc

SEQ ID NO: 2296728 - RNA, 20 nt, Yersinia pestis KIM
uuuaaagccuguaaaauaua

SEQ ID NO: 2296729 - RNA, 13 nt, Yersinia pestis KIM
uuuaagaaaucua

SEQ ID NO: 2296730 - RNA, 23 nt, Yersinia pestis KIM
uuuaagaaaucuauuaauauacc

SEQ ID NO: 2296731 - RNA, 12 nt, Yersinia pestis KIM
uuuaagaaaucu

SEQ ID NO: 2296732 - RNA, 14 nt, Yersinia pestis KIM
uuuaagcaauuuag

SEQ ID NO: 2296733 - RNA, 15 nt, Yersinia pestis KIM
uugcuugccagcgcu

SEQ ID NO: 2296734 - RNA, 17 nt, Yersinia pestis KIM
uugcuugccagcgcuuu

SEQ ID NO: 2296735 - RNA, 18 nt, Yersinia pestis KIM
uugcuugauagcgggcag

SEQ ID NO: 2296736 - RNA, 14 nt, Yersinia pestis KIM
uuggaacaggccaa

SEQ ID NO: 2296737 - RNA, 15 nt, Yersinia pestis KIM
uuggaaaugacaaau

SEQ ID NO: 2296738 - RNA, 18 nt, Yersinia pestis KIM
uugcuguaaugccuggug

SEQ ID NO: 2296739 - RNA, 17 nt, Yersinia pestis KIM
uugcuucacggacagca

SEQ ID NO: 2296740 - RNA, 17 nt, Yersinia pestis KIM
uuggaucaucgggaaca

SEQ ID NO: 2296741 - RNA, 20 nt, Yersinia pestis KIM
uuggauaauaaccugauauu

SEQ ID NO: 2296742 - RNA, 14 nt, Yersinia pestis KIM
uuggcaaaaauaau

SEQ ID NO: 2296743 - RNA, 22 nt, Yersinia pestis KIM
uuggcccacuggccugagaacc

SEQ ID NO: 2296744 - RNA, 21 nt, Yersinia pestis KIM
uuggccauuaaccuaaaaacg

SEQ ID NO: 2296745 - RNA, 16 nt, Yersinia pestis KIM
uuggggguguuacauc

SEQ ID NO: 2296746 - RNA, 19 nt, Yersinia pestis KIM
uugguuugacauacucuuc

SEQ ID NO: 2296747 - RNA, 14 nt, Yersinia pestis KIM
uugguuggcuuuaa

SEQ ID NO: 2296748 - RNA, 19 nt, Yersinia pestis KIM
uuggucaguugaauauucc

SEQ ID NO: 2296749 - RNA, 17 nt, Yersinia pestis KIM
uuggucucagaacaaga

SEQ ID NO: 2296750 - RNA, 18 nt, Yersinia pestis KIM
uugguaaaauauuuugcu

SEQ ID NO: 2296751 - RNA, 13 nt, Yersinia pestis KIM
uugguaacgcaga

SEQ ID NO: 2296752 - RNA, 18 nt, Yersinia pestis KIM
uugguaauacugagaccu

SEQ ID NO: 2296753 - RNA, 22 nt, Yersinia pestis KIM
uugggucgaucuguugauaaaa

SEQ ID NO: 2296754 - RNA, 13 nt, Yersinia pestis KIM
uuggguauaggcc

SEQ ID NO: 2296755 - RNA, 20 nt, Yersinia pestis KIM
uugcuaaauuuuguacaacu

SEQ ID NO: 2296756 - RNA, 22 nt, Yersinia pestis KIM
uugcuacuggaauauuccauac

SEQ ID NO: 2296757 - RNA, 14 nt, Yersinia pestis KIM
uugcuacuggccug

SEQ ID NO: 2296758 - RNA, 18 nt, Yersinia pestis KIM
uugcuauauuuuuuauau

SEQ ID NO: 2296759 - RNA, 21 nt, Yersinia pestis KIM
uugcuaugagcgcuguugcaa

SEQ ID NO: 2296760 - RNA, 18 nt, Yersinia pestis KIM
uugcuauuaaacauuuau

SEQ ID NO: 2296761 - RNA, 18 nt, Yersinia pestis KIM
uugcuauugaacauucau

SEQ ID NO: 2296762 - RNA, 19 nt, Yersinia pestis KIM
uugcgccacaacccaauaa

SEQ ID NO: 2296763 - RNA, 19 nt, Yersinia pestis KIM
uugcgcaaaauuaagacau

SEQ ID NO: 2296764 - RNA, 21 nt, Yersinia pestis KIM
uugcggcgcacccuccaauaa

SEQ ID NO: 2296765 - RNA, 14 nt, Yersinia pestis KIM
uugcggcaccugcc

SEQ ID NO: 2296766 - RNA, 22 nt, Yersinia pestis KIM
uugcggaguaacacuucagacu

SEQ ID NO: 2296767 - RNA, 16 nt, Yersinia pestis KIM
uugccguguaagaacu

SEQ ID NO: 2296768 - RNA, 21 nt, Yersinia pestis KIM
uugccugacagccugugccca

SEQ ID NO: 2296769 - RNA, 22 nt, Yersinia pestis KIM
uugccauuuuaaucagaaaauu

SEQ ID NO: 2296770 - RNA, 14 nt, Yersinia pestis KIM
uugcccaacuugua

SEQ ID NO: 2296771 - RNA, 17 nt, Yersinia pestis KIM
uugcccaccgacgccac

SEQ ID NO: 2296772 - RNA, 18 nt, Yersinia pestis KIM
uugccagugaaucagcca

SEQ ID NO: 2296773 - RNA, 21 nt, Yersinia pestis KIM
uugccaucuuguucuaauaau

SEQ ID NO: 2296774 - RNA, 13 nt, Yersinia pestis KIM
uugcauacucagg

SEQ ID NO: 2296775 - RNA, 21 nt, Yersinia pestis KIM
uugcaggcacuuugucaauaa

SEQ ID NO: 2296776 - RNA, 20 nt, Yersinia pestis KIM
uuccugcgccacgcuuuagc

SEQ ID NO: 2296777 - RNA, 18 nt, Yersinia pestis KIM
uuccugggccaguuucca

SEQ ID NO: 2296778 - RNA, 13 nt, Yersinia pestis KIM
uuccuuccucuuu

SEQ ID NO: 2296779 - RNA, 22 nt, Yersinia pestis KIM
uuccuuugcccuuacuauuuuu

SEQ ID NO: 2296780 - RNA, 21 nt, Yersinia pestis KIM
uuccuuuauuuuucauucuau

SEQ ID NO: 2296781 - RNA, 15 nt, Yersinia pestis KIM
uucgaaagaaauaaa

SEQ ID NO: 2296782 - RNA, 21 nt, Yersinia pestis KIM
uucgaaagaaauaaaagaaaa

SEQ ID NO: 2296783 - RNA, 21 nt, Yersinia pestis KIM
uuccggcugcgccauaugcca

SEQ ID NO: 2296784 - RNA, 17 nt, Yersinia pestis KIM
uuccgucccaagaaaag

SEQ ID NO: 2296785 - RNA, 21 nt, Yersinia pestis KIM
uuccucgugaaaaauaauguu

SEQ ID NO: 2296786 - RNA, 22 nt, Yersinia pestis KIM
uuccucgugaaaaauaauguuc

SEQ ID NO: 2296787 - RNA, 17 nt, Yersinia pestis KIM
uuccucugugacucuau

SEQ ID NO: 2296788 - RNA, 15 nt, Yersinia pestis KIM
uucgaguugaacuca

SEQ ID NO: 2296789 - RNA, 23 nt, Yersinia pestis KIM
uucgagguggcgauaaagaguga

SEQ ID NO: 2296790 - RNA, 21 nt, Yersinia pestis KIM
uucgagguggcgauaaagagu

SEQ ID NO: 2296791 - RNA, 15 nt, Yersinia pestis KIM
uucgagcaacuuuua

SEQ ID NO: 2296792 - RNA, 14 nt, Yersinia pestis KIM
uucgagcaccgcgc

SEQ ID NO: 2296793 - RNA, 19 nt, Yersinia pestis KIM
uucgacaggcaauuaucca

SEQ ID NO: 2296794 - RNA, 17 nt, Yersinia pestis KIM
uucgaccaaacguuuua

SEQ ID NO: 2296795 - RNA, 20 nt, Yersinia pestis KIM
uucgaccaauaauaggguca

SEQ ID NO: 2296796 - RNA, 22 nt, Yersinia pestis KIM
uucgaaagaaauaaaagaaaac

SEQ ID NO: 2296797 - RNA, 22 nt, Yersinia pestis KIM
uucgaagggaauaaugguauuu

SEQ ID NO: 2296798 - RNA, 13 nt, Yersinia pestis KIM
uucgaugauuauu

SEQ ID NO: 2296799 - RNA, 18 nt, Yersinia pestis KIM
uucgaguugaacucauau

SEQ ID NO: 2296800 - RNA, 13 nt, Yersinia pestis KIM
uucgauaacagcu

SEQ ID NO: 2296801 - RNA, 22 nt, Yersinia pestis KIM
uucgauaugaucagauuucuga

SEQ ID NO: 2296802 - RNA, 14 nt, Yersinia pestis KIM
uucgaucaaaacaa

SEQ ID NO: 2296803 - RNA, 19 nt, Yersinia pestis KIM
uucgauagucagcuucacu

SEQ ID NO: 2296804 - RNA, 16 nt, Yersinia pestis KIM
uucgcacuuuaaauac

SEQ ID NO: 2296805 - RNA, 15 nt, Yersinia pestis KIM
uucgcagccaaaaua

SEQ ID NO: 2296806 - RNA, 18 nt, Yersinia pestis KIM
uucgcagaccaaauuccc

SEQ ID NO: 2296807 - RNA, 23 nt, Yersinia pestis KIM
uucgcaaagcgggccagcaacca

SEQ ID NO: 2296808 - RNA, 22 nt, Yersinia pestis KIM
uucgauuugaucgaccacgccc

SEQ ID NO: 2296809 - RNA, 17 nt, Yersinia pestis KIM
uucgcgaucagacauuu

SEQ ID NO: 2296810 - RNA, 17 nt, Yersinia pestis KIM
uucgcuauuucucucua

SEQ ID NO: 2296811 - RNA, 15 nt, Yersinia pestis KIM
uucgcguuucauuuu

SEQ ID NO: 2296812 - RNA, 23 nt, Yersinia pestis KIM
uucgcugaaaucaggcuguucuu

SEQ ID NO: 2296813 - RNA, 20 nt, Yersinia pestis KIM
uucgcuggucauaaucaucu

SEQ ID NO: 2296814 - RNA, 14 nt, Yersinia pestis KIM
uucgcuuuacccug

SEQ ID NO: 2296815 - RNA, 16 nt, Yersinia pestis KIM
uucgcagcuuccagca

SEQ ID NO: 2296816 - RNA, 23 nt, Yersinia pestis KIM
uucgcaggauugauuaaccgauu

SEQ ID NO: 2296817 - RNA, 15 nt, Yersinia pestis KIM
uucgcaucuuccaaa

SEQ ID NO: 2296818 - RNA, 11 nt, Yersinia pestis KIM
uucgccccuua

SEQ ID NO: 2296819 - RNA, 22 nt, Yersinia pestis KIM
uuccgcgcaggauuucaauaua

SEQ ID NO: 2296820 - RNA, 18 nt, Yersinia pestis KIM
uuccgccgccaacaguga

SEQ ID NO: 2296821 - RNA, 18 nt, Yersinia pestis KIM
uucccguaggcugaccac

SEQ ID NO: 2296822 - RNA, 14 nt, Yersinia pestis KIM
uucccucugccuga

SEQ ID NO: 2296823 - RNA, 20 nt, Yersinia pestis KIM
uucccucaauagcuaauaau

SEQ ID NO: 2296824 - RNA, 21 nt, Yersinia pestis KIM
uuccauuggagauccguuuuu

SEQ ID NO: 2296825 - RNA, 18 nt, Yersinia pestis KIM
uuccauuuaagccaauaa

SEQ ID NO: 2296826 - RNA, 18 nt, Yersinia pestis KIM
uuccauuuuauuuaacgu

SEQ ID NO: 2296827 - RNA, 17 nt, Yersinia pestis KIM
uuccccuaauucuccuu

SEQ ID NO: 2296828 - RNA, 19 nt, Yersinia pestis KIM
uucccgauggaacaggauu

SEQ ID NO: 2296829 - RNA, 20 nt, Yersinia pestis KIM
uucccgauuauugugccgcc

SEQ ID NO: 2296830 - RNA, 23 nt, Yersinia pestis KIM
uucccaguaagcucuacuaauau

SEQ ID NO: 2296831 - RNA, 20 nt, Yersinia pestis KIM
uucccaguaagcucuacuaa

SEQ ID NO: 2296832 - RNA, 22 nt, Yersinia pestis KIM
uuccccaccauugcaaacauca

SEQ ID NO: 2296833 - RNA, 12 nt, Yersinia pestis KIM
uuccccagccca

SEQ ID NO: 2296834 - RNA, 16 nt, Yersinia pestis KIM
uuccacaauguugaua

SEQ ID NO: 2296835 - RNA, 16 nt, Yersinia pestis KIM
uuccaauuggugcuuu

SEQ ID NO: 2296836 - RNA, 17 nt, Yersinia pestis KIM
uuccaaugucaguggcg

SEQ ID NO: 2296837 - RNA, 22 nt, Yersinia pestis KIM
uuccacgaaggcacccaugcuc

SEQ ID NO: 2296838 - RNA, 23 nt, Yersinia pestis KIM
uuccaaaugacagcaucaauauc

SEQ ID NO: 2296839 - RNA, 16 nt, Yersinia pestis KIM
uuccaaaggaagggau

SEQ ID NO: 2296840 - RNA, 13 nt, Yersinia pestis KIM
uuccaacuccauc

SEQ ID NO: 2296841 - RNA, 21 nt, Yersinia pestis KIM
uuccaacaucucgccaaagua

SEQ ID NO: 2296842 - RNA, 12 nt, Yersinia pestis KIM
uuccagcggcaa

SEQ ID NO: 2296843 - RNA, 12 nt, Yersinia pestis KIM
uuccagcggcau

SEQ ID NO: 2296844 - RNA, 13 nt, Yersinia pestis KIM
uuccaguaaaaaa

SEQ ID NO: 2296845 - RNA, 15 nt, Yersinia pestis KIM
uuccaguaaaaaaau

SEQ ID NO: 2296846 - RNA, 18 nt, Yersinia pestis KIM
uuccaguucgauauuauu

SEQ ID NO: 2296847 - RNA, 18 nt, Yersinia pestis KIM
uuccaucacugcauuauc

SEQ ID NO: 2296848 - RNA, 15 nt, Yersinia pestis KIM
uuccaucgucaauuc

SEQ ID NO: 2296849 - RNA, 23 nt, Yersinia pestis KIM
uuccauaaacggaacucaucuuu

SEQ ID NO: 2296850 - RNA, 19 nt, Yersinia pestis KIM
uuccauacuguugcuaggc

SEQ ID NO: 2296851 - RNA, 14 nt, Yersinia pestis KIM
uucacccauuaaua

SEQ ID NO: 2296852 - RNA, 23 nt, Yersinia pestis KIM
uucacccuuggcuaccagagaac

SEQ ID NO: 2296853 - RNA, 18 nt, Yersinia pestis KIM
uucaccgcuuuucuggua

SEQ ID NO: 2296854 - RNA, 23 nt, Yersinia pestis KIM
uucaccgugacuguuaacaucca

SEQ ID NO: 2296855 - RNA, 23 nt, Yersinia pestis KIM
uucaccguaucaucaccaaacag

SEQ ID NO: 2296856 - RNA, 20 nt, Yersinia pestis KIM
uucacgcaucacaucuugca

SEQ ID NO: 2296857 - RNA, 14 nt, Yersinia pestis KIM
uucacuuaucccuu

SEQ ID NO: 2296858 - RNA, 18 nt, Yersinia pestis KIM
uucacuuauucccacuua

SEQ ID NO: 2296859 - RNA, 21 nt, Yersinia pestis KIM
uucacuggccuauuaagauaa

SEQ ID NO: 2296860 - RNA, 19 nt, Yersinia pestis KIM
uucacucuguuuuaaaaaa

SEQ ID NO: 2296861 - RNA, 22 nt, Yersinia pestis KIM
uucacuccggcaucauccucau

SEQ ID NO: 2296862 - RNA, 15 nt, Yersinia pestis KIM
uucacugaaucccag

SEQ ID NO: 2296863 - RNA, 19 nt, Yersinia pestis KIM
uucacuccuugaaguguuu

SEQ ID NO: 2296864 - RNA, 20 nt, Yersinia pestis KIM
uucacguuuuuccauucgca

SEQ ID NO: 2296865 - RNA, 15 nt, Yersinia pestis KIM
uucacguugguauac

SEQ ID NO: 2296866 - RNA, 20 nt, Yersinia pestis KIM
uucacuauuuauuaaucuau

SEQ ID NO: 2296867 - RNA, 21 nt, Yersinia pestis KIM
uucacuauaauuucucucaau

SEQ ID NO: 2296868 - RNA, 12 nt, Yersinia pestis KIM
uucacggauauc

SEQ ID NO: 2296869 - RNA, 17 nt, Yersinia pestis KIM
uucacggcaccaaccau

SEQ ID NO: 2296870 - RNA, 15 nt, Yersinia pestis KIM
uucagcaagccaaua

SEQ ID NO: 2296871 - RNA, 15 nt, Yersinia pestis KIM
uucagaggaaagaga

SEQ ID NO: 2296872 - RNA, 16 nt, Yersinia pestis KIM
uucagcacgcuuucca

SEQ ID NO: 2296873 - RNA, 21 nt, Yersinia pestis KIM
uucagcaggggcaaccucuuc

SEQ ID NO: 2296874 - RNA, 16 nt, Yersinia pestis KIM
uucagcauaaauauuc

SEQ ID NO: 2296875 - RNA, 19 nt, Yersinia pestis KIM
uucagaaaacccccugcua

SEQ ID NO: 2296876 - RNA, 20 nt, Yersinia pestis KIM
uucagacggcagauccugaa

SEQ ID NO: 2296877 - RNA, 10 nt, Yersinia pestis KIM
uucagacucc

SEQ ID NO: 2296878 - RNA, 14 nt, Yersinia pestis KIM
uucagacugaaagu

SEQ ID NO: 2296879 - RNA, 21 nt, Yersinia pestis KIM
uucagacggcagauccugaac

SEQ ID NO: 2296880 - RNA, 19 nt, Yersinia pestis KIM
uucagacgguugcuagagc

SEQ ID NO: 2296881 - RNA, 22 nt, Yersinia pestis KIM
uucagacugaaaguagaaauaa

SEQ ID NO: 2296882 - RNA, 17 nt, Yersinia pestis KIM
uucagacugaaaugaca

SEQ ID NO: 2296883 - RNA, 20 nt, Yersinia pestis KIM
uucacagcagaacaaaacaa

SEQ ID NO: 2296884 - RNA, 12 nt, Yersinia pestis KIM
uucaccaaaaaa

SEQ ID NO: 2296885 - RNA, 14 nt, Yersinia pestis KIM
uucaccaaaaaaac

SEQ ID NO: 2296886 - RNA, 19 nt, Yersinia pestis KIM
uucaccaaaggaagccgag

SEQ ID NO: 2296887 - RNA, 21 nt, Yersinia pestis KIM
uucaccaaaaaaaccaccaaa

SEQ ID NO: 2296888 - RNA, 20 nt, Yersinia pestis KIM
uucacccaggcugugguggc

SEQ ID NO: 2296889 - RNA, 18 nt, Yersinia pestis KIM
uucacccauaccaaccau

SEQ ID NO: 2296890 - RNA, 15 nt, Yersinia pestis KIM
uucaccaucugccug

SEQ ID NO: 2296891 - RNA, 12 nt, Yersinia pestis KIM
uucaccaaacag

SEQ ID NO: 2296892 - RNA, 16 nt, Yersinia pestis KIM
uucaccaauacaaaca

SEQ ID NO: 2296893 - RNA, 22 nt, Yersinia pestis KIM
uucacaagccaaacaaaugaac

SEQ ID NO: 2296894 - RNA, 19 nt, Yersinia pestis KIM
uucacacugguaguaaucg

SEQ ID NO: 2296895 - RNA, 20 nt, Yersinia pestis KIM
uucaauucucccauuuauua

SEQ ID NO: 2296896 - RNA, 16 nt, Yersinia pestis KIM
uucaauuccugauauu

SEQ ID NO: 2296897 - RNA, 19 nt, Yersinia pestis KIM
uucaagccgcgccaucucu

SEQ ID NO: 2296898 - RNA, 13 nt, Yersinia pestis KIM
uucaagugcucac

SEQ ID NO: 2296899 - RNA, 21 nt, Yersinia pestis KIM
uucaauacuggccaugugugu

SEQ ID NO: 2296900 - RNA, 22 nt, Yersinia pestis KIM
uucaauaacaccgucuuugacc

SEQ ID NO: 2296901 - RNA, 18 nt, Yersinia pestis KIM
uucaaugcgcccaagccu

SEQ ID NO: 2296902 - RNA, 18 nt, Yersinia pestis KIM
uucaaugacuccugaaau

SEQ ID NO: 2296903 - RNA, 21 nt, Yersinia pestis KIM
uucaaugacuccugaaauaaa

SEQ ID NO: 2296904 - RNA, 16 nt, Yersinia pestis KIM
uucaauccuacaauau

SEQ ID NO: 2296905 - RNA, 18 nt, Yersinia pestis KIM
uucauaaauuaaaacuga

SEQ ID NO: 2296906 - RNA, 17 nt, Yersinia pestis KIM
uucaguuuuaauuuaug

SEQ ID NO: 2296907 - RNA, 16 nt, Yersinia pestis KIM
uucagucgcgauaaaa

SEQ ID NO: 2296908 - RNA, 23 nt, Yersinia pestis KIM
uucagugauaacaacccuaacac

SEQ ID NO: 2296909 - RNA, 18 nt, Yersinia pestis KIM
uucagugccaauaauuca

SEQ ID NO: 2296910 - RNA, 19 nt, Yersinia pestis KIM
uucagugcgauguuuucca

SEQ ID NO: 2296911 - RNA, 20 nt, Yersinia pestis KIM
uucaguuuauuuaagcugaa

SEQ ID NO: 2296912 - RNA, 16 nt, Yersinia pestis KIM
uucaguuggccaccau

SEQ ID NO: 2296913 - RNA, 21 nt, Yersinia pestis KIM
uucaguucuucacgaagaauu

SEQ ID NO: 2296914 - RNA, 17 nt, Yersinia pestis KIM
uucauaugcgccuauaa

SEQ ID NO: 2296915 - RNA, 19 nt, Yersinia pestis KIM
uucauaugcgccuauaagg

SEQ ID NO: 2296916 - RNA, 19 nt, Yersinia pestis KIM
uucauaucgauaccgauaa

SEQ ID NO: 2296917 - RNA, 22 nt, Yersinia pestis KIM
uucaucaauagguguugccggc

SEQ ID NO: 2296918 - RNA, 21 nt, Yersinia pestis KIM
uucaucaaucgagaagaauuu

SEQ ID NO: 2296919 - RNA, 20 nt, Yersinia pestis KIM
uucauaccuuaauuaacucu

SEQ ID NO: 2296920 - RNA, 22 nt, Yersinia pestis KIM
uucauaauugaagaguugaucc

SEQ ID NO: 2296921 - RNA, 21 nt, Yersinia pestis KIM
uucauacugccgaccauaucu

SEQ ID NO: 2296922 - RNA, 14 nt, Yersinia pestis KIM
uucauagcgugcag

SEQ ID NO: 2296923 - RNA, 22 nt, Yersinia pestis KIM
uucagcucuucuaacacuucau

SEQ ID NO: 2296924 - RNA, 14 nt, Yersinia pestis KIM
uucagcucugccag

SEQ ID NO: 2296925 - RNA, 17 nt, Yersinia pestis KIM
uucagcguuuuauuugg

SEQ ID NO: 2296926 - RNA, 18 nt, Yersinia pestis KIM
uucaggaauaaacagcag

SEQ ID NO: 2296927 - RNA, 22 nt, Yersinia pestis KIM
uucaggaaugguguaaaugccc

SEQ ID NO: 2296928 - RNA, 17 nt, Yersinia pestis KIM
uucagccuauccucacc

SEQ ID NO: 2296929 - RNA, 16 nt, Yersinia pestis KIM
uucagccuauccucac

SEQ ID NO: 2296930 - RNA, 16 nt, Yersinia pestis KIM
uucagccgccagccau

SEQ ID NO: 2296931 - RNA, 18 nt, Yersinia pestis KIM
uucaggaucgaucuggau

SEQ ID NO: 2296932 - RNA, 16 nt, Yersinia pestis KIM
uucaggcagauaaauc

SEQ ID NO: 2296933 - RNA, 20 nt, Yersinia pestis KIM
uucaggccaagugcuuuuuu

SEQ ID NO: 2296934 - RNA, 19 nt, Yersinia pestis KIM
uucagggcguauaaacaga

SEQ ID NO: 2296935 - RNA, 15 nt, Yersinia pestis KIM
uucaguacauaaacc

SEQ ID NO: 2296936 - RNA, 17 nt, Yersinia pestis KIM
uucaguagcgucaguuu

SEQ ID NO: 2296937 - RNA, 22 nt, Yersinia pestis KIM
uucagguuuacgcuuuugccuu

SEQ ID NO: 2296938 - RNA, 20 nt, Yersinia pestis KIM
uucaguaaagcuuucagcuu

SEQ ID NO: 2296939 - RNA, 22 nt, Yersinia pestis KIM
uucagguaagcagagaauuuca

SEQ ID NO: 2296940 - RNA, 20 nt, Yersinia pestis KIM
uucauuaauuaauaagccca

SEQ ID NO: 2296941 - RNA, 21 nt, Yersinia pestis KIM
uucauucuauuauuuaacccc

SEQ ID NO: 2296942 - RNA, 13 nt, Yersinia pestis KIM
uucauuuuaaaaa

SEQ ID NO: 2296943 - RNA, 14 nt, Yersinia pestis KIM
uucauuuugaccag

SEQ ID NO: 2296944 - RNA, 12 nt, Yersinia pestis KIM
uucauuucaggu

SEQ ID NO: 2296945 - RNA, 20 nt, Yersinia pestis KIM
uucauuuacuugauaauugc

SEQ ID NO: 2296946 - RNA, 16 nt, Yersinia pestis KIM
uucaucggcaaaaaca

SEQ ID NO: 2296947 - RNA, 15 nt, Yersinia pestis KIM
uucaugacaaauugc

SEQ ID NO: 2296948 - RNA, 17 nt, Yersinia pestis KIM
uucauccgcagcaaaac

SEQ ID NO: 2296949 - RNA, 21 nt, Yersinia pestis KIM
uucauccuguaccgcgcuuuu

SEQ ID NO: 2296950 - RNA, 16 nt, Yersinia pestis KIM
uucaucgcccuguaac

SEQ ID NO: 2296951 - RNA, 16 nt, Yersinia pestis KIM
uucaucaccagucagc

SEQ ID NO: 2296952 - RNA, 15 nt, Yersinia pestis KIM
uucaucagcccagcg

SEQ ID NO: 2296953 - RNA, 18 nt, Yersinia pestis KIM
uucaucagcguuacccag

SEQ ID NO: 2296954 - RNA, 20 nt, Yersinia pestis KIM
uucaucacccaucaauaauu

SEQ ID NO: 2296955 - RNA, 16 nt, Yersinia pestis KIM
uucaucaccuuaucca

SEQ ID NO: 2296956 - RNA, 18 nt, Yersinia pestis KIM
uucauccaacuuaccuug

SEQ ID NO: 2296957 - RNA, 20 nt, Yersinia pestis KIM
uucaucauggauaaagccuu

SEQ ID NO: 2296958 - RNA, 15 nt, Yersinia pestis KIM
uucaucauccauaaa

SEQ ID NO: 2296959 - RNA, 11 nt, Yersinia pestis KIM
uucaucaucaa

SEQ ID NO: 2296960 - RNA, 21 nt, Yersinia pestis KIM
ugggccacgaugugaagcaau

SEQ ID NO: 2296961 - RNA, 14 nt, Yersinia pestis KIM
ugggcgcagaagaa

SEQ ID NO: 2296962 - RNA, 22 nt, Yersinia pestis KIM
uggcuugcaaucagaggccauc

SEQ ID NO: 2296963 - RNA, 17 nt, Yersinia pestis KIM
uggcuugcuugauggca

SEQ ID NO: 2296964 - RNA, 16 nt, Yersinia pestis KIM
uggcuucaaaaucacc

SEQ ID NO: 2296965 - RNA, 13 nt, Yersinia pestis KIM
uggcuuuauuaua

SEQ ID NO: 2296966 - RNA, 22 nt, Yersinia pestis KIM
uggcuuucagugagcauuuugu

SEQ ID NO: 2296967 - RNA, 12 nt, Yersinia pestis KIM
ugggaacaacag

SEQ ID NO: 2296968 - RNA, 13 nt, Yersinia pestis KIM
ugggaaugcaccc

SEQ ID NO: 2296969 - RNA, 23 nt, Yersinia pestis KIM
ugggaaccccucugcagcgucaa

SEQ ID NO: 2296970 - RNA, 21 nt, Yersinia pestis KIM
uggcugaauaucaucuuuuuc

SEQ ID NO: 2296971 - RNA, 19 nt, Yersinia pestis KIM
uggcugcccagagugacaa

SEQ ID NO: 2296972 - RNA, 19 nt, Yersinia pestis KIM
uggcuggggcgaugcgagu

SEQ ID NO: 2296973 - RNA, 17 nt, Yersinia pestis KIM
uggcuggcaaaguuauu

SEQ ID NO: 2296974 - RNA, 23 nt, Yersinia pestis KIM
uggcuguauuguugcucaacaua

SEQ ID NO: 2296975 - RNA, 13 nt, Yersinia pestis KIM
uggcugucugaug

SEQ ID NO: 2296976 - RNA, 23 nt, Yersinia pestis KIM
uggaaaaguaggacggugccaug

SEQ ID NO: 2296977 - RNA, 13 nt, Yersinia pestis KIM
uggaaaacagcaa

SEQ ID NO: 2296978 - RNA, 17 nt, Yersinia pestis KIM
uggcgcggcucgagccu

SEQ ID NO: 2296979 - RNA, 23 nt, Yersinia pestis KIM
uggcggucgcacugugagcggca

SEQ ID NO: 2296980 - RNA, 16 nt, Yersinia pestis KIM
uggcggucgcacugug

SEQ ID NO: 2296981 - RNA, 17 nt, Yersinia pestis KIM
uggcguaaguacugaug

SEQ ID NO: 2296982 - RNA, 14 nt, Yersinia pestis KIM
uggcggaaauuaaa

SEQ ID NO: 2296983 - RNA, 23 nt, Yersinia pestis KIM
uggcggcgagcucucacugcucc

SEQ ID NO: 2296984 - RNA, 15 nt, Yersinia pestis KIM
uggcguuaaucaagc

SEQ ID NO: 2296985 - RNA, 23 nt, Yersinia pestis KIM
uggcguuuaaaguaaaucagacc

SEQ ID NO: 2296986 - RNA, 15 nt, Yersinia pestis KIM
uggcuaauauaucuc

SEQ ID NO: 2296987 - RNA, 16 nt, Yersinia pestis KIM
uggcuaagcaugccgc

SEQ ID NO: 2296988 - RNA, 19 nt, Yersinia pestis KIM
uggcuaauuaggcuucuaa

SEQ ID NO: 2296989 - RNA, 15 nt, Yersinia pestis KIM
uggcuaauuuuauua

SEQ ID NO: 2296990 - RNA, 17 nt, Yersinia pestis KIM
uggcguuuuuguuacau

SEQ ID NO: 2296991 - RNA, 14 nt, Yersinia pestis KIM
uggcucucuuuuuu

SEQ ID NO: 2296992 - RNA, 18 nt, Yersinia pestis KIM
uggcugaaauaccaaccc

SEQ ID NO: 2296993 - RNA, 16 nt, Yersinia pestis KIM
uggcucugccaauaaa

SEQ ID NO: 2296994 - RNA, 19 nt, Yersinia pestis KIM
uggcucucucgaaguccuu

SEQ ID NO: 2296995 - RNA, 15 nt, Yersinia pestis KIM
uggcucagcaagaac

SEQ ID NO: 2296996 - RNA, 21 nt, Yersinia pestis KIM
uggcucaauccaaaugacacu

SEQ ID NO: 2296997 - RNA, 14 nt, Yersinia pestis KIM
uggcuaucaucccu

SEQ ID NO: 2296998 - RNA, 21 nt, Yersinia pestis KIM
uggcuauaagccuaggcuaau

SEQ ID NO: 2296999 - RNA, 20 nt, Yersinia pestis KIM
uggcuaccccaacauugguu

SEQ ID NO: 2297000 - RNA, 18 nt, Yersinia pestis KIM
ugguuuuaccaucaccau

SEQ ID NO: 2297001 - RNA, 18 nt, Yersinia pestis KIM
ugguuuggugguuuggug

SEQ ID NO: 2297002 - RNA, 20 nt, Yersinia pestis KIM
ugguuugacauacucuucca

SEQ ID NO: 2297003 - RNA, 21 nt, Yersinia pestis KIM
ugguuugauaacgucauucca

SEQ ID NO: 2297004 - RNA, 17 nt, Yersinia pestis KIM
ugguuugauagcaaaac

SEQ ID NO: 2297005 - RNA, 15 nt, Yersinia pestis KIM
ugguuugcucuuccc

SEQ ID NO: 2297006 - RNA, 16 nt, Yersinia pestis KIM
ugguuuauccccuucg

SEQ ID NO: 2297007 - RNA, 13 nt, Yersinia pestis KIM
ugguugucuaugu

SEQ ID NO: 2297008 - RNA, 19 nt, Yersinia pestis KIM
ugguugcggcaccugcccg

SEQ ID NO: 2297009 - RNA, 15 nt, Yersinia pestis KIM
ugguuggcagcucag

SEQ ID NO: 2297010 - RNA, 15 nt, Yersinia pestis KIM
ugguuggcaccacgg

SEQ ID NO: 2297011 - RNA, 14 nt, Yersinia pestis KIM
ugguuaacagcgug

SEQ ID NO: 2297012 - RNA, 23 nt, Yersinia pestis KIM
ugguuaaaucaccgacaccaacc

SEQ ID NO: 2297013 - RNA, 18 nt, Yersinia pestis KIM
ugguuaacuuauagcuca

SEQ ID NO: 2297014 - RNA, 15 nt, Yersinia pestis KIM
ugguuaaucuacccg

SEQ ID NO: 2297015 - RNA, 16 nt, Yersinia pestis KIM
ugguugccagauaaug

SEQ ID NO: 2297016 - RNA, 20 nt, Yersinia pestis KIM
uguaagcugggaaggcguaa

SEQ ID NO: 2297017 - RNA, 17 nt, Yersinia pestis KIM
uguaagcguaauucagc

SEQ ID NO: 2297018 - RNA, 18 nt, Yersinia pestis KIM
uguaagcguaauucagca

SEQ ID NO: 2297019 - RNA, 14 nt, Yersinia pestis KIM
uguaagauaauucg

SEQ ID NO: 2297020 - RNA, 22 nt, Yersinia pestis KIM
uguaacagagcagaaagcagca

SEQ ID NO: 2297021 - RNA, 16 nt, Yersinia pestis KIM
uguaacaacugaacca

SEQ ID NO: 2297022 - RNA, 22 nt, Yersinia pestis KIM
uguaaauuuuaaacaagcuuau

SEQ ID NO: 2297023 - RNA, 17 nt, Yersinia pestis KIM
ugguuuucuauuuccac

SEQ ID NO: 2297024 - RNA, 13 nt, Yersinia pestis KIM
ugguuuuuuaaaa

SEQ ID NO: 2297025 - RNA, 13 nt, Yersinia pestis KIM
uguaaugccuggu

SEQ ID NO: 2297026 - RNA, 18 nt, Yersinia pestis KIM
uguaaugccacacucaga

SEQ ID NO: 2297027 - RNA, 20 nt, Yersinia pestis KIM
uguaaugccacacucagaca

SEQ ID NO: 2297028 - RNA, 15 nt, Yersinia pestis KIM
uguaauuaauuauaa

SEQ ID NO: 2297029 - RNA, 16 nt, Yersinia pestis KIM
uguaauccauacagaa

SEQ ID NO: 2297030 - RNA, 20 nt, Yersinia pestis KIM
uguaaugacucuggcaguga

SEQ ID NO: 2297031 - RNA, 24 nt, Yersinia pestis KIM
uguaaugacucuggcagugaggca

SEQ ID NO: 2297032 - RNA, 17 nt, Yersinia pestis KIM
uggugaaccagauaaca

SEQ ID NO: 2297033 - RNA, 16 nt, Yersinia pestis KIM
uggugaagaaaccuaa

SEQ ID NO: 2297034 - RNA, 19 nt, Yersinia pestis KIM
uggucccgacaaauacugc

SEQ ID NO: 2297035 - RNA, 23 nt, Yersinia pestis KIM
uggugccgggucguaccggccca

SEQ ID NO: 2297036 - RNA, 14 nt, Yersinia pestis KIM
uggucaugcacagu

SEQ ID NO: 2297037 - RNA, 20 nt, Yersinia pestis KIM
uggucacccuuuugaauuca

SEQ ID NO: 2297038 - RNA, 16 nt, Yersinia pestis KIM
uggucauuuuucccuu

SEQ ID NO: 2297039 - RNA, 17 nt, Yersinia pestis KIM
uggucaauaaaauuaac

SEQ ID NO: 2297040 - RNA, 14 nt, Yersinia pestis KIM
uggucaauaaaauu

SEQ ID NO: 2297041 - RNA, 14 nt, Yersinia pestis KIM
uggucaaucaaguu

SEQ ID NO: 2297042 - RNA, 15 nt, Yersinia pestis KIM
uggucaacagugaac

SEQ ID NO: 2297043 - RNA, 15 nt, Yersinia pestis KIM
ugguaagguuucaaa

SEQ ID NO: 2297044 - RNA, 13 nt, Yersinia pestis KIM
ugggggaccagca

SEQ ID NO: 2297045 - RNA, 22 nt, Yersinia pestis KIM
uggggugucacaaaguagguua

SEQ ID NO: 2297046 - RNA, 20 nt, Yersinia pestis KIM
ugguaaauuccuauaaauuu

SEQ ID NO: 2297047 - RNA, 12 nt, Yersinia pestis KIM
ugguaacccgca

SEQ ID NO: 2297048 - RNA, 20 nt, Yersinia pestis KIM
ugguaacccgcaagcaaacu

SEQ ID NO: 2297049 - RNA, 23 nt, Yersinia pestis KIM
ugguaacccgcaagcaaacugau

SEQ ID NO: 2297050 - RNA, 23 nt, Yersinia pestis KIM
uggguaacauguagcacacuacc

SEQ ID NO: 2297051 - RNA, 15 nt, Yersinia pestis KIM
uggguaaaccaauca

SEQ ID NO: 2297052 - RNA, 13 nt, Yersinia pestis KIM
uguuacuuuuaau

SEQ ID NO: 2297053 - RNA, 19 nt, Yersinia pestis KIM
uguguugcgccauaauucc

SEQ ID NO: 2297054 - RNA, 15 nt, Yersinia pestis KIM
uguguugaaugacgc

SEQ ID NO: 2297055 - RNA, 16 nt, Yersinia pestis KIM
uguuaauuaagauuaa

SEQ ID NO: 2297056 - RNA, 21 nt, Yersinia pestis KIM
uguuaauuaagauuaagccau

SEQ ID NO: 2297057 - RNA, 15 nt, Yersinia pestis KIM
uguucauaaauuaaa

SEQ ID NO: 2297058 - RNA, 12 nt, Yersinia pestis KIM
uguucaaucacc

SEQ ID NO: 2297059 - RNA, 16 nt, Yersinia pestis KIM
uguucaagcaccucaa

SEQ ID NO: 2297060 - RNA, 12 nt, Yersinia pestis KIM
uguuauuuuucu

SEQ ID NO: 2297061 - RNA, 19 nt, Yersinia pestis KIM
uguuauuuuggcuuucagu

SEQ ID NO: 2297062 - RNA, 22 nt, Yersinia pestis KIM
uguucaaaaacgcacgaaaaca

SEQ ID NO: 2297063 - RNA, 23 nt, Yersinia pestis KIM
uguucaaaaacgcacgaaaacac

SEQ ID NO: 2297064 - RNA, 14 nt, Yersinia pestis KIM
uguuauauuuuacu

SEQ ID NO: 2297065 - RNA, 15 nt, Yersinia pestis KIM
uguuauauuuuacuu

SEQ ID NO: 2297066 - RNA, 14 nt, Yersinia pestis KIM
uguuagucuuauga

SEQ ID NO: 2297067 - RNA, 19 nt, Yersinia pestis KIM
uguuagcugccgaccugca

SEQ ID NO: 2297068 - RNA, 11 nt, Yersinia pestis KIM
uguucugcugg

SEQ ID NO: 2297069 - RNA, 20 nt, Yersinia pestis KIM
uguucuuacuguuuucauua

SEQ ID NO: 2297070 - RNA, 20 nt, Yersinia pestis KIM
uguucugguaccguuuuauu

SEQ ID NO: 2297071 - RNA, 13 nt, Yersinia pestis KIM
uguucauugagac

SEQ ID NO: 2297072 - RNA, 20 nt, Yersinia pestis KIM
uguucauauaguugcuuauc

SEQ ID NO: 2297073 - RNA, 20 nt, Yersinia pestis KIM
uguucgaucaaaacaauaaa

SEQ ID NO: 2297074 - RNA, 20 nt, Yersinia pestis KIM
uguucgagguggcgauaaag

SEQ ID NO: 2297075 - RNA, 17 nt, Yersinia pestis KIM
uguucuuauugcuaucu

SEQ ID NO: 2297076 - RNA, 12 nt, Yersinia pestis KIM
uguucuuaucac

SEQ ID NO: 2297077 - RNA, 21 nt, Yersinia pestis KIM
uguucuuaucacggccaaaaa

SEQ ID NO: 2297078 - RNA, 19 nt, Yersinia pestis KIM
uguucuucaucuaaauauu

SEQ ID NO: 2297079 - RNA, 20 nt, Yersinia pestis KIM
uguucuucuuggcuauucag

SEQ ID NO: 2297080 - RNA, 14 nt, Yersinia pestis KIM
uguugaucugaguu

SEQ ID NO: 2297081 - RNA, 17 nt, Yersinia pestis KIM
uguugcccccugcucca

SEQ ID NO: 2297082 - RNA, 16 nt, Yersinia pestis KIM
uguugagucaacucuu

SEQ ID NO: 2297083 - RNA, 19 nt, Yersinia pestis KIM
uguguaccaaaacgaacaa

SEQ ID NO: 2297084 - RNA, 14 nt, Yersinia pestis KIM
ugugguuaccauca

SEQ ID NO: 2297085 - RNA, 21 nt, Yersinia pestis KIM
uguggcaacucuagcgccagc

SEQ ID NO: 2297086 - RNA, 21 nt, Yersinia pestis KIM
ugugcccuuuuugguuuucua

SEQ ID NO: 2297087 - RNA, 12 nt, Yersinia pestis KIM
ugugcugaauug

SEQ ID NO: 2297088 - RNA, 22 nt, Yersinia pestis KIM
ugugcugcccgucaauuugacu

SEQ ID NO: 2297089 - RNA, 17 nt, Yersinia pestis KIM
ugugccaguagcaauaa

SEQ ID NO: 2297090 - RNA, 23 nt, Yersinia pestis KIM
ugugauccacacagcauucugcu

SEQ ID NO: 2297091 - RNA, 13 nt, Yersinia pestis KIM
ugugaucagugug

SEQ ID NO: 2297092 - RNA, 14 nt, Yersinia pestis KIM
ugugauaaacuguu

SEQ ID NO: 2297093 - RNA, 16 nt, Yersinia pestis KIM
ugugauaaagaaugcg

SEQ ID NO: 2297094 - RNA, 16 nt, Yersinia pestis KIM
ugugaugcauauuaua

SEQ ID NO: 2297095 - RNA, 14 nt, Yersinia pestis KIM
ugugaugaaacuaa

SEQ ID NO: 2297096 - RNA, 16 nt, Yersinia pestis KIM
ugugaugaaacuaaaa

SEQ ID NO: 2297097 - RNA, 14 nt, Yersinia pestis KIM
ugugaugaaauuaa

SEQ ID NO: 2297098 - RNA, 16 nt, Yersinia pestis KIM
ugugaugaaauuaaaa

SEQ ID NO: 2297099 - RNA, 14 nt, Yersinia pestis KIM
ugugaucgcugccg

SEQ ID NO: 2297100 - RNA, 22 nt, Yersinia pestis KIM
ugugaauuagguaacuuuccau

SEQ ID NO: 2297101 - RNA, 18 nt, Yersinia pestis KIM
ugugaaucuuuuugcuga

SEQ ID NO: 2297102 - RNA, 13 nt, Yersinia pestis KIM
ugugaacagugau

SEQ ID NO: 2297103 - RNA, 24 nt, Yersinia pestis KIM
ugugaagugugcaaauaaacgcga

SEQ ID NO: 2297104 - RNA, 21 nt, Yersinia pestis KIM
ugucuggguggcugaaauacc

SEQ ID NO: 2297105 - RNA, 15 nt, Yersinia pestis KIM
ugucuuaagccuguu

SEQ ID NO: 2297106 - RNA, 12 nt, Yersinia pestis KIM
ugucuuaugaua

SEQ ID NO: 2297107 - RNA, 17 nt, Yersinia pestis KIM
ugucuugcguucuguga

SEQ ID NO: 2297108 - RNA, 18 nt, Yersinia pestis KIM
ugucggguuaacuuuuuc

SEQ ID NO: 2297109 - RNA, 14 nt, Yersinia pestis KIM
ugucgucccaggcc

SEQ ID NO: 2297110 - RNA, 15 nt, Yersinia pestis KIM
ugucguacuuuccuu

SEQ ID NO: 2297111 - RNA, 17 nt, Yersinia pestis KIM
ugucgcuguagcgccag

SEQ ID NO: 2297112 - RNA, 14 nt, Yersinia pestis KIM
ugucgcuauuuccg

SEQ ID NO: 2297113 - RNA, 17 nt, Yersinia pestis KIM
ugucggcagguaaugca

SEQ ID NO: 2297114 - RNA, 21 nt, Yersinia pestis KIM
ugucggcaagcgauacagaua

SEQ ID NO: 2297115 - RNA, 13 nt, Yersinia pestis KIM
ugucuauuuucau

SEQ ID NO: 2297116 - RNA, 21 nt, Yersinia pestis KIM
ugucguuucugcuuaacucaa

SEQ ID NO: 2297117 - RNA, 20 nt, Yersinia pestis KIM
ugucuaaauugcuuaaaaaa

SEQ ID NO: 2297118 - RNA, 18 nt, Yersinia pestis KIM
ugucguuuacuggcugcc

SEQ ID NO: 2297119 - RNA, 15 nt, Yersinia pestis KIM
ugucuauugauuaca

SEQ ID NO: 2297120 - RNA, 18 nt, Yersinia pestis KIM
ugucgcccugaauuucaa

SEQ ID NO: 2297121 - RNA, 12 nt, Yersinia pestis KIM
ugucgaaagacg

SEQ ID NO: 2297122 - RNA, 15 nt, Yersinia pestis KIM
uguccguguuggcaa

SEQ ID NO: 2297123 - RNA, 16 nt, Yersinia pestis KIM
uguccucuaccagacg

SEQ ID NO: 2297124 - RNA, 19 nt, Yersinia pestis KIM
uguacagcguuggcagcaa

SEQ ID NO: 2297125 - RNA, 16 nt, Yersinia pestis KIM
uguacauaaauuugug

SEQ ID NO: 2297126 - RNA, 21 nt, Yersinia pestis KIM
uguacauccaauuuuuucauc

SEQ ID NO: 2297127 - RNA, 23 nt, Yersinia pestis KIM
uguaugccgcucaaggagaauuu

SEQ ID NO: 2297128 - RNA, 23 nt, Yersinia pestis KIM
uguauuguugcucaacauauugc

SEQ ID NO: 2297129 - RNA, 14 nt, Yersinia pestis KIM
ugucaggaagcaag

SEQ ID NO: 2297130 - RNA, 12 nt, Yersinia pestis KIM
ugucaggaucau

SEQ ID NO: 2297131 - RNA, 20 nt, Yersinia pestis KIM
ugucaggaaaugcagacucu

SEQ ID NO: 2297132 - RNA, 15 nt, Yersinia pestis KIM
ugucagggcaauaac

SEQ ID NO: 2297133 - RNA, 14 nt, Yersinia pestis KIM
ugucagggcaauaa

SEQ ID NO: 2297134 - RNA, 21 nt, Yersinia pestis KIM
ugucaguaucagcgauuuuaa

SEQ ID NO: 2297135 - RNA, 15 nt, Yersinia pestis KIM
uguauuuaacauuag

SEQ ID NO: 2297136 - RNA, 21 nt, Yersinia pestis KIM
uguauuuaaccaacacguauc

SEQ ID NO: 2297137 - RNA, 19 nt, Yersinia pestis KIM
uguauuuaaccgcccucuu

SEQ ID NO: 2297138 - RNA, 18 nt, Yersinia pestis KIM
ugucaauaaccucagccu

SEQ ID NO: 2297139 - RNA, 22 nt, Yersinia pestis KIM
ugucaauaaccucagaggcgcu

SEQ ID NO: 2297140 - RNA, 14 nt, Yersinia pestis KIM
ugucaauaaacuga

SEQ ID NO: 2297141 - RNA, 18 nt, Yersinia pestis KIM
ugucaucaacuucacuuu

SEQ ID NO: 2297142 - RNA, 14 nt, Yersinia pestis KIM
ugucauggcacgcu

SEQ ID NO: 2297143 - RNA, 22 nt, Yersinia pestis KIM
ugucaugcgauuuaugcaugaa

SEQ ID NO: 2297144 - RNA, 14 nt, Yersinia pestis KIM
ugucaugcaauuac

SEQ ID NO: 2297145 - RNA, 22 nt, Yersinia pestis KIM
ugucaugaguguuggccucaga

SEQ ID NO: 2297146 - RNA, 13 nt, Yersinia pestis KIM
uguccaaaggaag

SEQ ID NO: 2297147 - RNA, 16 nt, Yersinia pestis KIM
uguccaaaggaagggg

SEQ ID NO: 2297148 - RNA, 18 nt, Yersinia pestis KIM
uguccacaacaccacuuu

SEQ ID NO: 2297149 - RNA, 14 nt, Yersinia pestis KIM
uguccacauagcug

SEQ ID NO: 2297150 - RNA, 14 nt, Yersinia pestis KIM
ugucauuaauuggu

SEQ ID NO: 2297151 - RNA, 20 nt, Yersinia pestis KIM
ugucauuaccaaugguuuca

SEQ ID NO: 2297152 - RNA, 21 nt, Yersinia pestis KIM
uguccagggcaaucaggaaag

SEQ ID NO: 2297153 - RNA, 13 nt, Yersinia pestis KIM
uguccaguuauca

SEQ ID NO: 2297154 - RNA, 15 nt, Yersinia pestis KIM
uuauccguuaaccca

SEQ ID NO: 2297155 - RNA, 15 nt, Yersinia pestis KIM
uuaucccuccaucaa

SEQ ID NO: 2297156 - RNA, 21 nt, Yersinia pestis KIM
uuaucccuccaucaagccacc

SEQ ID NO: 2297157 - RNA, 17 nt, Yersinia pestis KIM
uuauccgcaccauagau

SEQ ID NO: 2297158 - RNA, 21 nt, Yersinia pestis KIM
uuauccccgccucgacaagca

SEQ ID NO: 2297159 - RNA, 18 nt, Yersinia pestis KIM
uuaucccaguuuuuaauu

SEQ ID NO: 2297160 - RNA, 21 nt, Yersinia pestis KIM
uuaucauucaagaaaaugauu

SEQ ID NO: 2297161 - RNA, 14 nt, Yersinia pestis KIM
uuaucauuuaaaua

SEQ ID NO: 2297162 - RNA, 13 nt, Yersinia pestis KIM
uuauccacagcau

SEQ ID NO: 2297163 - RNA, 17 nt, Yersinia pestis KIM
uuauccauuuucugcca

SEQ ID NO: 2297164 - RNA, 14 nt, Yersinia pestis KIM
uuaucaaucaaaaa

SEQ ID NO: 2297165 - RNA, 19 nt, Yersinia pestis KIM
uuaucaagaucaaaagcag

SEQ ID NO: 2297166 - RNA, 12 nt, Yersinia pestis KIM
uuaucaauacug

SEQ ID NO: 2297167 - RNA, 13 nt, Yersinia pestis KIM
uuaucaauacugc

SEQ ID NO: 2297168 - RNA, 22 nt, Yersinia pestis KIM
uuaucaucauuacacugaauug

SEQ ID NO: 2297169 - RNA, 13 nt, Yersinia pestis KIM
uuauauauuuuga

SEQ ID NO: 2297170 - RNA, 20 nt, Yersinia pestis KIM
uuaucaaagugcuuaaccca

SEQ ID NO: 2297171 - RNA, 22 nt, Yersinia pestis KIM
uuauagcucaucgguaacuuac

SEQ ID NO: 2297172 - RNA, 17 nt, Yersinia pestis KIM
uuauacagcauauaaaa

SEQ ID NO: 2297173 - RNA, 16 nt, Yersinia pestis KIM
uuauaauuaauuugug

SEQ ID NO: 2297174 - RNA, 16 nt, Yersinia pestis KIM
uuauaauucauuuuuu

SEQ ID NO: 2297175 - RNA, 19 nt, Yersinia pestis KIM
uuauaaacacuuaccuaua

SEQ ID NO: 2297176 - RNA, 15 nt, Yersinia pestis KIM
uuauaaauaauuauc

SEQ ID NO: 2297177 - RNA, 13 nt, Yersinia pestis KIM
uuauaagcguuau

SEQ ID NO: 2297178 - RNA, 16 nt, Yersinia pestis KIM
uuauaaggaauauacu

SEQ ID NO: 2297179 - RNA, 16 nt, Yersinia pestis KIM
uuagaggcugauaacc

SEQ ID NO: 2297180 - RNA, 14 nt, Yersinia pestis KIM
uuagagucuauaau

SEQ ID NO: 2297181 - RNA, 15 nt, Yersinia pestis KIM
uuauaaaaaccccuu

SEQ ID NO: 2297182 - RNA, 23 nt, Yersinia pestis KIM
uuaugcagggaagcuggccucuu

SEQ ID NO: 2297183 - RNA, 13 nt, Yersinia pestis KIM
uuaugaguucugc

SEQ ID NO: 2297184 - RNA, 21 nt, Yersinia pestis KIM
uuaugacacccguacgaauuu

SEQ ID NO: 2297185 - RNA, 22 nt, Yersinia pestis KIM
uuaugaccaauagucacgucuu

SEQ ID NO: 2297186 - RNA, 17 nt, Yersinia pestis KIM
uuaugaccaauagucac

SEQ ID NO: 2297187 - RNA, 16 nt, Yersinia pestis KIM
uuauggcauaaacuga

SEQ ID NO: 2297188 - RNA, 19 nt, Yersinia pestis KIM
uuauguaaauaguuacuau

SEQ ID NO: 2297189 - RNA, 16 nt, Yersinia pestis KIM
uuaugggugguuagca

SEQ ID NO: 2297190 - RNA, 22 nt, Yersinia pestis KIM
uuauggauauggaccugaguca

SEQ ID NO: 2297191 - RNA, 13 nt, Yersinia pestis KIM
uuauggagaggcg

SEQ ID NO: 2297192 - RNA, 21 nt, Yersinia pestis KIM
uuauuaaacagauucaauauu

SEQ ID NO: 2297193 - RNA, 19 nt, Yersinia pestis KIM
uuauguaguuaaucuaccc

SEQ ID NO: 2297194 - RNA, 22 nt, Yersinia pestis KIM
uuaucugcuaauuaaaccugac

SEQ ID NO: 2297195 - RNA, 16 nt, Yersinia pestis KIM
uuaucuguuguauacu

SEQ ID NO: 2297196 - RNA, 14 nt, Yersinia pestis KIM
uuaucugcuauuuc

SEQ ID NO: 2297197 - RNA, 18 nt, Yersinia pestis KIM
uuaucuuguaaauaguca

SEQ ID NO: 2297198 - RNA, 17 nt, Yersinia pestis KIM
uuaucuccgccauugag

SEQ ID NO: 2297199 - RNA, 22 nt, Yersinia pestis KIM
uuaucugaauagcgcugcauca

SEQ ID NO: 2297200 - RNA, 16 nt, Yersinia pestis KIM
uuaucuaucucaggcu

SEQ ID NO: 2297201 - RNA, 15 nt, Yersinia pestis KIM
uuaucucccauuaau

SEQ ID NO: 2297202 - RNA, 17 nt, Yersinia pestis KIM
uuaucucccauuaauua

SEQ ID NO: 2297203 - RNA, 19 nt, Yersinia pestis KIM
uuaucucccauuaauuaau

SEQ ID NO: 2297204 - RNA, 15 nt, Yersinia pestis KIM
uuaucggcaggcuua

SEQ ID NO: 2297205 - RNA, 22 nt, Yersinia pestis KIM
uuaucgccaagccaguaauuaa

SEQ ID NO: 2297206 - RNA, 18 nt, Yersinia pestis KIM
uuaucgccaagccaguaa

SEQ ID NO: 2297207 - RNA, 22 nt, Yersinia pestis KIM
uuaucgccuaccaucaaaauau

SEQ ID NO: 2297208 - RNA, 13 nt, Yersinia pestis KIM
uuaucuaaaacug

SEQ ID NO: 2297209 - RNA, 17 nt, Yersinia pestis KIM
uuaucguuucuguuuug

SEQ ID NO: 2297210 - RNA, 20 nt, Yersinia pestis KIM
uuaucgcaguaauagaaaaa

SEQ ID NO: 2297211 - RNA, 19 nt, Yersinia pestis KIM
uuaucgauuuaguaucauu

SEQ ID NO: 2297212 - RNA, 22 nt, Yersinia pestis KIM
uuaucgauaaauaauuacuuau

SEQ ID NO: 2297213 - RNA, 14 nt, Yersinia pestis KIM
uuauccuccauucu

SEQ ID NO: 2297214 - RNA, 14 nt, Yersinia pestis KIM
uuauccguuugcaa

SEQ ID NO: 2297215 - RNA, 17 nt, Yersinia pestis KIM
uucaaauagcugguuaa

SEQ ID NO: 2297216 - RNA, 14 nt, Yersinia pestis KIM
uucaaauaucauua

SEQ ID NO: 2297217 - RNA, 13 nt, Yersinia pestis KIM
uucaaaucaugca

SEQ ID NO: 2297218 - RNA, 14 nt, Yersinia pestis KIM
uucaacaagaaauc

SEQ ID NO: 2297219 - RNA, 20 nt, Yersinia pestis KIM
uucaacacggugaauaaacc

SEQ ID NO: 2297220 - RNA, 18 nt, Yersinia pestis KIM
uucaaccccuucuucacc

SEQ ID NO: 2297221 - RNA, 13 nt, Yersinia pestis KIM
uucaaccucaauu

SEQ ID NO: 2297222 - RNA, 20 nt, Yersinia pestis KIM
uucaacgcaccauccagcaa

SEQ ID NO: 2297223 - RNA, 15 nt, Yersinia pestis KIM
uucaacgcauccaaa

SEQ ID NO: 2297224 - RNA, 14 nt, Yersinia pestis KIM
uucaacuugccuga

SEQ ID NO: 2297225 - RNA, 19 nt, Yersinia pestis KIM
uucaacuucuccuguauuu

SEQ ID NO: 2297226 - RNA, 14 nt, Yersinia pestis KIM
uucaacuucuccug

SEQ ID NO: 2297227 - RNA, 17 nt, Yersinia pestis KIM
uucaacugcucauccau

SEQ ID NO: 2297228 - RNA, 19 nt, Yersinia pestis KIM
uucaagagggcgguuaaau

SEQ ID NO: 2297229 - RNA, 23 nt, Yersinia pestis KIM
uucaagacgggucgcguuggcua

SEQ ID NO: 2297230 - RNA, 16 nt, Yersinia pestis KIM
uucaaacguguacuuu

SEQ ID NO: 2297231 - RNA, 19 nt, Yersinia pestis KIM
uucaaacguguacuuuccc

SEQ ID NO: 2297232 - RNA, 21 nt, Yersinia pestis KIM
uucaaaauagaggaaauaaau

SEQ ID NO: 2297233 - RNA, 17 nt, Yersinia pestis KIM
uucaaaaggugcaagca

SEQ ID NO: 2297234 - RNA, 20 nt, Yersinia pestis KIM
uucaaaauagucaguaaaau

SEQ ID NO: 2297235 - RNA, 21 nt, Yersinia pestis KIM
uucaaacaguacuucagguaa

SEQ ID NO: 2297236 - RNA, 15 nt, Yersinia pestis KIM
uucaaaccgcuggug

SEQ ID NO: 2297237 - RNA, 20 nt, Yersinia pestis KIM
uucaaaaacgcacgaaaaca

SEQ ID NO: 2297238 - RNA, 17 nt, Yersinia pestis KIM
uuauuuuggguauauag

SEQ ID NO: 2297239 - RNA, 15 nt, Yersinia pestis KIM
uuauuuucccuuucu

SEQ ID NO: 2297240 - RNA, 17 nt, Yersinia pestis KIM
uuauuuuuuuccagguc

SEQ ID NO: 2297241 - RNA, 21 nt, Yersinia pestis KIM
uuauuuuuggucguuuaaaua

SEQ ID NO: 2297242 - RNA, 22 nt, Yersinia pestis KIM
uuauuuuuggucguuuaaauaa

SEQ ID NO: 2297243 - RNA, 16 nt, Yersinia pestis KIM
uuauuuuuguaacuca

SEQ ID NO: 2297244 - RNA, 11 nt, Yersinia pestis KIM
uuauuacauuu

SEQ ID NO: 2297245 - RNA, 23 nt, Yersinia pestis KIM
uuauuaaucaagauauuacuucu

SEQ ID NO: 2297246 - RNA, 14 nt, Yersinia pestis KIM
uuauuaucaucuuu

SEQ ID NO: 2297247 - RNA, 19 nt, Yersinia pestis KIM
uuauuaggcauugagucac

SEQ ID NO: 2297248 - RNA, 16 nt, Yersinia pestis KIM
uuauuacugucacugu

SEQ ID NO: 2297249 - RNA, 19 nt, Yersinia pestis KIM
uuauuauauauuuugaaua

SEQ ID NO: 2297250 - RNA, 21 nt, Yersinia pestis KIM
uuauucuuauuucgcgacuca

SEQ ID NO: 2297251 - RNA, 23 nt, Yersinia pestis KIM
uuauucguggugaugaugacggu

SEQ ID NO: 2297252 - RNA, 11 nt, Yersinia pestis KIM
uuauucuaauu

SEQ ID NO: 2297253 - RNA, 23 nt, Yersinia pestis KIM
uuauucucaauugacuguauaua

SEQ ID NO: 2297254 - RNA, 18 nt, Yersinia pestis KIM
uuauugacuguaaauauu

SEQ ID NO: 2297255 - RNA, 12 nt, Yersinia pestis KIM
uuauuauugauu

SEQ ID NO: 2297256 - RNA, 18 nt, Yersinia pestis KIM
uuauucgaguagggauuu

SEQ ID NO: 2297257 - RNA, 11 nt, Yersinia pestis KIM
uuauucauuca

SEQ ID NO: 2297258 - RNA, 19 nt, Yersinia pestis KIM
uuauucauaguuaagacaa

SEQ ID NO: 2297259 - RNA, 21 nt, Yersinia pestis KIM
uuauuuaaacaaugaaauugc

SEQ ID NO: 2297260 - RNA, 20 nt, Yersinia pestis KIM
uuauuuaagcaguucacucu

SEQ ID NO: 2297261 - RNA, 23 nt, Yersinia pestis KIM
uuauuuagagucuauaaugcuau

SEQ ID NO: 2297262 - RNA, 17 nt, Yersinia pestis KIM
uuauuuaccuguuugca

SEQ ID NO: 2297263 - RNA, 17 nt, Yersinia pestis KIM
uuauuuacgauaagaau

SEQ ID NO: 2297264 - RNA, 23 nt, Yersinia pestis KIM
uuauuuaggcuacagcuacugca

SEQ ID NO: 2297265 - RNA, 14 nt, Yersinia pestis KIM
uuauuuauagguau

SEQ ID NO: 2297266 - RNA, 19 nt, Yersinia pestis KIM
uuauuucacgcuaauuauu

SEQ ID NO: 2297267 - RNA, 16 nt, Yersinia pestis KIM
uuauugucuuuaauaa

SEQ ID NO: 2297268 - RNA, 20 nt, Yersinia pestis KIM
uuauugucucuacucucugu

SEQ ID NO: 2297269 - RNA, 23 nt, Yersinia pestis KIM
uuauuggggacaggcuccuccuu

SEQ ID NO: 2297270 - RNA, 19 nt, Yersinia pestis KIM
uuauuggggacaggcuccu

SEQ ID NO: 2297271 - RNA, 21 nt, Yersinia pestis KIM
uuauuggcuggcaaaguuauu

SEQ ID NO: 2297272 - RNA, 22 nt, Yersinia pestis KIM
uuauuggaaguacuuauuugaa

SEQ ID NO: 2297273 - RNA, 18 nt, Yersinia pestis KIM
uuauuggacaucaggcag

SEQ ID NO: 2297274 - RNA, 20 nt, Yersinia pestis KIM
uuauugggcgcgauaaaaga

SEQ ID NO: 2297275 - RNA, 16 nt, Yersinia pestis KIM
uuauugggcugccugu

SEQ ID NO: 2297276 - RNA, 17 nt, Yersinia pestis KIM
uuauuggaaguacuuau

SEQ ID NO: 2297277 - RNA, 16 nt, Yersinia pestis KIM
uuauugccauuuuaau

SEQ ID NO: 2297278 - RNA, 23 nt, Yersinia pestis KIM
uuauuuggcucagcaagaacuca

SEQ ID NO: 2297279 - RNA, 21 nt, Yersinia pestis KIM
uuauuucacuggaaaaagugu

SEQ ID NO: 2297280 - RNA, 18 nt, Yersinia pestis KIM
uuauuucuguuccaggca

SEQ ID NO: 2297281 - RNA, 17 nt, Yersinia pestis KIM
uuauuucgauucauuca

SEQ ID NO: 2297282 - RNA, 13 nt, Yersinia pestis KIM
uuauuugcuaucg

SEQ ID NO: 2297283 - RNA, 21 nt, Yersinia pestis KIM
uuauuugaguaagacaacuua

SEQ ID NO: 2297284 - RNA, 13 nt, Yersinia pestis KIM
uuauuugaauaag

SEQ ID NO: 2297285 - RNA, 18 nt, Yersinia pestis KIM
uuauuugaaauacuuauu

SEQ ID NO: 2297286 - RNA, 15 nt, Yersinia pestis KIM
uuaacacaucaaaau

SEQ ID NO: 2297287 - RNA, 17 nt, Yersinia pestis KIM
uuaacacaucaaaauua

SEQ ID NO: 2297288 - RNA, 20 nt, Yersinia pestis KIM
uuaacacauuccaguaaaaa

SEQ ID NO: 2297289 - RNA, 21 nt, Yersinia pestis KIM
uuaacacauuccaguaaaaaa

SEQ ID NO: 2297290 - RNA, 21 nt, Yersinia pestis KIM
uuaacacccaauaauaaaaaa

SEQ ID NO: 2297291 - RNA, 22 nt, Yersinia pestis KIM
uuaacacccaauaauaaaaaaa

SEQ ID NO: 2297292 - RNA, 20 nt, Yersinia pestis KIM
uuaacacccaauaauaaaaa

SEQ ID NO: 2297293 - RNA, 22 nt, Yersinia pestis KIM
uuaacacauuccaguaaaaaaa

SEQ ID NO: 2297294 - RNA, 19 nt, Yersinia pestis KIM
uuaacacccaauaauaaaa

SEQ ID NO: 2297295 - RNA, 15 nt, Yersinia pestis KIM
uuaacacgggcauga

SEQ ID NO: 2297296 - RNA, 20 nt, Yersinia pestis KIM
uuaacaaucagugcaauaaa

SEQ ID NO: 2297297 - RNA, 15 nt, Yersinia pestis KIM
uuaacagcaucacug

SEQ ID NO: 2297298 - RNA, 18 nt, Yersinia pestis KIM
uuaacagccccgucucaa

SEQ ID NO: 2297299 - RNA, 17 nt, Yersinia pestis KIM
uuaacaucgccacgaau

SEQ ID NO: 2297300 - RNA, 13 nt, Yersinia pestis KIM
uuaaccaacauga

SEQ ID NO: 2297301 - RNA, 13 nt, Yersinia pestis KIM
uuaacgcuuuauc

SEQ ID NO: 2297302 - RNA, 19 nt, Yersinia pestis KIM
uuaacggaaaugauaucug

SEQ ID NO: 2297303 - RNA, 18 nt, Yersinia pestis KIM
uuaacgucagauaaacaa

SEQ ID NO: 2297304 - RNA, 18 nt, Yersinia pestis KIM
uuaacgucgcugaaaugc

SEQ ID NO: 2297305 - RNA, 19 nt, Yersinia pestis KIM
uuaacuacaccgcuaaccu

SEQ ID NO: 2297306 - RNA, 21 nt, Yersinia pestis KIM
uuaacuacaccgcuaaccuua

SEQ ID NO: 2297307 - RNA, 22 nt, Yersinia pestis KIM
uuaacuacaccgcuaaccuuaa

SEQ ID NO: 2297308 - RNA, 14 nt, Yersinia pestis KIM
uuaacgacauuucg

SEQ ID NO: 2297309 - RNA, 17 nt, Yersinia pestis KIM
uuaaccgaugcaauaaa

SEQ ID NO: 2297310 - RNA, 15 nt, Yersinia pestis KIM
uuaacccaaagcccu

SEQ ID NO: 2297311 - RNA, 15 nt, Yersinia pestis KIM
uuaacccaaagccau

SEQ ID NO: 2297312 - RNA, 17 nt, Yersinia pestis KIM
uuaacccggcgacgauc

SEQ ID NO: 2297313 - RNA, 15 nt, Yersinia pestis KIM
uuaacccaccaauag

SEQ ID NO: 2297314 - RNA, 12 nt, Yersinia pestis KIM
uuaagcaaaaag

SEQ ID NO: 2297315 - RNA, 20 nt, Yersinia pestis KIM
uuaagauaggcagaaaagca

SEQ ID NO: 2297316 - RNA, 21 nt, Yersinia pestis KIM
uuaagccgcaaggauaaacga

SEQ ID NO: 2297317 - RNA, 17 nt, Yersinia pestis KIM
uuaagcgggcuuuaaua

SEQ ID NO: 2297318 - RNA, 13 nt, Yersinia pestis KIM
uuaagccaauaau

SEQ ID NO: 2297319 - RNA, 14 nt, Yersinia pestis KIM
uuaagccaauaaua

SEQ ID NO: 2297320 - RNA, 14 nt, Yersinia pestis KIM
uuaagcaauuuaga

SEQ ID NO: 2297321 - RNA, 16 nt, Yersinia pestis KIM
uuaagcauuggcaaau

SEQ ID NO: 2297322 - RNA, 13 nt, Yersinia pestis KIM
uuaagaaaacauu

SEQ ID NO: 2297323 - RNA, 17 nt, Yersinia pestis KIM
uuaauaacuuaaauaau

SEQ ID NO: 2297324 - RNA, 18 nt, Yersinia pestis KIM
uuaauaaccauaaaauaa

SEQ ID NO: 2297325 - RNA, 21 nt, Yersinia pestis KIM
uuaauaaauuauaaugaugua

SEQ ID NO: 2297326 - RNA, 15 nt, Yersinia pestis KIM
uuaaggaaacucaug

SEQ ID NO: 2297327 - RNA, 18 nt, Yersinia pestis KIM
uuaaguugaguugaauuu

SEQ ID NO: 2297328 - RNA, 15 nt, Yersinia pestis KIM
uuaaguugaugcagu

SEQ ID NO: 2297329 - RNA, 17 nt, Yersinia pestis KIM
uuaaguugaugcaguga

SEQ ID NO: 2297330 - RNA, 21 nt, Yersinia pestis KIM
uuaaggaaaaguagccaauag

SEQ ID NO: 2297331 - RNA, 17 nt, Yersinia pestis KIM
uuaaauucuaccuggcu

SEQ ID NO: 2297332 - RNA, 20 nt, Yersinia pestis KIM
uuaaauuuuuauauaauuga

SEQ ID NO: 2297333 - RNA, 22 nt, Yersinia pestis KIM
uuaacaaaccgcuuacgcugua

SEQ ID NO: 2297334 - RNA, 21 nt, Yersinia pestis KIM
uuaaauacugcacguuuaauu

SEQ ID NO: 2297335 - RNA, 15 nt, Yersinia pestis KIM
uguugcgccauaauu

SEQ ID NO: 2297336 - RNA, 22 nt, Yersinia pestis KIM
uuaaacaagcuuauauuauuca

SEQ ID NO: 2297337 - RNA, 16 nt, Yersinia pestis KIM
uuaaacccggcaucaa

SEQ ID NO: 2297338 - RNA, 19 nt, Yersinia pestis KIM
uuaaacccggcaucaacca

SEQ ID NO: 2297339 - RNA, 13 nt, Yersinia pestis KIM
uuaaagguaaaag

SEQ ID NO: 2297340 - RNA, 16 nt, Yersinia pestis KIM
uuaaauaacuaaaaaa

SEQ ID NO: 2297341 - RNA, 19 nt, Yersinia pestis KIM
uuaaaguaaaucagaccau

SEQ ID NO: 2297342 - RNA, 16 nt, Yersinia pestis KIM
uuaaauacaaaaauac

SEQ ID NO: 2297343 - RNA, 20 nt, Yersinia pestis KIM
uuaaagaagaauccacauaa

SEQ ID NO: 2297344 - RNA, 23 nt, Yersinia pestis KIM
uuaaagaagaauccacauaaaaa

SEQ ID NO: 2297345 - RNA, 13 nt, Yersinia pestis KIM
uuaaagaagacga

SEQ ID NO: 2297346 - RNA, 23 nt, Yersinia pestis KIM
uuaaagacgcaugagcuuaugcg

SEQ ID NO: 2297347 - RNA, 14 nt, Yersinia pestis KIM
uuaaagaaugcaac

SEQ ID NO: 2297348 - RNA, 20 nt, Yersinia pestis KIM
uuacgcucugccuguucucu

SEQ ID NO: 2297349 - RNA, 19 nt, Yersinia pestis KIM
uuacguguucuuaauuuaa

SEQ ID NO: 2297350 - RNA, 14 nt, Yersinia pestis KIM
uuacgucaaaacua

SEQ ID NO: 2297351 - RNA, 22 nt, Yersinia pestis KIM
uuacgggucagcucaccaccuc

SEQ ID NO: 2297352 - RNA, 14 nt, Yersinia pestis KIM
uuacguaauaguaa

SEQ ID NO: 2297353 - RNA, 19 nt, Yersinia pestis KIM
uuacguuucauaugucacc

SEQ ID NO: 2297354 - RNA, 15 nt, Yersinia pestis KIM
uuacccgaaagccau

SEQ ID NO: 2297355 - RNA, 19 nt, Yersinia pestis KIM
uuacccacauucaggccga

SEQ ID NO: 2297356 - RNA, 19 nt, Yersinia pestis KIM
uuacccacuugcaacauua

SEQ ID NO: 2297357 - RNA, 18 nt, Yersinia pestis KIM
uuaccauccguccucagg

SEQ ID NO: 2297358 - RNA, 14 nt, Yersinia pestis KIM
uuacccacauuaaa

SEQ ID NO: 2297359 - RNA, 21 nt, Yersinia pestis KIM
uuacgaucugccuguucucuc

SEQ ID NO: 2297360 - RNA, 15 nt, Yersinia pestis KIM
uuacgccauacauca

SEQ ID NO: 2297361 - RNA, 14 nt, Yersinia pestis KIM
uuacugcauucuga

SEQ ID NO: 2297362 - RNA, 18 nt, Yersinia pestis KIM
uuacucguauaaaaaaua

SEQ ID NO: 2297363 - RNA, 22 nt, Yersinia pestis KIM
uuacucuucagccuauccucac

SEQ ID NO: 2297364 - RNA, 14 nt, Yersinia pestis KIM
uuacucuucugccu

SEQ ID NO: 2297365 - RNA, 16 nt, Yersinia pestis KIM
uuacugaaaagaggca

SEQ ID NO: 2297366 - RNA, 17 nt, Yersinia pestis KIM
uuacugaaaagaggcac

SEQ ID NO: 2297367 - RNA, 18 nt, Yersinia pestis KIM
uuacuccucugccuaucc

SEQ ID NO: 2297368 - RNA, 22 nt, Yersinia pestis KIM
uuacuccucugccuauccucac

SEQ ID NO: 2297369 - RNA, 17 nt, Yersinia pestis KIM
uuacucccuuguugccu

SEQ ID NO: 2297370 - RNA, 19 nt, Yersinia pestis KIM
uuacucaggauuagcuucu

SEQ ID NO: 2297371 - RNA, 22 nt, Yersinia pestis KIM
uuacucaggauuagcuucugcu

SEQ ID NO: 2297372 - RNA, 18 nt, Yersinia pestis KIM
uuacucauuauggauaau

SEQ ID NO: 2297373 - RNA, 21 nt, Yersinia pestis KIM
uuacuacaaacgcguuaauua

SEQ ID NO: 2297374 - RNA, 12 nt, Yersinia pestis KIM
uuacuuuuuccu

SEQ ID NO: 2297375 - RNA, 14 nt, Yersinia pestis KIM
uuacuuuuuuauuu

SEQ ID NO: 2297376 - RNA, 18 nt, Yersinia pestis KIM
uuacuuuaucguccaugc

SEQ ID NO: 2297377 - RNA, 15 nt, Yersinia pestis KIM
uuacuuuaaauuuua

SEQ ID NO: 2297378 - RNA, 12 nt, Yersinia pestis KIM
uuacuuuauuua

SEQ ID NO: 2297379 - RNA, 14 nt, Yersinia pestis KIM
uuacuuuauuuaaa

SEQ ID NO: 2297380 - RNA, 14 nt, Yersinia pestis KIM
uuacuuugaaauua

SEQ ID NO: 2297381 - RNA, 22 nt, Yersinia pestis KIM
uuaauggcugcacggaucacgc

SEQ ID NO: 2297382 - RNA, 16 nt, Yersinia pestis KIM
uuaaugccgcugauca

SEQ ID NO: 2297383 - RNA, 18 nt, Yersinia pestis KIM
uuaauuccgcccugaaua

SEQ ID NO: 2297384 - RNA, 22 nt, Yersinia pestis KIM
uuaauuccgcccugaauaucgg

SEQ ID NO: 2297385 - RNA, 12 nt, Yersinia pestis KIM
uuaauuccaugc

SEQ ID NO: 2297386 - RNA, 21 nt, Yersinia pestis KIM
uuaauucaugugagauaacac

SEQ ID NO: 2297387 - RNA, 11 nt, Yersinia pestis KIM
uuaauucaguu

SEQ ID NO: 2297388 - RNA, 21 nt, Yersinia pestis KIM
uuaauuauaagcgaggguaaa

SEQ ID NO: 2297389 - RNA, 19 nt, Yersinia pestis KIM
uuaauaccuuguucccgca

SEQ ID NO: 2297390 - RNA, 13 nt, Yersinia pestis KIM
uuaauaccaugca

SEQ ID NO: 2297391 - RNA, 17 nt, Yersinia pestis KIM
uuaaucuccuggugguu

SEQ ID NO: 2297392 - RNA, 21 nt, Yersinia pestis KIM
uuaaucugcccagccugguuu

SEQ ID NO: 2297393 - RNA, 19 nt, Yersinia pestis KIM
uuaauagaagguuaaauuu

SEQ ID NO: 2297394 - RNA, 14 nt, Yersinia pestis KIM
uuaauuuaugaaca

SEQ ID NO: 2297395 - RNA, 20 nt, Yersinia pestis KIM
uuaauuuagcguuuacugau

SEQ ID NO: 2297396 - RNA, 15 nt, Yersinia pestis KIM
uuaauuucagucaau

SEQ ID NO: 2297397 - RNA, 16 nt, Yersinia pestis KIM
uuaauuuaaacucuuu

SEQ ID NO: 2297398 - RNA, 16 nt, Yersinia pestis KIM
uuaauugguuuuaaua

SEQ ID NO: 2297399 - RNA, 17 nt, Yersinia pestis KIM
uuaauugguuuuaauaa

SEQ ID NO: 2297400 - RNA, 15 nt, Yersinia pestis KIM
uuacagacuggccaa

SEQ ID NO: 2297401 - RNA, 18 nt, Yersinia pestis KIM
uuacagcaaggcggcaag

SEQ ID NO: 2297402 - RNA, 23 nt, Yersinia pestis KIM
uuacagcaaggcggcaagcaagc

SEQ ID NO: 2297403 - RNA, 13 nt, Yersinia pestis KIM
uuacaucaucuuc

SEQ ID NO: 2297404 - RNA, 21 nt, Yersinia pestis KIM
uuacaucaaccccuuucuuaa

SEQ ID NO: 2297405 - RNA, 17 nt, Yersinia pestis KIM
uuacauauaauccaaaa

SEQ ID NO: 2297406 - RNA, 19 nt, Yersinia pestis KIM
uuacauauaggaaaugucg

SEQ ID NO: 2297407 - RNA, 23 nt, Yersinia pestis KIM
uuacauaugauggcaucuuauua

SEQ ID NO: 2297408 - RNA, 13 nt, Yersinia pestis KIM
uuacauuuuuaac

SEQ ID NO: 2297409 - RNA, 10 nt, Yersinia pestis KIM
uuacauuuug

SEQ ID NO: 2297410 - RNA, 18 nt, Yersinia pestis KIM
uuaccaacagacucacuc

SEQ ID NO: 2297411 - RNA, 23 nt, Yersinia pestis KIM
uuacauugaauggugcuguauuu

SEQ ID NO: 2297412 - RNA, 22 nt, Yersinia pestis KIM
uuacauuaaucagcgaaugccg

SEQ ID NO: 2297413 - RNA, 23 nt, Yersinia pestis KIM
ugccgcuaacgucgcuguuacuc

SEQ ID NO: 2297414 - RNA, 16 nt, Yersinia pestis KIM
ugccgcucaaggagaa

SEQ ID NO: 2297415 - RNA, 20 nt, Yersinia pestis KIM
ugccggggagucgcuccuca

SEQ ID NO: 2297416 - RNA, 18 nt, Yersinia pestis KIM
ugccguacaacaauaaua

SEQ ID NO: 2297417 - RNA, 16 nt, Yersinia pestis KIM
ugccguacaacaauaa

SEQ ID NO: 2297418 - RNA, 16 nt, Yersinia pestis KIM
ugccggugagcacgau

SEQ ID NO: 2297419 - RNA, 18 nt, Yersinia pestis KIM
ugccgugucuuccagaca

SEQ ID NO: 2297420 - RNA, 18 nt, Yersinia pestis KIM
ugccgugcuugcuauuaa

SEQ ID NO: 2297421 - RNA, 20 nt, Yersinia pestis KIM
ugccugcuggcaaacuuuuc

SEQ ID NO: 2297422 - RNA, 14 nt, Yersinia pestis KIM
ugccugcuggcaaa

SEQ ID NO: 2297423 - RNA, 24 nt, Yersinia pestis KIM
ugccuggaucaaguuagcaggcag

SEQ ID NO: 2297424 - RNA, 21 nt, Yersinia pestis KIM
ugccugguauuuucuauacca

SEQ ID NO: 2297425 - RNA, 15 nt, Yersinia pestis KIM
ugccuggugcaaccg

SEQ ID NO: 2297426 - RNA, 13 nt, Yersinia pestis KIM
ugccucggucuga

SEQ ID NO: 2297427 - RNA, 23 nt, Yersinia pestis KIM
ugccguuuugcagaucaaucgca

SEQ ID NO: 2297428 - RNA, 13 nt, Yersinia pestis KIM
ugccgcauuaccc

SEQ ID NO: 2297429 - RNA, 16 nt, Yersinia pestis KIM
ugccgcaucaccgccc

SEQ ID NO: 2297430 - RNA, 16 nt, Yersinia pestis KIM
ugccgcaggucccucu

SEQ ID NO: 2297431 - RNA, 14 nt, Yersinia pestis KIM
ugccgccucugcuc

SEQ ID NO: 2297432 - RNA, 15 nt, Yersinia pestis KIM
ugccgaucaucucau

SEQ ID NO: 2297433 - RNA, 15 nt, Yersinia pestis KIM
ugcccugauccaggg

SEQ ID NO: 2297434 - RNA, 13 nt, Yersinia pestis KIM
ugcccgcgggggc

SEQ ID NO: 2297435 - RNA, 17 nt, Yersinia pestis KIM
ugcccgcgcuuccaggc

SEQ ID NO: 2297436 - RNA, 13 nt, Yersinia pestis KIM
ugcccuaaacagc

SEQ ID NO: 2297437 - RNA, 20 nt, Yersinia pestis KIM
ugcccguuagccaugcauua

SEQ ID NO: 2297438 - RNA, 14 nt, Yersinia pestis KIM
ugcccgcuuucuga

SEQ ID NO: 2297439 - RNA, 17 nt, Yersinia pestis KIM
ugcccgucaauaucauc

SEQ ID NO: 2297440 - RNA, 17 nt, Yersinia pestis KIM
ugcccccagguuucagu

SEQ ID NO: 2297441 - RNA, 21 nt, Yersinia pestis KIM
ugccccaaugaugacuugauu

SEQ ID NO: 2297442 - RNA, 12 nt, Yersinia pestis KIM
ugcauuggaaaa

SEQ ID NO: 2297443 - RNA, 12 nt, Yersinia pestis KIM
ugcauugauuaa

SEQ ID NO: 2297444 - RNA, 21 nt, Yersinia pestis KIM
ugcauuucaauucguucaaau

SEQ ID NO: 2297445 - RNA, 20 nt, Yersinia pestis KIM
ugcauuucguuccagugagc

SEQ ID NO: 2297446 - RNA, 16 nt, Yersinia pestis KIM
ugccaaauaucuuuca

SEQ ID NO: 2297447 - RNA, 16 nt, Yersinia pestis KIM
ugccaacaauugcucc

SEQ ID NO: 2297448 - RNA, 20 nt, Yersinia pestis KIM
ugccaaccaccaaagauaca

SEQ ID NO: 2297449 - RNA, 18 nt, Yersinia pestis KIM
ugccaaugccucuucaau

SEQ ID NO: 2297450 - RNA, 13 nt, Yersinia pestis KIM
ugccaaugcugcu

SEQ ID NO: 2297451 - RNA, 12 nt, Yersinia pestis KIM
ugccaaauauug

SEQ ID NO: 2297452 - RNA, 18 nt, Yersinia pestis KIM
ugccaacaacuuaauucc

SEQ ID NO: 2297453 - RNA, 21 nt, Yersinia pestis KIM
ugccacacagaaucaccaaca

SEQ ID NO: 2297454 - RNA, 13 nt, Yersinia pestis KIM
ugccacacucaga

SEQ ID NO: 2297455 - RNA, 14 nt, Yersinia pestis KIM
ugccacacucagac

SEQ ID NO: 2297456 - RNA, 16 nt, Yersinia pestis KIM
ugccacgaugagccgc

SEQ ID NO: 2297457 - RNA, 21 nt, Yersinia pestis KIM
ugccacgccaguaaacagcca

SEQ ID NO: 2297458 - RNA, 14 nt, Yersinia pestis KIM
ugccagcgaaaauu

SEQ ID NO: 2297459 - RNA, 16 nt, Yersinia pestis KIM
ugccagccuguuuagu

SEQ ID NO: 2297460 - RNA, 21 nt, Yersinia pestis KIM
ugccagccuguuuaguaaaua

SEQ ID NO: 2297461 - RNA, 22 nt, Yersinia pestis KIM
ugccagacacaagauaaauacc

SEQ ID NO: 2297462 - RNA, 20 nt, Yersinia pestis KIM
ugccagacacaagauaaaua

SEQ ID NO: 2297463 - RNA, 17 nt, Yersinia pestis KIM
ugccagacacaagauaa

SEQ ID NO: 2297464 - RNA, 22 nt, Yersinia pestis KIM
ugccagaaucgccugcacacgg

SEQ ID NO: 2297465 - RNA, 20 nt, Yersinia pestis KIM
ugccagaaucgccugcacac

SEQ ID NO: 2297466 - RNA, 19 nt, Yersinia pestis KIM
ugccagauagaccccuucu

SEQ ID NO: 2297467 - RNA, 12 nt, Yersinia pestis KIM
ugccagcccauc

SEQ ID NO: 2297468 - RNA, 21 nt, Yersinia pestis KIM
ugccaugauguggcugcuguu

SEQ ID NO: 2297469 - RNA, 15 nt, Yersinia pestis KIM
ugccaucgggcaauu

SEQ ID NO: 2297470 - RNA, 20 nt, Yersinia pestis KIM
ugccaucccccuuuggccgc

SEQ ID NO: 2297471 - RNA, 18 nt, Yersinia pestis KIM
ugccauccauuacauccu

SEQ ID NO: 2297472 - RNA, 12 nt, Yersinia pestis KIM
ugcacugagcca

SEQ ID NO: 2297473 - RNA, 17 nt, Yersinia pestis KIM
ugcaguuaaggcuggcu

SEQ ID NO: 2297474 - RNA, 16 nt, Yersinia pestis KIM
ugcagugcaaccaaca

SEQ ID NO: 2297475 - RNA, 20 nt, Yersinia pestis KIM
ugcaguggaugauaaauauc

SEQ ID NO: 2297476 - RNA, 17 nt, Yersinia pestis KIM
ugcaguuggaucugcac

SEQ ID NO: 2297477 - RNA, 18 nt, Yersinia pestis KIM
ugcaguuuuccucccugc

SEQ ID NO: 2297478 - RNA, 17 nt, Yersinia pestis KIM
ugcauagcguuguucaa

SEQ ID NO: 2297479 - RNA, 22 nt, Yersinia pestis KIM
ugcauauguagggguacagcag

SEQ ID NO: 2297480 - RNA, 19 nt, Yersinia pestis KIM
ugcauauuauaaugaaaua

SEQ ID NO: 2297481 - RNA, 12 nt, Yersinia pestis KIM
ugcauauuucuc

SEQ ID NO: 2297482 - RNA, 20 nt, Yersinia pestis KIM
ugcauaucauucgguuauuu

SEQ ID NO: 2297483 - RNA, 14 nt, Yersinia pestis KIM
ugcauauaaaacac

SEQ ID NO: 2297484 - RNA, 17 nt, Yersinia pestis KIM
ugcaucaauaaauagag

SEQ ID NO: 2297485 - RNA, 16 nt, Yersinia pestis KIM
ugcaucaacuuugguu

SEQ ID NO: 2297486 - RNA, 20 nt, Yersinia pestis KIM
ugcaucaacgacagcagcag

SEQ ID NO: 2297487 - RNA, 21 nt, Yersinia pestis KIM
ugcaucaacgacagcagcagg

SEQ ID NO: 2297488 - RNA, 21 nt, Yersinia pestis KIM
ugcauccgcaaaauggguaua

SEQ ID NO: 2297489 - RNA, 13 nt, Yersinia pestis KIM
ugcaucgcacuga

SEQ ID NO: 2297490 - RNA, 22 nt, Yersinia pestis KIM
ugcaucuauugugucaauaccu

SEQ ID NO: 2297491 - RNA, 23 nt, Yersinia pestis KIM
ugcaucgcgggcgcgcugcugcu

SEQ ID NO: 2297492 - RNA, 11 nt, Yersinia pestis KIM
ugcaucucugc

SEQ ID NO: 2297493 - RNA, 16 nt, Yersinia pestis KIM
ugcaucucugcaucac

SEQ ID NO: 2297494 - RNA, 17 nt, Yersinia pestis KIM
ugcaucuggucaucaug

SEQ ID NO: 2297495 - RNA, 19 nt, Yersinia pestis KIM
ugcaucuggucaucaugua

SEQ ID NO: 2297496 - RNA, 20 nt, Yersinia pestis KIM
ugcaucuggugacccgucag

SEQ ID NO: 2297497 - RNA, 19 nt, Yersinia pestis KIM
ugcgugcaauaaagcgaua

SEQ ID NO: 2297498 - RNA, 23 nt, Yersinia pestis KIM
ugcgugacauacuuugccuuauc

SEQ ID NO: 2297499 - RNA, 11 nt, Yersinia pestis KIM
ugcggucuggc

SEQ ID NO: 2297500 - RNA, 13 nt, Yersinia pestis KIM
ugcggccauccag

SEQ ID NO: 2297501 - RNA, 21 nt, Yersinia pestis KIM
ugcggauucacccauuaauag

SEQ ID NO: 2297502 - RNA, 14 nt, Yersinia pestis KIM
ugcggauucaccca

SEQ ID NO: 2297503 - RNA, 19 nt, Yersinia pestis KIM
ugcggaguaacacuucaga

SEQ ID NO: 2297504 - RNA, 23 nt, Yersinia pestis KIM
ugcggaagcgccgacacccagcc

SEQ ID NO: 2297505 - RNA, 23 nt, Yersinia pestis KIM
ugcgcucaaccgaagcugcggcu

SEQ ID NO: 2297506 - RNA, 17 nt, Yersinia pestis KIM
ugcgcuacgcaugaugc

SEQ ID NO: 2297507 - RNA, 15 nt, Yersinia pestis KIM
ugcgcuaacagcguu

SEQ ID NO: 2297508 - RNA, 19 nt, Yersinia pestis KIM
ugcgcguuaaucugcugcu

SEQ ID NO: 2297509 - RNA, 19 nt, Yersinia pestis KIM
ugcgcccuuuuccgucagc

SEQ ID NO: 2297510 - RNA, 21 nt, Yersinia pestis KIM
ugcgcccuuaucuaucucagg

SEQ ID NO: 2297511 - RNA, 16 nt, Yersinia pestis KIM
ugcgccggagaggcuu

SEQ ID NO: 2297512 - RNA, 21 nt, Yersinia pestis KIM
ugcgccauuaccacuguuacc

SEQ ID NO: 2297513 - RNA, 22 nt, Yersinia pestis KIM
ugcgcccgguaauaaugaacaa

SEQ ID NO: 2297514 - RNA, 22 nt, Yersinia pestis KIM
ugccuucuccuuucuguuccau

SEQ ID NO: 2297515 - RNA, 19 nt, Yersinia pestis KIM
ugcgcgguugucggcauaa

SEQ ID NO: 2297516 - RNA, 14 nt, Yersinia pestis KIM
ugcgcgcagcaagc

SEQ ID NO: 2297517 - RNA, 17 nt, Yersinia pestis KIM
ugcgcgaccaaguuuga

SEQ ID NO: 2297518 - RNA, 11 nt, Yersinia pestis KIM
ugcuucagaca

SEQ ID NO: 2297519 - RNA, 17 nt, Yersinia pestis KIM
ugcuugaguccaaccac

SEQ ID NO: 2297520 - RNA, 13 nt, Yersinia pestis KIM
ugcuuauccagcc

SEQ ID NO: 2297521 - RNA, 19 nt, Yersinia pestis KIM
ugcuucaaauccucggguu

SEQ ID NO: 2297522 - RNA, 21 nt, Yersinia pestis KIM
ugcuucaagcccgaaauucag

SEQ ID NO: 2297523 - RNA, 13 nt, Yersinia pestis KIM
ugcuucacaucau

SEQ ID NO: 2297524 - RNA, 12 nt, Yersinia pestis KIM
ugcuuuuaacuc

SEQ ID NO: 2297525 - RNA, 19 nt, Yersinia pestis KIM
ugcuuugugggcuuuugcu

SEQ ID NO: 2297526 - RNA, 21 nt, Yersinia pestis KIM
ugcuuuaaugaguuggcauuc

SEQ ID NO: 2297527 - RNA, 22 nt, Yersinia pestis KIM
ugcuugccagcgcuuuaggcaa

SEQ ID NO: 2297528 - RNA, 21 nt, Yersinia pestis KIM
ugcuggcuaauacuggcuaaa

SEQ ID NO: 2297529 - RNA, 13 nt, Yersinia pestis KIM
ugcugcuuccugc

SEQ ID NO: 2297530 - RNA, 12 nt, Yersinia pestis KIM
ugcugcuguuau

SEQ ID NO: 2297531 - RNA, 13 nt, Yersinia pestis KIM
ugcugcuguuauu

SEQ ID NO: 2297532 - RNA, 17 nt, Yersinia pestis KIM
ugcugccugcaccagug

SEQ ID NO: 2297533 - RNA, 17 nt, Yersinia pestis KIM
ugcuggggacuuuucuu

SEQ ID NO: 2297534 - RNA, 18 nt, Yersinia pestis KIM
ugcuguuacgcacaaaca

SEQ ID NO: 2297535 - RNA, 15 nt, Yersinia pestis KIM
ugcuguucuggcagg

SEQ ID NO: 2297536 - RNA, 22 nt, Yersinia pestis KIM
ugcuguuguuauuacugucacu

SEQ ID NO: 2297537 - RNA, 13 nt, Yersinia pestis KIM
ugcuguugccaca

SEQ ID NO: 2297538 - RNA, 15 nt, Yersinia pestis KIM
ugcugaaaaaugagu

SEQ ID NO: 2297539 - RNA, 18 nt, Yersinia pestis KIM
ugcucgucuucgacagca

SEQ ID NO: 2297540 - RNA, 17 nt, Yersinia pestis KIM
ugcugagugaagacauc

SEQ ID NO: 2297541 - RNA, 16 nt, Yersinia pestis KIM
ugcugagccaaauaau

SEQ ID NO: 2297542 - RNA, 18 nt, Yersinia pestis KIM
ugcugaugcaauaacucc

SEQ ID NO: 2297543 - RNA, 21 nt, Yersinia pestis KIM
ugcugaugucagugcuccauc

SEQ ID NO: 2297544 - RNA, 16 nt, Yersinia pestis KIM
ugcugcaccucugcug

SEQ ID NO: 2297545 - RNA, 17 nt, Yersinia pestis KIM
ugcugauuugccagauu

SEQ ID NO: 2297546 - RNA, 21 nt, Yersinia pestis KIM
ugcugcccggucgccauaauu

SEQ ID NO: 2297547 - RNA, 23 nt, Yersinia pestis KIM
ugcucgauuucacuugccgccuu

SEQ ID NO: 2297548 - RNA, 18 nt, Yersinia pestis KIM
ugcuccuuacuauuuuca

SEQ ID NO: 2297549 - RNA, 14 nt, Yersinia pestis KIM
ugcuccugaugacu

SEQ ID NO: 2297550 - RNA, 14 nt, Yersinia pestis KIM
ugcucccggcgcua

SEQ ID NO: 2297551 - RNA, 18 nt, Yersinia pestis KIM
ugcuccgcagugaucagu

SEQ ID NO: 2297552 - RNA, 19 nt, Yersinia pestis KIM
ugcuccgcagugaucaguc

SEQ ID NO: 2297553 - RNA, 23 nt, Yersinia pestis KIM
ugcguugugguuggucguauccu

SEQ ID NO: 2297554 - RNA, 13 nt, Yersinia pestis KIM
ugcucauguucau

SEQ ID NO: 2297555 - RNA, 15 nt, Yersinia pestis KIM
ugcucauguucaugu

SEQ ID NO: 2297556 - RNA, 16 nt, Yersinia pestis KIM
ugcucauuaccaauac

SEQ ID NO: 2297557 - RNA, 18 nt, Yersinia pestis KIM
ugcucaucaaccucagcc

SEQ ID NO: 2297558 - RNA, 19 nt, Yersinia pestis KIM
ugcucaucaaccucagccu

SEQ ID NO: 2297559 - RNA, 16 nt, Yersinia pestis KIM
ugcucaccauguacau

SEQ ID NO: 2297560 - RNA, 18 nt, Yersinia pestis KIM
ugcucaccauguacaugg

SEQ ID NO: 2297561 - RNA, 14 nt, Yersinia pestis KIM
ugaauagcgcugca

SEQ ID NO: 2297562 - RNA, 21 nt, Yersinia pestis KIM
ugaauaacuucgcgaacacaa

SEQ ID NO: 2297563 - RNA, 19 nt, Yersinia pestis KIM
ugaauaagguucuuucauu

SEQ ID NO: 2297564 - RNA, 15 nt, Yersinia pestis KIM
ugaauagaggacuau

SEQ ID NO: 2297565 - RNA, 23 nt, Yersinia pestis KIM
ugaauagaggacuauucaaugac

SEQ ID NO: 2297566 - RNA, 18 nt, Yersinia pestis KIM
ugaauacuuugcggcuca

SEQ ID NO: 2297567 - RNA, 20 nt, Yersinia pestis KIM
ugaauagagacgccauaacc

SEQ ID NO: 2297568 - RNA, 13 nt, Yersinia pestis KIM
ugaauaaaucaaa

SEQ ID NO: 2297569 - RNA, 15 nt, Yersinia pestis KIM
ugaauaaaaccgccc

SEQ ID NO: 2297570 - RNA, 19 nt, Yersinia pestis KIM
ugaaguuuauacuauuuau

SEQ ID NO: 2297571 - RNA, 13 nt, Yersinia pestis KIM
ugaauaaaagaga

SEQ ID NO: 2297572 - RNA, 12 nt, Yersinia pestis KIM
ugaauaaacacc

SEQ ID NO: 2297573 - RNA, 15 nt, Yersinia pestis KIM
ugaauaaacaccaua

SEQ ID NO: 2297574 - RNA, 20 nt, Yersinia pestis KIM
ugaauaaacaccauagccac

SEQ ID NO: 2297575 - RNA, 16 nt, Yersinia pestis KIM
ugaaguuauuuuuauu

SEQ ID NO: 2297576 - RNA, 17 nt, Yersinia pestis KIM
ugaagugugcaaauaaa

SEQ ID NO: 2297577 - RNA, 14 nt, Yersinia pestis KIM
ugaaguucucauca

SEQ ID NO: 2297578 - RNA, 18 nt, Yersinia pestis KIM
ugaaguaucaccacguug

SEQ ID NO: 2297579 - RNA, 13 nt, Yersinia pestis KIM
ugaagugagcuga

SEQ ID NO: 2297580 - RNA, 19 nt, Yersinia pestis KIM
ugaaguggcugaauaucau

SEQ ID NO: 2297581 - RNA, 15 nt, Yersinia pestis KIM
ugaauggcugccauc

SEQ ID NO: 2297582 - RNA, 15 nt, Yersinia pestis KIM
ugaauggcuauuuac

SEQ ID NO: 2297583 - RNA, 15 nt, Yersinia pestis KIM
ugaauggaaguuaaa

SEQ ID NO: 2297584 - RNA, 20 nt, Yersinia pestis KIM
ugaaucgaguaauauuuugu

SEQ ID NO: 2297585 - RNA, 16 nt, Yersinia pestis KIM
ugaaucaggugauggc

SEQ ID NO: 2297586 - RNA, 21 nt, Yersinia pestis KIM
ugaaucaagaauacacaaaaa

SEQ ID NO: 2297587 - RNA, 18 nt, Yersinia pestis KIM
ugaaugucucuggcgcga

SEQ ID NO: 2297588 - RNA, 17 nt, Yersinia pestis KIM
ugaauguuccggacuuc

SEQ ID NO: 2297589 - RNA, 13 nt, Yersinia pestis KIM
ugaauuaacauac

SEQ ID NO: 2297590 - RNA, 12 nt, Yersinia pestis KIM
ugaauuaaauuu

SEQ ID NO: 2297591 - RNA, 18 nt, Yersinia pestis KIM
ugaauuacguuuuggauc

SEQ ID NO: 2297592 - RNA, 15 nt, Yersinia pestis KIM
ugaauuugauacagu

SEQ ID NO: 2297593 - RNA, 18 nt, Yersinia pestis KIM
ugaauuugauacagugau

SEQ ID NO: 2297594 - RNA, 19 nt, Yersinia pestis KIM
ugaauuuuagucaaaacaa

SEQ ID NO: 2297595 - RNA, 14 nt, Yersinia pestis KIM
ugaagaaaccuaau

SEQ ID NO: 2297596 - RNA, 18 nt, Yersinia pestis KIM
ugaagagaaauaacccau

SEQ ID NO: 2297597 - RNA, 18 nt, Yersinia pestis KIM
ugaagaggguuuuuaaau

SEQ ID NO: 2297598 - RNA, 20 nt, Yersinia pestis KIM
ugaagaggguuuuuaaauuu

SEQ ID NO: 2297599 - RNA, 17 nt, Yersinia pestis KIM
ugaagaguuugaucaug

SEQ ID NO: 2297600 - RNA, 22 nt, Yersinia pestis KIM
ugaagaggguuuuuaaauuucu

SEQ ID NO: 2297601 - RNA, 15 nt, Yersinia pestis KIM
ugaagacaacucuuc

SEQ ID NO: 2297602 - RNA, 16 nt, Yersinia pestis KIM
ugaagacacacuuauu

SEQ ID NO: 2297603 - RNA, 22 nt, Yersinia pestis KIM
ugaacuucaaaucgccaaacug

SEQ ID NO: 2297604 - RNA, 21 nt, Yersinia pestis KIM
ugaacuucaaaucgccaaacu

SEQ ID NO: 2297605 - RNA, 18 nt, Yersinia pestis KIM
ugaacuucaaaucgccaa

SEQ ID NO: 2297606 - RNA, 15 nt, Yersinia pestis KIM
ugaacuguggcauga

SEQ ID NO: 2297607 - RNA, 23 nt, Yersinia pestis KIM
ugaacugacacacaccagugauu

SEQ ID NO: 2297608 - RNA, 19 nt, Yersinia pestis KIM
ugaacguagcuaacaccgc

SEQ ID NO: 2297609 - RNA, 16 nt, Yersinia pestis KIM
ugaacggugaggaugg

SEQ ID NO: 2297610 - RNA, 16 nt, Yersinia pestis KIM
ugaaggcguagguggu

SEQ ID NO: 2297611 - RNA, 21 nt, Yersinia pestis KIM
ugaaggcugauuaauaucaaa

SEQ ID NO: 2297612 - RNA, 19 nt, Yersinia pestis KIM
ugaagcucauuaauccccg

SEQ ID NO: 2297613 - RNA, 13 nt, Yersinia pestis KIM
ugaaggaugaaua

SEQ ID NO: 2297614 - RNA, 14 nt, Yersinia pestis KIM
ugaaggccauaauc

SEQ ID NO: 2297615 - RNA, 22 nt, Yersinia pestis KIM
ugaagauacccuucucuuuauc

SEQ ID NO: 2297616 - RNA, 15 nt, Yersinia pestis KIM
ugaagauacccuuga

SEQ ID NO: 2297617 - RNA, 13 nt, Yersinia pestis KIM
ugaagauuuaaau

SEQ ID NO: 2297618 - RNA, 17 nt, Yersinia pestis KIM
ugaagauuuaaauaaca

SEQ ID NO: 2297619 - RNA, 16 nt, Yersinia pestis KIM
ugaagcagauaaagaa

SEQ ID NO: 2297620 - RNA, 22 nt, Yersinia pestis KIM
ugaagccuucauguuuaucaaa

SEQ ID NO: 2297621 - RNA, 20 nt, Yersinia pestis KIM
ugaagccugauggguauauu

SEQ ID NO: 2297622 - RNA, 17 nt, Yersinia pestis KIM
ugaagcgacacuuauug

SEQ ID NO: 2297623 - RNA, 14 nt, Yersinia pestis KIM
ugaagccagcaccg

SEQ ID NO: 2297624 - RNA, 16 nt, Yersinia pestis KIM
ugaccuguuguaacac

SEQ ID NO: 2297625 - RNA, 21 nt, Yersinia pestis KIM
ugaccuuaauaccguguaccc

SEQ ID NO: 2297626 - RNA, 16 nt, Yersinia pestis KIM
ugacgaccaauaucau

SEQ ID NO: 2297627 - RNA, 13 nt, Yersinia pestis KIM
ugacgaaaugccg

SEQ ID NO: 2297628 - RNA, 18 nt, Yersinia pestis KIM
ugacgaaguuuuagccua

SEQ ID NO: 2297629 - RNA, 16 nt, Yersinia pestis KIM
ugacgccgccgcguga

SEQ ID NO: 2297630 - RNA, 17 nt, Yersinia pestis KIM
ugacgcgaucugaaacg

SEQ ID NO: 2297631 - RNA, 23 nt, Yersinia pestis KIM
ugacgcguagagccuuuacgggc

SEQ ID NO: 2297632 - RNA, 20 nt, Yersinia pestis KIM
ugacggcggcgagcacugcc

SEQ ID NO: 2297633 - RNA, 15 nt, Yersinia pestis KIM
ugacgcagcaggcgu

SEQ ID NO: 2297634 - RNA, 20 nt, Yersinia pestis KIM
ugacgccaacuucaagccga

SEQ ID NO: 2297635 - RNA, 15 nt, Yersinia pestis KIM
ugaccagauagcugu

SEQ ID NO: 2297636 - RNA, 17 nt, Yersinia pestis KIM
ugaccgauugaaucaag

SEQ ID NO: 2297637 - RNA, 14 nt, Yersinia pestis KIM
ugacauuuccuugu

SEQ ID NO: 2297638 - RNA, 13 nt, Yersinia pestis KIM
ugaccaaacauug

SEQ ID NO: 2297639 - RNA, 21 nt, Yersinia pestis KIM
ugaccaaagcaguaaacauuu

SEQ ID NO: 2297640 - RNA, 17 nt, Yersinia pestis KIM
ugacauucaaauacggc

SEQ ID NO: 2297641 - RNA, 13 nt, Yersinia pestis KIM
ugacaucccagca

SEQ ID NO: 2297642 - RNA, 19 nt, Yersinia pestis KIM
ugacaaugcguuauaacua

SEQ ID NO: 2297643 - RNA, 23 nt, Yersinia pestis KIM
ugagaaaggauuugaagacaacu

SEQ ID NO: 2297644 - RNA, 16 nt, Yersinia pestis KIM
ugagaaccaguucugg

SEQ ID NO: 2297645 - RNA, 18 nt, Yersinia pestis KIM
ugagaaccaguucuggua

SEQ ID NO: 2297646 - RNA, 23 nt, Yersinia pestis KIM
ugagacagcgcgguuugguacau

SEQ ID NO: 2297647 - RNA, 16 nt, Yersinia pestis KIM
ugacuuacgucuuuaa

SEQ ID NO: 2297648 - RNA, 23 nt, Yersinia pestis KIM
ugagcaaucuggcggccgcucac

SEQ ID NO: 2297649 - RNA, 15 nt, Yersinia pestis KIM
ugagcaccacaauac

SEQ ID NO: 2297650 - RNA, 16 nt, Yersinia pestis KIM
ugagauaaucacugag

SEQ ID NO: 2297651 - RNA, 13 nt, Yersinia pestis KIM
ugagcaaaucccg

SEQ ID NO: 2297652 - RNA, 12 nt, Yersinia pestis KIM
ugagagaaacuu

SEQ ID NO: 2297653 - RNA, 18 nt, Yersinia pestis KIM
ugagagcauaaccccaac

SEQ ID NO: 2297654 - RNA, 14 nt, Yersinia pestis KIM
ugagacuccucuuc

SEQ ID NO: 2297655 - RNA, 15 nt, Yersinia pestis KIM
ugagauaaggaucug

SEQ ID NO: 2297656 - RNA, 14 nt, Yersinia pestis KIM
ugacggugcccaca

SEQ ID NO: 2297657 - RNA, 16 nt, Yersinia pestis KIM
ugacguaaaaaggcag

SEQ ID NO: 2297658 - RNA, 18 nt, Yersinia pestis KIM
ugacggggaguuuuuauu

SEQ ID NO: 2297659 - RNA, 17 nt, Yersinia pestis KIM
ugacggguauauuuaug

SEQ ID NO: 2297660 - RNA, 12 nt, Yersinia pestis KIM
ugacgggucagc

SEQ ID NO: 2297661 - RNA, 13 nt, Yersinia pestis KIM
ugacuaaacugau

SEQ ID NO: 2297662 - RNA, 16 nt, Yersinia pestis KIM
ugacuauucccuuguu

SEQ ID NO: 2297663 - RNA, 19 nt, Yersinia pestis KIM
ugacuaacucuucuggcaa

SEQ ID NO: 2297664 - RNA, 17 nt, Yersinia pestis KIM
ugacuaauugugcagca

SEQ ID NO: 2297665 - RNA, 23 nt, Yersinia pestis KIM
ugacuaauuaauaaccauaaaau

SEQ ID NO: 2297666 - RNA, 17 nt, Yersinia pestis KIM
ugacuaccuugcuccgc

SEQ ID NO: 2297667 - RNA, 12 nt, Yersinia pestis KIM
ugacugaacauc

SEQ ID NO: 2297668 - RNA, 21 nt, Yersinia pestis KIM
ugacugaaaguuguucauuac

SEQ ID NO: 2297669 - RNA, 15 nt, Yersinia pestis KIM
ugacuauucugccua

SEQ ID NO: 2297670 - RNA, 17 nt, Yersinia pestis KIM
ugacuauuuaaauacaa

SEQ ID NO: 2297671 - RNA, 18 nt, Yersinia pestis KIM
ugauuaacauccauugua

SEQ ID NO: 2297672 - RNA, 20 nt, Yersinia pestis KIM
ugauuaagcggcaauaacac

SEQ ID NO: 2297673 - RNA, 13 nt, Yersinia pestis KIM
ugauuaauaucaa

SEQ ID NO: 2297674 - RNA, 19 nt, Yersinia pestis KIM
ugauuaauaucaaaacuga

SEQ ID NO: 2297675 - RNA, 22 nt, Yersinia pestis KIM
ugauuacguuccacugcuuuag

SEQ ID NO: 2297676 - RNA, 17 nt, Yersinia pestis KIM
ugauucagugauaacaa

SEQ ID NO: 2297677 - RNA, 20 nt, Yersinia pestis KIM
ugauugcagauaaacaucau

SEQ ID NO: 2297678 - RNA, 13 nt, Yersinia pestis KIM
ugauugauuauca

SEQ ID NO: 2297679 - RNA, 15 nt, Yersinia pestis KIM
ugauugcaucaucag

SEQ ID NO: 2297680 - RNA, 14 nt, Yersinia pestis KIM
ugauuggcuccuau

SEQ ID NO: 2297681 - RNA, 20 nt, Yersinia pestis KIM
ugauuggcuccuauagcuca

SEQ ID NO: 2297682 - RNA, 22 nt, Yersinia pestis KIM
ugauugguggucuuaucauaau

SEQ ID NO: 2297683 - RNA, 15 nt, Yersinia pestis KIM
ugauuuagcuauuga

SEQ ID NO: 2297684 - RNA, 11 nt, Yersinia pestis KIM
ugauuuuuaac

SEQ ID NO: 2297685 - RNA, 14 nt, Yersinia pestis KIM
ugcaaaucaugcuc

SEQ ID NO: 2297686 - RNA, 20 nt, Yersinia pestis KIM
ugcaaaucaugcucaaucug

SEQ ID NO: 2297687 - RNA, 18 nt, Yersinia pestis KIM
ugcaaauguucaacaaga

SEQ ID NO: 2297688 - RNA, 12 nt, Yersinia pestis KIM
ugcaaauaauaa

SEQ ID NO: 2297689 - RNA, 18 nt, Yersinia pestis KIM
ugcaaaaugcucuucacc

SEQ ID NO: 2297690 - RNA, 21 nt, Yersinia pestis KIM
ugcaaaauuccaccauucuca

SEQ ID NO: 2297691 - RNA, 23 nt, Yersinia pestis KIM
ugcaaacagguaaauaagauagc

SEQ ID NO: 2297692 - RNA, 21 nt, Yersinia pestis KIM
ugcaaaauacaaaguaaacuu

SEQ ID NO: 2297693 - RNA, 18 nt, Yersinia pestis KIM
ugauuuuuaucaucauaa

SEQ ID NO: 2297694 - RNA, 18 nt, Yersinia pestis KIM
ugauuuuuauauuuugag

SEQ ID NO: 2297695 - RNA, 14 nt, Yersinia pestis KIM
ugauuuuuauauuu

SEQ ID NO: 2297696 - RNA, 13 nt, Yersinia pestis KIM
ugcaacgccuuca

SEQ ID NO: 2297697 - RNA, 15 nt, Yersinia pestis KIM
ugcaacgcaggcacu

SEQ ID NO: 2297698 - RNA, 18 nt, Yersinia pestis KIM
ugcaaccaguuaaagaau

SEQ ID NO: 2297699 - RNA, 14 nt, Yersinia pestis KIM
ugcaacauuaaaaa

SEQ ID NO: 2297700 - RNA, 11 nt, Yersinia pestis KIM
ugcaacauuau

SEQ ID NO: 2297701 - RNA, 23 nt, Yersinia pestis KIM
ugcaacauuauccguuugcaaca

SEQ ID NO: 2297702 - RNA, 20 nt, Yersinia pestis KIM
ugcaacagcgcucauagcaa

SEQ ID NO: 2297703 - RNA, 11 nt, Yersinia pestis KIM
ugcaacaguga

SEQ ID NO: 2297704 - RNA, 14 nt, Yersinia pestis KIM
ugcaacaacgccag

SEQ ID NO: 2297705 - RNA, 14 nt, Yersinia pestis KIM
ugcaaauggcaggg

SEQ ID NO: 2297706 - RNA, 18 nt, Yersinia pestis KIM
ugcaaucagaggccauca

SEQ ID NO: 2297707 - RNA, 13 nt, Yersinia pestis KIM
ugcaacucauuaa

SEQ ID NO: 2297708 - RNA, 18 nt, Yersinia pestis KIM
ugcaacguuaaagaugaa

SEQ ID NO: 2297709 - RNA, 15 nt, Yersinia pestis KIM
ugcaacuucagccac

SEQ ID NO: 2297710 - RNA, 20 nt, Yersinia pestis KIM
ugcaccgcugauaaccagca

SEQ ID NO: 2297711 - RNA, 23 nt, Yersinia pestis KIM
ugcaccgcugauaaccagcagcu

SEQ ID NO: 2297712 - RNA, 14 nt, Yersinia pestis KIM
ugcaccguaacuuc

SEQ ID NO: 2297713 - RNA, 22 nt, Yersinia pestis KIM
ugcacguuuaauuucacuucca

SEQ ID NO: 2297714 - RNA, 16 nt, Yersinia pestis KIM
ugcacccauagcucag

SEQ ID NO: 2297715 - RNA, 13 nt, Yersinia pestis KIM
ugcacccccuucg

SEQ ID NO: 2297716 - RNA, 23 nt, Yersinia pestis KIM
ugcaccacacagcguagacaaug

SEQ ID NO: 2297717 - RNA, 16 nt, Yersinia pestis KIM
ugaucaucgcaccaua

SEQ ID NO: 2297718 - RNA, 14 nt, Yersinia pestis KIM
ugaucaucagcagc

SEQ ID NO: 2297719 - RNA, 20 nt, Yersinia pestis KIM
ugaucgguuagcuacugaug

SEQ ID NO: 2297720 - RNA, 18 nt, Yersinia pestis KIM
ugaucguuacggcugcgc

SEQ ID NO: 2297721 - RNA, 20 nt, Yersinia pestis KIM
ugaucuaacguccccugagc

SEQ ID NO: 2297722 - RNA, 23 nt, Yersinia pestis KIM
ugaucucaucauugacgugcagg

SEQ ID NO: 2297723 - RNA, 19 nt, Yersinia pestis KIM
ugaucuugaauaauauuca

SEQ ID NO: 2297724 - RNA, 20 nt, Yersinia pestis KIM
ugaucuugaauaauauucaa

SEQ ID NO: 2297725 - RNA, 14 nt, Yersinia pestis KIM
ugaucuugaauaau

SEQ ID NO: 2297726 - RNA, 16 nt, Yersinia pestis KIM
ugaugaaacuaaaaua

SEQ ID NO: 2297727 - RNA, 13 nt, Yersinia pestis KIM
ugaugaaauuaaa

SEQ ID NO: 2297728 - RNA, 19 nt, Yersinia pestis KIM
ugaugaucaugcucaccau

SEQ ID NO: 2297729 - RNA, 12 nt, Yersinia pestis KIM
ugaugauaucac

SEQ ID NO: 2297730 - RNA, 16 nt, Yersinia pestis KIM
ugaugagcuguagaac

SEQ ID NO: 2297731 - RNA, 17 nt, Yersinia pestis KIM
ugaugagucuauuuauu

SEQ ID NO: 2297732 - RNA, 18 nt, Yersinia pestis KIM
ugaucacaguaaauucuu

SEQ ID NO: 2297733 - RNA, 21 nt, Yersinia pestis KIM
ugaucaauaucccgagaaaca

SEQ ID NO: 2297734 - RNA, 13 nt, Yersinia pestis KIM
ugaucaacucacg

SEQ ID NO: 2297735 - RNA, 13 nt, Yersinia pestis KIM
ugaucaacugccu

SEQ ID NO: 2297736 - RNA, 16 nt, Yersinia pestis KIM
ugauaugggaacgucu

SEQ ID NO: 2297737 - RNA, 18 nt, Yersinia pestis KIM
ugauaugcuucacaucau

SEQ ID NO: 2297738 - RNA, 22 nt, Yersinia pestis KIM
ugauaugccugaaguugaucaa

SEQ ID NO: 2297739 - RNA, 15 nt, Yersinia pestis KIM
ugauaugcuuauaaa

SEQ ID NO: 2297740 - RNA, 17 nt, Yersinia pestis KIM
ugauaugaaaaaucuga

SEQ ID NO: 2297741 - RNA, 15 nt, Yersinia pestis KIM
ugauauaaagcauuu

SEQ ID NO: 2297742 - RNA, 14 nt, Yersinia pestis KIM
ugauaucuucacuc

SEQ ID NO: 2297743 - RNA, 17 nt, Yersinia pestis KIM
ugauaucuucacucagc

SEQ ID NO: 2297744 - RNA, 21 nt, Yersinia pestis KIM
ugauaucuucggcggcuaaag

SEQ ID NO: 2297745 - RNA, 14 nt, Yersinia pestis KIM
ugauagcaaaacac

SEQ ID NO: 2297746 - RNA, 22 nt, Yersinia pestis KIM
ugauagccaacacgaccugugc

SEQ ID NO: 2297747 - RNA, 23 nt, Yersinia pestis KIM
ugauagccaacacgaccugugca

SEQ ID NO: 2297748 - RNA, 21 nt, Yersinia pestis KIM
ugauagccacaucauuaccca

SEQ ID NO: 2297749 - RNA, 21 nt, Yersinia pestis KIM
ugauagauucaucaccaguca

SEQ ID NO: 2297750 - RNA, 20 nt, Yersinia pestis KIM
ugauagcagaaacccccaac

SEQ ID NO: 2297751 - RNA, 23 nt, Yersinia pestis KIM
ugauagcgacacccucagaggcc

SEQ ID NO: 2297752 - RNA, 22 nt, Yersinia pestis KIM
ugauacuccguuggcaaucugg

SEQ ID NO: 2297753 - RNA, 18 nt, Yersinia pestis KIM
ugauagguauugcgggug

SEQ ID NO: 2297754 - RNA, 13 nt, Yersinia pestis KIM
ugauaggcacggc

SEQ ID NO: 2297755 - RNA, 18 nt, Yersinia pestis KIM
ugauaguguaaaaaccau

SEQ ID NO: 2297756 - RNA, 23 nt, Yersinia pestis KIM
ugagcauacuguuggcaauuuca

SEQ ID NO: 2297757 - RNA, 19 nt, Yersinia pestis KIM
ugagccaccgcauuccagc

SEQ ID NO: 2297758 - RNA, 20 nt, Yersinia pestis KIM
ugagccagaaacgaucuugg

SEQ ID NO: 2297759 - RNA, 18 nt, Yersinia pestis KIM
ugagccacacauucaguc

SEQ ID NO: 2297760 - RNA, 13 nt, Yersinia pestis KIM
ugaguuaucuccu

SEQ ID NO: 2297761 - RNA, 16 nt, Yersinia pestis KIM
ugaguuaucuccugua

SEQ ID NO: 2297762 - RNA, 22 nt, Yersinia pestis KIM
ugagucucagggaugaagcuca

SEQ ID NO: 2297763 - RNA, 14 nt, Yersinia pestis KIM
ugagucucuggccc

SEQ ID NO: 2297764 - RNA, 14 nt, Yersinia pestis KIM
ugagucguaaaauu

SEQ ID NO: 2297765 - RNA, 17 nt, Yersinia pestis KIM
ugauaaaagucuauaua

SEQ ID NO: 2297766 - RNA, 22 nt, Yersinia pestis KIM
ugauaaaacuauucugcuugga

SEQ ID NO: 2297767 - RNA, 14 nt, Yersinia pestis KIM
ugauaaacaauaaa

SEQ ID NO: 2297768 - RNA, 18 nt, Yersinia pestis KIM
ugauaaacuguuuaagcu

SEQ ID NO: 2297769 - RNA, 22 nt, Yersinia pestis KIM
ugauaaacucaguauauuggua

SEQ ID NO: 2297770 - RNA, 14 nt, Yersinia pestis KIM
ugaguuucauuagu

SEQ ID NO: 2297771 - RNA, 21 nt, Yersinia pestis KIM
ugaguuuuagcccaaaauaga

SEQ ID NO: 2297772 - RNA, 17 nt, Yersinia pestis KIM
ugaguucugaucauuau

SEQ ID NO: 2297773 - RNA, 20 nt, Yersinia pestis KIM
ugaguugcaggaauccaagu

SEQ ID NO: 2297774 - RNA, 22 nt, Yersinia pestis KIM
ugaguugcccuaaacagcaaca

SEQ ID NO: 2297775 - RNA, 17 nt, Yersinia pestis KIM
ugauacaucucggcuuu

SEQ ID NO: 2297776 - RNA, 13 nt, Yersinia pestis KIM
ugauacaguaauu

SEQ ID NO: 2297777 - RNA, 21 nt, Yersinia pestis KIM
ugauaaugccuuuuaaaugaa

SEQ ID NO: 2297778 - RNA, 20 nt, Yersinia pestis KIM
ugauaauuaaugcaccuaca

SEQ ID NO: 2297779 - RNA, 16 nt, Yersinia pestis KIM
ugauaccgauaugccc

SEQ ID NO: 2297780 - RNA, 12 nt, Yersinia pestis KIM
ugauacccaguu

SEQ ID NO: 2297781 - RNA, 19 nt, Yersinia pestis KIM
ugauaccguuuuauauuga

SEQ ID NO: 2297782 - RNA, 17 nt, Yersinia pestis KIM
ugauaccggaaaaugcg

SEQ ID NO: 2297783 - RNA, 24 nt, Yersinia pestis KIM
ugauaccggaaaaugcgccagcca

SEQ ID NO: 2297784 - RNA, 23 nt, Yersinia pestis KIM
ugauaacgucauuccaguaggga

SEQ ID NO: 2297785 - RNA, 15 nt, Yersinia pestis KIM
ugauaacaccggcuu

SEQ ID NO: 2297786 - RNA, 17 nt, Yersinia pestis KIM
ugauaaccguucaagag

SEQ ID NO: 2297787 - RNA, 14 nt, Yersinia pestis KIM
ugauaauaguucau

SEQ ID NO: 2297788 - RNA, 15 nt, Yersinia pestis KIM
ugauaauaauauuga

SEQ ID NO: 2297789 - RNA, 22 nt, Yersinia pestis KIM
ucgccaacacguggguauccag

SEQ ID NO: 2297790 - RNA, 22 nt, Yersinia pestis KIM
ucgccaacauaaguaauaagua

SEQ ID NO: 2297791 - RNA, 19 nt, Yersinia pestis KIM
ucgccaauacaaucgucaa

SEQ ID NO: 2297792 - RNA, 20 nt, Yersinia pestis KIM
ucgccccuuagcgcacgggg

SEQ ID NO: 2297793 - RNA, 16 nt, Yersinia pestis KIM
ucgccgcuucuguacc

SEQ ID NO: 2297794 - RNA, 15 nt, Yersinia pestis KIM
ucgcccuguaacuuu

SEQ ID NO: 2297795 - RNA, 19 nt, Yersinia pestis KIM
ucgcccuguaaagccagua

SEQ ID NO: 2297796 - RNA, 23 nt, Yersinia pestis KIM
ucgccguuacccccuucaccaau

SEQ ID NO: 2297797 - RNA, 14 nt, Yersinia pestis KIM
ucgccuucuggcaa

SEQ ID NO: 2297798 - RNA, 22 nt, Yersinia pestis KIM
ucgccuuaaaugcguagaguca

SEQ ID NO: 2297799 - RNA, 22 nt, Yersinia pestis KIM
ucgccuuaucagcgaaaaauuu

SEQ ID NO: 2297800 - RNA, 13 nt, Yersinia pestis KIM
ucgauuucugcau

SEQ ID NO: 2297801 - RNA, 14 nt, Yersinia pestis KIM
ucgauuugcucuuu

SEQ ID NO: 2297802 - RNA, 14 nt, Yersinia pestis KIM
ucgauuuuagcuuu

SEQ ID NO: 2297803 - RNA, 21 nt, Yersinia pestis KIM
ucgcaaccagcguugagaaga

SEQ ID NO: 2297804 - RNA, 19 nt, Yersinia pestis KIM
ucgcaccgaugucuaacaa

SEQ ID NO: 2297805 - RNA, 15 nt, Yersinia pestis KIM
ucgcacaguuuucuu

SEQ ID NO: 2297806 - RNA, 15 nt, Yersinia pestis KIM
ucgcacugcucugcc

SEQ ID NO: 2297807 - RNA, 13 nt, Yersinia pestis KIM
ucgcacuucaacc

SEQ ID NO: 2297808 - RNA, 18 nt, Yersinia pestis KIM
ucgcacuuuaaauaccca

SEQ ID NO: 2297809 - RNA, 22 nt, Yersinia pestis KIM
ucgcacugugagcggcauccag

SEQ ID NO: 2297810 - RNA, 18 nt, Yersinia pestis KIM
ucgcaguaauagaaaaag

SEQ ID NO: 2297811 - RNA, 15 nt, Yersinia pestis KIM
ucgcagaccaaauuc

SEQ ID NO: 2297812 - RNA, 17 nt, Yersinia pestis KIM
ucgaucaaaacaauaaa

SEQ ID NO: 2297813 - RNA, 17 nt, Yersinia pestis KIM
ucgaucacaugcucagu

SEQ ID NO: 2297814 - RNA, 21 nt, Yersinia pestis KIM
ucgauaaauaauuacuuauaa

SEQ ID NO: 2297815 - RNA, 20 nt, Yersinia pestis KIM
ucgauaaaaggcuauuuaaa

SEQ ID NO: 2297816 - RNA, 21 nt, Yersinia pestis KIM
ucgauaaaaggcuauuuaaau

SEQ ID NO: 2297817 - RNA, 20 nt, Yersinia pestis KIM
ucgagcuguuugcuguaaac

SEQ ID NO: 2297818 - RNA, 14 nt, Yersinia pestis KIM
ucgaggaucaccac

SEQ ID NO: 2297819 - RNA, 12 nt, Yersinia pestis KIM
ucgaaccugaac

SEQ ID NO: 2297820 - RNA, 16 nt, Yersinia pestis KIM
ucgaacauuuucuaag

SEQ ID NO: 2297821 - RNA, 17 nt, Yersinia pestis KIM
ucgaacauuuucuaagc

SEQ ID NO: 2297822 - RNA, 21 nt, Yersinia pestis KIM
ucgaacauuuucuaagcugcc

SEQ ID NO: 2297823 - RNA, 21 nt, Yersinia pestis KIM
ucgaauaaacggauuugucug

SEQ ID NO: 2297824 - RNA, 17 nt, Yersinia pestis KIM
ucgaaucacuuauugga

SEQ ID NO: 2297825 - RNA, 15 nt, Yersinia pestis KIM
ucgacaccaaaacuc

SEQ ID NO: 2297826 - RNA, 17 nt, Yersinia pestis KIM
ucgacaccaagacugaa

SEQ ID NO: 2297827 - RNA, 14 nt, Yersinia pestis KIM
ucgacaccuucaau

SEQ ID NO: 2297828 - RNA, 19 nt, Yersinia pestis KIM
ucgacaccuucaaucauug

SEQ ID NO: 2297829 - RNA, 17 nt, Yersinia pestis KIM
ucgaaagauagcaaaag

SEQ ID NO: 2297830 - RNA, 19 nt, Yersinia pestis KIM
ucgaaagauagcaaaagaa

SEQ ID NO: 2297831 - RNA, 23 nt, Yersinia pestis KIM
ucgaaaauagacucgguagcggg

SEQ ID NO: 2297832 - RNA, 22 nt, Yersinia pestis KIM
uccuuuuuauuuaagcaguuca

SEQ ID NO: 2297833 - RNA, 23 nt, Yersinia pestis KIM
uccuuggcgcggacgcuuuacuc

SEQ ID NO: 2297834 - RNA, 21 nt, Yersinia pestis KIM
uccuugguaccgauuaugcca

SEQ ID NO: 2297835 - RNA, 20 nt, Yersinia pestis KIM
uccuuucuuuucgcuauuuc

SEQ ID NO: 2297836 - RNA, 22 nt, Yersinia pestis KIM
uccuuucuuuucgcuauuucuc

SEQ ID NO: 2297837 - RNA, 20 nt, Yersinia pestis KIM
uccuuucucuccuuauacua

SEQ ID NO: 2297838 - RNA, 19 nt, Yersinia pestis KIM
uccuuucguucacuuaucc

SEQ ID NO: 2297839 - RNA, 17 nt, Yersinia pestis KIM
uccuuuccauuuucauc

SEQ ID NO: 2297840 - RNA, 17 nt, Yersinia pestis KIM
uccuuugcccauaaacc

SEQ ID NO: 2297841 - RNA, 20 nt, Yersinia pestis KIM
uccugcgucucuaacccauu

SEQ ID NO: 2297842 - RNA, 16 nt, Yersinia pestis KIM
uccugcucaaacauga

SEQ ID NO: 2297843 - RNA, 20 nt, Yersinia pestis KIM
uccugcauauuauuuugcac

SEQ ID NO: 2297844 - RNA, 15 nt, Yersinia pestis KIM
uccugugcaaagugc

SEQ ID NO: 2297845 - RNA, 13 nt, Yersinia pestis KIM
uccugugccaaca

SEQ ID NO: 2297846 - RNA, 23 nt, Yersinia pestis KIM
uccuggaaccagugaaugcugcg

SEQ ID NO: 2297847 - RNA, 15 nt, Yersinia pestis KIM
uccuucagacugcug

SEQ ID NO: 2297848 - RNA, 13 nt, Yersinia pestis KIM
uccuucaauggca

SEQ ID NO: 2297849 - RNA, 13 nt, Yersinia pestis KIM
uccuuauacuaaa

SEQ ID NO: 2297850 - RNA, 20 nt, Yersinia pestis KIM
uccuuauuucuuacucuguu

SEQ ID NO: 2297851 - RNA, 19 nt, Yersinia pestis KIM
uccuuaccacugcucacuu

SEQ ID NO: 2297852 - RNA, 13 nt, Yersinia pestis KIM
uccuugaaguguu

SEQ ID NO: 2297853 - RNA, 20 nt, Yersinia pestis KIM
uccuucggacgcuccucacu

SEQ ID NO: 2297854 - RNA, 22 nt, Yersinia pestis KIM
ucggccaguguuuucuccacac

SEQ ID NO: 2297855 - RNA, 16 nt, Yersinia pestis KIM
ucggccacccgccauc

SEQ ID NO: 2297856 - RNA, 19 nt, Yersinia pestis KIM
ucggaugccgcuccagcac

SEQ ID NO: 2297857 - RNA, 16 nt, Yersinia pestis KIM
ucggauggucauccac

SEQ ID NO: 2297858 - RNA, 15 nt, Yersinia pestis KIM
ucggccuccccugcg

SEQ ID NO: 2297859 - RNA, 22 nt, Yersinia pestis KIM
ucggcccgcaaccugacugcug

SEQ ID NO: 2297860 - RNA, 19 nt, Yersinia pestis KIM
ucgcuguagcgccagguaa

SEQ ID NO: 2297861 - RNA, 20 nt, Yersinia pestis KIM
ucgcuggacgcaucagaucg

SEQ ID NO: 2297862 - RNA, 16 nt, Yersinia pestis KIM
ucgcugugcccuuuuu

SEQ ID NO: 2297863 - RNA, 16 nt, Yersinia pestis KIM
ucggaucagcgccugc

SEQ ID NO: 2297864 - RNA, 21 nt, Yersinia pestis KIM
ucggaucagcgccugcuguua

SEQ ID NO: 2297865 - RNA, 20 nt, Yersinia pestis KIM
ucggauaaccgcgaagaggg

SEQ ID NO: 2297866 - RNA, 17 nt, Yersinia pestis KIM
ucggauaguuaucuggg

SEQ ID NO: 2297867 - RNA, 23 nt, Yersinia pestis KIM
ucgggcuaucuuauuuaccuguu

SEQ ID NO: 2297868 - RNA, 19 nt, Yersinia pestis KIM
ucgggguuugucagcaguc

SEQ ID NO: 2297869 - RNA, 21 nt, Yersinia pestis KIM
ucgggugauggcugucugaug

SEQ ID NO: 2297870 - RNA, 16 nt, Yersinia pestis KIM
ucggcggagagaaugg

SEQ ID NO: 2297871 - RNA, 20 nt, Yersinia pestis KIM
ucggcgcgguaggggugcug

SEQ ID NO: 2297872 - RNA, 14 nt, Yersinia pestis KIM
ucggcgcgcuugcc

SEQ ID NO: 2297873 - RNA, 22 nt, Yersinia pestis KIM
ucggcggucugagucagucagg

SEQ ID NO: 2297874 - RNA, 22 nt, Yersinia pestis KIM
ucggcguucgguaaugccagcc

SEQ ID NO: 2297875 - RNA, 16 nt, Yersinia pestis KIM
ucguucggugcaaaac

SEQ ID NO: 2297876 - RNA, 19 nt, Yersinia pestis KIM
ucguuuaacucaaauaaac

SEQ ID NO: 2297877 - RNA, 12 nt, Yersinia pestis KIM
ucguuuuucauu

SEQ ID NO: 2297878 - RNA, 15 nt, Yersinia pestis KIM
ucguuuuucauuuuu

SEQ ID NO: 2297879 - RNA, 17 nt, Yersinia pestis KIM
ucguuuaaaaaauaucu

SEQ ID NO: 2297880 - RNA, 13 nt, Yersinia pestis KIM
ucguuuaaauaaa

SEQ ID NO: 2297881 - RNA, 20 nt, Yersinia pestis KIM
ucguuagggauucgugucaa

SEQ ID NO: 2297882 - RNA, 22 nt, Yersinia pestis KIM
ucguuacaucaugaguaaaaga

SEQ ID NO: 2297883 - RNA, 18 nt, Yersinia pestis KIM
ucguuauauaaauggcug

SEQ ID NO: 2297884 - RNA, 23 nt, Yersinia pestis KIM
ucguuagugaaguaauaaaaauc

SEQ ID NO: 2297885 - RNA, 14 nt, Yersinia pestis KIM
ucuaauuuauaacc

SEQ ID NO: 2297886 - RNA, 12 nt, Yersinia pestis KIM
ucuaaguccaag

SEQ ID NO: 2297887 - RNA, 16 nt, Yersinia pestis KIM
ucuaaguaaaacaaag

SEQ ID NO: 2297888 - RNA, 11 nt, Yersinia pestis KIM
ucuaagcugcc

SEQ ID NO: 2297889 - RNA, 16 nt, Yersinia pestis KIM
ucuaauuguuauuauu

SEQ ID NO: 2297890 - RNA, 15 nt, Yersinia pestis KIM
ucuaauaaugagcca

SEQ ID NO: 2297891 - RNA, 23 nt, Yersinia pestis KIM
ucuaauaaaccugcaauaaccag

SEQ ID NO: 2297892 - RNA, 16 nt, Yersinia pestis KIM
ucuaacuaauaauaau

SEQ ID NO: 2297893 - RNA, 17 nt, Yersinia pestis KIM
ucuaacucauucauaau

SEQ ID NO: 2297894 - RNA, 22 nt, Yersinia pestis KIM
ucuaacugauguauucccucaa

SEQ ID NO: 2297895 - RNA, 21 nt, Yersinia pestis KIM
ucgugaaguuuauacuauuua

SEQ ID NO: 2297896 - RNA, 14 nt, Yersinia pestis KIM
ucgugaaagcagaa

SEQ ID NO: 2297897 - RNA, 15 nt, Yersinia pestis KIM
ucgucguaauauuuc

SEQ ID NO: 2297898 - RNA, 21 nt, Yersinia pestis KIM
ucgucggcccggccaggcucc

SEQ ID NO: 2297899 - RNA, 20 nt, Yersinia pestis KIM
ucgucccaggccuccgcaaa

SEQ ID NO: 2297900 - RNA, 12 nt, Yersinia pestis KIM
ucguaccggccc

SEQ ID NO: 2297901 - RNA, 19 nt, Yersinia pestis KIM
ucggucgauuuuuauuuuc

SEQ ID NO: 2297902 - RNA, 20 nt, Yersinia pestis KIM
ucgguaacuuacaggcugcc

SEQ ID NO: 2297903 - RNA, 15 nt, Yersinia pestis KIM
ucgguaaucaauuuu

SEQ ID NO: 2297904 - RNA, 22 nt, Yersinia pestis KIM
ucgguacaaucucugggugcug

SEQ ID NO: 2297905 - RNA, 17 nt, Yersinia pestis KIM
ucggguuuaauucaggc

SEQ ID NO: 2297906 - RNA, 18 nt, Yersinia pestis KIM
ucgguaccgccagaauaa

SEQ ID NO: 2297907 - RNA, 11 nt, Yersinia pestis KIM
ucuuuuuaauu

SEQ ID NO: 2297908 - RNA, 14 nt, Yersinia pestis KIM
ucuuuucuuuaugu

SEQ ID NO: 2297909 - RNA, 13 nt, Yersinia pestis KIM
ucuuuucugccaa

SEQ ID NO: 2297910 - RNA, 21 nt, Yersinia pestis KIM
ugaaaaacagagggccccgau

SEQ ID NO: 2297911 - RNA, 12 nt, Yersinia pestis KIM
ugaaaaaauauc

SEQ ID NO: 2297912 - RNA, 13 nt, Yersinia pestis KIM
ugaaaaaauaaug

SEQ ID NO: 2297913 - RNA, 15 nt, Yersinia pestis KIM
ucuuugucaauaacc

SEQ ID NO: 2297914 - RNA, 14 nt, Yersinia pestis KIM
ucuuuuacaaauuu

SEQ ID NO: 2297915 - RNA, 20 nt, Yersinia pestis KIM
ucuuuuauacagcauauaaa

SEQ ID NO: 2297916 - RNA, 16 nt, Yersinia pestis KIM
ucuuuggcaaauuuag

SEQ ID NO: 2297917 - RNA, 16 nt, Yersinia pestis KIM
ucuuugccuauuucag

SEQ ID NO: 2297918 - RNA, 21 nt, Yersinia pestis KIM
ucuuugacaugucccucuguc

SEQ ID NO: 2297919 - RNA, 23 nt, Yersinia pestis KIM
ucuuugacaugucccucuguccc

SEQ ID NO: 2297920 - RNA, 23 nt, Yersinia pestis KIM
ucuuccauuuuauuuaacguguu

SEQ ID NO: 2297921 - RNA, 15 nt, Yersinia pestis KIM
ucuuggaacaggcca

SEQ ID NO: 2297922 - RNA, 23 nt, Yersinia pestis KIM
ucuugcugaaaacaauauaauaa

SEQ ID NO: 2297923 - RNA, 18 nt, Yersinia pestis KIM
ucuugcucgucaucuuuc

SEQ ID NO: 2297924 - RNA, 21 nt, Yersinia pestis KIM
ucuugggcagcgacaaccugu

SEQ ID NO: 2297925 - RNA, 22 nt, Yersinia pestis KIM
ucuugggcgggaucuccagaag

SEQ ID NO: 2297926 - RNA, 15 nt, Yersinia pestis KIM
ucuuggauaacagau

SEQ ID NO: 2297927 - RNA, 18 nt, Yersinia pestis KIM
ucuuucuggcuaaacgau

SEQ ID NO: 2297928 - RNA, 20 nt, Yersinia pestis KIM
ucuuucuguucagcauaaau

SEQ ID NO: 2297929 - RNA, 19 nt, Yersinia pestis KIM
ucuuuccggguuuuuaaca

SEQ ID NO: 2297930 - RNA, 16 nt, Yersinia pestis KIM
ucuuuccagcaaaagc

SEQ ID NO: 2297931 - RNA, 13 nt, Yersinia pestis KIM
ucuuuccagcaaa

SEQ ID NO: 2297932 - RNA, 14 nt, Yersinia pestis KIM
ucuuucagcaccau

SEQ ID NO: 2297933 - RNA, 18 nt, Yersinia pestis KIM
ucuuucacuaaugaggaa

SEQ ID NO: 2297934 - RNA, 12 nt, Yersinia pestis KIM
ucuuuaauuuuu

SEQ ID NO: 2297935 - RNA, 14 nt, Yersinia pestis KIM
ucuuuaaucacucu

SEQ ID NO: 2297936 - RNA, 12 nt, Yersinia pestis KIM
ucuuuaauaaua

SEQ ID NO: 2297937 - RNA, 18 nt, Yersinia pestis KIM
ugaacacucuuuuuaauu

SEQ ID NO: 2297938 - RNA, 20 nt, Yersinia pestis KIM
ugaacagauagauaaauguu

SEQ ID NO: 2297939 - RNA, 20 nt, Yersinia pestis KIM
ugaacacgacgccauaaaag

SEQ ID NO: 2297940 - RNA, 13 nt, Yersinia pestis KIM
ugaacacagaaac

SEQ ID NO: 2297941 - RNA, 12 nt, Yersinia pestis KIM
ugaacaaauauc

SEQ ID NO: 2297942 - RNA, 14 nt, Yersinia pestis KIM
ugaacaugaugggc

SEQ ID NO: 2297943 - RNA, 19 nt, Yersinia pestis KIM
ugaacauagcuaacaccgc

SEQ ID NO: 2297944 - RNA, 22 nt, Yersinia pestis KIM
ugaacauaacuuugccagugac

SEQ ID NO: 2297945 - RNA, 23 nt, Yersinia pestis KIM
ugaacaugggugccccauauuuu

SEQ ID NO: 2297946 - RNA, 24 nt, Yersinia pestis KIM
ugaaccaaaauucacaacuuguga

SEQ ID NO: 2297947 - RNA, 19 nt, Yersinia pestis KIM
ugaaccgccauugcauauu

SEQ ID NO: 2297948 - RNA, 23 nt, Yersinia pestis KIM
ugaaccccgguuuuuacuguucu

SEQ ID NO: 2297949 - RNA, 19 nt, Yersinia pestis KIM
ugaacccacgacuauuuag

SEQ ID NO: 2297950 - RNA, 18 nt, Yersinia pestis KIM
ugaacgaggacuuccugc

SEQ ID NO: 2297951 - RNA, 18 nt, Yersinia pestis KIM
ugaaccugacgcacagca

SEQ ID NO: 2297952 - RNA, 14 nt, Yersinia pestis KIM
ugaaccugaaauac

SEQ ID NO: 2297953 - RNA, 14 nt, Yersinia pestis KIM
ugaaauacuuauuu

SEQ ID NO: 2297954 - RNA, 13 nt, Yersinia pestis KIM
ugaaauagucaca

SEQ ID NO: 2297955 - RNA, 19 nt, Yersinia pestis KIM
ugaaaucagaucaacagau

SEQ ID NO: 2297956 - RNA, 16 nt, Yersinia pestis KIM
ugaaaucaguguauua

SEQ ID NO: 2297957 - RNA, 16 nt, Yersinia pestis KIM
ugaaaucgaucauaau

SEQ ID NO: 2297958 - RNA, 15 nt, Yersinia pestis KIM
ugaaauuauauucuu

SEQ ID NO: 2297959 - RNA, 22 nt, Yersinia pestis KIM
ugaaauuagggguugcaggcug

SEQ ID NO: 2297960 - RNA, 21 nt, Yersinia pestis KIM
ugaaauucuguagaguaaaac

SEQ ID NO: 2297961 - RNA, 13 nt, Yersinia pestis KIM
ugaaauuuuauuc

SEQ ID NO: 2297962 - RNA, 18 nt, Yersinia pestis KIM
ugaaaacguuaacugcag

SEQ ID NO: 2297963 - RNA, 20 nt, Yersinia pestis KIM
ugaaaacuacgguaauaaac

SEQ ID NO: 2297964 - RNA, 14 nt, Yersinia pestis KIM
ugaaaacaauauaa

SEQ ID NO: 2297965 - RNA, 22 nt, Yersinia pestis KIM
ugaaacacaacaacggugaaca

SEQ ID NO: 2297966 - RNA, 17 nt, Yersinia pestis KIM
ugaaacacuuauuugaa

SEQ ID NO: 2297967 - RNA, 12 nt, Yersinia pestis KIM
ugaaaauauuau

SEQ ID NO: 2297968 - RNA, 20 nt, Yersinia pestis KIM
ugaaaauauucauucuuauc

SEQ ID NO: 2297969 - RNA, 19 nt, Yersinia pestis KIM
ugaaacuucaaaaucaagu

SEQ ID NO: 2297970 - RNA, 21 nt, Yersinia pestis KIM
ugaaaccauugguaauaaugc

SEQ ID NO: 2297971 - RNA, 20 nt, Yersinia pestis KIM
ugaaacgauaugcuccagau

SEQ ID NO: 2297972 - RNA, 18 nt, Yersinia pestis KIM
ugaaacgauaugcuccag

SEQ ID NO: 2297973 - RNA, 19 nt, Yersinia pestis KIM
ugaaaccgguaauguucau

SEQ ID NO: 2297974 - RNA, 18 nt, Yersinia pestis KIM
ugaaacggugaggauagg

SEQ ID NO: 2297975 - RNA, 13 nt, Yersinia pestis KIM
ugaaauaacugcc

SEQ ID NO: 2297976 - RNA, 19 nt, Yersinia pestis KIM
ugaaauaaacuuuuaugca

SEQ ID NO: 2297977 - RNA, 14 nt, Yersinia pestis KIM
ugaaaguuuauaug

SEQ ID NO: 2297978 - RNA, 24 nt, Yersinia pestis KIM
ugaaaguggccacucaccucaguc

SEQ ID NO: 2297979 - RNA, 20 nt, Yersinia pestis KIM
ugaaagcuucaacuuccagu

SEQ ID NO: 2297980 - RNA, 18 nt, Yersinia pestis KIM
ugaaaggcggugaacagu

SEQ ID NO: 2297981 - RNA, 15 nt, Yersinia pestis KIM
ucuuauuuuuuguag

SEQ ID NO: 2297982 - RNA, 15 nt, Yersinia pestis KIM
ucuucaccaaugauu

SEQ ID NO: 2297983 - RNA, 14 nt, Yersinia pestis KIM
ucuucagccuaucc

SEQ ID NO: 2297984 - RNA, 19 nt, Yersinia pestis KIM
ucuuccacucuuucaauga

SEQ ID NO: 2297985 - RNA, 21 nt, Yersinia pestis KIM
ucuuccagacaaagugaggga

SEQ ID NO: 2297986 - RNA, 14 nt, Yersinia pestis KIM
ucuguuaccaaugg

SEQ ID NO: 2297987 - RNA, 13 nt, Yersinia pestis KIM
ucuguuaccuaau

SEQ ID NO: 2297988 - RNA, 17 nt, Yersinia pestis KIM
ucuuaccggccucuuuc

SEQ ID NO: 2297989 - RNA, 23 nt, Yersinia pestis KIM
ucuuauucauaucgcucaucaug

SEQ ID NO: 2297990 - RNA, 17 nt, Yersinia pestis KIM
ucuuaucgauucaaaua

SEQ ID NO: 2297991 - RNA, 20 nt, Yersinia pestis KIM
ucuuaucaaucaaaaaauaa

SEQ ID NO: 2297992 - RNA, 22 nt, Yersinia pestis KIM
ucuuaucaaucaaaaaauaaau

SEQ ID NO: 2297993 - RNA, 17 nt, Yersinia pestis KIM
ucuuauauaaauccagc

SEQ ID NO: 2297994 - RNA, 18 nt, Yersinia pestis KIM
ucuuaggguaaccaaugu

SEQ ID NO: 2297995 - RNA, 13 nt, Yersinia pestis KIM
ucuguaauaauaa

SEQ ID NO: 2297996 - RNA, 14 nt, Yersinia pestis KIM
ucugucguacuuuc

SEQ ID NO: 2297997 - RNA, 16 nt, Yersinia pestis KIM
ucugucguacuuuccu

SEQ ID NO: 2297998 - RNA, 14 nt, Yersinia pestis KIM
ucugucuaagugcc

SEQ ID NO: 2297999 - RNA, 16 nt, Yersinia pestis KIM
ucuggcgugucaucuu

SEQ ID NO: 2298000 - RNA, 14 nt, Yersinia pestis KIM
ucuggcguuuugca

SEQ ID NO: 2298001 - RNA, 23 nt, Yersinia pestis KIM
ucuggcuaaacgaucagaacuaa

SEQ ID NO: 2298002 - RNA, 13 nt, Yersinia pestis KIM
ucuggagccauau

SEQ ID NO: 2298003 - RNA, 22 nt, Yersinia pestis KIM
ucuggcuuucucaacagcauca

SEQ ID NO: 2298004 - RNA, 19 nt, Yersinia pestis KIM
ucuggcuuucucaacagca

SEQ ID NO: 2298005 - RNA, 18 nt, Yersinia pestis KIM
ucuggcugcuaauggucu

SEQ ID NO: 2298006 - RNA, 13 nt, Yersinia pestis KIM
ucugguugugcuu

SEQ ID NO: 2298007 - RNA, 13 nt, Yersinia pestis KIM
ucugcugcugccc

SEQ ID NO: 2298008 - RNA, 20 nt, Yersinia pestis KIM
ucugcuagcaaauuccgcuu

SEQ ID NO: 2298009 - RNA, 16 nt, Yersinia pestis KIM
ucugcuaauuaaaccu

SEQ ID NO: 2298010 - RNA, 22 nt, Yersinia pestis KIM
ucugcuaauuaaaccugacugg

SEQ ID NO: 2298011 - RNA, 15 nt, Yersinia pestis KIM
ucugcguuuuucccu

SEQ ID NO: 2298012 - RNA, 18 nt, Yersinia pestis KIM
ucugcguuuuucccugua

SEQ ID NO: 2298013 - RNA, 15 nt, Yersinia pestis KIM
ucugcucccggcgcu

SEQ ID NO: 2298014 - RNA, 14 nt, Yersinia pestis KIM
ucugcucccauguc

SEQ ID NO: 2298015 - RNA, 17 nt, Yersinia pestis KIM
ucugcucccaugucaga

SEQ ID NO: 2298016 - RNA, 14 nt, Yersinia pestis KIM
ucugcggauaaaca

SEQ ID NO: 2298017 - RNA, 14 nt, Yersinia pestis KIM
ucugcagaaugaag

SEQ ID NO: 2298018 - RNA, 18 nt, Yersinia pestis KIM
ucucgacaaauccuuuua

SEQ ID NO: 2298019 - RNA, 17 nt, Yersinia pestis KIM
ucucgaaguccuucgga

SEQ ID NO: 2298020 - RNA, 16 nt, Yersinia pestis KIM
ucucgauacaauuuuu

SEQ ID NO: 2298021 - RNA, 15 nt, Yersinia pestis KIM
ucucgauauuaaccc

SEQ ID NO: 2298022 - RNA, 16 nt, Yersinia pestis KIM
ucucggcaugcuucca

SEQ ID NO: 2298023 - RNA, 15 nt, Yersinia pestis KIM
ucucggcuuucaggu

SEQ ID NO: 2298024 - RNA, 18 nt, Yersinia pestis KIM
ucucuaaucgcgcauuuc

SEQ ID NO: 2298025 - RNA, 15 nt, Yersinia pestis KIM
ucuccagaauauaaa

SEQ ID NO: 2298026 - RNA, 15 nt, Yersinia pestis KIM
ucucauuccauaauu

SEQ ID NO: 2298027 - RNA, 16 nt, Yersinia pestis KIM
ucuccagugcaaauuu

SEQ ID NO: 2298028 - RNA, 17 nt, Yersinia pestis KIM
ucuccaguugccagcag

SEQ ID NO: 2298029 - RNA, 23 nt, Yersinia pestis KIM
ucucaucggcauacuccuuaauc

SEQ ID NO: 2298030 - RNA, 14 nt, Yersinia pestis KIM
ucucauuauuuauu

SEQ ID NO: 2298031 - RNA, 14 nt, Yersinia pestis KIM
ucucauuaauaaug

SEQ ID NO: 2298032 - RNA, 15 nt, Yersinia pestis KIM
ucucauuaauaauga

SEQ ID NO: 2298033 - RNA, 23 nt, Yersinia pestis KIM
ucuccucuccccuaccucauccg

SEQ ID NO: 2298034 - RNA, 13 nt, Yersinia pestis KIM
ucucuauucacua

SEQ ID NO: 2298035 - RNA, 17 nt, Yersinia pestis KIM
ucucuauuguucaggga

SEQ ID NO: 2298036 - RNA, 16 nt, Yersinia pestis KIM
ucucucacuuuggcgc

SEQ ID NO: 2298037 - RNA, 13 nt, Yersinia pestis KIM
ucucucaauauau

SEQ ID NO: 2298038 - RNA, 23 nt, Yersinia pestis KIM
ucucuccuauaucucaguugaaa

SEQ ID NO: 2298039 - RNA, 13 nt, Yersinia pestis KIM
ucucucuaugucu

SEQ ID NO: 2298040 - RNA, 22 nt, Yersinia pestis KIM
ucucucuuuuuacguauuaucc

SEQ ID NO: 2298041 - RNA, 22 nt, Yersinia pestis KIM
ucucuggcuaaugucucuauuc

SEQ ID NO: 2298042 - RNA, 18 nt, Yersinia pestis KIM
ucucugggugcugcuccc

SEQ ID NO: 2298043 - RNA, 23 nt, Yersinia pestis KIM
ucucuggguaagaacagagagaa

SEQ ID NO: 2298044 - RNA, 13 nt, Yersinia pestis KIM
ucucugcaucucu

SEQ ID NO: 2298045 - RNA, 19 nt, Yersinia pestis KIM
ucucugcaucacguauuag

SEQ ID NO: 2298046 - RNA, 17 nt, Yersinia pestis KIM
ucucugaugguaucaga

SEQ ID NO: 2298047 - RNA, 15 nt, Yersinia pestis KIM
ucucuuguuuugcaa

SEQ ID NO: 2298048 - RNA, 13 nt, Yersinia pestis KIM
ucucuuccuguuc

SEQ ID NO: 2298049 - RNA, 11 nt, Yersinia pestis KIM
ucucuucccac

SEQ ID NO: 2298050 - RNA, 14 nt, Yersinia pestis KIM
ucucuucagagauu

SEQ ID NO: 2298051 - RNA, 14 nt, Yersinia pestis KIM
ucucuuaggcaacc

SEQ ID NO: 2298052 - RNA, 14 nt, Yersinia pestis KIM
ucucuuaccccuuu

SEQ ID NO: 2298053 - RNA, 19 nt, Yersinia pestis KIM
ucucuuucuucucuucaga

SEQ ID NO: 2298054 - RNA, 21 nt, Yersinia pestis KIM
ucucuuugccuacuaccaaau

SEQ ID NO: 2298055 - RNA, 13 nt, Yersinia pestis KIM
ucucuuuuuucuc

SEQ ID NO: 2298056 - RNA, 17 nt, Yersinia pestis KIM
ucugacggguauaucac

SEQ ID NO: 2298057 - RNA, 23 nt, Yersinia pestis KIM
ucugaauaccauaacaauggccg

SEQ ID NO: 2298058 - RNA, 22 nt, Yersinia pestis KIM
ucugaaggguauugaagauacc

SEQ ID NO: 2298059 - RNA, 19 nt, Yersinia pestis KIM
ucugaaggguauugaagau

SEQ ID NO: 2298060 - RNA, 13 nt, Yersinia pestis KIM
ucugaauaaaaaa

SEQ ID NO: 2298061 - RNA, 18 nt, Yersinia pestis KIM
ucugaagccuacgagaga

SEQ ID NO: 2298062 - RNA, 15 nt, Yersinia pestis KIM
ucugacucuguaaaa

SEQ ID NO: 2298063 - RNA, 12 nt, Yersinia pestis KIM
ucugacuaagac

SEQ ID NO: 2298064 - RNA, 14 nt, Yersinia pestis KIM
ucugacuaacucuu

SEQ ID NO: 2298065 - RNA, 15 nt, Yersinia pestis KIM
ucugauauuaaaaaa

SEQ ID NO: 2298066 - RNA, 12 nt, Yersinia pestis KIM
ucugaucaaucu

SEQ ID NO: 2298067 - RNA, 15 nt, Yersinia pestis KIM
ucugaucgaguucag

SEQ ID NO: 2298068 - RNA, 14 nt, Yersinia pestis KIM
ucugaugaugguua

SEQ ID NO: 2298069 - RNA, 20 nt, Yersinia pestis KIM
ucugaugaguguuuauucuc

SEQ ID NO: 2298070 - RNA, 11 nt, Yersinia pestis KIM
ucugcaacuca

SEQ ID NO: 2298071 - RNA, 15 nt, Yersinia pestis KIM
gguuccaaagcacca

SEQ ID NO: 2298072 - RNA, 13 nt, Yersinia pestis KIM
gguucaaaucagu

SEQ ID NO: 2298073 - RNA, 14 nt, Yersinia pestis KIM
gguucaccccucac

SEQ ID NO: 2298074 - RNA, 15 nt, Yersinia pestis KIM
gguucaguaaaacca

SEQ ID NO: 2298075 - RNA, 15 nt, Yersinia pestis KIM
gguucaguaaagcuu

SEQ ID NO: 2298076 - RNA, 22 nt, Yersinia pestis KIM
gguuauuggccgcgcacagcac

SEQ ID NO: 2298077 - RNA, 17 nt, Yersinia pestis KIM
gguuaucacauaaauaa

SEQ ID NO: 2298078 - RNA, 13 nt, Yersinia pestis KIM
gguuaucccuacc

SEQ ID NO: 2298079 - RNA, 15 nt, Yersinia pestis KIM
gguuaucuggaauuu

SEQ ID NO: 2298080 - RNA, 22 nt, Yersinia pestis KIM
gguuagcucccccguguucuga

SEQ ID NO: 2298081 - RNA, 15 nt, Yersinia pestis KIM
gguuagggcaauaaa

SEQ ID NO: 2298082 - RNA, 12 nt, Yersinia pestis KIM
gguuagcgccuu

SEQ ID NO: 2298083 - RNA, 18 nt, Yersinia pestis KIM
ggugguuuuggccgggau

SEQ ID NO: 2298084 - RNA, 19 nt, Yersinia pestis KIM
gguguuaaccgccccaaca

SEQ ID NO: 2298085 - RNA, 13 nt, Yersinia pestis KIM
gguguguggcaau

SEQ ID NO: 2298086 - RNA, 18 nt, Yersinia pestis KIM
gguguguuguuggcuaau

SEQ ID NO: 2298087 - RNA, 14 nt, Yersinia pestis KIM
ggugcugacaaaca

SEQ ID NO: 2298088 - RNA, 20 nt, Yersinia pestis KIM
ggugcuggugggccugcugc

SEQ ID NO: 2298089 - RNA, 13 nt, Yersinia pestis KIM
ggugcuguuccaa

SEQ ID NO: 2298090 - RNA, 14 nt, Yersinia pestis KIM
gguggccaguaacg

SEQ ID NO: 2298091 - RNA, 15 nt, Yersinia pestis KIM
ggugggccgugcggg

SEQ ID NO: 2298092 - RNA, 20 nt, Yersinia pestis KIM
gguuuaggccaauuuggcca

SEQ ID NO: 2298093 - RNA, 22 nt, Yersinia pestis KIM
gguuuaggccaauuuggccaau

SEQ ID NO: 2298094 - RNA, 19 nt, Yersinia pestis KIM
gguugccauuaauuggccg

SEQ ID NO: 2298095 - RNA, 20 nt, Yersinia pestis KIM
gguugccgguuuauuauuca

SEQ ID NO: 2298096 - RNA, 14 nt, Yersinia pestis KIM
gguugcuguaaugc

SEQ ID NO: 2298097 - RNA, 16 nt, Yersinia pestis KIM
gguugcggcaccugcc

SEQ ID NO: 2298098 - RNA, 23 nt, Yersinia pestis KIM
gguuuuuauauuuaccugcucaa

SEQ ID NO: 2298099 - RNA, 15 nt, Yersinia pestis KIM
gguuuuuaacagcuu

SEQ ID NO: 2298100 - RNA, 19 nt, Yersinia pestis KIM
guaaaaaaccuuauuuuug

SEQ ID NO: 2298101 - RNA, 13 nt, Yersinia pestis KIM
guaaaaaaaaccu

SEQ ID NO: 2298102 - RNA, 19 nt, Yersinia pestis KIM
gguuuuuugcgggacagaa

SEQ ID NO: 2298103 - RNA, 17 nt, Yersinia pestis KIM
guaaaacacgcaacacu

SEQ ID NO: 2298104 - RNA, 14 nt, Yersinia pestis KIM
guaaaacagggagc

SEQ ID NO: 2298105 - RNA, 20 nt, Yersinia pestis KIM
guaaaacaagggguuucaga

SEQ ID NO: 2298106 - RNA, 18 nt, Yersinia pestis KIM
guaaaacaaaguaguacg

SEQ ID NO: 2298107 - RNA, 13 nt, Yersinia pestis KIM
guaaaaccagcag

SEQ ID NO: 2298108 - RNA, 13 nt, Yersinia pestis KIM
guaaaaacucacu

SEQ ID NO: 2298109 - RNA, 14 nt, Yersinia pestis KIM
gguuuucaccccca

SEQ ID NO: 2298110 - RNA, 12 nt, Yersinia pestis KIM
gguuuuagucau

SEQ ID NO: 2298111 - RNA, 14 nt, Yersinia pestis KIM
gguuugcuguucuu

SEQ ID NO: 2298112 - RNA, 15 nt, Yersinia pestis KIM
gguuugacggcggcg

SEQ ID NO: 2298113 - RNA, 19 nt, Yersinia pestis KIM
gguuugccaucacgcagca

SEQ ID NO: 2298114 - RNA, 13 nt, Yersinia pestis KIM
gguuucaaauagc

SEQ ID NO: 2298115 - RNA, 17 nt, Yersinia pestis KIM
gguuucaacauccaguu

SEQ ID NO: 2298116 - RNA, 20 nt, Yersinia pestis KIM
ggucucuuucgggcaaaaaa

SEQ ID NO: 2298117 - RNA, 18 nt, Yersinia pestis KIM
ggucugcaacucagugaa

SEQ ID NO: 2298118 - RNA, 16 nt, Yersinia pestis KIM
ggucuauugguuucua

SEQ ID NO: 2298119 - RNA, 14 nt, Yersinia pestis KIM
ggucucaaugcagu

SEQ ID NO: 2298120 - RNA, 19 nt, Yersinia pestis KIM
ggucgggcgcugagcgggc

SEQ ID NO: 2298121 - RNA, 23 nt, Yersinia pestis KIM
ggucgggcugucggcgaugaaaa

SEQ ID NO: 2298122 - RNA, 15 nt, Yersinia pestis KIM
ggucgguaaccugaa

SEQ ID NO: 2298123 - RNA, 23 nt, Yersinia pestis KIM
ggugccacacagaaucaccaaca

SEQ ID NO: 2298124 - RNA, 16 nt, Yersinia pestis KIM
ggugccaacgcaauuc

SEQ ID NO: 2298125 - RNA, 12 nt, Yersinia pestis KIM
ggugccaacgca

SEQ ID NO: 2298126 - RNA, 19 nt, Yersinia pestis KIM
ggugcaguuucacccucug

SEQ ID NO: 2298127 - RNA, 20 nt, Yersinia pestis KIM
ggugaauacguucaaaugau

SEQ ID NO: 2298128 - RNA, 17 nt, Yersinia pestis KIM
ggugaaguguuuaccac

SEQ ID NO: 2298129 - RNA, 18 nt, Yersinia pestis KIM
ggucuggcaacugcaaau

SEQ ID NO: 2298130 - RNA, 16 nt, Yersinia pestis KIM
ggugagcugaucugcc

SEQ ID NO: 2298131 - RNA, 15 nt, Yersinia pestis KIM
ggugagggagucagg

SEQ ID NO: 2298132 - RNA, 19 nt, Yersinia pestis KIM
ggugacauccgcuugcagc

SEQ ID NO: 2298133 - RNA, 23 nt, Yersinia pestis KIM
gguauagcgauagaguugauaaa

SEQ ID NO: 2298134 - RNA, 14 nt, Yersinia pestis KIM
gguauagcggcggg

SEQ ID NO: 2298135 - RNA, 19 nt, Yersinia pestis KIM
gguauauuuaccaaaagca

SEQ ID NO: 2298136 - RNA, 15 nt, Yersinia pestis KIM
gguauuggagcugaa

SEQ ID NO: 2298137 - RNA, 12 nt, Yersinia pestis KIM
gguauuuucuau

SEQ ID NO: 2298138 - RNA, 14 nt, Yersinia pestis KIM
gguauucggcggcu

SEQ ID NO: 2298139 - RNA, 18 nt, Yersinia pestis KIM
gguaucaguggcgguucg

SEQ ID NO: 2298140 - RNA, 18 nt, Yersinia pestis KIM
ggucaauaccauauccac

SEQ ID NO: 2298141 - RNA, 14 nt, Yersinia pestis KIM
ggucaagaugcaua

SEQ ID NO: 2298142 - RNA, 19 nt, Yersinia pestis KIM
ggucaaccguuguguauca

SEQ ID NO: 2298143 - RNA, 12 nt, Yersinia pestis KIM
ggucacuuaaau

SEQ ID NO: 2298144 - RNA, 20 nt, Yersinia pestis KIM
ggucacuuuaauacuggcau

SEQ ID NO: 2298145 - RNA, 16 nt, Yersinia pestis KIM
ggucacuuuuauuuuu

SEQ ID NO: 2298146 - RNA, 10 nt, Yersinia pestis KIM
ggucaucaug

SEQ ID NO: 2298147 - RNA, 16 nt, Yersinia pestis KIM
ggucauaccggcggca

SEQ ID NO: 2298148 - RNA, 20 nt, Yersinia pestis KIM
ggucauaguuuuuauagaca

SEQ ID NO: 2298149 - RNA, 22 nt, Yersinia pestis KIM
ggucauauacaccgcaccacga

SEQ ID NO: 2298150 - RNA, 15 nt, Yersinia pestis KIM
ggucaguuggcuuau

SEQ ID NO: 2298151 - RNA, 21 nt, Yersinia pestis KIM
ggucaguuuagcgagaaaguc

SEQ ID NO: 2298152 - RNA, 23 nt, Yersinia pestis KIM
ggucauacacaugaaaaucaagu

SEQ ID NO: 2298153 - RNA, 14 nt, Yersinia pestis KIM
ggucauggagagca

SEQ ID NO: 2298154 - RNA, 15 nt, Yersinia pestis KIM
ggucauuuuucccuu

SEQ ID NO: 2298155 - RNA, 19 nt, Yersinia pestis KIM
ggucauugcgugcaauaaa

SEQ ID NO: 2298156 - RNA, 20 nt, Yersinia pestis KIM
ggucauugcgugcaauaaag

SEQ ID NO: 2298157 - RNA, 14 nt, Yersinia pestis KIM
ggucauuagccguu

SEQ ID NO: 2298158 - RNA, 12 nt, Yersinia pestis KIM
gggaucgcgcag

SEQ ID NO: 2298159 - RNA, 22 nt, Yersinia pestis KIM
gggauucaauaaguugcagagg

SEQ ID NO: 2298160 - RNA, 12 nt, Yersinia pestis KIM
gggcaaaaaaau

SEQ ID NO: 2298161 - RNA, 14 nt, Yersinia pestis KIM
gggauuugcucaga

SEQ ID NO: 2298162 - RNA, 11 nt, Yersinia pestis KIM
gggcagaaaau

SEQ ID NO: 2298163 - RNA, 20 nt, Yersinia pestis KIM
gggcaaaccauuugcggccu

SEQ ID NO: 2298164 - RNA, 17 nt, Yersinia pestis KIM
gggcaaaccgcuaagcu

SEQ ID NO: 2298165 - RNA, 21 nt, Yersinia pestis KIM
gggcaauaacaaacacaucca

SEQ ID NO: 2298166 - RNA, 16 nt, Yersinia pestis KIM
gggccgacucugcaug

SEQ ID NO: 2298167 - RNA, 20 nt, Yersinia pestis KIM
gggccgaugccaggcaccag

SEQ ID NO: 2298168 - RNA, 19 nt, Yersinia pestis KIM
ggcuucuaggugcucugcc

SEQ ID NO: 2298169 - RNA, 19 nt, Yersinia pestis KIM
ggcuucaaaaucaccuggc

SEQ ID NO: 2298170 - RNA, 23 nt, Yersinia pestis KIM
ggcuugagcgacaaaagugucau

SEQ ID NO: 2298171 - RNA, 20 nt, Yersinia pestis KIM
ggcuucuguaauaaaggcug

SEQ ID NO: 2298172 - RNA, 19 nt, Yersinia pestis KIM
ggcuugcgcgaaauauugc

SEQ ID NO: 2298173 - RNA, 13 nt, Yersinia pestis KIM
ggcuuucagcaua

SEQ ID NO: 2298174 - RNA, 17 nt, Yersinia pestis KIM
ggcuuuauuugcugccu

SEQ ID NO: 2298175 - RNA, 18 nt, Yersinia pestis KIM
ggcugucggcgaugaaaa

SEQ ID NO: 2298176 - RNA, 23 nt, Yersinia pestis KIM
ggcugugaucugccagugccuca

SEQ ID NO: 2298177 - RNA, 22 nt, Yersinia pestis KIM
ggcuguauuguugcucaacaua

SEQ ID NO: 2298178 - RNA, 18 nt, Yersinia pestis KIM
ggcuuugcgcaaaauuaa

SEQ ID NO: 2298179 - RNA, 15 nt, Yersinia pestis KIM
ggcuuucucuugcca

SEQ ID NO: 2298180 - RNA, 14 nt, Yersinia pestis KIM
gggaauaaugguau

SEQ ID NO: 2298181 - RNA, 12 nt, Yersinia pestis KIM
gggaaugcccuu

SEQ ID NO: 2298182 - RNA, 17 nt, Yersinia pestis KIM
gggacuaugagccucau

SEQ ID NO: 2298183 - RNA, 20 nt, Yersinia pestis KIM
gggacugccagaucaaagau

SEQ ID NO: 2298184 - RNA, 17 nt, Yersinia pestis KIM
gggacagagagauaauc

SEQ ID NO: 2298185 - RNA, 19 nt, Yersinia pestis KIM
gggugauggcugucugaug

SEQ ID NO: 2298186 - RNA, 12 nt, Yersinia pestis KIM
gggugagugagc

SEQ ID NO: 2298187 - RNA, 18 nt, Yersinia pestis KIM
gggguucgcuauccccac

SEQ ID NO: 2298188 - RNA, 14 nt, Yersinia pestis KIM
ggguaagaacagag

SEQ ID NO: 2298189 - RNA, 16 nt, Yersinia pestis KIM
ggguaagauccaccac

SEQ ID NO: 2298190 - RNA, 18 nt, Yersinia pestis KIM
ggguaaaccaaucaagca

SEQ ID NO: 2298191 - RNA, 16 nt, Yersinia pestis KIM
gggggcaauugauuga

SEQ ID NO: 2298192 - RNA, 12 nt, Yersinia pestis KIM
gggggcaccgca

SEQ ID NO: 2298193 - RNA, 21 nt, Yersinia pestis KIM
gggggcgauggccaauaccca

SEQ ID NO: 2298194 - RNA, 19 nt, Yersinia pestis KIM
ggggguugucagcagucug

SEQ ID NO: 2298195 - RNA, 20 nt, Yersinia pestis KIM
ggggguugucagcagucuga

SEQ ID NO: 2298196 - RNA, 14 nt, Yersinia pestis KIM
gggcggccagcaag

SEQ ID NO: 2298197 - RNA, 14 nt, Yersinia pestis KIM
gggcggauccccug

SEQ ID NO: 2298198 - RNA, 14 nt, Yersinia pestis KIM
gggcgcuuuucuuu

SEQ ID NO: 2298199 - RNA, 21 nt, Yersinia pestis KIM
gggcuaaaagggaguucauca

SEQ ID NO: 2298200 - RNA, 17 nt, Yersinia pestis KIM
ggggccaauaggccccu

SEQ ID NO: 2298201 - RNA, 17 nt, Yersinia pestis KIM
ggggccaacaggccccu

SEQ ID NO: 2298202 - RNA, 17 nt, Yersinia pestis KIM
gggcuuccaucaggaag

SEQ ID NO: 2298203 - RNA, 16 nt, Yersinia pestis KIM
gggcuuccaucaggaa

SEQ ID NO: 2298204 - RNA, 23 nt, Yersinia pestis KIM
ggggcacacuuuucacuccggca

SEQ ID NO: 2298205 - RNA, 13 nt, Yersinia pestis KIM
ggggauggccgug

SEQ ID NO: 2298206 - RNA, 19 nt, Yersinia pestis KIM
gucggcauuaaaagcaugc

SEQ ID NO: 2298207 - RNA, 16 nt, Yersinia pestis KIM
gucggcauuaaaagca

SEQ ID NO: 2298208 - RNA, 13 nt, Yersinia pestis KIM
gucgcucaagccu

SEQ ID NO: 2298209 - RNA, 16 nt, Yersinia pestis KIM
gucgcguuggcuaaaa

SEQ ID NO: 2298210 - RNA, 20 nt, Yersinia pestis KIM
gucgauggucauuuguugcu

SEQ ID NO: 2298211 - RNA, 14 nt, Yersinia pestis KIM
gucgguaaccugaa

SEQ ID NO: 2298212 - RNA, 14 nt, Yersinia pestis KIM
gucguacugccuga

SEQ ID NO: 2298213 - RNA, 13 nt, Yersinia pestis KIM
gucgucagcgaca

SEQ ID NO: 2298214 - RNA, 20 nt, Yersinia pestis KIM
gucguuauaaaccaaauggu

SEQ ID NO: 2298215 - RNA, 19 nt, Yersinia pestis KIM
gucgucugauauuaaaaaa

SEQ ID NO: 2298216 - RNA, 18 nt, Yersinia pestis KIM
gucuaagugccaguuaau

SEQ ID NO: 2298217 - RNA, 14 nt, Yersinia pestis KIM
gucuaaugacagac

SEQ ID NO: 2298218 - RNA, 12 nt, Yersinia pestis KIM
gucuacgcucuc

SEQ ID NO: 2298219 - RNA, 22 nt, Yersinia pestis KIM
gucuagcgcaguacucaccgcc

SEQ ID NO: 2298220 - RNA, 14 nt, Yersinia pestis KIM
gucuaacaacuggu

SEQ ID NO: 2298221 - RNA, 22 nt, Yersinia pestis KIM
gucuaacaguuguuucaauaaa

SEQ ID NO: 2298222 - RNA, 15 nt, Yersinia pestis KIM
gucuaaagaaucagc

SEQ ID NO: 2298223 - RNA, 18 nt, Yersinia pestis KIM
gucuaaauugcuuaaaaa

SEQ ID NO: 2298224 - RNA, 11 nt, Yersinia pestis KIM
gucuaaacgcc

SEQ ID NO: 2298225 - RNA, 20 nt, Yersinia pestis KIM
gucguugagcggguguagau

SEQ ID NO: 2298226 - RNA, 22 nt, Yersinia pestis KIM
gucuauuuuuauaaucaucuac

SEQ ID NO: 2298227 - RNA, 13 nt, Yersinia pestis KIM
gucuauuuucauu

SEQ ID NO: 2298228 - RNA, 21 nt, Yersinia pestis KIM
gucuauuuucauuauuuucaa

SEQ ID NO: 2298229 - RNA, 22 nt, Yersinia pestis KIM
gucuauuuucgaacaacauacu

SEQ ID NO: 2298230 - RNA, 22 nt, Yersinia pestis KIM
gucucacccgcuugucuugaaa

SEQ ID NO: 2298231 - RNA, 14 nt, Yersinia pestis KIM
gucucaaugcagua

SEQ ID NO: 2298232 - RNA, 17 nt, Yersinia pestis KIM
gucucaggauacaaaug

SEQ ID NO: 2298233 - RNA, 20 nt, Yersinia pestis KIM
gucucaggauacaaaugaga

SEQ ID NO: 2298234 - RNA, 14 nt, Yersinia pestis KIM
gucccugauggggc

SEQ ID NO: 2298235 - RNA, 14 nt, Yersinia pestis KIM
gucccuaaagagcg

SEQ ID NO: 2298236 - RNA, 13 nt, Yersinia pestis KIM
gucccaagaaaag

SEQ ID NO: 2298237 - RNA, 17 nt, Yersinia pestis KIM
guccgcgccauaaaaga

SEQ ID NO: 2298238 - RNA, 13 nt, Yersinia pestis KIM
guccgugacgcuc

SEQ ID NO: 2298239 - RNA, 16 nt, Yersinia pestis KIM
gucgacaaaaugugaa

SEQ ID NO: 2298240 - RNA, 12 nt, Yersinia pestis KIM
gucgaaagcuca

SEQ ID NO: 2298241 - RNA, 11 nt, Yersinia pestis KIM
guccuccugcc

SEQ ID NO: 2298242 - RNA, 13 nt, Yersinia pestis KIM
gucaucccagcac

SEQ ID NO: 2298243 - RNA, 14 nt, Yersinia pestis KIM
gucaucccagcaca

SEQ ID NO: 2298244 - RNA, 14 nt, Yersinia pestis KIM
gucaucagcauccg

SEQ ID NO: 2298245 - RNA, 17 nt, Yersinia pestis KIM
gucaucacccagcaaaa

SEQ ID NO: 2298246 - RNA, 12 nt, Yersinia pestis KIM
gucauauuuauc

SEQ ID NO: 2298247 - RNA, 22 nt, Yersinia pestis KIM
gucaugucgcuguagcgccagg

SEQ ID NO: 2298248 - RNA, 17 nt, Yersinia pestis KIM
gucauggagagcagggc

SEQ ID NO: 2298249 - RNA, 15 nt, Yersinia pestis KIM
gucaugcucacaauc

SEQ ID NO: 2298250 - RNA, 20 nt, Yersinia pestis KIM
guccaagaagauaacuuuuu

SEQ ID NO: 2298251 - RNA, 14 nt, Yersinia pestis KIM
guccaagaagccaa

SEQ ID NO: 2298252 - RNA, 17 nt, Yersinia pestis KIM
guauuggaaaaaucagu

SEQ ID NO: 2298253 - RNA, 22 nt, Yersinia pestis KIM
guauugguaacgcagaaauauu

SEQ ID NO: 2298254 - RNA, 16 nt, Yersinia pestis KIM
guauuuugucaugaaa

SEQ ID NO: 2298255 - RNA, 14 nt, Yersinia pestis KIM
guauuugguuauau

SEQ ID NO: 2298256 - RNA, 23 nt, Yersinia pestis KIM
guauuugcaaugcggagccgaua

SEQ ID NO: 2298257 - RNA, 20 nt, Yersinia pestis KIM
guauucauaucgcuaaaaca

SEQ ID NO: 2298258 - RNA, 17 nt, Yersinia pestis KIM
guauucagguaauuaca

SEQ ID NO: 2298259 - RNA, 15 nt, Yersinia pestis KIM
guauucacugucaau

SEQ ID NO: 2298260 - RNA, 19 nt, Yersinia pestis KIM
guauucacugucaaucgau

SEQ ID NO: 2298261 - RNA, 13 nt, Yersinia pestis KIM
guauuauuuacaa

SEQ ID NO: 2298262 - RNA, 19 nt, Yersinia pestis KIM
guauugcagagcaaaacug

SEQ ID NO: 2298263 - RNA, 14 nt, Yersinia pestis KIM
guauugaagauacc

SEQ ID NO: 2298264 - RNA, 14 nt, Yersinia pestis KIM
guauuccugccugg

SEQ ID NO: 2298265 - RNA, 13 nt, Yersinia pestis KIM
guauucuugauuc

SEQ ID NO: 2298266 - RNA, 12 nt, Yersinia pestis KIM
guauucuuauca

SEQ ID NO: 2298267 - RNA, 17 nt, Yersinia pestis KIM
guauucugccggacuca

SEQ ID NO: 2298268 - RNA, 22 nt, Yersinia pestis KIM
gucaccaaaaucccaaaauaug

SEQ ID NO: 2298269 - RNA, 23 nt, Yersinia pestis KIM
gucaccaaaaucccaaaauauga

SEQ ID NO: 2298270 - RNA, 22 nt, Yersinia pestis KIM
gucacauuucagcguagcagga

SEQ ID NO: 2298271 - RNA, 18 nt, Yersinia pestis KIM
gucacaguaaaucaggcc

SEQ ID NO: 2298272 - RNA, 21 nt, Yersinia pestis KIM
gucaccacggcuuucaauaaa

SEQ ID NO: 2298273 - RNA, 15 nt, Yersinia pestis KIM
gucaccacaugccau

SEQ ID NO: 2298274 - RNA, 16 nt, Yersinia pestis KIM
gucaccacaaagguca

SEQ ID NO: 2298275 - RNA, 16 nt, Yersinia pestis KIM
gucaccugaaccugac

SEQ ID NO: 2298276 - RNA, 19 nt, Yersinia pestis KIM
gucaccuagauaaucaagu

SEQ ID NO: 2298277 - RNA, 21 nt, Yersinia pestis KIM
gucacccaaccgaccaaaggc

SEQ ID NO: 2298278 - RNA, 20 nt, Yersinia pestis KIM
gucaauaaaacagagcgcga

SEQ ID NO: 2298279 - RNA, 23 nt, Yersinia pestis KIM
gucaaguucuaaggaaaauaccc

SEQ ID NO: 2298280 - RNA, 20 nt, Yersinia pestis KIM
gucaauaaccucagccucau

SEQ ID NO: 2298281 - RNA, 21 nt, Yersinia pestis KIM
gucaauaaccucagggagcca

SEQ ID NO: 2298282 - RNA, 23 nt, Yersinia pestis KIM
gucaauaaccucacgggcuucca

SEQ ID NO: 2298283 - RNA, 21 nt, Yersinia pestis KIM
gucaaacucagcgaauaaaua

SEQ ID NO: 2298284 - RNA, 10 nt, Yersinia pestis KIM
gucacagcau

SEQ ID NO: 2298285 - RNA, 14 nt, Yersinia pestis KIM
gucacaauagucuc

SEQ ID NO: 2298286 - RNA, 19 nt, Yersinia pestis KIM
gucacaaugcuguuuuguc

SEQ ID NO: 2298287 - RNA, 21 nt, Yersinia pestis KIM
gucacaaugcuguuuugucau

SEQ ID NO: 2298288 - RNA, 18 nt, Yersinia pestis KIM
gucaauccaaucauucug

SEQ ID NO: 2298289 - RNA, 22 nt, Yersinia pestis KIM
gucaaucgaugagcuggugaga

SEQ ID NO: 2298290 - RNA, 16 nt, Yersinia pestis KIM
gucaauaucaucaucu

SEQ ID NO: 2298291 - RNA, 21 nt, Yersinia pestis KIM
gucaauaauaaaaucugcuuc

SEQ ID NO: 2298292 - RNA, 19 nt, Yersinia pestis KIM
guaugagcgcagaguccuc

SEQ ID NO: 2298293 - RNA, 18 nt, Yersinia pestis KIM
guaugaccgguuuauaca

SEQ ID NO: 2298294 - RNA, 22 nt, Yersinia pestis KIM
guaugaccgguuuauacacaaa

SEQ ID NO: 2298295 - RNA, 23 nt, Yersinia pestis KIM
guaugaauggaaguuaaaaaaau

SEQ ID NO: 2298296 - RNA, 18 nt, Yersinia pestis KIM
guaucuguuuuugccacc

SEQ ID NO: 2298297 - RNA, 21 nt, Yersinia pestis KIM
guaucgcccuggcuaauuuua

SEQ ID NO: 2298298 - RNA, 14 nt, Yersinia pestis KIM
guauccuuagccaa

SEQ ID NO: 2298299 - RNA, 16 nt, Yersinia pestis KIM
guaucgggggguuuuc

SEQ ID NO: 2298300 - RNA, 19 nt, Yersinia pestis KIM
guaucggccaauucagcaa

SEQ ID NO: 2298301 - RNA, 15 nt, Yersinia pestis KIM
guaugcuuucaucuu

SEQ ID NO: 2298302 - RNA, 16 nt, Yersinia pestis KIM
guaugccaaacccauu

SEQ ID NO: 2298303 - RNA, 22 nt, Yersinia pestis KIM
guauuaccgauaaaggccgcag

SEQ ID NO: 2298304 - RNA, 23 nt, Yersinia pestis KIM
guauuaaucaacagauaugcauu

SEQ ID NO: 2298305 - RNA, 14 nt, Yersinia pestis KIM
guaugggugacucu

SEQ ID NO: 2298306 - RNA, 21 nt, Yersinia pestis KIM
guauggcgcuuaacugcacga

SEQ ID NO: 2298307 - RNA, 15 nt, Yersinia pestis KIM
guauguaaugccaca

SEQ ID NO: 2298308 - RNA, 21 nt, Yersinia pestis KIM
guauguuguucgaaaauagac

SEQ ID NO: 2298309 - RNA, 23 nt, Yersinia pestis KIM
guauccuggccguguuuuucccu

SEQ ID NO: 2298310 - RNA, 19 nt, Yersinia pestis KIM
guaucccuggcucaucaaa

SEQ ID NO: 2298311 - RNA, 12 nt, Yersinia pestis KIM
guaucccacugg

SEQ ID NO: 2298312 - RNA, 22 nt, Yersinia pestis KIM
guaucauauguucgaucaaaac

SEQ ID NO: 2298313 - RNA, 19 nt, Yersinia pestis KIM
guauccagugucaugcgca

SEQ ID NO: 2298314 - RNA, 15 nt, Yersinia pestis KIM
guaucagcgauuuua

SEQ ID NO: 2298315 - RNA, 12 nt, Yersinia pestis KIM
guaucacagcaa

SEQ ID NO: 2298316 - RNA, 13 nt, Yersinia pestis KIM
guagcuuaucccc

SEQ ID NO: 2298317 - RNA, 15 nt, Yersinia pestis KIM
guagcuguuugcacc

SEQ ID NO: 2298318 - RNA, 14 nt, Yersinia pestis KIM
guagcgucaaguuc

SEQ ID NO: 2298319 - RNA, 19 nt, Yersinia pestis KIM
guagcuuuuuaaauaccag

SEQ ID NO: 2298320 - RNA, 16 nt, Yersinia pestis KIM
guaggacggugccaug

SEQ ID NO: 2298321 - RNA, 17 nt, Yersinia pestis KIM
guaucaacaauuuccau

SEQ ID NO: 2298322 - RNA, 12 nt, Yersinia pestis KIM
guauauaaaaaa

SEQ ID NO: 2298323 - RNA, 23 nt, Yersinia pestis KIM
guaucaaaacgccagauaugauc

SEQ ID NO: 2298324 - RNA, 13 nt, Yersinia pestis KIM
guauagcggcggg

SEQ ID NO: 2298325 - RNA, 18 nt, Yersinia pestis KIM
guacaaucucugggugcu

SEQ ID NO: 2298326 - RNA, 21 nt, Yersinia pestis KIM
guacaaucucugggugcugcu

SEQ ID NO: 2298327 - RNA, 13 nt, Yersinia pestis KIM
guacaagacaaua

SEQ ID NO: 2298328 - RNA, 17 nt, Yersinia pestis KIM
guacaacgcuuaucaaa

SEQ ID NO: 2298329 - RNA, 15 nt, Yersinia pestis KIM
guacaacaagauccc

SEQ ID NO: 2298330 - RNA, 16 nt, Yersinia pestis KIM
guacaacaagauccca

SEQ ID NO: 2298331 - RNA, 14 nt, Yersinia pestis KIM
guacaacaauaaua

SEQ ID NO: 2298332 - RNA, 12 nt, Yersinia pestis KIM
guacaacacaaa

SEQ ID NO: 2298333 - RNA, 20 nt, Yersinia pestis KIM
guacaacacaaaaaccggcg

SEQ ID NO: 2298334 - RNA, 12 nt, Yersinia pestis KIM
guacaacacauc

SEQ ID NO: 2298335 - RNA, 23 nt, Yersinia pestis KIM
guacaaaaauaaacgggcuucca

SEQ ID NO: 2298336 - RNA, 18 nt, Yersinia pestis KIM
guaauuuccaacugaucu

SEQ ID NO: 2298337 - RNA, 16 nt, Yersinia pestis KIM
guaauuuacugacggu

SEQ ID NO: 2298338 - RNA, 21 nt, Yersinia pestis KIM
guaauuuacgagaguguaauu

SEQ ID NO: 2298339 - RNA, 21 nt, Yersinia pestis KIM
guacagaaaauacugucgauu

SEQ ID NO: 2298340 - RNA, 11 nt, Yersinia pestis KIM
guacaggcaaa

SEQ ID NO: 2298341 - RNA, 22 nt, Yersinia pestis KIM
guaaugccacacucagacaauc

SEQ ID NO: 2298342 - RNA, 14 nt, Yersinia pestis KIM
guaaugaggcuacc

SEQ ID NO: 2298343 - RNA, 11 nt, Yersinia pestis KIM
guaaugaaauc

SEQ ID NO: 2298344 - RNA, 22 nt, Yersinia pestis KIM
guaaucuguugauggaguuguu

SEQ ID NO: 2298345 - RNA, 21 nt, Yersinia pestis KIM
guaaugagccgcauugauccu

SEQ ID NO: 2298346 - RNA, 18 nt, Yersinia pestis KIM
guaauuacgcaauaccga

SEQ ID NO: 2298347 - RNA, 15 nt, Yersinia pestis KIM
guaauucagcacggu

SEQ ID NO: 2298348 - RNA, 16 nt, Yersinia pestis KIM
guaauugacuuuuuua

SEQ ID NO: 2298349 - RNA, 16 nt, Yersinia pestis KIM
guaaaagauucauaaa

SEQ ID NO: 2298350 - RNA, 17 nt, Yersinia pestis KIM
guaauaaggucacuguu

SEQ ID NO: 2298351 - RNA, 16 nt, Yersinia pestis KIM
guaauaaguagaaaaa

SEQ ID NO: 2298352 - RNA, 20 nt, Yersinia pestis KIM
guaaaagaauaaaugucacu

SEQ ID NO: 2298353 - RNA, 17 nt, Yersinia pestis KIM
guaaaagaauaaauguc

SEQ ID NO: 2298354 - RNA, 20 nt, Yersinia pestis KIM
guaaaacugccauacccugg

SEQ ID NO: 2298355 - RNA, 20 nt, Yersinia pestis KIM
guaauacccucgacaccaaa

SEQ ID NO: 2298356 - RNA, 11 nt, Yersinia pestis KIM
guaaucaccag

SEQ ID NO: 2298357 - RNA, 16 nt, Yersinia pestis KIM
guaaucaccauuaaua

SEQ ID NO: 2298358 - RNA, 19 nt, Yersinia pestis KIM
guaaucaccauuaauaaua

SEQ ID NO: 2298359 - RNA, 16 nt, Yersinia pestis KIM
guacgcuaaacaagga

SEQ ID NO: 2298360 - RNA, 15 nt, Yersinia pestis KIM
guacuccugcucaaa

SEQ ID NO: 2298361 - RNA, 16 nt, Yersinia pestis KIM
guacugcugcaacuca

SEQ ID NO: 2298362 - RNA, 20 nt, Yersinia pestis KIM
guaccuugacgccgaugaau

SEQ ID NO: 2298363 - RNA, 23 nt, Yersinia pestis KIM
guaccuugacgccgaugaauaua

SEQ ID NO: 2298364 - RNA, 20 nt, Yersinia pestis KIM
guaccuguaagguugaccug

SEQ ID NO: 2298365 - RNA, 16 nt, Yersinia pestis KIM
guaccugcaucaucac

SEQ ID NO: 2298366 - RNA, 15 nt, Yersinia pestis KIM
guacgcaggccuucu

SEQ ID NO: 2298367 - RNA, 18 nt, Yersinia pestis KIM
guagcagcccaacacuuu

SEQ ID NO: 2298368 - RNA, 18 nt, Yersinia pestis KIM
guagcagccuguaggcca

SEQ ID NO: 2298369 - RNA, 20 nt, Yersinia pestis KIM
guagcagccuguaggccagu

SEQ ID NO: 2298370 - RNA, 20 nt, Yersinia pestis KIM
guagauuuucucaggcacau

SEQ ID NO: 2298371 - RNA, 17 nt, Yersinia pestis KIM
guagauuuaaccccaau

SEQ ID NO: 2298372 - RNA, 17 nt, Yersinia pestis KIM
guagacaaugacugugc

SEQ ID NO: 2298373 - RNA, 14 nt, Yersinia pestis KIM
guagaccaccaacu

SEQ ID NO: 2298374 - RNA, 17 nt, Yersinia pestis KIM
guagccaauagacaaaa

SEQ ID NO: 2298375 - RNA, 14 nt, Yersinia pestis KIM
guagcccacugaca

SEQ ID NO: 2298376 - RNA, 23 nt, Yersinia pestis KIM
guagccauauaauaugccagcgc

SEQ ID NO: 2298377 - RNA, 19 nt, Yersinia pestis KIM
guagccgcaggcgaugcaa

SEQ ID NO: 2298378 - RNA, 13 nt, Yersinia pestis KIM
gugcgccaaccgc

SEQ ID NO: 2298379 - RNA, 12 nt, Yersinia pestis KIM
gugcgcaaaaau

SEQ ID NO: 2298380 - RNA, 18 nt, Yersinia pestis KIM
guggaagauauucugcau

SEQ ID NO: 2298381 - RNA, 14 nt, Yersinia pestis KIM
guggcagagaacau

SEQ ID NO: 2298382 - RNA, 16 nt, Yersinia pestis KIM
guggcagauuggcuug

SEQ ID NO: 2298383 - RNA, 19 nt, Yersinia pestis KIM
guggcagccugcggcggcu

SEQ ID NO: 2298384 - RNA, 13 nt, Yersinia pestis KIM
guggauaaacaaa

SEQ ID NO: 2298385 - RNA, 19 nt, Yersinia pestis KIM
guggauaauuucagcagca

SEQ ID NO: 2298386 - RNA, 22 nt, Yersinia pestis KIM
gugggaaugcccuuuugugcau

SEQ ID NO: 2298387 - RNA, 20 nt, Yersinia pestis KIM
guggucaugcucacaaucau

SEQ ID NO: 2298388 - RNA, 18 nt, Yersinia pestis KIM
gugguccccagagcgcaa

SEQ ID NO: 2298389 - RNA, 11 nt, Yersinia pestis KIM
gugggcgcaga

SEQ ID NO: 2298390 - RNA, 23 nt, Yersinia pestis KIM
gugggcgguaguauuuguaguga

SEQ ID NO: 2298391 - RNA, 16 nt, Yersinia pestis KIM
gugggcgggggaagca

SEQ ID NO: 2298392 - RNA, 12 nt, Yersinia pestis KIM
gugggcauuuuu

SEQ ID NO: 2298393 - RNA, 11 nt, Yersinia pestis KIM
guuaacccaaa

SEQ ID NO: 2298394 - RNA, 18 nt, Yersinia pestis KIM
guuaacugcaguaaaaau

SEQ ID NO: 2298395 - RNA, 23 nt, Yersinia pestis KIM
guuaacugccguuucaguaaaac

SEQ ID NO: 2298396 - RNA, 14 nt, Yersinia pestis KIM
guuaacuuuuucua

SEQ ID NO: 2298397 - RNA, 13 nt, Yersinia pestis KIM
guuaagacaauua

SEQ ID NO: 2298398 - RNA, 15 nt, Yersinia pestis KIM
guuaagaugacuacu

SEQ ID NO: 2298399 - RNA, 16 nt, Yersinia pestis KIM
guuaaugccaccccca

SEQ ID NO: 2298400 - RNA, 11 nt, Yersinia pestis KIM
guuaaaugaag

SEQ ID NO: 2298401 - RNA, 17 nt, Yersinia pestis KIM
guuaaaaacugugccug

SEQ ID NO: 2298402 - RNA, 17 nt, Yersinia pestis KIM
guuaaaacagauaaaaa

SEQ ID NO: 2298403 - RNA, 14 nt, Yersinia pestis KIM
guguuuuucaucug

SEQ ID NO: 2298404 - RNA, 16 nt, Yersinia pestis KIM
guguagauagccuugc

SEQ ID NO: 2298405 - RNA, 22 nt, Yersinia pestis KIM
guguaucccccucacugccagc

SEQ ID NO: 2298406 - RNA, 20 nt, Yersinia pestis KIM
guguaggcgaauuggcaagu

SEQ ID NO: 2298407 - RNA, 21 nt, Yersinia pestis KIM
gugucagggcaauaacaaaca

SEQ ID NO: 2298408 - RNA, 18 nt, Yersinia pestis KIM
gugucagaccaaauagca

SEQ ID NO: 2298409 - RNA, 18 nt, Yersinia pestis KIM
gugucacaguaaaucagg

SEQ ID NO: 2298410 - RNA, 18 nt, Yersinia pestis KIM
guguauucgcaucuucca

SEQ ID NO: 2298411 - RNA, 17 nt, Yersinia pestis KIM
gugugcuguaagaaaaa

SEQ ID NO: 2298412 - RNA, 13 nt, Yersinia pestis KIM
gugugcugggugu

SEQ ID NO: 2298413 - RNA, 16 nt, Yersinia pestis KIM
gugugcucacaaucuu

SEQ ID NO: 2298414 - RNA, 18 nt, Yersinia pestis KIM
gugucucuggagcuucug

SEQ ID NO: 2298415 - RNA, 24 nt, Yersinia pestis KIM
gugugggauucguuaguauacuau

SEQ ID NO: 2298416 - RNA, 17 nt, Yersinia pestis KIM
guuaucaauacugcaaa

SEQ ID NO: 2298417 - RNA, 18 nt, Yersinia pestis KIM
guuaucaauacugcaaau

SEQ ID NO: 2298418 - RNA, 15 nt, Yersinia pestis KIM
guuaucacagcaaau

SEQ ID NO: 2298419 - RNA, 21 nt, Yersinia pestis KIM
guuaucacauaaauaaguuca

SEQ ID NO: 2298420 - RNA, 20 nt, Yersinia pestis KIM
guuaucggccauauuaccgc

SEQ ID NO: 2298421 - RNA, 19 nt, Yersinia pestis KIM
guuaucgguauuuuugucg

SEQ ID NO: 2298422 - RNA, 16 nt, Yersinia pestis KIM
guuaucgaacaucucc

SEQ ID NO: 2298423 - RNA, 22 nt, Yersinia pestis KIM
guuaucgaacaucuccugguuc

SEQ ID NO: 2298424 - RNA, 23 nt, Yersinia pestis KIM
guuauaacuauauucucauugcc

SEQ ID NO: 2298425 - RNA, 19 nt, Yersinia pestis KIM
guuauaaggcuaacaccuu

SEQ ID NO: 2298426 - RNA, 14 nt, Yersinia pestis KIM
guuauacacuugcu

SEQ ID NO: 2298427 - RNA, 17 nt, Yersinia pestis KIM
guuauaggccuaaaccc

SEQ ID NO: 2298428 - RNA, 17 nt, Yersinia pestis KIM
guuaaugggcguauuug

SEQ ID NO: 2298429 - RNA, 22 nt, Yersinia pestis KIM
guuaccccccaagcuuuugcca

SEQ ID NO: 2298430 - RNA, 22 nt, Yersinia pestis KIM
guuagccacucaacugauguuu

SEQ ID NO: 2298431 - RNA, 15 nt, Yersinia pestis KIM
guuagguaauaccaa

SEQ ID NO: 2298432 - RNA, 22 nt, Yersinia pestis KIM
guuaguaacuguaaggccaaac

SEQ ID NO: 2298433 - RNA, 15 nt, Yersinia pestis KIM
guuagugccuaucug

SEQ ID NO: 2298434 - RNA, 17 nt, Yersinia pestis KIM
guuagugguucaccacu

SEQ ID NO: 2298435 - RNA, 18 nt, Yersinia pestis KIM
guuagugguucaccacuu

SEQ ID NO: 2298436 - RNA, 22 nt, Yersinia pestis KIM
guuagugguucaccacuuucca

SEQ ID NO: 2298437 - RNA, 14 nt, Yersinia pestis KIM
guuagcucuucacg

SEQ ID NO: 2298438 - RNA, 15 nt, Yersinia pestis KIM
guuagcgaugacuga

SEQ ID NO: 2298439 - RNA, 21 nt, Yersinia pestis KIM
guuagcgacgucuaauuguua

SEQ ID NO: 2298440 - RNA, 18 nt, Yersinia pestis KIM
guuaucuguaaucaccag

SEQ ID NO: 2298441 - RNA, 11 nt, Yersinia pestis KIM
guuaugacacc

SEQ ID NO: 2298442 - RNA, 18 nt, Yersinia pestis KIM
guuauugaccaauauaaa

SEQ ID NO: 2298443 - RNA, 23 nt, Yersinia pestis KIM
guuauugaccaauauaaaagcca

SEQ ID NO: 2298444 - RNA, 14 nt, Yersinia pestis KIM
guuauuauuaaauu

SEQ ID NO: 2298445 - RNA, 14 nt, Yersinia pestis KIM
guuauuaacuucaa

SEQ ID NO: 2298446 - RNA, 21 nt, Yersinia pestis KIM
guucaaaucaguuccugauuc

SEQ ID NO: 2298447 - RNA, 13 nt, Yersinia pestis KIM
guuauuugcuauc

SEQ ID NO: 2298448 - RNA, 14 nt, Yersinia pestis KIM
guuauuugaauaag

SEQ ID NO: 2298449 - RNA, 22 nt, Yersinia pestis KIM
guuauuucugaccguuguaugu

SEQ ID NO: 2298450 - RNA, 12 nt, Yersinia pestis KIM
guuauuuuaauu

SEQ ID NO: 2298451 - RNA, 19 nt, Yersinia pestis KIM
guucaagauaaaguucuuc

SEQ ID NO: 2298452 - RNA, 12 nt, Yersinia pestis KIM
guucaagaucgu

SEQ ID NO: 2298453 - RNA, 22 nt, Yersinia pestis KIM
guucaagagcgauagaucgaua

SEQ ID NO: 2298454 - RNA, 12 nt, Yersinia pestis KIM
guucaauaauua

SEQ ID NO: 2298455 - RNA, 15 nt, Yersinia pestis KIM
guucgacuaucccac

SEQ ID NO: 2298456 - RNA, 15 nt, Yersinia pestis KIM
guucucacgaauaaa

SEQ ID NO: 2298457 - RNA, 21 nt, Yersinia pestis KIM
guucuaucucaucuuaaucac

SEQ ID NO: 2298458 - RNA, 15 nt, Yersinia pestis KIM
guucuaucucaucuu

SEQ ID NO: 2298459 - RNA, 18 nt, Yersinia pestis KIM
guucucaaccaaauagcg

SEQ ID NO: 2298460 - RNA, 21 nt, Yersinia pestis KIM
guucuccggcggcuucaucag

SEQ ID NO: 2298461 - RNA, 19 nt, Yersinia pestis KIM
guucugccaauuuggggcu

SEQ ID NO: 2298462 - RNA, 19 nt, Yersinia pestis KIM
guucucuggguaagaacag

SEQ ID NO: 2298463 - RNA, 16 nt, Yersinia pestis KIM
guucaccaaagcaaug

SEQ ID NO: 2298464 - RNA, 16 nt, Yersinia pestis KIM
guucaccagcuugggu

SEQ ID NO: 2298465 - RNA, 15 nt, Yersinia pestis KIM
guucaccccucaccc

SEQ ID NO: 2298466 - RNA, 15 nt, Yersinia pestis KIM
guucaccgcaucgcc

SEQ ID NO: 2298467 - RNA, 16 nt, Yersinia pestis KIM
guucacgaucucuauc

SEQ ID NO: 2298468 - RNA, 20 nt, Yersinia pestis KIM
guucacgauggaaaaaauac

SEQ ID NO: 2298469 - RNA, 19 nt, Yersinia pestis KIM
gugccgugucuuccagaca

SEQ ID NO: 2298470 - RNA, 12 nt, Yersinia pestis KIM
gugccgggaaua

SEQ ID NO: 2298471 - RNA, 22 nt, Yersinia pestis KIM
gugccguucuccaguugccagc

SEQ ID NO: 2298472 - RNA, 15 nt, Yersinia pestis KIM
gugcccaaucuauga

SEQ ID NO: 2298473 - RNA, 14 nt, Yersinia pestis KIM
gugccauggucagu

SEQ ID NO: 2298474 - RNA, 23 nt, Yersinia pestis KIM
gugccaucgcuugauaacacauu

SEQ ID NO: 2298475 - RNA, 22 nt, Yersinia pestis KIM
gugcccaaaaacgcuggccagc

SEQ ID NO: 2298476 - RNA, 15 nt, Yersinia pestis KIM
gugcauguaacugua

SEQ ID NO: 2298477 - RNA, 19 nt, Yersinia pestis KIM
gugcauguggaagcgggcg

SEQ ID NO: 2298478 - RNA, 13 nt, Yersinia pestis KIM
gugccaucgccaa

SEQ ID NO: 2298479 - RNA, 21 nt, Yersinia pestis KIM
gugccauaaauaccaauuuca

SEQ ID NO: 2298480 - RNA, 13 nt, Yersinia pestis KIM
gugccgcuggggu

SEQ ID NO: 2298481 - RNA, 20 nt, Yersinia pestis KIM
gugcaguaauggaaauagcu

SEQ ID NO: 2298482 - RNA, 18 nt, Yersinia pestis KIM
gugcauaaaacgauuuuc

SEQ ID NO: 2298483 - RNA, 13 nt, Yersinia pestis KIM
gugcauccccacu

SEQ ID NO: 2298484 - RNA, 19 nt, Yersinia pestis KIM
gugauuugcacguagagau

SEQ ID NO: 2298485 - RNA, 16 nt, Yersinia pestis KIM
gugcaacauuaaaaau

SEQ ID NO: 2298486 - RNA, 12 nt, Yersinia pestis KIM
gugaucaucgca

SEQ ID NO: 2298487 - RNA, 15 nt, Yersinia pestis KIM
gugaucaucuuuuuu

SEQ ID NO: 2298488 - RNA, 21 nt, Yersinia pestis KIM
gugaucgcguacagagcaaaa

SEQ ID NO: 2298489 - RNA, 20 nt, Yersinia pestis KIM
gugauaugcaaaucaugcuc

SEQ ID NO: 2298490 - RNA, 17 nt, Yersinia pestis KIM
gugaucaacugccuguu

SEQ ID NO: 2298491 - RNA, 20 nt, Yersinia pestis KIM
gugaguuuuuggccuccgaa

SEQ ID NO: 2298492 - RNA, 16 nt, Yersinia pestis KIM
gugaguuccagcccca

SEQ ID NO: 2298493 - RNA, 15 nt, Yersinia pestis KIM
gugagugagcgcagg

SEQ ID NO: 2298494 - RNA, 20 nt, Yersinia pestis KIM
gugaguuaacgaguguacag

SEQ ID NO: 2298495 - RNA, 14 nt, Yersinia pestis KIM
gugaguggcuggga

SEQ ID NO: 2298496 - RNA, 11 nt, Yersinia pestis KIM
gugagugacau

SEQ ID NO: 2298497 - RNA, 13 nt, Yersinia pestis KIM
gugagugagcgca

SEQ ID NO: 2298498 - RNA, 15 nt, Yersinia pestis KIM
gugagguggccgaga

SEQ ID NO: 2298499 - RNA, 21 nt, Yersinia pestis KIM
gugaguaauucgcagacagau

SEQ ID NO: 2298500 - RNA, 12 nt, Yersinia pestis KIM
gugagcgucauu

SEQ ID NO: 2298501 - RNA, 17 nt, Yersinia pestis KIM
gugacauguuccagugc

SEQ ID NO: 2298502 - RNA, 15 nt, Yersinia pestis KIM
gugacaggcaaagac

SEQ ID NO: 2298503 - RNA, 23 nt, Yersinia pestis KIM
gugacaguagaauaccucacugg

SEQ ID NO: 2298504 - RNA, 13 nt, Yersinia pestis KIM
gugacaggcaaag

SEQ ID NO: 2298505 - RNA, 17 nt, Yersinia pestis KIM
gugacugaauggcuauu

SEQ ID NO: 2298506 - RNA, 17 nt, Yersinia pestis KIM
gugacuugcaguggccu

SEQ ID NO: 2298507 - RNA, 21 nt, Yersinia pestis KIM
gugacggcuuuauaguccuuc

SEQ ID NO: 2298508 - RNA, 21 nt, Yersinia pestis KIM
gucuucuuuugggauaaaaua

SEQ ID NO: 2298509 - RNA, 22 nt, Yersinia pestis KIM
gugaaacccgcgcagccuaaaa

SEQ ID NO: 2298510 - RNA, 20 nt, Yersinia pestis KIM
gugaaacgauaugcuccaga

SEQ ID NO: 2298511 - RNA, 23 nt, Yersinia pestis KIM
gucuuuucaaccaacacuccucu

SEQ ID NO: 2298512 - RNA, 17 nt, Yersinia pestis KIM
gucuuuuuaauauguga

SEQ ID NO: 2298513 - RNA, 23 nt, Yersinia pestis KIM
gugaaaaaauaucuuuaaacccc

SEQ ID NO: 2298514 - RNA, 19 nt, Yersinia pestis KIM
gucuuuacgaucugccugu

SEQ ID NO: 2298515 - RNA, 17 nt, Yersinia pestis KIM
gucuuuaccuccauaua

SEQ ID NO: 2298516 - RNA, 16 nt, Yersinia pestis KIM
gucuuucgggcugaug

SEQ ID NO: 2298517 - RNA, 17 nt, Yersinia pestis KIM
gucuuucgggcugauga

SEQ ID NO: 2298518 - RNA, 18 nt, Yersinia pestis KIM
gucuuuaauaaaaucaaa

SEQ ID NO: 2298519 - RNA, 18 nt, Yersinia pestis KIM
gucuuuuaaugaugcggg

SEQ ID NO: 2298520 - RNA, 21 nt, Yersinia pestis KIM
gugaaccgcgcucugcuggga

SEQ ID NO: 2298521 - RNA, 13 nt, Yersinia pestis KIM
gugaacauuuauc

SEQ ID NO: 2298522 - RNA, 15 nt, Yersinia pestis KIM
gugaaccagauaaca

SEQ ID NO: 2298523 - RNA, 20 nt, Yersinia pestis KIM
gugaagagcgauugacugaa

SEQ ID NO: 2298524 - RNA, 12 nt, Yersinia pestis KIM
gugaagaacagc

SEQ ID NO: 2298525 - RNA, 19 nt, Yersinia pestis KIM
gugaacuuagcgccauaac

SEQ ID NO: 2298526 - RNA, 20 nt, Yersinia pestis KIM
gugaacaggccccaaaauag

SEQ ID NO: 2298527 - RNA, 14 nt, Yersinia pestis KIM
gugaacaugaugaa

SEQ ID NO: 2298528 - RNA, 16 nt, Yersinia pestis KIM
gugaaauugcccgccg

SEQ ID NO: 2298529 - RNA, 17 nt, Yersinia pestis KIM
gugaaagggaaguuucu

SEQ ID NO: 2298530 - RNA, 16 nt, Yersinia pestis KIM
gugaaagccugcacca

SEQ ID NO: 2298531 - RNA, 16 nt, Yersinia pestis KIM
gugaaaucgguagaca

SEQ ID NO: 2298532 - RNA, 12 nt, Yersinia pestis KIM
gugaaguuuaua

SEQ ID NO: 2298533 - RNA, 19 nt, Yersinia pestis KIM
gugaauaacugguccaacu

SEQ ID NO: 2298534 - RNA, 11 nt, Yersinia pestis KIM
gugaauaacgc

SEQ ID NO: 2298535 - RNA, 14 nt, Yersinia pestis KIM
gugaagugagcuga

SEQ ID NO: 2298536 - RNA, 16 nt, Yersinia pestis KIM
gugaauaccauuucac

SEQ ID NO: 2298537 - RNA, 23 nt, Yersinia pestis KIM
gucuucaguggcuggaaaggaau

SEQ ID NO: 2298538 - RNA, 15 nt, Yersinia pestis KIM
gucuuauuacucauu

SEQ ID NO: 2298539 - RNA, 12 nt, Yersinia pestis KIM
gucuucagcuuc

SEQ ID NO: 2298540 - RNA, 16 nt, Yersinia pestis KIM
gucuguuaugcccaac

SEQ ID NO: 2298541 - RNA, 22 nt, Yersinia pestis KIM
gucuuacuauguccgcauauuc

SEQ ID NO: 2298542 - RNA, 21 nt, Yersinia pestis KIM
gucugguggugaacggccauc

SEQ ID NO: 2298543 - RNA, 19 nt, Yersinia pestis KIM
gucugggacuuuaucugcc

SEQ ID NO: 2298544 - RNA, 21 nt, Yersinia pestis KIM
gucucuuucgggcaaaaaaau

SEQ ID NO: 2298545 - RNA, 14 nt, Yersinia pestis KIM
gucucuuugccaag

SEQ ID NO: 2298546 - RNA, 14 nt, Yersinia pestis KIM
gucucgcaaugaaa

SEQ ID NO: 2298547 - RNA, 13 nt, Yersinia pestis KIM
gucugacagauac

SEQ ID NO: 2298548 - RNA, 14 nt, Yersinia pestis KIM
gucugagguggcac

SEQ ID NO: 2298549 - RNA, 23 nt, Yersinia pestis KIM
gucugagguggcacccagugacc

SEQ ID NO: 2298550 - RNA, 13 nt, Yersinia pestis KIM
gucugauaaccgu

SEQ ID NO: 2298551 - RNA, 20 nt, Yersinia pestis KIM
gucugacggguauaucacuu

SEQ ID NO: 2298552 - RNA, 22 nt, Yersinia pestis KIM
uaaaucucuuaccccuuucaau

SEQ ID NO: 2298553 - RNA, 17 nt, Yersinia pestis KIM
uaaaucuacuuuauuca

SEQ ID NO: 2298554 - RNA, 21 nt, Yersinia pestis KIM
uaaaucaauucuaucgcugua

SEQ ID NO: 2298555 - RNA, 17 nt, Yersinia pestis KIM
uaaaucacaauuucacc

SEQ ID NO: 2298556 - RNA, 18 nt, Yersinia pestis KIM
uaaaucuuguuuaaucac

SEQ ID NO: 2298557 - RNA, 18 nt, Yersinia pestis KIM
uaaauauggcggcaucag

SEQ ID NO: 2298558 - RNA, 22 nt, Yersinia pestis KIM
uaaauggcuguuauauaaaugg

SEQ ID NO: 2298559 - RNA, 22 nt, Yersinia pestis KIM
uaaauggcacuggaaacaaaac

SEQ ID NO: 2298560 - RNA, 16 nt, Yersinia pestis KIM
uaaaugguuuauuuaa

SEQ ID NO: 2298561 - RNA, 15 nt, Yersinia pestis KIM
uaaauguacagucau

SEQ ID NO: 2298562 - RNA, 17 nt, Yersinia pestis KIM
uaaauuaaaaagagugu

SEQ ID NO: 2298563 - RNA, 14 nt, Yersinia pestis KIM
uaaaugaacgugcc

SEQ ID NO: 2298564 - RNA, 21 nt, Yersinia pestis KIM
uaaaugacuaucccuucaauc

SEQ ID NO: 2298565 - RNA, 22 nt, Yersinia pestis KIM
uaaaugacuaucccuucaauca

SEQ ID NO: 2298566 - RNA, 19 nt, Yersinia pestis KIM
uaaaugaccaacuguaaaa

SEQ ID NO: 2298567 - RNA, 21 nt, Yersinia pestis KIM
uaaaugacauauugugcuauc

SEQ ID NO: 2298568 - RNA, 21 nt, Yersinia pestis KIM
uaaauagagugaaguaucacc

SEQ ID NO: 2298569 - RNA, 17 nt, Yersinia pestis KIM
uaaauagauaaaaacau

SEQ ID NO: 2298570 - RNA, 18 nt, Yersinia pestis KIM
uaaauagauaaaaacauu

SEQ ID NO: 2298571 - RNA, 12 nt, Yersinia pestis KIM
uaaauacaaaaa

SEQ ID NO: 2298572 - RNA, 14 nt, Yersinia pestis KIM
uaaauaaauuuaau

SEQ ID NO: 2298573 - RNA, 16 nt, Yersinia pestis KIM
uaaauaaauaaucauu

SEQ ID NO: 2298574 - RNA, 13 nt, Yersinia pestis KIM
uaaauaauuacuu

SEQ ID NO: 2298575 - RNA, 17 nt, Yersinia pestis KIM
uaaauaauuacuuauaa

SEQ ID NO: 2298576 - RNA, 19 nt, Yersinia pestis KIM
uaaauaauuacuuauaaac

SEQ ID NO: 2298577 - RNA, 19 nt, Yersinia pestis KIM
uaaauaaugucgucaauua

SEQ ID NO: 2298578 - RNA, 23 nt, Yersinia pestis KIM
uaaauaaugucgucaauuaaaau

SEQ ID NO: 2298579 - RNA, 20 nt, Yersinia pestis KIM
uaaaggugaucgcucaggcg

SEQ ID NO: 2298580 - RNA, 16 nt, Yersinia pestis KIM
uaaauaaaauaauaau

SEQ ID NO: 2298581 - RNA, 13 nt, Yersinia pestis KIM
uaaauaaaauaau

SEQ ID NO: 2298582 - RNA, 14 nt, Yersinia pestis KIM
uaaauaaaaacgca

SEQ ID NO: 2298583 - RNA, 14 nt, Yersinia pestis KIM
uaaauaaaaaagcu

SEQ ID NO: 2298584 - RNA, 16 nt, Yersinia pestis KIM
uaaacuuuuaugcauc

SEQ ID NO: 2298585 - RNA, 17 nt, Yersinia pestis KIM
uaaacuuguaucaaaac

SEQ ID NO: 2298586 - RNA, 21 nt, Yersinia pestis KIM
uaaagaaucagcgguugaaaa

SEQ ID NO: 2298587 - RNA, 23 nt, Yersinia pestis KIM
uaaagacgccguaaauacaucca

SEQ ID NO: 2298588 - RNA, 21 nt, Yersinia pestis KIM
uaaagacgccguaaauacauc

SEQ ID NO: 2298589 - RNA, 17 nt, Yersinia pestis KIM
uaaagacgccguaaaua

SEQ ID NO: 2298590 - RNA, 20 nt, Yersinia pestis KIM
uaaagacgccguaaauacau

SEQ ID NO: 2298591 - RNA, 19 nt, Yersinia pestis KIM
uaaagacgccggcuucccu

SEQ ID NO: 2298592 - RNA, 23 nt, Yersinia pestis KIM
uaaagcguccgcgccaaggaagg

SEQ ID NO: 2298593 - RNA, 19 nt, Yersinia pestis KIM
uaaagguaaaaggcccgcu

SEQ ID NO: 2298594 - RNA, 15 nt, Yersinia pestis KIM
uaaagcgccuuccuu

SEQ ID NO: 2298595 - RNA, 23 nt, Yersinia pestis KIM
uaaagcgauaaauacucccgcca

SEQ ID NO: 2298596 - RNA, 13 nt, Yersinia pestis KIM
uaaagccuugucc

SEQ ID NO: 2298597 - RNA, 14 nt, Yersinia pestis KIM
uaaagccuuucagc

SEQ ID NO: 2298598 - RNA, 13 nt, Yersinia pestis KIM
uaaagcccagcag

SEQ ID NO: 2298599 - RNA, 20 nt, Yersinia pestis KIM
uaaagccgacauccaccauu

SEQ ID NO: 2298600 - RNA, 15 nt, Yersinia pestis KIM
uaaagccaucgccau

SEQ ID NO: 2298601 - RNA, 20 nt, Yersinia pestis KIM
uaaagccaguaaacgcagag

SEQ ID NO: 2298602 - RNA, 12 nt, Yersinia pestis KIM
uaaagccagaca

SEQ ID NO: 2298603 - RNA, 21 nt, Yersinia pestis KIM
uaaagcagguaguuacagcaa

SEQ ID NO: 2298604 - RNA, 17 nt, Yersinia pestis KIM
uaaacauuguuauauua

SEQ ID NO: 2298605 - RNA, 15 nt, Yersinia pestis KIM
uaaacauuuacuuau

SEQ ID NO: 2298606 - RNA, 13 nt, Yersinia pestis KIM
uaaacauuuugac

SEQ ID NO: 2298607 - RNA, 17 nt, Yersinia pestis KIM
uaaacauugacgaugga

SEQ ID NO: 2298608 - RNA, 18 nt, Yersinia pestis KIM
uaaaaucuguaauuaauu

SEQ ID NO: 2298609 - RNA, 23 nt, Yersinia pestis KIM
uaaaaucuguaauuaauuauaag

SEQ ID NO: 2298610 - RNA, 15 nt, Yersinia pestis KIM
uaaaccgugauuggu

SEQ ID NO: 2298611 - RNA, 22 nt, Yersinia pestis KIM
uaaaccgcucucaccuaagccu

SEQ ID NO: 2298612 - RNA, 16 nt, Yersinia pestis KIM
uaaaccgguuaaaaca

SEQ ID NO: 2298613 - RNA, 17 nt, Yersinia pestis KIM
uaaaccgguuaaaacag

SEQ ID NO: 2298614 - RNA, 14 nt, Yersinia pestis KIM
uaaaccagccagug

SEQ ID NO: 2298615 - RNA, 16 nt, Yersinia pestis KIM
uaaaccuacagccauc

SEQ ID NO: 2298616 - RNA, 15 nt, Yersinia pestis KIM
uaaaccucagaaaaa

SEQ ID NO: 2298617 - RNA, 16 nt, Yersinia pestis KIM
uaaaccucagaaaaau

SEQ ID NO: 2298618 - RNA, 20 nt, Yersinia pestis KIM
uaaaccucagaaaaaugccu

SEQ ID NO: 2298619 - RNA, 15 nt, Yersinia pestis KIM
uaaaccugacugguu

SEQ ID NO: 2298620 - RNA, 23 nt, Yersinia pestis KIM
uaaaccugacugguucacaccaa

SEQ ID NO: 2298621 - RNA, 13 nt, Yersinia pestis KIM
uaaaccugcaaua

SEQ ID NO: 2298622 - RNA, 19 nt, Yersinia pestis KIM
uaaaccugcaauaaccaga

SEQ ID NO: 2298623 - RNA, 17 nt, Yersinia pestis KIM
uaaacgaccauuucucu

SEQ ID NO: 2298624 - RNA, 22 nt, Yersinia pestis KIM
uaaacgaauggucugcaacuca

SEQ ID NO: 2298625 - RNA, 15 nt, Yersinia pestis KIM
uaaacgaguuuccag

SEQ ID NO: 2298626 - RNA, 12 nt, Yersinia pestis KIM
uaaacuaauauc

SEQ ID NO: 2298627 - RNA, 14 nt, Yersinia pestis KIM
uaaacuaauaucuu

SEQ ID NO: 2298628 - RNA, 13 nt, Yersinia pestis KIM
uaaacgucagauu

SEQ ID NO: 2298629 - RNA, 15 nt, Yersinia pestis KIM
uaaacgguugcugua

SEQ ID NO: 2298630 - RNA, 18 nt, Yersinia pestis KIM
uaaacgguaaccauccau

SEQ ID NO: 2298631 - RNA, 15 nt, Yersinia pestis KIM
uaacaauuuuauugu

SEQ ID NO: 2298632 - RNA, 20 nt, Yersinia pestis KIM
uaacaauuuuauuguuuucg

SEQ ID NO: 2298633 - RNA, 20 nt, Yersinia pestis KIM
uaacacauuccaguaaaaaa

SEQ ID NO: 2298634 - RNA, 18 nt, Yersinia pestis KIM
uaacacauuccaguaaaa

SEQ ID NO: 2298635 - RNA, 21 nt, Yersinia pestis KIM
uaacaccaaccggauuacaua

SEQ ID NO: 2298636 - RNA, 16 nt, Yersinia pestis KIM
uaacacauuaauuuau

SEQ ID NO: 2298637 - RNA, 14 nt, Yersinia pestis KIM
uaacacauuauucu

SEQ ID NO: 2298638 - RNA, 19 nt, Yersinia pestis KIM
uaacaaacuguuuuuuaaa

SEQ ID NO: 2298639 - RNA, 12 nt, Yersinia pestis KIM
uaacaaacacau

SEQ ID NO: 2298640 - RNA, 18 nt, Yersinia pestis KIM
uaacaauuaauuggcuca

SEQ ID NO: 2298641 - RNA, 17 nt, Yersinia pestis KIM
uaacaauuacuuuggca

SEQ ID NO: 2298642 - RNA, 14 nt, Yersinia pestis KIM
uaacaauucucucg

SEQ ID NO: 2298643 - RNA, 22 nt, Yersinia pestis KIM
uaacaaaaugcgguggcacuga

SEQ ID NO: 2298644 - RNA, 18 nt, Yersinia pestis KIM
uaaauuuucuaagcugcc

SEQ ID NO: 2298645 - RNA, 11 nt, Yersinia pestis KIM
uaaauuuuaaa

SEQ ID NO: 2298646 - RNA, 12 nt, Yersinia pestis KIM
uaaauuuuaaac

SEQ ID NO: 2298647 - RNA, 16 nt, Yersinia pestis KIM
uaaauuuucaguucau

SEQ ID NO: 2298648 - RNA, 13 nt, Yersinia pestis KIM
uaaauuuauauuu

SEQ ID NO: 2298649 - RNA, 18 nt, Yersinia pestis KIM
uaaauuuauauuuacgca

SEQ ID NO: 2298650 - RNA, 17 nt, Yersinia pestis KIM
uaaauuucuucaauaau

SEQ ID NO: 2298651 - RNA, 20 nt, Yersinia pestis KIM
uaaauuacucguauaaaaaa

SEQ ID NO: 2298652 - RNA, 14 nt, Yersinia pestis KIM
uaaauuagaaaaca

SEQ ID NO: 2298653 - RNA, 20 nt, Yersinia pestis KIM
uaaauucagguugaggcagg

SEQ ID NO: 2298654 - RNA, 22 nt, Yersinia pestis KIM
uaaauucagguugaggcagggu

SEQ ID NO: 2298655 - RNA, 15 nt, Yersinia pestis KIM
uaaauucaaaauaga

SEQ ID NO: 2298656 - RNA, 13 nt, Yersinia pestis KIM
uaaauucaaaaua

SEQ ID NO: 2298657 - RNA, 23 nt, Yersinia pestis KIM
uaaauucaaaauagaggaaauaa

SEQ ID NO: 2298658 - RNA, 16 nt, Yersinia pestis KIM
uaaauucaaauaucau

SEQ ID NO: 2298659 - RNA, 22 nt, Yersinia pestis KIM
uaaauuaucgccuaccaucaaa

SEQ ID NO: 2298660 - RNA, 19 nt, Yersinia pestis KIM
uaaauuaucccguucaaua

SEQ ID NO: 2298661 - RNA, 15 nt, Yersinia pestis KIM
uaaauuuaauaugac

SEQ ID NO: 2298662 - RNA, 17 nt, Yersinia pestis KIM
uaaauugcuuaaaaaaa

SEQ ID NO: 2298663 - RNA, 17 nt, Yersinia pestis KIM
uaaauuccguaccaguu

SEQ ID NO: 2298664 - RNA, 21 nt, Yersinia pestis KIM
uaaauuccuauaaauuuuaag

SEQ ID NO: 2298665 - RNA, 15 nt, Yersinia pestis KIM
uaaauucuagcaaca

SEQ ID NO: 2298666 - RNA, 16 nt, Yersinia pestis KIM
uaaccgaauaaaaccu

SEQ ID NO: 2298667 - RNA, 14 nt, Yersinia pestis KIM
uaaccgaauaaaac

SEQ ID NO: 2298668 - RNA, 23 nt, Yersinia pestis KIM
uaaccgccgauauucaagcagug

SEQ ID NO: 2298669 - RNA, 14 nt, Yersinia pestis KIM
uaaccgcauucaca

SEQ ID NO: 2298670 - RNA, 22 nt, Yersinia pestis KIM
uaaccgccaaaauaucgcgcuu

SEQ ID NO: 2298671 - RNA, 19 nt, Yersinia pestis KIM
uaaccggguaaauuccgua

SEQ ID NO: 2298672 - RNA, 21 nt, Yersinia pestis KIM
uaaccgggcuugauuaaauga

SEQ ID NO: 2298673 - RNA, 20 nt, Yersinia pestis KIM
uaaccgccugugacgcuuga

SEQ ID NO: 2298674 - RNA, 15 nt, Yersinia pestis KIM
uaaccggguggccca

SEQ ID NO: 2298675 - RNA, 16 nt, Yersinia pestis KIM
uaaccuaaaaacguca

SEQ ID NO: 2298676 - RNA, 13 nt, Yersinia pestis KIM
uaaccucagccuc

SEQ ID NO: 2298677 - RNA, 16 nt, Yersinia pestis KIM
uaaccucagccucauu

SEQ ID NO: 2298678 - RNA, 18 nt, Yersinia pestis KIM
uaaccucacgggcuucca

SEQ ID NO: 2298679 - RNA, 15 nt, Yersinia pestis KIM
uaaccucaaaaggau

SEQ ID NO: 2298680 - RNA, 13 nt, Yersinia pestis KIM
uaaccuacuccaa

SEQ ID NO: 2298681 - RNA, 13 nt, Yersinia pestis KIM
uaacgcagaaaua

SEQ ID NO: 2298682 - RNA, 15 nt, Yersinia pestis KIM
uaacgcagauaaauc

SEQ ID NO: 2298683 - RNA, 21 nt, Yersinia pestis KIM
uaacgcuaauaacauggggua

SEQ ID NO: 2298684 - RNA, 19 nt, Yersinia pestis KIM
uaacgcuggauaagugaau

SEQ ID NO: 2298685 - RNA, 20 nt, Yersinia pestis KIM
uaacgcuggauaagugaaua

SEQ ID NO: 2298686 - RNA, 19 nt, Yersinia pestis KIM
uaacgcuucaucauggaua

SEQ ID NO: 2298687 - RNA, 23 nt, Yersinia pestis KIM
uaacgaacagguagaucaaacau

SEQ ID NO: 2298688 - RNA, 21 nt, Yersinia pestis KIM
uaacgaauuucauuuuaaaau

SEQ ID NO: 2298689 - RNA, 14 nt, Yersinia pestis KIM
uaacgaauuucauu

SEQ ID NO: 2298690 - RNA, 18 nt, Yersinia pestis KIM
uaacgauauaauagcugg

SEQ ID NO: 2298691 - RNA, 22 nt, Yersinia pestis KIM
uaacgaucgcuuaacgaggcgc

SEQ ID NO: 2298692 - RNA, 23 nt, Yersinia pestis KIM
uaacagagcagaaagcagcagcu

SEQ ID NO: 2298693 - RNA, 14 nt, Yersinia pestis KIM
uaacagccccgucu

SEQ ID NO: 2298694 - RNA, 13 nt, Yersinia pestis KIM
uaacagcaucacu

SEQ ID NO: 2298695 - RNA, 19 nt, Yersinia pestis KIM
uaacagcaucacugucuau

SEQ ID NO: 2298696 - RNA, 16 nt, Yersinia pestis KIM
uaacagagcagaaagc

SEQ ID NO: 2298697 - RNA, 21 nt, Yersinia pestis KIM
uaacagagcagaaagcagcag

SEQ ID NO: 2298698 - RNA, 20 nt, Yersinia pestis KIM
uaacacccaauaauaaaaaa

SEQ ID NO: 2298699 - RNA, 18 nt, Yersinia pestis KIM
uaacaugccacauagcgu

SEQ ID NO: 2298700 - RNA, 12 nt, Yersinia pestis KIM
uaacaugccaca

SEQ ID NO: 2298701 - RNA, 16 nt, Yersinia pestis KIM
uaacaugccacauagc

SEQ ID NO: 2298702 - RNA, 16 nt, Yersinia pestis KIM
uaacaugcugauagca

SEQ ID NO: 2298703 - RNA, 15 nt, Yersinia pestis KIM
uaacaugguaugcca

SEQ ID NO: 2298704 - RNA, 17 nt, Yersinia pestis KIM
uaacaugguaugccacu

SEQ ID NO: 2298705 - RNA, 21 nt, Yersinia pestis KIM
uaacauuacuuugaauagcac

SEQ ID NO: 2298706 - RNA, 13 nt, Yersinia pestis KIM
uaacauguagcac

SEQ ID NO: 2298707 - RNA, 16 nt, Yersinia pestis KIM
uaaccauuaauugguu

SEQ ID NO: 2298708 - RNA, 16 nt, Yersinia pestis KIM
uaaccaucaaauacac

SEQ ID NO: 2298709 - RNA, 17 nt, Yersinia pestis KIM
uaacccgcaagcaaacu

SEQ ID NO: 2298710 - RNA, 14 nt, Yersinia pestis KIM
uaacauuuuuucuu

SEQ ID NO: 2298711 - RNA, 18 nt, Yersinia pestis KIM
uaaccagugccgcccagc

SEQ ID NO: 2298712 - RNA, 19 nt, Yersinia pestis KIM
guuuuugaggaaauuucag

SEQ ID NO: 2298713 - RNA, 20 nt, Yersinia pestis KIM
guuuuucccguaggcugacc

SEQ ID NO: 2298714 - RNA, 12 nt, Yersinia pestis KIM
guuuuuccagcc

SEQ ID NO: 2298715 - RNA, 16 nt, Yersinia pestis KIM
guuuuucauuuacuug

SEQ ID NO: 2298716 - RNA, 21 nt, Yersinia pestis KIM
guuuuuauauauccaaaauaa

SEQ ID NO: 2298717 - RNA, 23 nt, Yersinia pestis KIM
guuuuuauauuuaccugcucaac

SEQ ID NO: 2298718 - RNA, 16 nt, Yersinia pestis KIM
guuuuuagcuuaacau

SEQ ID NO: 2298719 - RNA, 16 nt, Yersinia pestis KIM
guuuuuauuacagagu

SEQ ID NO: 2298720 - RNA, 18 nt, Yersinia pestis KIM
guuuuucaaucuauucuu

SEQ ID NO: 2298721 - RNA, 13 nt, Yersinia pestis KIM
guuuugcucugca

SEQ ID NO: 2298722 - RNA, 17 nt, Yersinia pestis KIM
guuuugcaucaagcucu

SEQ ID NO: 2298723 - RNA, 17 nt, Yersinia pestis KIM
uaaaaaaaaauaaaauu

SEQ ID NO: 2298724 - RNA, 13 nt, Yersinia pestis KIM
uaaaaaaaaauaa

SEQ ID NO: 2298725 - RNA, 15 nt, Yersinia pestis KIM
uaaaaaaaaagaaaa

SEQ ID NO: 2298726 - RNA, 17 nt, Yersinia pestis KIM
guuuuuuuuaucagccc

SEQ ID NO: 2298727 - RNA, 12 nt, Yersinia pestis KIM
uaaaaaaauagc

SEQ ID NO: 2298728 - RNA, 12 nt, Yersinia pestis KIM
guuuuuuugcca

SEQ ID NO: 2298729 - RNA, 13 nt, Yersinia pestis KIM
guuuuuuaaaaaa

SEQ ID NO: 2298730 - RNA, 13 nt, Yersinia pestis KIM
guuuuuucuuucu

SEQ ID NO: 2298731 - RNA, 22 nt, Yersinia pestis KIM
uaaaaaaucuauugauugcuua

SEQ ID NO: 2298732 - RNA, 16 nt, Yersinia pestis KIM
uaaaaaaucaguauua

SEQ ID NO: 2298733 - RNA, 22 nt, Yersinia pestis KIM
uaaaaaaugauuuuauucacuu

SEQ ID NO: 2298734 - RNA, 16 nt, Yersinia pestis KIM
uaaaaaaggguaauca

SEQ ID NO: 2298735 - RNA, 21 nt, Yersinia pestis KIM
uaaaaaagcugucauaaaaaa

SEQ ID NO: 2298736 - RNA, 13 nt, Yersinia pestis KIM
uaaaaaaauucau

SEQ ID NO: 2298737 - RNA, 14 nt, Yersinia pestis KIM
uaaaaaaauucauu

SEQ ID NO: 2298738 - RNA, 21 nt, Yersinia pestis KIM
uaaaaaaauucauucuuuuau

SEQ ID NO: 2298739 - RNA, 18 nt, Yersinia pestis KIM
uaaaaaacgcgacgguca

SEQ ID NO: 2298740 - RNA, 14 nt, Yersinia pestis KIM
uaaaauagcccagu

SEQ ID NO: 2298741 - RNA, 19 nt, Yersinia pestis KIM
uaaaauagguguuuuucgu

SEQ ID NO: 2298742 - RNA, 16 nt, Yersinia pestis KIM
uaaaauaccaauuaau

SEQ ID NO: 2298743 - RNA, 14 nt, Yersinia pestis KIM
uaaaauauuuugcu

SEQ ID NO: 2298744 - RNA, 14 nt, Yersinia pestis KIM
uaaaaucaaaacag

SEQ ID NO: 2298745 - RNA, 15 nt, Yersinia pestis KIM
uaaaaucaaaacagg

SEQ ID NO: 2298746 - RNA, 19 nt, Yersinia pestis KIM
uaaaaucacccgcaagaau

SEQ ID NO: 2298747 - RNA, 12 nt, Yersinia pestis KIM
uaaaaucaucag

SEQ ID NO: 2298748 - RNA, 20 nt, Yersinia pestis KIM
uaaaaucaucagccucuaac

SEQ ID NO: 2298749 - RNA, 23 nt, Yersinia pestis KIM
uaaaaucacguuuccaaaacuca

SEQ ID NO: 2298750 - RNA, 22 nt, Yersinia pestis KIM
uaaaagcggguuaccaguaacu

SEQ ID NO: 2298751 - RNA, 14 nt, Yersinia pestis KIM
uaaaagccagucag

SEQ ID NO: 2298752 - RNA, 19 nt, Yersinia pestis KIM
uaaaagcacagacaaacaa

SEQ ID NO: 2298753 - RNA, 19 nt, Yersinia pestis KIM
uaaaagcaucucgauacau

SEQ ID NO: 2298754 - RNA, 23 nt, Yersinia pestis KIM
uaaaagcaucucgauacauacca

SEQ ID NO: 2298755 - RNA, 18 nt, Yersinia pestis KIM
uaaaagcacagacaaaca

SEQ ID NO: 2298756 - RNA, 16 nt, Yersinia pestis KIM
uaaaagucuauauaga

SEQ ID NO: 2298757 - RNA, 23 nt, Yersinia pestis KIM
uaaaaacauuuaaauaugaauga

SEQ ID NO: 2298758 - RNA, 22 nt, Yersinia pestis KIM
uaaaaaauuauuaaauaagaag

SEQ ID NO: 2298759 - RNA, 15 nt, Yersinia pestis KIM
uaaaaaauuauuaaa

SEQ ID NO: 2298760 - RNA, 17 nt, Yersinia pestis KIM
uaaaaaauuauuaaaua

SEQ ID NO: 2298761 - RNA, 14 nt, Yersinia pestis KIM
uaaaacagcucacu

SEQ ID NO: 2298762 - RNA, 18 nt, Yersinia pestis KIM
uaaaacgaguaaauacaa

SEQ ID NO: 2298763 - RNA, 21 nt, Yersinia pestis KIM
uaaaacgaguaaauacaaaua

SEQ ID NO: 2298764 - RNA, 19 nt, Yersinia pestis KIM
uaaaaccuuuacaauuaca

SEQ ID NO: 2298765 - RNA, 14 nt, Yersinia pestis KIM
uaaaagaaagggca

SEQ ID NO: 2298766 - RNA, 22 nt, Yersinia pestis KIM
guuuuacgcgaccauucauccc

SEQ ID NO: 2298767 - RNA, 20 nt, Yersinia pestis KIM
guuuuaacguacccucccag

SEQ ID NO: 2298768 - RNA, 14 nt, Yersinia pestis KIM
guuuuaauaaccau

SEQ ID NO: 2298769 - RNA, 18 nt, Yersinia pestis KIM
guuuuauucaagugcuca

SEQ ID NO: 2298770 - RNA, 17 nt, Yersinia pestis KIM
guuuuauugcaacuggg

SEQ ID NO: 2298771 - RNA, 20 nt, Yersinia pestis KIM
guuuuauugaugauuugacc

SEQ ID NO: 2298772 - RNA, 18 nt, Yersinia pestis KIM
guuuuaucaauaggucag

SEQ ID NO: 2298773 - RNA, 15 nt, Yersinia pestis KIM
guuuucuauuuccac

SEQ ID NO: 2298774 - RNA, 21 nt, Yersinia pestis KIM
guuuucccugcgccagcagca

SEQ ID NO: 2298775 - RNA, 16 nt, Yersinia pestis KIM
guuuucaaauccaguc

SEQ ID NO: 2298776 - RNA, 19 nt, Yersinia pestis KIM
guuuucacccaaccgggau

SEQ ID NO: 2298777 - RNA, 17 nt, Yersinia pestis KIM
guuuuaaaaaaaaagaa

SEQ ID NO: 2298778 - RNA, 22 nt, Yersinia pestis KIM
guuuguaccuguucaaucaccc

SEQ ID NO: 2298779 - RNA, 22 nt, Yersinia pestis KIM
guuuguaaccgacuugcccaau

SEQ ID NO: 2298780 - RNA, 14 nt, Yersinia pestis KIM
guuuguaaauuuua

SEQ ID NO: 2298781 - RNA, 12 nt, Yersinia pestis KIM
guuuggugguuu

SEQ ID NO: 2298782 - RNA, 18 nt, Yersinia pestis KIM
guuugcgccguaaacugc

SEQ ID NO: 2298783 - RNA, 21 nt, Yersinia pestis KIM
guuucuggaaugagaugaaca

SEQ ID NO: 2298784 - RNA, 14 nt, Yersinia pestis KIM
guuucugucuuacu

SEQ ID NO: 2298785 - RNA, 14 nt, Yersinia pestis KIM
guuucuucuggaau

SEQ ID NO: 2298786 - RNA, 15 nt, Yersinia pestis KIM
guuucuguuuugugc

SEQ ID NO: 2298787 - RNA, 18 nt, Yersinia pestis KIM
guuucaacauccaguucg

SEQ ID NO: 2298788 - RNA, 17 nt, Yersinia pestis KIM
guuucaacaucgcaccg

SEQ ID NO: 2298789 - RNA, 17 nt, Yersinia pestis KIM
guuucaaauaaguacuu

SEQ ID NO: 2298790 - RNA, 12 nt, Yersinia pestis KIM
guuuauuauuca

SEQ ID NO: 2298791 - RNA, 13 nt, Yersinia pestis KIM
guuucaccaaaca

SEQ ID NO: 2298792 - RNA, 17 nt, Yersinia pestis KIM
guuucagcuugcaacaa

SEQ ID NO: 2298793 - RNA, 16 nt, Yersinia pestis KIM
guuucguuuacugccu

SEQ ID NO: 2298794 - RNA, 19 nt, Yersinia pestis KIM
guuuccacgaaggcaccca

SEQ ID NO: 2298795 - RNA, 19 nt, Yersinia pestis KIM
guuuccacucggccagagc

SEQ ID NO: 2298796 - RNA, 17 nt, Yersinia pestis KIM
guuguuauuucuguucc

SEQ ID NO: 2298797 - RNA, 18 nt, Yersinia pestis KIM
guuguucaacgccauagc

SEQ ID NO: 2298798 - RNA, 20 nt, Yersinia pestis KIM
guuuaacucaaauaaaccaa

SEQ ID NO: 2298799 - RNA, 14 nt, Yersinia pestis KIM
guuuaacucaaaua

SEQ ID NO: 2298800 - RNA, 14 nt, Yersinia pestis KIM
guugugccaguaga

SEQ ID NO: 2298801 - RNA, 20 nt, Yersinia pestis KIM
guuuacugaucucaucaaac

SEQ ID NO: 2298802 - RNA, 20 nt, Yersinia pestis KIM
guuuacuggcgggcauuuuc

SEQ ID NO: 2298803 - RNA, 15 nt, Yersinia pestis KIM
guuuaauuucacuuc

SEQ ID NO: 2298804 - RNA, 20 nt, Yersinia pestis KIM
guuuacgcacguugagugau

SEQ ID NO: 2298805 - RNA, 22 nt, Yersinia pestis KIM
guucuggaucggcauacuccau

SEQ ID NO: 2298806 - RNA, 11 nt, Yersinia pestis KIM
guucuggcagg

SEQ ID NO: 2298807 - RNA, 13 nt, Yersinia pestis KIM
guucugcugccag

SEQ ID NO: 2298808 - RNA, 20 nt, Yersinia pestis KIM
guucuuauugcuaucuguua

SEQ ID NO: 2298809 - RNA, 19 nt, Yersinia pestis KIM
guucugguagcugcucacg

SEQ ID NO: 2298810 - RNA, 20 nt, Yersinia pestis KIM
guugucaugcuguagcagcc

SEQ ID NO: 2298811 - RNA, 14 nt, Yersinia pestis KIM
ucaaaauaaaaauu

SEQ ID NO: 2298812 - RNA, 14 nt, Yersinia pestis KIM
ucaaaacuauuuau

SEQ ID NO: 2298813 - RNA, 20 nt, Yersinia pestis KIM
ucaaaagcagagaaugagua

SEQ ID NO: 2298814 - RNA, 16 nt, Yersinia pestis KIM
ucaaaacggcaauuaa

SEQ ID NO: 2298815 - RNA, 14 nt, Yersinia pestis KIM
ucaaaacaaucacu

SEQ ID NO: 2298816 - RNA, 12 nt, Yersinia pestis KIM
ucaaaacaauau

SEQ ID NO: 2298817 - RNA, 16 nt, Yersinia pestis KIM
ucaaaacaaucacuga

SEQ ID NO: 2298818 - RNA, 18 nt, Yersinia pestis KIM
uauuuuugcauauaaaac

SEQ ID NO: 2298819 - RNA, 21 nt, Yersinia pestis KIM
uauuuuuggucguuuaaauaa

SEQ ID NO: 2298820 - RNA, 14 nt, Yersinia pestis KIM
uauuuuuuaugacu

SEQ ID NO: 2298821 - RNA, 13 nt, Yersinia pestis KIM
uauuuuuauuaau

SEQ ID NO: 2298822 - RNA, 19 nt, Yersinia pestis KIM
uauuuuuauuaauauauuu

SEQ ID NO: 2298823 - RNA, 18 nt, Yersinia pestis KIM
uauuuuguuuguaaauuu

SEQ ID NO: 2298824 - RNA, 14 nt, Yersinia pestis KIM
uauuuucauuauuu

SEQ ID NO: 2298825 - RNA, 16 nt, Yersinia pestis KIM
uauuuuauuuaaaauu

SEQ ID NO: 2298826 - RNA, 20 nt, Yersinia pestis KIM
uauuuucuacugaauaaaca

SEQ ID NO: 2298827 - RNA, 22 nt, Yersinia pestis KIM
uauuuuccgggucaaacucagc

SEQ ID NO: 2298828 - RNA, 21 nt, Yersinia pestis KIM
uauuuugaaccguaugcuuuc

SEQ ID NO: 2298829 - RNA, 19 nt, Yersinia pestis KIM
uauuuugaauauuuuuaau

SEQ ID NO: 2298830 - RNA, 22 nt, Yersinia pestis KIM
uauuuugaauacggcggugagu

SEQ ID NO: 2298831 - RNA, 16 nt, Yersinia pestis KIM
ucaaacuggcccagcu

SEQ ID NO: 2298832 - RNA, 16 nt, Yersinia pestis KIM
ucaaagaccacaucaa

SEQ ID NO: 2298833 - RNA, 13 nt, Yersinia pestis KIM
ucaaagauuucau

SEQ ID NO: 2298834 - RNA, 20 nt, Yersinia pestis KIM
ucaaauaaguguuucaaaua

SEQ ID NO: 2298835 - RNA, 17 nt, Yersinia pestis KIM
ucaaauaaguguuucaa

SEQ ID NO: 2298836 - RNA, 17 nt, Yersinia pestis KIM
ucaaaaucugauacuga

SEQ ID NO: 2298837 - RNA, 15 nt, Yersinia pestis KIM
ucaaaaucuucggca

SEQ ID NO: 2298838 - RNA, 18 nt, Yersinia pestis KIM
ucaaaauagaggaaauaa

SEQ ID NO: 2298839 - RNA, 13 nt, Yersinia pestis KIM
ucaaaaucaaaaa

SEQ ID NO: 2298840 - RNA, 19 nt, Yersinia pestis KIM
ucaaaauuagguuuucccu

SEQ ID NO: 2298841 - RNA, 23 nt, Yersinia pestis KIM
ucaaacaaaucuuaaauugaaga

SEQ ID NO: 2298842 - RNA, 21 nt, Yersinia pestis KIM
ucaaaccgccagccacgcaga

SEQ ID NO: 2298843 - RNA, 17 nt, Yersinia pestis KIM
ucaaacagguugguaua

SEQ ID NO: 2298844 - RNA, 13 nt, Yersinia pestis KIM
ucaaacuauucau

SEQ ID NO: 2298845 - RNA, 18 nt, Yersinia pestis KIM
ucaaacgugaaauugcuu

SEQ ID NO: 2298846 - RNA, 17 nt, Yersinia pestis KIM
ucaaacucagcgaauaa

SEQ ID NO: 2298847 - RNA, 19 nt, Yersinia pestis KIM
ucaaacucagcgaauaaau

SEQ ID NO: 2298848 - RNA, 17 nt, Yersinia pestis KIM
ucaaacggcuuuuuaaa

SEQ ID NO: 2298849 - RNA, 18 nt, Yersinia pestis KIM
ucaaacgggugauguuua

SEQ ID NO: 2298850 - RNA, 14 nt, Yersinia pestis KIM
ucaaccaguugaug

SEQ ID NO: 2298851 - RNA, 22 nt, Yersinia pestis KIM
ucaaccaauuauccaucccuau

SEQ ID NO: 2298852 - RNA, 11 nt, Yersinia pestis KIM
ucaacaugacg

SEQ ID NO: 2298853 - RNA, 19 nt, Yersinia pestis KIM
ucaacacugccugaugcua

SEQ ID NO: 2298854 - RNA, 12 nt, Yersinia pestis KIM
ucaacagaacua

SEQ ID NO: 2298855 - RNA, 23 nt, Yersinia pestis KIM
ucaacaauuucgcuggucuuaau

SEQ ID NO: 2298856 - RNA, 12 nt, Yersinia pestis KIM
ucaacaagaaau

SEQ ID NO: 2298857 - RNA, 18 nt, Yersinia pestis KIM
ucaaaugagucguaaaau

SEQ ID NO: 2298858 - RNA, 17 nt, Yersinia pestis KIM
ucaaauaucauuauuuu

SEQ ID NO: 2298859 - RNA, 16 nt, Yersinia pestis KIM
ucaaaucaguuccuga

SEQ ID NO: 2298860 - RNA, 16 nt, Yersinia pestis KIM
ucaaaucgccaaacug

SEQ ID NO: 2298861 - RNA, 20 nt, Yersinia pestis KIM
ucaaaucgccaaacugcuca

SEQ ID NO: 2298862 - RNA, 17 nt, Yersinia pestis KIM
ucaaccugaucaucaaa

SEQ ID NO: 2298863 - RNA, 14 nt, Yersinia pestis KIM
ucaacgacggauga

SEQ ID NO: 2298864 - RNA, 15 nt, Yersinia pestis KIM
ucaacgacagcagca

SEQ ID NO: 2298865 - RNA, 21 nt, Yersinia pestis KIM
ucaacgacagcagcaggccau

SEQ ID NO: 2298866 - RNA, 16 nt, Yersinia pestis KIM
ucaaccucuuguaaac

SEQ ID NO: 2298867 - RNA, 13 nt, Yersinia pestis KIM
ucaaccucagccu

SEQ ID NO: 2298868 - RNA, 20 nt, Yersinia pestis KIM
ucaacgcaccauccagcaaa

SEQ ID NO: 2298869 - RNA, 19 nt, Yersinia pestis KIM
ucaacgcaccccacaaccu

SEQ ID NO: 2298870 - RNA, 18 nt, Yersinia pestis KIM
ucaacgcaccauccagca

SEQ ID NO: 2298871 - RNA, 14 nt, Yersinia pestis KIM
ucaacgccaaaaua

SEQ ID NO: 2298872 - RNA, 22 nt, Yersinia pestis KIM
ucaacgcccgcggccaauagca

SEQ ID NO: 2298873 - RNA, 22 nt, Yersinia pestis KIM
ucaacgcuccgguuuucacccc

SEQ ID NO: 2298874 - RNA, 20 nt, Yersinia pestis KIM
ucaacggguaauuuacugac

SEQ ID NO: 2298875 - RNA, 19 nt, Yersinia pestis KIM
ucaacugcucaacugcuca

SEQ ID NO: 2298876 - RNA, 16 nt, Yersinia pestis KIM
ucaacucaaaacaauu

SEQ ID NO: 2298877 - RNA, 18 nt, Yersinia pestis KIM
ucaacuauugcaucuuua

SEQ ID NO: 2298878 - RNA, 21 nt, Yersinia pestis KIM
ucaacuauugcaucuuuaauu

SEQ ID NO: 2298879 - RNA, 14 nt, Yersinia pestis KIM
ucaacucaaaacaa

SEQ ID NO: 2298880 - RNA, 19 nt, Yersinia pestis KIM
ucaagcagcuuuucacgag

SEQ ID NO: 2298881 - RNA, 13 nt, Yersinia pestis KIM
ucaagcaauaauu

SEQ ID NO: 2298882 - RNA, 21 nt, Yersinia pestis KIM
ucaagcauugucauggccuga

SEQ ID NO: 2298883 - RNA, 16 nt, Yersinia pestis KIM
ucaagccaacccccau

SEQ ID NO: 2298884 - RNA, 18 nt, Yersinia pestis KIM
ucaagccgauaaucccug

SEQ ID NO: 2298885 - RNA, 15 nt, Yersinia pestis KIM
ucaagccguguaaau

SEQ ID NO: 2298886 - RNA, 17 nt, Yersinia pestis KIM
ucaagccgauaaucccu

SEQ ID NO: 2298887 - RNA, 15 nt, Yersinia pestis KIM
ucaagaugcagggcg

SEQ ID NO: 2298888 - RNA, 18 nt, Yersinia pestis KIM
ucaagaucaaaagcagag

SEQ ID NO: 2298889 - RNA, 19 nt, Yersinia pestis KIM
ucaagaucaaaagcagaga

SEQ ID NO: 2298890 - RNA, 18 nt, Yersinia pestis KIM
ucaagauggucauaaaua

SEQ ID NO: 2298891 - RNA, 16 nt, Yersinia pestis KIM
ucaagaucaaaagcag

SEQ ID NO: 2298892 - RNA, 13 nt, Yersinia pestis KIM
ucaagauaaaguu

SEQ ID NO: 2298893 - RNA, 19 nt, Yersinia pestis KIM
ucaagaauugugccccaag

SEQ ID NO: 2298894 - RNA, 22 nt, Yersinia pestis KIM
ucaagaccgauuuguaagcgga

SEQ ID NO: 2298895 - RNA, 16 nt, Yersinia pestis KIM
ucaacuuuaauaugca

SEQ ID NO: 2298896 - RNA, 14 nt, Yersinia pestis KIM
ucaacuuccgcguu

SEQ ID NO: 2298897 - RNA, 14 nt, Yersinia pestis KIM
ucaacuucugcaaa

SEQ ID NO: 2298898 - RNA, 16 nt, Yersinia pestis KIM
ucaacuugccugaaau

SEQ ID NO: 2298899 - RNA, 16 nt, Yersinia pestis KIM
uauugcucugccgcag

SEQ ID NO: 2298900 - RNA, 18 nt, Yersinia pestis KIM
uauugcugugguugaucc

SEQ ID NO: 2298901 - RNA, 17 nt, Yersinia pestis KIM
uauugccgcagauaaau

SEQ ID NO: 2298902 - RNA, 21 nt, Yersinia pestis KIM
uauuggccgucagcagauaag

SEQ ID NO: 2298903 - RNA, 18 nt, Yersinia pestis KIM
uauuggucguaccaaugg

SEQ ID NO: 2298904 - RNA, 20 nt, Yersinia pestis KIM
uauuggucauuuuucccuuc

SEQ ID NO: 2298905 - RNA, 22 nt, Yersinia pestis KIM
uauuggaaaaaucaguauuaua

SEQ ID NO: 2298906 - RNA, 12 nt, Yersinia pestis KIM
uauugcuuuuau

SEQ ID NO: 2298907 - RNA, 17 nt, Yersinia pestis KIM
uauuggccgucagcaga

SEQ ID NO: 2298908 - RNA, 16 nt, Yersinia pestis KIM
uauuggccaguugcca

SEQ ID NO: 2298909 - RNA, 15 nt, Yersinia pestis KIM
uauugggcugccugu

SEQ ID NO: 2298910 - RNA, 18 nt, Yersinia pestis KIM
uauugggcugccugugcg

SEQ ID NO: 2298911 - RNA, 17 nt, Yersinia pestis KIM
uauuggggacaggcucc

SEQ ID NO: 2298912 - RNA, 22 nt, Yersinia pestis KIM
uauuggggacaggcuccuccuu

SEQ ID NO: 2298913 - RNA, 16 nt, Yersinia pestis KIM
uauugcaucuuuaauu

SEQ ID NO: 2298914 - RNA, 19 nt, Yersinia pestis KIM
uauugauuaauuuuucaua

SEQ ID NO: 2298915 - RNA, 18 nt, Yersinia pestis KIM
uauugauuacaaaauaua

SEQ ID NO: 2298916 - RNA, 22 nt, Yersinia pestis KIM
uauugauuaagcggcaauaaca

SEQ ID NO: 2298917 - RNA, 19 nt, Yersinia pestis KIM
uauugauagccacaucauu

SEQ ID NO: 2298918 - RNA, 14 nt, Yersinia pestis KIM
uauugauagccaca

SEQ ID NO: 2298919 - RNA, 20 nt, Yersinia pestis KIM
uauugauaaaaccgcuuauc

SEQ ID NO: 2298920 - RNA, 13 nt, Yersinia pestis KIM
uauugauagccac

SEQ ID NO: 2298921 - RNA, 22 nt, Yersinia pestis KIM
uauugagcauauucaguaacaa

SEQ ID NO: 2298922 - RNA, 16 nt, Yersinia pestis KIM
uauugauaaaaccgcu

SEQ ID NO: 2298923 - RNA, 22 nt, Yersinia pestis KIM
uauugagcguuauaacaaccuc

SEQ ID NO: 2298924 - RNA, 16 nt, Yersinia pestis KIM
uauugaggacaauuca

SEQ ID NO: 2298925 - RNA, 15 nt, Yersinia pestis KIM
uauugaucacaguaa

SEQ ID NO: 2298926 - RNA, 16 nt, Yersinia pestis KIM
uauugaucuuuaauau

SEQ ID NO: 2298927 - RNA, 21 nt, Yersinia pestis KIM
uauugaucuuuaauauugcau

SEQ ID NO: 2298928 - RNA, 20 nt, Yersinia pestis KIM
uauugauauagcgguaaccg

SEQ ID NO: 2298929 - RNA, 16 nt, Yersinia pestis KIM
uauugauaaaaccacu

SEQ ID NO: 2298930 - RNA, 15 nt, Yersinia pestis KIM
uauugagaagaaauc

SEQ ID NO: 2298931 - RNA, 21 nt, Yersinia pestis KIM
uauuuacaagccaacauugau

SEQ ID NO: 2298932 - RNA, 21 nt, Yersinia pestis KIM
uauuuaagcugaaauuuuuua

SEQ ID NO: 2298933 - RNA, 12 nt, Yersinia pestis KIM
uauuuaacuguu

SEQ ID NO: 2298934 - RNA, 22 nt, Yersinia pestis KIM
uauuuaagcaguucacucuguu

SEQ ID NO: 2298935 - RNA, 16 nt, Yersinia pestis KIM
uauuuauaaaaccacu

SEQ ID NO: 2298936 - RNA, 17 nt, Yersinia pestis KIM
uauuuauaaaaaaugga

SEQ ID NO: 2298937 - RNA, 15 nt, Yersinia pestis KIM
uauuuauaaaaccac

SEQ ID NO: 2298938 - RNA, 20 nt, Yersinia pestis KIM
uauuuagguaguuuuauuca

SEQ ID NO: 2298939 - RNA, 14 nt, Yersinia pestis KIM
uauuuaggcuacag

SEQ ID NO: 2298940 - RNA, 15 nt, Yersinia pestis KIM
uauuuaccugcucaa

SEQ ID NO: 2298941 - RNA, 12 nt, Yersinia pestis KIM
uauuuacgguga

SEQ ID NO: 2298942 - RNA, 17 nt, Yersinia pestis KIM
uauuuacggcgucuuua

SEQ ID NO: 2298943 - RNA, 20 nt, Yersinia pestis KIM
uauuuacucaucuauuagau

SEQ ID NO: 2298944 - RNA, 22 nt, Yersinia pestis KIM
uauuguggggccuuuauucauu

SEQ ID NO: 2298945 - RNA, 19 nt, Yersinia pestis KIM
uauugucuuuaauaaaauc

SEQ ID NO: 2298946 - RNA, 14 nt, Yersinia pestis KIM
uauuguggcuacca

SEQ ID NO: 2298947 - RNA, 17 nt, Yersinia pestis KIM
uauuguucaaaaacgca

SEQ ID NO: 2298948 - RNA, 17 nt, Yersinia pestis KIM
uauuguaaggucaacga

SEQ ID NO: 2298949 - RNA, 17 nt, Yersinia pestis KIM
uauuguccaaaggaagg

SEQ ID NO: 2298950 - RNA, 21 nt, Yersinia pestis KIM
uauuguuggcgauauucugau

SEQ ID NO: 2298951 - RNA, 19 nt, Yersinia pestis KIM
uauuuaaaauuaauaguuu

SEQ ID NO: 2298952 - RNA, 18 nt, Yersinia pestis KIM
uauuuaaaauuaauaguu

SEQ ID NO: 2298953 - RNA, 18 nt, Yersinia pestis KIM
uauuugcagaaaguaauc

SEQ ID NO: 2298954 - RNA, 24 nt, Yersinia pestis KIM
uauuugcagaaaguaaucuuugag

SEQ ID NO: 2298955 - RNA, 22 nt, Yersinia pestis KIM
uauuugcaguggaugauaaaua

SEQ ID NO: 2298956 - RNA, 23 nt, Yersinia pestis KIM
uauuugcaguggaugauaaauau

SEQ ID NO: 2298957 - RNA, 13 nt, Yersinia pestis KIM
uauuugcugccug

SEQ ID NO: 2298958 - RNA, 14 nt, Yersinia pestis KIM
uauuugcugccugu

SEQ ID NO: 2298959 - RNA, 19 nt, Yersinia pestis KIM
uauuugacagucauaaggu

SEQ ID NO: 2298960 - RNA, 16 nt, Yersinia pestis KIM
uauuugaaauacuuau

SEQ ID NO: 2298961 - RNA, 13 nt, Yersinia pestis KIM
uauuugaacuuca

SEQ ID NO: 2298962 - RNA, 15 nt, Yersinia pestis KIM
uauuuuaccuauuua

SEQ ID NO: 2298963 - RNA, 17 nt, Yersinia pestis KIM
uauuuuaccuauuuauu

SEQ ID NO: 2298964 - RNA, 16 nt, Yersinia pestis KIM
uauuuuacuuugaaau

SEQ ID NO: 2298965 - RNA, 18 nt, Yersinia pestis KIM
uauuugucgcauuuauuu

SEQ ID NO: 2298966 - RNA, 19 nt, Yersinia pestis KIM
uauuuggugaguaaaugcc

SEQ ID NO: 2298967 - RNA, 16 nt, Yersinia pestis KIM
uauuuggcucagcaag

SEQ ID NO: 2298968 - RNA, 19 nt, Yersinia pestis KIM
uauuucacacuguuuaguu

SEQ ID NO: 2298969 - RNA, 20 nt, Yersinia pestis KIM
uauuuauuggucaauaaaau

SEQ ID NO: 2298970 - RNA, 19 nt, Yersinia pestis KIM
uauuuauugccauuuuaau

SEQ ID NO: 2298971 - RNA, 21 nt, Yersinia pestis KIM
uauuucaaauaaguguuucaa

SEQ ID NO: 2298972 - RNA, 17 nt, Yersinia pestis KIM
uauuuaucgccaacaua

SEQ ID NO: 2298973 - RNA, 15 nt, Yersinia pestis KIM
uauuuauccuauuuu

SEQ ID NO: 2298974 - RNA, 14 nt, Yersinia pestis KIM
uauuuauuaaucua

SEQ ID NO: 2298975 - RNA, 16 nt, Yersinia pestis KIM
uauuucagauuuauuu

SEQ ID NO: 2298976 - RNA, 20 nt, Yersinia pestis KIM
uauuucacgcuaauuauuuu

SEQ ID NO: 2298977 - RNA, 22 nt, Yersinia pestis KIM
uauuucacgcuaauuauuuuau

SEQ ID NO: 2298978 - RNA, 14 nt, Yersinia pestis KIM
uauuucacuguuau

SEQ ID NO: 2298979 - RNA, 14 nt, Yersinia pestis KIM
uauuucauuagauc

SEQ ID NO: 2298980 - RNA, 13 nt, Yersinia pestis KIM
uauuaggccgcga

SEQ ID NO: 2298981 - RNA, 21 nt, Yersinia pestis KIM
uauuagccgccagucauucac

SEQ ID NO: 2298982 - RNA, 22 nt, Yersinia pestis KIM
uauuagcgauagccugaugaga

SEQ ID NO: 2298983 - RNA, 14 nt, Yersinia pestis KIM
uauuagccaaauac

SEQ ID NO: 2298984 - RNA, 15 nt, Yersinia pestis KIM
uauuacugucacugu

SEQ ID NO: 2298985 - RNA, 16 nt, Yersinia pestis KIM
uauuacugucauugcu

SEQ ID NO: 2298986 - RNA, 13 nt, Yersinia pestis KIM
uauuacuucuuuu

SEQ ID NO: 2298987 - RNA, 16 nt, Yersinia pestis KIM
uauuagggcugacaga

SEQ ID NO: 2298988 - RNA, 16 nt, Yersinia pestis KIM
uauuagugacagccac

SEQ ID NO: 2298989 - RNA, 20 nt, Yersinia pestis KIM
uauuaguuaacccuauuuuu

SEQ ID NO: 2298990 - RNA, 19 nt, Yersinia pestis KIM
uauuauaaugaaauaguaa

SEQ ID NO: 2298991 - RNA, 12 nt, Yersinia pestis KIM
uauuauaaauuu

SEQ ID NO: 2298992 - RNA, 14 nt, Yersinia pestis KIM
uauuauguauuuuu

SEQ ID NO: 2298993 - RNA, 16 nt, Yersinia pestis KIM
uauuauguaaauaguu

SEQ ID NO: 2298994 - RNA, 24 nt, Yersinia pestis KIM
uauuauguaaauaguuacuauaua

SEQ ID NO: 2298995 - RNA, 16 nt, Yersinia pestis KIM
uauuauuaaauuuuau

SEQ ID NO: 2298996 - RNA, 13 nt, Yersinia pestis KIM
uauuauuacuaga

SEQ ID NO: 2298997 - RNA, 14 nt, Yersinia pestis KIM
uauuauuauuuaua

SEQ ID NO: 2298998 - RNA, 15 nt, Yersinia pestis KIM
uauuauucucaaccg

SEQ ID NO: 2298999 - RNA, 19 nt, Yersinia pestis KIM
uauuaucccaguuuuuaau

SEQ ID NO: 2299000 - RNA, 13 nt, Yersinia pestis KIM
uauuaucauucaa

SEQ ID NO: 2299001 - RNA, 14 nt, Yersinia pestis KIM
uauuaucaucuuuc

SEQ ID NO: 2299002 - RNA, 15 nt, Yersinia pestis KIM
uauuauauucaauug

SEQ ID NO: 2299003 - RNA, 15 nt, Yersinia pestis KIM
uauuaucuuuuaaaa

SEQ ID NO: 2299004 - RNA, 19 nt, Yersinia pestis KIM
uauuacgcagccauaccca

SEQ ID NO: 2299005 - RNA, 19 nt, Yersinia pestis KIM
uauuacaccuuaaaacagc

SEQ ID NO: 2299006 - RNA, 23 nt, Yersinia pestis KIM
uauuaauggugaacaaagagcau

SEQ ID NO: 2299007 - RNA, 17 nt, Yersinia pestis KIM
uauuaaucuauuaauau

SEQ ID NO: 2299008 - RNA, 18 nt, Yersinia pestis KIM
uauuaaaugcauuauaag

SEQ ID NO: 2299009 - RNA, 22 nt, Yersinia pestis KIM
uauuaaacgggccgcgcagauu

SEQ ID NO: 2299010 - RNA, 20 nt, Yersinia pestis KIM
uauuaaacagauucaauauu

SEQ ID NO: 2299011 - RNA, 21 nt, Yersinia pestis KIM
uauuaaacagauucaauauuu

SEQ ID NO: 2299012 - RNA, 22 nt, Yersinia pestis KIM
uauuaaacagauucaauauuua

SEQ ID NO: 2299013 - RNA, 17 nt, Yersinia pestis KIM
uauuaaucaacagauau

SEQ ID NO: 2299014 - RNA, 13 nt, Yersinia pestis KIM
uauuaacugcagu

SEQ ID NO: 2299015 - RNA, 16 nt, Yersinia pestis KIM
uauuaacugcagugaa

SEQ ID NO: 2299016 - RNA, 18 nt, Yersinia pestis KIM
uauuaacugcagugaaaa

SEQ ID NO: 2299017 - RNA, 15 nt, Yersinia pestis KIM
uauucgcgcuuuaac

SEQ ID NO: 2299018 - RNA, 17 nt, Yersinia pestis KIM
uauucgcggccugcugu

SEQ ID NO: 2299019 - RNA, 15 nt, Yersinia pestis KIM
uauucgcguuucauu

SEQ ID NO: 2299020 - RNA, 21 nt, Yersinia pestis KIM
uauucgccagauugccaauca

SEQ ID NO: 2299021 - RNA, 23 nt, Yersinia pestis KIM
uauucgccccguucacacgauuc

SEQ ID NO: 2299022 - RNA, 23 nt, Yersinia pestis KIM
uauucgggcaacuaauucuuagg

SEQ ID NO: 2299023 - RNA, 22 nt, Yersinia pestis KIM
uauucuaauugauauuauuuau

SEQ ID NO: 2299024 - RNA, 20 nt, Yersinia pestis KIM
uauucuaauugauauuauuu

SEQ ID NO: 2299025 - RNA, 15 nt, Yersinia pestis KIM
uauucuauugaggac

SEQ ID NO: 2299026 - RNA, 18 nt, Yersinia pestis KIM
uauucuacaaugucacgc

SEQ ID NO: 2299027 - RNA, 15 nt, Yersinia pestis KIM
uauucugauaccugc

SEQ ID NO: 2299028 - RNA, 16 nt, Yersinia pestis KIM
uauucuccaacaacug

SEQ ID NO: 2299029 - RNA, 21 nt, Yersinia pestis KIM
uauucucgccccgugcuacuc

SEQ ID NO: 2299030 - RNA, 15 nt, Yersinia pestis KIM
uauugacaaagugcc

SEQ ID NO: 2299031 - RNA, 16 nt, Yersinia pestis KIM
uauugaauuaaauuuu

SEQ ID NO: 2299032 - RNA, 20 nt, Yersinia pestis KIM
uauugaauuaaauuuuauau

SEQ ID NO: 2299033 - RNA, 15 nt, Yersinia pestis KIM
uauugaacgcuugca

SEQ ID NO: 2299034 - RNA, 19 nt, Yersinia pestis KIM
uauugaacgcuugcaacaa

SEQ ID NO: 2299035 - RNA, 13 nt, Yersinia pestis KIM
uauugaacauuca

SEQ ID NO: 2299036 - RNA, 16 nt, Yersinia pestis KIM
uauucuuaucaaucaa

SEQ ID NO: 2299037 - RNA, 15 nt, Yersinia pestis KIM
uauucuuagccagug

SEQ ID NO: 2299038 - RNA, 22 nt, Yersinia pestis KIM
uauucugcuuccaggauauuca

SEQ ID NO: 2299039 - RNA, 18 nt, Yersinia pestis KIM
uauucuggcggcuuuaau

SEQ ID NO: 2299040 - RNA, 13 nt, Yersinia pestis KIM
uauucaagugcuc

SEQ ID NO: 2299041 - RNA, 16 nt, Yersinia pestis KIM
uauucaauacuggcca

SEQ ID NO: 2299042 - RNA, 20 nt, Yersinia pestis KIM
uauucaacauuuaagugcua

SEQ ID NO: 2299043 - RNA, 13 nt, Yersinia pestis KIM
uauucaagagauu

SEQ ID NO: 2299044 - RNA, 18 nt, Yersinia pestis KIM
uauucaaacggugugcaa

SEQ ID NO: 2299045 - RNA, 21 nt, Yersinia pestis KIM
uauucacagcagaacaaaaca

SEQ ID NO: 2299046 - RNA, 16 nt, Yersinia pestis KIM
uauucacguuuuucca

SEQ ID NO: 2299047 - RNA, 17 nt, Yersinia pestis KIM
uauucacguuuuuccau

SEQ ID NO: 2299048 - RNA, 18 nt, Yersinia pestis KIM
uauucacuauuuauuaau

SEQ ID NO: 2299049 - RNA, 11 nt, Yersinia pestis KIM
uauucagcaag

SEQ ID NO: 2299050 - RNA, 12 nt, Yersinia pestis KIM
uauucagcaagc

SEQ ID NO: 2299051 - RNA, 17 nt, Yersinia pestis KIM
uauucagcagcauuucu

SEQ ID NO: 2299052 - RNA, 20 nt, Yersinia pestis KIM
uauucagccgccagccauua

SEQ ID NO: 2299053 - RNA, 19 nt, Yersinia pestis KIM
uauuccggggguggcugcc

SEQ ID NO: 2299054 - RNA, 17 nt, Yersinia pestis KIM
uauuccgcaccuuuguc

SEQ ID NO: 2299055 - RNA, 20 nt, Yersinia pestis KIM
uauucauauugaauuaaauu

SEQ ID NO: 2299056 - RNA, 20 nt, Yersinia pestis KIM
uauucauuaaaaaauaauuu

SEQ ID NO: 2299057 - RNA, 11 nt, Yersinia pestis KIM
uauucauuaga

SEQ ID NO: 2299058 - RNA, 12 nt, Yersinia pestis KIM
uauucauucuua

SEQ ID NO: 2299059 - RNA, 15 nt, Yersinia pestis KIM
ucaccauuauguuca

SEQ ID NO: 2299060 - RNA, 20 nt, Yersinia pestis KIM
ucaccauguacauggccgug

SEQ ID NO: 2299061 - RNA, 20 nt, Yersinia pestis KIM
ucaccaucgccuuuagcuuu

SEQ ID NO: 2299062 - RNA, 14 nt, Yersinia pestis KIM
ucaccauugaccag

SEQ ID NO: 2299063 - RNA, 14 nt, Yersinia pestis KIM
ucaccauuuauugc

SEQ ID NO: 2299064 - RNA, 15 nt, Yersinia pestis KIM
ucaccauuuauugcc

SEQ ID NO: 2299065 - RNA, 18 nt, Yersinia pestis KIM
ucacccaauaagauaaac

SEQ ID NO: 2299066 - RNA, 12 nt, Yersinia pestis KIM
ucacccagcaaa

SEQ ID NO: 2299067 - RNA, 15 nt, Yersinia pestis KIM
ucacccauuuuaucc

SEQ ID NO: 2299068 - RNA, 14 nt, Yersinia pestis KIM
ucacccauuuuauc

SEQ ID NO: 2299069 - RNA, 21 nt, Yersinia pestis KIM
ucaccacgauuagccauaaga

SEQ ID NO: 2299070 - RNA, 24 nt, Yersinia pestis KIM
ucaccaccauuaacaagcgaccau

SEQ ID NO: 2299071 - RNA, 12 nt, Yersinia pestis KIM
ucaccaccauua

SEQ ID NO: 2299072 - RNA, 18 nt, Yersinia pestis KIM
ucaccaccgcauuuucaa

SEQ ID NO: 2299073 - RNA, 14 nt, Yersinia pestis KIM
ucaccagacaacca

SEQ ID NO: 2299074 - RNA, 16 nt, Yersinia pestis KIM
ucaccacuuuccaggu

SEQ ID NO: 2299075 - RNA, 22 nt, Yersinia pestis KIM
ucaccacggcuuucaauaaaac

SEQ ID NO: 2299076 - RNA, 14 nt, Yersinia pestis KIM
ucaccauaacugcu

SEQ ID NO: 2299077 - RNA, 17 nt, Yersinia pestis KIM
ucacccgauacaggcuc

SEQ ID NO: 2299078 - RNA, 15 nt, Yersinia pestis KIM
ucacccccacaucag

SEQ ID NO: 2299079 - RNA, 15 nt, Yersinia pestis KIM
ucacccugcguacaa

SEQ ID NO: 2299080 - RNA, 22 nt, Yersinia pestis KIM
ucacccuuuugaauucaccaaa

SEQ ID NO: 2299081 - RNA, 18 nt, Yersinia pestis KIM
ucaccgccuuucauucug

SEQ ID NO: 2299082 - RNA, 16 nt, Yersinia pestis KIM
ucaccgcuuuucuggu

SEQ ID NO: 2299083 - RNA, 12 nt, Yersinia pestis KIM
ucaccgcgggcu

SEQ ID NO: 2299084 - RNA, 18 nt, Yersinia pestis KIM
ucaccguaaccauuggca

SEQ ID NO: 2299085 - RNA, 16 nt, Yersinia pestis KIM
ucaccgguaugcagua

SEQ ID NO: 2299086 - RNA, 24 nt, Yersinia pestis KIM
ucaccguagaacgucaccgccaaa

SEQ ID NO: 2299087 - RNA, 18 nt, Yersinia pestis KIM
ucaccguucaagaucgcg

SEQ ID NO: 2299088 - RNA, 17 nt, Yersinia pestis KIM
ucaccacaauauggggu

SEQ ID NO: 2299089 - RNA, 20 nt, Yersinia pestis KIM
ucaccaauauguucaucagg

SEQ ID NO: 2299090 - RNA, 18 nt, Yersinia pestis KIM
ucaccaagaggaaaugcc

SEQ ID NO: 2299091 - RNA, 15 nt, Yersinia pestis KIM
ucaccaacaccacca

SEQ ID NO: 2299092 - RNA, 17 nt, Yersinia pestis KIM
ucaccaacaccaccauc

SEQ ID NO: 2299093 - RNA, 16 nt, Yersinia pestis KIM
ucaccaaagcaacagc

SEQ ID NO: 2299094 - RNA, 15 nt, Yersinia pestis KIM
ucaccaaaggaagcc

SEQ ID NO: 2299095 - RNA, 14 nt, Yersinia pestis KIM
ucaccaaaauccca

SEQ ID NO: 2299096 - RNA, 19 nt, Yersinia pestis KIM
ucaccaaaaucccaaaaua

SEQ ID NO: 2299097 - RNA, 20 nt, Yersinia pestis KIM
ucacauuuuuaauaaugugu

SEQ ID NO: 2299098 - RNA, 23 nt, Yersinia pestis KIM
ucaccaaaaaaaccaccaaaaua

SEQ ID NO: 2299099 - RNA, 24 nt, Yersinia pestis KIM
ucacaugcggauugaacugcgcua

SEQ ID NO: 2299100 - RNA, 20 nt, Yersinia pestis KIM
ucacauuaacuucagguuca

SEQ ID NO: 2299101 - RNA, 21 nt, Yersinia pestis KIM
ucacaucacagugccaaaaga

SEQ ID NO: 2299102 - RNA, 15 nt, Yersinia pestis KIM
ucacaugacugaaca

SEQ ID NO: 2299103 - RNA, 21 nt, Yersinia pestis KIM
ucacaucugggucauguggaa

SEQ ID NO: 2299104 - RNA, 14 nt, Yersinia pestis KIM
ucacauaauauuua

SEQ ID NO: 2299105 - RNA, 21 nt, Yersinia pestis KIM
ucacaaucucuggcaacggca

SEQ ID NO: 2299106 - RNA, 16 nt, Yersinia pestis KIM
ucacaaucucuggcaa

SEQ ID NO: 2299107 - RNA, 22 nt, Yersinia pestis KIM
ucacacacuaauaauaauuaau

SEQ ID NO: 2299108 - RNA, 17 nt, Yersinia pestis KIM
ucacacagccagccuua

SEQ ID NO: 2299109 - RNA, 20 nt, Yersinia pestis KIM
ucacaacuuuuauuggcauu

SEQ ID NO: 2299110 - RNA, 18 nt, Yersinia pestis KIM
ucacaauacagcaaauag

SEQ ID NO: 2299111 - RNA, 21 nt, Yersinia pestis KIM
ucacaauacagcaaauagguu

SEQ ID NO: 2299112 - RNA, 22 nt, Yersinia pestis KIM
ucacaauacagcaaauagguuu

SEQ ID NO: 2299113 - RNA, 15 nt, Yersinia pestis KIM
ucacaacagugcaac

SEQ ID NO: 2299114 - RNA, 15 nt, Yersinia pestis KIM
ucacaacuuuuauug

SEQ ID NO: 2299115 - RNA, 22 nt, Yersinia pestis KIM
ucacaacuuucccagucauaaa

SEQ ID NO: 2299116 - RNA, 16 nt, Yersinia pestis KIM
ucacacgcccaggcca

SEQ ID NO: 2299117 - RNA, 17 nt, Yersinia pestis KIM
ucacacuguuuaguuca

SEQ ID NO: 2299118 - RNA, 21 nt, Yersinia pestis KIM
ucacacuggcggacaucuuac

SEQ ID NO: 2299119 - RNA, 14 nt, Yersinia pestis KIM
ucacagcauucaga

SEQ ID NO: 2299120 - RNA, 18 nt, Yersinia pestis KIM
ucacagcagaacaaaaca

SEQ ID NO: 2299121 - RNA, 22 nt, Yersinia pestis KIM
ucacaggcuucgacaggcaauu

SEQ ID NO: 2299122 - RNA, 21 nt, Yersinia pestis KIM
ucaauugugcaaaaucagcau

SEQ ID NO: 2299123 - RNA, 22 nt, Yersinia pestis KIM
ucaauuggacuaaccccaauau

SEQ ID NO: 2299124 - RNA, 21 nt, Yersinia pestis KIM
ucaauuggcagcggcaaauag

SEQ ID NO: 2299125 - RNA, 19 nt, Yersinia pestis KIM
ucaauuggcccuuuacuau

SEQ ID NO: 2299126 - RNA, 22 nt, Yersinia pestis KIM
ucaauugccgucguauagaaaa

SEQ ID NO: 2299127 - RNA, 19 nt, Yersinia pestis KIM
ucaauuccauaucggcaaa

SEQ ID NO: 2299128 - RNA, 21 nt, Yersinia pestis KIM
ucaauguuggcccaagauacu

SEQ ID NO: 2299129 - RNA, 13 nt, Yersinia pestis KIM
ucaauuuggcaug

SEQ ID NO: 2299130 - RNA, 13 nt, Yersinia pestis KIM
ucaaucucaucaa

SEQ ID NO: 2299131 - RNA, 14 nt, Yersinia pestis KIM
ucaaucucaucaau

SEQ ID NO: 2299132 - RNA, 23 nt, Yersinia pestis KIM
ucaaucuaaugacuacuaaucaa

SEQ ID NO: 2299133 - RNA, 20 nt, Yersinia pestis KIM
ucaaucuaaugguuguuaau

SEQ ID NO: 2299134 - RNA, 22 nt, Yersinia pestis KIM
ucaaucuauucuuuuuagcgga

SEQ ID NO: 2299135 - RNA, 14 nt, Yersinia pestis KIM
ucaaucggcagugc

SEQ ID NO: 2299136 - RNA, 13 nt, Yersinia pestis KIM
ucaaucgugcacc

SEQ ID NO: 2299137 - RNA, 15 nt, Yersinia pestis KIM
ucaaucgcuuucugu

SEQ ID NO: 2299138 - RNA, 17 nt, Yersinia pestis KIM
ucaaucugcaaugcgau

SEQ ID NO: 2299139 - RNA, 20 nt, Yersinia pestis KIM
ucaauccgggcaaacgccag

SEQ ID NO: 2299140 - RNA, 16 nt, Yersinia pestis KIM
ucaauccaaucauucu

SEQ ID NO: 2299141 - RNA, 15 nt, Yersinia pestis KIM
ucaaugaccacuaaa

SEQ ID NO: 2299142 - RNA, 18 nt, Yersinia pestis KIM
ucaaugagcauaccgguu

SEQ ID NO: 2299143 - RNA, 16 nt, Yersinia pestis KIM
ucaaugauaaaauccu

SEQ ID NO: 2299144 - RNA, 21 nt, Yersinia pestis KIM
ucaauggucaugcacaguugu

SEQ ID NO: 2299145 - RNA, 14 nt, Yersinia pestis KIM
ucaaugguucacua

SEQ ID NO: 2299146 - RNA, 13 nt, Yersinia pestis KIM
ucaaguucuaagg

SEQ ID NO: 2299147 - RNA, 17 nt, Yersinia pestis KIM
ucaauaaaacucacuug

SEQ ID NO: 2299148 - RNA, 20 nt, Yersinia pestis KIM
ucaauaaacauugaucaggu

SEQ ID NO: 2299149 - RNA, 22 nt, Yersinia pestis KIM
ucaauaaaaugggccugagugg

SEQ ID NO: 2299150 - RNA, 15 nt, Yersinia pestis KIM
ucaauaaagaacgcg

SEQ ID NO: 2299151 - RNA, 21 nt, Yersinia pestis KIM
ucaauaaacccacagacauuu

SEQ ID NO: 2299152 - RNA, 14 nt, Yersinia pestis KIM
ucaauaaacgcuuu

SEQ ID NO: 2299153 - RNA, 14 nt, Yersinia pestis KIM
ucaauaaauaaaaa

SEQ ID NO: 2299154 - RNA, 16 nt, Yersinia pestis KIM
ucaaggcuuuaauauc

SEQ ID NO: 2299155 - RNA, 16 nt, Yersinia pestis KIM
ucaaggcggcagagcc

SEQ ID NO: 2299156 - RNA, 16 nt, Yersinia pestis KIM
ucaaggccuucugggc

SEQ ID NO: 2299157 - RNA, 19 nt, Yersinia pestis KIM
ucaagguacccauuauucu

SEQ ID NO: 2299158 - RNA, 17 nt, Yersinia pestis KIM
ucaaggugacuauuuaa

SEQ ID NO: 2299159 - RNA, 18 nt, Yersinia pestis KIM
ucaaggugacuauuuaaa

SEQ ID NO: 2299160 - RNA, 14 nt, Yersinia pestis KIM
ucaauaauuucacu

SEQ ID NO: 2299161 - RNA, 15 nt, Yersinia pestis KIM
ucaauaauuucacua

SEQ ID NO: 2299162 - RNA, 16 nt, Yersinia pestis KIM
ucaauaccaaauuuac

SEQ ID NO: 2299163 - RNA, 18 nt, Yersinia pestis KIM
ucaauacccugccaccuu

SEQ ID NO: 2299164 - RNA, 19 nt, Yersinia pestis KIM
ucaauaccgugagaacgca

SEQ ID NO: 2299165 - RNA, 17 nt, Yersinia pestis KIM
ucaauaccuuacugcau

SEQ ID NO: 2299166 - RNA, 20 nt, Yersinia pestis KIM
ucaauaccuuacugcaucaa

SEQ ID NO: 2299167 - RNA, 21 nt, Yersinia pestis KIM
ucaauaaguagccacuuaaua

SEQ ID NO: 2299168 - RNA, 23 nt, Yersinia pestis KIM
ucaauaauauuugacagucauaa

SEQ ID NO: 2299169 - RNA, 14 nt, Yersinia pestis KIM
ucaauaauaaaauc

SEQ ID NO: 2299170 - RNA, 15 nt, Yersinia pestis KIM
ucaauaauaaaaucu

SEQ ID NO: 2299171 - RNA, 22 nt, Yersinia pestis KIM
ucaauaauaacgaauuucauuu

SEQ ID NO: 2299172 - RNA, 19 nt, Yersinia pestis KIM
ucaauaaccucagccucau

SEQ ID NO: 2299173 - RNA, 16 nt, Yersinia pestis KIM
ucaauaaccucagggc

SEQ ID NO: 2299174 - RNA, 21 nt, Yersinia pestis KIM
ucaauaaccucagggagccaa

SEQ ID NO: 2299175 - RNA, 22 nt, Yersinia pestis KIM
ucaauaaccucagggagccaau

SEQ ID NO: 2299176 - RNA, 15 nt, Yersinia pestis KIM
ucaauaacauuacca

SEQ ID NO: 2299177 - RNA, 13 nt, Yersinia pestis KIM
ucaauaacauuac

SEQ ID NO: 2299178 - RNA, 14 nt, Yersinia pestis KIM
ucaauaacaguugu

SEQ ID NO: 2299179 - RNA, 15 nt, Yersinia pestis KIM
ucaauauaagagaaa

SEQ ID NO: 2299180 - RNA, 16 nt, Yersinia pestis KIM
ucaauagugauuguuu

SEQ ID NO: 2299181 - RNA, 20 nt, Yersinia pestis KIM
ucaauaggucagugguuuua

SEQ ID NO: 2299182 - RNA, 23 nt, Yersinia pestis KIM
ucaauagcuaauaauuguucaua

SEQ ID NO: 2299183 - RNA, 22 nt, Yersinia pestis KIM
ucaauagcguuaacgauauaau

SEQ ID NO: 2299184 - RNA, 15 nt, Yersinia pestis KIM
ucaauaggauuuuca

SEQ ID NO: 2299185 - RNA, 21 nt, Yersinia pestis KIM
ucaauaggauuuucaugaucc

SEQ ID NO: 2299186 - RNA, 18 nt, Yersinia pestis KIM
ucaauaggguaauaccac

SEQ ID NO: 2299187 - RNA, 19 nt, Yersinia pestis KIM
ucaaucaccgaaucaccga

SEQ ID NO: 2299188 - RNA, 19 nt, Yersinia pestis KIM
ucaaucacgacaagucaug

SEQ ID NO: 2299189 - RNA, 22 nt, Yersinia pestis KIM
ucaaucaauugcccccaucacu

SEQ ID NO: 2299190 - RNA, 15 nt, Yersinia pestis KIM
ucaauauuaauaaug

SEQ ID NO: 2299191 - RNA, 16 nt, Yersinia pestis KIM
ucaauauuaauaaugc

SEQ ID NO: 2299192 - RNA, 16 nt, Yersinia pestis KIM
ucacugccaucucaug

SEQ ID NO: 2299193 - RNA, 14 nt, Yersinia pestis KIM
ucacuggcaccauu

SEQ ID NO: 2299194 - RNA, 20 nt, Yersinia pestis KIM
ucacugaugagcuggcaaaa

SEQ ID NO: 2299195 - RNA, 17 nt, Yersinia pestis KIM
ucacugaguugcaggaa

SEQ ID NO: 2299196 - RNA, 15 nt, Yersinia pestis KIM
ucacugaccugacgu

SEQ ID NO: 2299197 - RNA, 14 nt, Yersinia pestis KIM
ucacuggcuuuauu

SEQ ID NO: 2299198 - RNA, 15 nt, Yersinia pestis KIM
ucacuggcaccauuu

SEQ ID NO: 2299199 - RNA, 19 nt, Yersinia pestis KIM
ucacugucaaaaagcaccu

SEQ ID NO: 2299200 - RNA, 22 nt, Yersinia pestis KIM
ucacuguuggcgggauccaucu

SEQ ID NO: 2299201 - RNA, 21 nt, Yersinia pestis KIM
ucacuucugcuguucagauga

SEQ ID NO: 2299202 - RNA, 14 nt, Yersinia pestis KIM
ucacuuagaagcga

SEQ ID NO: 2299203 - RNA, 22 nt, Yersinia pestis KIM
ucacuuagaagcgauaacccac

SEQ ID NO: 2299204 - RNA, 16 nt, Yersinia pestis KIM
ucacuuauucccacuu

SEQ ID NO: 2299205 - RNA, 18 nt, Yersinia pestis KIM
ucacuuggguagcagccc

SEQ ID NO: 2299206 - RNA, 13 nt, Yersinia pestis KIM
ucacuuucuuuug

SEQ ID NO: 2299207 - RNA, 12 nt, Yersinia pestis KIM
ucacuauuucag

SEQ ID NO: 2299208 - RNA, 13 nt, Yersinia pestis KIM
ucacuauccuuug

SEQ ID NO: 2299209 - RNA, 16 nt, Yersinia pestis KIM
ucacuauccuuugaua

SEQ ID NO: 2299210 - RNA, 15 nt, Yersinia pestis KIM
ucacuauaauuauuu

SEQ ID NO: 2299211 - RNA, 18 nt, Yersinia pestis KIM
ucacuauaauuauuucuc

SEQ ID NO: 2299212 - RNA, 20 nt, Yersinia pestis KIM
ucacuauaauuauuucucug

SEQ ID NO: 2299213 - RNA, 16 nt, Yersinia pestis KIM
ucacuauaauuucucu

SEQ ID NO: 2299214 - RNA, 13 nt, Yersinia pestis KIM
ucacuagcgggcc

SEQ ID NO: 2299215 - RNA, 18 nt, Yersinia pestis KIM
ucacuagcgggccuuuua

SEQ ID NO: 2299216 - RNA, 21 nt, Yersinia pestis KIM
ucacuagcgggccuuuuaccu

SEQ ID NO: 2299217 - RNA, 14 nt, Yersinia pestis KIM
ucacuacagcauuu

SEQ ID NO: 2299218 - RNA, 16 nt, Yersinia pestis KIM
ucacucgggauaugac

SEQ ID NO: 2299219 - RNA, 21 nt, Yersinia pestis KIM
ucacuccuugaaguguuuaau

SEQ ID NO: 2299220 - RNA, 19 nt, Yersinia pestis KIM
ucacucaagccaguaacua

SEQ ID NO: 2299221 - RNA, 23 nt, Yersinia pestis KIM
ucacucaagccaguaacuacuau

SEQ ID NO: 2299222 - RNA, 16 nt, Yersinia pestis KIM
ucacucaccgccagca

SEQ ID NO: 2299223 - RNA, 13 nt, Yersinia pestis KIM
ucacguuuuucca

SEQ ID NO: 2299224 - RNA, 16 nt, Yersinia pestis KIM
ucacguuuagcccacu

SEQ ID NO: 2299225 - RNA, 21 nt, Yersinia pestis KIM
ucacuaaauccaaaugcccau

SEQ ID NO: 2299226 - RNA, 20 nt, Yersinia pestis KIM
ucacuaacauaaucaagaaa

SEQ ID NO: 2299227 - RNA, 14 nt, Yersinia pestis KIM
ucacuaaaacugaa

SEQ ID NO: 2299228 - RNA, 20 nt, Yersinia pestis KIM
ucacgucgauaguccuucgu

SEQ ID NO: 2299229 - RNA, 22 nt, Yersinia pestis KIM
ucacgucuucaccaaugauuaa

SEQ ID NO: 2299230 - RNA, 20 nt, Yersinia pestis KIM
ucacguucauccgcagcaaa

SEQ ID NO: 2299231 - RNA, 15 nt, Yersinia pestis KIM
ucacgucaguaauga

SEQ ID NO: 2299232 - RNA, 23 nt, Yersinia pestis KIM
ucacguauuuucauuuuaacaac

SEQ ID NO: 2299233 - RNA, 23 nt, Yersinia pestis KIM
ucacgcagguaguuaguggcuuu

SEQ ID NO: 2299234 - RNA, 20 nt, Yersinia pestis KIM
ucacgcacgguacagagggc

SEQ ID NO: 2299235 - RNA, 12 nt, Yersinia pestis KIM
ucacgcaaaggg

SEQ ID NO: 2299236 - RNA, 18 nt, Yersinia pestis KIM
ucacgccaugccgguuga

SEQ ID NO: 2299237 - RNA, 13 nt, Yersinia pestis KIM
ucacgccaccuuc

SEQ ID NO: 2299238 - RNA, 17 nt, Yersinia pestis KIM
ucacgcucaucgguacc

SEQ ID NO: 2299239 - RNA, 24 nt, Yersinia pestis KIM
ucacgcuggcgauaaacacccaag

SEQ ID NO: 2299240 - RNA, 14 nt, Yersinia pestis KIM
ucacgcugaauaac

SEQ ID NO: 2299241 - RNA, 19 nt, Yersinia pestis KIM
ucacggaagguugccccca

SEQ ID NO: 2299242 - RNA, 17 nt, Yersinia pestis KIM
ucacggcuuugcugugc

SEQ ID NO: 2299243 - RNA, 15 nt, Yersinia pestis KIM
ucacggccaaaaaug

SEQ ID NO: 2299244 - RNA, 20 nt, Yersinia pestis KIM
ucacgggcuuccaucaggaa

SEQ ID NO: 2299245 - RNA, 21 nt, Yersinia pestis KIM
ucaccucuucagguaagccuu

SEQ ID NO: 2299246 - RNA, 15 nt, Yersinia pestis KIM
ucaccugaguaauau

SEQ ID NO: 2299247 - RNA, 22 nt, Yersinia pestis KIM
ucaccuacuuuggguauccucu

SEQ ID NO: 2299248 - RNA, 22 nt, Yersinia pestis KIM
ucaccuauaauuaacagcauca

SEQ ID NO: 2299249 - RNA, 13 nt, Yersinia pestis KIM
ucaccucccugca

SEQ ID NO: 2299250 - RNA, 16 nt, Yersinia pestis KIM
ucaccucccugcaaga

SEQ ID NO: 2299251 - RNA, 23 nt, Yersinia pestis KIM
ucaccugcgggauagcauaaaua

SEQ ID NO: 2299252 - RNA, 14 nt, Yersinia pestis KIM
ucaccugcuuaguu

SEQ ID NO: 2299253 - RNA, 15 nt, Yersinia pestis KIM
ucacgauagccagug

SEQ ID NO: 2299254 - RNA, 18 nt, Yersinia pestis KIM
ucacgauggaaaaaauac

SEQ ID NO: 2299255 - RNA, 17 nt, Yersinia pestis KIM
ucacgauacgacuucuu

SEQ ID NO: 2299256 - RNA, 20 nt, Yersinia pestis KIM
ucacgacaagucaugguaca

SEQ ID NO: 2299257 - RNA, 14 nt, Yersinia pestis KIM
ucacgacgcgaugc

SEQ ID NO: 2299258 - RNA, 18 nt, Yersinia pestis KIM
ucacgagggcuuaugcuu

SEQ ID NO: 2299259 - RNA, 14 nt, Yersinia pestis KIM
ucaccuuugaucau

SEQ ID NO: 2299260 - RNA, 19 nt, Yersinia pestis KIM
ucagauuguuuauaaauua

SEQ ID NO: 2299261 - RNA, 21 nt, Yersinia pestis KIM
ucagauuguuuauaaauuaaa

SEQ ID NO: 2299262 - RNA, 19 nt, Yersinia pestis KIM
ucagauuaguuuuagacgu

SEQ ID NO: 2299263 - RNA, 21 nt, Yersinia pestis KIM
ucagauuaguuuuagacguca

SEQ ID NO: 2299264 - RNA, 12 nt, Yersinia pestis KIM
ucagauugucag

SEQ ID NO: 2299265 - RNA, 17 nt, Yersinia pestis KIM
ucagauugucagacacg

SEQ ID NO: 2299266 - RNA, 15 nt, Yersinia pestis KIM
ucagauugaacgcug

SEQ ID NO: 2299267 - RNA, 17 nt, Yersinia pestis KIM
ucagaugccgcuuuagu

SEQ ID NO: 2299268 - RNA, 16 nt, Yersinia pestis KIM
ucagaugcugacgggc

SEQ ID NO: 2299269 - RNA, 19 nt, Yersinia pestis KIM
ucagauuaacggucacugg

SEQ ID NO: 2299270 - RNA, 17 nt, Yersinia pestis KIM
ucagaugaucaaauuau

SEQ ID NO: 2299271 - RNA, 16 nt, Yersinia pestis KIM
ucagaugaaaaacugu

SEQ ID NO: 2299272 - RNA, 22 nt, Yersinia pestis KIM
ucagaucaacagauuuuccauc

SEQ ID NO: 2299273 - RNA, 16 nt, Yersinia pestis KIM
ucagauacggcuccag

SEQ ID NO: 2299274 - RNA, 20 nt, Yersinia pestis KIM
ucagauauuagugacagcca

SEQ ID NO: 2299275 - RNA, 22 nt, Yersinia pestis KIM
ucagauauuagugacagccaca

SEQ ID NO: 2299276 - RNA, 18 nt, Yersinia pestis KIM
ucagauaucugcucauua

SEQ ID NO: 2299277 - RNA, 21 nt, Yersinia pestis KIM
ucagauaucugcucauuacca

SEQ ID NO: 2299278 - RNA, 20 nt, Yersinia pestis KIM
ucagauaaauucaacuucuc

SEQ ID NO: 2299279 - RNA, 23 nt, Yersinia pestis KIM
ucagaggaaagagagccauaauu

SEQ ID NO: 2299280 - RNA, 15 nt, Yersinia pestis KIM
ucagaguccaauagc

SEQ ID NO: 2299281 - RNA, 20 nt, Yersinia pestis KIM
ucagagccaacugaggcaga

SEQ ID NO: 2299282 - RNA, 21 nt, Yersinia pestis KIM
ucagaccaaauagcaagccaa

SEQ ID NO: 2299283 - RNA, 20 nt, Yersinia pestis KIM
ucagacauuuuucuauuucu

SEQ ID NO: 2299284 - RNA, 15 nt, Yersinia pestis KIM
ucagacagcacgggc

SEQ ID NO: 2299285 - RNA, 21 nt, Yersinia pestis KIM
ucagacaggauaaucaucagu

SEQ ID NO: 2299286 - RNA, 22 nt, Yersinia pestis KIM
ucagaaugaaguucaccagcuu

SEQ ID NO: 2299287 - RNA, 15 nt, Yersinia pestis KIM
ucagaccuuuaggaa

SEQ ID NO: 2299288 - RNA, 17 nt, Yersinia pestis KIM
ucagacugaaaguagaa

SEQ ID NO: 2299289 - RNA, 19 nt, Yersinia pestis KIM
ucagacugcucuuucccuu

SEQ ID NO: 2299290 - RNA, 16 nt, Yersinia pestis KIM
ucagaaacaucuucau

SEQ ID NO: 2299291 - RNA, 20 nt, Yersinia pestis KIM
ucagaaaacagccaccagcc

SEQ ID NO: 2299292 - RNA, 17 nt, Yersinia pestis KIM
ucagaaaacccccugcu

SEQ ID NO: 2299293 - RNA, 23 nt, Yersinia pestis KIM
ucagaaccuguuacaucagagcu

SEQ ID NO: 2299294 - RNA, 19 nt, Yersinia pestis KIM
ucagaacguuaauuuagcg

SEQ ID NO: 2299295 - RNA, 20 nt, Yersinia pestis KIM
ucagccgcggcgcuggcaug

SEQ ID NO: 2299296 - RNA, 16 nt, Yersinia pestis KIM
ucagccgcgaaaaacc

SEQ ID NO: 2299297 - RNA, 18 nt, Yersinia pestis KIM
ucagccgcgaaaaaccau

SEQ ID NO: 2299298 - RNA, 19 nt, Yersinia pestis KIM
ucagcccuaauauccucaa

SEQ ID NO: 2299299 - RNA, 17 nt, Yersinia pestis KIM
ucagcccgauccccugc

SEQ ID NO: 2299300 - RNA, 20 nt, Yersinia pestis KIM
ucagccucauucaugaggcu

SEQ ID NO: 2299301 - RNA, 11 nt, Yersinia pestis KIM
ucagccucuga

SEQ ID NO: 2299302 - RNA, 19 nt, Yersinia pestis KIM
ucagccuauccucaccguu

SEQ ID NO: 2299303 - RNA, 15 nt, Yersinia pestis KIM
ucagccuauccucac

SEQ ID NO: 2299304 - RNA, 13 nt, Yersinia pestis KIM
ucagccuauccuc

SEQ ID NO: 2299305 - RNA, 15 nt, Yersinia pestis KIM
ucagcccauggcuga

SEQ ID NO: 2299306 - RNA, 13 nt, Yersinia pestis KIM
ucagccagcuccu

SEQ ID NO: 2299307 - RNA, 13 nt, Yersinia pestis KIM
ucagccaccagau

SEQ ID NO: 2299308 - RNA, 18 nt, Yersinia pestis KIM
ucagccacaaaaguucac

SEQ ID NO: 2299309 - RNA, 16 nt, Yersinia pestis KIM
ucagccacaagauagu

SEQ ID NO: 2299310 - RNA, 14 nt, Yersinia pestis KIM
ucagcauggaagau

SEQ ID NO: 2299311 - RNA, 18 nt, Yersinia pestis KIM
ucagcacgcuuuccagcu

SEQ ID NO: 2299312 - RNA, 22 nt, Yersinia pestis KIM
ucagcaacgguuucaacuucaa

SEQ ID NO: 2299313 - RNA, 14 nt, Yersinia pestis KIM
ucagcaacuuggua

SEQ ID NO: 2299314 - RNA, 20 nt, Yersinia pestis KIM
ucagcaacuugguaccaguc

SEQ ID NO: 2299315 - RNA, 19 nt, Yersinia pestis KIM
ucagcaacccgcccaagcc

SEQ ID NO: 2299316 - RNA, 18 nt, Yersinia pestis KIM
ucagcaagguucucgcug

SEQ ID NO: 2299317 - RNA, 13 nt, Yersinia pestis KIM
ucagcaauaugaa

SEQ ID NO: 2299318 - RNA, 11 nt, Yersinia pestis KIM
ucagcagagag

SEQ ID NO: 2299319 - RNA, 20 nt, Yersinia pestis KIM
ucagcagagucgcaaaaaau

SEQ ID NO: 2299320 - RNA, 17 nt, Yersinia pestis KIM
ucagcagacucaagcau

SEQ ID NO: 2299321 - RNA, 21 nt, Yersinia pestis KIM
ucagcagacgaaccgcuuuga

SEQ ID NO: 2299322 - RNA, 20 nt, Yersinia pestis KIM
ucagcagucugauuaccuuc

SEQ ID NO: 2299323 - RNA, 15 nt, Yersinia pestis KIM
ucagcagucugaaau

SEQ ID NO: 2299324 - RNA, 12 nt, Yersinia pestis KIM
ucagcagucuga

SEQ ID NO: 2299325 - RNA, 13 nt, Yersinia pestis KIM
uagauuauuuucu

SEQ ID NO: 2299326 - RNA, 19 nt, Yersinia pestis KIM
uagauuaaugaaaaggcau

SEQ ID NO: 2299327 - RNA, 18 nt, Yersinia pestis KIM
uagauuuuaaugaaaacu

SEQ ID NO: 2299328 - RNA, 16 nt, Yersinia pestis KIM
uagauggaaaucacac

SEQ ID NO: 2299329 - RNA, 13 nt, Yersinia pestis KIM
uagaugucagauu

SEQ ID NO: 2299330 - RNA, 11 nt, Yersinia pestis KIM
uagaaaacagc

SEQ ID NO: 2299331 - RNA, 14 nt, Yersinia pestis KIM
uagcccaaaauaga

SEQ ID NO: 2299332 - RNA, 18 nt, Yersinia pestis KIM
uagcccaucuuaugcaug

SEQ ID NO: 2299333 - RNA, 21 nt, Yersinia pestis KIM
uagccccggcaaguugaucac

SEQ ID NO: 2299334 - RNA, 20 nt, Yersinia pestis KIM
uagcccggcucauccgccaa

SEQ ID NO: 2299335 - RNA, 17 nt, Yersinia pestis KIM
uagcaaaacugaggucg

SEQ ID NO: 2299336 - RNA, 15 nt, Yersinia pestis KIM
uagcaacacaucggu

SEQ ID NO: 2299337 - RNA, 14 nt, Yersinia pestis KIM
uagcagcgcacugg

SEQ ID NO: 2299338 - RNA, 14 nt, Yersinia pestis KIM
uagcaggcagcacg

SEQ ID NO: 2299339 - RNA, 15 nt, Yersinia pestis KIM
uagcaagcacggcag

SEQ ID NO: 2299340 - RNA, 16 nt, Yersinia pestis KIM
uagcaagcacggcagg

SEQ ID NO: 2299341 - RNA, 13 nt, Yersinia pestis KIM
uagcgccuuuuuu

SEQ ID NO: 2299342 - RNA, 13 nt, Yersinia pestis KIM
uagcgccuccggc

SEQ ID NO: 2299343 - RNA, 22 nt, Yersinia pestis KIM
uagcgccgauggugugcagcaa

SEQ ID NO: 2299344 - RNA, 21 nt, Yersinia pestis KIM
uagcccuucccccaaguaaaa

SEQ ID NO: 2299345 - RNA, 23 nt, Yersinia pestis KIM
uagcccuucccccaaguaaaaaa

SEQ ID NO: 2299346 - RNA, 13 nt, Yersinia pestis KIM
uagcccuucagca

SEQ ID NO: 2299347 - RNA, 16 nt, Yersinia pestis KIM
uagcccuaacugcuca

SEQ ID NO: 2299348 - RNA, 16 nt, Yersinia pestis KIM
uagcccguugagugaa

SEQ ID NO: 2299349 - RNA, 22 nt, Yersinia pestis KIM
uagcgcuuuuacaucaaccccu

SEQ ID NO: 2299350 - RNA, 18 nt, Yersinia pestis KIM
uagcgcugcaucagcagu

SEQ ID NO: 2299351 - RNA, 12 nt, Yersinia pestis KIM
uagcgucaagga

SEQ ID NO: 2299352 - RNA, 17 nt, Yersinia pestis KIM
uagcuacagcaccauua

SEQ ID NO: 2299353 - RNA, 19 nt, Yersinia pestis KIM
uagcuauuggcugauucaa

SEQ ID NO: 2299354 - RNA, 18 nt, Yersinia pestis KIM
uagcuggcggauaaaaau

SEQ ID NO: 2299355 - RNA, 17 nt, Yersinia pestis KIM
uagcugucguaauaguu

SEQ ID NO: 2299356 - RNA, 23 nt, Yersinia pestis KIM
uagcuuauccccugagaaacauc

SEQ ID NO: 2299357 - RNA, 13 nt, Yersinia pestis KIM
uaggcaucucuga

SEQ ID NO: 2299358 - RNA, 13 nt, Yersinia pestis KIM
uaggcaucugcca

SEQ ID NO: 2299359 - RNA, 16 nt, Yersinia pestis KIM
uaggcauaaauaauaa

SEQ ID NO: 2299360 - RNA, 14 nt, Yersinia pestis KIM
uaggccacuuaaca

SEQ ID NO: 2299361 - RNA, 14 nt, Yersinia pestis KIM
uaggcuacagcuac

SEQ ID NO: 2299362 - RNA, 16 nt, Yersinia pestis KIM
uaggcgggugaaauau

SEQ ID NO: 2299363 - RNA, 15 nt, Yersinia pestis KIM
uaggcagaauaguca

SEQ ID NO: 2299364 - RNA, 16 nt, Yersinia pestis KIM
uaggauuuauuucucu

SEQ ID NO: 2299365 - RNA, 14 nt, Yersinia pestis KIM
uaguaauagauugu

SEQ ID NO: 2299366 - RNA, 20 nt, Yersinia pestis KIM
uaguaaugacgcuauggaua

SEQ ID NO: 2299367 - RNA, 20 nt, Yersinia pestis KIM
uaguaaacuuaucgaucucc

SEQ ID NO: 2299368 - RNA, 15 nt, Yersinia pestis KIM
uaggucaucccagca

SEQ ID NO: 2299369 - RNA, 14 nt, Yersinia pestis KIM
uaggcucgagccgc

SEQ ID NO: 2299370 - RNA, 22 nt, Yersinia pestis KIM
uaggcucgagccgcgccauccu

SEQ ID NO: 2299371 - RNA, 16 nt, Yersinia pestis KIM
uaggcucagcauggaa

SEQ ID NO: 2299372 - RNA, 14 nt, Yersinia pestis KIM
uaggcuuuuuacuu

SEQ ID NO: 2299373 - RNA, 18 nt, Yersinia pestis KIM
uaggcuugaaguucucau

SEQ ID NO: 2299374 - RNA, 16 nt, Yersinia pestis KIM
uaggcuugagguuauu

SEQ ID NO: 2299375 - RNA, 19 nt, Yersinia pestis KIM
uaggugguaccugcacuga

SEQ ID NO: 2299376 - RNA, 17 nt, Yersinia pestis KIM
uaggugccaucuggcuc

SEQ ID NO: 2299377 - RNA, 14 nt, Yersinia pestis KIM
uagguuauaagcca

SEQ ID NO: 2299378 - RNA, 21 nt, Yersinia pestis KIM
uagugaugcaguaaauagucu

SEQ ID NO: 2299379 - RNA, 21 nt, Yersinia pestis KIM
uagugagccgugagaauagac

SEQ ID NO: 2299380 - RNA, 15 nt, Yersinia pestis KIM
uagugaugcaguaaa

SEQ ID NO: 2299381 - RNA, 15 nt, Yersinia pestis KIM
uagugauuauuuaaa

SEQ ID NO: 2299382 - RNA, 18 nt, Yersinia pestis KIM
uagugauuguuugauuau

SEQ ID NO: 2299383 - RNA, 21 nt, Yersinia pestis KIM
uagugaguuauucgccccuua

SEQ ID NO: 2299384 - RNA, 15 nt, Yersinia pestis KIM
uagucauauauuuuu

SEQ ID NO: 2299385 - RNA, 19 nt, Yersinia pestis KIM
uagucauagugauaaaaag

SEQ ID NO: 2299386 - RNA, 16 nt, Yersinia pestis KIM
uagucacucaagccag

SEQ ID NO: 2299387 - RNA, 21 nt, Yersinia pestis KIM
uaguauugcggaauggcaacg

SEQ ID NO: 2299388 - RNA, 22 nt, Yersinia pestis KIM
uagucacgucuucaccaaugau

SEQ ID NO: 2299389 - RNA, 17 nt, Yersinia pestis KIM
uagucaaaacaauaucu

SEQ ID NO: 2299390 - RNA, 14 nt, Yersinia pestis KIM
uaguauuuguagug

SEQ ID NO: 2299391 - RNA, 14 nt, Yersinia pestis KIM
uaguacuugccaca

SEQ ID NO: 2299392 - RNA, 17 nt, Yersinia pestis KIM
uauaaggaauauacuuu

SEQ ID NO: 2299393 - RNA, 14 nt, Yersinia pestis KIM
uauaaggaauauac

SEQ ID NO: 2299394 - RNA, 16 nt, Yersinia pestis KIM
uauaaggaauauacuu

SEQ ID NO: 2299395 - RNA, 18 nt, Yersinia pestis KIM
uauaacauaauaaauuaa

SEQ ID NO: 2299396 - RNA, 12 nt, Yersinia pestis KIM
uauaacauaaua

SEQ ID NO: 2299397 - RNA, 15 nt, Yersinia pestis KIM
uauaaauuuuaaguu

SEQ ID NO: 2299398 - RNA, 14 nt, Yersinia pestis KIM
uauaaagcauuuau

SEQ ID NO: 2299399 - RNA, 23 nt, Yersinia pestis KIM
uauaaagcauuuaucauauuaac

SEQ ID NO: 2299400 - RNA, 19 nt, Yersinia pestis KIM
uauaacauaauaaauuaau

SEQ ID NO: 2299401 - RNA, 17 nt, Yersinia pestis KIM
uauaaccauuuuaauau

SEQ ID NO: 2299402 - RNA, 19 nt, Yersinia pestis KIM
uauaaccccccugcugaua

SEQ ID NO: 2299403 - RNA, 21 nt, Yersinia pestis KIM
uauaacgcccggcaauaauag

SEQ ID NO: 2299404 - RNA, 20 nt, Yersinia pestis KIM
uauaaaacacgcauaugaau

SEQ ID NO: 2299405 - RNA, 18 nt, Yersinia pestis KIM
uauaaaaccacugaccua

SEQ ID NO: 2299406 - RNA, 22 nt, Yersinia pestis KIM
uauaaaauaauaagauucagcu

SEQ ID NO: 2299407 - RNA, 16 nt, Yersinia pestis KIM
uauaaaagcacagaca

SEQ ID NO: 2299408 - RNA, 12 nt, Yersinia pestis KIM
uauaaaaacccc

SEQ ID NO: 2299409 - RNA, 13 nt, Yersinia pestis KIM
uaguugcuaucaa

SEQ ID NO: 2299410 - RNA, 15 nt, Yersinia pestis KIM
uaguuguuagccacu

SEQ ID NO: 2299411 - RNA, 19 nt, Yersinia pestis KIM
uaguucuucugauaaaaca

SEQ ID NO: 2299412 - RNA, 21 nt, Yersinia pestis KIM
uaguucuucugauaaaacagu

SEQ ID NO: 2299413 - RNA, 13 nt, Yersinia pestis KIM
uaguucauuuugu

SEQ ID NO: 2299414 - RNA, 18 nt, Yersinia pestis KIM
uaguuggcaagacgguau

SEQ ID NO: 2299415 - RNA, 22 nt, Yersinia pestis KIM
uaguucacgauggaaaaaauac

SEQ ID NO: 2299416 - RNA, 23 nt, Yersinia pestis KIM
uaguucacgauggaaaaaauaca

SEQ ID NO: 2299417 - RNA, 20 nt, Yersinia pestis KIM
uaguucacgauggaaaaaau

SEQ ID NO: 2299418 - RNA, 16 nt, Yersinia pestis KIM
uagugcuacagcagca

SEQ ID NO: 2299419 - RNA, 14 nt, Yersinia pestis KIM
uagugccuaucuga

SEQ ID NO: 2299420 - RNA, 13 nt, Yersinia pestis KIM
uaucgcucuugag

SEQ ID NO: 2299421 - RNA, 14 nt, Yersinia pestis KIM
uaucggcggagaga

SEQ ID NO: 2299422 - RNA, 14 nt, Yersinia pestis KIM
uauccuccauucug

SEQ ID NO: 2299423 - RNA, 11 nt, Yersinia pestis KIM
uauccuccggc

SEQ ID NO: 2299424 - RNA, 17 nt, Yersinia pestis KIM
uauccucggccaguguu

SEQ ID NO: 2299425 - RNA, 15 nt, Yersinia pestis KIM
uauccugugccaaca

SEQ ID NO: 2299426 - RNA, 17 nt, Yersinia pestis KIM
uaucgggauucacaccg

SEQ ID NO: 2299427 - RNA, 12 nt, Yersinia pestis KIM
uaucgucacugg

SEQ ID NO: 2299428 - RNA, 22 nt, Yersinia pestis KIM
uaucgugcgucaauaauaaaau

SEQ ID NO: 2299429 - RNA, 12 nt, Yersinia pestis KIM
uaucuauuucca

SEQ ID NO: 2299430 - RNA, 14 nt, Yersinia pestis KIM
uaucuauuuccauc

SEQ ID NO: 2299431 - RNA, 21 nt, Yersinia pestis KIM
uaucuccguugaaaccuacau

SEQ ID NO: 2299432 - RNA, 21 nt, Yersinia pestis KIM
uaucugccaauucaaggccag

SEQ ID NO: 2299433 - RNA, 19 nt, Yersinia pestis KIM
uaucucccauuaauuaauc

SEQ ID NO: 2299434 - RNA, 19 nt, Yersinia pestis KIM
uaucuccaccaacggccca

SEQ ID NO: 2299435 - RNA, 18 nt, Yersinia pestis KIM
uaucagaaccaagcaaua

SEQ ID NO: 2299436 - RNA, 20 nt, Yersinia pestis KIM
uaucagaaauacgcuuucca

SEQ ID NO: 2299437 - RNA, 13 nt, Yersinia pestis KIM
uaucauuguccuc

SEQ ID NO: 2299438 - RNA, 23 nt, Yersinia pestis KIM
uaucauuuuccugcauauuauuu

SEQ ID NO: 2299439 - RNA, 20 nt, Yersinia pestis KIM
uaucauuuaaauacagauca

SEQ ID NO: 2299440 - RNA, 13 nt, Yersinia pestis KIM
uauccaacuucuu

SEQ ID NO: 2299441 - RNA, 12 nt, Yersinia pestis KIM
uauccaauaagc

SEQ ID NO: 2299442 - RNA, 21 nt, Yersinia pestis KIM
uauccaauaagcguauuuugu

SEQ ID NO: 2299443 - RNA, 15 nt, Yersinia pestis KIM
uauccaauccuuugg

SEQ ID NO: 2299444 - RNA, 20 nt, Yersinia pestis KIM
uauccguuuacgacaauccu

SEQ ID NO: 2299445 - RNA, 22 nt, Yersinia pestis KIM
uauccuaagaauuaguugcccg

SEQ ID NO: 2299446 - RNA, 12 nt, Yersinia pestis KIM
uauccuauuuuu

SEQ ID NO: 2299447 - RNA, 14 nt, Yersinia pestis KIM
uauccuauuuuuac

SEQ ID NO: 2299448 - RNA, 21 nt, Yersinia pestis KIM
uauccggggcauucccccgga

SEQ ID NO: 2299449 - RNA, 16 nt, Yersinia pestis KIM
uauccaucugaugagu

SEQ ID NO: 2299450 - RNA, 14 nt, Yersinia pestis KIM
uauccacuuggcua

SEQ ID NO: 2299451 - RNA, 15 nt, Yersinia pestis KIM
uauccaccugaucau

SEQ ID NO: 2299452 - RNA, 17 nt, Yersinia pestis KIM
uauaucacuauuucagg

SEQ ID NO: 2299453 - RNA, 15 nt, Yersinia pestis KIM
uauaucaaggcggca

SEQ ID NO: 2299454 - RNA, 19 nt, Yersinia pestis KIM
uauaucccaauaauagcua

SEQ ID NO: 2299455 - RNA, 13 nt, Yersinia pestis KIM
uauauauuuugaa

SEQ ID NO: 2299456 - RNA, 18 nt, Yersinia pestis KIM
uauauauuuugaauauuu

SEQ ID NO: 2299457 - RNA, 12 nt, Yersinia pestis KIM
uauauaaaugau

SEQ ID NO: 2299458 - RNA, 13 nt, Yersinia pestis KIM
uauauaaauggcu

SEQ ID NO: 2299459 - RNA, 21 nt, Yersinia pestis KIM
uauaauccaaaauaauauaau

SEQ ID NO: 2299460 - RNA, 14 nt, Yersinia pestis KIM
uauaauccaaaaua

SEQ ID NO: 2299461 - RNA, 15 nt, Yersinia pestis KIM
uauaaucaucuacaa

SEQ ID NO: 2299462 - RNA, 18 nt, Yersinia pestis KIM
uauaaucaucuacaacau

SEQ ID NO: 2299463 - RNA, 22 nt, Yersinia pestis KIM
uauaaugaugagguaauacuca

SEQ ID NO: 2299464 - RNA, 14 nt, Yersinia pestis KIM
uauaguuaaacuga

SEQ ID NO: 2299465 - RNA, 13 nt, Yersinia pestis KIM
uauaguuaaaacu

SEQ ID NO: 2299466 - RNA, 22 nt, Yersinia pestis KIM
uaucacuguccaagaagccaag

SEQ ID NO: 2299467 - RNA, 15 nt, Yersinia pestis KIM
uaucacuauuucagg

SEQ ID NO: 2299468 - RNA, 21 nt, Yersinia pestis KIM
uaucagaaacaauaaauaucc

SEQ ID NO: 2299469 - RNA, 17 nt, Yersinia pestis KIM
uaucacuauaauuauuu

SEQ ID NO: 2299470 - RNA, 16 nt, Yersinia pestis KIM
uaucacggccaaaaau

SEQ ID NO: 2299471 - RNA, 19 nt, Yersinia pestis KIM
uaucaacguagcugaauug

SEQ ID NO: 2299472 - RNA, 14 nt, Yersinia pestis KIM
uaucaacgauguaa

SEQ ID NO: 2299473 - RNA, 14 nt, Yersinia pestis KIM
uaucaacagaacua

SEQ ID NO: 2299474 - RNA, 15 nt, Yersinia pestis KIM
uaucaaaauaaaaau

SEQ ID NO: 2299475 - RNA, 14 nt, Yersinia pestis KIM
uaucaaaaggauaa

SEQ ID NO: 2299476 - RNA, 22 nt, Yersinia pestis KIM
uauauuuugaauauuuuuaauc

SEQ ID NO: 2299477 - RNA, 18 nt, Yersinia pestis KIM
uauauuuuacuuccugcc

SEQ ID NO: 2299478 - RNA, 21 nt, Yersinia pestis KIM
uauaugcgcuggcucuauuuu

SEQ ID NO: 2299479 - RNA, 16 nt, Yersinia pestis KIM
uauaugaucagugggg

SEQ ID NO: 2299480 - RNA, 16 nt, Yersinia pestis KIM
uauauggauuggcauu

SEQ ID NO: 2299481 - RNA, 16 nt, Yersinia pestis KIM
uaugccauaacaucgu

SEQ ID NO: 2299482 - RNA, 18 nt, Yersinia pestis KIM
uaugccauauuacucucu

SEQ ID NO: 2299483 - RNA, 16 nt, Yersinia pestis KIM
uaugccaguuauuauu

SEQ ID NO: 2299484 - RNA, 14 nt, Yersinia pestis KIM
uaugccauuaucuu

SEQ ID NO: 2299485 - RNA, 19 nt, Yersinia pestis KIM
uaugccauuaucuuuaauu

SEQ ID NO: 2299486 - RNA, 22 nt, Yersinia pestis KIM
uaugcauuauugauguuauuaa

SEQ ID NO: 2299487 - RNA, 19 nt, Yersinia pestis KIM
uaugccggggauauuuugc

SEQ ID NO: 2299488 - RNA, 14 nt, Yersinia pestis KIM
uaugccgacaacca

SEQ ID NO: 2299489 - RNA, 13 nt, Yersinia pestis KIM
uaugcguggguuc

SEQ ID NO: 2299490 - RNA, 15 nt, Yersinia pestis KIM
uaugcgcuggcucua

SEQ ID NO: 2299491 - RNA, 15 nt, Yersinia pestis KIM
uaugcuuaauuuggc

SEQ ID NO: 2299492 - RNA, 16 nt, Yersinia pestis KIM
uaugcuucacaucaua

SEQ ID NO: 2299493 - RNA, 12 nt, Yersinia pestis KIM
uaugcucugcug

SEQ ID NO: 2299494 - RNA, 14 nt, Yersinia pestis KIM
uaugcugugguuca

SEQ ID NO: 2299495 - RNA, 17 nt, Yersinia pestis KIM
uaugcuguauaaaagaa

SEQ ID NO: 2299496 - RNA, 20 nt, Yersinia pestis KIM
uauggacaagggcuauuuuu

SEQ ID NO: 2299497 - RNA, 21 nt, Yersinia pestis KIM
uauggagaggcgcuagccucu

SEQ ID NO: 2299498 - RNA, 17 nt, Yersinia pestis KIM
uauggaugguguagcau

SEQ ID NO: 2299499 - RNA, 22 nt, Yersinia pestis KIM
uauggcgaugaugauuauuuua

SEQ ID NO: 2299500 - RNA, 13 nt, Yersinia pestis KIM
uaugguuaaucua

SEQ ID NO: 2299501 - RNA, 14 nt, Yersinia pestis KIM
uaugguuaucacau

SEQ ID NO: 2299502 - RNA, 17 nt, Yersinia pestis KIM
uauguaaauaguuacua

SEQ ID NO: 2299503 - RNA, 23 nt, Yersinia pestis KIM
uauguaaauaguuacuauauaaa

SEQ ID NO: 2299504 - RNA, 22 nt, Yersinia pestis KIM
uaugggggauggccgggcuguc

SEQ ID NO: 2299505 - RNA, 16 nt, Yersinia pestis KIM
uauguaaugccacacu

SEQ ID NO: 2299506 - RNA, 20 nt, Yersinia pestis KIM
uauguaaugccacacucaga

SEQ ID NO: 2299507 - RNA, 19 nt, Yersinia pestis KIM
uauguuguucgaaaauaga

SEQ ID NO: 2299508 - RNA, 21 nt, Yersinia pestis KIM
uauguugauuccguauuauuu

SEQ ID NO: 2299509 - RNA, 17 nt, Yersinia pestis KIM
uauguucuuccugugcg

SEQ ID NO: 2299510 - RNA, 13 nt, Yersinia pestis KIM
uauguucuucuug

SEQ ID NO: 2299511 - RNA, 13 nt, Yersinia pestis KIM
uauguuccaucag

SEQ ID NO: 2299512 - RNA, 15 nt, Yersinia pestis KIM
uaugauaauaguuca

SEQ ID NO: 2299513 - RNA, 21 nt, Yersinia pestis KIM
uaugauccuuuagcgcugcau

SEQ ID NO: 2299514 - RNA, 20 nt, Yersinia pestis KIM
uaugaggaucccuucugaaa

SEQ ID NO: 2299515 - RNA, 13 nt, Yersinia pestis KIM
uaugacuucuuau

SEQ ID NO: 2299516 - RNA, 16 nt, Yersinia pestis KIM
uaugacuucuuaucuu

SEQ ID NO: 2299517 - RNA, 14 nt, Yersinia pestis KIM
uaugacgcgcugcu

SEQ ID NO: 2299518 - RNA, 21 nt, Yersinia pestis KIM
uaugacggguauauagccauu

SEQ ID NO: 2299519 - RNA, 21 nt, Yersinia pestis KIM
uaugacgccaacuucaagccg

SEQ ID NO: 2299520 - RNA, 24 nt, Yersinia pestis KIM
uaugacgccaacuucaagccgaua

SEQ ID NO: 2299521 - RNA, 19 nt, Yersinia pestis KIM
uaugacagaaaaaucacau

SEQ ID NO: 2299522 - RNA, 13 nt, Yersinia pestis KIM
uaugcaacaguga

SEQ ID NO: 2299523 - RNA, 13 nt, Yersinia pestis KIM
uaugcagcgauua

SEQ ID NO: 2299524 - RNA, 15 nt, Yersinia pestis KIM
uaugcaguuuuccuc

SEQ ID NO: 2299525 - RNA, 10 nt, Yersinia pestis KIM
uaucugcuau

SEQ ID NO: 2299526 - RNA, 20 nt, Yersinia pestis KIM
uaucugcuaauuaaaccuga

SEQ ID NO: 2299527 - RNA, 15 nt, Yersinia pestis KIM
uaucuugaaccaauu

SEQ ID NO: 2299528 - RNA, 21 nt, Yersinia pestis KIM
uaucuugaaccaauuuuucug

SEQ ID NO: 2299529 - RNA, 19 nt, Yersinia pestis KIM
uaucuugcugaaaacaaua

SEQ ID NO: 2299530 - RNA, 20 nt, Yersinia pestis KIM
uaucuugcugaaaacaauau

SEQ ID NO: 2299531 - RNA, 15 nt, Yersinia pestis KIM
uaucuuuaauuuucu

SEQ ID NO: 2299532 - RNA, 16 nt, Yersinia pestis KIM
uaucuuuaauuuucug

SEQ ID NO: 2299533 - RNA, 19 nt, Yersinia pestis KIM
uaucuuguaaauagucaua

SEQ ID NO: 2299534 - RNA, 19 nt, Yersinia pestis KIM
uaucuuuccagccaauaca

SEQ ID NO: 2299535 - RNA, 19 nt, Yersinia pestis KIM
uaugaaugagguuuacauu

SEQ ID NO: 2299536 - RNA, 20 nt, Yersinia pestis KIM
uaugaauggaaguuaaaaaa

SEQ ID NO: 2299537 - RNA, 21 nt, Yersinia pestis KIM
uaugaauggaaguuaaaaaaa

SEQ ID NO: 2299538 - RNA, 13 nt, Yersinia pestis KIM
uaugaagauaacg

SEQ ID NO: 2299539 - RNA, 16 nt, Yersinia pestis KIM
uaucuuuuaaaaaauu

SEQ ID NO: 2299540 - RNA, 17 nt, Yersinia pestis KIM
uaucuuuucugauuuuu

SEQ ID NO: 2299541 - RNA, 13 nt, Yersinia pestis KIM
uaugaaaguaaga

SEQ ID NO: 2299542 - RNA, 15 nt, Yersinia pestis KIM
uacuggcaguaaaac

SEQ ID NO: 2299543 - RNA, 18 nt, Yersinia pestis KIM
uacugcuuuucuaccuga

SEQ ID NO: 2299544 - RNA, 18 nt, Yersinia pestis KIM
uacuggcuaucuuaugac

SEQ ID NO: 2299545 - RNA, 14 nt, Yersinia pestis KIM
uacugguaccaaau

SEQ ID NO: 2299546 - RNA, 14 nt, Yersinia pestis KIM
uacuguuuucauua

SEQ ID NO: 2299547 - RNA, 21 nt, Yersinia pestis KIM
uacuguuuucauuauuuucac

SEQ ID NO: 2299548 - RNA, 18 nt, Yersinia pestis KIM
uacuguuggcaauuucac

SEQ ID NO: 2299549 - RNA, 14 nt, Yersinia pestis KIM
uacuguuuauuaau

SEQ ID NO: 2299550 - RNA, 17 nt, Yersinia pestis KIM
uacuguggucaguggug

SEQ ID NO: 2299551 - RNA, 20 nt, Yersinia pestis KIM
uacuguuaccgcgcuugcau

SEQ ID NO: 2299552 - RNA, 14 nt, Yersinia pestis KIM
uacuguuaguucag

SEQ ID NO: 2299553 - RNA, 18 nt, Yersinia pestis KIM
uacugucgauaauaaauu

SEQ ID NO: 2299554 - RNA, 21 nt, Yersinia pestis KIM
uacuuaaguugaguugaauuu

SEQ ID NO: 2299555 - RNA, 17 nt, Yersinia pestis KIM
uacuuagcaauaauaga

SEQ ID NO: 2299556 - RNA, 23 nt, Yersinia pestis KIM
uacuuuauuuaaaauuaauaguu

SEQ ID NO: 2299557 - RNA, 23 nt, Yersinia pestis KIM
uacuuuauuuuaauggagcaaga

SEQ ID NO: 2299558 - RNA, 15 nt, Yersinia pestis KIM
uacuugauggcuguu

SEQ ID NO: 2299559 - RNA, 13 nt, Yersinia pestis KIM
uacuuuuuauuaa

SEQ ID NO: 2299560 - RNA, 14 nt, Yersinia pestis KIM
uacuuuuuccuuau

SEQ ID NO: 2299561 - RNA, 18 nt, Yersinia pestis KIM
uagaaaaacacuggcagc

SEQ ID NO: 2299562 - RNA, 19 nt, Yersinia pestis KIM
uagaaaaacacuggcagcc

SEQ ID NO: 2299563 - RNA, 18 nt, Yersinia pestis KIM
uacuuuuuuauuuuacuu

SEQ ID NO: 2299564 - RNA, 22 nt, Yersinia pestis KIM
uacuuucccauagcuggcuuca

SEQ ID NO: 2299565 - RNA, 14 nt, Yersinia pestis KIM
uacuuuccugcugc

SEQ ID NO: 2299566 - RNA, 13 nt, Yersinia pestis KIM
uacuuuccuuccu

SEQ ID NO: 2299567 - RNA, 17 nt, Yersinia pestis KIM
uacuuuggguauccucu

SEQ ID NO: 2299568 - RNA, 16 nt, Yersinia pestis KIM
uacugcguucuucuug

SEQ ID NO: 2299569 - RNA, 16 nt, Yersinia pestis KIM
uacugcucuaucucuu

SEQ ID NO: 2299570 - RNA, 13 nt, Yersinia pestis KIM
uacugcuuuucua

SEQ ID NO: 2299571 - RNA, 14 nt, Yersinia pestis KIM
uacugcgagcggca

SEQ ID NO: 2299572 - RNA, 16 nt, Yersinia pestis KIM
uacugccgacaggguu

SEQ ID NO: 2299573 - RNA, 19 nt, Yersinia pestis KIM
uacugaugaagccgccgga

SEQ ID NO: 2299574 - RNA, 19 nt, Yersinia pestis KIM
uacugaucucaucaaacac

SEQ ID NO: 2299575 - RNA, 13 nt, Yersinia pestis KIM
uacugaagguuau

SEQ ID NO: 2299576 - RNA, 17 nt, Yersinia pestis KIM
uacugaccguaccuauc

SEQ ID NO: 2299577 - RNA, 13 nt, Yersinia pestis KIM
uacucuucugccc

SEQ ID NO: 2299578 - RNA, 14 nt, Yersinia pestis KIM
uacucucuauugau

SEQ ID NO: 2299579 - RNA, 14 nt, Yersinia pestis KIM
uacucucuguuuug

SEQ ID NO: 2299580 - RNA, 15 nt, Yersinia pestis KIM
uacucuauugcucau

SEQ ID NO: 2299581 - RNA, 13 nt, Yersinia pestis KIM
uacucguuuugcu

SEQ ID NO: 2299582 - RNA, 12 nt, Yersinia pestis KIM
uacuccucugcc

SEQ ID NO: 2299583 - RNA, 23 nt, Yersinia pestis KIM
uacuccccaaagccuacgagaga

SEQ ID NO: 2299584 - RNA, 19 nt, Yersinia pestis KIM
uacuccauccccaacucuu

SEQ ID NO: 2299585 - RNA, 19 nt, Yersinia pestis KIM
uacuccauuugaacugugg

SEQ ID NO: 2299586 - RNA, 21 nt, Yersinia pestis KIM
uacucauuauggauaauuuaa

SEQ ID NO: 2299587 - RNA, 19 nt, Yersinia pestis KIM
uacucauauuguccaaagg

SEQ ID NO: 2299588 - RNA, 22 nt, Yersinia pestis KIM
uacucauauuguccaaaggaag

SEQ ID NO: 2299589 - RNA, 21 nt, Yersinia pestis KIM
uacucaggauuagcuucugcu

SEQ ID NO: 2299590 - RNA, 15 nt, Yersinia pestis KIM
uacucaucuauuaga

SEQ ID NO: 2299591 - RNA, 14 nt, Yersinia pestis KIM
uacucauccagauu

SEQ ID NO: 2299592 - RNA, 22 nt, Yersinia pestis KIM
uacgugacggcagcgagcacug

SEQ ID NO: 2299593 - RNA, 19 nt, Yersinia pestis KIM
uacuauguccgcauauucu

SEQ ID NO: 2299594 - RNA, 20 nt, Yersinia pestis KIM
uacuauguccgcauauucuc

SEQ ID NO: 2299595 - RNA, 17 nt, Yersinia pestis KIM
uacuauuuucauuguuc

SEQ ID NO: 2299596 - RNA, 18 nt, Yersinia pestis KIM
uacucaaaaauggcaaca

SEQ ID NO: 2299597 - RNA, 15 nt, Yersinia pestis KIM
uacucagcauccucc

SEQ ID NO: 2299598 - RNA, 19 nt, Yersinia pestis KIM
uacccuguuuuaaaugcca

SEQ ID NO: 2299599 - RNA, 23 nt, Yersinia pestis KIM
uacccuaagaauugguuauccua

SEQ ID NO: 2299600 - RNA, 18 nt, Yersinia pestis KIM
uacccuacccauuauaaa

SEQ ID NO: 2299601 - RNA, 22 nt, Yersinia pestis KIM
uacccgucguacuuuaagcugc

SEQ ID NO: 2299602 - RNA, 19 nt, Yersinia pestis KIM
uacccucgacaccaaaacu

SEQ ID NO: 2299603 - RNA, 17 nt, Yersinia pestis KIM
uacccucgacaccaaaa

SEQ ID NO: 2299604 - RNA, 16 nt, Yersinia pestis KIM
uacccucgacaccaaa

SEQ ID NO: 2299605 - RNA, 14 nt, Yersinia pestis KIM
uacccugcaccaua

SEQ ID NO: 2299606 - RNA, 20 nt, Yersinia pestis KIM
uacccucuauuaucuucuau

SEQ ID NO: 2299607 - RNA, 16 nt, Yersinia pestis KIM
uacccgaguaugguua

SEQ ID NO: 2299608 - RNA, 20 nt, Yersinia pestis KIM
uacccccgacgacuuguuca

SEQ ID NO: 2299609 - RNA, 21 nt, Yersinia pestis KIM
uacccaccagagaccacagau

SEQ ID NO: 2299610 - RNA, 17 nt, Yersinia pestis KIM
uacccacauucaggccg

SEQ ID NO: 2299611 - RNA, 18 nt, Yersinia pestis KIM
uaccgggcgaacagaaau

SEQ ID NO: 2299612 - RNA, 17 nt, Yersinia pestis KIM
uaccgggcgaacagaaa

SEQ ID NO: 2299613 - RNA, 23 nt, Yersinia pestis KIM
uaccgguaaaauuauugccgcag

SEQ ID NO: 2299614 - RNA, 13 nt, Yersinia pestis KIM
uaccgcccguuga

SEQ ID NO: 2299615 - RNA, 23 nt, Yersinia pestis KIM
uaccgcaaccgggccggguugau

SEQ ID NO: 2299616 - RNA, 12 nt, Yersinia pestis KIM
uaccgcaaccac

SEQ ID NO: 2299617 - RNA, 15 nt, Yersinia pestis KIM
uaccgcaaccaccuu

SEQ ID NO: 2299618 - RNA, 16 nt, Yersinia pestis KIM
uaccgccaauaucugu

SEQ ID NO: 2299619 - RNA, 22 nt, Yersinia pestis KIM
uaccgcagaaccuuguuuuacc

SEQ ID NO: 2299620 - RNA, 17 nt, Yersinia pestis KIM
uaccacgucuaauugcu

SEQ ID NO: 2299621 - RNA, 22 nt, Yersinia pestis KIM
uaccacgucuaauugcugccca

SEQ ID NO: 2299622 - RNA, 19 nt, Yersinia pestis KIM
uaccacggcaccuucugau

SEQ ID NO: 2299623 - RNA, 14 nt, Yersinia pestis KIM
uaccacugcucacu

SEQ ID NO: 2299624 - RNA, 17 nt, Yersinia pestis KIM
uacauaaguaagugauu

SEQ ID NO: 2299625 - RNA, 22 nt, Yersinia pestis KIM
uacauaaucuuuacugcauuga

SEQ ID NO: 2299626 - RNA, 23 nt, Yersinia pestis KIM
uacauaaaccgugugcuuccacc

SEQ ID NO: 2299627 - RNA, 22 nt, Yersinia pestis KIM
uacauagaagcucauaugcagc

SEQ ID NO: 2299628 - RNA, 16 nt, Yersinia pestis KIM
uacauagaagcucaua

SEQ ID NO: 2299629 - RNA, 22 nt, Yersinia pestis KIM
uacauaccacuuaguggcauug

SEQ ID NO: 2299630 - RNA, 15 nt, Yersinia pestis KIM
uacauagaaaauaau

SEQ ID NO: 2299631 - RNA, 17 nt, Yersinia pestis KIM
uacauagaaaauaauau

SEQ ID NO: 2299632 - RNA, 17 nt, Yersinia pestis KIM
uaccaggaagcggccag

SEQ ID NO: 2299633 - RNA, 20 nt, Yersinia pestis KIM
uaccagcguagguacuucuc

SEQ ID NO: 2299634 - RNA, 13 nt, Yersinia pestis KIM
uacccaaaccaac

SEQ ID NO: 2299635 - RNA, 14 nt, Yersinia pestis KIM
uacccaaagucauu

SEQ ID NO: 2299636 - RNA, 22 nt, Yersinia pestis KIM
uaccauuuucagacugaaauga

SEQ ID NO: 2299637 - RNA, 20 nt, Yersinia pestis KIM
uaccauuuucagacugaaau

SEQ ID NO: 2299638 - RNA, 13 nt, Yersinia pestis KIM
uaccagcaagaau

SEQ ID NO: 2299639 - RNA, 20 nt, Yersinia pestis KIM
uaccagccgcgcccuaacag

SEQ ID NO: 2299640 - RNA, 21 nt, Yersinia pestis KIM
uacgcgucaucauauucaaug

SEQ ID NO: 2299641 - RNA, 22 nt, Yersinia pestis KIM
uacgaucuuauuaauugguauu

SEQ ID NO: 2299642 - RNA, 22 nt, Yersinia pestis KIM
uacgcauuacccuguuuuaaau

SEQ ID NO: 2299643 - RNA, 16 nt, Yersinia pestis KIM
uacgcgccgcagcagu

SEQ ID NO: 2299644 - RNA, 15 nt, Yersinia pestis KIM
uacggccagucaaaa

SEQ ID NO: 2299645 - RNA, 23 nt, Yersinia pestis KIM
uacggaucuccaguugcacacca

SEQ ID NO: 2299646 - RNA, 14 nt, Yersinia pestis KIM
uacggagaagagga

SEQ ID NO: 2299647 - RNA, 16 nt, Yersinia pestis KIM
uacgucaggaauaaag

SEQ ID NO: 2299648 - RNA, 18 nt, Yersinia pestis KIM
uacgucagaaauaaauuc

SEQ ID NO: 2299649 - RNA, 16 nt, Yersinia pestis KIM
uacguauggcaugacu

SEQ ID NO: 2299650 - RNA, 16 nt, Yersinia pestis KIM
uacggguauagcggcg

SEQ ID NO: 2299651 - RNA, 23 nt, Yersinia pestis KIM
uacgggccucgcggaaaucagcu

SEQ ID NO: 2299652 - RNA, 17 nt, Yersinia pestis KIM
uacgaucgauaguaaca

SEQ ID NO: 2299653 - RNA, 13 nt, Yersinia pestis KIM
uacgaucagcaag

SEQ ID NO: 2299654 - RNA, 18 nt, Yersinia pestis KIM
uacgaauuuuucccugcu

SEQ ID NO: 2299655 - RNA, 13 nt, Yersinia pestis KIM
uacgaacaguagc

SEQ ID NO: 2299656 - RNA, 19 nt, Yersinia pestis KIM
uacgaacaguagccccuga

SEQ ID NO: 2299657 - RNA, 15 nt, Yersinia pestis KIM
uaccuugugucacca

SEQ ID NO: 2299658 - RNA, 16 nt, Yersinia pestis KIM
uaccuuguuacucaua

SEQ ID NO: 2299659 - RNA, 18 nt, Yersinia pestis KIM
uaccuuuaaaacugguca

SEQ ID NO: 2299660 - RNA, 18 nt, Yersinia pestis KIM
uaccuuuaacuguuuuau

SEQ ID NO: 2299661 - RNA, 23 nt, Yersinia pestis KIM
uaccgguucauuuagcagcgcac

SEQ ID NO: 2299662 - RNA, 15 nt, Yersinia pestis KIM
uaccuaaccaaacau

SEQ ID NO: 2299663 - RNA, 23 nt, Yersinia pestis KIM
uaccuaaccaaacauugucaccu

SEQ ID NO: 2299664 - RNA, 18 nt, Yersinia pestis KIM
uaccuauggcgaagagaa

SEQ ID NO: 2299665 - RNA, 12 nt, Yersinia pestis KIM
uaccuauuuauu

SEQ ID NO: 2299666 - RNA, 14 nt, Yersinia pestis KIM
uaccuaggccagca

SEQ ID NO: 2299667 - RNA, 19 nt, Yersinia pestis KIM
uaccuauaaacauuuacuu

SEQ ID NO: 2299668 - RNA, 20 nt, Yersinia pestis KIM
uaccuauaaacauuuacuua

SEQ ID NO: 2299669 - RNA, 11 nt, Yersinia pestis KIM
uacaaaaagcg

SEQ ID NO: 2299670 - RNA, 19 nt, Yersinia pestis KIM
uacaaaaagcgacuaauau

SEQ ID NO: 2299671 - RNA, 22 nt, Yersinia pestis KIM
uacaaaaagcgacuaauaucag

SEQ ID NO: 2299672 - RNA, 12 nt, Yersinia pestis KIM
uaauuuuucaua

SEQ ID NO: 2299673 - RNA, 21 nt, Yersinia pestis KIM
uaauuuucgcgcaccaacucu

SEQ ID NO: 2299674 - RNA, 15 nt, Yersinia pestis KIM
uaauuuuauuaccaa

SEQ ID NO: 2299675 - RNA, 14 nt, Yersinia pestis KIM
uaauuugucaguaa

SEQ ID NO: 2299676 - RNA, 19 nt, Yersinia pestis KIM
uaauuucggaucagcgccu

SEQ ID NO: 2299677 - RNA, 18 nt, Yersinia pestis KIM
uaauuucaccacaucuug

SEQ ID NO: 2299678 - RNA, 21 nt, Yersinia pestis KIM
uaauuucacuuccauuccguu

SEQ ID NO: 2299679 - RNA, 12 nt, Yersinia pestis KIM
uaauuugccugg

SEQ ID NO: 2299680 - RNA, 14 nt, Yersinia pestis KIM
uaauuuguaaauuu

SEQ ID NO: 2299681 - RNA, 21 nt, Yersinia pestis KIM
uaauuuaaauaagauccagaa

SEQ ID NO: 2299682 - RNA, 11 nt, Yersinia pestis KIM
uaauuuaaacu

SEQ ID NO: 2299683 - RNA, 16 nt, Yersinia pestis KIM
uaauuuaaacucuuua

SEQ ID NO: 2299684 - RNA, 14 nt, Yersinia pestis KIM
uaauucucucuuuu

SEQ ID NO: 2299685 - RNA, 22 nt, Yersinia pestis KIM
uaauucgugggcauuuuuugcc

SEQ ID NO: 2299686 - RNA, 23 nt, Yersinia pestis KIM
uaauuuaucugcuaauuaaaccu

SEQ ID NO: 2299687 - RNA, 18 nt, Yersinia pestis KIM
uaauuuaucaguagucaa

SEQ ID NO: 2299688 - RNA, 23 nt, Yersinia pestis KIM
uacaccuugcagcacaccggcca

SEQ ID NO: 2299689 - RNA, 23 nt, Yersinia pestis KIM
uacacgguuaauucaugugagau

SEQ ID NO: 2299690 - RNA, 19 nt, Yersinia pestis KIM
uacacuaccuucaucugca

SEQ ID NO: 2299691 - RNA, 21 nt, Yersinia pestis KIM
uacacgugagaauugcugcuu

SEQ ID NO: 2299692 - RNA, 18 nt, Yersinia pestis KIM
uacagcauauaaaaaagc

SEQ ID NO: 2299693 - RNA, 20 nt, Yersinia pestis KIM
uacagcagggauucugucag

SEQ ID NO: 2299694 - RNA, 15 nt, Yersinia pestis KIM
uacagcagguggcug

SEQ ID NO: 2299695 - RNA, 12 nt, Yersinia pestis KIM
uacagcaccauu

SEQ ID NO: 2299696 - RNA, 14 nt, Yersinia pestis KIM
uacagcaccauuca

SEQ ID NO: 2299697 - RNA, 15 nt, Yersinia pestis KIM
uacagugaucauggg

SEQ ID NO: 2299698 - RNA, 15 nt, Yersinia pestis KIM
uacagugauaaauuu

SEQ ID NO: 2299699 - RNA, 19 nt, Yersinia pestis KIM
uacaguuccuguuuuugaa

SEQ ID NO: 2299700 - RNA, 14 nt, Yersinia pestis KIM
uacauaaaaucaau

SEQ ID NO: 2299701 - RNA, 16 nt, Yersinia pestis KIM
uacaguaaggcagcaa

SEQ ID NO: 2299702 - RNA, 15 nt, Yersinia pestis KIM
uacagcucaucacca

SEQ ID NO: 2299703 - RNA, 15 nt, Yersinia pestis KIM
uacagcgucaguaca

SEQ ID NO: 2299704 - RNA, 15 nt, Yersinia pestis KIM
uacaggauuaaauaa

SEQ ID NO: 2299705 - RNA, 14 nt, Yersinia pestis KIM
uacaccauguucuu

SEQ ID NO: 2299706 - RNA, 23 nt, Yersinia pestis KIM
uacaccaccgccgcaacaauaaa

SEQ ID NO: 2299707 - RNA, 16 nt, Yersinia pestis KIM
uacacagucuuuuucc

SEQ ID NO: 2299708 - RNA, 14 nt, Yersinia pestis KIM
uacaccuuaaaaca

SEQ ID NO: 2299709 - RNA, 14 nt, Yersinia pestis KIM
uacaccccaucagc

SEQ ID NO: 2299710 - RNA, 22 nt, Yersinia pestis KIM
uacaccgauaaaagugaccaca

SEQ ID NO: 2299711 - RNA, 16 nt, Yersinia pestis KIM
uacaaaccguuugccg

SEQ ID NO: 2299712 - RNA, 22 nt, Yersinia pestis KIM
uacaaacgcguuaauuaagacc

SEQ ID NO: 2299713 - RNA, 22 nt, Yersinia pestis KIM
uacaacuucuucauaacgcuuu

SEQ ID NO: 2299714 - RNA, 17 nt, Yersinia pestis KIM
uacaacuucuucauaac

SEQ ID NO: 2299715 - RNA, 20 nt, Yersinia pestis KIM
uacaagugccaaauggaaua

SEQ ID NO: 2299716 - RNA, 15 nt, Yersinia pestis KIM
uacaagacaagcccg

SEQ ID NO: 2299717 - RNA, 13 nt, Yersinia pestis KIM
uacaagacaauau

SEQ ID NO: 2299718 - RNA, 18 nt, Yersinia pestis KIM
uacaagacaauauguuua

SEQ ID NO: 2299719 - RNA, 11 nt, Yersinia pestis KIM
uaauccaaggc

SEQ ID NO: 2299720 - RNA, 20 nt, Yersinia pestis KIM
uaauccgaccaccacugcau

SEQ ID NO: 2299721 - RNA, 23 nt, Yersinia pestis KIM
uaaucaugggguuuauugguuau

SEQ ID NO: 2299722 - RNA, 20 nt, Yersinia pestis KIM
uaaucauuuguuucucaccg

SEQ ID NO: 2299723 - RNA, 22 nt, Yersinia pestis KIM
uaaucauuggcaacuuaagcau

SEQ ID NO: 2299724 - RNA, 23 nt, Yersinia pestis KIM
uaaucauuggcaacuuaagcauu

SEQ ID NO: 2299725 - RNA, 23 nt, Yersinia pestis KIM
uaaucacgauacgacuucuuauu

SEQ ID NO: 2299726 - RNA, 21 nt, Yersinia pestis KIM
uaaucagaggugaaaaaauau

SEQ ID NO: 2299727 - RNA, 15 nt, Yersinia pestis KIM
uaauauugaauaacc

SEQ ID NO: 2299728 - RNA, 16 nt, Yersinia pestis KIM
uaauauuuauaaaaaa

SEQ ID NO: 2299729 - RNA, 17 nt, Yersinia pestis KIM
uaauauuuccguggguu

SEQ ID NO: 2299730 - RNA, 14 nt, Yersinia pestis KIM
uaauauuuauaaaa

SEQ ID NO: 2299731 - RNA, 17 nt, Yersinia pestis KIM
uaacguugcaaaugcua

SEQ ID NO: 2299732 - RNA, 23 nt, Yersinia pestis KIM
uaacguguccccgagaggcuauu

SEQ ID NO: 2299733 - RNA, 21 nt, Yersinia pestis KIM
uaauaguuaaucgcagcagag

SEQ ID NO: 2299734 - RNA, 16 nt, Yersinia pestis KIM
uaauaguucauuuugu

SEQ ID NO: 2299735 - RNA, 13 nt, Yersinia pestis KIM
uaauaucagcgau

SEQ ID NO: 2299736 - RNA, 18 nt, Yersinia pestis KIM
uaauaucagucgcuuuuu

SEQ ID NO: 2299737 - RNA, 12 nt, Yersinia pestis KIM
uaauaucaccau

SEQ ID NO: 2299738 - RNA, 16 nt, Yersinia pestis KIM
uaauaucaacagaacu

SEQ ID NO: 2299739 - RNA, 14 nt, Yersinia pestis KIM
uaauauauuuaauu

SEQ ID NO: 2299740 - RNA, 11 nt, Yersinia pestis KIM
uaauaucugcc

SEQ ID NO: 2299741 - RNA, 16 nt, Yersinia pestis KIM
uaauaucgguaaaaaa

SEQ ID NO: 2299742 - RNA, 16 nt, Yersinia pestis KIM
uaauaucgacuccuuu

SEQ ID NO: 2299743 - RNA, 15 nt, Yersinia pestis KIM
uaauauaccaacucu

SEQ ID NO: 2299744 - RNA, 16 nt, Yersinia pestis KIM
uaauggcauuuuucgc

SEQ ID NO: 2299745 - RNA, 17 nt, Yersinia pestis KIM
uaauggcgcacauuaca

SEQ ID NO: 2299746 - RNA, 14 nt, Yersinia pestis KIM
uaauggccuaaauu

SEQ ID NO: 2299747 - RNA, 19 nt, Yersinia pestis KIM
uaauggugcuauuucuggc

SEQ ID NO: 2299748 - RNA, 22 nt, Yersinia pestis KIM
uaauggguuagcgguuaaaaac

SEQ ID NO: 2299749 - RNA, 22 nt, Yersinia pestis KIM
uaauuaauucaaucggcagauu

SEQ ID NO: 2299750 - RNA, 14 nt, Yersinia pestis KIM
uaauuaauuauuca

SEQ ID NO: 2299751 - RNA, 14 nt, Yersinia pestis KIM
uaauuaauuuaaac

SEQ ID NO: 2299752 - RNA, 15 nt, Yersinia pestis KIM
uaauuaauuaugaua

SEQ ID NO: 2299753 - RNA, 13 nt, Yersinia pestis KIM
uaauuauuucucu

SEQ ID NO: 2299754 - RNA, 15 nt, Yersinia pestis KIM
uaauuaugauaaaug

SEQ ID NO: 2299755 - RNA, 16 nt, Yersinia pestis KIM
uaauuaugauaaaugg

SEQ ID NO: 2299756 - RNA, 17 nt, Yersinia pestis KIM
uaauuaucgauaaauaa

SEQ ID NO: 2299757 - RNA, 19 nt, Yersinia pestis KIM
uaauucaguuaauagggcu

SEQ ID NO: 2299758 - RNA, 16 nt, Yersinia pestis KIM
uaauucaggcaaauuc

SEQ ID NO: 2299759 - RNA, 23 nt, Yersinia pestis KIM
uaauucacgucgccgguggcuga

SEQ ID NO: 2299760 - RNA, 15 nt, Yersinia pestis KIM
uaauucaccuaaucu

SEQ ID NO: 2299761 - RNA, 12 nt, Yersinia pestis KIM
uaaugcggcucu

SEQ ID NO: 2299762 - RNA, 21 nt, Yersinia pestis KIM
uaaugcgcgcagcaagcugag

SEQ ID NO: 2299763 - RNA, 21 nt, Yersinia pestis KIM
uaaugccgaaugauucauuga

SEQ ID NO: 2299764 - RNA, 20 nt, Yersinia pestis KIM
uaaugccgcugaucaggaag

SEQ ID NO: 2299765 - RNA, 14 nt, Yersinia pestis KIM
uaaugccacacuca

SEQ ID NO: 2299766 - RNA, 24 nt, Yersinia pestis KIM
uaaugcacgucaguuaaauaugac

SEQ ID NO: 2299767 - RNA, 23 nt, Yersinia pestis KIM
uaaugcaauuuuggaauagcugu

SEQ ID NO: 2299768 - RNA, 16 nt, Yersinia pestis KIM
uaaugcaauggcucca

SEQ ID NO: 2299769 - RNA, 20 nt, Yersinia pestis KIM
uaaugcagguucauuacaca

SEQ ID NO: 2299770 - RNA, 15 nt, Yersinia pestis KIM
uaaugcauuccccug

SEQ ID NO: 2299771 - RNA, 21 nt, Yersinia pestis KIM
uaaugauguaguguguuuucu

SEQ ID NO: 2299772 - RNA, 23 nt, Yersinia pestis KIM
uaaugauugauuaucaaguuaaa

SEQ ID NO: 2299773 - RNA, 19 nt, Yersinia pestis KIM
uaaugauuauugaccagau

SEQ ID NO: 2299774 - RNA, 17 nt, Yersinia pestis KIM
uaaugaacaaauaucgg

SEQ ID NO: 2299775 - RNA, 19 nt, Yersinia pestis KIM
uaaugaacgaguaaaaaga

SEQ ID NO: 2299776 - RNA, 20 nt, Yersinia pestis KIM
uaaugagccgcauugauccu

SEQ ID NO: 2299777 - RNA, 13 nt, Yersinia pestis KIM
uaaugagcguuau

SEQ ID NO: 2299778 - RNA, 20 nt, Yersinia pestis KIM
uaaugagcguuauuauuagu

SEQ ID NO: 2299779 - RNA, 14 nt, Yersinia pestis KIM
uaaugacauaauca

SEQ ID NO: 2299780 - RNA, 15 nt, Yersinia pestis KIM
uaaugacauaaucag

SEQ ID NO: 2299781 - RNA, 17 nt, Yersinia pestis KIM
uaaugagaaucaaucaa

SEQ ID NO: 2299782 - RNA, 22 nt, Yersinia pestis KIM
uaaugagauuaauucaaaaauu

SEQ ID NO: 2299783 - RNA, 21 nt, Yersinia pestis KIM
ggccacggcucacacacuaau

SEQ ID NO: 2299784 - RNA, 18 nt, Yersinia pestis KIM
ggccacccugccaaaaaa

SEQ ID NO: 2299785 - RNA, 19 nt, Yersinia pestis KIM
ggccacccugccaaaaaau

SEQ ID NO: 2299786 - RNA, 14 nt, Yersinia pestis KIM
ggccacccccauaa

SEQ ID NO: 2299787 - RNA, 17 nt, Yersinia pestis KIM
ggccaccacgaaaaaau

SEQ ID NO: 2299788 - RNA, 14 nt, Yersinia pestis KIM
ggcauuaaacugaa

SEQ ID NO: 2299789 - RNA, 14 nt, Yersinia pestis KIM
ggccaccacgaaaa

SEQ ID NO: 2299790 - RNA, 20 nt, Yersinia pestis KIM
ggcauguucacaucggucaa

SEQ ID NO: 2299791 - RNA, 15 nt, Yersinia pestis KIM
ggcaugugggcaggg

SEQ ID NO: 2299792 - RNA, 16 nt, Yersinia pestis KIM
ggcaugugggcagggc

SEQ ID NO: 2299793 - RNA, 21 nt, Yersinia pestis KIM
ggccaguuuccacgaaggcac

SEQ ID NO: 2299794 - RNA, 17 nt, Yersinia pestis KIM
ggccaguugccacucau

SEQ ID NO: 2299795 - RNA, 15 nt, Yersinia pestis KIM
ggccauguuggucaa

SEQ ID NO: 2299796 - RNA, 23 nt, Yersinia pestis KIM
ggccauugaacauaacuuugcca

SEQ ID NO: 2299797 - RNA, 18 nt, Yersinia pestis KIM
ggccgauggaaccacauc

SEQ ID NO: 2299798 - RNA, 22 nt, Yersinia pestis KIM
ggcccuccucucucuggggagg

SEQ ID NO: 2299799 - RNA, 11 nt, Yersinia pestis KIM
ggcccggcaug

SEQ ID NO: 2299800 - RNA, 13 nt, Yersinia pestis KIM
ggcccgcuaguga

SEQ ID NO: 2299801 - RNA, 14 nt, Yersinia pestis KIM
ggcccgcuagugau

SEQ ID NO: 2299802 - RNA, 19 nt, Yersinia pestis KIM
ggccccaauccaccacuga

SEQ ID NO: 2299803 - RNA, 19 nt, Yersinia pestis KIM
ggcccgaugguuucuccac

SEQ ID NO: 2299804 - RNA, 23 nt, Yersinia pestis KIM
ggcagacauuccgucagcaugaa

SEQ ID NO: 2299805 - RNA, 20 nt, Yersinia pestis KIM
ggcagauuggauugaaauca

SEQ ID NO: 2299806 - RNA, 21 nt, Yersinia pestis KIM
ggcagauaugccaggcaucau

SEQ ID NO: 2299807 - RNA, 16 nt, Yersinia pestis KIM
ggcagacucgacagca

SEQ ID NO: 2299808 - RNA, 16 nt, Yersinia pestis KIM
ggcagcacagagcaca

SEQ ID NO: 2299809 - RNA, 21 nt, Yersinia pestis KIM
ggcacaucuccagaauauaaa

SEQ ID NO: 2299810 - RNA, 17 nt, Yersinia pestis KIM
ggcaccacggucagaga

SEQ ID NO: 2299811 - RNA, 17 nt, Yersinia pestis KIM
ggcacaccgcuacaggc

SEQ ID NO: 2299812 - RNA, 15 nt, Yersinia pestis KIM
ggcaaacuccuccaa

SEQ ID NO: 2299813 - RNA, 22 nt, Yersinia pestis KIM
ggcaaagaauugagguaaacca

SEQ ID NO: 2299814 - RNA, 17 nt, Yersinia pestis KIM
ggcaccaugcccauaca

SEQ ID NO: 2299815 - RNA, 14 nt, Yersinia pestis KIM
ggcagcgagcacug

SEQ ID NO: 2299816 - RNA, 15 nt, Yersinia pestis KIM
ggcagcgacaaccug

SEQ ID NO: 2299817 - RNA, 16 nt, Yersinia pestis KIM
ggcagcgacaaccugu

SEQ ID NO: 2299818 - RNA, 17 nt, Yersinia pestis KIM
ggcagccugcggcggcu

SEQ ID NO: 2299819 - RNA, 14 nt, Yersinia pestis KIM
ggcagcguaggcaa

SEQ ID NO: 2299820 - RNA, 18 nt, Yersinia pestis KIM
ggcaggcccgcuucccua

SEQ ID NO: 2299821 - RNA, 12 nt, Yersinia pestis KIM
ggcaggccccau

SEQ ID NO: 2299822 - RNA, 17 nt, Yersinia pestis KIM
ggcaggccccaucauaa

SEQ ID NO: 2299823 - RNA, 15 nt, Yersinia pestis KIM
ggcagcuugaagccu

SEQ ID NO: 2299824 - RNA, 16 nt, Yersinia pestis KIM
ggcagcuuggggaugg

SEQ ID NO: 2299825 - RNA, 16 nt, Yersinia pestis KIM
ggcaugcauuggaaaa

SEQ ID NO: 2299826 - RNA, 13 nt, Yersinia pestis KIM
ggcagucacugcu

SEQ ID NO: 2299827 - RNA, 18 nt, Yersinia pestis KIM
ggcaguauuuuaagaaaa

SEQ ID NO: 2299828 - RNA, 21 nt, Yersinia pestis KIM
ggcauaaucaacgcucaauca

SEQ ID NO: 2299829 - RNA, 18 nt, Yersinia pestis KIM
ggcauaacugaauacuuu

SEQ ID NO: 2299830 - RNA, 19 nt, Yersinia pestis KIM
ggacuaauacggguuucug

SEQ ID NO: 2299831 - RNA, 20 nt, Yersinia pestis KIM
ggacuaauacggguuucugc

SEQ ID NO: 2299832 - RNA, 15 nt, Yersinia pestis KIM
ggacgcuuuacuccu

SEQ ID NO: 2299833 - RNA, 22 nt, Yersinia pestis KIM
ggacggaugguaaagcagguag

SEQ ID NO: 2299834 - RNA, 15 nt, Yersinia pestis KIM
ggacaggcuccuccu

SEQ ID NO: 2299835 - RNA, 15 nt, Yersinia pestis KIM
ggagcaagugcuuca

SEQ ID NO: 2299836 - RNA, 17 nt, Yersinia pestis KIM
ggagauuucagacugcu

SEQ ID NO: 2299837 - RNA, 15 nt, Yersinia pestis KIM
ggagaggagauuaga

SEQ ID NO: 2299838 - RNA, 14 nt, Yersinia pestis KIM
ggagagaacaggca

SEQ ID NO: 2299839 - RNA, 15 nt, Yersinia pestis KIM
ggagagaaauaggca

SEQ ID NO: 2299840 - RNA, 18 nt, Yersinia pestis KIM
ggagagcagggcccgcca

SEQ ID NO: 2299841 - RNA, 14 nt, Yersinia pestis KIM
ggagaauagugggg

SEQ ID NO: 2299842 - RNA, 12 nt, Yersinia pestis KIM
ggagcguacacg

SEQ ID NO: 2299843 - RNA, 11 nt, Yersinia pestis KIM
ggagccaauag

SEQ ID NO: 2299844 - RNA, 19 nt, Yersinia pestis KIM
ggagccaauagaggcuccc

SEQ ID NO: 2299845 - RNA, 23 nt, Yersinia pestis KIM
ggagccaaguguccgcgccauaa

SEQ ID NO: 2299846 - RNA, 13 nt, Yersinia pestis KIM
ggauaaccuauua

SEQ ID NO: 2299847 - RNA, 21 nt, Yersinia pestis KIM
ggauaaccuccgcuuuaaccu

SEQ ID NO: 2299848 - RNA, 19 nt, Yersinia pestis KIM
ggauaacguuucagggugg

SEQ ID NO: 2299849 - RNA, 17 nt, Yersinia pestis KIM
ggaguuugagaccccca

SEQ ID NO: 2299850 - RNA, 18 nt, Yersinia pestis KIM
ggaguuugagacccccaa

SEQ ID NO: 2299851 - RNA, 17 nt, Yersinia pestis KIM
ggcaaaauaaucggcaa

SEQ ID NO: 2299852 - RNA, 12 nt, Yersinia pestis KIM
ggcaaaaugauc

SEQ ID NO: 2299853 - RNA, 14 nt, Yersinia pestis KIM
ggauucuugcugca

SEQ ID NO: 2299854 - RNA, 14 nt, Yersinia pestis KIM
ggauugaaaucaga

SEQ ID NO: 2299855 - RNA, 16 nt, Yersinia pestis KIM
ggauugcaaauccguc

SEQ ID NO: 2299856 - RNA, 15 nt, Yersinia pestis KIM
ggauugccaaaugca

SEQ ID NO: 2299857 - RNA, 18 nt, Yersinia pestis KIM
ggcaaaacguauaaaagc

SEQ ID NO: 2299858 - RNA, 22 nt, Yersinia pestis KIM
ggauguguggcagucacugcug

SEQ ID NO: 2299859 - RNA, 14 nt, Yersinia pestis KIM
ggaugaaaagagcu

SEQ ID NO: 2299860 - RNA, 15 nt, Yersinia pestis KIM
ggaugaaaagagcuu

SEQ ID NO: 2299861 - RNA, 19 nt, Yersinia pestis KIM
ggaugccuuguuucuggca

SEQ ID NO: 2299862 - RNA, 19 nt, Yersinia pestis KIM
ggaugcgcuuguuagcugc

SEQ ID NO: 2299863 - RNA, 14 nt, Yersinia pestis KIM
ggauccauaggauc

SEQ ID NO: 2299864 - RNA, 19 nt, Yersinia pestis KIM
ggaucaugaaaaaugagca

SEQ ID NO: 2299865 - RNA, 15 nt, Yersinia pestis KIM
ggaucaggccagaga

SEQ ID NO: 2299866 - RNA, 16 nt, Yersinia pestis KIM
ggaucaggaucaccag

SEQ ID NO: 2299867 - RNA, 18 nt, Yersinia pestis KIM
ggauauucacguuuuucc

SEQ ID NO: 2299868 - RNA, 20 nt, Yersinia pestis KIM
ggauauuaucugguuggcau

SEQ ID NO: 2299869 - RNA, 15 nt, Yersinia pestis KIM
ggauaucuucaauca

SEQ ID NO: 2299870 - RNA, 20 nt, Yersinia pestis KIM
ggauaugacuaaacugauca

SEQ ID NO: 2299871 - RNA, 17 nt, Yersinia pestis KIM
ggauaaucuaggccugg

SEQ ID NO: 2299872 - RNA, 16 nt, Yersinia pestis KIM
ggauaaggugaugaau

SEQ ID NO: 2299873 - RNA, 13 nt, Yersinia pestis KIM
ggauaauuucagc

SEQ ID NO: 2299874 - RNA, 16 nt, Yersinia pestis KIM
ggauauagagauaaaa

SEQ ID NO: 2299875 - RNA, 16 nt, Yersinia pestis KIM
ggaagggugcggcuug

SEQ ID NO: 2299876 - RNA, 18 nt, Yersinia pestis KIM
ggaaucagcguuuuauuc

SEQ ID NO: 2299877 - RNA, 15 nt, Yersinia pestis KIM
ggaauccccauggcu

SEQ ID NO: 2299878 - RNA, 14 nt, Yersinia pestis KIM
ggaaugcuauauuu

SEQ ID NO: 2299879 - RNA, 14 nt, Yersinia pestis KIM
ggaauucuuuggca

SEQ ID NO: 2299880 - RNA, 19 nt, Yersinia pestis KIM
ggaauugugucaucgcgga

SEQ ID NO: 2299881 - RNA, 12 nt, Yersinia pestis KIM
ggaauuaauauc

SEQ ID NO: 2299882 - RNA, 21 nt, Yersinia pestis KIM
ggaauuaagaagccucaugaa

SEQ ID NO: 2299883 - RNA, 13 nt, Yersinia pestis KIM
ggaagcggccagg

SEQ ID NO: 2299884 - RNA, 15 nt, Yersinia pestis KIM
ggaagcaagaaacug

SEQ ID NO: 2299885 - RNA, 21 nt, Yersinia pestis KIM
ggaacgucugcaauagcucau

SEQ ID NO: 2299886 - RNA, 16 nt, Yersinia pestis KIM
ggaacguugcacccug

SEQ ID NO: 2299887 - RNA, 15 nt, Yersinia pestis KIM
ggaacggacauuuag

SEQ ID NO: 2299888 - RNA, 20 nt, Yersinia pestis KIM
ggaacggacauuuagcacug

SEQ ID NO: 2299889 - RNA, 22 nt, Yersinia pestis KIM
ggaacgguugcccguuaauauu

SEQ ID NO: 2299890 - RNA, 13 nt, Yersinia pestis KIM
ggaacuguaaaua

SEQ ID NO: 2299891 - RNA, 16 nt, Yersinia pestis KIM
ggaaaguagccauuuu

SEQ ID NO: 2299892 - RNA, 22 nt, Yersinia pestis KIM
ggaaaucgaaauuaaggaaaag

SEQ ID NO: 2299893 - RNA, 18 nt, Yersinia pestis KIM
ggaaaugccgauaaaaac

SEQ ID NO: 2299894 - RNA, 21 nt, Yersinia pestis KIM
ggaaauuugcacugcagggaa

SEQ ID NO: 2299895 - RNA, 21 nt, Yersinia pestis KIM
ggaaccgcuaaagucacacug

SEQ ID NO: 2299896 - RNA, 21 nt, Yersinia pestis KIM
ggaacccauuugcacagcauu

SEQ ID NO: 2299897 - RNA, 17 nt, Yersinia pestis KIM
ggaaacgaacagggagu

SEQ ID NO: 2299898 - RNA, 15 nt, Yersinia pestis KIM
ggaaaaaaucuuccu

SEQ ID NO: 2299899 - RNA, 11 nt, Yersinia pestis KIM
ggaaaaaauac

SEQ ID NO: 2299900 - RNA, 19 nt, Yersinia pestis KIM
ggaaaaacgugaauauccu

SEQ ID NO: 2299901 - RNA, 22 nt, Yersinia pestis KIM
gcuuuuuuuauugggaaccccu

SEQ ID NO: 2299902 - RNA, 20 nt, Yersinia pestis KIM
ggaaaaacugaaaaaggcac

SEQ ID NO: 2299903 - RNA, 14 nt, Yersinia pestis KIM
ggaaaacgccagca

SEQ ID NO: 2299904 - RNA, 23 nt, Yersinia pestis KIM
gcuuuuagggauauuucucccca

SEQ ID NO: 2299905 - RNA, 20 nt, Yersinia pestis KIM
gcuuuucauauaagcaauac

SEQ ID NO: 2299906 - RNA, 18 nt, Yersinia pestis KIM
gcuuugugggcuuuugcu

SEQ ID NO: 2299907 - RNA, 18 nt, Yersinia pestis KIM
gcuuuguuggcacugcau

SEQ ID NO: 2299908 - RNA, 19 nt, Yersinia pestis KIM
gcuuuuuauugucucuacu

SEQ ID NO: 2299909 - RNA, 15 nt, Yersinia pestis KIM
gcuuuuuguauuuuu

SEQ ID NO: 2299910 - RNA, 11 nt, Yersinia pestis KIM
gcuuuuugcug

SEQ ID NO: 2299911 - RNA, 18 nt, Yersinia pestis KIM
gcuuuucgaacugacgau

SEQ ID NO: 2299912 - RNA, 17 nt, Yersinia pestis KIM
gcuuuugcugcaaacug

SEQ ID NO: 2299913 - RNA, 19 nt, Yersinia pestis KIM
gcuuuugccucacugucuu

SEQ ID NO: 2299914 - RNA, 18 nt, Yersinia pestis KIM
gcuuuugauuuucuuacc

SEQ ID NO: 2299915 - RNA, 14 nt, Yersinia pestis KIM
gcuuuuuacccagu

SEQ ID NO: 2299916 - RNA, 18 nt, Yersinia pestis KIM
gcuuuaucgguuguccuu

SEQ ID NO: 2299917 - RNA, 16 nt, Yersinia pestis KIM
gcuuuaucgccaacac

SEQ ID NO: 2299918 - RNA, 14 nt, Yersinia pestis KIM
gcuuuaucaccagu

SEQ ID NO: 2299919 - RNA, 22 nt, Yersinia pestis KIM
gcuuucagcacgcuuuccagcu

SEQ ID NO: 2299920 - RNA, 15 nt, Yersinia pestis KIM
gcuuucaauaaaacu

SEQ ID NO: 2299921 - RNA, 14 nt, Yersinia pestis KIM
gcuuucaauaaaac

SEQ ID NO: 2299922 - RNA, 14 nt, Yersinia pestis KIM
gcuuucaucuucuu

SEQ ID NO: 2299923 - RNA, 18 nt, Yersinia pestis KIM
gcuuucagugagcauuuu

SEQ ID NO: 2299924 - RNA, 21 nt, Yersinia pestis KIM
gcuuucagugagcauuuuguu

SEQ ID NO: 2299925 - RNA, 18 nt, Yersinia pestis KIM
gcuuucggauuaaaaccu

SEQ ID NO: 2299926 - RNA, 12 nt, Yersinia pestis KIM
gcuuugcaccau

SEQ ID NO: 2299927 - RNA, 14 nt, Yersinia pestis KIM
gcuuugcaccauca

SEQ ID NO: 2299928 - RNA, 17 nt, Yersinia pestis KIM
gcuuggguaucuggagc

SEQ ID NO: 2299929 - RNA, 13 nt, Yersinia pestis KIM
gcuuggcgggcug

SEQ ID NO: 2299930 - RNA, 18 nt, Yersinia pestis KIM
gcuuggcgggcuggccac

SEQ ID NO: 2299931 - RNA, 23 nt, Yersinia pestis KIM
gcuugucaccguaaccauuggca

SEQ ID NO: 2299932 - RNA, 16 nt, Yersinia pestis KIM
gcuuguggaaauagaa

SEQ ID NO: 2299933 - RNA, 18 nt, Yersinia pestis KIM
gcuuuacugcuuuucuac

SEQ ID NO: 2299934 - RNA, 16 nt, Yersinia pestis KIM
gcuuuacugcuuuucu

SEQ ID NO: 2299935 - RNA, 14 nt, Yersinia pestis KIM
gcuuuacuccucug

SEQ ID NO: 2299936 - RNA, 17 nt, Yersinia pestis KIM
gcuuuaagcuaauucug

SEQ ID NO: 2299937 - RNA, 20 nt, Yersinia pestis KIM
gcuuuaaccuuucuaauuau

SEQ ID NO: 2299938 - RNA, 13 nt, Yersinia pestis KIM
gcuuguucuuccg

SEQ ID NO: 2299939 - RNA, 19 nt, Yersinia pestis KIM
gcuugccgguucccgccgu

SEQ ID NO: 2299940 - RNA, 18 nt, Yersinia pestis KIM
gcuugagagucgagcggg

SEQ ID NO: 2299941 - RNA, 17 nt, Yersinia pestis KIM
gcuugagcuuauaucaa

SEQ ID NO: 2299942 - RNA, 17 nt, Yersinia pestis KIM
gcuugacuaacacgacu

SEQ ID NO: 2299943 - RNA, 20 nt, Yersinia pestis KIM
gcuugcgcguuaaucugcug

SEQ ID NO: 2299944 - RNA, 16 nt, Yersinia pestis KIM
gcuugcgcgccuguuu

SEQ ID NO: 2299945 - RNA, 22 nt, Yersinia pestis KIM
gcuugccugacagccugugccc

SEQ ID NO: 2299946 - RNA, 14 nt, Yersinia pestis KIM
gcuuggcaaccgag

SEQ ID NO: 2299947 - RNA, 16 nt, Yersinia pestis KIM
gcuuggcccgauggug

SEQ ID NO: 2299948 - RNA, 18 nt, Yersinia pestis KIM
gcuucacauccaauggca

SEQ ID NO: 2299949 - RNA, 19 nt, Yersinia pestis KIM
gcuucaccgcuuuucuggu

SEQ ID NO: 2299950 - RNA, 22 nt, Yersinia pestis KIM
gcuucacccuggcucuggccag

SEQ ID NO: 2299951 - RNA, 18 nt, Yersinia pestis KIM
gcuucaucauggauaaag

SEQ ID NO: 2299952 - RNA, 19 nt, Yersinia pestis KIM
gcuuccaauauugagcagu

SEQ ID NO: 2299953 - RNA, 19 nt, Yersinia pestis KIM
gcuuacaccauguucuuca

SEQ ID NO: 2299954 - RNA, 11 nt, Yersinia pestis KIM
gcuuaaaacag

SEQ ID NO: 2299955 - RNA, 22 nt, Yersinia pestis KIM
gcuuaacauccgaauuuuuacu

SEQ ID NO: 2299956 - RNA, 19 nt, Yersinia pestis KIM
gcuuaaucuuuuuaaccac

SEQ ID NO: 2299957 - RNA, 16 nt, Yersinia pestis KIM
gcuuaguuacaauaaa

SEQ ID NO: 2299958 - RNA, 16 nt, Yersinia pestis KIM
gcuuauccagccgcuc

SEQ ID NO: 2299959 - RNA, 16 nt, Yersinia pestis KIM
gcuuccgguaaagaag

SEQ ID NO: 2299960 - RNA, 18 nt, Yersinia pestis KIM
gcuuccugcgccacgcuu

SEQ ID NO: 2299961 - RNA, 19 nt, Yersinia pestis KIM
gcuucccuguauaaaaaua

SEQ ID NO: 2299962 - RNA, 20 nt, Yersinia pestis KIM
gcuucguccagaugccaaau

SEQ ID NO: 2299963 - RNA, 15 nt, Yersinia pestis KIM
gcuucugggccaaag

SEQ ID NO: 2299964 - RNA, 14 nt, Yersinia pestis KIM
gcuucuguaauaaa

SEQ ID NO: 2299965 - RNA, 16 nt, Yersinia pestis KIM
gcuucuguaauaaagg

SEQ ID NO: 2299966 - RNA, 15 nt, Yersinia pestis KIM
gcuucugccaugguu

SEQ ID NO: 2299967 - RNA, 18 nt, Yersinia pestis KIM
gcuucuccuguaaugcau

SEQ ID NO: 2299968 - RNA, 14 nt, Yersinia pestis KIM
gcuucuaacaauaa

SEQ ID NO: 2299969 - RNA, 19 nt, Yersinia pestis KIM
gcugcagcgugauuagcag

SEQ ID NO: 2299970 - RNA, 13 nt, Yersinia pestis KIM
gcugcagcaucaa

SEQ ID NO: 2299971 - RNA, 23 nt, Yersinia pestis KIM
gcugcagccgggaugaucaacag

SEQ ID NO: 2299972 - RNA, 19 nt, Yersinia pestis KIM
gcugccagugccgccgccu

SEQ ID NO: 2299973 - RNA, 12 nt, Yersinia pestis KIM
gcugcacuuuua

SEQ ID NO: 2299974 - RNA, 19 nt, Yersinia pestis KIM
gcugcaagcguuacucggc

SEQ ID NO: 2299975 - RNA, 21 nt, Yersinia pestis KIM
gcugcaagccgcguucaaauc

SEQ ID NO: 2299976 - RNA, 19 nt, Yersinia pestis KIM
gcugcaacuccuuaccacu

SEQ ID NO: 2299977 - RNA, 21 nt, Yersinia pestis KIM
gcugcaacuccuuaccacugc

SEQ ID NO: 2299978 - RNA, 13 nt, Yersinia pestis KIM
gcugauucaacac

SEQ ID NO: 2299979 - RNA, 16 nt, Yersinia pestis KIM
gcugauucacuggcaa

SEQ ID NO: 2299980 - RNA, 14 nt, Yersinia pestis KIM
gcugauugugccuu

SEQ ID NO: 2299981 - RNA, 21 nt, Yersinia pestis KIM
gcugcccuuugcuggcaugga

SEQ ID NO: 2299982 - RNA, 17 nt, Yersinia pestis KIM
gcugcccacauaaagau

SEQ ID NO: 2299983 - RNA, 23 nt, Yersinia pestis KIM
gcugcccacauaaagauagccac

SEQ ID NO: 2299984 - RNA, 23 nt, Yersinia pestis KIM
gcugccugccugagguucccaac

SEQ ID NO: 2299985 - RNA, 16 nt, Yersinia pestis KIM
gcugccugugcggcag

SEQ ID NO: 2299986 - RNA, 20 nt, Yersinia pestis KIM
gcugccugugcggcagugaa

SEQ ID NO: 2299987 - RNA, 17 nt, Yersinia pestis KIM
gcugcgauaauccgcca

SEQ ID NO: 2299988 - RNA, 17 nt, Yersinia pestis KIM
gcuggauauaauccaaa

SEQ ID NO: 2299989 - RNA, 16 nt, Yersinia pestis KIM
gcuggaucagcagacu

SEQ ID NO: 2299990 - RNA, 13 nt, Yersinia pestis KIM
gcugcuuccugcu

SEQ ID NO: 2299991 - RNA, 23 nt, Yersinia pestis KIM
gcugcuugcgcguuaaucugcug

SEQ ID NO: 2299992 - RNA, 20 nt, Yersinia pestis KIM
gcugcuuuucagugaaaucg

SEQ ID NO: 2299993 - RNA, 12 nt, Yersinia pestis KIM
gcugcuuccugc

SEQ ID NO: 2299994 - RNA, 16 nt, Yersinia pestis KIM
gcugcuccgcccuaaa

SEQ ID NO: 2299995 - RNA, 21 nt, Yersinia pestis KIM
gcugcuaauauuuauaaaaaa

SEQ ID NO: 2299996 - RNA, 15 nt, Yersinia pestis KIM
gcugcuaaacagggu

SEQ ID NO: 2299997 - RNA, 23 nt, Yersinia pestis KIM
gcugcuaaacaggguugagccaa

SEQ ID NO: 2299998 - RNA, 18 nt, Yersinia pestis KIM
gcugcguucuuugauuug

SEQ ID NO: 2299999 - RNA, 18 nt, Yersinia pestis KIM
gcuggcgaccacuuccug

SEQ ID NO: 2300000 - RNA, 23 nt, Yersinia pestis KIM
gcuggcgauaaacacccaagaau

SEQ ID NO: 2300001 - RNA, 16 nt, Yersinia pestis KIM
gcuggcggauaaaaau

SEQ ID NO: 2300002 - RNA, 13 nt, Yersinia pestis KIM
gcuggccuaggcu

SEQ ID NO: 2300003 - RNA, 20 nt, Yersinia pestis KIM
gcuggccggcuacuggucag

SEQ ID NO: 2300004 - RNA, 18 nt, Yersinia pestis KIM
gcuggcccccaaugacac

SEQ ID NO: 2300005 - RNA, 21 nt, Yersinia pestis KIM
gcuggccaguuucgguaccau

SEQ ID NO: 2300006 - RNA, 15 nt, Yersinia pestis KIM
gcuggugaaugguca

SEQ ID NO: 2300007 - RNA, 17 nt, Yersinia pestis KIM
gcugggcguaacagccg

SEQ ID NO: 2300008 - RNA, 16 nt, Yersinia pestis KIM
gcugggaauuaagaag

SEQ ID NO: 2300009 - RNA, 20 nt, Yersinia pestis KIM
gcuggcuaauacuggcuaaa

SEQ ID NO: 2300010 - RNA, 21 nt, Yersinia pestis KIM
gcuguguuuugcuaaccgccu

SEQ ID NO: 2300011 - RNA, 21 nt, Yersinia pestis KIM
gcugugccaugucggcaggua

SEQ ID NO: 2300012 - RNA, 22 nt, Yersinia pestis KIM
gcugucggcgaugaaaaacaga

SEQ ID NO: 2300013 - RNA, 17 nt, Yersinia pestis KIM
gcuguuuugucacaaug

SEQ ID NO: 2300014 - RNA, 20 nt, Yersinia pestis KIM
gcuguuuuuuaguuaaauaa

SEQ ID NO: 2300015 - RNA, 20 nt, Yersinia pestis KIM
gcuguucagaugaucaaauu

SEQ ID NO: 2300016 - RNA, 14 nt, Yersinia pestis KIM
gcuguucaugguca

SEQ ID NO: 2300017 - RNA, 19 nt, Yersinia pestis KIM
gcuguucauggucaccaca

SEQ ID NO: 2300018 - RNA, 12 nt, Yersinia pestis KIM
gcuguuccaacc

SEQ ID NO: 2300019 - RNA, 16 nt, Yersinia pestis KIM
gcuguuaccaaacauu

SEQ ID NO: 2300020 - RNA, 16 nt, Yersinia pestis KIM
gcugucagccagcgac

SEQ ID NO: 2300021 - RNA, 21 nt, Yersinia pestis KIM
gcuguauuuuucgcaguaacg

SEQ ID NO: 2300022 - RNA, 23 nt, Yersinia pestis KIM
gcuguaugccgcucaaggagaau

SEQ ID NO: 2300023 - RNA, 16 nt, Yersinia pestis KIM
gcugguggcuugggcu

SEQ ID NO: 2300024 - RNA, 19 nt, Yersinia pestis KIM
gcugguuaucacagcaaau

SEQ ID NO: 2300025 - RNA, 20 nt, Yersinia pestis KIM
gcuguacaacaagaucccaa

SEQ ID NO: 2300026 - RNA, 13 nt, Yersinia pestis KIM
gcuguaaccgccu

SEQ ID NO: 2300027 - RNA, 21 nt, Yersinia pestis KIM
gcuguaaaggcaaagaagaau

SEQ ID NO: 2300028 - RNA, 18 nt, Yersinia pestis KIM
gcuguaaauauaaaauaa

SEQ ID NO: 2300029 - RNA, 15 nt, Yersinia pestis KIM
gcgaauaucaggcac

SEQ ID NO: 2300030 - RNA, 17 nt, Yersinia pestis KIM
gcgaagcgcacccaaaa

SEQ ID NO: 2300031 - RNA, 13 nt, Yersinia pestis KIM
gcgaagaagagau

SEQ ID NO: 2300032 - RNA, 13 nt, Yersinia pestis KIM
gcgaacaucaucc

SEQ ID NO: 2300033 - RNA, 20 nt, Yersinia pestis KIM
gcgaacagccccgcaggugg

SEQ ID NO: 2300034 - RNA, 20 nt, Yersinia pestis KIM
gccguuucaggguauaugga

SEQ ID NO: 2300035 - RNA, 17 nt, Yersinia pestis KIM
gccguuuaccuugugcg

SEQ ID NO: 2300036 - RNA, 20 nt, Yersinia pestis KIM
gccguuucagauaaaaagcc

SEQ ID NO: 2300037 - RNA, 12 nt, Yersinia pestis KIM
gccuaaacccca

SEQ ID NO: 2300038 - RNA, 14 nt, Yersinia pestis KIM
gcgaccaauucauc

SEQ ID NO: 2300039 - RNA, 23 nt, Yersinia pestis KIM
gcgaauuaucauccagauucaga

SEQ ID NO: 2300040 - RNA, 12 nt, Yersinia pestis KIM
gcgaaucccccc

SEQ ID NO: 2300041 - RNA, 23 nt, Yersinia pestis KIM
gcgaguaguugucaagagugcga

SEQ ID NO: 2300042 - RNA, 22 nt, Yersinia pestis KIM
gcgagcucucacugcuccagcc

SEQ ID NO: 2300043 - RNA, 19 nt, Yersinia pestis KIM
gcgauaaagagugaaauau

SEQ ID NO: 2300044 - RNA, 12 nt, Yersinia pestis KIM
gcgauaaaagau

SEQ ID NO: 2300045 - RNA, 13 nt, Yersinia pestis KIM
gcgaucugaaacg

SEQ ID NO: 2300046 - RNA, 12 nt, Yersinia pestis KIM
gcgauauuuauu

SEQ ID NO: 2300047 - RNA, 19 nt, Yersinia pestis KIM
gcgagaaagucaaagcgcu

SEQ ID NO: 2300048 - RNA, 20 nt, Yersinia pestis KIM
gcgagcagugauuucuuaca

SEQ ID NO: 2300049 - RNA, 13 nt, Yersinia pestis KIM
gcgagcacugccc

SEQ ID NO: 2300050 - RNA, 23 nt, Yersinia pestis KIM
gcgagcacugccccgaagcucaa

SEQ ID NO: 2300051 - RNA, 15 nt, Yersinia pestis KIM
gcgacuaauggccag

SEQ ID NO: 2300052 - RNA, 20 nt, Yersinia pestis KIM
gcgacuauagauacccacuu

SEQ ID NO: 2300053 - RNA, 15 nt, Yersinia pestis KIM
gcgacuccuggcaau

SEQ ID NO: 2300054 - RNA, 17 nt, Yersinia pestis KIM
gcgcacauagggcucgg

SEQ ID NO: 2300055 - RNA, 20 nt, Yersinia pestis KIM
gcgcaagaguuagggcugga

SEQ ID NO: 2300056 - RNA, 17 nt, Yersinia pestis KIM
gcgcaacugccauggaa

SEQ ID NO: 2300057 - RNA, 15 nt, Yersinia pestis KIM
gcgcagaguauccag

SEQ ID NO: 2300058 - RNA, 22 nt, Yersinia pestis KIM
gcgcagaugaucaacgccaaaa

SEQ ID NO: 2300059 - RNA, 23 nt, Yersinia pestis KIM
gcgcagugccgucaauuaucaaa

SEQ ID NO: 2300060 - RNA, 17 nt, Yersinia pestis KIM
gcgcauccccaucgcca

SEQ ID NO: 2300061 - RNA, 16 nt, Yersinia pestis KIM
gcgccauauauugauc

SEQ ID NO: 2300062 - RNA, 16 nt, Yersinia pestis KIM
gcgccacccauugcuc

SEQ ID NO: 2300063 - RNA, 14 nt, Yersinia pestis KIM
gcgccacaucggcg

SEQ ID NO: 2300064 - RNA, 12 nt, Yersinia pestis KIM
gcgccacaaccc

SEQ ID NO: 2300065 - RNA, 18 nt, Yersinia pestis KIM
gcgccaaugacaaagggu

SEQ ID NO: 2300066 - RNA, 14 nt, Yersinia pestis KIM
gcgccaaucgccac

SEQ ID NO: 2300067 - RNA, 19 nt, Yersinia pestis KIM
gcgccaaggauggcgcggc

SEQ ID NO: 2300068 - RNA, 20 nt, Yersinia pestis KIM
gcgccaaaacgcgcgccagu

SEQ ID NO: 2300069 - RNA, 15 nt, Yersinia pestis KIM
gcgccugugggcggc

SEQ ID NO: 2300070 - RNA, 22 nt, Yersinia pestis KIM
gcgccuccaguuuuccagagcc

SEQ ID NO: 2300071 - RNA, 17 nt, Yersinia pestis KIM
gcgcggguaauggcggu

SEQ ID NO: 2300072 - RNA, 13 nt, Yersinia pestis KIM
gcgcggcuagcca

SEQ ID NO: 2300073 - RNA, 23 nt, Yersinia pestis KIM
gcggcaaaaagcgccagaugggc

SEQ ID NO: 2300074 - RNA, 15 nt, Yersinia pestis KIM
gcggcaaauagagca

SEQ ID NO: 2300075 - RNA, 21 nt, Yersinia pestis KIM
gcggaucgacgugaagugagc

SEQ ID NO: 2300076 - RNA, 13 nt, Yersinia pestis KIM
gcggacaccaacu

SEQ ID NO: 2300077 - RNA, 18 nt, Yersinia pestis KIM
gcggacgcuuuacuccuc

SEQ ID NO: 2300078 - RNA, 23 nt, Yersinia pestis KIM
gcggacaucuuacugauacccgc

SEQ ID NO: 2300079 - RNA, 22 nt, Yersinia pestis KIM
gcgcugcugguuuuacugaaac

SEQ ID NO: 2300080 - RNA, 16 nt, Yersinia pestis KIM
gcgcuuaauucuggcc

SEQ ID NO: 2300081 - RNA, 18 nt, Yersinia pestis KIM
gcgcuuaccgucugggcu

SEQ ID NO: 2300082 - RNA, 21 nt, Yersinia pestis KIM
gcgcuucgagcccccagggaa

SEQ ID NO: 2300083 - RNA, 13 nt, Yersinia pestis KIM
gcgcuuccaggcu

SEQ ID NO: 2300084 - RNA, 16 nt, Yersinia pestis KIM
gcgcuuccagcucugg

SEQ ID NO: 2300085 - RNA, 16 nt, Yersinia pestis KIM
gcgcuugccacgccag

SEQ ID NO: 2300086 - RNA, 16 nt, Yersinia pestis KIM
gcggaaauaaggcgca

SEQ ID NO: 2300087 - RNA, 20 nt, Yersinia pestis KIM
gcggaagaaggcuagucugu

SEQ ID NO: 2300088 - RNA, 14 nt, Yersinia pestis KIM
gcguuuaaauaccc

SEQ ID NO: 2300089 - RNA, 14 nt, Yersinia pestis KIM
gcguucagcaauau

SEQ ID NO: 2300090 - RNA, 21 nt, Yersinia pestis KIM
gcguucaaucgugcacccccu

SEQ ID NO: 2300091 - RNA, 21 nt, Yersinia pestis KIM
gcgugcgggcauugaggccau

SEQ ID NO: 2300092 - RNA, 21 nt, Yersinia pestis KIM
gcgugacuauucugccuaucc

SEQ ID NO: 2300093 - RNA, 17 nt, Yersinia pestis KIM
gcgugacuauucugccu

SEQ ID NO: 2300094 - RNA, 17 nt, Yersinia pestis KIM
gcgugagcagcaccggu

SEQ ID NO: 2300095 - RNA, 19 nt, Yersinia pestis KIM
gcgucuacgggcgcuuuuc

SEQ ID NO: 2300096 - RNA, 21 nt, Yersinia pestis KIM
gcgucuacgggcgcuuuucuu

SEQ ID NO: 2300097 - RNA, 22 nt, Yersinia pestis KIM
gcgucgccugggaaugcaccca

SEQ ID NO: 2300098 - RNA, 16 nt, Yersinia pestis KIM
gcguccgcgccaagga

SEQ ID NO: 2300099 - RNA, 16 nt, Yersinia pestis KIM
gcguccgucauccaau

SEQ ID NO: 2300100 - RNA, 13 nt, Yersinia pestis KIM
gcgucgccacccc

SEQ ID NO: 2300101 - RNA, 17 nt, Yersinia pestis KIM
gcggugagggagucagg

SEQ ID NO: 2300102 - RNA, 13 nt, Yersinia pestis KIM
gcguauugaauug

SEQ ID NO: 2300103 - RNA, 22 nt, Yersinia pestis KIM
gcgucauaccauucucugucuu

SEQ ID NO: 2300104 - RNA, 17 nt, Yersinia pestis KIM
gcgucagguaaguagaa

SEQ ID NO: 2300105 - RNA, 17 nt, Yersinia pestis KIM
gcgucaguucaagcagc

SEQ ID NO: 2300106 - RNA, 12 nt, Yersinia pestis KIM
gcgggcgcgcug

SEQ ID NO: 2300107 - RNA, 13 nt, Yersinia pestis KIM
gcgguaguucagu

SEQ ID NO: 2300108 - RNA, 14 nt, Yersinia pestis KIM
gcgguagugaugca

SEQ ID NO: 2300109 - RNA, 19 nt, Yersinia pestis KIM
gcgguaguauuuguaguga

SEQ ID NO: 2300110 - RNA, 16 nt, Yersinia pestis KIM
gcgguccuacccuuug

SEQ ID NO: 2300111 - RNA, 21 nt, Yersinia pestis KIM
gcggucuggcaacugcaaaug

SEQ ID NO: 2300112 - RNA, 17 nt, Yersinia pestis KIM
gcgguacuuuuugugau

SEQ ID NO: 2300113 - RNA, 16 nt, Yersinia pestis KIM
gcggcuccaggcauua

SEQ ID NO: 2300114 - RNA, 15 nt, Yersinia pestis KIM
gcugagcgggcggca

SEQ ID NO: 2300115 - RNA, 23 nt, Yersinia pestis KIM
gcugagcauauacagcccgguau

SEQ ID NO: 2300116 - RNA, 16 nt, Yersinia pestis KIM
gcugaggggcacacuu

SEQ ID NO: 2300117 - RNA, 13 nt, Yersinia pestis KIM
gcugagguugaug

SEQ ID NO: 2300118 - RNA, 17 nt, Yersinia pestis KIM
gcugacuugcagguuca

SEQ ID NO: 2300119 - RNA, 17 nt, Yersinia pestis KIM
gcugauuaauaucaaaa

SEQ ID NO: 2300120 - RNA, 17 nt, Yersinia pestis KIM
gcugaugucauucuauc

SEQ ID NO: 2300121 - RNA, 20 nt, Yersinia pestis KIM
gcugauggucauggagagca

SEQ ID NO: 2300122 - RNA, 16 nt, Yersinia pestis KIM
gcugaugaauagagga

SEQ ID NO: 2300123 - RNA, 18 nt, Yersinia pestis KIM
gcugaugcgcccaugcca

SEQ ID NO: 2300124 - RNA, 21 nt, Yersinia pestis KIM
gcugagugaagacaucgccag

SEQ ID NO: 2300125 - RNA, 17 nt, Yersinia pestis KIM
gcugauaacuuccuuug

SEQ ID NO: 2300126 - RNA, 14 nt, Yersinia pestis KIM
gcugaucaucauca

SEQ ID NO: 2300127 - RNA, 13 nt, Yersinia pestis KIM
gcugaucaggaag

SEQ ID NO: 2300128 - RNA, 21 nt, Yersinia pestis KIM
gcugauacagcaguuccagua

SEQ ID NO: 2300129 - RNA, 17 nt, Yersinia pestis KIM
gcugauagccaauaacc

SEQ ID NO: 2300130 - RNA, 16 nt, Yersinia pestis KIM
gcugaccccaaauuug

SEQ ID NO: 2300131 - RNA, 14 nt, Yersinia pestis KIM
gcugaccacaaaaa

SEQ ID NO: 2300132 - RNA, 22 nt, Yersinia pestis KIM
gcugaccacaaaaacaguguca

SEQ ID NO: 2300133 - RNA, 13 nt, Yersinia pestis KIM
gcugacauugccc

SEQ ID NO: 2300134 - RNA, 17 nt, Yersinia pestis KIM
gcugacagagcggguuu

SEQ ID NO: 2300135 - RNA, 15 nt, Yersinia pestis KIM
gcugacaauuuacac

SEQ ID NO: 2300136 - RNA, 16 nt, Yersinia pestis KIM
gcugaauugauuuauu

SEQ ID NO: 2300137 - RNA, 16 nt, Yersinia pestis KIM
gcugaauuuuugugcu

SEQ ID NO: 2300138 - RNA, 15 nt, Yersinia pestis KIM
gcugacaaacagaua

SEQ ID NO: 2300139 - RNA, 17 nt, Yersinia pestis KIM
gcugaaucuguaaguca

SEQ ID NO: 2300140 - RNA, 13 nt, Yersinia pestis KIM
gcugaaggccugc

SEQ ID NO: 2300141 - RNA, 19 nt, Yersinia pestis KIM
gcugaauaaacggcaagcg

SEQ ID NO: 2300142 - RNA, 16 nt, Yersinia pestis KIM
gcugaacaauugccag

SEQ ID NO: 2300143 - RNA, 12 nt, Yersinia pestis KIM
gcugaaaugcua

SEQ ID NO: 2300144 - RNA, 15 nt, Yersinia pestis KIM
gcugaacuucuggga

SEQ ID NO: 2300145 - RNA, 13 nt, Yersinia pestis KIM
gcugaagacccaa

SEQ ID NO: 2300146 - RNA, 22 nt, Yersinia pestis KIM
gcucuucaccaaaggaagccga

SEQ ID NO: 2300147 - RNA, 12 nt, Yersinia pestis KIM
gcucuucaucau

SEQ ID NO: 2300148 - RNA, 16 nt, Yersinia pestis KIM
gcucuucaccaaagga

SEQ ID NO: 2300149 - RNA, 19 nt, Yersinia pestis KIM
gcucuucaucaucaaauga

SEQ ID NO: 2300150 - RNA, 22 nt, Yersinia pestis KIM
gcucuucuucacugagcagguu

SEQ ID NO: 2300151 - RNA, 12 nt, Yersinia pestis KIM
gcucuucugggc

SEQ ID NO: 2300152 - RNA, 19 nt, Yersinia pestis KIM
gcucuuuuuugaaguugua

SEQ ID NO: 2300153 - RNA, 22 nt, Yersinia pestis KIM
gcugaaaaaugagucauuaucu

SEQ ID NO: 2300154 - RNA, 23 nt, Yersinia pestis KIM
gcugaaaaauggugagaaacgug

SEQ ID NO: 2300155 - RNA, 16 nt, Yersinia pestis KIM
gcugaaaaucaugaaa

SEQ ID NO: 2300156 - RNA, 19 nt, Yersinia pestis KIM
gcucugcguuuuucccugu

SEQ ID NO: 2300157 - RNA, 13 nt, Yersinia pestis KIM
gcucugccgcagu

SEQ ID NO: 2300158 - RNA, 17 nt, Yersinia pestis KIM
gcucugcguuuuucccu

SEQ ID NO: 2300159 - RNA, 14 nt, Yersinia pestis KIM
gcucugccuguucu

SEQ ID NO: 2300160 - RNA, 12 nt, Yersinia pestis KIM
gcucugauagua

SEQ ID NO: 2300161 - RNA, 17 nt, Yersinia pestis KIM
gcucucuuuuuucucuu

SEQ ID NO: 2300162 - RNA, 21 nt, Yersinia pestis KIM
gcucugacaaaaugccagaau

SEQ ID NO: 2300163 - RNA, 15 nt, Yersinia pestis KIM
gcucucuuuuuucuc

SEQ ID NO: 2300164 - RNA, 14 nt, Yersinia pestis KIM
gcucuggucacuaa

SEQ ID NO: 2300165 - RNA, 15 nt, Yersinia pestis KIM
gcucuggcguacugu

SEQ ID NO: 2300166 - RNA, 19 nt, Yersinia pestis KIM
gcucuuacguuucauaugu

SEQ ID NO: 2300167 - RNA, 19 nt, Yersinia pestis KIM
gcucgugaucagcagacuc

SEQ ID NO: 2300168 - RNA, 14 nt, Yersinia pestis KIM
gcucguuaucugua

SEQ ID NO: 2300169 - RNA, 17 nt, Yersinia pestis KIM
gcucucucaauucaaua

SEQ ID NO: 2300170 - RNA, 15 nt, Yersinia pestis KIM
gcucuccacucgguc

SEQ ID NO: 2300171 - RNA, 16 nt, Yersinia pestis KIM
gcucucauaucccccc

SEQ ID NO: 2300172 - RNA, 20 nt, Yersinia pestis KIM
gcucucacccaauaagauaa

SEQ ID NO: 2300173 - RNA, 20 nt, Yersinia pestis KIM
gcucuaucgauaaagucauc

SEQ ID NO: 2300174 - RNA, 11 nt, Yersinia pestis KIM
gcucuacuaau

SEQ ID NO: 2300175 - RNA, 20 nt, Yersinia pestis KIM
gcucuacaacguccagaaca

SEQ ID NO: 2300176 - RNA, 21 nt, Yersinia pestis KIM
gcucuacacaggcguaauaug

SEQ ID NO: 2300177 - RNA, 21 nt, Yersinia pestis KIM
gcucccguaaacguucugcca

SEQ ID NO: 2300178 - RNA, 20 nt, Yersinia pestis KIM
gcuccccccgugauaugcaa

SEQ ID NO: 2300179 - RNA, 15 nt, Yersinia pestis KIM
gcucccgcacucugu

SEQ ID NO: 2300180 - RNA, 17 nt, Yersinia pestis KIM
gcucgagccgcgccauc

SEQ ID NO: 2300181 - RNA, 18 nt, Yersinia pestis KIM
gcuccuuacuauuuucau

SEQ ID NO: 2300182 - RNA, 22 nt, Yersinia pestis KIM
gcucccaaggguauaacucauc

SEQ ID NO: 2300183 - RNA, 21 nt, Yersinia pestis KIM
gcuccauuuuuugugcccaga

SEQ ID NO: 2300184 - RNA, 14 nt, Yersinia pestis KIM
gcucaucgguacca

SEQ ID NO: 2300185 - RNA, 21 nt, Yersinia pestis KIM
gcucauguucgcacugcucug

SEQ ID NO: 2300186 - RNA, 17 nt, Yersinia pestis KIM
gcucauguucauguuca

SEQ ID NO: 2300187 - RNA, 14 nt, Yersinia pestis KIM
gcuaucuguuaucu

SEQ ID NO: 2300188 - RNA, 19 nt, Yersinia pestis KIM
gcuaucuguuaucugguua

SEQ ID NO: 2300189 - RNA, 18 nt, Yersinia pestis KIM
gcuaucuuaugacgcugc

SEQ ID NO: 2300190 - RNA, 11 nt, Yersinia pestis KIM
gcuaucugcug

SEQ ID NO: 2300191 - RNA, 16 nt, Yersinia pestis KIM
gcuaucugugucagua

SEQ ID NO: 2300192 - RNA, 17 nt, Yersinia pestis KIM
gcuauccgcgccgagcg

SEQ ID NO: 2300193 - RNA, 14 nt, Yersinia pestis KIM
gcuauccaccaucg

SEQ ID NO: 2300194 - RNA, 17 nt, Yersinia pestis KIM
gcuaucacgauaaucaa

SEQ ID NO: 2300195 - RNA, 20 nt, Yersinia pestis KIM
gcuaucaucaaaggcaauac

SEQ ID NO: 2300196 - RNA, 19 nt, Yersinia pestis KIM
gcuauauacccgucauaaa

SEQ ID NO: 2300197 - RNA, 20 nt, Yersinia pestis KIM
gcuagaauaaguugaugcag

SEQ ID NO: 2300198 - RNA, 14 nt, Yersinia pestis KIM
gcuagccccaauca

SEQ ID NO: 2300199 - RNA, 23 nt, Yersinia pestis KIM
gcuagccaccucacucagcgacu

SEQ ID NO: 2300200 - RNA, 15 nt, Yersinia pestis KIM
gcuaguuugacgcug

SEQ ID NO: 2300201 - RNA, 16 nt, Yersinia pestis KIM
gcucaccuuucaacaa

SEQ ID NO: 2300202 - RNA, 23 nt, Yersinia pestis KIM
gcucaagggcacaguuuaucucg

SEQ ID NO: 2300203 - RNA, 12 nt, Yersinia pestis KIM
gcucaagcuggc

SEQ ID NO: 2300204 - RNA, 10 nt, Yersinia pestis KIM
gcucaacaug

SEQ ID NO: 2300205 - RNA, 18 nt, Yersinia pestis KIM
gcuauugaacauucaucu

SEQ ID NO: 2300206 - RNA, 20 nt, Yersinia pestis KIM
gcuauugaccgaugacuaac

SEQ ID NO: 2300207 - RNA, 11 nt, Yersinia pestis KIM
gcuauuuaucg

SEQ ID NO: 2300208 - RNA, 20 nt, Yersinia pestis KIM
gcuauugaugucuaaugaca

SEQ ID NO: 2300209 - RNA, 12 nt, Yersinia pestis KIM
gcuauuucucuc

SEQ ID NO: 2300210 - RNA, 16 nt, Yersinia pestis KIM
gcuauuucucucuacu

SEQ ID NO: 2300211 - RNA, 15 nt, Yersinia pestis KIM
gcuaugcuaaaaaac

SEQ ID NO: 2300212 - RNA, 23 nt, Yersinia pestis KIM
gcuauggguaauccccaccaaca

SEQ ID NO: 2300213 - RNA, 16 nt, Yersinia pestis KIM
gcuaugugaaugcagu

SEQ ID NO: 2300214 - RNA, 17 nt, Yersinia pestis KIM
gcuauuaaacauuuaug

SEQ ID NO: 2300215 - RNA, 14 nt, Yersinia pestis KIM
gcuauuaagaaacc

SEQ ID NO: 2300216 - RNA, 19 nt, Yersinia pestis KIM
gcccacauaaagauagcca

SEQ ID NO: 2300217 - RNA, 22 nt, Yersinia pestis KIM
gcccacagggugagucucaggg

SEQ ID NO: 2300218 - RNA, 18 nt, Yersinia pestis KIM
gcccacauuuagggcaga

SEQ ID NO: 2300219 - RNA, 16 nt, Yersinia pestis KIM
gcccaauaagugaaac

SEQ ID NO: 2300220 - RNA, 22 nt, Yersinia pestis KIM
gcccaaggcgacuuugaugcca

SEQ ID NO: 2300221 - RNA, 23 nt, Yersinia pestis KIM
gcccaagauacuggaagaaaccc

SEQ ID NO: 2300222 - RNA, 21 nt, Yersinia pestis KIM
gcccaauacggcacucaaaua

SEQ ID NO: 2300223 - RNA, 21 nt, Yersinia pestis KIM
gccauuugaacaaaccccacu

SEQ ID NO: 2300224 - RNA, 12 nt, Yersinia pestis KIM
gccauugcucau

SEQ ID NO: 2300225 - RNA, 19 nt, Yersinia pestis KIM
gccauuggcaaaggccagc

SEQ ID NO: 2300226 - RNA, 20 nt, Yersinia pestis KIM
gccauuucaccaauauguuc

SEQ ID NO: 2300227 - RNA, 16 nt, Yersinia pestis KIM
gccauuucaaaacgcc

SEQ ID NO: 2300228 - RNA, 16 nt, Yersinia pestis KIM
gcccaaaugagcagca

SEQ ID NO: 2300229 - RNA, 17 nt, Yersinia pestis KIM
gcccagacgccggccgg

SEQ ID NO: 2300230 - RNA, 16 nt, Yersinia pestis KIM
gcccagacucaaaaua

SEQ ID NO: 2300231 - RNA, 16 nt, Yersinia pestis KIM
gcccagaucauccaga

SEQ ID NO: 2300232 - RNA, 14 nt, Yersinia pestis KIM
gcccagcaggcugu

SEQ ID NO: 2300233 - RNA, 17 nt, Yersinia pestis KIM
gccagucaaaagaaacu

SEQ ID NO: 2300234 - RNA, 19 nt, Yersinia pestis KIM
gccagucauucaucaccuu

SEQ ID NO: 2300235 - RNA, 22 nt, Yersinia pestis KIM
gccauccuucaagaugcagggc

SEQ ID NO: 2300236 - RNA, 21 nt, Yersinia pestis KIM
gccauccuucagacugcugac

SEQ ID NO: 2300237 - RNA, 20 nt, Yersinia pestis KIM
gccaucaucuucaaccugga

SEQ ID NO: 2300238 - RNA, 16 nt, Yersinia pestis KIM
gccaucaggcaaaagc

SEQ ID NO: 2300239 - RNA, 18 nt, Yersinia pestis KIM
gccauuaauuggccggga

SEQ ID NO: 2300240 - RNA, 19 nt, Yersinia pestis KIM
gccauguuggucaagcggg

SEQ ID NO: 2300241 - RNA, 14 nt, Yersinia pestis KIM
gccaugucacuguu

SEQ ID NO: 2300242 - RNA, 21 nt, Yersinia pestis KIM
gccauguguuuguuuggauaa

SEQ ID NO: 2300243 - RNA, 23 nt, Yersinia pestis KIM
gccauguguuuguuuggauaaaa

SEQ ID NO: 2300244 - RNA, 23 nt, Yersinia pestis KIM
gccauucagcguuuuauuuggcu

SEQ ID NO: 2300245 - RNA, 20 nt, Yersinia pestis KIM
gccauugccgaaccugcaug

SEQ ID NO: 2300246 - RNA, 21 nt, Yersinia pestis KIM
gccauugaguaaguucgucag

SEQ ID NO: 2300247 - RNA, 21 nt, Yersinia pestis KIM
gccauggcgaaaauccuucau

SEQ ID NO: 2300248 - RNA, 16 nt, Yersinia pestis KIM
gccaugggucauuaau

SEQ ID NO: 2300249 - RNA, 20 nt, Yersinia pestis KIM
gccauggaauuuaugcacca

SEQ ID NO: 2300250 - RNA, 16 nt, Yersinia pestis KIM
gccaugaaucaaauua

SEQ ID NO: 2300251 - RNA, 12 nt, Yersinia pestis KIM
gccaugagaacc

SEQ ID NO: 2300252 - RNA, 20 nt, Yersinia pestis KIM
gccaugagaaccaguucugg

SEQ ID NO: 2300253 - RNA, 19 nt, Yersinia pestis KIM
gccaucuuguucuaauaau

SEQ ID NO: 2300254 - RNA, 11 nt, Yersinia pestis KIM
gccaucuucag

SEQ ID NO: 2300255 - RNA, 17 nt, Yersinia pestis KIM
gccagggguaagaucca

SEQ ID NO: 2300256 - RNA, 18 nt, Yersinia pestis KIM
gccagcugcaauugccgc

SEQ ID NO: 2300257 - RNA, 14 nt, Yersinia pestis KIM
gccagcccaucacc

SEQ ID NO: 2300258 - RNA, 13 nt, Yersinia pestis KIM
gccagcauggcgc

SEQ ID NO: 2300259 - RNA, 20 nt, Yersinia pestis KIM
gccagcaauuggccuuccau

SEQ ID NO: 2300260 - RNA, 13 nt, Yersinia pestis KIM
gccagacuggccg

SEQ ID NO: 2300261 - RNA, 20 nt, Yersinia pestis KIM
gccagagacauaaagcccgc

SEQ ID NO: 2300262 - RNA, 15 nt, Yersinia pestis KIM
gccagagcuugcugg

SEQ ID NO: 2300263 - RNA, 23 nt, Yersinia pestis KIM
gccagagacauaaagcccgcuuc

SEQ ID NO: 2300264 - RNA, 18 nt, Yersinia pestis KIM
gccacuucgguggcccug

SEQ ID NO: 2300265 - RNA, 18 nt, Yersinia pestis KIM
gccacuucgguggcccuu

SEQ ID NO: 2300266 - RNA, 14 nt, Yersinia pestis KIM
gccacuucuaacaa

SEQ ID NO: 2300267 - RNA, 14 nt, Yersinia pestis KIM
gccagaaagcagcc

SEQ ID NO: 2300268 - RNA, 19 nt, Yersinia pestis KIM
gccaccggcaguucauucc

SEQ ID NO: 2300269 - RNA, 20 nt, Yersinia pestis KIM
gccaccgcucgucacacugg

SEQ ID NO: 2300270 - RNA, 13 nt, Yersinia pestis KIM
gccaccgcuggug

SEQ ID NO: 2300271 - RNA, 16 nt, Yersinia pestis KIM
gccacugggcuacccg

SEQ ID NO: 2300272 - RNA, 17 nt, Yersinia pestis KIM
gccaccaaauaaaacaa

SEQ ID NO: 2300273 - RNA, 13 nt, Yersinia pestis KIM
gccacacaauaca

SEQ ID NO: 2300274 - RNA, 18 nt, Yersinia pestis KIM
gccacacaauacauagaa

SEQ ID NO: 2300275 - RNA, 14 nt, Yersinia pestis KIM
gccacacucagaca

SEQ ID NO: 2300276 - RNA, 16 nt, Yersinia pestis KIM
gccaauaaccgcagca

SEQ ID NO: 2300277 - RNA, 23 nt, Yersinia pestis KIM
gccaagcuacggccuguaccacc

SEQ ID NO: 2300278 - RNA, 17 nt, Yersinia pestis KIM
gccaaggauggcgcggc

SEQ ID NO: 2300279 - RNA, 14 nt, Yersinia pestis KIM
gccaauaggccccu

SEQ ID NO: 2300280 - RNA, 13 nt, Yersinia pestis KIM
gccaauaggcccc

SEQ ID NO: 2300281 - RNA, 20 nt, Yersinia pestis KIM
gccaauagacaaaagugacg

SEQ ID NO: 2300282 - RNA, 21 nt, Yersinia pestis KIM
gccaaucggccuuaaccaagc

SEQ ID NO: 2300283 - RNA, 13 nt, Yersinia pestis KIM
gccaauccuuccu

SEQ ID NO: 2300284 - RNA, 14 nt, Yersinia pestis KIM
gccaauccuuccug

SEQ ID NO: 2300285 - RNA, 20 nt, Yersinia pestis KIM
gccaaucccgauaaaaacca

SEQ ID NO: 2300286 - RNA, 23 nt, Yersinia pestis KIM
gccaaugccuuagguaagucagc

SEQ ID NO: 2300287 - RNA, 18 nt, Yersinia pestis KIM
gccaaugccucuucaaua

SEQ ID NO: 2300288 - RNA, 20 nt, Yersinia pestis KIM
gccaaucucuuguuuugcaa

SEQ ID NO: 2300289 - RNA, 22 nt, Yersinia pestis KIM
gccaaugacaaaggguaauuaa

SEQ ID NO: 2300290 - RNA, 23 nt, Yersinia pestis KIM
gccaauggccacugcgggcagua

SEQ ID NO: 2300291 - RNA, 24 nt, Yersinia pestis KIM
gccaauguaugaccgguuuauaca

SEQ ID NO: 2300292 - RNA, 23 nt, Yersinia pestis KIM
gccaauggaaccgcuaaagucac

SEQ ID NO: 2300293 - RNA, 15 nt, Yersinia pestis KIM
gccaauggccacugc

SEQ ID NO: 2300294 - RNA, 23 nt, Yersinia pestis KIM
gccaauucguuuuucauuuuucu

SEQ ID NO: 2300295 - RNA, 21 nt, Yersinia pestis KIM
gccaauuggucaugaugaaua

SEQ ID NO: 2300296 - RNA, 18 nt, Yersinia pestis KIM
gccaauuuggggcugcuu

SEQ ID NO: 2300297 - RNA, 16 nt, Yersinia pestis KIM
gccacaacccaauaau

SEQ ID NO: 2300298 - RNA, 15 nt, Yersinia pestis KIM
gccacaauaaaauaa

SEQ ID NO: 2300299 - RNA, 18 nt, Yersinia pestis KIM
gccaacgcccugcaucuu

SEQ ID NO: 2300300 - RNA, 21 nt, Yersinia pestis KIM
gccaacggacggaauccaaca

SEQ ID NO: 2300301 - RNA, 13 nt, Yersinia pestis KIM
gccaacuggcgca

SEQ ID NO: 2300302 - RNA, 20 nt, Yersinia pestis KIM
gccaagcgccgugcauaaug

SEQ ID NO: 2300303 - RNA, 20 nt, Yersinia pestis KIM
gccaagcaagcggcagcgcu

SEQ ID NO: 2300304 - RNA, 22 nt, Yersinia pestis KIM
gccaaccggauaaaacaauagc

SEQ ID NO: 2300305 - RNA, 15 nt, Yersinia pestis KIM
gccaacaggccccuu

SEQ ID NO: 2300306 - RNA, 18 nt, Yersinia pestis KIM
gccaacaauugcuccagu

SEQ ID NO: 2300307 - RNA, 12 nt, Yersinia pestis KIM
gccaacaacuua

SEQ ID NO: 2300308 - RNA, 17 nt, Yersinia pestis KIM
gccaaaugcaaaccagg

SEQ ID NO: 2300309 - RNA, 20 nt, Yersinia pestis KIM
gccaaaugaaaauauucauu

SEQ ID NO: 2300310 - RNA, 18 nt, Yersinia pestis KIM
gccaaauuuggccuuucu

SEQ ID NO: 2300311 - RNA, 19 nt, Yersinia pestis KIM
gccaaauuacgugcccaaa

SEQ ID NO: 2300312 - RNA, 20 nt, Yersinia pestis KIM
gccaaauacauauaaccauc

SEQ ID NO: 2300313 - RNA, 19 nt, Yersinia pestis KIM
gccaaaucaucagacagcc

SEQ ID NO: 2300314 - RNA, 19 nt, Yersinia pestis KIM
gccaaacgugcuacuuaau

SEQ ID NO: 2300315 - RNA, 18 nt, Yersinia pestis KIM
gcauuuuaucuucuucag

SEQ ID NO: 2300316 - RNA, 20 nt, Yersinia pestis KIM
gccaaaaaauaagggccacc

SEQ ID NO: 2300317 - RNA, 14 nt, Yersinia pestis KIM
gcauuuuuugccag

SEQ ID NO: 2300318 - RNA, 22 nt, Yersinia pestis KIM
gcauuuuucuguucagauuuac

SEQ ID NO: 2300319 - RNA, 20 nt, Yersinia pestis KIM
gcauugaguuucaaugccaa

SEQ ID NO: 2300320 - RNA, 16 nt, Yersinia pestis KIM
gcauugcaugaugaau

SEQ ID NO: 2300321 - RNA, 17 nt, Yersinia pestis KIM
gcauuucauuaaaugcu

SEQ ID NO: 2300322 - RNA, 19 nt, Yersinia pestis KIM
gcauuuaauguucgcugac

SEQ ID NO: 2300323 - RNA, 20 nt, Yersinia pestis KIM
gcauuuaucauauuaacaua

SEQ ID NO: 2300324 - RNA, 21 nt, Yersinia pestis KIM
gcauuguuggcccgcaucuuu

SEQ ID NO: 2300325 - RNA, 16 nt, Yersinia pestis KIM
gcauuguuggcccgca

SEQ ID NO: 2300326 - RNA, 23 nt, Yersinia pestis KIM
gcauugacgauaucaauaaagaa

SEQ ID NO: 2300327 - RNA, 21 nt, Yersinia pestis KIM
gcauucgugccauaaaguuuu

SEQ ID NO: 2300328 - RNA, 22 nt, Yersinia pestis KIM
gcauucagguguucagccaagu

SEQ ID NO: 2300329 - RNA, 21 nt, Yersinia pestis KIM
gcauucauaucguccaaaggg

SEQ ID NO: 2300330 - RNA, 14 nt, Yersinia pestis KIM
gcauuauaaggaga

SEQ ID NO: 2300331 - RNA, 14 nt, Yersinia pestis KIM
gcauggaucacccg

SEQ ID NO: 2300332 - RNA, 19 nt, Yersinia pestis KIM
gcauggacgagcacauggc

SEQ ID NO: 2300333 - RNA, 20 nt, Yersinia pestis KIM
gcauggaagauaucuaauuu

SEQ ID NO: 2300334 - RNA, 15 nt, Yersinia pestis KIM
gcaugcuuccagaua

SEQ ID NO: 2300335 - RNA, 15 nt, Yersinia pestis KIM
gcaugggcuugcaua

SEQ ID NO: 2300336 - RNA, 17 nt, Yersinia pestis KIM
gcaugguaaggccucgg

SEQ ID NO: 2300337 - RNA, 19 nt, Yersinia pestis KIM
gcauggcuaaaauuaagcc

SEQ ID NO: 2300338 - RNA, 19 nt, Yersinia pestis KIM
gcauuagacauucaagccu

SEQ ID NO: 2300339 - RNA, 18 nt, Yersinia pestis KIM
gcauuacucuuauaaaga

SEQ ID NO: 2300340 - RNA, 19 nt, Yersinia pestis KIM
gcauuaccuuuaaaacugg

SEQ ID NO: 2300341 - RNA, 20 nt, Yersinia pestis KIM
gcauuaccacgguaaugaau

SEQ ID NO: 2300342 - RNA, 15 nt, Yersinia pestis KIM
gcauuacaacuugaa

SEQ ID NO: 2300343 - RNA, 23 nt, Yersinia pestis KIM
gcauguuauuggcuaaaguguac

SEQ ID NO: 2300344 - RNA, 13 nt, Yersinia pestis KIM
gcaugugggcagg

SEQ ID NO: 2300345 - RNA, 20 nt, Yersinia pestis KIM
gcaugugauguggcuugcaa

SEQ ID NO: 2300346 - RNA, 14 nt, Yersinia pestis KIM
gcaugccauccugc

SEQ ID NO: 2300347 - RNA, 18 nt, Yersinia pestis KIM
gcaugccauccugccaac

SEQ ID NO: 2300348 - RNA, 17 nt, Yersinia pestis KIM
gcaugcccggucaugau

SEQ ID NO: 2300349 - RNA, 16 nt, Yersinia pestis KIM
gcaugaccaaaggcua

SEQ ID NO: 2300350 - RNA, 18 nt, Yersinia pestis KIM
gcaucuuuugcuauugaa

SEQ ID NO: 2300351 - RNA, 15 nt, Yersinia pestis KIM
gcaucuuuugcuauu

SEQ ID NO: 2300352 - RNA, 21 nt, Yersinia pestis KIM
gcaucuuuaccccauugcacc

SEQ ID NO: 2300353 - RNA, 11 nt, Yersinia pestis KIM
gcaucuuccaa

SEQ ID NO: 2300354 - RNA, 18 nt, Yersinia pestis KIM
gcaucuuccaaaggaagg

SEQ ID NO: 2300355 - RNA, 23 nt, Yersinia pestis KIM
gcaucgcgggcgcgcugcugcuc

SEQ ID NO: 2300356 - RNA, 20 nt, Yersinia pestis KIM
gcaucgcgacugagaagcgg

SEQ ID NO: 2300357 - RNA, 13 nt, Yersinia pestis KIM
gcaucugccacac

SEQ ID NO: 2300358 - RNA, 19 nt, Yersinia pestis KIM
gcaucuccgcgaccacaug

SEQ ID NO: 2300359 - RNA, 16 nt, Yersinia pestis KIM
gcaucuaugcuaucca

SEQ ID NO: 2300360 - RNA, 16 nt, Yersinia pestis KIM
gcaucgucauugccag

SEQ ID NO: 2300361 - RNA, 18 nt, Yersinia pestis KIM
gccgcaaggccauagaau

SEQ ID NO: 2300362 - RNA, 17 nt, Yersinia pestis KIM
gccgcccuuuagccagc

SEQ ID NO: 2300363 - RNA, 18 nt, Yersinia pestis KIM
gccgccuucaacugugga

SEQ ID NO: 2300364 - RNA, 20 nt, Yersinia pestis KIM
gccgcgcccuaacaggcgca

SEQ ID NO: 2300365 - RNA, 17 nt, Yersinia pestis KIM
gccgcgcccuaacaggc

SEQ ID NO: 2300366 - RNA, 21 nt, Yersinia pestis KIM
gccgcuucggucucuggaugc

SEQ ID NO: 2300367 - RNA, 15 nt, Yersinia pestis KIM
gccggaacggucagg

SEQ ID NO: 2300368 - RNA, 17 nt, Yersinia pestis KIM
gccggaacggucaggga

SEQ ID NO: 2300369 - RNA, 16 nt, Yersinia pestis KIM
gccggauguaaaacac

SEQ ID NO: 2300370 - RNA, 20 nt, Yersinia pestis KIM
gccggauuauuauucauagu

SEQ ID NO: 2300371 - RNA, 12 nt, Yersinia pestis KIM
gccgcggcggcc

SEQ ID NO: 2300372 - RNA, 22 nt, Yersinia pestis KIM
gccgcgugauagggaguuguuu

SEQ ID NO: 2300373 - RNA, 15 nt, Yersinia pestis KIM
gccgcucaugcccca

SEQ ID NO: 2300374 - RNA, 16 nt, Yersinia pestis KIM
gccguacaacaauaau

SEQ ID NO: 2300375 - RNA, 12 nt, Yersinia pestis KIM
gccgguggcuga

SEQ ID NO: 2300376 - RNA, 13 nt, Yersinia pestis KIM
gccgucaucaucu

SEQ ID NO: 2300377 - RNA, 23 nt, Yersinia pestis KIM
gccguaucuucugccagccccaa

SEQ ID NO: 2300378 - RNA, 14 nt, Yersinia pestis KIM
gccgugcugucagc

SEQ ID NO: 2300379 - RNA, 18 nt, Yersinia pestis KIM
gccgugcugucagccagc

SEQ ID NO: 2300380 - RNA, 17 nt, Yersinia pestis KIM
gccgugcgguuguaaag

SEQ ID NO: 2300381 - RNA, 18 nt, Yersinia pestis KIM
gccguuacccccuucacc

SEQ ID NO: 2300382 - RNA, 18 nt, Yersinia pestis KIM
gccguggcgaagcccaua

SEQ ID NO: 2300383 - RNA, 19 nt, Yersinia pestis KIM
gccguuauagaucuccugc

SEQ ID NO: 2300384 - RNA, 14 nt, Yersinia pestis KIM
gccgggaugaucaa

SEQ ID NO: 2300385 - RNA, 20 nt, Yersinia pestis KIM
gccggcguuaaugccacccc

SEQ ID NO: 2300386 - RNA, 13 nt, Yersinia pestis KIM
gccgguggcaaaa

SEQ ID NO: 2300387 - RNA, 20 nt, Yersinia pestis KIM
gcccgaugguggcagccugc

SEQ ID NO: 2300388 - RNA, 14 nt, Yersinia pestis KIM
gcccgauucaccuu

SEQ ID NO: 2300389 - RNA, 15 nt, Yersinia pestis KIM
gcccggaagccguga

SEQ ID NO: 2300390 - RNA, 22 nt, Yersinia pestis KIM
gcccgcggccaauagcaaaccc

SEQ ID NO: 2300391 - RNA, 13 nt, Yersinia pestis KIM
gcccgcgggggcc

SEQ ID NO: 2300392 - RNA, 16 nt, Yersinia pestis KIM
gcccgauccccugcuu

SEQ ID NO: 2300393 - RNA, 23 nt, Yersinia pestis KIM
gccccuuguugccgguaggguuc

SEQ ID NO: 2300394 - RNA, 14 nt, Yersinia pestis KIM
gccccugauugcag

SEQ ID NO: 2300395 - RNA, 15 nt, Yersinia pestis KIM
gccccuugcuucagu

SEQ ID NO: 2300396 - RNA, 20 nt, Yersinia pestis KIM
gccccuugcuucaguuuugc

SEQ ID NO: 2300397 - RNA, 13 nt, Yersinia pestis KIM
gccccucagacug

SEQ ID NO: 2300398 - RNA, 20 nt, Yersinia pestis KIM
gccccuaagaaucggccagu

SEQ ID NO: 2300399 - RNA, 15 nt, Yersinia pestis KIM
gccccggugacaaag

SEQ ID NO: 2300400 - RNA, 21 nt, Yersinia pestis KIM
gcccaggcaaucucuccccaa

SEQ ID NO: 2300401 - RNA, 14 nt, Yersinia pestis KIM
gcccguaaacgggc

SEQ ID NO: 2300402 - RNA, 19 nt, Yersinia pestis KIM
gcccgucguuaugagauuu

SEQ ID NO: 2300403 - RNA, 13 nt, Yersinia pestis KIM
gcccuaacugcuc

SEQ ID NO: 2300404 - RNA, 15 nt, Yersinia pestis KIM
gcccuacuggcugaa

SEQ ID NO: 2300405 - RNA, 14 nt, Yersinia pestis KIM
gcccuguuucauuu

SEQ ID NO: 2300406 - RNA, 19 nt, Yersinia pestis KIM
gcccugagauucaacccac

SEQ ID NO: 2300407 - RNA, 19 nt, Yersinia pestis KIM
gccgauccgggaaaaaaua

SEQ ID NO: 2300408 - RNA, 15 nt, Yersinia pestis KIM
gccgauaaucccugc

SEQ ID NO: 2300409 - RNA, 21 nt, Yersinia pestis KIM
gccgauaaucccugccagaau

SEQ ID NO: 2300410 - RNA, 15 nt, Yersinia pestis KIM
gccgaucauaaauca

SEQ ID NO: 2300411 - RNA, 12 nt, Yersinia pestis KIM
gccgacugcuga

SEQ ID NO: 2300412 - RNA, 20 nt, Yersinia pestis KIM
gccgacgaucuugcccaaug

SEQ ID NO: 2300413 - RNA, 23 nt, Yersinia pestis KIM
gccgaccugcaacgccagugacu

SEQ ID NO: 2300414 - RNA, 14 nt, Yersinia pestis KIM
gccgagaacagaau

SEQ ID NO: 2300415 - RNA, 12 nt, Yersinia pestis KIM
gccgacaaaccc

SEQ ID NO: 2300416 - RNA, 17 nt, Yersinia pestis KIM
gccgacaaaauccccca

SEQ ID NO: 2300417 - RNA, 17 nt, Yersinia pestis KIM
gccgaaccccuagccag

SEQ ID NO: 2300418 - RNA, 17 nt, Yersinia pestis KIM
gcccuuuugugcaucca

SEQ ID NO: 2300419 - RNA, 19 nt, Yersinia pestis KIM
gcccuuugcuauucagacg

SEQ ID NO: 2300420 - RNA, 19 nt, Yersinia pestis KIM
gcccuuuuugguuuucuau

SEQ ID NO: 2300421 - RNA, 13 nt, Yersinia pestis KIM
gcccuugcagcgu

SEQ ID NO: 2300422 - RNA, 19 nt, Yersinia pestis KIM
gcccuucgggucaacgcug

SEQ ID NO: 2300423 - RNA, 14 nt, Yersinia pestis KIM
gcccuucggacggc

SEQ ID NO: 2300424 - RNA, 19 nt, Yersinia pestis KIM
gcccuuacuauuuuucuca

SEQ ID NO: 2300425 - RNA, 15 nt, Yersinia pestis KIM
gcacggcaucgcugc

SEQ ID NO: 2300426 - RNA, 17 nt, Yersinia pestis KIM
gcacggccgggugcagc

SEQ ID NO: 2300427 - RNA, 12 nt, Yersinia pestis KIM
gcacgggcuauc

SEQ ID NO: 2300428 - RNA, 20 nt, Yersinia pestis KIM
gcacgucaguuaaauaugac

SEQ ID NO: 2300429 - RNA, 17 nt, Yersinia pestis KIM
gcacugagccgaagaac

SEQ ID NO: 2300430 - RNA, 17 nt, Yersinia pestis KIM
gcacugaguucugcugc

SEQ ID NO: 2300431 - RNA, 17 nt, Yersinia pestis KIM
gcacugcagaaaaugcg

SEQ ID NO: 2300432 - RNA, 19 nt, Yersinia pestis KIM
gcacugauucucuucaccu

SEQ ID NO: 2300433 - RNA, 18 nt, Yersinia pestis KIM
gcacugcauuugauacua

SEQ ID NO: 2300434 - RNA, 15 nt, Yersinia pestis KIM
gcacucauaaugcug

SEQ ID NO: 2300435 - RNA, 16 nt, Yersinia pestis KIM
gcacucagcauauugu

SEQ ID NO: 2300436 - RNA, 14 nt, Yersinia pestis KIM
gcacgugccgcugg

SEQ ID NO: 2300437 - RNA, 18 nt, Yersinia pestis KIM
gcacguuuuucagcuucu

SEQ ID NO: 2300438 - RNA, 17 nt, Yersinia pestis KIM
gcaccagaaaguuguuc

SEQ ID NO: 2300439 - RNA, 22 nt, Yersinia pestis KIM
gcaccagggaugggcgccgcuu

SEQ ID NO: 2300440 - RNA, 22 nt, Yersinia pestis KIM
gcaccgaugucuaacaaacuca

SEQ ID NO: 2300441 - RNA, 17 nt, Yersinia pestis KIM
gcaccgguguucacucg

SEQ ID NO: 2300442 - RNA, 12 nt, Yersinia pestis KIM
gcaccuucacgc

SEQ ID NO: 2300443 - RNA, 16 nt, Yersinia pestis KIM
gcaccuucugauuuuu

SEQ ID NO: 2300444 - RNA, 15 nt, Yersinia pestis KIM
gcaccuuugucauug

SEQ ID NO: 2300445 - RNA, 23 nt, Yersinia pestis KIM
gcaccuuugucauugaggagcga

SEQ ID NO: 2300446 - RNA, 21 nt, Yersinia pestis KIM
gcacgacggauuugguuggcu

SEQ ID NO: 2300447 - RNA, 17 nt, Yersinia pestis KIM
gcaagcagcucaaaauc

SEQ ID NO: 2300448 - RNA, 21 nt, Yersinia pestis KIM
gcaagcgggauagcccggugc

SEQ ID NO: 2300449 - RNA, 16 nt, Yersinia pestis KIM
gcaaggucgccucugg

SEQ ID NO: 2300450 - RNA, 21 nt, Yersinia pestis KIM
gcaagaaagaaaaauagacuc

SEQ ID NO: 2300451 - RNA, 15 nt, Yersinia pestis KIM
gcaagaaagaaaaau

SEQ ID NO: 2300452 - RNA, 17 nt, Yersinia pestis KIM
gcaagaaacuucauuuc

SEQ ID NO: 2300453 - RNA, 20 nt, Yersinia pestis KIM
gcaagaaacuucauuucagg

SEQ ID NO: 2300454 - RNA, 20 nt, Yersinia pestis KIM
gcaagaacaauccauccggu

SEQ ID NO: 2300455 - RNA, 14 nt, Yersinia pestis KIM
gcaagaacaaucca

SEQ ID NO: 2300456 - RNA, 16 nt, Yersinia pestis KIM
gcaagauuuuguagcc

SEQ ID NO: 2300457 - RNA, 14 nt, Yersinia pestis KIM
gcaacuucagccac

SEQ ID NO: 2300458 - RNA, 17 nt, Yersinia pestis KIM
gcaaauugcugaaaaaa

SEQ ID NO: 2300459 - RNA, 21 nt, Yersinia pestis KIM
gcaaauugcgagcugagcuua

SEQ ID NO: 2300460 - RNA, 23 nt, Yersinia pestis KIM
gcaaauuuaugcgcuuucucgac

SEQ ID NO: 2300461 - RNA, 23 nt, Yersinia pestis KIM
gcaaguuaaucauuggcaacuua

SEQ ID NO: 2300462 - RNA, 13 nt, Yersinia pestis KIM
gcaaguuagguac

SEQ ID NO: 2300463 - RNA, 23 nt, Yersinia pestis KIM
gcaaguaaaagucagcaaaucaa

SEQ ID NO: 2300464 - RNA, 13 nt, Yersinia pestis KIM
gcaauagccaugg

SEQ ID NO: 2300465 - RNA, 22 nt, Yersinia pestis KIM
gcaauagcgaucacggguuuuu

SEQ ID NO: 2300466 - RNA, 15 nt, Yersinia pestis KIM
gcaauagucuggccu

SEQ ID NO: 2300467 - RNA, 16 nt, Yersinia pestis KIM
gcaauagcaucuggcc

SEQ ID NO: 2300468 - RNA, 22 nt, Yersinia pestis KIM
gcaaucaauguauugcuccaga

SEQ ID NO: 2300469 - RNA, 15 nt, Yersinia pestis KIM
gcaaucacaaccccc

SEQ ID NO: 2300470 - RNA, 21 nt, Yersinia pestis KIM
gcaaucaauguauugcuccag

SEQ ID NO: 2300471 - RNA, 21 nt, Yersinia pestis KIM
gcaauauugucuuaugauaua

SEQ ID NO: 2300472 - RNA, 17 nt, Yersinia pestis KIM
gcaauauugcuugccag

SEQ ID NO: 2300473 - RNA, 19 nt, Yersinia pestis KIM
gcaaucucugcaguacaga

SEQ ID NO: 2300474 - RNA, 19 nt, Yersinia pestis KIM
gcaauggaagaaucaccga

SEQ ID NO: 2300475 - RNA, 20 nt, Yersinia pestis KIM
gcaaugcgguacgcaggccu

SEQ ID NO: 2300476 - RNA, 12 nt, Yersinia pestis KIM
gcaaugaaagug

SEQ ID NO: 2300477 - RNA, 16 nt, Yersinia pestis KIM
gcaaucuguuauaaaa

SEQ ID NO: 2300478 - RNA, 17 nt, Yersinia pestis KIM
gcaccaaccauugacua

SEQ ID NO: 2300479 - RNA, 16 nt, Yersinia pestis KIM
gcaccaagaaaaccca

SEQ ID NO: 2300480 - RNA, 15 nt, Yersinia pestis KIM
gcaccaaaucuucca

SEQ ID NO: 2300481 - RNA, 16 nt, Yersinia pestis KIM
gcaccaaaucuuccag

SEQ ID NO: 2300482 - RNA, 17 nt, Yersinia pestis KIM
gcaccaaacagacccca

SEQ ID NO: 2300483 - RNA, 17 nt, Yersinia pestis KIM
gcacacugacagcaacg

SEQ ID NO: 2300484 - RNA, 22 nt, Yersinia pestis KIM
gcacacucagaugaaaaacugu

SEQ ID NO: 2300485 - RNA, 19 nt, Yersinia pestis KIM
gcacacagaugcuggcuuu

SEQ ID NO: 2300486 - RNA, 24 nt, Yersinia pestis KIM
gcacaucaauauaaaacaucucuu

SEQ ID NO: 2300487 - RNA, 16 nt, Yersinia pestis KIM
gcacauacuaauagaa

SEQ ID NO: 2300488 - RNA, 18 nt, Yersinia pestis KIM
gcacauacuaauagaaga

SEQ ID NO: 2300489 - RNA, 16 nt, Yersinia pestis KIM
gcacagaaaaugucca

SEQ ID NO: 2300490 - RNA, 17 nt, Yersinia pestis KIM
gcacacuuuucacuccg

SEQ ID NO: 2300491 - RNA, 21 nt, Yersinia pestis KIM
gcacacuuuucacuccggcau

SEQ ID NO: 2300492 - RNA, 14 nt, Yersinia pestis KIM
gcacaaugcauuca

SEQ ID NO: 2300493 - RNA, 13 nt, Yersinia pestis KIM
gcacaaugccuaa

SEQ ID NO: 2300494 - RNA, 10 nt, Yersinia pestis KIM
gcacaaggcc

SEQ ID NO: 2300495 - RNA, 19 nt, Yersinia pestis KIM
gcaauuugcccaucuuuua

SEQ ID NO: 2300496 - RNA, 18 nt, Yersinia pestis KIM
gcaauuuaucaaacauac

SEQ ID NO: 2300497 - RNA, 20 nt, Yersinia pestis KIM
gcaauuaagcaaaaaggcug

SEQ ID NO: 2300498 - RNA, 18 nt, Yersinia pestis KIM
gcaauguguuugcgagcc

SEQ ID NO: 2300499 - RNA, 20 nt, Yersinia pestis KIM
gcaauggcucaggcucauca

SEQ ID NO: 2300500 - RNA, 23 nt, Yersinia pestis KIM
gcaaugggucauugcgugcaaua

SEQ ID NO: 2300501 - RNA, 18 nt, Yersinia pestis KIM
gcaauuaugacguucagu

SEQ ID NO: 2300502 - RNA, 18 nt, Yersinia pestis KIM
gcaauuagcacauaugca

SEQ ID NO: 2300503 - RNA, 18 nt, Yersinia pestis KIM
gcaauucagccucauaca

SEQ ID NO: 2300504 - RNA, 16 nt, Yersinia pestis KIM
gcaauucagccugugc

SEQ ID NO: 2300505 - RNA, 20 nt, Yersinia pestis KIM
gcaauucgcuuaugacaaua

SEQ ID NO: 2300506 - RNA, 23 nt, Yersinia pestis KIM
gcaauucggcuaaugagcucacu

SEQ ID NO: 2300507 - RNA, 17 nt, Yersinia pestis KIM
gcagcgcgcagccaacg

SEQ ID NO: 2300508 - RNA, 18 nt, Yersinia pestis KIM
gcagcggcuagcagcagg

SEQ ID NO: 2300509 - RNA, 16 nt, Yersinia pestis KIM
gcagcggcaaauagag

SEQ ID NO: 2300510 - RNA, 15 nt, Yersinia pestis KIM
gcagcgucaaggucg

SEQ ID NO: 2300511 - RNA, 20 nt, Yersinia pestis KIM
gcagcguaggcaacuaagcu

SEQ ID NO: 2300512 - RNA, 17 nt, Yersinia pestis KIM
gcagcguagguaacuaa

SEQ ID NO: 2300513 - RNA, 18 nt, Yersinia pestis KIM
gcagcguagguaacuaag

SEQ ID NO: 2300514 - RNA, 20 nt, Yersinia pestis KIM
gcagcguagguaacuaagcu

SEQ ID NO: 2300515 - RNA, 17 nt, Yersinia pestis KIM
gcaggccccaucauaaa

SEQ ID NO: 2300516 - RNA, 21 nt, Yersinia pestis KIM
gcaggccccaucauaaaggcu

SEQ ID NO: 2300517 - RNA, 12 nt, Yersinia pestis KIM
gcaggcaaacaa

SEQ ID NO: 2300518 - RNA, 22 nt, Yersinia pestis KIM
gcaggcaaacaaugugccgcgc

SEQ ID NO: 2300519 - RNA, 14 nt, Yersinia pestis KIM
gcagcuuguugaua

SEQ ID NO: 2300520 - RNA, 18 nt, Yersinia pestis KIM
gcaggcacugcagaaaau

SEQ ID NO: 2300521 - RNA, 22 nt, Yersinia pestis KIM
gcacugggaucugaucaaucuc

SEQ ID NO: 2300522 - RNA, 23 nt, Yersinia pestis KIM
gcacugggucaucacccagcaaa

SEQ ID NO: 2300523 - RNA, 15 nt, Yersinia pestis KIM
gcacugguugcuuca

SEQ ID NO: 2300524 - RNA, 16 nt, Yersinia pestis KIM
gcacuguagaccucuu

SEQ ID NO: 2300525 - RNA, 18 nt, Yersinia pestis KIM
gcacugucugagcaaaag

SEQ ID NO: 2300526 - RNA, 22 nt, Yersinia pestis KIM
gcacuguugaccgacucauuaa

SEQ ID NO: 2300527 - RNA, 16 nt, Yersinia pestis KIM
gcacuucaaccugauc

SEQ ID NO: 2300528 - RNA, 16 nt, Yersinia pestis KIM
gcagcaaaaccaagcu

SEQ ID NO: 2300529 - RNA, 12 nt, Yersinia pestis KIM
gcagauuucacc

SEQ ID NO: 2300530 - RNA, 18 nt, Yersinia pestis KIM
gcagauuuguacgugacu

SEQ ID NO: 2300531 - RNA, 21 nt, Yersinia pestis KIM
gcagauguauuagcgcugcuc

SEQ ID NO: 2300532 - RNA, 18 nt, Yersinia pestis KIM
gcagcaucccaaugaaua

SEQ ID NO: 2300533 - RNA, 22 nt, Yersinia pestis KIM
gcagcagugccugguuuuacgc

SEQ ID NO: 2300534 - RNA, 13 nt, Yersinia pestis KIM
gcagcagagaaug

SEQ ID NO: 2300535 - RNA, 15 nt, Yersinia pestis KIM
gcagcccuuauucaa

SEQ ID NO: 2300536 - RNA, 20 nt, Yersinia pestis KIM
gcagcccuuauucaaagaau

SEQ ID NO: 2300537 - RNA, 14 nt, Yersinia pestis KIM
gcagccaaaauaau

SEQ ID NO: 2300538 - RNA, 15 nt, Yersinia pestis KIM
gcauccguacccgcu

SEQ ID NO: 2300539 - RNA, 14 nt, Yersinia pestis KIM
gcauccgcccacac

SEQ ID NO: 2300540 - RNA, 22 nt, Yersinia pestis KIM
gcauccgcgaugacacaauucc

SEQ ID NO: 2300541 - RNA, 16 nt, Yersinia pestis KIM
gcauccccaucgccaa

SEQ ID NO: 2300542 - RNA, 18 nt, Yersinia pestis KIM
gcauccaagccaucauua

SEQ ID NO: 2300543 - RNA, 21 nt, Yersinia pestis KIM
gcauccccggcaucccaccuu

SEQ ID NO: 2300544 - RNA, 20 nt, Yersinia pestis KIM
gcaucacccgcgagcgaccu

SEQ ID NO: 2300545 - RNA, 20 nt, Yersinia pestis KIM
gcaucaccgguuuacccugc

SEQ ID NO: 2300546 - RNA, 20 nt, Yersinia pestis KIM
gcaucaccggcgaacguuug

SEQ ID NO: 2300547 - RNA, 16 nt, Yersinia pestis KIM
gcaucaaccaagacau

SEQ ID NO: 2300548 - RNA, 21 nt, Yersinia pestis KIM
gcaucaacgacagcagcaggc

SEQ ID NO: 2300549 - RNA, 15 nt, Yersinia pestis KIM
gcaucaaccaagaca

SEQ ID NO: 2300550 - RNA, 18 nt, Yersinia pestis KIM
gcaucaacauggaugucu

SEQ ID NO: 2300551 - RNA, 17 nt, Yersinia pestis KIM
gcauauuauuuugcaca

SEQ ID NO: 2300552 - RNA, 13 nt, Yersinia pestis KIM
gcauauuacccag

SEQ ID NO: 2300553 - RNA, 18 nt, Yersinia pestis KIM
gcauauuguaaacuucca

SEQ ID NO: 2300554 - RNA, 16 nt, Yersinia pestis KIM
gcaucauacugacggg

SEQ ID NO: 2300555 - RNA, 12 nt, Yersinia pestis KIM
gcaucauacuga

SEQ ID NO: 2300556 - RNA, 21 nt, Yersinia pestis KIM
gcaucaucaguauugacgaug

SEQ ID NO: 2300557 - RNA, 13 nt, Yersinia pestis KIM
gcaucagccagcc

SEQ ID NO: 2300558 - RNA, 16 nt, Yersinia pestis KIM
gcaucagcccauugcu

SEQ ID NO: 2300559 - RNA, 18 nt, Yersinia pestis KIM
gcaucagcaaaguauuua

SEQ ID NO: 2300560 - RNA, 22 nt, Yersinia pestis KIM
gcaucacuucauacacggcggc

SEQ ID NO: 2300561 - RNA, 16 nt, Yersinia pestis KIM
gcaucacuucauacac

SEQ ID NO: 2300562 - RNA, 21 nt, Yersinia pestis KIM
gcaucacgauagccagugaca

SEQ ID NO: 2300563 - RNA, 19 nt, Yersinia pestis KIM
gcagucagccacaaaaguu

SEQ ID NO: 2300564 - RNA, 20 nt, Yersinia pestis KIM
gcagucaccuuuuuagcgag

SEQ ID NO: 2300565 - RNA, 13 nt, Yersinia pestis KIM
gcaguccaaaaaa

SEQ ID NO: 2300566 - RNA, 18 nt, Yersinia pestis KIM
gcaguaucccuggcucau

SEQ ID NO: 2300567 - RNA, 19 nt, Yersinia pestis KIM
gcaguauuuuaagaaaacu

SEQ ID NO: 2300568 - RNA, 22 nt, Yersinia pestis KIM
gcagggaaagguagaucgggga

SEQ ID NO: 2300569 - RNA, 12 nt, Yersinia pestis KIM
gcagggagugaa

SEQ ID NO: 2300570 - RNA, 21 nt, Yersinia pestis KIM
gcauauacagcccgguaucac

SEQ ID NO: 2300571 - RNA, 16 nt, Yersinia pestis KIM
gcauacguugccagcc

SEQ ID NO: 2300572 - RNA, 17 nt, Yersinia pestis KIM
gcauagacgaaggcacg

SEQ ID NO: 2300573 - RNA, 24 nt, Yersinia pestis KIM
gcauacucaaaaauggcaacauca

SEQ ID NO: 2300574 - RNA, 14 nt, Yersinia pestis KIM
gcauacucacuuaa

SEQ ID NO: 2300575 - RNA, 11 nt, Yersinia pestis KIM
gcauacucagg

SEQ ID NO: 2300576 - RNA, 19 nt, Yersinia pestis KIM
gcagugccaucgccaacag

SEQ ID NO: 2300577 - RNA, 20 nt, Yersinia pestis KIM
gcagugccacggauauccaa

SEQ ID NO: 2300578 - RNA, 17 nt, Yersinia pestis KIM
gcagugcagccaagauc

SEQ ID NO: 2300579 - RNA, 15 nt, Yersinia pestis KIM
gcagugcuucaucac

SEQ ID NO: 2300580 - RNA, 16 nt, Yersinia pestis KIM
gcaguuuuccucccug

SEQ ID NO: 2300581 - RNA, 23 nt, Yersinia pestis KIM
gcaaacgccgcucuucagcauca

SEQ ID NO: 2300582 - RNA, 18 nt, Yersinia pestis KIM
gcaaacgcugcacaucau

SEQ ID NO: 2300583 - RNA, 13 nt, Yersinia pestis KIM
gcaaacucagcca

SEQ ID NO: 2300584 - RNA, 18 nt, Yersinia pestis KIM
gcaaaccugguuugcgcc

SEQ ID NO: 2300585 - RNA, 18 nt, Yersinia pestis KIM
gcaaacgaacgaauaauu

SEQ ID NO: 2300586 - RNA, 22 nt, Yersinia pestis KIM
gcaaagacuacacacagcaaua

SEQ ID NO: 2300587 - RNA, 13 nt, Yersinia pestis KIM
gcaaacuccucca

SEQ ID NO: 2300588 - RNA, 15 nt, Yersinia pestis KIM
gcaaaaugcucuuca

SEQ ID NO: 2300589 - RNA, 15 nt, Yersinia pestis KIM
gcaaagcaucaauca

SEQ ID NO: 2300590 - RNA, 21 nt, Yersinia pestis KIM
gcaaagugcugcaaggcauua

SEQ ID NO: 2300591 - RNA, 24 nt, Yersinia pestis KIM
gcaaaguuauugaccaauauaaaa

SEQ ID NO: 2300592 - RNA, 22 nt, Yersinia pestis KIM
gcaaaguauuuauacauaccac

SEQ ID NO: 2300593 - RNA, 14 nt, Yersinia pestis KIM
gcaaagggcaacaa

SEQ ID NO: 2300594 - RNA, 19 nt, Yersinia pestis KIM
gcaaagguuggaacaccaa

SEQ ID NO: 2300595 - RNA, 19 nt, Yersinia pestis KIM
gcaaauuaacacaucaaaa

SEQ ID NO: 2300596 - RNA, 18 nt, Yersinia pestis KIM
gcaaaucauaaaucaagg

SEQ ID NO: 2300597 - RNA, 14 nt, Yersinia pestis KIM
gcaaaucaaacaaa

SEQ ID NO: 2300598 - RNA, 14 nt, Yersinia pestis KIM
gcaaaaaauauuaa

SEQ ID NO: 2300599 - RNA, 21 nt, Yersinia pestis KIM
gcaaaaacagucauuaacaca

SEQ ID NO: 2300600 - RNA, 15 nt, Yersinia pestis KIM
gauuuuuaucuuucu

SEQ ID NO: 2300601 - RNA, 19 nt, Yersinia pestis KIM
gauuuuuaacgucagauaa

SEQ ID NO: 2300602 - RNA, 20 nt, Yersinia pestis KIM
gauuucacggauaucaacau

SEQ ID NO: 2300603 - RNA, 21 nt, Yersinia pestis KIM
gauuucaccuauaauuaacag

SEQ ID NO: 2300604 - RNA, 14 nt, Yersinia pestis KIM
gauuucuucauuua

SEQ ID NO: 2300605 - RNA, 13 nt, Yersinia pestis KIM
gauuucaucagcg

SEQ ID NO: 2300606 - RNA, 14 nt, Yersinia pestis KIM
gauuucagcugcuu

SEQ ID NO: 2300607 - RNA, 21 nt, Yersinia pestis KIM
gauuugaaccgcuaucugcug

SEQ ID NO: 2300608 - RNA, 16 nt, Yersinia pestis KIM
gauuugcccgguaccg

SEQ ID NO: 2300609 - RNA, 15 nt, Yersinia pestis KIM
gauuuuaagcacugc

SEQ ID NO: 2300610 - RNA, 15 nt, Yersinia pestis KIM
gauuuaaaaucccuc

SEQ ID NO: 2300611 - RNA, 23 nt, Yersinia pestis KIM
gauuuaaauaacagcuaaaauga

SEQ ID NO: 2300612 - RNA, 21 nt, Yersinia pestis KIM
gauuggcacccucuagcagcg

SEQ ID NO: 2300613 - RNA, 18 nt, Yersinia pestis KIM
gauugugcuccagcacuu

SEQ ID NO: 2300614 - RNA, 14 nt, Yersinia pestis KIM
gauugcugccaacg

SEQ ID NO: 2300615 - RNA, 15 nt, Yersinia pestis KIM
gauugaucaguggcu

SEQ ID NO: 2300616 - RNA, 16 nt, Yersinia pestis KIM
gauugaucagccaaca

SEQ ID NO: 2300617 - RNA, 18 nt, Yersinia pestis KIM
gauugaccaucaaccgug

SEQ ID NO: 2300618 - RNA, 22 nt, Yersinia pestis KIM
gauugacggaaaauuaacuuau

SEQ ID NO: 2300619 - RNA, 17 nt, Yersinia pestis KIM
gauuauuuauuuacagc

SEQ ID NO: 2300620 - RNA, 15 nt, Yersinia pestis KIM
gauuauuucagcuuc

SEQ ID NO: 2300621 - RNA, 16 nt, Yersinia pestis KIM
gauucucuauucugcu

SEQ ID NO: 2300622 - RNA, 16 nt, Yersinia pestis KIM
gauuauuguuauccac

SEQ ID NO: 2300623 - RNA, 16 nt, Yersinia pestis KIM
gauuauugggcugccu

SEQ ID NO: 2300624 - RNA, 16 nt, Yersinia pestis KIM
gaugggaggaaacugc

SEQ ID NO: 2300625 - RNA, 12 nt, Yersinia pestis KIM
gaugggccaaac

SEQ ID NO: 2300626 - RNA, 22 nt, Yersinia pestis KIM
gaugggcaggguauuuucuccu

SEQ ID NO: 2300627 - RNA, 20 nt, Yersinia pestis KIM
gaugguuaacucauuuaucu

SEQ ID NO: 2300628 - RNA, 13 nt, Yersinia pestis KIM
gauguauccaagg

SEQ ID NO: 2300629 - RNA, 14 nt, Yersinia pestis KIM
gauuaaccuuaauu

SEQ ID NO: 2300630 - RNA, 20 nt, Yersinia pestis KIM
gauuaaccuuaucaccaacg

SEQ ID NO: 2300631 - RNA, 21 nt, Yersinia pestis KIM
gauuaacuuuucuucauugcu

SEQ ID NO: 2300632 - RNA, 15 nt, Yersinia pestis KIM
gauuaagacuuucuc

SEQ ID NO: 2300633 - RNA, 13 nt, Yersinia pestis KIM
gauuaacauccau

SEQ ID NO: 2300634 - RNA, 19 nt, Yersinia pestis KIM
gaugucagauuaguuuuag

SEQ ID NO: 2300635 - RNA, 15 nt, Yersinia pestis KIM
gaugucaucuuccgu

SEQ ID NO: 2300636 - RNA, 19 nt, Yersinia pestis KIM
gauuaaguccgguuguggc

SEQ ID NO: 2300637 - RNA, 18 nt, Yersinia pestis KIM
gauuacuggcuaucuuau

SEQ ID NO: 2300638 - RNA, 17 nt, Yersinia pestis KIM
gauuaccugcauauccu

SEQ ID NO: 2300639 - RNA, 15 nt, Yersinia pestis KIM
gauuaccugcauauc

SEQ ID NO: 2300640 - RNA, 20 nt, Yersinia pestis KIM
gaugccuucuuucaaaguga

SEQ ID NO: 2300641 - RNA, 23 nt, Yersinia pestis KIM
gaugcgaucuauccaauccuuug

SEQ ID NO: 2300642 - RNA, 21 nt, Yersinia pestis KIM
gaugcgggauaaaccagugua

SEQ ID NO: 2300643 - RNA, 18 nt, Yersinia pestis KIM
gauggauaaauucagccg

SEQ ID NO: 2300644 - RNA, 20 nt, Yersinia pestis KIM
gauggauuugcacauagccc

SEQ ID NO: 2300645 - RNA, 19 nt, Yersinia pestis KIM
gauggaguaaucauugcca

SEQ ID NO: 2300646 - RNA, 19 nt, Yersinia pestis KIM
gauggaacaggauuuucaa

SEQ ID NO: 2300647 - RNA, 18 nt, Yersinia pestis KIM
gaugcuaaccgaauaaaa

SEQ ID NO: 2300648 - RNA, 13 nt, Yersinia pestis KIM
gaugcuaaagcgu

SEQ ID NO: 2300649 - RNA, 22 nt, Yersinia pestis KIM
gaugcuaaagcguaagugcaau

SEQ ID NO: 2300650 - RNA, 19 nt, Yersinia pestis KIM
gaugaugaguaugcaacag

SEQ ID NO: 2300651 - RNA, 19 nt, Yersinia pestis KIM
gaugcaguaaauagucuug

SEQ ID NO: 2300652 - RNA, 20 nt, Yersinia pestis KIM
gaugcauauuauaaugaaau

SEQ ID NO: 2300653 - RNA, 20 nt, Yersinia pestis KIM
gaugccaaucaaaaaaccgg

SEQ ID NO: 2300654 - RNA, 19 nt, Yersinia pestis KIM
gaugccaaauuaaucuugu

SEQ ID NO: 2300655 - RNA, 14 nt, Yersinia pestis KIM
gaugagaaguaaaa

SEQ ID NO: 2300656 - RNA, 16 nt, Yersinia pestis KIM
gaugacuacugucuuu

SEQ ID NO: 2300657 - RNA, 22 nt, Yersinia pestis KIM
gaugacaacaccguaacgcccu

SEQ ID NO: 2300658 - RNA, 16 nt, Yersinia pestis KIM
gaugacaaugcguuau

SEQ ID NO: 2300659 - RNA, 22 nt, Yersinia pestis KIM
gaugacaaugcguuauaaccau

SEQ ID NO: 2300660 - RNA, 15 nt, Yersinia pestis KIM
gaugacacaauuccc

SEQ ID NO: 2300661 - RNA, 19 nt, Yersinia pestis KIM
gaugaauguuccggacuuc

SEQ ID NO: 2300662 - RNA, 23 nt, Yersinia pestis KIM
gaucgguuugccaucacgcagca

SEQ ID NO: 2300663 - RNA, 16 nt, Yersinia pestis KIM
gaugaaucaaugaaau

SEQ ID NO: 2300664 - RNA, 23 nt, Yersinia pestis KIM
gaugaaugacuggcuauuagaau

SEQ ID NO: 2300665 - RNA, 22 nt, Yersinia pestis KIM
gauccgcgauaacguuguuucu

SEQ ID NO: 2300666 - RNA, 21 nt, Yersinia pestis KIM
gauccgauaaacuucacaaug

SEQ ID NO: 2300667 - RNA, 20 nt, Yersinia pestis KIM
gaucccucggugauaaguuu

SEQ ID NO: 2300668 - RNA, 17 nt, Yersinia pestis KIM
gauccagcaacguaaca

SEQ ID NO: 2300669 - RNA, 19 nt, Yersinia pestis KIM
gauccuggguuuuauugca

SEQ ID NO: 2300670 - RNA, 13 nt, Yersinia pestis KIM
gauccugcaauaa

SEQ ID NO: 2300671 - RNA, 16 nt, Yersinia pestis KIM
gauccguuuaaucagu

SEQ ID NO: 2300672 - RNA, 20 nt, Yersinia pestis KIM
gauccguuuaaucagugaca

SEQ ID NO: 2300673 - RNA, 23 nt, Yersinia pestis KIM
gauccugaacgaggacuuccugc

SEQ ID NO: 2300674 - RNA, 22 nt, Yersinia pestis KIM
gauccugaaaauagagcauacc

SEQ ID NO: 2300675 - RNA, 23 nt, Yersinia pestis KIM
gauccucguuagucacucaagcc

SEQ ID NO: 2300676 - RNA, 17 nt, Yersinia pestis KIM
gauccgggaaaaaauac

SEQ ID NO: 2300677 - RNA, 16 nt, Yersinia pestis KIM
gaucggauaguuaucu

SEQ ID NO: 2300678 - RNA, 13 nt, Yersinia pestis KIM
gaucgccaaauaa

SEQ ID NO: 2300679 - RNA, 21 nt, Yersinia pestis KIM
gaucgaucucuuuauauucaa

SEQ ID NO: 2300680 - RNA, 22 nt, Yersinia pestis KIM
gaucgauggaaccucgcgugcg

SEQ ID NO: 2300681 - RNA, 17 nt, Yersinia pestis KIM
gaucgcgacgaaaaccu

SEQ ID NO: 2300682 - RNA, 17 nt, Yersinia pestis KIM
gaucagccaucagcgcc

SEQ ID NO: 2300683 - RNA, 18 nt, Yersinia pestis KIM
gaucaacgccucacaacu

SEQ ID NO: 2300684 - RNA, 23 nt, Yersinia pestis KIM
gaucaaauuauauaagagaugaa

SEQ ID NO: 2300685 - RNA, 14 nt, Yersinia pestis KIM
gaucaacauuaucu

SEQ ID NO: 2300686 - RNA, 13 nt, Yersinia pestis KIM
gaucaguggcuua

SEQ ID NO: 2300687 - RNA, 16 nt, Yersinia pestis KIM
gaucaugguagagcug

SEQ ID NO: 2300688 - RNA, 16 nt, Yersinia pestis KIM
gaucagugaagagaua

SEQ ID NO: 2300689 - RNA, 23 nt, Yersinia pestis KIM
gauccaaaacaucggccagcguc

SEQ ID NO: 2300690 - RNA, 17 nt, Yersinia pestis KIM
gaucagcguauaaaacu

SEQ ID NO: 2300691 - RNA, 22 nt, Yersinia pestis KIM
gauaugcauuauugauguuauu

SEQ ID NO: 2300692 - RNA, 12 nt, Yersinia pestis KIM
gauaugaauaaa

SEQ ID NO: 2300693 - RNA, 16 nt, Yersinia pestis KIM
gauauguaccggugcg

SEQ ID NO: 2300694 - RNA, 21 nt, Yersinia pestis KIM
gauauuagggcugacagagcg

SEQ ID NO: 2300695 - RNA, 22 nt, Yersinia pestis KIM
gauauuaccgagcgucaagcca

SEQ ID NO: 2300696 - RNA, 13 nt, Yersinia pestis KIM
gauauuacuucuu

SEQ ID NO: 2300697 - RNA, 21 nt, Yersinia pestis KIM
gauaucgccaacguguauucc

SEQ ID NO: 2300698 - RNA, 21 nt, Yersinia pestis KIM
gauaucuaaguccaagacaga

SEQ ID NO: 2300699 - RNA, 12 nt, Yersinia pestis KIM
gauaucucuuua

SEQ ID NO: 2300700 - RNA, 20 nt, Yersinia pestis KIM
gauaucuucggcggcuaaag

SEQ ID NO: 2300701 - RNA, 19 nt, Yersinia pestis KIM
gauauccagugccaaaaua

SEQ ID NO: 2300702 - RNA, 17 nt, Yersinia pestis KIM
gauauccagugccaaaa

SEQ ID NO: 2300703 - RNA, 15 nt, Yersinia pestis KIM
gauauccgccaaaga

SEQ ID NO: 2300704 - RNA, 16 nt, Yersinia pestis KIM
gauaucaauaaagaac

SEQ ID NO: 2300705 - RNA, 13 nt, Yersinia pestis KIM
gauagcaaucaau

SEQ ID NO: 2300706 - RNA, 21 nt, Yersinia pestis KIM
gauaauccgaccaccacugca

SEQ ID NO: 2300707 - RNA, 18 nt, Yersinia pestis KIM
gauaaucguggcuguaaa

SEQ ID NO: 2300708 - RNA, 14 nt, Yersinia pestis KIM
gauaauuaauucaa

SEQ ID NO: 2300709 - RNA, 21 nt, Yersinia pestis KIM
gauaauuauccauuuucugcc

SEQ ID NO: 2300710 - RNA, 16 nt, Yersinia pestis KIM
gauaauuuaauuaguu

SEQ ID NO: 2300711 - RNA, 18 nt, Yersinia pestis KIM
gauaauuggcaauaaugu

SEQ ID NO: 2300712 - RNA, 23 nt, Yersinia pestis KIM
gauacaaagugaaacccgcgcag

SEQ ID NO: 2300713 - RNA, 23 nt, Yersinia pestis KIM
gauaauuucuacgccgucaucau

SEQ ID NO: 2300714 - RNA, 18 nt, Yersinia pestis KIM
gauaaguuuuuuuauccc

SEQ ID NO: 2300715 - RNA, 18 nt, Yersinia pestis KIM
gauaaauaauuacuuaua

SEQ ID NO: 2300716 - RNA, 21 nt, Yersinia pestis KIM
gauaauaaaacggcucaucgc

SEQ ID NO: 2300717 - RNA, 20 nt, Yersinia pestis KIM
gauaauaaauacccugcacc

SEQ ID NO: 2300718 - RNA, 21 nt, Yersinia pestis KIM
gauaauaaauacccugcacca

SEQ ID NO: 2300719 - RNA, 16 nt, Yersinia pestis KIM
gauaccacaauccggu

SEQ ID NO: 2300720 - RNA, 13 nt, Yersinia pestis KIM
gauacccgccagu

SEQ ID NO: 2300721 - RNA, 18 nt, Yersinia pestis KIM
gauacgcaaaccauggcg

SEQ ID NO: 2300722 - RNA, 13 nt, Yersinia pestis KIM
gauacccacuuua

SEQ ID NO: 2300723 - RNA, 16 nt, Yersinia pestis KIM
gauacagcccaagaga

SEQ ID NO: 2300724 - RNA, 15 nt, Yersinia pestis KIM
gauacggcuccagaa

SEQ ID NO: 2300725 - RNA, 16 nt, Yersinia pestis KIM
gauacgcgccgcagca

SEQ ID NO: 2300726 - RNA, 18 nt, Yersinia pestis KIM
gauacgcgccgcagcagu

SEQ ID NO: 2300727 - RNA, 17 nt, Yersinia pestis KIM
gauagcaaaagaaucag

SEQ ID NO: 2300728 - RNA, 19 nt, Yersinia pestis KIM
gauagcaaacaaacaguaa

SEQ ID NO: 2300729 - RNA, 20 nt, Yersinia pestis KIM
gauacuuucggguaucuguu

SEQ ID NO: 2300730 - RNA, 15 nt, Yersinia pestis KIM
gauacuuuugcuaac

SEQ ID NO: 2300731 - RNA, 19 nt, Yersinia pestis KIM
gauacuuuuuauuuuuuaa

SEQ ID NO: 2300732 - RNA, 21 nt, Yersinia pestis KIM
gaguuaucuguuucaaauaag

SEQ ID NO: 2300733 - RNA, 20 nt, Yersinia pestis KIM
gaguuaccuugugucaccau

SEQ ID NO: 2300734 - RNA, 13 nt, Yersinia pestis KIM
gagugcuggcaag

SEQ ID NO: 2300735 - RNA, 14 nt, Yersinia pestis KIM
gaguucucaccaag

SEQ ID NO: 2300736 - RNA, 17 nt, Yersinia pestis KIM
gauaaaaacauuuaaau

SEQ ID NO: 2300737 - RNA, 19 nt, Yersinia pestis KIM
gauaaacacccaagaauau

SEQ ID NO: 2300738 - RNA, 21 nt, Yersinia pestis KIM
gauaaacacccaagaauauaa

SEQ ID NO: 2300739 - RNA, 23 nt, Yersinia pestis KIM
gauaaaggcaaaagcaucaccaa

SEQ ID NO: 2300740 - RNA, 18 nt, Yersinia pestis KIM
gauaaaggccgcagauaa

SEQ ID NO: 2300741 - RNA, 23 nt, Yersinia pestis KIM
gauaaaagaaagggcaacgacau

SEQ ID NO: 2300742 - RNA, 17 nt, Yersinia pestis KIM
gauaaaacuauucugcu

SEQ ID NO: 2300743 - RNA, 18 nt, Yersinia pestis KIM
gauaaaaggcuauuuaaa

SEQ ID NO: 2300744 - RNA, 19 nt, Yersinia pestis KIM
gauaaaaggcuauuuaaau

SEQ ID NO: 2300745 - RNA, 12 nt, Yersinia pestis KIM
gauaaaaaugca

SEQ ID NO: 2300746 - RNA, 20 nt, Yersinia pestis KIM
gauaaaaauaaucaaugacc

SEQ ID NO: 2300747 - RNA, 14 nt, Yersinia pestis KIM
gauaaaaagccagu

SEQ ID NO: 2300748 - RNA, 11 nt, Yersinia pestis KIM
gauaaaaccac

SEQ ID NO: 2300749 - RNA, 23 nt, Yersinia pestis KIM
gagugcauccagcguaaacagua

SEQ ID NO: 2300750 - RNA, 13 nt, Yersinia pestis KIM
gagugauuauucu

SEQ ID NO: 2300751 - RNA, 17 nt, Yersinia pestis KIM
gagucuauugaaaaaau

SEQ ID NO: 2300752 - RNA, 21 nt, Yersinia pestis KIM
gagucuaucugcaguauuugc

SEQ ID NO: 2300753 - RNA, 21 nt, Yersinia pestis KIM
gagucgguguacguauggcau

SEQ ID NO: 2300754 - RNA, 15 nt, Yersinia pestis KIM
gagucgcuccucagc

SEQ ID NO: 2300755 - RNA, 16 nt, Yersinia pestis KIM
gagucgcuccucagcc

SEQ ID NO: 2300756 - RNA, 19 nt, Yersinia pestis KIM
gagucgcuccucagccuuu

SEQ ID NO: 2300757 - RNA, 13 nt, Yersinia pestis KIM
gagucagucaggg

SEQ ID NO: 2300758 - RNA, 13 nt, Yersinia pestis KIM
gagucagucuuug

SEQ ID NO: 2300759 - RNA, 19 nt, Yersinia pestis KIM
gaguccaaccaccaaaaac

SEQ ID NO: 2300760 - RNA, 12 nt, Yersinia pestis KIM
gaauuugcugcu

SEQ ID NO: 2300761 - RNA, 14 nt, Yersinia pestis KIM
gaauuugcugcucg

SEQ ID NO: 2300762 - RNA, 16 nt, Yersinia pestis KIM
gaauuugauacaguga

SEQ ID NO: 2300763 - RNA, 23 nt, Yersinia pestis KIM
gagucacuggggugaaucaaaac

SEQ ID NO: 2300764 - RNA, 23 nt, Yersinia pestis KIM
gagucacuuauauugaagcuguu

SEQ ID NO: 2300765 - RNA, 15 nt, Yersinia pestis KIM
gagucacugggguga

SEQ ID NO: 2300766 - RNA, 21 nt, Yersinia pestis KIM
gagucagcaaggugagcacuu

SEQ ID NO: 2300767 - RNA, 13 nt, Yersinia pestis KIM
gagucacagcauu

SEQ ID NO: 2300768 - RNA, 18 nt, Yersinia pestis KIM
cuuuuaacguuagagcac

SEQ ID NO: 2300769 - RNA, 22 nt, Yersinia pestis KIM
cuuuuaaaugaagcaguucacu

SEQ ID NO: 2300770 - RNA, 22 nt, Yersinia pestis KIM
cuuuuacaaauuugacauuucc

SEQ ID NO: 2300771 - RNA, 18 nt, Yersinia pestis KIM
cuuuguuuuuuagcauca

SEQ ID NO: 2300772 - RNA, 21 nt, Yersinia pestis KIM
cuuucuuuucgcuauuucucu

SEQ ID NO: 2300773 - RNA, 20 nt, Yersinia pestis KIM
cuuugucaauaaccucagcc

SEQ ID NO: 2300774 - RNA, 21 nt, Yersinia pestis KIM
cuuugucaauaaccucagccu

SEQ ID NO: 2300775 - RNA, 16 nt, Yersinia pestis KIM
cuuuuaccgcaaccac

SEQ ID NO: 2300776 - RNA, 15 nt, Yersinia pestis KIM
cuuuuaccaacccag

SEQ ID NO: 2300777 - RNA, 21 nt, Yersinia pestis KIM
cuuuuauacagcauauaaaaa

SEQ ID NO: 2300778 - RNA, 22 nt, Yersinia pestis KIM
cuuuuauacagcauauaaaaaa

SEQ ID NO: 2300779 - RNA, 21 nt, Yersinia pestis KIM
cuuuuauugucuuuaauaaaa

SEQ ID NO: 2300780 - RNA, 22 nt, Yersinia pestis KIM
cuuuuauuggcauuaaacugaa

SEQ ID NO: 2300781 - RNA, 18 nt, Yersinia pestis KIM
cuuuuccuccguuuuuuc

SEQ ID NO: 2300782 - RNA, 18 nt, Yersinia pestis KIM
cuuuuccgccaugagaac

SEQ ID NO: 2300783 - RNA, 13 nt, Yersinia pestis KIM
cuuuuauuuuuua

SEQ ID NO: 2300784 - RNA, 23 nt, Yersinia pestis KIM
cuuuuauuuuuuaugacuucuua

SEQ ID NO: 2300785 - RNA, 22 nt, Yersinia pestis KIM
cuuuuauuugauucgucugcca

SEQ ID NO: 2300786 - RNA, 15 nt, Yersinia pestis KIM
cuuuuggcagcacca

SEQ ID NO: 2300787 - RNA, 20 nt, Yersinia pestis KIM
cuuuugcauauuucucuuug

SEQ ID NO: 2300788 - RNA, 17 nt, Yersinia pestis KIM
cuuuugcauauuucucu

SEQ ID NO: 2300789 - RNA, 14 nt, Yersinia pestis KIM
cuuuugccacauuu

SEQ ID NO: 2300790 - RNA, 16 nt, Yersinia pestis KIM
cuuuugaauucaccaa

SEQ ID NO: 2300791 - RNA, 17 nt, Yersinia pestis KIM
cuuuugauuuguuaaaa

SEQ ID NO: 2300792 - RNA, 13 nt, Yersinia pestis KIM
cuuuucugccuau

SEQ ID NO: 2300793 - RNA, 21 nt, Yersinia pestis KIM
cuuuucugccuaucuuaaaaa

SEQ ID NO: 2300794 - RNA, 22 nt, Yersinia pestis KIM
cuuuucuuuaugucuuuuucuu

SEQ ID NO: 2300795 - RNA, 16 nt, Yersinia pestis KIM
cuuuucugauuuuuua

SEQ ID NO: 2300796 - RNA, 12 nt, Yersinia pestis KIM
cuuuucugccua

SEQ ID NO: 2300797 - RNA, 13 nt, Yersinia pestis KIM
cuuuuuauuucuu

SEQ ID NO: 2300798 - RNA, 19 nt, Yersinia pestis KIM
cuuuuuauuucuuuuaaau

SEQ ID NO: 2300799 - RNA, 19 nt, Yersinia pestis KIM
cuuuuuauguaacaacuga

SEQ ID NO: 2300800 - RNA, 23 nt, Yersinia pestis KIM
cuuuuuauaagcguuauuuuugu

SEQ ID NO: 2300801 - RNA, 19 nt, Yersinia pestis KIM
cuuuuuacgccuauccuca

SEQ ID NO: 2300802 - RNA, 14 nt, Yersinia pestis KIM
cuuuuuacuuuuua

SEQ ID NO: 2300803 - RNA, 14 nt, Yersinia pestis KIM
cuuuuuaauuuaua

SEQ ID NO: 2300804 - RNA, 17 nt, Yersinia pestis KIM
cuuuuuccuuauuucuu

SEQ ID NO: 2300805 - RNA, 15 nt, Yersinia pestis KIM
cuuuuucuuuuuaac

SEQ ID NO: 2300806 - RNA, 19 nt, Yersinia pestis KIM
gaaaaguggcuaucugaaa

SEQ ID NO: 2300807 - RNA, 15 nt, Yersinia pestis KIM
gaaaagugauccacu

SEQ ID NO: 2300808 - RNA, 21 nt, Yersinia pestis KIM
gaaaauagagcauaccaauac

SEQ ID NO: 2300809 - RNA, 19 nt, Yersinia pestis KIM
gaaaauaccgcgaucaaca

SEQ ID NO: 2300810 - RNA, 17 nt, Yersinia pestis KIM
gaaaacguuaacugcag

SEQ ID NO: 2300811 - RNA, 13 nt, Yersinia pestis KIM
gaaaagcaccgca

SEQ ID NO: 2300812 - RNA, 12 nt, Yersinia pestis KIM
gaaaagaggggc

SEQ ID NO: 2300813 - RNA, 19 nt, Yersinia pestis KIM
gaaaagagucgcuuuggga

SEQ ID NO: 2300814 - RNA, 19 nt, Yersinia pestis KIM
gaaacaccacgcccaauuc

SEQ ID NO: 2300815 - RNA, 15 nt, Yersinia pestis KIM
gaaacaaaaccaacc

SEQ ID NO: 2300816 - RNA, 11 nt, Yersinia pestis KIM
gaaacaaauac

SEQ ID NO: 2300817 - RNA, 13 nt, Yersinia pestis KIM
gaaacaacccaaa

SEQ ID NO: 2300818 - RNA, 20 nt, Yersinia pestis KIM
gaaacaacccaaaggggagc

SEQ ID NO: 2300819 - RNA, 16 nt, Yersinia pestis KIM
gaaaauguccauaaua

SEQ ID NO: 2300820 - RNA, 20 nt, Yersinia pestis KIM
gaaaaugguuagauuacagc

SEQ ID NO: 2300821 - RNA, 21 nt, Yersinia pestis KIM
gaaaauauucuaaguaaaaca

SEQ ID NO: 2300822 - RNA, 14 nt, Yersinia pestis KIM
gaaaaugcggcggc

SEQ ID NO: 2300823 - RNA, 19 nt, Yersinia pestis KIM
gaaaaaggcaccagcgcac

SEQ ID NO: 2300824 - RNA, 18 nt, Yersinia pestis KIM
gaaaaaggccgacugaga

SEQ ID NO: 2300825 - RNA, 23 nt, Yersinia pestis KIM
gaaaaaugagccgaccgucguaa

SEQ ID NO: 2300826 - RNA, 17 nt, Yersinia pestis KIM
gaaaaaucacauacugg

SEQ ID NO: 2300827 - RNA, 15 nt, Yersinia pestis KIM
gaaaaauacaaauau

SEQ ID NO: 2300828 - RNA, 15 nt, Yersinia pestis KIM
gaaaacgccagcaga

SEQ ID NO: 2300829 - RNA, 18 nt, Yersinia pestis KIM
gaaaacccauaccacuga

SEQ ID NO: 2300830 - RNA, 21 nt, Yersinia pestis KIM
gaaaacauuaaggcgauauua

SEQ ID NO: 2300831 - RNA, 15 nt, Yersinia pestis KIM
gaaaacaaguuucac

SEQ ID NO: 2300832 - RNA, 21 nt, Yersinia pestis KIM
gaaaacaaguuucacuuucaa

SEQ ID NO: 2300833 - RNA, 22 nt, Yersinia pestis KIM
gaaaacaaguuucacuuucaac

SEQ ID NO: 2300834 - RNA, 17 nt, Yersinia pestis KIM
gaaaaauuucacuggca

SEQ ID NO: 2300835 - RNA, 21 nt, Yersinia pestis KIM
gaaaacagccaccagccaacu

SEQ ID NO: 2300836 - RNA, 15 nt, Yersinia pestis KIM
gaaaacagguaaugc

SEQ ID NO: 2300837 - RNA, 17 nt, Yersinia pestis KIM
gaaaacagccaccagcc

SEQ ID NO: 2300838 - RNA, 16 nt, Yersinia pestis KIM
gaaaacagcaacacca

SEQ ID NO: 2300839 - RNA, 21 nt, Yersinia pestis KIM
gaaaacaauauaauaacucua

SEQ ID NO: 2300840 - RNA, 15 nt, Yersinia pestis KIM
gaaaaaacaucacac

SEQ ID NO: 2300841 - RNA, 12 nt, Yersinia pestis KIM
cuuuuuuugugu

SEQ ID NO: 2300842 - RNA, 16 nt, Yersinia pestis KIM
gaaaaaaucuuccuuu

SEQ ID NO: 2300843 - RNA, 13 nt, Yersinia pestis KIM
gaaaaaauaaugu

SEQ ID NO: 2300844 - RNA, 15 nt, Yersinia pestis KIM
cuuuuuuaauaaaaa

SEQ ID NO: 2300845 - RNA, 17 nt, Yersinia pestis KIM
cuuuuuggcaaacucag

SEQ ID NO: 2300846 - RNA, 15 nt, Yersinia pestis KIM
cuuuuuguauuuuug

SEQ ID NO: 2300847 - RNA, 17 nt, Yersinia pestis KIM
cuuuuuuguugccacuc

SEQ ID NO: 2300848 - RNA, 18 nt, Yersinia pestis KIM
cuuuuuuguuguuuuuuu

SEQ ID NO: 2300849 - RNA, 14 nt, Yersinia pestis KIM
cuuuuuuauaauaa

SEQ ID NO: 2300850 - RNA, 14 nt, Yersinia pestis KIM
gaaaccuaaugcca

SEQ ID NO: 2300851 - RNA, 20 nt, Yersinia pestis KIM
gaaaccuacgccuaaaaaug

SEQ ID NO: 2300852 - RNA, 19 nt, Yersinia pestis KIM
gaaacgccuccucuuggau

SEQ ID NO: 2300853 - RNA, 20 nt, Yersinia pestis KIM
gaaacgauuacccaccaccu

SEQ ID NO: 2300854 - RNA, 16 nt, Yersinia pestis KIM
gaaacgauuacccacc

SEQ ID NO: 2300855 - RNA, 17 nt, Yersinia pestis KIM
gaaacgauaugcuccag

SEQ ID NO: 2300856 - RNA, 20 nt, Yersinia pestis KIM
gaaacgcccaaaucugccug

SEQ ID NO: 2300857 - RNA, 17 nt, Yersinia pestis KIM
gaaacccacauaucucc

SEQ ID NO: 2300858 - RNA, 19 nt, Yersinia pestis KIM
gaaaccauugguaauaaug

SEQ ID NO: 2300859 - RNA, 20 nt, Yersinia pestis KIM
gaaaccauugguaauaaugc

SEQ ID NO: 2300860 - RNA, 15 nt, Yersinia pestis KIM
gaaaccagcggcagc

SEQ ID NO: 2300861 - RNA, 15 nt, Yersinia pestis KIM
gaaacaucuucauuu

SEQ ID NO: 2300862 - RNA, 19 nt, Yersinia pestis KIM
gaaacaugcugaagccagc

SEQ ID NO: 2300863 - RNA, 18 nt, Yersinia pestis KIM
gaaacagguaguggaaau

SEQ ID NO: 2300864 - RNA, 16 nt, Yersinia pestis KIM
gaaagaaauaaaagaa

SEQ ID NO: 2300865 - RNA, 14 nt, Yersinia pestis KIM
gaaagacguggcac

SEQ ID NO: 2300866 - RNA, 15 nt, Yersinia pestis KIM
gaaacuucauuucag

SEQ ID NO: 2300867 - RNA, 15 nt, Yersinia pestis KIM
gaaacuucaaaauca

SEQ ID NO: 2300868 - RNA, 21 nt, Yersinia pestis KIM
gaaacugccgccaccauauca

SEQ ID NO: 2300869 - RNA, 19 nt, Yersinia pestis KIM
gaaacuccagucacuggcc

SEQ ID NO: 2300870 - RNA, 17 nt, Yersinia pestis KIM
gaaacggugaggauagg

SEQ ID NO: 2300871 - RNA, 22 nt, Yersinia pestis KIM
gaaauaauaucaagucuugaag

SEQ ID NO: 2300872 - RNA, 17 nt, Yersinia pestis KIM
gaaauaacugccagggc

SEQ ID NO: 2300873 - RNA, 18 nt, Yersinia pestis KIM
gaaauaaauaaguucaga

SEQ ID NO: 2300874 - RNA, 19 nt, Yersinia pestis KIM
gaaauaaagucguucuuug

SEQ ID NO: 2300875 - RNA, 17 nt, Yersinia pestis KIM
gaaauaaauucaucuca

SEQ ID NO: 2300876 - RNA, 18 nt, Yersinia pestis KIM
gaaauaaaaaccgcagca

SEQ ID NO: 2300877 - RNA, 21 nt, Yersinia pestis KIM
gaaaguugagcagcaauaacu

SEQ ID NO: 2300878 - RNA, 15 nt, Yersinia pestis KIM
gaaaguuguucauua

SEQ ID NO: 2300879 - RNA, 15 nt, Yersinia pestis KIM
gaaaguuuauaugcu

SEQ ID NO: 2300880 - RNA, 17 nt, Yersinia pestis KIM
gaaauauggugauaacu

SEQ ID NO: 2300881 - RNA, 19 nt, Yersinia pestis KIM
gaaauauggugauaacugc

SEQ ID NO: 2300882 - RNA, 14 nt, Yersinia pestis KIM
gaaauauucgcauu

SEQ ID NO: 2300883 - RNA, 16 nt, Yersinia pestis KIM
gaaauagucgcgcugu

SEQ ID NO: 2300884 - RNA, 14 nt, Yersinia pestis KIM
gaaauauaaaacag

SEQ ID NO: 2300885 - RNA, 13 nt, Yersinia pestis KIM
gaaauagaaaacc

SEQ ID NO: 2300886 - RNA, 20 nt, Yersinia pestis KIM
gaaauaguaauuaauuauga

SEQ ID NO: 2300887 - RNA, 12 nt, Yersinia pestis KIM
gaaauagcacca

SEQ ID NO: 2300888 - RNA, 20 nt, Yersinia pestis KIM
gaaauacaggcuauauugcu

SEQ ID NO: 2300889 - RNA, 15 nt, Yersinia pestis KIM
gaaauaccacggcac

SEQ ID NO: 2300890 - RNA, 13 nt, Yersinia pestis KIM
gaaauacccccca

SEQ ID NO: 2300891 - RNA, 19 nt, Yersinia pestis KIM
gaaagcauggcagguauca

SEQ ID NO: 2300892 - RNA, 23 nt, Yersinia pestis KIM
gaaagcaauuagcacauaugcag

SEQ ID NO: 2300893 - RNA, 18 nt, Yersinia pestis KIM
gaaagcaggucgccaaac

SEQ ID NO: 2300894 - RNA, 21 nt, Yersinia pestis KIM
gaaaggccggauguaaaacac

SEQ ID NO: 2300895 - RNA, 23 nt, Yersinia pestis KIM
gaaagcuucaacuuccagugcca

SEQ ID NO: 2300896 - RNA, 17 nt, Yersinia pestis KIM
gaaagggaaguuucuua

SEQ ID NO: 2300897 - RNA, 23 nt, Yersinia pestis KIM
gaaagguagaucggggacaggcu

SEQ ID NO: 2300898 - RNA, 18 nt, Yersinia pestis KIM
gaacagccccgcaggugg

SEQ ID NO: 2300899 - RNA, 12 nt, Yersinia pestis KIM
gaacagcccucc

SEQ ID NO: 2300900 - RNA, 14 nt, Yersinia pestis KIM
gaacagauugcagg

SEQ ID NO: 2300901 - RNA, 21 nt, Yersinia pestis KIM
gaacacuuaauuccaugcaaa

SEQ ID NO: 2300902 - RNA, 19 nt, Yersinia pestis KIM
gaacaauaccgccaauauc

SEQ ID NO: 2300903 - RNA, 15 nt, Yersinia pestis KIM
gaacaacgaaacaca

SEQ ID NO: 2300904 - RNA, 15 nt, Yersinia pestis KIM
gaacaccauacuuuu

SEQ ID NO: 2300905 - RNA, 23 nt, Yersinia pestis KIM
gaacauagcuauuggcugauuca

SEQ ID NO: 2300906 - RNA, 21 nt, Yersinia pestis KIM
gaacauucaucuuuugcuauu

SEQ ID NO: 2300907 - RNA, 16 nt, Yersinia pestis KIM
gaacauuauuuuucac

SEQ ID NO: 2300908 - RNA, 20 nt, Yersinia pestis KIM
gaacaugcguugaugcucuu

SEQ ID NO: 2300909 - RNA, 13 nt, Yersinia pestis KIM
gaacauuuucuaa

SEQ ID NO: 2300910 - RNA, 22 nt, Yersinia pestis KIM
gaacauuuucuaagcugccugu

SEQ ID NO: 2300911 - RNA, 18 nt, Yersinia pestis KIM
gaacauuuaucuaucugu

SEQ ID NO: 2300912 - RNA, 15 nt, Yersinia pestis KIM
gaaccaaggugguau

SEQ ID NO: 2300913 - RNA, 15 nt, Yersinia pestis KIM
gaaccaauuuuucug

SEQ ID NO: 2300914 - RNA, 21 nt, Yersinia pestis KIM
gaacagcggcuuaaugauggc

SEQ ID NO: 2300915 - RNA, 18 nt, Yersinia pestis KIM
gaaauuuaaaaacccucu

SEQ ID NO: 2300916 - RNA, 17 nt, Yersinia pestis KIM
gaaauucauaccuuaau

SEQ ID NO: 2300917 - RNA, 16 nt, Yersinia pestis KIM
gaaauucgggcugagu

SEQ ID NO: 2300918 - RNA, 23 nt, Yersinia pestis KIM
gaaauucgggcugaguaaagccc

SEQ ID NO: 2300919 - RNA, 19 nt, Yersinia pestis KIM
gaaauucuguagaguaaaa

SEQ ID NO: 2300920 - RNA, 18 nt, Yersinia pestis KIM
gaaaucgcggcgaaggcu

SEQ ID NO: 2300921 - RNA, 15 nt, Yersinia pestis KIM
gaaaucgaaauuaag

SEQ ID NO: 2300922 - RNA, 15 nt, Yersinia pestis KIM
gaaaucgaucauaau

SEQ ID NO: 2300923 - RNA, 21 nt, Yersinia pestis KIM
gaagacacuuugguuugcagc

SEQ ID NO: 2300924 - RNA, 15 nt, Yersinia pestis KIM
gaagagaaaagcaga

SEQ ID NO: 2300925 - RNA, 23 nt, Yersinia pestis KIM
gaagagaacaggcagcaaauaaa

SEQ ID NO: 2300926 - RNA, 21 nt, Yersinia pestis KIM
gaagacuuccagcaccacuaa

SEQ ID NO: 2300927 - RNA, 15 nt, Yersinia pestis KIM
gaagacaucgccaga

SEQ ID NO: 2300928 - RNA, 17 nt, Yersinia pestis KIM
gaagacaacucuucuau

SEQ ID NO: 2300929 - RNA, 12 nt, Yersinia pestis KIM
gaagaauugcag

SEQ ID NO: 2300930 - RNA, 13 nt, Yersinia pestis KIM
gaagaaacccagu

SEQ ID NO: 2300931 - RNA, 22 nt, Yersinia pestis KIM
gaagaaaccuaaugccagacac

SEQ ID NO: 2300932 - RNA, 14 nt, Yersinia pestis KIM
gaagaacagcccuc

SEQ ID NO: 2300933 - RNA, 19 nt, Yersinia pestis KIM
gaagcaguucacugaguug

SEQ ID NO: 2300934 - RNA, 19 nt, Yersinia pestis KIM
gaagcaauuugaucaccaa

SEQ ID NO: 2300935 - RNA, 15 nt, Yersinia pestis KIM
gaagcacaaaaagag

SEQ ID NO: 2300936 - RNA, 22 nt, Yersinia pestis KIM
gaagauuuaaauaacagcuaaa

SEQ ID NO: 2300937 - RNA, 19 nt, Yersinia pestis KIM
gaagauacaauagauaacu

SEQ ID NO: 2300938 - RNA, 22 nt, Yersinia pestis KIM
gaagaguuugaucauggcucag

SEQ ID NO: 2300939 - RNA, 22 nt, Yersinia pestis KIM
gaagaguugauccgauaaacuu

SEQ ID NO: 2300940 - RNA, 17 nt, Yersinia pestis KIM
gaagaguaaagcguccg

SEQ ID NO: 2300941 - RNA, 19 nt, Yersinia pestis KIM
gaagcguggaguuuacgca

SEQ ID NO: 2300942 - RNA, 14 nt, Yersinia pestis KIM
gaagcuaccagcac

SEQ ID NO: 2300943 - RNA, 14 nt, Yersinia pestis KIM
gaagcguaaagcac

SEQ ID NO: 2300944 - RNA, 22 nt, Yersinia pestis KIM
gaagcgggcggccucugcugcu

SEQ ID NO: 2300945 - RNA, 23 nt, Yersinia pestis KIM
gaagcugauggcgaucaaaauca

SEQ ID NO: 2300946 - RNA, 18 nt, Yersinia pestis KIM
gaagcucauuaauccccg

SEQ ID NO: 2300947 - RNA, 15 nt, Yersinia pestis KIM
gaaggcacccaugcu

SEQ ID NO: 2300948 - RNA, 13 nt, Yersinia pestis KIM
gaaggccauaauc

SEQ ID NO: 2300949 - RNA, 18 nt, Yersinia pestis KIM
gaaggccauaaucugcug

SEQ ID NO: 2300950 - RNA, 18 nt, Yersinia pestis KIM
gaaggacuuggcguaacu

SEQ ID NO: 2300951 - RNA, 15 nt, Yersinia pestis KIM
gaagcuguuuccuga

SEQ ID NO: 2300952 - RNA, 21 nt, Yersinia pestis KIM
gaagcuguuuccugagucugu

SEQ ID NO: 2300953 - RNA, 18 nt, Yersinia pestis KIM
gaagcgccgacacccagc

SEQ ID NO: 2300954 - RNA, 14 nt, Yersinia pestis KIM
gaagcgcgcccucc

SEQ ID NO: 2300955 - RNA, 21 nt, Yersinia pestis KIM
gaagccuacgagagaucguag

SEQ ID NO: 2300956 - RNA, 21 nt, Yersinia pestis KIM
gaagccugaauauucaccauc

SEQ ID NO: 2300957 - RNA, 20 nt, Yersinia pestis KIM
gaagccuguucgauuugauc

SEQ ID NO: 2300958 - RNA, 22 nt, Yersinia pestis KIM
gaagcgacacuuauuggucgcu

SEQ ID NO: 2300959 - RNA, 18 nt, Yersinia pestis KIM
gaagcccguuauggcaag

SEQ ID NO: 2300960 - RNA, 17 nt, Yersinia pestis KIM
gaagccgacgaucuugc

SEQ ID NO: 2300961 - RNA, 12 nt, Yersinia pestis KIM
gaaccagauaac

SEQ ID NO: 2300962 - RNA, 20 nt, Yersinia pestis KIM
gaaccacaucgaguggucga

SEQ ID NO: 2300963 - RNA, 19 nt, Yersinia pestis KIM
gaaccaugagaaugcgaca

SEQ ID NO: 2300964 - RNA, 15 nt, Yersinia pestis KIM
gaacccauucaucaa

SEQ ID NO: 2300965 - RNA, 18 nt, Yersinia pestis KIM
gaacccccgcgaacagca

SEQ ID NO: 2300966 - RNA, 17 nt, Yersinia pestis KIM
gaaccgcgcucugcugg

SEQ ID NO: 2300967 - RNA, 16 nt, Yersinia pestis KIM
gaaccgcuaucugcug

SEQ ID NO: 2300968 - RNA, 20 nt, Yersinia pestis KIM
gaaccccuucaggccaucca

SEQ ID NO: 2300969 - RNA, 20 nt, Yersinia pestis KIM
gaacccgauaacccacagca

SEQ ID NO: 2300970 - RNA, 17 nt, Yersinia pestis KIM
gaacccuucagcaucga

SEQ ID NO: 2300971 - RNA, 21 nt, Yersinia pestis KIM
gaacgaguaaaaagauggccu

SEQ ID NO: 2300972 - RNA, 19 nt, Yersinia pestis KIM
gaacgaggcccgauaaacu

SEQ ID NO: 2300973 - RNA, 17 nt, Yersinia pestis KIM
gaacgauauuuucgaca

SEQ ID NO: 2300974 - RNA, 23 nt, Yersinia pestis KIM
gaacgauuuucuuucaccacugc

SEQ ID NO: 2300975 - RNA, 16 nt, Yersinia pestis KIM
gaaccugacgcacagc

SEQ ID NO: 2300976 - RNA, 20 nt, Yersinia pestis KIM
gaaccugaaauacaaauaaa

SEQ ID NO: 2300977 - RNA, 22 nt, Yersinia pestis KIM
gaaccuguuacaucagagcuca

SEQ ID NO: 2300978 - RNA, 23 nt, Yersinia pestis KIM
gaaccuuggcauugucugcuggc

SEQ ID NO: 2300979 - RNA, 15 nt, Yersinia pestis KIM
gaaccuuguuuuacc

SEQ ID NO: 2300980 - RNA, 22 nt, Yersinia pestis KIM
gaacggacauuuuacucccuga

SEQ ID NO: 2300981 - RNA, 23 nt, Yersinia pestis KIM
gaacggccaucaauaaagcuggc

SEQ ID NO: 2300982 - RNA, 14 nt, Yersinia pestis KIM
gaacggucagggaa

SEQ ID NO: 2300983 - RNA, 16 nt, Yersinia pestis KIM
gaacuagguuaaaauc

SEQ ID NO: 2300984 - RNA, 20 nt, Yersinia pestis KIM
gaacuaccgugcggcuucuu

SEQ ID NO: 2300985 - RNA, 14 nt, Yersinia pestis KIM
gaacuaauaucaac

SEQ ID NO: 2300986 - RNA, 16 nt, Yersinia pestis KIM
gaacuaacaugccagc

SEQ ID NO: 2300987 - RNA, 17 nt, Yersinia pestis KIM
gaacguuugaucccacu

SEQ ID NO: 2300988 - RNA, 15 nt, Yersinia pestis KIM
gaacguagcuaacac

SEQ ID NO: 2300989 - RNA, 18 nt, Yersinia pestis KIM
gaacguagcuaacaccgc

SEQ ID NO: 2300990 - RNA, 21 nt, Yersinia pestis KIM
gaacguaagauaauacggaua

SEQ ID NO: 2300991 - RNA, 14 nt, Yersinia pestis KIM
gaacuuacucccuu

SEQ ID NO: 2300992 - RNA, 22 nt, Yersinia pestis KIM
gaacuuacaugaguaagugauu

SEQ ID NO: 2300993 - RNA, 15 nt, Yersinia pestis KIM
gaacuguaaauauca

SEQ ID NO: 2300994 - RNA, 19 nt, Yersinia pestis KIM
gaauggggggcaaccuggu

SEQ ID NO: 2300995 - RNA, 17 nt, Yersinia pestis KIM
gaauggucugcaacuca

SEQ ID NO: 2300996 - RNA, 21 nt, Yersinia pestis KIM
gaauuaagaagccucaugaau

SEQ ID NO: 2300997 - RNA, 14 nt, Yersinia pestis KIM
gaauuaagaagccu

SEQ ID NO: 2300998 - RNA, 17 nt, Yersinia pestis KIM
gaauuaagaagccucau

SEQ ID NO: 2300999 - RNA, 17 nt, Yersinia pestis KIM
gaauuaacaauucucuc

SEQ ID NO: 2301000 - RNA, 21 nt, Yersinia pestis KIM
gaauuaaauuuuauauuaucu

SEQ ID NO: 2301001 - RNA, 13 nt, Yersinia pestis KIM
gaauguuaaaccc

SEQ ID NO: 2301002 - RNA, 16 nt, Yersinia pestis KIM
gaauguuaaacccccu

SEQ ID NO: 2301003 - RNA, 13 nt, Yersinia pestis KIM
gaauguucauuca

SEQ ID NO: 2301004 - RNA, 21 nt, Yersinia pestis KIM
gaaugcgguucuguaucauau

SEQ ID NO: 2301005 - RNA, 22 nt, Yersinia pestis KIM
gaaugcgccgcggcccugaggu

SEQ ID NO: 2301006 - RNA, 17 nt, Yersinia pestis KIM
gaauggcaacguauaau

SEQ ID NO: 2301007 - RNA, 17 nt, Yersinia pestis KIM
gaauggcaaagcacagu

SEQ ID NO: 2301008 - RNA, 16 nt, Yersinia pestis KIM
gaauggaaguuaaaaa

SEQ ID NO: 2301009 - RNA, 22 nt, Yersinia pestis KIM
gaauggagccgcuagcgcaggu

SEQ ID NO: 2301010 - RNA, 18 nt, Yersinia pestis KIM
gaauuaucauccagauuc

SEQ ID NO: 2301011 - RNA, 16 nt, Yersinia pestis KIM
gaauuaaggaaacuca

SEQ ID NO: 2301012 - RNA, 10 nt, Yersinia pestis KIM
gaauuaauaa

SEQ ID NO: 2301013 - RNA, 15 nt, Yersinia pestis KIM
gaauuaauaaaaccu

SEQ ID NO: 2301014 - RNA, 14 nt, Yersinia pestis KIM
gaauuaauaacagu

SEQ ID NO: 2301015 - RNA, 17 nt, Yersinia pestis KIM
gaauccggauccagcgc

SEQ ID NO: 2301016 - RNA, 13 nt, Yersinia pestis KIM
gaauccgcuggcg

SEQ ID NO: 2301017 - RNA, 14 nt, Yersinia pestis KIM
gaaucccaucaaac

SEQ ID NO: 2301018 - RNA, 14 nt, Yersinia pestis KIM
gaaucacuuacugg

SEQ ID NO: 2301019 - RNA, 20 nt, Yersinia pestis KIM
gaaucagauacggcuccaga

SEQ ID NO: 2301020 - RNA, 14 nt, Yersinia pestis KIM
gaaucagcggcggc

SEQ ID NO: 2301021 - RNA, 20 nt, Yersinia pestis KIM
gaaucaguggucuuccgccu

SEQ ID NO: 2301022 - RNA, 15 nt, Yersinia pestis KIM
gaaucaucagacgca

SEQ ID NO: 2301023 - RNA, 21 nt, Yersinia pestis KIM
gaaugaaguucaccagcuugg

SEQ ID NO: 2301024 - RNA, 14 nt, Yersinia pestis KIM
gaaugaauucuaua

SEQ ID NO: 2301025 - RNA, 21 nt, Yersinia pestis KIM
gaaucuucaaugguguuaucu

SEQ ID NO: 2301026 - RNA, 15 nt, Yersinia pestis KIM
gaaugauucauugag

SEQ ID NO: 2301027 - RNA, 19 nt, Yersinia pestis KIM
gaaugaguugcccuaaaca

SEQ ID NO: 2301028 - RNA, 16 nt, Yersinia pestis KIM
gaaugaucagaggcug

SEQ ID NO: 2301029 - RNA, 16 nt, Yersinia pestis KIM
gaaugaggcugagguu

SEQ ID NO: 2301030 - RNA, 22 nt, Yersinia pestis KIM
gaaucgccguagauuuaacccc

SEQ ID NO: 2301031 - RNA, 15 nt, Yersinia pestis KIM
gaaucucccuuguuu

SEQ ID NO: 2301032 - RNA, 12 nt, Yersinia pestis KIM
gaagguaaugcg

SEQ ID NO: 2301033 - RNA, 18 nt, Yersinia pestis KIM
gaagguaaucagacugcu

SEQ ID NO: 2301034 - RNA, 19 nt, Yersinia pestis KIM
gaagguaaucagacugcug

SEQ ID NO: 2301035 - RNA, 22 nt, Yersinia pestis KIM
gaagguaaucagacugcugaca

SEQ ID NO: 2301036 - RNA, 22 nt, Yersinia pestis KIM
gaaggucauucccgagauaacc

SEQ ID NO: 2301037 - RNA, 19 nt, Yersinia pestis KIM
gaagguguuuaaaauuaau

SEQ ID NO: 2301038 - RNA, 21 nt, Yersinia pestis KIM
gaagggaguuacucagcaucc

SEQ ID NO: 2301039 - RNA, 13 nt, Yersinia pestis KIM
gaagggcgcagcc

SEQ ID NO: 2301040 - RNA, 16 nt, Yersinia pestis KIM
gaagggcggccagcaa

SEQ ID NO: 2301041 - RNA, 22 nt, Yersinia pestis KIM
gaagggcggccagcaagagcag

SEQ ID NO: 2301042 - RNA, 15 nt, Yersinia pestis KIM
gaaggguauugaaga

SEQ ID NO: 2301043 - RNA, 16 nt, Yersinia pestis KIM
gaagguaacuuaaaau

SEQ ID NO: 2301044 - RNA, 14 nt, Yersinia pestis KIM
gaaggccugcugug

SEQ ID NO: 2301045 - RNA, 21 nt, Yersinia pestis KIM
gaaggcucauagucggcagcu

SEQ ID NO: 2301046 - RNA, 15 nt, Yersinia pestis KIM
gaaggcugauuaaua

SEQ ID NO: 2301047 - RNA, 15 nt, Yersinia pestis KIM
gaaguuggcuuuugc

SEQ ID NO: 2301048 - RNA, 13 nt, Yersinia pestis KIM
gaauaaaauccac

SEQ ID NO: 2301049 - RNA, 17 nt, Yersinia pestis KIM
gaauaaaaaagcccggu

SEQ ID NO: 2301050 - RNA, 12 nt, Yersinia pestis KIM
gaaguggacacg

SEQ ID NO: 2301051 - RNA, 18 nt, Yersinia pestis KIM
gaauacccaaaauuugcu

SEQ ID NO: 2301052 - RNA, 20 nt, Yersinia pestis KIM
gaauacacagcgagaaucuu

SEQ ID NO: 2301053 - RNA, 17 nt, Yersinia pestis KIM
gaauaauuacagcuggg

SEQ ID NO: 2301054 - RNA, 21 nt, Yersinia pestis KIM
gaauaccggccugauuuacug

SEQ ID NO: 2301055 - RNA, 19 nt, Yersinia pestis KIM
gaauacguagcccuuugcu

SEQ ID NO: 2301056 - RNA, 19 nt, Yersinia pestis KIM
gaauacggcggugaguacu

SEQ ID NO: 2301057 - RNA, 23 nt, Yersinia pestis KIM
gaauaauccccacggccagagcc

SEQ ID NO: 2301058 - RNA, 20 nt, Yersinia pestis KIM
gaauaagagagacgggauaa

SEQ ID NO: 2301059 - RNA, 12 nt, Yersinia pestis KIM
gaauaaggguag

SEQ ID NO: 2301060 - RNA, 17 nt, Yersinia pestis KIM
gaauaacaaaagcccgu

SEQ ID NO: 2301061 - RNA, 16 nt, Yersinia pestis KIM
gaauaaccuacuccaa

SEQ ID NO: 2301062 - RNA, 17 nt, Yersinia pestis KIM
gaauaacggcaguaacc

SEQ ID NO: 2301063 - RNA, 20 nt, Yersinia pestis KIM
gaauaacguggaaaaaacgg

SEQ ID NO: 2301064 - RNA, 17 nt, Yersinia pestis KIM
gaauaacucucaucuau

SEQ ID NO: 2301065 - RNA, 20 nt, Yersinia pestis KIM
gaauagagccucuauuaccu

SEQ ID NO: 2301066 - RNA, 22 nt, Yersinia pestis KIM
gaauagagacggaaagagccag

SEQ ID NO: 2301067 - RNA, 19 nt, Yersinia pestis KIM
gaauagaccugaugacccg

SEQ ID NO: 2301068 - RNA, 16 nt, Yersinia pestis KIM
gaauacuucaggccaa

SEQ ID NO: 2301069 - RNA, 15 nt, Yersinia pestis KIM
gaauagccaagccuu

SEQ ID NO: 2301070 - RNA, 15 nt, Yersinia pestis KIM
gaauagcaucagggg

SEQ ID NO: 2301071 - RNA, 16 nt, Yersinia pestis KIM
gaauagcuguaaaaua

SEQ ID NO: 2301072 - RNA, 22 nt, Yersinia pestis KIM
gaauagcuguaaaauaccaauu

SEQ ID NO: 2301073 - RNA, 19 nt, Yersinia pestis KIM
gaauagcgcugcaucagca

SEQ ID NO: 2301074 - RNA, 20 nt, Yersinia pestis KIM
gaauagcgcugcaucagcag

SEQ ID NO: 2301075 - RNA, 21 nt, Yersinia pestis KIM
gaauauaaaagcacagacaaa

SEQ ID NO: 2301076 - RNA, 17 nt, Yersinia pestis KIM
gaauauaaacauaaaaa

SEQ ID NO: 2301077 - RNA, 19 nt, Yersinia pestis KIM
gaauauaaugauauucaua

SEQ ID NO: 2301078 - RNA, 14 nt, Yersinia pestis KIM
gaauaggcagggga

SEQ ID NO: 2301079 - RNA, 17 nt, Yersinia pestis KIM
gaauaugucauuaccgc

SEQ ID NO: 2301080 - RNA, 24 nt, Yersinia pestis KIM
gaauauccuggaagcagaauacug

SEQ ID NO: 2301081 - RNA, 17 nt, Yersinia pestis KIM
cuuaaaauauggcaggu

SEQ ID NO: 2301082 - RNA, 18 nt, Yersinia pestis KIM
cuguuuuuuaaagaaaaa

SEQ ID NO: 2301083 - RNA, 16 nt, Yersinia pestis KIM
cuguuuuugaagauuc

SEQ ID NO: 2301084 - RNA, 16 nt, Yersinia pestis KIM
cuuaaaaaucaaaagu

SEQ ID NO: 2301085 - RNA, 18 nt, Yersinia pestis KIM
cuguuugcaacauuaucc

SEQ ID NO: 2301086 - RNA, 13 nt, Yersinia pestis KIM
cuguuuugucaua

SEQ ID NO: 2301087 - RNA, 23 nt, Yersinia pestis KIM
cuguuuugucauaaagcccauac

SEQ ID NO: 2301088 - RNA, 18 nt, Yersinia pestis KIM
cuguuuuucauuuacuug

SEQ ID NO: 2301089 - RNA, 18 nt, Yersinia pestis KIM
cuguuuucauuauuuuca

SEQ ID NO: 2301090 - RNA, 16 nt, Yersinia pestis KIM
cuguuuucauuauuuu

SEQ ID NO: 2301091 - RNA, 14 nt, Yersinia pestis KIM
cuguuucaaauaag

SEQ ID NO: 2301092 - RNA, 20 nt, Yersinia pestis KIM
cuguugcccccugcuccaaa

SEQ ID NO: 2301093 - RNA, 23 nt, Yersinia pestis KIM
cuguugagguacggcucuauuuc

SEQ ID NO: 2301094 - RNA, 15 nt, Yersinia pestis KIM
cuguugaucugaguu

SEQ ID NO: 2301095 - RNA, 15 nt, Yersinia pestis KIM
cuguugaugaguaaa

SEQ ID NO: 2301096 - RNA, 17 nt, Yersinia pestis KIM
cuguugccaugccaugg

SEQ ID NO: 2301097 - RNA, 19 nt, Yersinia pestis KIM
cuguugguagcguuuuuuc

SEQ ID NO: 2301098 - RNA, 19 nt, Yersinia pestis KIM
cuguuggcgggauccaucu

SEQ ID NO: 2301099 - RNA, 21 nt, Yersinia pestis KIM
cuguuggcgggauccaucuga

SEQ ID NO: 2301100 - RNA, 15 nt, Yersinia pestis KIM
cuguugguaaauaac

SEQ ID NO: 2301101 - RNA, 18 nt, Yersinia pestis KIM
cuguuuaccuaucucagu

SEQ ID NO: 2301102 - RNA, 19 nt, Yersinia pestis KIM
cuguucuuggaacaggcca

SEQ ID NO: 2301103 - RNA, 17 nt, Yersinia pestis KIM
cuguugaccgacucauu

SEQ ID NO: 2301104 - RNA, 20 nt, Yersinia pestis KIM
cuguugaccgacucauuaaa

SEQ ID NO: 2301105 - RNA, 15 nt, Yersinia pestis KIM
cugucugaugauuug

SEQ ID NO: 2301106 - RNA, 16 nt, Yersinia pestis KIM
cugucuggguggcuga

SEQ ID NO: 2301107 - RNA, 19 nt, Yersinia pestis KIM
cugucuggguggcugaaau

SEQ ID NO: 2301108 - RNA, 20 nt, Yersinia pestis KIM
cugucuaaauugcuuaaaaa

SEQ ID NO: 2301109 - RNA, 21 nt, Yersinia pestis KIM
cugucuaaauugcuuaaaaaa

SEQ ID NO: 2301110 - RNA, 11 nt, Yersinia pestis KIM
cuuaaauaaaa

SEQ ID NO: 2301111 - RNA, 11 nt, Yersinia pestis KIM
cuuaaauaacu

SEQ ID NO: 2301112 - RNA, 23 nt, Yersinia pestis KIM
cuuaaagaaauaaauauccuccg

SEQ ID NO: 2301113 - RNA, 21 nt, Yersinia pestis KIM
cuuaaucaucaucacaaauaa

SEQ ID NO: 2301114 - RNA, 22 nt, Yersinia pestis KIM
cuuaauuggcggaagacuucca

SEQ ID NO: 2301115 - RNA, 15 nt, Yersinia pestis KIM
cuuaaucgccagcaa

SEQ ID NO: 2301116 - RNA, 21 nt, Yersinia pestis KIM
cuuaauucccguuguuuaucc

SEQ ID NO: 2301117 - RNA, 16 nt, Yersinia pestis KIM
cuuacaaagcauuuca

SEQ ID NO: 2301118 - RNA, 18 nt, Yersinia pestis KIM
cuuaauuuggcuauugag

SEQ ID NO: 2301119 - RNA, 21 nt, Yersinia pestis KIM
cuuaccuauaaacauuuacuu

SEQ ID NO: 2301120 - RNA, 18 nt, Yersinia pestis KIM
cuuacuaaaauaucacua

SEQ ID NO: 2301121 - RNA, 18 nt, Yersinia pestis KIM
cuuacggugauacaucuc

SEQ ID NO: 2301122 - RNA, 14 nt, Yersinia pestis KIM
cuuacgucuuuaaa

SEQ ID NO: 2301123 - RNA, 16 nt, Yersinia pestis KIM
cuuagcaauaccagcc

SEQ ID NO: 2301124 - RNA, 17 nt, Yersinia pestis KIM
cuuagauugcaaaucac

SEQ ID NO: 2301125 - RNA, 22 nt, Yersinia pestis KIM
cuuagagucacgguaugugugu

SEQ ID NO: 2301126 - RNA, 18 nt, Yersinia pestis KIM
cuuacuauuuuucucaau

SEQ ID NO: 2301127 - RNA, 18 nt, Yersinia pestis KIM
cuuauacuaaagaaauaa

SEQ ID NO: 2301128 - RNA, 19 nt, Yersinia pestis KIM
cuuagcacguuuuucagcu

SEQ ID NO: 2301129 - RNA, 16 nt, Yersinia pestis KIM
cuuauccugcaaccca

SEQ ID NO: 2301130 - RNA, 20 nt, Yersinia pestis KIM
cuuaucgaccaacuggcaau

SEQ ID NO: 2301131 - RNA, 18 nt, Yersinia pestis KIM
cuuauccccugagaaaca

SEQ ID NO: 2301132 - RNA, 21 nt, Yersinia pestis KIM
cuuauccccugagaaacaucc

SEQ ID NO: 2301133 - RNA, 19 nt, Yersinia pestis KIM
cuuauccagcgccaucagc

SEQ ID NO: 2301134 - RNA, 15 nt, Yersinia pestis KIM
cuuauccacagcaug

SEQ ID NO: 2301135 - RNA, 17 nt, Yersinia pestis KIM
cuuaucagcgaaaaauu

SEQ ID NO: 2301136 - RNA, 20 nt, Yersinia pestis KIM
cuuaucagcgguaucuagag

SEQ ID NO: 2301137 - RNA, 10 nt, Yersinia pestis KIM
cuuccaucag

SEQ ID NO: 2301138 - RNA, 12 nt, Yersinia pestis KIM
cuuccaguggcu

SEQ ID NO: 2301139 - RNA, 20 nt, Yersinia pestis KIM
cuucauuaaggagugccauc

SEQ ID NO: 2301140 - RNA, 16 nt, Yersinia pestis KIM
cuucauuaucauguaa

SEQ ID NO: 2301141 - RNA, 14 nt, Yersinia pestis KIM
cuucauuucaggua

SEQ ID NO: 2301142 - RNA, 23 nt, Yersinia pestis KIM
cuucauuggcuugguuguuucuu

SEQ ID NO: 2301143 - RNA, 12 nt, Yersinia pestis KIM
cuucauugcugc

SEQ ID NO: 2301144 - RNA, 22 nt, Yersinia pestis KIM
cuuccgccucuuuuuccacacc

SEQ ID NO: 2301145 - RNA, 19 nt, Yersinia pestis KIM
cuuccauuccguuauuaaa

SEQ ID NO: 2301146 - RNA, 22 nt, Yersinia pestis KIM
cuuccauugauggccuugaauc

SEQ ID NO: 2301147 - RNA, 19 nt, Yersinia pestis KIM
cuuccaugacacauauuuc

SEQ ID NO: 2301148 - RNA, 13 nt, Yersinia pestis KIM
cuuccaucaggaa

SEQ ID NO: 2301149 - RNA, 22 nt, Yersinia pestis KIM
cuuccaucgucagaaccugcau

SEQ ID NO: 2301150 - RNA, 15 nt, Yersinia pestis KIM
cuucgcgaacacaau

SEQ ID NO: 2301151 - RNA, 20 nt, Yersinia pestis KIM
cuucgcgagucacauuuuua

SEQ ID NO: 2301152 - RNA, 21 nt, Yersinia pestis KIM
cuucgccgggucaggaagaga

SEQ ID NO: 2301153 - RNA, 22 nt, Yersinia pestis KIM
cuucgccaggucaggaagagaa

SEQ ID NO: 2301154 - RNA, 21 nt, Yersinia pestis KIM
cuucgccaggucaggaagaga

SEQ ID NO: 2301155 - RNA, 20 nt, Yersinia pestis KIM
cuucgccaaucucaaagcaa

SEQ ID NO: 2301156 - RNA, 16 nt, Yersinia pestis KIM
cuuccggcguaccaca

SEQ ID NO: 2301157 - RNA, 15 nt, Yersinia pestis KIM
cuucaggaauaaaca

SEQ ID NO: 2301158 - RNA, 22 nt, Yersinia pestis KIM
cuucagcuuccgcuucaacuuc

SEQ ID NO: 2301159 - RNA, 11 nt, Yersinia pestis KIM
cuucaggccaa

SEQ ID NO: 2301160 - RNA, 18 nt, Yersinia pestis KIM
cuucagucaguguuucua

SEQ ID NO: 2301161 - RNA, 19 nt, Yersinia pestis KIM
cuucaguuuauuuaagcug

SEQ ID NO: 2301162 - RNA, 17 nt, Yersinia pestis KIM
cuucaguuuugcgggug

SEQ ID NO: 2301163 - RNA, 23 nt, Yersinia pestis KIM
cuucauagcuacgggcaaacucc

SEQ ID NO: 2301164 - RNA, 20 nt, Yersinia pestis KIM
cuucauauauugcauuuaug

SEQ ID NO: 2301165 - RNA, 18 nt, Yersinia pestis KIM
cuucauaucggccaaguu

SEQ ID NO: 2301166 - RNA, 20 nt, Yersinia pestis KIM
cuucauaucggccaaguuua

SEQ ID NO: 2301167 - RNA, 12 nt, Yersinia pestis KIM
cuucauauugag

SEQ ID NO: 2301168 - RNA, 22 nt, Yersinia pestis KIM
cuucaucagucacuaaaccauu

SEQ ID NO: 2301169 - RNA, 15 nt, Yersinia pestis KIM
cuucaucaucaacaa

SEQ ID NO: 2301170 - RNA, 17 nt, Yersinia pestis KIM
cuucaucccaaucauca

SEQ ID NO: 2301171 - RNA, 18 nt, Yersinia pestis KIM
cuucaucgauaguaaaca

SEQ ID NO: 2301172 - RNA, 17 nt, Yersinia pestis KIM
cuucacgcucuugcucu

SEQ ID NO: 2301173 - RNA, 19 nt, Yersinia pestis KIM
cuucacggacagcaaccac

SEQ ID NO: 2301174 - RNA, 15 nt, Yersinia pestis KIM
cuucagccaccagau

SEQ ID NO: 2301175 - RNA, 19 nt, Yersinia pestis KIM
cuucagcccauggcugaaa

SEQ ID NO: 2301176 - RNA, 15 nt, Yersinia pestis KIM
cuucagcccauggcu

SEQ ID NO: 2301177 - RNA, 15 nt, Yersinia pestis KIM
cuucagccuucauau

SEQ ID NO: 2301178 - RNA, 18 nt, Yersinia pestis KIM
cuucaccaauacaaacag

SEQ ID NO: 2301179 - RNA, 14 nt, Yersinia pestis KIM
cuucaccaaaaaaa

SEQ ID NO: 2301180 - RNA, 16 nt, Yersinia pestis KIM
cuucaccaaaggaagc

SEQ ID NO: 2301181 - RNA, 13 nt, Yersinia pestis KIM
cuucaccacugug

SEQ ID NO: 2301182 - RNA, 20 nt, Yersinia pestis KIM
cuuauuaauugguauuuuac

SEQ ID NO: 2301183 - RNA, 13 nt, Yersinia pestis KIM
cuuaucuaaaaaa

SEQ ID NO: 2301184 - RNA, 18 nt, Yersinia pestis KIM
cuuaucgucaaguucaua

SEQ ID NO: 2301185 - RNA, 22 nt, Yersinia pestis KIM
cuuaucuaucucaggcucagcg

SEQ ID NO: 2301186 - RNA, 17 nt, Yersinia pestis KIM
cuuggacaucugcuuua

SEQ ID NO: 2301187 - RNA, 19 nt, Yersinia pestis KIM
cuuggaacuuacucccuug

SEQ ID NO: 2301188 - RNA, 22 nt, Yersinia pestis KIM
cuuguaagaccaauugguaaga

SEQ ID NO: 2301189 - RNA, 19 nt, Yersinia pestis KIM
cuuguccauagcuaaaaua

SEQ ID NO: 2301190 - RNA, 15 nt, Yersinia pestis KIM
cuuguaccugugcca

SEQ ID NO: 2301191 - RNA, 17 nt, Yersinia pestis KIM
cuugugcucacgucacc

SEQ ID NO: 2301192 - RNA, 20 nt, Yersinia pestis KIM
cuugugaugaaauuaaaaug

SEQ ID NO: 2301193 - RNA, 19 nt, Yersinia pestis KIM
cuugugggcaucugucuaa

SEQ ID NO: 2301194 - RNA, 19 nt, Yersinia pestis KIM
cuuguguugggcaguaacg

SEQ ID NO: 2301195 - RNA, 16 nt, Yersinia pestis KIM
cuuguucacggcuuug

SEQ ID NO: 2301196 - RNA, 15 nt, Yersinia pestis KIM
cuuguuaauuuaaac

SEQ ID NO: 2301197 - RNA, 19 nt, Yersinia pestis KIM
cuuguuuaucggucacuuu

SEQ ID NO: 2301198 - RNA, 16 nt, Yersinia pestis KIM
cuuguuggucaccacu

SEQ ID NO: 2301199 - RNA, 20 nt, Yersinia pestis KIM
cuuguuugcgccguaaacug

SEQ ID NO: 2301200 - RNA, 22 nt, Yersinia pestis KIM
cuuuaaauacccagcuucuuuu

SEQ ID NO: 2301201 - RNA, 18 nt, Yersinia pestis KIM
cuuuaaaaaaauuaucau

SEQ ID NO: 2301202 - RNA, 23 nt, Yersinia pestis KIM
cuuuaaaaaaauuaucaucaaua

SEQ ID NO: 2301203 - RNA, 16 nt, Yersinia pestis KIM
cuuuaaaaacccgccu

SEQ ID NO: 2301204 - RNA, 20 nt, Yersinia pestis KIM
cuuuaauagccaaaauaauu

SEQ ID NO: 2301205 - RNA, 14 nt, Yersinia pestis KIM
cuuuaauaaaauca

SEQ ID NO: 2301206 - RNA, 16 nt, Yersinia pestis KIM
cuuuaauaaaaucaaa

SEQ ID NO: 2301207 - RNA, 14 nt, Yersinia pestis KIM
cuuuaaccaaagaa

SEQ ID NO: 2301208 - RNA, 17 nt, Yersinia pestis KIM
cuuuaaccgcauucaca

SEQ ID NO: 2301209 - RNA, 13 nt, Yersinia pestis KIM
cuuuaacaacaac

SEQ ID NO: 2301210 - RNA, 15 nt, Yersinia pestis KIM
cuuucgcacuuuaaa

SEQ ID NO: 2301211 - RNA, 21 nt, Yersinia pestis KIM
cuuucgccaucgucucugcau

SEQ ID NO: 2301212 - RNA, 20 nt, Yersinia pestis KIM
cuuucgaguuuauauugcca

SEQ ID NO: 2301213 - RNA, 16 nt, Yersinia pestis KIM
cuuucucauuagcguc

SEQ ID NO: 2301214 - RNA, 17 nt, Yersinia pestis KIM
cuuucuccuuugauuug

SEQ ID NO: 2301215 - RNA, 14 nt, Yersinia pestis KIM
cuuuccauccagaa

SEQ ID NO: 2301216 - RNA, 16 nt, Yersinia pestis KIM
cuuucaucuucuucuu

SEQ ID NO: 2301217 - RNA, 24 nt, Yersinia pestis KIM
cuuucccccauaauucugccgacu

SEQ ID NO: 2301218 - RNA, 19 nt, Yersinia pestis KIM
cuuucccgcgucgugauga

SEQ ID NO: 2301219 - RNA, 16 nt, Yersinia pestis KIM
cuuucccucgguguca

SEQ ID NO: 2301220 - RNA, 21 nt, Yersinia pestis KIM
cuuuauguauucuuguauccu

SEQ ID NO: 2301221 - RNA, 23 nt, Yersinia pestis KIM
cuuuauguacauccaauuuuuuc

SEQ ID NO: 2301222 - RNA, 14 nt, Yersinia pestis KIM
cuuuaugucuuuuu

SEQ ID NO: 2301223 - RNA, 17 nt, Yersinia pestis KIM
cuuuauguauucuugua

SEQ ID NO: 2301224 - RNA, 19 nt, Yersinia pestis KIM
cuuuauguaacacauauuu

SEQ ID NO: 2301225 - RNA, 21 nt, Yersinia pestis KIM
cuuuauccagccaccuuaagu

SEQ ID NO: 2301226 - RNA, 21 nt, Yersinia pestis KIM
cuuucaccgcuguagguguca

SEQ ID NO: 2301227 - RNA, 15 nt, Yersinia pestis KIM
cuuucaccacugcca

SEQ ID NO: 2301228 - RNA, 13 nt, Yersinia pestis KIM
cuuucacauuacc

SEQ ID NO: 2301229 - RNA, 17 nt, Yersinia pestis KIM
cuuuaucaauuuauacc

SEQ ID NO: 2301230 - RNA, 14 nt, Yersinia pestis KIM
cuuuaccagccccg

SEQ ID NO: 2301231 - RNA, 16 nt, Yersinia pestis KIM
cuuuaccccauugcac

SEQ ID NO: 2301232 - RNA, 17 nt, Yersinia pestis KIM
cuuuaaucgccugaugc

SEQ ID NO: 2301233 - RNA, 18 nt, Yersinia pestis KIM
cuuuaaucagcccuucuu

SEQ ID NO: 2301234 - RNA, 20 nt, Yersinia pestis KIM
cuugcgcgcugggacgcuua

SEQ ID NO: 2301235 - RNA, 21 nt, Yersinia pestis KIM
cuugcagcgaucacagauaaa

SEQ ID NO: 2301236 - RNA, 13 nt, Yersinia pestis KIM
cuugcagcaacag

SEQ ID NO: 2301237 - RNA, 14 nt, Yersinia pestis KIM
cuugcagcaacagg

SEQ ID NO: 2301238 - RNA, 11 nt, Yersinia pestis KIM
cuugcagcaca

SEQ ID NO: 2301239 - RNA, 15 nt, Yersinia pestis KIM
cuugcucucuucaua

SEQ ID NO: 2301240 - RNA, 16 nt, Yersinia pestis KIM
cuugcucgucaucuuu

SEQ ID NO: 2301241 - RNA, 13 nt, Yersinia pestis KIM
cuugauucucaaa

SEQ ID NO: 2301242 - RNA, 13 nt, Yersinia pestis KIM
cuugauucaccag

SEQ ID NO: 2301243 - RNA, 10 nt, Yersinia pestis KIM
cuugauggcu

SEQ ID NO: 2301244 - RNA, 23 nt, Yersinia pestis KIM
cuugauggcuaauuaauuuaaac

SEQ ID NO: 2301245 - RNA, 20 nt, Yersinia pestis KIM
cuugauagcgggcagacguu

SEQ ID NO: 2301246 - RNA, 19 nt, Yersinia pestis KIM
cuugaugaaagcuauuuuu

SEQ ID NO: 2301247 - RNA, 21 nt, Yersinia pestis KIM
cuugagggugaccaucuggcg

SEQ ID NO: 2301248 - RNA, 20 nt, Yersinia pestis KIM
cuugaaccaauuuuucugua

SEQ ID NO: 2301249 - RNA, 16 nt, Yersinia pestis KIM
cuucuuuauuguuuug

SEQ ID NO: 2301250 - RNA, 19 nt, Yersinia pestis KIM
cuugaaaccgguaauguuc

SEQ ID NO: 2301251 - RNA, 20 nt, Yersinia pestis KIM
cuucgcggugauuccaauga

SEQ ID NO: 2301252 - RNA, 16 nt, Yersinia pestis KIM
cuucucgugucacagu

SEQ ID NO: 2301253 - RNA, 16 nt, Yersinia pestis KIM
cuucucguaauuauug

SEQ ID NO: 2301254 - RNA, 19 nt, Yersinia pestis KIM
cuucugccuauccucaccg

SEQ ID NO: 2301255 - RNA, 20 nt, Yersinia pestis KIM
cuucugccuauccucaccgu

SEQ ID NO: 2301256 - RNA, 16 nt, Yersinia pestis KIM
cuucugcccauccuca

SEQ ID NO: 2301257 - RNA, 17 nt, Yersinia pestis KIM
cuucugaacgaccagaa

SEQ ID NO: 2301258 - RNA, 16 nt, Yersinia pestis KIM
cuucugauucaauuuc

SEQ ID NO: 2301259 - RNA, 14 nt, Yersinia pestis KIM
cuucuuccauugau

SEQ ID NO: 2301260 - RNA, 22 nt, Yersinia pestis KIM
cuucuuguggcaguucacccaa

SEQ ID NO: 2301261 - RNA, 15 nt, Yersinia pestis KIM
cuucuuggguggcaa

SEQ ID NO: 2301262 - RNA, 16 nt, Yersinia pestis KIM
cuucuggcgcuaauga

SEQ ID NO: 2301263 - RNA, 15 nt, Yersinia pestis KIM
cuucuggugguguca

SEQ ID NO: 2301264 - RNA, 22 nt, Yersinia pestis KIM
cuucugucggagccugauacac

SEQ ID NO: 2301265 - RNA, 16 nt, Yersinia pestis KIM
cuucuguaccacugau

SEQ ID NO: 2301266 - RNA, 13 nt, Yersinia pestis KIM
cuucuucaaaagc

SEQ ID NO: 2301267 - RNA, 16 nt, Yersinia pestis KIM
cuucuuaucuuuucug

SEQ ID NO: 2301268 - RNA, 20 nt, Yersinia pestis KIM
cuucuuaauucccagccacu

SEQ ID NO: 2301269 - RNA, 14 nt, Yersinia pestis KIM
cuggccuauuaaga

SEQ ID NO: 2301270 - RNA, 19 nt, Yersinia pestis KIM
cuggccuauuaagauaauu

SEQ ID NO: 2301271 - RNA, 20 nt, Yersinia pestis KIM
cuggccucuuuacgcucugc

SEQ ID NO: 2301272 - RNA, 22 nt, Yersinia pestis KIM
cuggccucuuuacgcucugccu

SEQ ID NO: 2301273 - RNA, 18 nt, Yersinia pestis KIM
cuggcgcaacagcgccuc

SEQ ID NO: 2301274 - RNA, 22 nt, Yersinia pestis KIM
cuggcgauaaacacccaagaau

SEQ ID NO: 2301275 - RNA, 19 nt, Yersinia pestis KIM
cuggcggauaacggcggca

SEQ ID NO: 2301276 - RNA, 14 nt, Yersinia pestis KIM
cuggcggaagcacg

SEQ ID NO: 2301277 - RNA, 11 nt, Yersinia pestis KIM
cuggauaaacu

SEQ ID NO: 2301278 - RNA, 16 nt, Yersinia pestis KIM
cuggagcuauggaaga

SEQ ID NO: 2301279 - RNA, 14 nt, Yersinia pestis KIM
cuggagcuucuggc

SEQ ID NO: 2301280 - RNA, 17 nt, Yersinia pestis KIM
cuggcaaggcacgagcg

SEQ ID NO: 2301281 - RNA, 16 nt, Yersinia pestis KIM
cuggcaauggcuagcu

SEQ ID NO: 2301282 - RNA, 21 nt, Yersinia pestis KIM
cuggcaaugcgcggguaacaa

SEQ ID NO: 2301283 - RNA, 14 nt, Yersinia pestis KIM
cuggcaagcagacg

SEQ ID NO: 2301284 - RNA, 15 nt, Yersinia pestis KIM
cuggcaccggacaaa

SEQ ID NO: 2301285 - RNA, 15 nt, Yersinia pestis KIM
cuggccacagagugg

SEQ ID NO: 2301286 - RNA, 16 nt, Yersinia pestis KIM
cuggcauacaguuuug

SEQ ID NO: 2301287 - RNA, 12 nt, Yersinia pestis KIM
cuggcauuuuuu

SEQ ID NO: 2301288 - RNA, 23 nt, Yersinia pestis KIM
cugcuuuaggauuuauuucucug

SEQ ID NO: 2301289 - RNA, 12 nt, Yersinia pestis KIM
cuggaaacaaaa

SEQ ID NO: 2301290 - RNA, 22 nt, Yersinia pestis KIM
cugcuuuuuauugucucuacuc

SEQ ID NO: 2301291 - RNA, 16 nt, Yersinia pestis KIM
cugcuuuucuaccuga

SEQ ID NO: 2301292 - RNA, 16 nt, Yersinia pestis KIM
cugcucauaagauacc

SEQ ID NO: 2301293 - RNA, 16 nt, Yersinia pestis KIM
cugcucacgcaaauaa

SEQ ID NO: 2301294 - RNA, 13 nt, Yersinia pestis KIM
cugcucacgcaaa

SEQ ID NO: 2301295 - RNA, 21 nt, Yersinia pestis KIM
cugcuagcaaauuccgcuucu

SEQ ID NO: 2301296 - RNA, 22 nt, Yersinia pestis KIM
cugcuaucaugauaaauaauaa

SEQ ID NO: 2301297 - RNA, 16 nt, Yersinia pestis KIM
cugcuaucaugauaaa

SEQ ID NO: 2301298 - RNA, 22 nt, Yersinia pestis KIM
cugcuaccaggaagcggccagg

SEQ ID NO: 2301299 - RNA, 17 nt, Yersinia pestis KIM
cugcucaacugcucaac

SEQ ID NO: 2301300 - RNA, 14 nt, Yersinia pestis KIM
cugcucaacugcuc

SEQ ID NO: 2301301 - RNA, 15 nt, Yersinia pestis KIM
cugcucaacugcuca

SEQ ID NO: 2301302 - RNA, 20 nt, Yersinia pestis KIM
cuggagcaagauuuuguagc

SEQ ID NO: 2301303 - RNA, 16 nt, Yersinia pestis KIM
cuggacguuugcugcu

SEQ ID NO: 2301304 - RNA, 14 nt, Yersinia pestis KIM
cuggacugguugcu

SEQ ID NO: 2301305 - RNA, 21 nt, Yersinia pestis KIM
cuggacugguugcugguuaau

SEQ ID NO: 2301306 - RNA, 16 nt, Yersinia pestis KIM
cuggacgcaucagauc

SEQ ID NO: 2301307 - RNA, 16 nt, Yersinia pestis KIM
cuggaccuuaucauca

SEQ ID NO: 2301308 - RNA, 17 nt, Yersinia pestis KIM
cuggacaauguugaucg

SEQ ID NO: 2301309 - RNA, 19 nt, Yersinia pestis KIM
cuggaaggcggcccgcaga

SEQ ID NO: 2301310 - RNA, 17 nt, Yersinia pestis KIM
cuggaagcagaauacug

SEQ ID NO: 2301311 - RNA, 22 nt, Yersinia pestis KIM
cuggaagccgacgaucuugccc

SEQ ID NO: 2301312 - RNA, 20 nt, Yersinia pestis KIM
cuggaacguugcacccugcu

SEQ ID NO: 2301313 - RNA, 17 nt, Yersinia pestis KIM
cuggaacaagagaucuc

SEQ ID NO: 2301314 - RNA, 20 nt, Yersinia pestis KIM
cuggaaauauuggcaacaac

SEQ ID NO: 2301315 - RNA, 13 nt, Yersinia pestis KIM
cuggaaauaagcc

SEQ ID NO: 2301316 - RNA, 21 nt, Yersinia pestis KIM
cuggaaaggaauaucugugau

SEQ ID NO: 2301317 - RNA, 18 nt, Yersinia pestis KIM
cuggcgggaauugaaccu

SEQ ID NO: 2301318 - RNA, 14 nt, Yersinia pestis KIM
cuggcggcgagcuc

SEQ ID NO: 2301319 - RNA, 15 nt, Yersinia pestis KIM
cuggcgguaauaaau

SEQ ID NO: 2301320 - RNA, 19 nt, Yersinia pestis KIM
cuggguggcugaaauacca

SEQ ID NO: 2301321 - RNA, 15 nt, Yersinia pestis KIM
cugggugcugcuccc

SEQ ID NO: 2301322 - RNA, 22 nt, Yersinia pestis KIM
cugguaagcuggcgcacucauc

SEQ ID NO: 2301323 - RNA, 20 nt, Yersinia pestis KIM
cugguaccguuuuauuuccc

SEQ ID NO: 2301324 - RNA, 14 nt, Yersinia pestis KIM
cugguaccaaauaa

SEQ ID NO: 2301325 - RNA, 16 nt, Yersinia pestis KIM
cugguaccaaauaaca

SEQ ID NO: 2301326 - RNA, 21 nt, Yersinia pestis KIM
cugguaccaaauaacaacaca

SEQ ID NO: 2301327 - RNA, 22 nt, Yersinia pestis KIM
cugggucaucacccagcaaaau

SEQ ID NO: 2301328 - RNA, 21 nt, Yersinia pestis KIM
cugggugacgcgaaacgccca

SEQ ID NO: 2301329 - RNA, 20 nt, Yersinia pestis KIM
cugggucgugagucaggugg

SEQ ID NO: 2301330 - RNA, 14 nt, Yersinia pestis KIM
cuggucgauaagca

SEQ ID NO: 2301331 - RNA, 16 nt, Yersinia pestis KIM
cuggucguugaccuua

SEQ ID NO: 2301332 - RNA, 13 nt, Yersinia pestis KIM
cuggugaacgaaa

SEQ ID NO: 2301333 - RNA, 22 nt, Yersinia pestis KIM
cuggugacccgucagcguccug

SEQ ID NO: 2301334 - RNA, 13 nt, Yersinia pestis KIM
cuggugacccuca

SEQ ID NO: 2301335 - RNA, 21 nt, Yersinia pestis KIM
cugguagucauauucaggcug

SEQ ID NO: 2301336 - RNA, 18 nt, Yersinia pestis KIM
cugguaguuuugcauaau

SEQ ID NO: 2301337 - RNA, 17 nt, Yersinia pestis KIM
cuggucagguaaaccgg

SEQ ID NO: 2301338 - RNA, 18 nt, Yersinia pestis KIM
cugguccaacuaaacagg

SEQ ID NO: 2301339 - RNA, 18 nt, Yersinia pestis KIM
cuggucccgacaaauacu

SEQ ID NO: 2301340 - RNA, 13 nt, Yersinia pestis KIM
cuguaaaggcaaa

SEQ ID NO: 2301341 - RNA, 14 nt, Yersinia pestis KIM
cuguaaaggcaaag

SEQ ID NO: 2301342 - RNA, 18 nt, Yersinia pestis KIM
cuguaaauaaauaaucau

SEQ ID NO: 2301343 - RNA, 19 nt, Yersinia pestis KIM
cuguaauugcgucagggca

SEQ ID NO: 2301344 - RNA, 15 nt, Yersinia pestis KIM
cuguaaccgcaagga

SEQ ID NO: 2301345 - RNA, 12 nt, Yersinia pestis KIM
cuguaaaacaag

SEQ ID NO: 2301346 - RNA, 16 nt, Yersinia pestis KIM
cuguaaaaaucaccuc

SEQ ID NO: 2301347 - RNA, 21 nt, Yersinia pestis KIM
cuguaaaauaccaauuaauaa

SEQ ID NO: 2301348 - RNA, 13 nt, Yersinia pestis KIM
cuguaaaaucuuu

SEQ ID NO: 2301349 - RNA, 13 nt, Yersinia pestis KIM
cugguuuuuuaaa

SEQ ID NO: 2301350 - RNA, 14 nt, Yersinia pestis KIM
cuguaccaccacca

SEQ ID NO: 2301351 - RNA, 20 nt, Yersinia pestis KIM
cuguaccaccaccaacagca

SEQ ID NO: 2301352 - RNA, 18 nt, Yersinia pestis KIM
cuguacccguucaaugug

SEQ ID NO: 2301353 - RNA, 17 nt, Yersinia pestis KIM
cuguacauaaauuugug

SEQ ID NO: 2301354 - RNA, 16 nt, Yersinia pestis KIM
cuguacauaaauuugu

SEQ ID NO: 2301355 - RNA, 17 nt, Yersinia pestis KIM
cuguacaacaagauccc

SEQ ID NO: 2301356 - RNA, 13 nt, Yersinia pestis KIM
cuguaguucauca

SEQ ID NO: 2301357 - RNA, 17 nt, Yersinia pestis KIM
cugucagcccuaauauc

SEQ ID NO: 2301358 - RNA, 17 nt, Yersinia pestis KIM
cugucagucaaaagaaa

SEQ ID NO: 2301359 - RNA, 17 nt, Yersinia pestis KIM
cugucaaucgaugagcu

SEQ ID NO: 2301360 - RNA, 21 nt, Yersinia pestis KIM
cuguauugauacuccguuggc

SEQ ID NO: 2301361 - RNA, 21 nt, Yersinia pestis KIM
cugaucugccccuggcucagu

SEQ ID NO: 2301362 - RNA, 14 nt, Yersinia pestis KIM
cugaucucaucauu

SEQ ID NO: 2301363 - RNA, 14 nt, Yersinia pestis KIM
cugaucgcugugca

SEQ ID NO: 2301364 - RNA, 17 nt, Yersinia pestis KIM
cugaugugcauguggaa

SEQ ID NO: 2301365 - RNA, 19 nt, Yersinia pestis KIM
cugaugugcauguggaagc

SEQ ID NO: 2301366 - RNA, 15 nt, Yersinia pestis KIM
cugauguucugccaa

SEQ ID NO: 2301367 - RNA, 16 nt, Yersinia pestis KIM
cugauguguauauuuu

SEQ ID NO: 2301368 - RNA, 17 nt, Yersinia pestis KIM
cugauuaacacaguaaa

SEQ ID NO: 2301369 - RNA, 22 nt, Yersinia pestis KIM
cugauuagcagggcaguaaaau

SEQ ID NO: 2301370 - RNA, 18 nt, Yersinia pestis KIM
cugauuugggaacaacag

SEQ ID NO: 2301371 - RNA, 21 nt, Yersinia pestis KIM
cugcaaacggcucaucacacc

SEQ ID NO: 2301372 - RNA, 13 nt, Yersinia pestis KIM
cugcagugaaaag

SEQ ID NO: 2301373 - RNA, 21 nt, Yersinia pestis KIM
cugcaguuuccaacacgauau

SEQ ID NO: 2301374 - RNA, 15 nt, Yersinia pestis KIM
cugcaguacagauaa

SEQ ID NO: 2301375 - RNA, 16 nt, Yersinia pestis KIM
cugcaauuauaagcac

SEQ ID NO: 2301376 - RNA, 16 nt, Yersinia pestis KIM
cugcaauaacaccagc

SEQ ID NO: 2301377 - RNA, 22 nt, Yersinia pestis KIM
cugagcuuauagaacggcagug

SEQ ID NO: 2301378 - RNA, 18 nt, Yersinia pestis KIM
cugagcuggcuaauguuc

SEQ ID NO: 2301379 - RNA, 21 nt, Yersinia pestis KIM
cugagcuguaaauauaaaaua

SEQ ID NO: 2301380 - RNA, 23 nt, Yersinia pestis KIM
cugaggccaacacucaugacaaa

SEQ ID NO: 2301381 - RNA, 23 nt, Yersinia pestis KIM
cugaggagccauugauuggcucc

SEQ ID NO: 2301382 - RNA, 22 nt, Yersinia pestis KIM
cugaggacggaugguaaagcag

SEQ ID NO: 2301383 - RNA, 23 nt, Yersinia pestis KIM
cucuagaauuugaucagccagaa

SEQ ID NO: 2301384 - RNA, 20 nt, Yersinia pestis KIM
cucuagaccugaggauaaaa

SEQ ID NO: 2301385 - RNA, 13 nt, Yersinia pestis KIM
cucuaucucuucc

SEQ ID NO: 2301386 - RNA, 17 nt, Yersinia pestis KIM
cucuauucugcuuuuug

SEQ ID NO: 2301387 - RNA, 14 nt, Yersinia pestis KIM
cucuauucugcuuu

SEQ ID NO: 2301388 - RNA, 19 nt, Yersinia pestis KIM
cucuauucugcuuuuugcu

SEQ ID NO: 2301389 - RNA, 20 nt, Yersinia pestis KIM
cucuauugaucacaguaaau

SEQ ID NO: 2301390 - RNA, 21 nt, Yersinia pestis KIM
cugaggguuagcgaugacuga

SEQ ID NO: 2301391 - RNA, 23 nt, Yersinia pestis KIM
cugagguucccaacggcagaagu

SEQ ID NO: 2301392 - RNA, 17 nt, Yersinia pestis KIM
cugagguugcucagcgg

SEQ ID NO: 2301393 - RNA, 18 nt, Yersinia pestis KIM
cugagguggcacccagug

SEQ ID NO: 2301394 - RNA, 18 nt, Yersinia pestis KIM
cugaguaaagcccagcag

SEQ ID NO: 2301395 - RNA, 12 nt, Yersinia pestis KIM
cugaguaauauu

SEQ ID NO: 2301396 - RNA, 17 nt, Yersinia pestis KIM
cugaguagcauaaaaau

SEQ ID NO: 2301397 - RNA, 17 nt, Yersinia pestis KIM
cugagucaguaauucac

SEQ ID NO: 2301398 - RNA, 20 nt, Yersinia pestis KIM
cugagucaaaucgauuugcu

SEQ ID NO: 2301399 - RNA, 17 nt, Yersinia pestis KIM
cugagucagucagggug

SEQ ID NO: 2301400 - RNA, 20 nt, Yersinia pestis KIM
cugagugggggcgauuaauu

SEQ ID NO: 2301401 - RNA, 18 nt, Yersinia pestis KIM
cugaguggucgcuggcau

SEQ ID NO: 2301402 - RNA, 14 nt, Yersinia pestis KIM
cugagucuguuucc

SEQ ID NO: 2301403 - RNA, 11 nt, Yersinia pestis KIM
cugaguucugc

SEQ ID NO: 2301404 - RNA, 15 nt, Yersinia pestis KIM
cugaguucugcugcc

SEQ ID NO: 2301405 - RNA, 22 nt, Yersinia pestis KIM
cugaucaauaucccgagaaaca

SEQ ID NO: 2301406 - RNA, 22 nt, Yersinia pestis KIM
cugaucacgcugaauuugugcu

SEQ ID NO: 2301407 - RNA, 14 nt, Yersinia pestis KIM
cugaucagcauuuc

SEQ ID NO: 2301408 - RNA, 20 nt, Yersinia pestis KIM
cugauauuccggugaucuug

SEQ ID NO: 2301409 - RNA, 17 nt, Yersinia pestis KIM
cugauaucucuuuauca

SEQ ID NO: 2301410 - RNA, 20 nt, Yersinia pestis KIM
cugauagugauuuuuuucac

SEQ ID NO: 2301411 - RNA, 20 nt, Yersinia pestis KIM
cugaucaugccacgaccauu

SEQ ID NO: 2301412 - RNA, 13 nt, Yersinia pestis KIM
cugaucaugccac

SEQ ID NO: 2301413 - RNA, 21 nt, Yersinia pestis KIM
cugauccacuacuuauuuccg

SEQ ID NO: 2301414 - RNA, 22 nt, Yersinia pestis KIM
cugauccucuaaggggcgagaa

SEQ ID NO: 2301415 - RNA, 11 nt, Yersinia pestis KIM
cugaucgagca

SEQ ID NO: 2301416 - RNA, 18 nt, Yersinia pestis KIM
cugauagugauuuuuuuc

SEQ ID NO: 2301417 - RNA, 14 nt, Yersinia pestis KIM
cugauagccaauaa

SEQ ID NO: 2301418 - RNA, 15 nt, Yersinia pestis KIM
cugauaaaacaguuc

SEQ ID NO: 2301419 - RNA, 11 nt, Yersinia pestis KIM
cugauaaaauu

SEQ ID NO: 2301420 - RNA, 23 nt, Yersinia pestis KIM
cugauaaaauuaccgccccuguu

SEQ ID NO: 2301421 - RNA, 22 nt, Yersinia pestis KIM
cugauaaaccgcuauaucauca

SEQ ID NO: 2301422 - RNA, 18 nt, Yersinia pestis KIM
cugauaaggagagaggcc

SEQ ID NO: 2301423 - RNA, 18 nt, Yersinia pestis KIM
cugcuaacacgaccuuca

SEQ ID NO: 2301424 - RNA, 15 nt, Yersinia pestis KIM
cugcuaauuaaaccu

SEQ ID NO: 2301425 - RNA, 19 nt, Yersinia pestis KIM
cugcuaauuaaaccugacu

SEQ ID NO: 2301426 - RNA, 22 nt, Yersinia pestis KIM
cugcguuuuucccuguagaaca

SEQ ID NO: 2301427 - RNA, 20 nt, Yersinia pestis KIM
cugcgguuuguuugcaucug

SEQ ID NO: 2301428 - RNA, 19 nt, Yersinia pestis KIM
cugcgcggaaaaaaggauu

SEQ ID NO: 2301429 - RNA, 13 nt, Yersinia pestis KIM
cugcgccugcgcu

SEQ ID NO: 2301430 - RNA, 23 nt, Yersinia pestis KIM
cugcgcgacaaaaccgauggcuu

SEQ ID NO: 2301431 - RNA, 23 nt, Yersinia pestis KIM
cugcgcccaaaucugcccccagc

SEQ ID NO: 2301432 - RNA, 15 nt, Yersinia pestis KIM
cugcgccaaauguca

SEQ ID NO: 2301433 - RNA, 13 nt, Yersinia pestis KIM
cugccugaguaau

SEQ ID NO: 2301434 - RNA, 11 nt, Yersinia pestis KIM
cugccugugcg

SEQ ID NO: 2301435 - RNA, 16 nt, Yersinia pestis KIM
cugccugugcggcagu

SEQ ID NO: 2301436 - RNA, 19 nt, Yersinia pestis KIM
cugccugugcggcagugaa

SEQ ID NO: 2301437 - RNA, 18 nt, Yersinia pestis KIM
cugcccgucacucagaaa

SEQ ID NO: 2301438 - RNA, 20 nt, Yersinia pestis KIM
cugccggcguuaaugccacc

SEQ ID NO: 2301439 - RNA, 15 nt, Yersinia pestis KIM
cugccuauccucacc

SEQ ID NO: 2301440 - RNA, 14 nt, Yersinia pestis KIM
cugccuauuuaucg

SEQ ID NO: 2301441 - RNA, 14 nt, Yersinia pestis KIM
cugccuaccugcaa

SEQ ID NO: 2301442 - RNA, 19 nt, Yersinia pestis KIM
cugccguaccaaugucuca

SEQ ID NO: 2301443 - RNA, 20 nt, Yersinia pestis KIM
cugccgucuaucugccagau

SEQ ID NO: 2301444 - RNA, 22 nt, Yersinia pestis KIM
cugccagaaucagccccaagcu

SEQ ID NO: 2301445 - RNA, 22 nt, Yersinia pestis KIM
cugccaguaaaaucaucagccu

SEQ ID NO: 2301446 - RNA, 22 nt, Yersinia pestis KIM
cugcccagucacuaccgcucag

SEQ ID NO: 2301447 - RNA, 15 nt, Yersinia pestis KIM
cugccaugucacugu

SEQ ID NO: 2301448 - RNA, 11 nt, Yersinia pestis KIM
cuauaaaaccg

SEQ ID NO: 2301449 - RNA, 22 nt, Yersinia pestis KIM
cuauaaauuuuaaguuaauguu

SEQ ID NO: 2301450 - RNA, 15 nt, Yersinia pestis KIM
cuauaauuauuucuc

SEQ ID NO: 2301451 - RNA, 20 nt, Yersinia pestis KIM
cuauaauuucucucaauaua

SEQ ID NO: 2301452 - RNA, 15 nt, Yersinia pestis KIM
cuauaaggcucuguu

SEQ ID NO: 2301453 - RNA, 22 nt, Yersinia pestis KIM
cuauaaggcucuguuaccagcc

SEQ ID NO: 2301454 - RNA, 17 nt, Yersinia pestis KIM
cuauaagcgcucaaaua

SEQ ID NO: 2301455 - RNA, 19 nt, Yersinia pestis KIM
cuauagacucaucuaauuu

SEQ ID NO: 2301456 - RNA, 13 nt, Yersinia pestis KIM
cuauaugguaacg

SEQ ID NO: 2301457 - RNA, 13 nt, Yersinia pestis KIM
cuauaucucaguu

SEQ ID NO: 2301458 - RNA, 20 nt, Yersinia pestis KIM
cuauccuuugauagaaauag

SEQ ID NO: 2301459 - RNA, 14 nt, Yersinia pestis KIM
cuaucgaaacaccc

SEQ ID NO: 2301460 - RNA, 20 nt, Yersinia pestis KIM
cuauccucuuaaugucuuua

SEQ ID NO: 2301461 - RNA, 17 nt, Yersinia pestis KIM
cuaucugguuuaaauuc

SEQ ID NO: 2301462 - RNA, 19 nt, Yersinia pestis KIM
cuaucugguuuaaauucua

SEQ ID NO: 2301463 - RNA, 15 nt, Yersinia pestis KIM
cuaucugaaugaauu

SEQ ID NO: 2301464 - RNA, 19 nt, Yersinia pestis KIM
cuauggauuacuuacggcc

SEQ ID NO: 2301465 - RNA, 18 nt, Yersinia pestis KIM
cuauggcgguuccaaagc

SEQ ID NO: 2301466 - RNA, 13 nt, Yersinia pestis KIM
cuauggauaaauc

SEQ ID NO: 2301467 - RNA, 15 nt, Yersinia pestis KIM
cuaugggauaaacuu

SEQ ID NO: 2301468 - RNA, 16 nt, Yersinia pestis KIM
cuaucuuaaaaauaac

SEQ ID NO: 2301469 - RNA, 14 nt, Yersinia pestis KIM
cuaucuguucaccg

SEQ ID NO: 2301470 - RNA, 16 nt, Yersinia pestis KIM
cuagagcauaacuggu

SEQ ID NO: 2301471 - RNA, 22 nt, Yersinia pestis KIM
cuagagcaugauggucaucaua

SEQ ID NO: 2301472 - RNA, 17 nt, Yersinia pestis KIM
cuagaacuauuggucaa

SEQ ID NO: 2301473 - RNA, 16 nt, Yersinia pestis KIM
cuagaaauacuguugg

SEQ ID NO: 2301474 - RNA, 11 nt, Yersinia pestis KIM
cuagaaaucac

SEQ ID NO: 2301475 - RNA, 17 nt, Yersinia pestis KIM
cuagaaaucacacuggc

SEQ ID NO: 2301476 - RNA, 21 nt, Yersinia pestis KIM
cuacuauaagcgcucaaauac

SEQ ID NO: 2301477 - RNA, 13 nt, Yersinia pestis KIM
cuacguucgcuuu

SEQ ID NO: 2301478 - RNA, 23 nt, Yersinia pestis KIM
cuacguuguuaucaucaccaccc

SEQ ID NO: 2301479 - RNA, 16 nt, Yersinia pestis KIM
cuagccaccucacuca

SEQ ID NO: 2301480 - RNA, 18 nt, Yersinia pestis KIM
cuagccaccucacucagc

SEQ ID NO: 2301481 - RNA, 14 nt, Yersinia pestis KIM
cuagccagccaccg

SEQ ID NO: 2301482 - RNA, 20 nt, Yersinia pestis KIM
cuagcccaguaccgcuggug

SEQ ID NO: 2301483 - RNA, 17 nt, Yersinia pestis KIM
cuagauauaaugguggg

SEQ ID NO: 2301484 - RNA, 19 nt, Yersinia pestis KIM
cuagcagugauuucagugu

SEQ ID NO: 2301485 - RNA, 23 nt, Yersinia pestis KIM
cuacgccgucaucaucuucuuca

SEQ ID NO: 2301486 - RNA, 16 nt, Yersinia pestis KIM
cuacgccauuaaaagg

SEQ ID NO: 2301487 - RNA, 17 nt, Yersinia pestis KIM
cuaccuuuugcauauuu

SEQ ID NO: 2301488 - RNA, 19 nt, Yersinia pestis KIM
cuaccuuuugcauauuucu

SEQ ID NO: 2301489 - RNA, 18 nt, Yersinia pestis KIM
cuacggccuguaccacca

SEQ ID NO: 2301490 - RNA, 21 nt, Yersinia pestis KIM
cuacggcugaucugccccugg

SEQ ID NO: 2301491 - RNA, 17 nt, Yersinia pestis KIM
cuacggcugaucugccc

SEQ ID NO: 2301492 - RNA, 18 nt, Yersinia pestis KIM
cuacgggcgcuuuucuuu

SEQ ID NO: 2301493 - RNA, 17 nt, Yersinia pestis KIM
cuaauacagcaccaccg

SEQ ID NO: 2301494 - RNA, 13 nt, Yersinia pestis KIM
cuaccgcucagau

SEQ ID NO: 2301495 - RNA, 15 nt, Yersinia pestis KIM
cuaauagcauuuuuc

SEQ ID NO: 2301496 - RNA, 23 nt, Yersinia pestis KIM
cuaccggauaacguuucagggug

SEQ ID NO: 2301497 - RNA, 20 nt, Yersinia pestis KIM
cuaccggcauuggcugguaa

SEQ ID NO: 2301498 - RNA, 12 nt, Yersinia pestis KIM
cuaccugaaugc

SEQ ID NO: 2301499 - RNA, 21 nt, Yersinia pestis KIM
cuaccugaaugcgccgcggcc

SEQ ID NO: 2301500 - RNA, 15 nt, Yersinia pestis KIM
cucauccguaaaaaa

SEQ ID NO: 2301501 - RNA, 16 nt, Yersinia pestis KIM
cucauccgccaagauu

SEQ ID NO: 2301502 - RNA, 23 nt, Yersinia pestis KIM
cucaucgaaauucccguuuuauu

SEQ ID NO: 2301503 - RNA, 12 nt, Yersinia pestis KIM
cucaucgccaaa

SEQ ID NO: 2301504 - RNA, 20 nt, Yersinia pestis KIM
cucaucgccaaagccgucag

SEQ ID NO: 2301505 - RNA, 19 nt, Yersinia pestis KIM
cucaucaaccucagccuca

SEQ ID NO: 2301506 - RNA, 16 nt, Yersinia pestis KIM
cucaucaacuucugca

SEQ ID NO: 2301507 - RNA, 13 nt, Yersinia pestis KIM
cucaucaccuucc

SEQ ID NO: 2301508 - RNA, 14 nt, Yersinia pestis KIM
cucaucaaaacaau

SEQ ID NO: 2301509 - RNA, 17 nt, Yersinia pestis KIM
cucaucaaaggagugcc

SEQ ID NO: 2301510 - RNA, 13 nt, Yersinia pestis KIM
cucaucaaacacc

SEQ ID NO: 2301511 - RNA, 22 nt, Yersinia pestis KIM
cucauauuguccaaaggaaggg

SEQ ID NO: 2301512 - RNA, 14 nt, Yersinia pestis KIM
cucagucaucgccu

SEQ ID NO: 2301513 - RNA, 15 nt, Yersinia pestis KIM
cucaguaucuuucca

SEQ ID NO: 2301514 - RNA, 20 nt, Yersinia pestis KIM
cucaguaucuuuccagccaa

SEQ ID NO: 2301515 - RNA, 22 nt, Yersinia pestis KIM
cucaguaaaagcggguuaccag

SEQ ID NO: 2301516 - RNA, 20 nt, Yersinia pestis KIM
cucaguacagucccugugcg

SEQ ID NO: 2301517 - RNA, 17 nt, Yersinia pestis KIM
cucaguaccugaagcua

SEQ ID NO: 2301518 - RNA, 18 nt, Yersinia pestis KIM
cucaucggguaaaaucau

SEQ ID NO: 2301519 - RNA, 22 nt, Yersinia pestis KIM
cucaucgguaacuuacaggcug

SEQ ID NO: 2301520 - RNA, 17 nt, Yersinia pestis KIM
cucaucggguaaaauca

SEQ ID NO: 2301521 - RNA, 20 nt, Yersinia pestis KIM
cucaucuggcguucuacugc

SEQ ID NO: 2301522 - RNA, 14 nt, Yersinia pestis KIM
cucauuaauaauga

SEQ ID NO: 2301523 - RNA, 18 nt, Yersinia pestis KIM
cucauguucgcacugcuc

SEQ ID NO: 2301524 - RNA, 19 nt, Yersinia pestis KIM
cucauguucgcacugcucu

SEQ ID NO: 2301525 - RNA, 13 nt, Yersinia pestis KIM
cucauuaaaucca

SEQ ID NO: 2301526 - RNA, 15 nt, Yersinia pestis KIM
cucaucuuauuucac

SEQ ID NO: 2301527 - RNA, 16 nt, Yersinia pestis KIM
cucagccuuuuuugcu

SEQ ID NO: 2301528 - RNA, 16 nt, Yersinia pestis KIM
cucagccucauucaug

SEQ ID NO: 2301529 - RNA, 17 nt, Yersinia pestis KIM
cucagccucauucauga

SEQ ID NO: 2301530 - RNA, 18 nt, Yersinia pestis KIM
cucagccucauucaugag

SEQ ID NO: 2301531 - RNA, 17 nt, Yersinia pestis KIM
cucagcacaaacauggc

SEQ ID NO: 2301532 - RNA, 13 nt, Yersinia pestis KIM
cucagcaucaccg

SEQ ID NO: 2301533 - RNA, 15 nt, Yersinia pestis KIM
cucagcauccuccug

SEQ ID NO: 2301534 - RNA, 23 nt, Yersinia pestis KIM
cucagcagagucgcaaaaaauau

SEQ ID NO: 2301535 - RNA, 14 nt, Yersinia pestis KIM
cucaccgcuggaag

SEQ ID NO: 2301536 - RNA, 19 nt, Yersinia pestis KIM
cucacuuuuauauccgcca

SEQ ID NO: 2301537 - RNA, 21 nt, Yersinia pestis KIM
cucacuuuuauauccgccauc

SEQ ID NO: 2301538 - RNA, 12 nt, Yersinia pestis KIM
cucaccucccug

SEQ ID NO: 2301539 - RNA, 17 nt, Yersinia pestis KIM
cucacuuugcauuuucu

SEQ ID NO: 2301540 - RNA, 21 nt, Yersinia pestis KIM
cucagaaaaaugccugagauc

SEQ ID NO: 2301541 - RNA, 13 nt, Yersinia pestis KIM
cucagaaaauaaa

SEQ ID NO: 2301542 - RNA, 12 nt, Yersinia pestis KIM
cucagaggcgcu

SEQ ID NO: 2301543 - RNA, 21 nt, Yersinia pestis KIM
cucagagacaucuuuaccagc

SEQ ID NO: 2301544 - RNA, 15 nt, Yersinia pestis KIM
cucagagacaucuuu

SEQ ID NO: 2301545 - RNA, 18 nt, Yersinia pestis KIM
cucaaugucaugcaauua

SEQ ID NO: 2301546 - RNA, 19 nt, Yersinia pestis KIM
cucaauggcgggggcgaga

SEQ ID NO: 2301547 - RNA, 15 nt, Yersinia pestis KIM
cucaauggcuuuuuu

SEQ ID NO: 2301548 - RNA, 12 nt, Yersinia pestis KIM
cucaauugacug

SEQ ID NO: 2301549 - RNA, 18 nt, Yersinia pestis KIM
cucaccauguacauggcc

SEQ ID NO: 2301550 - RNA, 16 nt, Yersinia pestis KIM
cucaagggcacaguuu

SEQ ID NO: 2301551 - RNA, 17 nt, Yersinia pestis KIM
cucaagggcacaguuua

SEQ ID NO: 2301552 - RNA, 14 nt, Yersinia pestis KIM
cucaacauucuuua

SEQ ID NO: 2301553 - RNA, 16 nt, Yersinia pestis KIM
cucaaggagaauuuag

SEQ ID NO: 2301554 - RNA, 23 nt, Yersinia pestis KIM
cucaaccugaucacgcugaauuu

SEQ ID NO: 2301555 - RNA, 13 nt, Yersinia pestis KIM
cuauuuaaauaca

SEQ ID NO: 2301556 - RNA, 23 nt, Yersinia pestis KIM
cuauuagccagaaauagcaccau

SEQ ID NO: 2301557 - RNA, 11 nt, Yersinia pestis KIM
cuauuaauauc

SEQ ID NO: 2301558 - RNA, 14 nt, Yersinia pestis KIM
cuauuuccccgccg

SEQ ID NO: 2301559 - RNA, 13 nt, Yersinia pestis KIM
cuauuucuucaua

SEQ ID NO: 2301560 - RNA, 15 nt, Yersinia pestis KIM
cuauuugaugcuaac

SEQ ID NO: 2301561 - RNA, 23 nt, Yersinia pestis KIM
cuauuucagggcguauaaacaga

SEQ ID NO: 2301562 - RNA, 19 nt, Yersinia pestis KIM
cuauuuauuuauaaaacca

SEQ ID NO: 2301563 - RNA, 21 nt, Yersinia pestis KIM
cuauuuauuuauaaaaccacu

SEQ ID NO: 2301564 - RNA, 16 nt, Yersinia pestis KIM
cuauuuauuuuaucug

SEQ ID NO: 2301565 - RNA, 17 nt, Yersinia pestis KIM
cuauuuauuuuaucugu

SEQ ID NO: 2301566 - RNA, 22 nt, Yersinia pestis KIM
cuauuuacugcauucugagcac

SEQ ID NO: 2301567 - RNA, 13 nt, Yersinia pestis KIM
cucaaagaaaaau

SEQ ID NO: 2301568 - RNA, 19 nt, Yersinia pestis KIM
cucaaacugauaaagcaaa

SEQ ID NO: 2301569 - RNA, 18 nt, Yersinia pestis KIM
cucaaacugacuuuacuu

SEQ ID NO: 2301570 - RNA, 18 nt, Yersinia pestis KIM
cuauuuuuauuucuccuu

SEQ ID NO: 2301571 - RNA, 19 nt, Yersinia pestis KIM
cuauuuuuauaaucaucua

SEQ ID NO: 2301572 - RNA, 23 nt, Yersinia pestis KIM
cuauuuuauaucgaucugauauc

SEQ ID NO: 2301573 - RNA, 17 nt, Yersinia pestis KIM
cucgcuaaucaagccuu

SEQ ID NO: 2301574 - RNA, 20 nt, Yersinia pestis KIM
cucgcgguucgcagcuucca

SEQ ID NO: 2301575 - RNA, 17 nt, Yersinia pestis KIM
cucgcucaccacugagu

SEQ ID NO: 2301576 - RNA, 21 nt, Yersinia pestis KIM
cucgauaauaucgacuccuuu

SEQ ID NO: 2301577 - RNA, 22 nt, Yersinia pestis KIM
cucgauaauaucgacuccuuua

SEQ ID NO: 2301578 - RNA, 18 nt, Yersinia pestis KIM
cucgauugaauaacuucg

SEQ ID NO: 2301579 - RNA, 21 nt, Yersinia pestis KIM
cuccugcaacgccuucacauu

SEQ ID NO: 2301580 - RNA, 13 nt, Yersinia pestis KIM
cuccugauuuaac

SEQ ID NO: 2301581 - RNA, 19 nt, Yersinia pestis KIM
cuccugcaacgccuucaca

SEQ ID NO: 2301582 - RNA, 18 nt, Yersinia pestis KIM
cuccugaucuucauugcc

SEQ ID NO: 2301583 - RNA, 22 nt, Yersinia pestis KIM
cuccugaucuucauugccuucu

SEQ ID NO: 2301584 - RNA, 13 nt, Yersinia pestis KIM
cuccugaugacuc

SEQ ID NO: 2301585 - RNA, 16 nt, Yersinia pestis KIM
cucgacuaaacgccca

SEQ ID NO: 2301586 - RNA, 14 nt, Yersinia pestis KIM
cucggcgucagccg

SEQ ID NO: 2301587 - RNA, 22 nt, Yersinia pestis KIM
cucggcucgaaccugaacgcag

SEQ ID NO: 2301588 - RNA, 17 nt, Yersinia pestis KIM
cucggcgcgcuugccac

SEQ ID NO: 2301589 - RNA, 22 nt, Yersinia pestis KIM
cucggcgcgcuugccacgccag

SEQ ID NO: 2301590 - RNA, 22 nt, Yersinia pestis KIM
cucgggauaugacuaaacugau

SEQ ID NO: 2301591 - RNA, 21 nt, Yersinia pestis KIM
cucggcuuucaggugacugaa

SEQ ID NO: 2301592 - RNA, 14 nt, Yersinia pestis KIM
cucggucacugccu

SEQ ID NO: 2301593 - RNA, 18 nt, Yersinia pestis KIM
cucggucugaauaagaga

SEQ ID NO: 2301594 - RNA, 19 nt, Yersinia pestis KIM
cucgcuguggcuaccauag

SEQ ID NO: 2301595 - RNA, 23 nt, Yersinia pestis KIM
cucuacgacgcccgcagacugcu

SEQ ID NO: 2301596 - RNA, 17 nt, Yersinia pestis KIM
cucuacauugacuaauu

SEQ ID NO: 2301597 - RNA, 17 nt, Yersinia pestis KIM
cucgguuguucagcacc

SEQ ID NO: 2301598 - RNA, 22 nt, Yersinia pestis KIM
cucauuugaccuccguaggcca

SEQ ID NO: 2301599 - RNA, 19 nt, Yersinia pestis KIM
cucauuuuuugcguauuau

SEQ ID NO: 2301600 - RNA, 12 nt, Yersinia pestis KIM
cuccagaagcau

SEQ ID NO: 2301601 - RNA, 14 nt, Yersinia pestis KIM
cuccagaagcauau

SEQ ID NO: 2301602 - RNA, 18 nt, Yersinia pestis KIM
cuccagaauauaaaagca

SEQ ID NO: 2301603 - RNA, 20 nt, Yersinia pestis KIM
cuccaggcauuaaaaucacc

SEQ ID NO: 2301604 - RNA, 13 nt, Yersinia pestis KIM
cuccaggcauuaa

SEQ ID NO: 2301605 - RNA, 24 nt, Yersinia pestis KIM
cuccaggguaauaagugaucagcu

SEQ ID NO: 2301606 - RNA, 16 nt, Yersinia pestis KIM
cuccagugcaaauuua

SEQ ID NO: 2301607 - RNA, 17 nt, Yersinia pestis KIM
cuccaucgccacuucua

SEQ ID NO: 2301608 - RNA, 22 nt, Yersinia pestis KIM
cuccaucgccacuucuaacaag

SEQ ID NO: 2301609 - RNA, 13 nt, Yersinia pestis KIM
cuccauauagccc

SEQ ID NO: 2301610 - RNA, 24 nt, Yersinia pestis KIM
cuccauauuuuagcggccucuagc

SEQ ID NO: 2301611 - RNA, 22 nt, Yersinia pestis KIM
cuccaucaagccaccgcuggug

SEQ ID NO: 2301612 - RNA, 14 nt, Yersinia pestis KIM
cucccauuuauuac

SEQ ID NO: 2301613 - RNA, 23 nt, Yersinia pestis KIM
cuccccaaagccuacgagagauc

SEQ ID NO: 2301614 - RNA, 17 nt, Yersinia pestis KIM
cucccccacucgcccca

SEQ ID NO: 2301615 - RNA, 11 nt, Yersinia pestis KIM
cucccugacuc

SEQ ID NO: 2301616 - RNA, 14 nt, Yersinia pestis KIM
cucccugacucccu

SEQ ID NO: 2301617 - RNA, 15 nt, Yersinia pestis KIM
cucccugacucccug

SEQ ID NO: 2301618 - RNA, 19 nt, Yersinia pestis KIM
cucccugacucccugacuc

SEQ ID NO: 2301619 - RNA, 20 nt, Yersinia pestis KIM
cucccugacucccugacucc

SEQ ID NO: 2301620 - RNA, 12 nt, Yersinia pestis KIM
cuccggcggcuu

SEQ ID NO: 2301621 - RNA, 17 nt, Yersinia pestis KIM
cuccggcggcuucauca

SEQ ID NO: 2301622 - RNA, 16 nt, Yersinia pestis KIM
cuccggcaucauccuc

SEQ ID NO: 2301623 - RNA, 16 nt, Yersinia pestis KIM
cuccgcacuuggcccc

SEQ ID NO: 2301624 - RNA, 16 nt, Yersinia pestis KIM
cuccgcauccggcggu

SEQ ID NO: 2301625 - RNA, 22 nt, Yersinia pestis KIM
cuccuagccgggacuuugcucu

SEQ ID NO: 2301626 - RNA, 22 nt, Yersinia pestis KIM
cuccgguaauccuuguaagacc

SEQ ID NO: 2301627 - RNA, 19 nt, Yersinia pestis KIM
cguggguauccagugucau

SEQ ID NO: 2301628 - RNA, 13 nt, Yersinia pestis KIM
cguggguucuuca

SEQ ID NO: 2301629 - RNA, 14 nt, Yersinia pestis KIM
cguggugaugauga

SEQ ID NO: 2301630 - RNA, 21 nt, Yersinia pestis KIM
cguggcgcggaugcuuuauuc

SEQ ID NO: 2301631 - RNA, 22 nt, Yersinia pestis KIM
cgugcgcuccauuucugguugu

SEQ ID NO: 2301632 - RNA, 23 nt, Yersinia pestis KIM
cgugcucaucaaccucagccuca

SEQ ID NO: 2301633 - RNA, 21 nt, Yersinia pestis KIM
cgugcguuuuugaaauaccac

SEQ ID NO: 2301634 - RNA, 17 nt, Yersinia pestis KIM
cgugcugucagccagcg

SEQ ID NO: 2301635 - RNA, 21 nt, Yersinia pestis KIM
cgugcucgucuucgacagcag

SEQ ID NO: 2301636 - RNA, 17 nt, Yersinia pestis KIM
cgugucaaaccaauuuc

SEQ ID NO: 2301637 - RNA, 19 nt, Yersinia pestis KIM
cguguauaucacuauuuca

SEQ ID NO: 2301638 - RNA, 21 nt, Yersinia pestis KIM
cgugucaauauucuguuaguc

SEQ ID NO: 2301639 - RNA, 14 nt, Yersinia pestis KIM
cgugugauuuccau

SEQ ID NO: 2301640 - RNA, 21 nt, Yersinia pestis KIM
cguguugcaucauuggcuuca

SEQ ID NO: 2301641 - RNA, 16 nt, Yersinia pestis KIM
cguuaaauuucuucaa

SEQ ID NO: 2301642 - RNA, 18 nt, Yersinia pestis KIM
cguuaaaaggcaccucaa

SEQ ID NO: 2301643 - RNA, 20 nt, Yersinia pestis KIM
cguguuuuucaucugugccu

SEQ ID NO: 2301644 - RNA, 17 nt, Yersinia pestis KIM
cguuacagggggcacuu

SEQ ID NO: 2301645 - RNA, 18 nt, Yersinia pestis KIM
cguuacaguaaggcagca

SEQ ID NO: 2301646 - RNA, 17 nt, Yersinia pestis KIM
cguuacagaugggaaga

SEQ ID NO: 2301647 - RNA, 18 nt, Yersinia pestis KIM
cguuacagcaaggcagca

SEQ ID NO: 2301648 - RNA, 16 nt, Yersinia pestis KIM
cguuaauuauagugaa

SEQ ID NO: 2301649 - RNA, 19 nt, Yersinia pestis KIM
cguuaauuuagcguuuacu

SEQ ID NO: 2301650 - RNA, 20 nt, Yersinia pestis KIM
cguuaaauuucuucaauaau

SEQ ID NO: 2301651 - RNA, 13 nt, Yersinia pestis KIM
cguuaacccaaag

SEQ ID NO: 2301652 - RNA, 17 nt, Yersinia pestis KIM
cguuaaguucaagaacc

SEQ ID NO: 2301653 - RNA, 22 nt, Yersinia pestis KIM
cguucaaucgugcacccccuuc

SEQ ID NO: 2301654 - RNA, 23 nt, Yersinia pestis KIM
cguucaaucgugcacccccuucg

SEQ ID NO: 2301655 - RNA, 15 nt, Yersinia pestis KIM
cguucagcaauauga

SEQ ID NO: 2301656 - RNA, 17 nt, Yersinia pestis KIM
cguucaagagugaguca

SEQ ID NO: 2301657 - RNA, 14 nt, Yersinia pestis KIM
cguucaaaaucaaa

SEQ ID NO: 2301658 - RNA, 15 nt, Yersinia pestis KIM
cguuauuaaacaguc

SEQ ID NO: 2301659 - RNA, 15 nt, Yersinia pestis KIM
cguuagccuacuggc

SEQ ID NO: 2301660 - RNA, 19 nt, Yersinia pestis KIM
cguuagaucaacauuaucu

SEQ ID NO: 2301661 - RNA, 23 nt, Yersinia pestis KIM
cguuacucgguccaucugaaauu

SEQ ID NO: 2301662 - RNA, 22 nt, Yersinia pestis KIM
cguuugccaaaauccaccagcg

SEQ ID NO: 2301663 - RNA, 18 nt, Yersinia pestis KIM
cguuuuaaugccaauuga

SEQ ID NO: 2301664 - RNA, 13 nt, Yersinia pestis KIM
cuaaaaaaaacaa

SEQ ID NO: 2301665 - RNA, 19 nt, Yersinia pestis KIM
cguuuuugguuaaagaaga

SEQ ID NO: 2301666 - RNA, 18 nt, Yersinia pestis KIM
cguuuuuucguuuacuug

SEQ ID NO: 2301667 - RNA, 9 nt, Yersinia pestis KIM
cuaaaccac

SEQ ID NO: 2301668 - RNA, 11 nt, Yersinia pestis KIM
cguucucuggc

SEQ ID NO: 2301669 - RNA, 18 nt, Yersinia pestis KIM
cguuggcagcaaaucuug

SEQ ID NO: 2301670 - RNA, 17 nt, Yersinia pestis KIM
cguuguuguaugacaag

SEQ ID NO: 2301671 - RNA, 12 nt, Yersinia pestis KIM
cguuuaaauaaa

SEQ ID NO: 2301672 - RNA, 20 nt, Yersinia pestis KIM
cguuuccaaaacucaugucc

SEQ ID NO: 2301673 - RNA, 21 nt, Yersinia pestis KIM
cguuuccaaaacucaugucca

SEQ ID NO: 2301674 - RNA, 22 nt, Yersinia pestis KIM
cguuuccagugcggcauguaca

SEQ ID NO: 2301675 - RNA, 16 nt, Yersinia pestis KIM
cguuuacuggcugccu

SEQ ID NO: 2301676 - RNA, 23 nt, Yersinia pestis KIM
cguuuacugaucucaucaaacac

SEQ ID NO: 2301677 - RNA, 15 nt, Yersinia pestis KIM
cuaaccuuaacugca

SEQ ID NO: 2301678 - RNA, 14 nt, Yersinia pestis KIM
cuaaccacagcaau

SEQ ID NO: 2301679 - RNA, 24 nt, Yersinia pestis KIM
cuaaccgcacugggucaucaccca

SEQ ID NO: 2301680 - RNA, 18 nt, Yersinia pestis KIM
cuaacgcuucggcgcggu

SEQ ID NO: 2301681 - RNA, 22 nt, Yersinia pestis KIM
cuaacgccgcguuagcuauauu

SEQ ID NO: 2301682 - RNA, 14 nt, Yersinia pestis KIM
cuaacgucaacaga

SEQ ID NO: 2301683 - RNA, 20 nt, Yersinia pestis KIM
cuaagcggaguuggcuagca

SEQ ID NO: 2301684 - RNA, 20 nt, Yersinia pestis KIM
cuaagccucucucacuuugg

SEQ ID NO: 2301685 - RNA, 22 nt, Yersinia pestis KIM
cuaagacgccauuaauaauaaa

SEQ ID NO: 2301686 - RNA, 17 nt, Yersinia pestis KIM
cuaaguuaacaccauca

SEQ ID NO: 2301687 - RNA, 13 nt, Yersinia pestis KIM
cuaagcugccugu

SEQ ID NO: 2301688 - RNA, 17 nt, Yersinia pestis KIM
cuaaauugcuuaaaaaa

SEQ ID NO: 2301689 - RNA, 14 nt, Yersinia pestis KIM
cuaacaacuuccac

SEQ ID NO: 2301690 - RNA, 14 nt, Yersinia pestis KIM
cuaaccaaacauug

SEQ ID NO: 2301691 - RNA, 12 nt, Yersinia pestis KIM
cuaacaugguau

SEQ ID NO: 2301692 - RNA, 17 nt, Yersinia pestis KIM
cuaacaguuguuucaau

SEQ ID NO: 2301693 - RNA, 21 nt, Yersinia pestis KIM
cuaacauaaucaagaaaacag

SEQ ID NO: 2301694 - RNA, 23 nt, Yersinia pestis KIM
cuaaauguugauacaccgucuca

SEQ ID NO: 2301695 - RNA, 17 nt, Yersinia pestis KIM
cuaaauucuccuugagc

SEQ ID NO: 2301696 - RNA, 21 nt, Yersinia pestis KIM
cuaaagaaauaaucauaucaa

SEQ ID NO: 2301697 - RNA, 16 nt, Yersinia pestis KIM
cuaaagauaauuaauu

SEQ ID NO: 2301698 - RNA, 15 nt, Yersinia pestis KIM
cgucgccgcagaaga

SEQ ID NO: 2301699 - RNA, 13 nt, Yersinia pestis KIM
cgucgcuguuacc

SEQ ID NO: 2301700 - RNA, 19 nt, Yersinia pestis KIM
cgucccuaaagccaucgcc

SEQ ID NO: 2301701 - RNA, 21 nt, Yersinia pestis KIM
cgucccuaaagccaucgccau

SEQ ID NO: 2301702 - RNA, 14 nt, Yersinia pestis KIM
cgucccaagaaaag

SEQ ID NO: 2301703 - RNA, 19 nt, Yersinia pestis KIM
cguccagggcgcccuaaua

SEQ ID NO: 2301704 - RNA, 22 nt, Yersinia pestis KIM
cguccagaacaauaccgccaau

SEQ ID NO: 2301705 - RNA, 12 nt, Yersinia pestis KIM
cguccagaugcc

SEQ ID NO: 2301706 - RNA, 12 nt, Yersinia pestis KIM
cguccggcggcu

SEQ ID NO: 2301707 - RNA, 20 nt, Yersinia pestis KIM
cguccugaugaugaagcauu

SEQ ID NO: 2301708 - RNA, 16 nt, Yersinia pestis KIM
cgugcagcgcgcagcc

SEQ ID NO: 2301709 - RNA, 18 nt, Yersinia pestis KIM
cgugccugcuggcaaacu

SEQ ID NO: 2301710 - RNA, 18 nt, Yersinia pestis KIM
cgugcccaaaaacgcugg

SEQ ID NO: 2301711 - RNA, 21 nt, Yersinia pestis KIM
cgugauaugaauauccgccgc

SEQ ID NO: 2301712 - RNA, 18 nt, Yersinia pestis KIM
cgugaugccaguaauuca

SEQ ID NO: 2301713 - RNA, 16 nt, Yersinia pestis KIM
cgugauuuuuauauuu

SEQ ID NO: 2301714 - RNA, 17 nt, Yersinia pestis KIM
cgugauuuuuauauuuu

SEQ ID NO: 2301715 - RNA, 21 nt, Yersinia pestis KIM
cgugauuuuuauauuuugaga

SEQ ID NO: 2301716 - RNA, 21 nt, Yersinia pestis KIM
cgugacggcagcgagcacugc

SEQ ID NO: 2301717 - RNA, 13 nt, Yersinia pestis KIM
cgugacggcagcg

SEQ ID NO: 2301718 - RNA, 21 nt, Yersinia pestis KIM
cgugacggcggcgagcacugc

SEQ ID NO: 2301719 - RNA, 16 nt, Yersinia pestis KIM
cgugagaaaaaagucg

SEQ ID NO: 2301720 - RNA, 15 nt, Yersinia pestis KIM
cgugaagugagcuga

SEQ ID NO: 2301721 - RNA, 18 nt, Yersinia pestis KIM
cgugaagugagcugaacu

SEQ ID NO: 2301722 - RNA, 13 nt, Yersinia pestis KIM
cgugaagauaacg

SEQ ID NO: 2301723 - RNA, 20 nt, Yersinia pestis KIM
cgucguuugcuccauuuuuu

SEQ ID NO: 2301724 - RNA, 16 nt, Yersinia pestis KIM
cgucucuacgacgccc

SEQ ID NO: 2301725 - RNA, 16 nt, Yersinia pestis KIM
cgucugcaauagcuca

SEQ ID NO: 2301726 - RNA, 21 nt, Yersinia pestis KIM
cgucugacggguauaucacuu

SEQ ID NO: 2301727 - RNA, 21 nt, Yersinia pestis KIM
cgucugagguggcacccagug

SEQ ID NO: 2301728 - RNA, 16 nt, Yersinia pestis KIM
cgucuugaucaacuca

SEQ ID NO: 2301729 - RNA, 20 nt, Yersinia pestis KIM
cgucuuccgcccguucauca

SEQ ID NO: 2301730 - RNA, 21 nt, Yersinia pestis KIM
cgucuuugaccgaaccaccgc

SEQ ID NO: 2301731 - RNA, 17 nt, Yersinia pestis KIM
cgucuuuagauuucacc

SEQ ID NO: 2301732 - RNA, 13 nt, Yersinia pestis KIM
cgccagcaacagc

SEQ ID NO: 2301733 - RNA, 14 nt, Yersinia pestis KIM
cgccagauuaucca

SEQ ID NO: 2301734 - RNA, 16 nt, Yersinia pestis KIM
cgccagauuauccagc

SEQ ID NO: 2301735 - RNA, 13 nt, Yersinia pestis KIM
cgcgccugcucac

SEQ ID NO: 2301736 - RNA, 21 nt, Yersinia pestis KIM
cgcgccuguuacugaccgugc

SEQ ID NO: 2301737 - RNA, 22 nt, Yersinia pestis KIM
cgcgcgcccagacgccggccgg

SEQ ID NO: 2301738 - RNA, 18 nt, Yersinia pestis KIM
cgcgggcgcgcugcugcu

SEQ ID NO: 2301739 - RNA, 19 nt, Yersinia pestis KIM
cgcggacgcuuuacuccuc

SEQ ID NO: 2301740 - RNA, 21 nt, Yersinia pestis KIM
cgcggacgcuuuacuccucug

SEQ ID NO: 2301741 - RNA, 14 nt, Yersinia pestis KIM
cgcgcuuccaggcu

SEQ ID NO: 2301742 - RNA, 20 nt, Yersinia pestis KIM
cgcggacaccaacuggcggc

SEQ ID NO: 2301743 - RNA, 16 nt, Yersinia pestis KIM
cgcggaaaucagcuuc

SEQ ID NO: 2301744 - RNA, 13 nt, Yersinia pestis KIM
cgcgcuuccaggc

SEQ ID NO: 2301745 - RNA, 13 nt, Yersinia pestis KIM
cgcgcugcugcuc

SEQ ID NO: 2301746 - RNA, 15 nt, Yersinia pestis KIM
cgcguuaauaccuug

SEQ ID NO: 2301747 - RNA, 12 nt, Yersinia pestis KIM
cgcuagcacuga

SEQ ID NO: 2301748 - RNA, 22 nt, Yersinia pestis KIM
cgcuaauggauuccgaugcuug

SEQ ID NO: 2301749 - RNA, 18 nt, Yersinia pestis KIM
cgcucaguauucgccaga

SEQ ID NO: 2301750 - RNA, 14 nt, Yersinia pestis KIM
cgcucaauuaaccu

SEQ ID NO: 2301751 - RNA, 17 nt, Yersinia pestis KIM
cgcucaauggcgggggc

SEQ ID NO: 2301752 - RNA, 15 nt, Yersinia pestis KIM
cgcucaaucacgaca

SEQ ID NO: 2301753 - RNA, 12 nt, Yersinia pestis KIM
cgcuccucagcc

SEQ ID NO: 2301754 - RNA, 13 nt, Yersinia pestis KIM
cgcuccagguuca

SEQ ID NO: 2301755 - RNA, 20 nt, Yersinia pestis KIM
cgcuccacacaaaaacgcuc

SEQ ID NO: 2301756 - RNA, 17 nt, Yersinia pestis KIM
cgcuccaccagcccauc

SEQ ID NO: 2301757 - RNA, 13 nt, Yersinia pestis KIM
cgcugcaauaaag

SEQ ID NO: 2301758 - RNA, 16 nt, Yersinia pestis KIM
cgcugcaauuauaagc

SEQ ID NO: 2301759 - RNA, 16 nt, Yersinia pestis KIM
cgcugcaagccgcguu

SEQ ID NO: 2301760 - RNA, 15 nt, Yersinia pestis KIM
cgcugcaucagcagu

SEQ ID NO: 2301761 - RNA, 13 nt, Yersinia pestis KIM
cgcugcagcuuua

SEQ ID NO: 2301762 - RNA, 23 nt, Yersinia pestis KIM
cgcugcaaacaggcccacugcaa

SEQ ID NO: 2301763 - RNA, 23 nt, Yersinia pestis KIM
cgcugauguaggcaauacaccgc

SEQ ID NO: 2301764 - RNA, 22 nt, Yersinia pestis KIM
cgcugauugugccuuacuuuuu

SEQ ID NO: 2301765 - RNA, 15 nt, Yersinia pestis KIM
cgcucuucagcauca

SEQ ID NO: 2301766 - RNA, 21 nt, Yersinia pestis KIM
cgcucuguugacucgcggcag

SEQ ID NO: 2301767 - RNA, 22 nt, Yersinia pestis KIM
cggcagauaugaugcggaagaa

SEQ ID NO: 2301768 - RNA, 17 nt, Yersinia pestis KIM
cggcagauaugccaggc

SEQ ID NO: 2301769 - RNA, 22 nt, Yersinia pestis KIM
cggcacguuuccccuucauuug

SEQ ID NO: 2301770 - RNA, 17 nt, Yersinia pestis KIM
cggcaaguugaucaccc

SEQ ID NO: 2301771 - RNA, 15 nt, Yersinia pestis KIM
cggcaaucccggcca

SEQ ID NO: 2301772 - RNA, 23 nt, Yersinia pestis KIM
cggcaauuaagcaaaaaggcugc

SEQ ID NO: 2301773 - RNA, 15 nt, Yersinia pestis KIM
cggauacuguuuggu

SEQ ID NO: 2301774 - RNA, 14 nt, Yersinia pestis KIM
cggauacugaccca

SEQ ID NO: 2301775 - RNA, 14 nt, Yersinia pestis KIM
cggaucaaccgccc

SEQ ID NO: 2301776 - RNA, 16 nt, Yersinia pestis KIM
cggccacccgccauca

SEQ ID NO: 2301777 - RNA, 17 nt, Yersinia pestis KIM
cggccaggcucccaagg

SEQ ID NO: 2301778 - RNA, 15 nt, Yersinia pestis KIM
cggcaucuuuugcua

SEQ ID NO: 2301779 - RNA, 14 nt, Yersinia pestis KIM
cggcauuagugaau

SEQ ID NO: 2301780 - RNA, 14 nt, Yersinia pestis KIM
cggacagcgcgcag

SEQ ID NO: 2301781 - RNA, 19 nt, Yersinia pestis KIM
cggacagcgcgcagccaac

SEQ ID NO: 2301782 - RNA, 21 nt, Yersinia pestis KIM
cggacauuuuacucccugacu

SEQ ID NO: 2301783 - RNA, 23 nt, Yersinia pestis KIM
cggacauuuuacucccugacucc

SEQ ID NO: 2301784 - RNA, 21 nt, Yersinia pestis KIM
cggacauaagaugaccaccaa

SEQ ID NO: 2301785 - RNA, 22 nt, Yersinia pestis KIM
cggacauaaugcauccacuuuu

SEQ ID NO: 2301786 - RNA, 16 nt, Yersinia pestis KIM
cggacaccaacuggcg

SEQ ID NO: 2301787 - RNA, 16 nt, Yersinia pestis KIM
cggacgcuuuacuccu

SEQ ID NO: 2301788 - RNA, 18 nt, Yersinia pestis KIM
cggacggaauccaacauc

SEQ ID NO: 2301789 - RNA, 17 nt, Yersinia pestis KIM
cggacucauuccgccug

SEQ ID NO: 2301790 - RNA, 14 nt, Yersinia pestis KIM
cggagagucagcaa

SEQ ID NO: 2301791 - RNA, 15 nt, Yersinia pestis KIM
cggauaauguugcaa

SEQ ID NO: 2301792 - RNA, 15 nt, Yersinia pestis KIM
cggaagcaaucagga

SEQ ID NO: 2301793 - RNA, 16 nt, Yersinia pestis KIM
cggaagcacguaaauc

SEQ ID NO: 2301794 - RNA, 19 nt, Yersinia pestis KIM
cggaagccgugaccgcaga

SEQ ID NO: 2301795 - RNA, 22 nt, Yersinia pestis KIM
cggaagcgccgacacccagcca

SEQ ID NO: 2301796 - RNA, 14 nt, Yersinia pestis KIM
cggaauaaaugaga

SEQ ID NO: 2301797 - RNA, 19 nt, Yersinia pestis KIM
cggaaucaccuuucuccau

SEQ ID NO: 2301798 - RNA, 19 nt, Yersinia pestis KIM
cggaagacuuccagcacca

SEQ ID NO: 2301799 - RNA, 23 nt, Yersinia pestis KIM
cggaagagauagagcaguaaguu

SEQ ID NO: 2301800 - RNA, 21 nt, Yersinia pestis KIM
cgcuucgcuggucauaaucau

SEQ ID NO: 2301801 - RNA, 12 nt, Yersinia pestis KIM
cgcuucgcugug

SEQ ID NO: 2301802 - RNA, 14 nt, Yersinia pestis KIM
cggcgcaagcgaua

SEQ ID NO: 2301803 - RNA, 17 nt, Yersinia pestis KIM
cggcgagcacugccccg

SEQ ID NO: 2301804 - RNA, 16 nt, Yersinia pestis KIM
cggcgaaauauaaaac

SEQ ID NO: 2301805 - RNA, 21 nt, Yersinia pestis KIM
cggcgaaggcuucguggugcu

SEQ ID NO: 2301806 - RNA, 23 nt, Yersinia pestis KIM
cggcuugggagucagaugccgcu

SEQ ID NO: 2301807 - RNA, 18 nt, Yersinia pestis KIM
cggcuugcuuggugcccg

SEQ ID NO: 2301808 - RNA, 22 nt, Yersinia pestis KIM
cggcuggaaauauuggcaacaa

SEQ ID NO: 2301809 - RNA, 14 nt, Yersinia pestis KIM
cgggaacgccaagu

SEQ ID NO: 2301810 - RNA, 17 nt, Yersinia pestis KIM
cgggcacuaucaccgcg

SEQ ID NO: 2301811 - RNA, 11 nt, Yersinia pestis KIM
cgggcaaccug

SEQ ID NO: 2301812 - RNA, 15 nt, Yersinia pestis KIM
cgggaucaccgcuuu

SEQ ID NO: 2301813 - RNA, 19 nt, Yersinia pestis KIM
cggcgugaguuccagcccc

SEQ ID NO: 2301814 - RNA, 20 nt, Yersinia pestis KIM
cggcucuauuucaugauucu

SEQ ID NO: 2301815 - RNA, 22 nt, Yersinia pestis KIM
cgguguuagaucggccaaugcu

SEQ ID NO: 2301816 - RNA, 15 nt, Yersinia pestis KIM
cgguguuuggugaag

SEQ ID NO: 2301817 - RNA, 14 nt, Yersinia pestis KIM
cggugcuggugggc

SEQ ID NO: 2301818 - RNA, 15 nt, Yersinia pestis KIM
cggugcugacaaaca

SEQ ID NO: 2301819 - RNA, 11 nt, Yersinia pestis KIM
cggugaggaua

SEQ ID NO: 2301820 - RNA, 19 nt, Yersinia pestis KIM
cggugccgcaucaccgccc

SEQ ID NO: 2301821 - RNA, 16 nt, Yersinia pestis KIM
cggugaauacguucaa

SEQ ID NO: 2301822 - RNA, 11 nt, Yersinia pestis KIM
cggugaacaga

SEQ ID NO: 2301823 - RNA, 20 nt, Yersinia pestis KIM
cggucuggcaacugcaaaug

SEQ ID NO: 2301824 - RNA, 14 nt, Yersinia pestis KIM
cggucucuggaugc

SEQ ID NO: 2301825 - RNA, 15 nt, Yersinia pestis KIM
cgguucggauaaaua

SEQ ID NO: 2301826 - RNA, 14 nt, Yersinia pestis KIM
cgguuccaaagcac

SEQ ID NO: 2301827 - RNA, 14 nt, Yersinia pestis KIM
cguaaaaaacccuc

SEQ ID NO: 2301828 - RNA, 20 nt, Yersinia pestis KIM
cgguuuuuucuuucuucagc

SEQ ID NO: 2301829 - RNA, 21 nt, Yersinia pestis KIM
cguaaaaaggcagugacagua

SEQ ID NO: 2301830 - RNA, 17 nt, Yersinia pestis KIM
cguaaaucauagccagc

SEQ ID NO: 2301831 - RNA, 16 nt, Yersinia pestis KIM
cguaaauacauccaug

SEQ ID NO: 2301832 - RNA, 11 nt, Yersinia pestis KIM
cguaaauacau

SEQ ID NO: 2301833 - RNA, 11 nt, Yersinia pestis KIM
cguaacuucuu

SEQ ID NO: 2301834 - RNA, 14 nt, Yersinia pestis KIM
cguaacuguugcaa

SEQ ID NO: 2301835 - RNA, 12 nt, Yersinia pestis KIM
cguaagauuggg

SEQ ID NO: 2301836 - RNA, 21 nt, Yersinia pestis KIM
cguaauacccucgacaccaaa

SEQ ID NO: 2301837 - RNA, 22 nt, Yersinia pestis KIM
cguaagcgguuuguuaaaaagc

SEQ ID NO: 2301838 - RNA, 23 nt, Yersinia pestis KIM
cguaagcgguuuguuaaaaagcg

SEQ ID NO: 2301839 - RNA, 17 nt, Yersinia pestis KIM
cguacauuaaaugaaua

SEQ ID NO: 2301840 - RNA, 13 nt, Yersinia pestis KIM
cguacauuaaaug

SEQ ID NO: 2301841 - RNA, 21 nt, Yersinia pestis KIM
cguacauauaucacuauuuca

SEQ ID NO: 2301842 - RNA, 13 nt, Yersinia pestis KIM
cguacgacgucca

SEQ ID NO: 2301843 - RNA, 21 nt, Yersinia pestis KIM
cguacaaaaauaaacgggcuu

SEQ ID NO: 2301844 - RNA, 14 nt, Yersinia pestis KIM
cguaauucagauaa

SEQ ID NO: 2301845 - RNA, 19 nt, Yersinia pestis KIM
cguacaacaauaauaagcc

SEQ ID NO: 2301846 - RNA, 14 nt, Yersinia pestis KIM
cguaaucagccgcg

SEQ ID NO: 2301847 - RNA, 17 nt, Yersinia pestis KIM
cguaaugaugaugagua

SEQ ID NO: 2301848 - RNA, 16 nt, Yersinia pestis KIM
cgggugcuuuaaugag

SEQ ID NO: 2301849 - RNA, 17 nt, Yersinia pestis KIM
cggguggaccuccauca

SEQ ID NO: 2301850 - RNA, 13 nt, Yersinia pestis KIM
cgggugagugaac

SEQ ID NO: 2301851 - RNA, 23 nt, Yersinia pestis KIM
cgggugcgccaaucgccaccggc

SEQ ID NO: 2301852 - RNA, 14 nt, Yersinia pestis KIM
cgggucagcugacg

SEQ ID NO: 2301853 - RNA, 20 nt, Yersinia pestis KIM
cggguaacaacucaccgccg

SEQ ID NO: 2301854 - RNA, 16 nt, Yersinia pestis KIM
cggggccaucaucuuc

SEQ ID NO: 2301855 - RNA, 17 nt, Yersinia pestis KIM
cgggcugaguaaagccc

SEQ ID NO: 2301856 - RNA, 23 nt, Yersinia pestis KIM
cgggcugcugcagccgggaugau

SEQ ID NO: 2301857 - RNA, 16 nt, Yersinia pestis KIM
cggguuaacuuuuucu

SEQ ID NO: 2301858 - RNA, 23 nt, Yersinia pestis KIM
cggguggcccaaaugagcagcaa

SEQ ID NO: 2301859 - RNA, 17 nt, Yersinia pestis KIM
cggguggcgcugacggu

SEQ ID NO: 2301860 - RNA, 16 nt, Yersinia pestis KIM
cggguggugaaaucgg

SEQ ID NO: 2301861 - RNA, 16 nt, Yersinia pestis KIM
cggguuuugucggcgg

SEQ ID NO: 2301862 - RNA, 15 nt, Yersinia pestis KIM
cggguuuugcaucaa

SEQ ID NO: 2301863 - RNA, 23 nt, Yersinia pestis KIM
cgguaaucccgauauaaauaaaa

SEQ ID NO: 2301864 - RNA, 22 nt, Yersinia pestis KIM
cgguaaucccgauauaaauaaa

SEQ ID NO: 2301865 - RNA, 11 nt, Yersinia pestis KIM
cgguaauaaug

SEQ ID NO: 2301866 - RNA, 16 nt, Yersinia pestis KIM
cgguaauacucuggcc

SEQ ID NO: 2301867 - RNA, 17 nt, Yersinia pestis KIM
cgguaaucaauuuuugc

SEQ ID NO: 2301868 - RNA, 22 nt, Yersinia pestis KIM
cgguaaugagccgcauugaucc

SEQ ID NO: 2301869 - RNA, 22 nt, Yersinia pestis KIM
cgguaacgcccguugcccaccg

SEQ ID NO: 2301870 - RNA, 21 nt, Yersinia pestis KIM
cgguaaauggcgugcacugac

SEQ ID NO: 2301871 - RNA, 18 nt, Yersinia pestis KIM
cgguauccaucccaacaa

SEQ ID NO: 2301872 - RNA, 24 nt, Yersinia pestis KIM
cgguaucaacaauuuccauaucaa

SEQ ID NO: 2301873 - RNA, 18 nt, Yersinia pestis KIM
cgguagguuucugggcug

SEQ ID NO: 2301874 - RNA, 14 nt, Yersinia pestis KIM
cgguauucagccgc

SEQ ID NO: 2301875 - RNA, 19 nt, Yersinia pestis KIM
cgguaugaaacaaccgugu

SEQ ID NO: 2301876 - RNA, 15 nt, Yersinia pestis KIM
cgguagaccaccaac

SEQ ID NO: 2301877 - RNA, 14 nt, Yersinia pestis KIM
cgguacaggcaaag

SEQ ID NO: 2301878 - RNA, 16 nt, Yersinia pestis KIM
cgguacaggcaaagug

SEQ ID NO: 2301879 - RNA, 14 nt, Yersinia pestis KIM
cgguaccagcaaac

SEQ ID NO: 2301880 - RNA, 16 nt, Yersinia pestis KIM
cgguaccgcaggucag

SEQ ID NO: 2301881 - RNA, 16 nt, Yersinia pestis KIM
ccgcucuucaccaauc

SEQ ID NO: 2301882 - RNA, 13 nt, Yersinia pestis KIM
ccgcugcccggcu

SEQ ID NO: 2301883 - RNA, 17 nt, Yersinia pestis KIM
ccgcucgucacacuggu

SEQ ID NO: 2301884 - RNA, 14 nt, Yersinia pestis KIM
ccgcuugggcgaua

SEQ ID NO: 2301885 - RNA, 19 nt, Yersinia pestis KIM
ccgcuugcuuugcuucauc

SEQ ID NO: 2301886 - RNA, 17 nt, Yersinia pestis KIM
ccgcuuccaucacaaau

SEQ ID NO: 2301887 - RNA, 16 nt, Yersinia pestis KIM
ccgcuaaaucaucaaa

SEQ ID NO: 2301888 - RNA, 12 nt, Yersinia pestis KIM
ccgcguuucucu

SEQ ID NO: 2301889 - RNA, 20 nt, Yersinia pestis KIM
ccgcuaacaaccgugcacca

SEQ ID NO: 2301890 - RNA, 14 nt, Yersinia pestis KIM
ccgcuaucugcuga

SEQ ID NO: 2301891 - RNA, 23 nt, Yersinia pestis KIM
ccgcguugucagccaugccugcg

SEQ ID NO: 2301892 - RNA, 22 nt, Yersinia pestis KIM
ccgcguaagccgugccugcugg

SEQ ID NO: 2301893 - RNA, 15 nt, Yersinia pestis KIM
ccggcaccuucaacg

SEQ ID NO: 2301894 - RNA, 22 nt, Yersinia pestis KIM
ccggcaaccaguuauagcggug

SEQ ID NO: 2301895 - RNA, 17 nt, Yersinia pestis KIM
ccggagaacuugaacua

SEQ ID NO: 2301896 - RNA, 14 nt, Yersinia pestis KIM
ccggacucaaaaua

SEQ ID NO: 2301897 - RNA, 17 nt, Yersinia pestis KIM
ccggaaugaguugcccu

SEQ ID NO: 2301898 - RNA, 17 nt, Yersinia pestis KIM
ccgcuuuuaccaaccca

SEQ ID NO: 2301899 - RNA, 20 nt, Yersinia pestis KIM
ccggaaucagcguuuuauuc

SEQ ID NO: 2301900 - RNA, 13 nt, Yersinia pestis KIM
ccgcgcacagcac

SEQ ID NO: 2301901 - RNA, 19 nt, Yersinia pestis KIM
ccgcgauaaaaaauaaagu

SEQ ID NO: 2301902 - RNA, 19 nt, Yersinia pestis KIM
ccgccgucaaaccaagccc

SEQ ID NO: 2301903 - RNA, 21 nt, Yersinia pestis KIM
ccgccggguuuugcaucaagc

SEQ ID NO: 2301904 - RNA, 21 nt, Yersinia pestis KIM
ccgccucuuuuuccacacccu

SEQ ID NO: 2301905 - RNA, 19 nt, Yersinia pestis KIM
ccgccggauuucaauccga

SEQ ID NO: 2301906 - RNA, 15 nt, Yersinia pestis KIM
ccgccgccagccccg

SEQ ID NO: 2301907 - RNA, 14 nt, Yersinia pestis KIM
ccgccgccagcccc

SEQ ID NO: 2301908 - RNA, 23 nt, Yersinia pestis KIM
ccgccgccaacagugaauaacug

SEQ ID NO: 2301909 - RNA, 13 nt, Yersinia pestis KIM
ccgcccguagaaa

SEQ ID NO: 2301910 - RNA, 17 nt, Yersinia pestis KIM
ccgccaugagaaccagu

SEQ ID NO: 2301911 - RNA, 15 nt, Yersinia pestis KIM
ccgcagcucaccuag

SEQ ID NO: 2301912 - RNA, 11 nt, Yersinia pestis KIM
ccgcaguccaa

SEQ ID NO: 2301913 - RNA, 20 nt, Yersinia pestis KIM
ccgcaccacaaaggcaaaau

SEQ ID NO: 2301914 - RNA, 12 nt, Yersinia pestis KIM
ccgcaaggccau

SEQ ID NO: 2301915 - RNA, 17 nt, Yersinia pestis KIM
ccgcaagaauaacuggg

SEQ ID NO: 2301916 - RNA, 20 nt, Yersinia pestis KIM
ccgaugacgcgaucuugaac

SEQ ID NO: 2301917 - RNA, 18 nt, Yersinia pestis KIM
ccgaugacgcgaucugaa

SEQ ID NO: 2301918 - RNA, 15 nt, Yersinia pestis KIM
ccgaugacucgaacu

SEQ ID NO: 2301919 - RNA, 20 nt, Yersinia pestis KIM
ccgaugacucgaucuugaac

SEQ ID NO: 2301920 - RNA, 17 nt, Yersinia pestis KIM
ccgaugcgacaauuucc

SEQ ID NO: 2301921 - RNA, 14 nt, Yersinia pestis KIM
ccgagaaacaaaac

SEQ ID NO: 2301922 - RNA, 14 nt, Yersinia pestis KIM
ccgagcaaucaaaa

SEQ ID NO: 2301923 - RNA, 16 nt, Yersinia pestis KIM
ccgagcaaucaaaagg

SEQ ID NO: 2301924 - RNA, 18 nt, Yersinia pestis KIM
ccgagccgcaccaucuuc

SEQ ID NO: 2301925 - RNA, 14 nt, Yersinia pestis KIM
ccgaucaccaucau

SEQ ID NO: 2301926 - RNA, 20 nt, Yersinia pestis KIM
cccugguugcagcacgccag

SEQ ID NO: 2301927 - RNA, 16 nt, Yersinia pestis KIM
cccuguaaagccagua

SEQ ID NO: 2301928 - RNA, 12 nt, Yersinia pestis KIM
cccuguccagcc

SEQ ID NO: 2301929 - RNA, 20 nt, Yersinia pestis KIM
cccugucuccuaucugaggu

SEQ ID NO: 2301930 - RNA, 17 nt, Yersinia pestis KIM
cccuguugaucugaguu

SEQ ID NO: 2301931 - RNA, 23 nt, Yersinia pestis KIM
cccuguugcccagcaaggcgggc

SEQ ID NO: 2301932 - RNA, 18 nt, Yersinia pestis KIM
cccuggcucaucaaagga

SEQ ID NO: 2301933 - RNA, 17 nt, Yersinia pestis KIM
cccuggcucuggccagc

SEQ ID NO: 2301934 - RNA, 23 nt, Yersinia pestis KIM
cccugguuagcaaccgcugcagc

SEQ ID NO: 2301935 - RNA, 16 nt, Yersinia pestis KIM
cccuucgagcaccgcg

SEQ ID NO: 2301936 - RNA, 17 nt, Yersinia pestis KIM
cccuucagucaguaggc

SEQ ID NO: 2301937 - RNA, 11 nt, Yersinia pestis KIM
cccuucaguca

SEQ ID NO: 2301938 - RNA, 20 nt, Yersinia pestis KIM
cccuucaaagccgcuuuaau

SEQ ID NO: 2301939 - RNA, 15 nt, Yersinia pestis KIM
cccuucacacuggua

SEQ ID NO: 2301940 - RNA, 17 nt, Yersinia pestis KIM
cccuucaacucuacauu

SEQ ID NO: 2301941 - RNA, 20 nt, Yersinia pestis KIM
cccuuaugaguacuauuuuu

SEQ ID NO: 2301942 - RNA, 12 nt, Yersinia pestis KIM
cccuuacgauca

SEQ ID NO: 2301943 - RNA, 17 nt, Yersinia pestis KIM
cccuuacgaucacuuac

SEQ ID NO: 2301944 - RNA, 16 nt, Yersinia pestis KIM
cccuugauuuuaccaa

SEQ ID NO: 2301945 - RNA, 14 nt, Yersinia pestis KIM
cccuugacugacca

SEQ ID NO: 2301946 - RNA, 16 nt, Yersinia pestis KIM
ccccuucgagcaccgc

SEQ ID NO: 2301947 - RNA, 11 nt, Yersinia pestis KIM
ccccugucucc

SEQ ID NO: 2301948 - RNA, 21 nt, Yersinia pestis KIM
cccucuguccccgcuauuauu

SEQ ID NO: 2301949 - RNA, 13 nt, Yersinia pestis KIM
cccucucacacca

SEQ ID NO: 2301950 - RNA, 14 nt, Yersinia pestis KIM
cccugaauagccug

SEQ ID NO: 2301951 - RNA, 14 nt, Yersinia pestis KIM
cccugaaccauggc

SEQ ID NO: 2301952 - RNA, 13 nt, Yersinia pestis KIM
cccugacucccug

SEQ ID NO: 2301953 - RNA, 14 nt, Yersinia pestis KIM
cccugacucccuga

SEQ ID NO: 2301954 - RNA, 19 nt, Yersinia pestis KIM
cccugacucccugacuccc

SEQ ID NO: 2301955 - RNA, 16 nt, Yersinia pestis KIM
cccugacucccucacc

SEQ ID NO: 2301956 - RNA, 21 nt, Yersinia pestis KIM
cccugacgaaauuuaagaaau

SEQ ID NO: 2301957 - RNA, 13 nt, Yersinia pestis KIM
cccugccaccuug

SEQ ID NO: 2301958 - RNA, 16 nt, Yersinia pestis KIM
cccugcuuguuacgua

SEQ ID NO: 2301959 - RNA, 23 nt, Yersinia pestis KIM
cccugcuggccggcuacugguca

SEQ ID NO: 2301960 - RNA, 21 nt, Yersinia pestis KIM
cccugcgguauccuuagccaa

SEQ ID NO: 2301961 - RNA, 20 nt, Yersinia pestis KIM
cccugcguuuguaggggagg

SEQ ID NO: 2301962 - RNA, 17 nt, Yersinia pestis KIM
ccugcggccauccagaa

SEQ ID NO: 2301963 - RNA, 12 nt, Yersinia pestis KIM
ccugcguaaauu

SEQ ID NO: 2301964 - RNA, 14 nt, Yersinia pestis KIM
ccugccuauccuca

SEQ ID NO: 2301965 - RNA, 18 nt, Yersinia pestis KIM
ccugcgaauuaucaucca

SEQ ID NO: 2301966 - RNA, 23 nt, Yersinia pestis KIM
ccugcaccagugccaauccccac

SEQ ID NO: 2301967 - RNA, 12 nt, Yersinia pestis KIM
ccugcaccauau

SEQ ID NO: 2301968 - RNA, 23 nt, Yersinia pestis KIM
ccugcaauaccgccggcaacagc

SEQ ID NO: 2301969 - RNA, 16 nt, Yersinia pestis KIM
ccugcaauaacaccag

SEQ ID NO: 2301970 - RNA, 19 nt, Yersinia pestis KIM
ccugcaaugccaugacuuu

SEQ ID NO: 2301971 - RNA, 19 nt, Yersinia pestis KIM
ccugaaucucgcgcccugc

SEQ ID NO: 2301972 - RNA, 17 nt, Yersinia pestis KIM
ccugccgccucugcucc

SEQ ID NO: 2301973 - RNA, 15 nt, Yersinia pestis KIM
ccugccgccucugcu

SEQ ID NO: 2301974 - RNA, 15 nt, Yersinia pestis KIM
ccuguacauaaauuu

SEQ ID NO: 2301975 - RNA, 20 nt, Yersinia pestis KIM
ccuguaccaccaccaacagc

SEQ ID NO: 2301976 - RNA, 17 nt, Yersinia pestis KIM
ccuguaggccaguuauu

SEQ ID NO: 2301977 - RNA, 14 nt, Yersinia pestis KIM
ccugugcggcagug

SEQ ID NO: 2301978 - RNA, 16 nt, Yersinia pestis KIM
ccugugcggcagugaa

SEQ ID NO: 2301979 - RNA, 15 nt, Yersinia pestis KIM
ccugucguuacugcc

SEQ ID NO: 2301980 - RNA, 14 nt, Yersinia pestis KIM
ccuguggaaauuua

SEQ ID NO: 2301981 - RNA, 20 nt, Yersinia pestis KIM
ccugggccaguuuccacgaa

SEQ ID NO: 2301982 - RNA, 15 nt, Yersinia pestis KIM
ccugcucaacugcuc

SEQ ID NO: 2301983 - RNA, 19 nt, Yersinia pestis KIM
ccugcuacucgaauuauuu

SEQ ID NO: 2301984 - RNA, 19 nt, Yersinia pestis KIM
ccugcguuuguaggggagg

SEQ ID NO: 2301985 - RNA, 19 nt, Yersinia pestis KIM
ccugcugaaaaaugaguca

SEQ ID NO: 2301986 - RNA, 17 nt, Yersinia pestis KIM
ccugcugcaccucugcu

SEQ ID NO: 2301987 - RNA, 20 nt, Yersinia pestis KIM
ccucgaaaucauccgcggca

SEQ ID NO: 2301988 - RNA, 20 nt, Yersinia pestis KIM
ccucgacaccaaaacucccu

SEQ ID NO: 2301989 - RNA, 23 nt, Yersinia pestis KIM
ccucgacaccaaaacucccuguu

SEQ ID NO: 2301990 - RNA, 18 nt, Yersinia pestis KIM
ccucggugauaaguuuua

SEQ ID NO: 2301991 - RNA, 19 nt, Yersinia pestis KIM
ccucggucggcaagaccuu

SEQ ID NO: 2301992 - RNA, 16 nt, Yersinia pestis KIM
ccucucuuuccagcaa

SEQ ID NO: 2301993 - RNA, 14 nt, Yersinia pestis KIM
ccucuuguaaacca

SEQ ID NO: 2301994 - RNA, 20 nt, Yersinia pestis KIM
ccucuugcgcuccacgcccc

SEQ ID NO: 2301995 - RNA, 13 nt, Yersinia pestis KIM
ccucuucuuccgc

SEQ ID NO: 2301996 - RNA, 20 nt, Yersinia pestis KIM
ccucguuguuguaugacaag

SEQ ID NO: 2301997 - RNA, 13 nt, Yersinia pestis KIM
ccucuauuaucuu

SEQ ID NO: 2301998 - RNA, 15 nt, Yersinia pestis KIM
ccucuccccuaccuc

SEQ ID NO: 2301999 - RNA, 13 nt, Yersinia pestis KIM
ccugaaagucagg

SEQ ID NO: 2302000 - RNA, 20 nt, Yersinia pestis KIM
ccugaaagucaggauuggag

SEQ ID NO: 2302001 - RNA, 20 nt, Yersinia pestis KIM
ccugaaaugauuaaacgccu

SEQ ID NO: 2302002 - RNA, 17 nt, Yersinia pestis KIM
ccucuuuagguacuuug

SEQ ID NO: 2302003 - RNA, 14 nt, Yersinia pestis KIM
ccucuuuuaucugu

SEQ ID NO: 2302004 - RNA, 13 nt, Yersinia pestis KIM
ccucuuuccaaca

SEQ ID NO: 2302005 - RNA, 16 nt, Yersinia pestis KIM
ccuccauucugcagau

SEQ ID NO: 2302006 - RNA, 20 nt, Yersinia pestis KIM
ccuccuuggggccucacucu

SEQ ID NO: 2302007 - RNA, 18 nt, Yersinia pestis KIM
ccuccugacgaugauaaa

SEQ ID NO: 2302008 - RNA, 16 nt, Yersinia pestis KIM
ccuccggcgcccuucc

SEQ ID NO: 2302009 - RNA, 14 nt, Yersinia pestis KIM
ccuccguaggccaa

SEQ ID NO: 2302010 - RNA, 17 nt, Yersinia pestis KIM
ccucauucaugaggcuc

SEQ ID NO: 2302011 - RNA, 20 nt, Yersinia pestis KIM
ccucauucaugaggcucaga

SEQ ID NO: 2302012 - RNA, 16 nt, Yersinia pestis KIM
ccucauccguaaaaaa

SEQ ID NO: 2302013 - RNA, 18 nt, Yersinia pestis KIM
ccucaugauuuguugaug

SEQ ID NO: 2302014 - RNA, 20 nt, Yersinia pestis KIM
ccuacgguaccgcaggucag

SEQ ID NO: 2302015 - RNA, 15 nt, Yersinia pestis KIM
ccuaccggccauuga

SEQ ID NO: 2302016 - RNA, 18 nt, Yersinia pestis KIM
ccuacccauuauaaauaa

SEQ ID NO: 2302017 - RNA, 20 nt, Yersinia pestis KIM
ccuacggaggucaaaugagu

SEQ ID NO: 2302018 - RNA, 21 nt, Yersinia pestis KIM
ccuacgcuggcgcauccccac

SEQ ID NO: 2302019 - RNA, 12 nt, Yersinia pestis KIM
ccggcucgccca

SEQ ID NO: 2302020 - RNA, 19 nt, Yersinia pestis KIM
ccggcgugaguuccagccc

SEQ ID NO: 2302021 - RNA, 22 nt, Yersinia pestis KIM
ccgguauucagccaaaucauca

SEQ ID NO: 2302022 - RNA, 20 nt, Yersinia pestis KIM
ccgucgguuucucuuggagc

SEQ ID NO: 2302023 - RNA, 20 nt, Yersinia pestis KIM
ccguaaacguucugccaauu

SEQ ID NO: 2302024 - RNA, 23 nt, Yersinia pestis KIM
ccgucacucagaaaacagccacc

SEQ ID NO: 2302025 - RNA, 13 nt, Yersinia pestis KIM
ccguaggccaccc

SEQ ID NO: 2302026 - RNA, 17 nt, Yersinia pestis KIM
ccguagcacacacagcc

SEQ ID NO: 2302027 - RNA, 20 nt, Yersinia pestis KIM
ccguaacugaccgcagccuu

SEQ ID NO: 2302028 - RNA, 12 nt, Yersinia pestis KIM
ccguaacuucuu

SEQ ID NO: 2302029 - RNA, 19 nt, Yersinia pestis KIM
ccguucacccuuuggugag

SEQ ID NO: 2302030 - RNA, 13 nt, Yersinia pestis KIM
ccguucacccuuu

SEQ ID NO: 2302031 - RNA, 14 nt, Yersinia pestis KIM
ccguucaauaauag

SEQ ID NO: 2302032 - RNA, 16 nt, Yersinia pestis KIM
ccgugcgggaugacuc

SEQ ID NO: 2302033 - RNA, 17 nt, Yersinia pestis KIM
ccguggauaaacaaaua

SEQ ID NO: 2302034 - RNA, 19 nt, Yersinia pestis KIM
ccgugcgccugaacagccu

SEQ ID NO: 2302035 - RNA, 23 nt, Yersinia pestis KIM
ccgugacauuuucaccgaggcgg

SEQ ID NO: 2302036 - RNA, 20 nt, Yersinia pestis KIM
ccgugaccaccgcagcaacc

SEQ ID NO: 2302037 - RNA, 20 nt, Yersinia pestis KIM
ccuaauauccucaaaauucg

SEQ ID NO: 2302038 - RNA, 18 nt, Yersinia pestis KIM
ccuaacgccaaaauguag

SEQ ID NO: 2302039 - RNA, 20 nt, Yersinia pestis KIM
ccuaacgccaaaauguagua

SEQ ID NO: 2302040 - RNA, 23 nt, Yersinia pestis KIM
ccuaacgccguggugaaaaauga

SEQ ID NO: 2302041 - RNA, 15 nt, Yersinia pestis KIM
ccuaacacguuaaau

SEQ ID NO: 2302042 - RNA, 18 nt, Yersinia pestis KIM
ccuaacaacugccgccau

SEQ ID NO: 2302043 - RNA, 14 nt, Yersinia pestis KIM
ccuaccaaauguug

SEQ ID NO: 2302044 - RNA, 23 nt, Yersinia pestis KIM
ccuacauaaaaauagcuucccug

SEQ ID NO: 2302045 - RNA, 18 nt, Yersinia pestis KIM
ccuaaugaacacuuaauu

SEQ ID NO: 2302046 - RNA, 22 nt, Yersinia pestis KIM
ccuaaugaacacuuaauuccau

SEQ ID NO: 2302047 - RNA, 16 nt, Yersinia pestis KIM
ccuaauguacuaccaa

SEQ ID NO: 2302048 - RNA, 18 nt, Yersinia pestis KIM
ccuaauguacuaccaaaa

SEQ ID NO: 2302049 - RNA, 22 nt, Yersinia pestis KIM
ccguucgcgguaugaaacaacc

SEQ ID NO: 2302050 - RNA, 10 nt, Yersinia pestis KIM
ccguuucucu

SEQ ID NO: 2302051 - RNA, 13 nt, Yersinia pestis KIM
ccguuugcaacag

SEQ ID NO: 2302052 - RNA, 21 nt, Yersinia pestis KIM
ccguuuuaacgcugcccaaua

SEQ ID NO: 2302053 - RNA, 23 nt, Yersinia pestis KIM
ccguuuguaaccgacuugcccaa

SEQ ID NO: 2302054 - RNA, 12 nt, Yersinia pestis KIM
cgaggaugacga

SEQ ID NO: 2302055 - RNA, 13 nt, Yersinia pestis KIM
cgaggaucaccac

SEQ ID NO: 2302056 - RNA, 20 nt, Yersinia pestis KIM
cgagcuguuugcuguaaaca

SEQ ID NO: 2302057 - RNA, 16 nt, Yersinia pestis KIM
cgaggaaaacgccagc

SEQ ID NO: 2302058 - RNA, 17 nt, Yersinia pestis KIM
cgagccuacuacaugga

SEQ ID NO: 2302059 - RNA, 18 nt, Yersinia pestis KIM
cgagccgcgcccucccug

SEQ ID NO: 2302060 - RNA, 22 nt, Yersinia pestis KIM
cgagcgugcgguagaccaccaa

SEQ ID NO: 2302061 - RNA, 19 nt, Yersinia pestis KIM
cgagcgucaagccaacccc

SEQ ID NO: 2302062 - RNA, 22 nt, Yersinia pestis KIM
cgagcggggcaaaaauuacagu

SEQ ID NO: 2302063 - RNA, 18 nt, Yersinia pestis KIM
cgaguccguuaaaaaauu

SEQ ID NO: 2302064 - RNA, 17 nt, Yersinia pestis KIM
cgaguccguuaaaaaau

SEQ ID NO: 2302065 - RNA, 16 nt, Yersinia pestis KIM
cgagucacauuuuuaa

SEQ ID NO: 2302066 - RNA, 14 nt, Yersinia pestis KIM
cgaguaaugaaauc

SEQ ID NO: 2302067 - RNA, 16 nt, Yersinia pestis KIM
cgaguaaauacaaaua

SEQ ID NO: 2302068 - RNA, 15 nt, Yersinia pestis KIM
cgagugccaacucag

SEQ ID NO: 2302069 - RNA, 14 nt, Yersinia pestis KIM
cgaguguaaaaagc

SEQ ID NO: 2302070 - RNA, 19 nt, Yersinia pestis KIM
cgauauggcacaggcaaaa

SEQ ID NO: 2302071 - RNA, 15 nt, Yersinia pestis KIM
cgauaugcuccagau

SEQ ID NO: 2302072 - RNA, 22 nt, Yersinia pestis KIM
cgauaguaauuuuuagccgcaa

SEQ ID NO: 2302073 - RNA, 21 nt, Yersinia pestis KIM
cgauacaccauuuccaggcua

SEQ ID NO: 2302074 - RNA, 20 nt, Yersinia pestis KIM
cgauacauaccauaaggcca

SEQ ID NO: 2302075 - RNA, 15 nt, Yersinia pestis KIM
cgauacaccauuucc

SEQ ID NO: 2302076 - RNA, 16 nt, Yersinia pestis KIM
cgaguuuccaguucaa

SEQ ID NO: 2302077 - RNA, 17 nt, Yersinia pestis KIM
cgaguuaaacugggucg

SEQ ID NO: 2302078 - RNA, 23 nt, Yersinia pestis KIM
cgaguuaacacgggcaugaacgu

SEQ ID NO: 2302079 - RNA, 23 nt, Yersinia pestis KIM
cgaguuaggaaaaauuguuugac

SEQ ID NO: 2302080 - RNA, 13 nt, Yersinia pestis KIM
cgaguucagugau

SEQ ID NO: 2302081 - RNA, 13 nt, Yersinia pestis KIM
cgacggagagaac

SEQ ID NO: 2302082 - RNA, 16 nt, Yersinia pestis KIM
cgacggagagaacagg

SEQ ID NO: 2302083 - RNA, 15 nt, Yersinia pestis KIM
cgacucaagccucua

SEQ ID NO: 2302084 - RNA, 14 nt, Yersinia pestis KIM
cgacuauagauacc

SEQ ID NO: 2302085 - RNA, 20 nt, Yersinia pestis KIM
cgacucuuuuugugcuucau

SEQ ID NO: 2302086 - RNA, 14 nt, Yersinia pestis KIM
cgacuccaucaccg

SEQ ID NO: 2302087 - RNA, 14 nt, Yersinia pestis KIM
cgacuaauggccag

SEQ ID NO: 2302088 - RNA, 13 nt, Yersinia pestis KIM
cgacugcaccuug

SEQ ID NO: 2302089 - RNA, 17 nt, Yersinia pestis KIM
cgagcccccagggaagg

SEQ ID NO: 2302090 - RNA, 13 nt, Yersinia pestis KIM
cgagcccaggcga

SEQ ID NO: 2302091 - RNA, 23 nt, Yersinia pestis KIM
cgagcacugccccgaagcucaag

SEQ ID NO: 2302092 - RNA, 12 nt, Yersinia pestis KIM
cgagcacugccc

SEQ ID NO: 2302093 - RNA, 13 nt, Yersinia pestis KIM
cgagcacugcccc

SEQ ID NO: 2302094 - RNA, 17 nt, Yersinia pestis KIM
cgagcacauggcgaaca

SEQ ID NO: 2302095 - RNA, 22 nt, Yersinia pestis KIM
cgagaaagucuuaaucuuuaau

SEQ ID NO: 2302096 - RNA, 19 nt, Yersinia pestis KIM
cgagaagcuucaacuuaau

SEQ ID NO: 2302097 - RNA, 18 nt, Yersinia pestis KIM
cgagaaggauugaccaau

SEQ ID NO: 2302098 - RNA, 13 nt, Yersinia pestis KIM
cgagauggucaug

SEQ ID NO: 2302099 - RNA, 17 nt, Yersinia pestis KIM
cgagauguauccaaggc

SEQ ID NO: 2302100 - RNA, 19 nt, Yersinia pestis KIM
cgagaugcgcgaauagcug

SEQ ID NO: 2302101 - RNA, 15 nt, Yersinia pestis KIM
cgcaucgucgcuguu

SEQ ID NO: 2302102 - RNA, 13 nt, Yersinia pestis KIM
cgcaugacuagug

SEQ ID NO: 2302103 - RNA, 16 nt, Yersinia pestis KIM
cgcauccccacuugua

SEQ ID NO: 2302104 - RNA, 12 nt, Yersinia pestis KIM
cgcauaggccaa

SEQ ID NO: 2302105 - RNA, 20 nt, Yersinia pestis KIM
cgcaggucccucuugaauaa

SEQ ID NO: 2302106 - RNA, 12 nt, Yersinia pestis KIM
cgcaguuaucau

SEQ ID NO: 2302107 - RNA, 21 nt, Yersinia pestis KIM
cgcaguuaucauugcuccugu

SEQ ID NO: 2302108 - RNA, 19 nt, Yersinia pestis KIM
cgcagcaaauaaacaaaau

SEQ ID NO: 2302109 - RNA, 16 nt, Yersinia pestis KIM
cgcagcguccauaaac

SEQ ID NO: 2302110 - RNA, 15 nt, Yersinia pestis KIM
cgcaggcacugcaga

SEQ ID NO: 2302111 - RNA, 18 nt, Yersinia pestis KIM
cgcaggcacuuugucaac

SEQ ID NO: 2302112 - RNA, 15 nt, Yersinia pestis KIM
cgccacuucuaacaa

SEQ ID NO: 2302113 - RNA, 23 nt, Yersinia pestis KIM
cgccacuuuuaccgcaaccaccu

SEQ ID NO: 2302114 - RNA, 21 nt, Yersinia pestis KIM
cgccaauaaccgcagcaggca

SEQ ID NO: 2302115 - RNA, 13 nt, Yersinia pestis KIM
cgccaagcuuucu

SEQ ID NO: 2302116 - RNA, 20 nt, Yersinia pestis KIM
cgccaaggaaggcuauuuuu

SEQ ID NO: 2302117 - RNA, 15 nt, Yersinia pestis KIM
cgccaaguccuccuu

SEQ ID NO: 2302118 - RNA, 20 nt, Yersinia pestis KIM
cgcauucauaucguccaaag

SEQ ID NO: 2302119 - RNA, 17 nt, Yersinia pestis KIM
cgcauuaauccgccuga

SEQ ID NO: 2302120 - RNA, 19 nt, Yersinia pestis KIM
cgcauuaauccgccugaga

SEQ ID NO: 2302121 - RNA, 22 nt, Yersinia pestis KIM
cgcauucuuuuuguuaaaauag

SEQ ID NO: 2302122 - RNA, 21 nt, Yersinia pestis KIM
cgcauugaccgcuguuugauu

SEQ ID NO: 2302123 - RNA, 20 nt, Yersinia pestis KIM
cgcauuuauuuguagugacg

SEQ ID NO: 2302124 - RNA, 14 nt, Yersinia pestis KIM
cgccaacugcggca

SEQ ID NO: 2302125 - RNA, 16 nt, Yersinia pestis KIM
cgccaacacuauugug

SEQ ID NO: 2302126 - RNA, 23 nt, Yersinia pestis KIM
cgccaacaggccuaaugccgcgc

SEQ ID NO: 2302127 - RNA, 13 nt, Yersinia pestis KIM
cgaugcucaggcc

SEQ ID NO: 2302128 - RNA, 18 nt, Yersinia pestis KIM
cgaucacuuauuccuuuc

SEQ ID NO: 2302129 - RNA, 20 nt, Yersinia pestis KIM
cgaucacuuucccgcgucgu

SEQ ID NO: 2302130 - RNA, 12 nt, Yersinia pestis KIM
cgaucaacagug

SEQ ID NO: 2302131 - RNA, 23 nt, Yersinia pestis KIM
cgauggggaguauucgugguggg

SEQ ID NO: 2302132 - RNA, 23 nt, Yersinia pestis KIM
cgauggaacaggauuuucaaacu

SEQ ID NO: 2302133 - RNA, 14 nt, Yersinia pestis KIM
cgauggaaccacau

SEQ ID NO: 2302134 - RNA, 18 nt, Yersinia pestis KIM
cgaugcuuggggcuuauu

SEQ ID NO: 2302135 - RNA, 16 nt, Yersinia pestis KIM
cgauuugcucuuuuuu

SEQ ID NO: 2302136 - RNA, 12 nt, Yersinia pestis KIM
cgauuucuacgg

SEQ ID NO: 2302137 - RNA, 13 nt, Yersinia pestis KIM
cgauuucaucagc

SEQ ID NO: 2302138 - RNA, 17 nt, Yersinia pestis KIM
cgauuucaucagcguua

SEQ ID NO: 2302139 - RNA, 14 nt, Yersinia pestis KIM
cgauuuuugaguuu

SEQ ID NO: 2302140 - RNA, 13 nt, Yersinia pestis KIM
cgauuuuaaaaaa

SEQ ID NO: 2302141 - RNA, 15 nt, Yersinia pestis KIM
cgauuuuaaaaaauc

SEQ ID NO: 2302142 - RNA, 18 nt, Yersinia pestis KIM
cgauuggacccgucacca

SEQ ID NO: 2302143 - RNA, 14 nt, Yersinia pestis KIM
cgauuuaugaaccg

SEQ ID NO: 2302144 - RNA, 20 nt, Yersinia pestis KIM
cgauuccgcgagcaauacca

SEQ ID NO: 2302145 - RNA, 13 nt, Yersinia pestis KIM
cgauuccucugua

SEQ ID NO: 2302146 - RNA, 17 nt, Yersinia pestis KIM
cgauuccuguugaccaa

SEQ ID NO: 2302147 - RNA, 16 nt, Yersinia pestis KIM
cgauguuuuccaacuc

SEQ ID NO: 2302148 - RNA, 21 nt, Yersinia pestis KIM
cgauuccaucagcgcacugca

SEQ ID NO: 2302149 - RNA, 20 nt, Yersinia pestis KIM
cgcaauggaagaaucaccga

SEQ ID NO: 2302150 - RNA, 19 nt, Yersinia pestis KIM
cgcaaucucuugacgccga

SEQ ID NO: 2302151 - RNA, 14 nt, Yersinia pestis KIM
cgcaaucagauggu

SEQ ID NO: 2302152 - RNA, 14 nt, Yersinia pestis KIM
cgcacacagcccug

SEQ ID NO: 2302153 - RNA, 22 nt, Yersinia pestis KIM
cgcaauucgucuaaagaaucag

SEQ ID NO: 2302154 - RNA, 10 nt, Yersinia pestis KIM
cgcaaaacuu

SEQ ID NO: 2302155 - RNA, 19 nt, Yersinia pestis KIM
cgcaaggauaccaaucccu

SEQ ID NO: 2302156 - RNA, 16 nt, Yersinia pestis KIM
cgcaaggccagguuag

SEQ ID NO: 2302157 - RNA, 18 nt, Yersinia pestis KIM
cgcaagaaagaaaaauag

SEQ ID NO: 2302158 - RNA, 17 nt, Yersinia pestis KIM
cgcaagaguuagggcug

SEQ ID NO: 2302159 - RNA, 23 nt, Yersinia pestis KIM
cgcaccggcuaaccacagcaaug

SEQ ID NO: 2302160 - RNA, 22 nt, Yersinia pestis KIM
cgcacgggucauuaacgcacau

SEQ ID NO: 2302161 - RNA, 14 nt, Yersinia pestis KIM
cgcagaaccuuguu

SEQ ID NO: 2302162 - RNA, 17 nt, Yersinia pestis KIM
cgcacguucccaggcca

SEQ ID NO: 2302163 - RNA, 18 nt, Yersinia pestis KIM
cgcagauccagaauuuca

SEQ ID NO: 2302164 - RNA, 18 nt, Yersinia pestis KIM
ccuuuugaauucaccaaa

SEQ ID NO: 2302165 - RNA, 13 nt, Yersinia pestis KIM
ccuuuugacuggu

SEQ ID NO: 2302166 - RNA, 19 nt, Yersinia pestis KIM
ccuuuuccgucagcccaac

SEQ ID NO: 2302167 - RNA, 20 nt, Yersinia pestis KIM
ccuuuuugguuuucuauuuc

SEQ ID NO: 2302168 - RNA, 17 nt, Yersinia pestis KIM
cgaaacacacuucgccg

SEQ ID NO: 2302169 - RNA, 10 nt, Yersinia pestis KIM
cgaaacacca

SEQ ID NO: 2302170 - RNA, 18 nt, Yersinia pestis KIM
cgaaaaccuaauacuuuc

SEQ ID NO: 2302171 - RNA, 13 nt, Yersinia pestis KIM
cgaaaagcagcag

SEQ ID NO: 2302172 - RNA, 18 nt, Yersinia pestis KIM
cgaaaaaacagcgaucua

SEQ ID NO: 2302173 - RNA, 22 nt, Yersinia pestis KIM
ccuuuuagccuucguuugucaa

SEQ ID NO: 2302174 - RNA, 20 nt, Yersinia pestis KIM
ccuuuuacaccacuaguuaa

SEQ ID NO: 2302175 - RNA, 18 nt, Yersinia pestis KIM
ccuuuuagauuacugcuc

SEQ ID NO: 2302176 - RNA, 15 nt, Yersinia pestis KIM
ccuuugcuuucagga

SEQ ID NO: 2302177 - RNA, 16 nt, Yersinia pestis KIM
ccuuugcuuucaggau

SEQ ID NO: 2302178 - RNA, 18 nt, Yersinia pestis KIM
ccuuugcuuuucugccua

SEQ ID NO: 2302179 - RNA, 19 nt, Yersinia pestis KIM
ccuuuggauuuaaugcugu

SEQ ID NO: 2302180 - RNA, 18 nt, Yersinia pestis KIM
ccuuugacagcaucugca

SEQ ID NO: 2302181 - RNA, 15 nt, Yersinia pestis KIM
ccuuucuaauuauua

SEQ ID NO: 2302182 - RNA, 22 nt, Yersinia pestis KIM
ccuuucaacaaauucaccagca

SEQ ID NO: 2302183 - RNA, 17 nt, Yersinia pestis KIM
ccuuuauguaguucagu

SEQ ID NO: 2302184 - RNA, 21 nt, Yersinia pestis KIM
ccuuuaucgcggacaccaacu

SEQ ID NO: 2302185 - RNA, 16 nt, Yersinia pestis KIM
ccuuuaggaaagccca

SEQ ID NO: 2302186 - RNA, 23 nt, Yersinia pestis KIM
cgaacggauagcgcuucagugau

SEQ ID NO: 2302187 - RNA, 21 nt, Yersinia pestis KIM
cgaacagugccaacagcgaga

SEQ ID NO: 2302188 - RNA, 15 nt, Yersinia pestis KIM
cgaaagcgccugugg

SEQ ID NO: 2302189 - RNA, 15 nt, Yersinia pestis KIM
cgaaaggaacaaaag

SEQ ID NO: 2302190 - RNA, 15 nt, Yersinia pestis KIM
cgaaauaaaaccauc

SEQ ID NO: 2302191 - RNA, 23 nt, Yersinia pestis KIM
cgaaaguuaaacaauguuaaacu

SEQ ID NO: 2302192 - RNA, 14 nt, Yersinia pestis KIM
cgaaauauaaaaca

SEQ ID NO: 2302193 - RNA, 22 nt, Yersinia pestis KIM
cgaaauaaaugcgacagguagu

SEQ ID NO: 2302194 - RNA, 16 nt, Yersinia pestis KIM
cgaaaucacccggcca

SEQ ID NO: 2302195 - RNA, 14 nt, Yersinia pestis KIM
cgaaaugaucuuca

SEQ ID NO: 2302196 - RNA, 15 nt, Yersinia pestis KIM
cgaaauuaaggaaaa

SEQ ID NO: 2302197 - RNA, 18 nt, Yersinia pestis KIM
cgaaauuuaagaaaucua

SEQ ID NO: 2302198 - RNA, 11 nt, Yersinia pestis KIM
ccuuguuucug

SEQ ID NO: 2302199 - RNA, 19 nt, Yersinia pestis KIM
ccuuguucaggcagauaaa

SEQ ID NO: 2302200 - RNA, 17 nt, Yersinia pestis KIM
ccuuuaaaucuagcccu

SEQ ID NO: 2302201 - RNA, 12 nt, Yersinia pestis KIM
ccuuuaaaacug

SEQ ID NO: 2302202 - RNA, 20 nt, Yersinia pestis KIM
ccuuuaaaacuggucagccc

SEQ ID NO: 2302203 - RNA, 16 nt, Yersinia pestis KIM
ccuuuacuaucacuau

SEQ ID NO: 2302204 - RNA, 20 nt, Yersinia pestis KIM
ccuuuacuaucacuauccuu

SEQ ID NO: 2302205 - RNA, 20 nt, Yersinia pestis KIM
ccuuuacgggcggcauaauc

SEQ ID NO: 2302206 - RNA, 14 nt, Yersinia pestis KIM
ccuuuaccaugcuc

SEQ ID NO: 2302207 - RNA, 19 nt, Yersinia pestis KIM
ccuuggcauugucugcugg

SEQ ID NO: 2302208 - RNA, 15 nt, Yersinia pestis KIM
ccuugcgaucaauug

SEQ ID NO: 2302209 - RNA, 17 nt, Yersinia pestis KIM
ccuugagggucgcccgg

SEQ ID NO: 2302210 - RNA, 14 nt, Yersinia pestis KIM
ccuugauccgccaa

SEQ ID NO: 2302211 - RNA, 14 nt, Yersinia pestis KIM
ccuugaguauccaa

SEQ ID NO: 2302212 - RNA, 14 nt, Yersinia pestis KIM
ccuugaucgccaaa

SEQ ID NO: 2302213 - RNA, 21 nt, Yersinia pestis KIM
ccuugcauccggucaagcgca

SEQ ID NO: 2302214 - RNA, 14 nt, Yersinia pestis KIM
ccuugccagugcaa

SEQ ID NO: 2302215 - RNA, 20 nt, Yersinia pestis KIM
ccuugauggaaauacgcuua

SEQ ID NO: 2302216 - RNA, 14 nt, Yersinia pestis KIM
ccuugauucacuga

SEQ ID NO: 2302217 - RNA, 17 nt, Yersinia pestis KIM
ccuucggacgcuccuca

SEQ ID NO: 2302218 - RNA, 22 nt, Yersinia pestis KIM
ccuucgggcuugguguugcaaa

SEQ ID NO: 2302219 - RNA, 17 nt, Yersinia pestis KIM
ccuguuacaucagagcu

SEQ ID NO: 2302220 - RNA, 15 nt, Yersinia pestis KIM
ccuguuaauaauuca

SEQ ID NO: 2302221 - RNA, 20 nt, Yersinia pestis KIM
ccuuccaaugucaguggcgg

SEQ ID NO: 2302222 - RNA, 20 nt, Yersinia pestis KIM
ccuguguuuugagcaucacu

SEQ ID NO: 2302223 - RNA, 14 nt, Yersinia pestis KIM
ccuuccggcaucuu

SEQ ID NO: 2302224 - RNA, 23 nt, Yersinia pestis KIM
ccuuccugugcggaucccguuuc

SEQ ID NO: 2302225 - RNA, 20 nt, Yersinia pestis KIM
ccuucccuacagaaaaauaa

SEQ ID NO: 2302226 - RNA, 20 nt, Yersinia pestis KIM
ccuucccccaaguaaaaaaa

SEQ ID NO: 2302227 - RNA, 19 nt, Yersinia pestis KIM
ccuucucuuuaucaauuua

SEQ ID NO: 2302228 - RNA, 11 nt, Yersinia pestis KIM
ccuucuucacc

SEQ ID NO: 2302229 - RNA, 15 nt, Yersinia pestis KIM
ccuucuggugguguc

SEQ ID NO: 2302230 - RNA, 16 nt, Yersinia pestis KIM
ccuucgguaaucaauu

SEQ ID NO: 2302231 - RNA, 20 nt, Yersinia pestis KIM
ccuucgguaaucaauuuuug

SEQ ID NO: 2302232 - RNA, 14 nt, Yersinia pestis KIM
ccuucuuuaucugu

SEQ ID NO: 2302233 - RNA, 18 nt, Yersinia pestis KIM
ccuucuuucaaagugaca

SEQ ID NO: 2302234 - RNA, 23 nt, Yersinia pestis KIM
ccuugacgccgaugaauauaaac

SEQ ID NO: 2302235 - RNA, 15 nt, Yersinia pestis KIM
ccuugaacugagcca

SEQ ID NO: 2302236 - RNA, 11 nt, Yersinia pestis KIM
cgaccagcaga

SEQ ID NO: 2302237 - RNA, 17 nt, Yersinia pestis KIM
cgaccaauucacgcagg

SEQ ID NO: 2302238 - RNA, 15 nt, Yersinia pestis KIM
cgacaggcuaacaac

SEQ ID NO: 2302239 - RNA, 23 nt, Yersinia pestis KIM
cgacagguaguuaggugaaauau

SEQ ID NO: 2302240 - RNA, 16 nt, Yersinia pestis KIM
cgacagcaucaacaug

SEQ ID NO: 2302241 - RNA, 18 nt, Yersinia pestis KIM
cgacauuaagcauaucca

SEQ ID NO: 2302242 - RNA, 15 nt, Yersinia pestis KIM
cgaccaacuggcaau

SEQ ID NO: 2302243 - RNA, 20 nt, Yersinia pestis KIM
cgacaucagcgccacagucg

SEQ ID NO: 2302244 - RNA, 13 nt, Yersinia pestis KIM
cgacauccaacaa

SEQ ID NO: 2302245 - RNA, 20 nt, Yersinia pestis KIM
cgacauccaacaacugccaa

SEQ ID NO: 2302246 - RNA, 23 nt, Yersinia pestis KIM
cgacauagccggagguuuuucau

SEQ ID NO: 2302247 - RNA, 18 nt, Yersinia pestis KIM
cgacauccaauucaguac

SEQ ID NO: 2302248 - RNA, 20 nt, Yersinia pestis KIM
cgacccguuuaugccccugc

SEQ ID NO: 2302249 - RNA, 14 nt, Yersinia pestis KIM
cgaccgucaccaaa

SEQ ID NO: 2302250 - RNA, 17 nt, Yersinia pestis KIM
cgaccggcugauguucu

SEQ ID NO: 2302251 - RNA, 22 nt, Yersinia pestis KIM
cgaccucaguuuugcuauuuac

SEQ ID NO: 2302252 - RNA, 13 nt, Yersinia pestis KIM
cgacgccccacua

SEQ ID NO: 2302253 - RNA, 13 nt, Yersinia pestis KIM
cgacacccagcca

SEQ ID NO: 2302254 - RNA, 16 nt, Yersinia pestis KIM
cgacagcaacaacaaa

SEQ ID NO: 2302255 - RNA, 18 nt, Yersinia pestis KIM
cgacaacuucaauaccaa

SEQ ID NO: 2302256 - RNA, 17 nt, Yersinia pestis KIM
cgacaauauaauaaugc

SEQ ID NO: 2302257 - RNA, 16 nt, Yersinia pestis KIM
cgacaauauaauaaug

SEQ ID NO: 2302258 - RNA, 18 nt, Yersinia pestis KIM
cgaauuugcugcucgacu

SEQ ID NO: 2302259 - RNA, 20 nt, Yersinia pestis KIM
cgaauuauuuagagucuaua

SEQ ID NO: 2302260 - RNA, 22 nt, Yersinia pestis KIM
cgaauuggaaugaaauagucac

SEQ ID NO: 2302261 - RNA, 21 nt, Yersinia pestis KIM
cgaaugagcaguaauagcaaa

SEQ ID NO: 2302262 - RNA, 17 nt, Yersinia pestis KIM
cgaauggaaaaacguga

SEQ ID NO: 2302263 - RNA, 16 nt, Yersinia pestis KIM
cgaauagagacggaaa

SEQ ID NO: 2302264 - RNA, 17 nt, Yersinia pestis KIM
cgaaucacuuacugguc

SEQ ID NO: 2302265 - RNA, 20 nt, Yersinia pestis KIM
cgaauauugcguuaccuaaa

SEQ ID NO: 2302266 - RNA, 15 nt, Yersinia pestis KIM
cgaauauaguugauc

SEQ ID NO: 2302267 - RNA, 17 nt, Yersinia pestis KIM
cgaauauaguugaucua

SEQ ID NO: 2302268 - RNA, 18 nt, Yersinia pestis KIM
cgaauauguucuucuugg

SEQ ID NO: 2302269 - RNA, 21 nt, Yersinia pestis KIM
cgaagauaaccggcuggaaau

SEQ ID NO: 2302270 - RNA, 13 nt, Yersinia pestis KIM
cgaagaucacuca

SEQ ID NO: 2302271 - RNA, 18 nt, Yersinia pestis KIM
cgaacuacgccucgcaga

SEQ ID NO: 2302272 - RNA, 17 nt, Yersinia pestis KIM
cgaauaaacaccgugcu

SEQ ID NO: 2302273 - RNA, 20 nt, Yersinia pestis KIM
cgaauaaaaccuugcgccaa

SEQ ID NO: 2302274 - RNA, 15 nt, Yersinia pestis KIM
cgaaguuagacccaa

SEQ ID NO: 2302275 - RNA, 14 nt, Yersinia pestis KIM
cccaucccuuugau

SEQ ID NO: 2302276 - RNA, 14 nt, Yersinia pestis KIM
cccauccuguucaa

SEQ ID NO: 2302277 - RNA, 16 nt, Yersinia pestis KIM
cccaguuacuaccuuu

SEQ ID NO: 2302278 - RNA, 18 nt, Yersinia pestis KIM
cccagugcguacgccaac

SEQ ID NO: 2302279 - RNA, 21 nt, Yersinia pestis KIM
cccaguuuuuaauuuaaacuc

SEQ ID NO: 2302280 - RNA, 20 nt, Yersinia pestis KIM
cccauaagcgggguauuuua

SEQ ID NO: 2302281 - RNA, 16 nt, Yersinia pestis KIM
cccauaaccauugaaa

SEQ ID NO: 2302282 - RNA, 14 nt, Yersinia pestis KIM
cccaguaccgcugg

SEQ ID NO: 2302283 - RNA, 16 nt, Yersinia pestis KIM
cccaguaccgcuggug

SEQ ID NO: 2302284 - RNA, 20 nt, Yersinia pestis KIM
cccagucgucuucagcuucc

SEQ ID NO: 2302285 - RNA, 13 nt, Yersinia pestis KIM
cccaggccuccgc

SEQ ID NO: 2302286 - RNA, 12 nt, Yersinia pestis KIM
ccccauccccaa

SEQ ID NO: 2302287 - RNA, 14 nt, Yersinia pestis KIM
ccccaucauaaagg

SEQ ID NO: 2302288 - RNA, 13 nt, Yersinia pestis KIM
ccccaugaccgcc

SEQ ID NO: 2302289 - RNA, 16 nt, Yersinia pestis KIM
ccccaugaccgccagu

SEQ ID NO: 2302290 - RNA, 12 nt, Yersinia pestis KIM
ccccaugcaccu

SEQ ID NO: 2302291 - RNA, 22 nt, Yersinia pestis KIM
ccccauuuaucgccaagccagu

SEQ ID NO: 2302292 - RNA, 17 nt, Yersinia pestis KIM
cccauucgcgccccaaa

SEQ ID NO: 2302293 - RNA, 14 nt, Yersinia pestis KIM
cccauugcaccaau

SEQ ID NO: 2302294 - RNA, 15 nt, Yersinia pestis KIM
cccauuuaucgccaa

SEQ ID NO: 2302295 - RNA, 17 nt, Yersinia pestis KIM
ccccagccggugucacu

SEQ ID NO: 2302296 - RNA, 16 nt, Yersinia pestis KIM
ccccggaucacuggcu

SEQ ID NO: 2302297 - RNA, 16 nt, Yersinia pestis KIM
ccccgacccacgcccc

SEQ ID NO: 2302298 - RNA, 14 nt, Yersinia pestis KIM
ccccgguaaucuga

SEQ ID NO: 2302299 - RNA, 18 nt, Yersinia pestis KIM
ccccggucacuuaaauaa

SEQ ID NO: 2302300 - RNA, 21 nt, Yersinia pestis KIM
ccccuaaacgauagcgggcgg

SEQ ID NO: 2302301 - RNA, 15 nt, Yersinia pestis KIM
ccccuccggaaucag

SEQ ID NO: 2302302 - RNA, 13 nt, Yersinia pestis KIM
ccccuagccagcc

SEQ ID NO: 2302303 - RNA, 17 nt, Yersinia pestis KIM
ccccucacauuacugau

SEQ ID NO: 2302304 - RNA, 16 nt, Yersinia pestis KIM
cccacugacacugaua

SEQ ID NO: 2302305 - RNA, 18 nt, Yersinia pestis KIM
cccacuuguaccugugcc

SEQ ID NO: 2302306 - RNA, 19 nt, Yersinia pestis KIM
cccacuuguaccugugcca

SEQ ID NO: 2302307 - RNA, 14 nt, Yersinia pestis KIM
cccacuuccaucug

SEQ ID NO: 2302308 - RNA, 16 nt, Yersinia pestis KIM
cccagaaaggcaaaaa

SEQ ID NO: 2302309 - RNA, 14 nt, Yersinia pestis KIM
cccagaaaaccccc

SEQ ID NO: 2302310 - RNA, 20 nt, Yersinia pestis KIM
cccagacugcugacaaaccc

SEQ ID NO: 2302311 - RNA, 22 nt, Yersinia pestis KIM
cccagaagaucgguucaucgga

SEQ ID NO: 2302312 - RNA, 20 nt, Yersinia pestis KIM
cccagauaguaguguuugau

SEQ ID NO: 2302313 - RNA, 15 nt, Yersinia pestis KIM
cccagcaucauaaga

SEQ ID NO: 2302314 - RNA, 18 nt, Yersinia pestis KIM
cccagcacagccugccgg

SEQ ID NO: 2302315 - RNA, 17 nt, Yersinia pestis KIM
cccaauggcaacaaaau

SEQ ID NO: 2302316 - RNA, 13 nt, Yersinia pestis KIM
cccaaucuugcaa

SEQ ID NO: 2302317 - RNA, 20 nt, Yersinia pestis KIM
cccaaugccauagcugcugc

SEQ ID NO: 2302318 - RNA, 14 nt, Yersinia pestis KIM
cccacaucaggccg

SEQ ID NO: 2302319 - RNA, 15 nt, Yersinia pestis KIM
cccacauucaggccg

SEQ ID NO: 2302320 - RNA, 14 nt, Yersinia pestis KIM
cccacauucaguac

SEQ ID NO: 2302321 - RNA, 12 nt, Yersinia pestis KIM
cccacauucagg

SEQ ID NO: 2302322 - RNA, 17 nt, Yersinia pestis KIM
cccacauuaaaggccgc

SEQ ID NO: 2302323 - RNA, 15 nt, Yersinia pestis KIM
cccacaucggccccu

SEQ ID NO: 2302324 - RNA, 12 nt, Yersinia pestis KIM
cccaagcaggaa

SEQ ID NO: 2302325 - RNA, 16 nt, Yersinia pestis KIM
cccaagauacuggaag

SEQ ID NO: 2302326 - RNA, 22 nt, Yersinia pestis KIM
cccaaggguauaacucaucagu

SEQ ID NO: 2302327 - RNA, 23 nt, Yersinia pestis KIM
cccaaggguauaacucaucagua

SEQ ID NO: 2302328 - RNA, 13 nt, Yersinia pestis KIM
cccaaguaaaaaa

SEQ ID NO: 2302329 - RNA, 21 nt, Yersinia pestis KIM
cccaauaagugaaacaaauac

SEQ ID NO: 2302330 - RNA, 20 nt, Yersinia pestis KIM
ccauggugacuuacgucuuu

SEQ ID NO: 2302331 - RNA, 17 nt, Yersinia pestis KIM
ccauggcguaaccgccg

SEQ ID NO: 2302332 - RNA, 18 nt, Yersinia pestis KIM
ccauggcggcucgccuga

SEQ ID NO: 2302333 - RNA, 13 nt, Yersinia pestis KIM
ccauguucuucaa

SEQ ID NO: 2302334 - RNA, 23 nt, Yersinia pestis KIM
ccauguugaguuuacgcagugcu

SEQ ID NO: 2302335 - RNA, 24 nt, Yersinia pestis KIM
ccaugucacuguucuugaugguca

SEQ ID NO: 2302336 - RNA, 19 nt, Yersinia pestis KIM
ccauggaauuuaugcacca

SEQ ID NO: 2302337 - RNA, 18 nt, Yersinia pestis KIM
ccaugcugcccgcacacu

SEQ ID NO: 2302338 - RNA, 18 nt, Yersinia pestis KIM
ccauugcgcaacuugcuu

SEQ ID NO: 2302339 - RNA, 14 nt, Yersinia pestis KIM
ccauucuuucccuc

SEQ ID NO: 2302340 - RNA, 20 nt, Yersinia pestis KIM
ccauuggguauggucagcaa

SEQ ID NO: 2302341 - RNA, 16 nt, Yersinia pestis KIM
ccauugguaauaaugc

SEQ ID NO: 2302342 - RNA, 21 nt, Yersinia pestis KIM
ccauucggcacugcaucugac

SEQ ID NO: 2302343 - RNA, 22 nt, Yersinia pestis KIM
ccauucgcaggccagacccauu

SEQ ID NO: 2302344 - RNA, 21 nt, Yersinia pestis KIM
ccauuaaaaggugcccgcuug

SEQ ID NO: 2302345 - RNA, 24 nt, Yersinia pestis KIM
ccauguuggguaaaccaaucaagc

SEQ ID NO: 2302346 - RNA, 18 nt, Yersinia pestis KIM
ccauuaccacuguuacca

SEQ ID NO: 2302347 - RNA, 23 nt, Yersinia pestis KIM
ccauuacgcaacguaauaucugc

SEQ ID NO: 2302348 - RNA, 19 nt, Yersinia pestis KIM
ccauuaaccuaaaaacguc

SEQ ID NO: 2302349 - RNA, 13 nt, Yersinia pestis KIM
ccauuaauaauau

SEQ ID NO: 2302350 - RNA, 16 nt, Yersinia pestis KIM
ccauuaucguuagcau

SEQ ID NO: 2302351 - RNA, 13 nt, Yersinia pestis KIM
ccauuauaaauaa

SEQ ID NO: 2302352 - RNA, 14 nt, Yersinia pestis KIM
ccauuaucuuuaau

SEQ ID NO: 2302353 - RNA, 20 nt, Yersinia pestis KIM
ccauuaucuuuaauuuucug

SEQ ID NO: 2302354 - RNA, 21 nt, Yersinia pestis KIM
ccauuaucuuuaauuuucuga

SEQ ID NO: 2302355 - RNA, 19 nt, Yersinia pestis KIM
ccauccauauuuggcaugu

SEQ ID NO: 2302356 - RNA, 21 nt, Yersinia pestis KIM
ccauccaucggaaacagaggg

SEQ ID NO: 2302357 - RNA, 21 nt, Yersinia pestis KIM
ccaucaccgggugaaaauggc

SEQ ID NO: 2302358 - RNA, 19 nt, Yersinia pestis KIM
ccauccuuuugacugguca

SEQ ID NO: 2302359 - RNA, 21 nt, Yersinia pestis KIM
ccauccugccaacgccccuga

SEQ ID NO: 2302360 - RNA, 17 nt, Yersinia pestis KIM
ccauccuagcguuucua

SEQ ID NO: 2302361 - RNA, 19 nt, Yersinia pestis KIM
ccauccuagcguuucuaca

SEQ ID NO: 2302362 - RNA, 18 nt, Yersinia pestis KIM
ccauccgguuuuaaauua

SEQ ID NO: 2302363 - RNA, 21 nt, Yersinia pestis KIM
ccauccccaacucuuucaacu

SEQ ID NO: 2302364 - RNA, 15 nt, Yersinia pestis KIM
ccaucgucucugcau

SEQ ID NO: 2302365 - RNA, 21 nt, Yersinia pestis KIM
ccaucugaugcagguuuugga

SEQ ID NO: 2302366 - RNA, 12 nt, Yersinia pestis KIM
ccaugagaacca

SEQ ID NO: 2302367 - RNA, 21 nt, Yersinia pestis KIM
ccaugagaauacuucaggcca

SEQ ID NO: 2302368 - RNA, 13 nt, Yersinia pestis KIM
ccaugaccgccag

SEQ ID NO: 2302369 - RNA, 17 nt, Yersinia pestis KIM
ccaugccagcccaucac

SEQ ID NO: 2302370 - RNA, 18 nt, Yersinia pestis KIM
ccaugaugacaaugcguu

SEQ ID NO: 2302371 - RNA, 14 nt, Yersinia pestis KIM
ccaugccgguugau

SEQ ID NO: 2302372 - RNA, 20 nt, Yersinia pestis KIM
ccauaaaaacuucagagcca

SEQ ID NO: 2302373 - RNA, 17 nt, Yersinia pestis KIM
ccauaaaauaaauaauu

SEQ ID NO: 2302374 - RNA, 12 nt, Yersinia pestis KIM
ccauaaaaggau

SEQ ID NO: 2302375 - RNA, 22 nt, Yersinia pestis KIM
ccauaagugaacaugaugaaug

SEQ ID NO: 2302376 - RNA, 22 nt, Yersinia pestis KIM
ccauaagugcacugaaccccaa

SEQ ID NO: 2302377 - RNA, 21 nt, Yersinia pestis KIM
ccauaaaauaaauaauuugua

SEQ ID NO: 2302378 - RNA, 14 nt, Yersinia pestis KIM
ccaguucaguccag

SEQ ID NO: 2302379 - RNA, 22 nt, Yersinia pestis KIM
ccaguuugcucaucaguugguc

SEQ ID NO: 2302380 - RNA, 20 nt, Yersinia pestis KIM
ccaguguuuucuccacacca

SEQ ID NO: 2302381 - RNA, 21 nt, Yersinia pestis KIM
ccaguguuuucuccacaccaa

SEQ ID NO: 2302382 - RNA, 17 nt, Yersinia pestis KIM
ccaguuaaagaauacag

SEQ ID NO: 2302383 - RNA, 23 nt, Yersinia pestis KIM
ccaguuaauaucaaugagucuca

SEQ ID NO: 2302384 - RNA, 14 nt, Yersinia pestis KIM
ccaguggugcuccc

SEQ ID NO: 2302385 - RNA, 21 nt, Yersinia pestis KIM
ccaucaacgcgcauugcgccg

SEQ ID NO: 2302386 - RNA, 20 nt, Yersinia pestis KIM
ccaucaaccacgacgugcuc

SEQ ID NO: 2302387 - RNA, 13 nt, Yersinia pestis KIM
ccaucaacauggg

SEQ ID NO: 2302388 - RNA, 20 nt, Yersinia pestis KIM
ccaucaccauugaccagcgu

SEQ ID NO: 2302389 - RNA, 18 nt, Yersinia pestis KIM
ccaucacccgcagugccu

SEQ ID NO: 2302390 - RNA, 15 nt, Yersinia pestis KIM
ccaucaccacaauau

SEQ ID NO: 2302391 - RNA, 21 nt, Yersinia pestis KIM
ccaucaaauacacauaaccau

SEQ ID NO: 2302392 - RNA, 16 nt, Yersinia pestis KIM
ccaucaaacauagaca

SEQ ID NO: 2302393 - RNA, 12 nt, Yersinia pestis KIM
ccaucaaaauau

SEQ ID NO: 2302394 - RNA, 23 nt, Yersinia pestis KIM
ccauagugauuauuuaaacaaug

SEQ ID NO: 2302395 - RNA, 21 nt, Yersinia pestis KIM
ccauaaugccguuauagaucu

SEQ ID NO: 2302396 - RNA, 18 nt, Yersinia pestis KIM
ccauaauuaauuauucaa

SEQ ID NO: 2302397 - RNA, 23 nt, Yersinia pestis KIM
ccauaaucgcaccggagcaaggg

SEQ ID NO: 2302398 - RNA, 13 nt, Yersinia pestis KIM
ccauacuguugcu

SEQ ID NO: 2302399 - RNA, 14 nt, Yersinia pestis KIM
ccauacuguugcua

SEQ ID NO: 2302400 - RNA, 17 nt, Yersinia pestis KIM
ccaggcagcuaucacgu

SEQ ID NO: 2302401 - RNA, 19 nt, Yersinia pestis KIM
ccaggccuccgcaaacuua

SEQ ID NO: 2302402 - RNA, 18 nt, Yersinia pestis KIM
ccaggccuagcccaguac

SEQ ID NO: 2302403 - RNA, 23 nt, Yersinia pestis KIM
ccaggcuuuuguuaauucaccua

SEQ ID NO: 2302404 - RNA, 14 nt, Yersinia pestis KIM
ccagguaagaaaga

SEQ ID NO: 2302405 - RNA, 22 nt, Yersinia pestis KIM
ccagggcguuuaccauccagug

SEQ ID NO: 2302406 - RNA, 16 nt, Yersinia pestis KIM
ccaguaaaaaaauagc

SEQ ID NO: 2302407 - RNA, 17 nt, Yersinia pestis KIM
ccaguaaaagaauaaau

SEQ ID NO: 2302408 - RNA, 17 nt, Yersinia pestis KIM
ccagguuuuuuuuacuu

SEQ ID NO: 2302409 - RNA, 13 nt, Yersinia pestis KIM
ccaguaagugauu

SEQ ID NO: 2302410 - RNA, 14 nt, Yersinia pestis KIM
ccagcucauauaau

SEQ ID NO: 2302411 - RNA, 18 nt, Yersinia pestis KIM
ccagcguggcccaggcaa

SEQ ID NO: 2302412 - RNA, 21 nt, Yersinia pestis KIM
ccagcguagguacuucucugg

SEQ ID NO: 2302413 - RNA, 19 nt, Yersinia pestis KIM
ccagcuuuagcauugcaga

SEQ ID NO: 2302414 - RNA, 14 nt, Yersinia pestis KIM
ccagcuugggugaa

SEQ ID NO: 2302415 - RNA, 19 nt, Yersinia pestis KIM
ccagcuuuuuacgcaacaa

SEQ ID NO: 2302416 - RNA, 15 nt, Yersinia pestis KIM
ccaggcaacgacagc

SEQ ID NO: 2302417 - RNA, 17 nt, Yersinia pestis KIM
ccaggcaacgacagcaa

SEQ ID NO: 2302418 - RNA, 19 nt, Yersinia pestis KIM
ccaggcaacgacagcaaca

SEQ ID NO: 2302419 - RNA, 20 nt, Yersinia pestis KIM
ccaggcaagaaacuucauuu

SEQ ID NO: 2302420 - RNA, 16 nt, Yersinia pestis KIM
ccaggacuuuguuagc

SEQ ID NO: 2302421 - RNA, 16 nt, Yersinia pestis KIM
ccagcuucuuuuaaag

SEQ ID NO: 2302422 - RNA, 17 nt, Yersinia pestis KIM
ccacagucauuugaacg

SEQ ID NO: 2302423 - RNA, 18 nt, Yersinia pestis KIM
ccacagcaacaggguaau

SEQ ID NO: 2302424 - RNA, 11 nt, Yersinia pestis KIM
ccacacucaag

SEQ ID NO: 2302425 - RNA, 15 nt, Yersinia pestis KIM
ccacagacuuucuuu

SEQ ID NO: 2302426 - RNA, 17 nt, Yersinia pestis KIM
ccacaccacguuuaauu

SEQ ID NO: 2302427 - RNA, 15 nt, Yersinia pestis KIM
ccacacaauacauag

SEQ ID NO: 2302428 - RNA, 21 nt, Yersinia pestis KIM
ccacacagcauucugcuucca

SEQ ID NO: 2302429 - RNA, 14 nt, Yersinia pestis KIM
ccacacccucucuu

SEQ ID NO: 2302430 - RNA, 15 nt, Yersinia pestis KIM
ccacaccggcugcaa

SEQ ID NO: 2302431 - RNA, 19 nt, Yersinia pestis KIM
ccaaugcauccaagccauc

SEQ ID NO: 2302432 - RNA, 18 nt, Yersinia pestis KIM
ccaaugccaagaauaauu

SEQ ID NO: 2302433 - RNA, 16 nt, Yersinia pestis KIM
ccaaugccucuucaau

SEQ ID NO: 2302434 - RNA, 21 nt, Yersinia pestis KIM
ccaauucacgccuaucucgac

SEQ ID NO: 2302435 - RNA, 19 nt, Yersinia pestis KIM
ccaauucaaggccagcacg

SEQ ID NO: 2302436 - RNA, 18 nt, Yersinia pestis KIM
ccaauuacgcugcccuga

SEQ ID NO: 2302437 - RNA, 18 nt, Yersinia pestis KIM
ccaauucguauuccucaa

SEQ ID NO: 2302438 - RNA, 16 nt, Yersinia pestis KIM
ccaauugaguaacuga

SEQ ID NO: 2302439 - RNA, 16 nt, Yersinia pestis KIM
ccaauugacuagcagg

SEQ ID NO: 2302440 - RNA, 15 nt, Yersinia pestis KIM
ccacaaccugcgcca

SEQ ID NO: 2302441 - RNA, 22 nt, Yersinia pestis KIM
ccacaaccgccacuuuuaccgc

SEQ ID NO: 2302442 - RNA, 22 nt, Yersinia pestis KIM
ccaauuucucggccaacaucuu

SEQ ID NO: 2302443 - RNA, 16 nt, Yersinia pestis KIM
ccaauuguuucuuccc

SEQ ID NO: 2302444 - RNA, 20 nt, Yersinia pestis KIM
ccacaaaggucagcaugguc

SEQ ID NO: 2302445 - RNA, 19 nt, Yersinia pestis KIM
ccaauaauaaaaaaaaaua

SEQ ID NO: 2302446 - RNA, 15 nt, Yersinia pestis KIM
ccaauaagauaaaca

SEQ ID NO: 2302447 - RNA, 20 nt, Yersinia pestis KIM
ccaauaagugaaacaaauac

SEQ ID NO: 2302448 - RNA, 14 nt, Yersinia pestis KIM
ccaauaauaaaaaa

SEQ ID NO: 2302449 - RNA, 14 nt, Yersinia pestis KIM
ccaauaacguccug

SEQ ID NO: 2302450 - RNA, 23 nt, Yersinia pestis KIM
ccaauaaagcucugacaaaaugc

SEQ ID NO: 2302451 - RNA, 14 nt, Yersinia pestis KIM
ccaauacaaucguc

SEQ ID NO: 2302452 - RNA, 16 nt, Yersinia pestis KIM
ccaauaaugccgaaug

SEQ ID NO: 2302453 - RNA, 10 nt, Yersinia pestis KIM
ccaauaaugc

SEQ ID NO: 2302454 - RNA, 13 nt, Yersinia pestis KIM
ccaauauuaaaau

SEQ ID NO: 2302455 - RNA, 14 nt, Yersinia pestis KIM
ccaauauugaguaa

SEQ ID NO: 2302456 - RNA, 16 nt, Yersinia pestis KIM
ccaauaucugccaauu

SEQ ID NO: 2302457 - RNA, 17 nt, Yersinia pestis KIM
ccaauagaaaagcgccu

SEQ ID NO: 2302458 - RNA, 23 nt, Yersinia pestis KIM
ccaauagaaaagcgccugauggc

SEQ ID NO: 2302459 - RNA, 13 nt, Yersinia pestis KIM
ccaauagaaaggc

SEQ ID NO: 2302460 - RNA, 19 nt, Yersinia pestis KIM
ccaauagcccaaauaaccu

SEQ ID NO: 2302461 - RNA, 16 nt, Yersinia pestis KIM
ccaauagacaaaagug

SEQ ID NO: 2302462 - RNA, 15 nt, Yersinia pestis KIM
ccaauagaggcuccc

SEQ ID NO: 2302463 - RNA, 16 nt, Yersinia pestis KIM
ccaauagaaaaacacu

SEQ ID NO: 2302464 - RNA, 14 nt, Yersinia pestis KIM
ccaauccccaccaa

SEQ ID NO: 2302465 - RNA, 18 nt, Yersinia pestis KIM
ccaaucauuacaucaucu

SEQ ID NO: 2302466 - RNA, 18 nt, Yersinia pestis KIM
ccaaucaucaucccaguc

SEQ ID NO: 2302467 - RNA, 16 nt, Yersinia pestis KIM
ccaaucgaaccgauac

SEQ ID NO: 2302468 - RNA, 20 nt, Yersinia pestis KIM
ccaauauuggauaauaaccu

SEQ ID NO: 2302469 - RNA, 22 nt, Yersinia pestis KIM
ccaaucgcucugcguuuuuccc

SEQ ID NO: 2302470 - RNA, 13 nt, Yersinia pestis KIM
ccaaucucaaagc

SEQ ID NO: 2302471 - RNA, 15 nt, Yersinia pestis KIM
ccaaucucaaagcaa

SEQ ID NO: 2302472 - RNA, 12 nt, Yersinia pestis KIM
ccaaugauuaac

SEQ ID NO: 2302473 - RNA, 20 nt, Yersinia pestis KIM
ccaaugcacguaaagaguua

SEQ ID NO: 2302474 - RNA, 21 nt, Yersinia pestis KIM
ccaaugaugacuugauuaaca

SEQ ID NO: 2302475 - RNA, 15 nt, Yersinia pestis KIM
ccaagagaaacccau

SEQ ID NO: 2302476 - RNA, 12 nt, Yersinia pestis KIM
ccaagacugaag

SEQ ID NO: 2302477 - RNA, 17 nt, Yersinia pestis KIM
ccaagaacccuuuaucu

SEQ ID NO: 2302478 - RNA, 18 nt, Yersinia pestis KIM
ccaagaagauaacuuuuu

SEQ ID NO: 2302479 - RNA, 19 nt, Yersinia pestis KIM
ccaagaagauaacuuuuua

SEQ ID NO: 2302480 - RNA, 13 nt, Yersinia pestis KIM
ccaagaggcugcg

SEQ ID NO: 2302481 - RNA, 19 nt, Yersinia pestis KIM
ccaagaguacuaacgucaa

SEQ ID NO: 2302482 - RNA, 17 nt, Yersinia pestis KIM
ccaagauagcuguguga

SEQ ID NO: 2302483 - RNA, 14 nt, Yersinia pestis KIM
ccaagcggcagggg

SEQ ID NO: 2302484 - RNA, 24 nt, Yersinia pestis KIM
ccaagauuuuuagcgugccgcagu

SEQ ID NO: 2302485 - RNA, 17 nt, Yersinia pestis KIM
ccaagcccgcugcaacu

SEQ ID NO: 2302486 - RNA, 21 nt, Yersinia pestis KIM
ccaagcuuuugccacauuucc

SEQ ID NO: 2302487 - RNA, 20 nt, Yersinia pestis KIM
ccaaggcggaauagaggaag

SEQ ID NO: 2302488 - RNA, 15 nt, Yersinia pestis KIM
ccaaguccuccuuga

SEQ ID NO: 2302489 - RNA, 19 nt, Yersinia pestis KIM
ccaaguaugauaaugccuu

SEQ ID NO: 2302490 - RNA, 18 nt, Yersinia pestis KIM
ccaaguaaaaaaaaccug

SEQ ID NO: 2302491 - RNA, 22 nt, Yersinia pestis KIM
ccaaguaaaaaaaaccuggcuc

SEQ ID NO: 2302492 - RNA, 16 nt, Yersinia pestis KIM
ccaaaugcaaaccagg

SEQ ID NO: 2302493 - RNA, 12 nt, Yersinia pestis KIM
ccaaaucuucca

SEQ ID NO: 2302494 - RNA, 17 nt, Yersinia pestis KIM
ccaaaucuuccagcggc

SEQ ID NO: 2302495 - RNA, 15 nt, Yersinia pestis KIM
ccaaauccaacuggc

SEQ ID NO: 2302496 - RNA, 18 nt, Yersinia pestis KIM
ccaaaggggagccaaugu

SEQ ID NO: 2302497 - RNA, 12 nt, Yersinia pestis KIM
ccaaauaaaaca

SEQ ID NO: 2302498 - RNA, 18 nt, Yersinia pestis KIM
ccaaauacauauaaccau

SEQ ID NO: 2302499 - RNA, 19 nt, Yersinia pestis KIM
ccaaagccgucaguuccug

SEQ ID NO: 2302500 - RNA, 15 nt, Yersinia pestis KIM
ccaaagacaauugag

SEQ ID NO: 2302501 - RNA, 22 nt, Yersinia pestis KIM
ccaaagauaauacauaaaauca

SEQ ID NO: 2302502 - RNA, 18 nt, Yersinia pestis KIM
ccaaacugcucauaaagc

SEQ ID NO: 2302503 - RNA, 12 nt, Yersinia pestis KIM
ccaaaauuugcu

SEQ ID NO: 2302504 - RNA, 17 nt, Yersinia pestis KIM
ccaaaauuuagaagccc

SEQ ID NO: 2302505 - RNA, 16 nt, Yersinia pestis KIM
ccaaaauccaccagcg

SEQ ID NO: 2302506 - RNA, 19 nt, Yersinia pestis KIM
ccaaaauaaauauccuccg

SEQ ID NO: 2302507 - RNA, 13 nt, Yersinia pestis KIM
ccaaaauaauaua

SEQ ID NO: 2302508 - RNA, 24 nt, Yersinia pestis KIM
ccaaaauaauucgaguagauucau

SEQ ID NO: 2302509 - RNA, 20 nt, Yersinia pestis KIM
ccaaaauacggccagucaaa

SEQ ID NO: 2302510 - RNA, 19 nt, Yersinia pestis KIM
ccaaacauugucaccugaa

SEQ ID NO: 2302511 - RNA, 12 nt, Yersinia pestis KIM
ccaaacauuuuc

SEQ ID NO: 2302512 - RNA, 22 nt, Yersinia pestis KIM
ccaaaccauugguuaaguuuca

SEQ ID NO: 2302513 - RNA, 18 nt, Yersinia pestis KIM
ccaaaacgaacaaaaugg

SEQ ID NO: 2302514 - RNA, 15 nt, Yersinia pestis KIM
ccaaaacaucggcca

SEQ ID NO: 2302515 - RNA, 19 nt, Yersinia pestis KIM
ccaaaacagccuaaggcca

SEQ ID NO: 2302516 - RNA, 12 nt, Yersinia pestis KIM
ccaaaacagccu

SEQ ID NO: 2302517 - RNA, 12 nt, Yersinia pestis KIM
ccaaaaaucuug

SEQ ID NO: 2302518 - RNA, 15 nt, Yersinia pestis KIM
ccaaaacucaugucc

SEQ ID NO: 2302519 - RNA, 18 nt, Yersinia pestis KIM
ccaaaacucccuguuacg

SEQ ID NO: 2302520 - RNA, 16 nt, Yersinia pestis KIM
ccaaaaguaucuuuca

SEQ ID NO: 2302521 - RNA, 20 nt, Yersinia pestis KIM
ccaaccggauaaaacaauag

SEQ ID NO: 2302522 - RNA, 20 nt, Yersinia pestis KIM
ccaacccccauuagcaguaa

SEQ ID NO: 2302523 - RNA, 16 nt, Yersinia pestis KIM
ccaaccccaucagcau

SEQ ID NO: 2302524 - RNA, 21 nt, Yersinia pestis KIM
ccaaccaggccgccaucauca

SEQ ID NO: 2302525 - RNA, 22 nt, Yersinia pestis KIM
ccaacaucgcuugugcuacauc

SEQ ID NO: 2302526 - RNA, 16 nt, Yersinia pestis KIM
ccaacaucuccgccaa

SEQ ID NO: 2302527 - RNA, 16 nt, Yersinia pestis KIM
ccaacaucuuccaaug

SEQ ID NO: 2302528 - RNA, 16 nt, Yersinia pestis KIM
ccaacagcauuaccaa

SEQ ID NO: 2302529 - RNA, 16 nt, Yersinia pestis KIM
ccaacagacucacucu

SEQ ID NO: 2302530 - RNA, 23 nt, Yersinia pestis KIM
ccaacacguggguauccaguguc

SEQ ID NO: 2302531 - RNA, 21 nt, Yersinia pestis KIM
ccaacacucaugacaaaaugc

SEQ ID NO: 2302532 - RNA, 20 nt, Yersinia pestis KIM
ccaacaacuggguggccagu

SEQ ID NO: 2302533 - RNA, 16 nt, Yersinia pestis KIM
ccaacaacugccccuc

SEQ ID NO: 2302534 - RNA, 23 nt, Yersinia pestis KIM
ccaacaacuucaccacugugaua

SEQ ID NO: 2302535 - RNA, 13 nt, Yersinia pestis KIM
ccaaaugguuagu

SEQ ID NO: 2302536 - RNA, 19 nt, Yersinia pestis KIM
ccaacuuaccuugauccgc

SEQ ID NO: 2302537 - RNA, 21 nt, Yersinia pestis KIM
ccaacuuaccuugauccgcca

SEQ ID NO: 2302538 - RNA, 22 nt, Yersinia pestis KIM
ccaagaaacgccccgauaaacc

SEQ ID NO: 2302539 - RNA, 13 nt, Yersinia pestis KIM
ccaagaaacgccc

SEQ ID NO: 2302540 - RNA, 14 nt, Yersinia pestis KIM
ccaagaaaagcacc

SEQ ID NO: 2302541 - RNA, 23 nt, Yersinia pestis KIM
ccaacuucguuccaguggucauc

SEQ ID NO: 2302542 - RNA, 17 nt, Yersinia pestis KIM
ccaacugaucucaucau

SEQ ID NO: 2302543 - RNA, 20 nt, Yersinia pestis KIM
ccaacugaucucaucauuga

SEQ ID NO: 2302544 - RNA, 15 nt, Yersinia pestis KIM
ccaacugaaacugga

SEQ ID NO: 2302545 - RNA, 14 nt, Yersinia pestis KIM
ccaacugaggcaga

SEQ ID NO: 2302546 - RNA, 18 nt, Yersinia pestis KIM
ccaacugaggcagaaugg

SEQ ID NO: 2302547 - RNA, 18 nt, Yersinia pestis KIM
ccaacuccugccuacgcu

SEQ ID NO: 2302548 - RNA, 21 nt, Yersinia pestis KIM
ccaacucgccugugaaucaag

SEQ ID NO: 2302549 - RNA, 22 nt, Yersinia pestis KIM
ccaacuaaacagggcagaaaau

SEQ ID NO: 2302550 - RNA, 21 nt, Yersinia pestis KIM
ccaacggcuaacgguaaauaa

SEQ ID NO: 2302551 - RNA, 17 nt, Yersinia pestis KIM
ccaacggccccucaggc

SEQ ID NO: 2302552 - RNA, 15 nt, Yersinia pestis KIM
ccaacggacacauaa

SEQ ID NO: 2302553 - RNA, 16 nt, Yersinia pestis KIM
ccaacgcggcccccgc

SEQ ID NO: 2302554 - RNA, 22 nt, Yersinia pestis KIM
ccaacgcggcccccgcaggggu

SEQ ID NO: 2302555 - RNA, 23 nt, Yersinia pestis KIM
ccaacgguagggcguucugucac

SEQ ID NO: 2302556 - RNA, 23 nt, Yersinia pestis KIM
ccaacgcacaugcaacuugaggu

SEQ ID NO: 2302557 - RNA, 21 nt, Yersinia pestis KIM
ccaacgcacugguugcuucau

SEQ ID NO: 2302558 - RNA, 19 nt, Yersinia pestis KIM
ccaacgcccugcaucuuga

SEQ ID NO: 2302559 - RNA, 16 nt, Yersinia pestis KIM
ccaaccugcaaugccu

SEQ ID NO: 2302560 - RNA, 15 nt, Yersinia pestis KIM
ccaccccagcauuca

SEQ ID NO: 2302561 - RNA, 22 nt, Yersinia pestis KIM
ccaccauuugggguguuacccc

SEQ ID NO: 2302562 - RNA, 21 nt, Yersinia pestis KIM
ccaccaguaaacgccaaucac

SEQ ID NO: 2302563 - RNA, 14 nt, Yersinia pestis KIM
ccaccacaucaucc

SEQ ID NO: 2302564 - RNA, 16 nt, Yersinia pestis KIM
ccaccacaucauccag

SEQ ID NO: 2302565 - RNA, 17 nt, Yersinia pestis KIM
ccaccacaucauccagu

SEQ ID NO: 2302566 - RNA, 20 nt, Yersinia pestis KIM
ccacauucaguacauaaacc

SEQ ID NO: 2302567 - RNA, 15 nt, Yersinia pestis KIM
ccacauugaccagau

SEQ ID NO: 2302568 - RNA, 14 nt, Yersinia pestis KIM
ccaccaaauaaaac

SEQ ID NO: 2302569 - RNA, 16 nt, Yersinia pestis KIM
ccaccaacuccugccu

SEQ ID NO: 2302570 - RNA, 20 nt, Yersinia pestis KIM
ccacaugcuuuuuuuaagca

SEQ ID NO: 2302571 - RNA, 21 nt, Yersinia pestis KIM
ccacaugccacccgcaccaaa

SEQ ID NO: 2302572 - RNA, 14 nt, Yersinia pestis KIM
ccacauucaggccg

SEQ ID NO: 2302573 - RNA, 16 nt, Yersinia pestis KIM
ccacauuauucuaggc

SEQ ID NO: 2302574 - RNA, 19 nt, Yersinia pestis KIM
ccacaucuugcauccccac

SEQ ID NO: 2302575 - RNA, 17 nt, Yersinia pestis KIM
ccacaucgaguggucga

SEQ ID NO: 2302576 - RNA, 19 nt, Yersinia pestis KIM
ccacauaaaauagcccagu

SEQ ID NO: 2302577 - RNA, 22 nt, Yersinia pestis KIM
ccacauaaaauagcccagugcg

SEQ ID NO: 2302578 - RNA, 17 nt, Yersinia pestis KIM
ccacauaaaauagccca

SEQ ID NO: 2302579 - RNA, 13 nt, Yersinia pestis KIM
ccacaucaggccg

SEQ ID NO: 2302580 - RNA, 11 nt, Yersinia pestis KIM
ccacaucauua

SEQ ID NO: 2302581 - RNA, 14 nt, Yersinia pestis KIM
ccacaucaaccuga

SEQ ID NO: 2302582 - RNA, 17 nt, Yersinia pestis KIM
ccacaucacgcagcgcu

SEQ ID NO: 2302583 - RNA, 15 nt, Yersinia pestis KIM
ccacgguaucaauca

SEQ ID NO: 2302584 - RNA, 22 nt, Yersinia pestis KIM
ccacgggcauccgcuucgcugg

SEQ ID NO: 2302585 - RNA, 15 nt, Yersinia pestis KIM
ccacggcucacacac

SEQ ID NO: 2302586 - RNA, 21 nt, Yersinia pestis KIM
ccacggcgggcaacagagaaa

SEQ ID NO: 2302587 - RNA, 22 nt, Yersinia pestis KIM
ccacggcaccuucugauuuuuu

SEQ ID NO: 2302588 - RNA, 19 nt, Yersinia pestis KIM
ccacgccaguaaacagcca

SEQ ID NO: 2302589 - RNA, 22 nt, Yersinia pestis KIM
ccacgccaguaaacagccagca

SEQ ID NO: 2302590 - RNA, 12 nt, Yersinia pestis KIM
ccacgcccaauu

SEQ ID NO: 2302591 - RNA, 13 nt, Yersinia pestis KIM
ccacggcacccac

SEQ ID NO: 2302592 - RNA, 20 nt, Yersinia pestis KIM
ccacccguugcauuuuucug

SEQ ID NO: 2302593 - RNA, 19 nt, Yersinia pestis KIM
ccacccguugcauuuuucu

SEQ ID NO: 2302594 - RNA, 16 nt, Yersinia pestis KIM
ccaccgucaccaaaua

SEQ ID NO: 2302595 - RNA, 14 nt, Yersinia pestis KIM
ccaccgucaccaaa

SEQ ID NO: 2302596 - RNA, 15 nt, Yersinia pestis KIM
ccaccgucuguggug

SEQ ID NO: 2302597 - RNA, 21 nt, Yersinia pestis KIM
ccaccgucaagacaacaaaca

SEQ ID NO: 2302598 - RNA, 22 nt, Yersinia pestis KIM
ccaccuaauacagcaccaccga

SEQ ID NO: 2302599 - RNA, 13 nt, Yersinia pestis KIM
ccacgaaaaaaug

SEQ ID NO: 2302600 - RNA, 13 nt, Yersinia pestis KIM
ccaccuuuaccau

SEQ ID NO: 2302601 - RNA, 13 nt, Yersinia pestis KIM
ccacgaggacagg

SEQ ID NO: 2302602 - RNA, 16 nt, Yersinia pestis KIM
ccaccuaucuauuuuu

SEQ ID NO: 2302603 - RNA, 17 nt, Yersinia pestis KIM
ccaccuaucuauuuuua

SEQ ID NO: 2302604 - RNA, 21 nt, Yersinia pestis KIM
ccaccuuaaguaaguuuaaac

SEQ ID NO: 2302605 - RNA, 17 nt, Yersinia pestis KIM
ccacgucuaauugcugc

SEQ ID NO: 2302606 - RNA, 13 nt, Yersinia pestis KIM
ccacuuuccaggu

SEQ ID NO: 2302607 - RNA, 19 nt, Yersinia pestis KIM
ccacuuuuaccgcaaccac

SEQ ID NO: 2302608 - RNA, 15 nt, Yersinia pestis KIM
ccacuuugcugugag

SEQ ID NO: 2302609 - RNA, 14 nt, Yersinia pestis KIM
ccagacaaccaaua

SEQ ID NO: 2302610 - RNA, 18 nt, Yersinia pestis KIM
ccagacaccugauaggca

SEQ ID NO: 2302611 - RNA, 16 nt, Yersinia pestis KIM
ccagaagaacagcccu

SEQ ID NO: 2302612 - RNA, 17 nt, Yersinia pestis KIM
ccagaagaacagcccuc

SEQ ID NO: 2302613 - RNA, 23 nt, Yersinia pestis KIM
ccagacucugcuaccaggaagcg

SEQ ID NO: 2302614 - RNA, 20 nt, Yersinia pestis KIM
ccagagacauaaagcccgcu

SEQ ID NO: 2302615 - RNA, 14 nt, Yersinia pestis KIM
ccagagcuugcugg

SEQ ID NO: 2302616 - RNA, 18 nt, Yersinia pestis KIM
ccagagcggagccucagu

SEQ ID NO: 2302617 - RNA, 18 nt, Yersinia pestis KIM
ccagacgaguauucccca

SEQ ID NO: 2302618 - RNA, 18 nt, Yersinia pestis KIM
ccagaccgcguaagccgu

SEQ ID NO: 2302619 - RNA, 20 nt, Yersinia pestis KIM
ccagaccgcguaagccgugc

SEQ ID NO: 2302620 - RNA, 23 nt, Yersinia pestis KIM
ccagcagaaguuguugcccuuca

SEQ ID NO: 2302621 - RNA, 22 nt, Yersinia pestis KIM
ccagcacguuuuaaugccaauu

SEQ ID NO: 2302622 - RNA, 17 nt, Yersinia pestis KIM
ccagcacacagaugcug

SEQ ID NO: 2302623 - RNA, 20 nt, Yersinia pestis KIM
ccagaugccaaauaucuuuc

SEQ ID NO: 2302624 - RNA, 19 nt, Yersinia pestis KIM
ccagaucuuuuucauucug

SEQ ID NO: 2302625 - RNA, 20 nt, Yersinia pestis KIM
ccagcaacguaacaugcagc

SEQ ID NO: 2302626 - RNA, 18 nt, Yersinia pestis KIM
ccagcaacucaagccacu

SEQ ID NO: 2302627 - RNA, 13 nt, Yersinia pestis KIM
ccagcaucaguag

SEQ ID NO: 2302628 - RNA, 15 nt, Yersinia pestis KIM
ccagccaacuccuug

SEQ ID NO: 2302629 - RNA, 20 nt, Yersinia pestis KIM
cagguaaugucacugccauc

SEQ ID NO: 2302630 - RNA, 21 nt, Yersinia pestis KIM
cagguaauuuccaacugaucu

SEQ ID NO: 2302631 - RNA, 16 nt, Yersinia pestis KIM
cagguacuucaaauaa

SEQ ID NO: 2302632 - RNA, 19 nt, Yersinia pestis KIM
cagggaugggcgccgcuuu

SEQ ID NO: 2302633 - RNA, 21 nt, Yersinia pestis KIM
cagguaaugcgcgcagcaagc

SEQ ID NO: 2302634 - RNA, 13 nt, Yersinia pestis KIM
cagguaguucauu

SEQ ID NO: 2302635 - RNA, 14 nt, Yersinia pestis KIM
cagguaguggaaau

SEQ ID NO: 2302636 - RNA, 17 nt, Yersinia pestis KIM
caggucaggaagagaaa

SEQ ID NO: 2302637 - RNA, 14 nt, Yersinia pestis KIM
cagguauucuccag

SEQ ID NO: 2302638 - RNA, 19 nt, Yersinia pestis KIM
cagguauucuccaguuggc

SEQ ID NO: 2302639 - RNA, 19 nt, Yersinia pestis KIM
cagguauuugggcuucagc

SEQ ID NO: 2302640 - RNA, 13 nt, Yersinia pestis KIM
caggucaaucaau

SEQ ID NO: 2302641 - RNA, 20 nt, Yersinia pestis KIM
caggucaaucaauucuucaa

SEQ ID NO: 2302642 - RNA, 20 nt, Yersinia pestis KIM
caggugaacguuggcuucac

SEQ ID NO: 2302643 - RNA, 22 nt, Yersinia pestis KIM
caggugaacguuggcuucaccu

SEQ ID NO: 2302644 - RNA, 19 nt, Yersinia pestis KIM
caguaggcugaaggccugc

SEQ ID NO: 2302645 - RNA, 20 nt, Yersinia pestis KIM
caguaggcugaaggccugcu

SEQ ID NO: 2302646 - RNA, 14 nt, Yersinia pestis KIM
caguaggcugaagg

SEQ ID NO: 2302647 - RNA, 14 nt, Yersinia pestis KIM
caguccagccaccc

SEQ ID NO: 2302648 - RNA, 14 nt, Yersinia pestis KIM
cagucauuaacaca

SEQ ID NO: 2302649 - RNA, 17 nt, Yersinia pestis KIM
caguauucgccagauac

SEQ ID NO: 2302650 - RNA, 13 nt, Yersinia pestis KIM
cagucauuuacug

SEQ ID NO: 2302651 - RNA, 17 nt, Yersinia pestis KIM
caguaucuuuccagcca

SEQ ID NO: 2302652 - RNA, 21 nt, Yersinia pestis KIM
caguauguuguucgaaaauag

SEQ ID NO: 2302653 - RNA, 17 nt, Yersinia pestis KIM
caguaacgggucucaau

SEQ ID NO: 2302654 - RNA, 18 nt, Yersinia pestis KIM
caguaacgggucucaaug

SEQ ID NO: 2302655 - RNA, 17 nt, Yersinia pestis KIM
caguaacguccaacuga

SEQ ID NO: 2302656 - RNA, 21 nt, Yersinia pestis KIM
caguaaccccuucgagcaccg

SEQ ID NO: 2302657 - RNA, 21 nt, Yersinia pestis KIM
caguaacgccugauucaucgc

SEQ ID NO: 2302658 - RNA, 17 nt, Yersinia pestis KIM
caguaaauuauuuucca

SEQ ID NO: 2302659 - RNA, 23 nt, Yersinia pestis KIM
caguaaagcaaauucccaccaua

SEQ ID NO: 2302660 - RNA, 21 nt, Yersinia pestis KIM
cagguuguuauuacuaaugag

SEQ ID NO: 2302661 - RNA, 22 nt, Yersinia pestis KIM
cagguuguuaucgaacaucucc

SEQ ID NO: 2302662 - RNA, 13 nt, Yersinia pestis KIM
cagguugaagauc

SEQ ID NO: 2302663 - RNA, 14 nt, Yersinia pestis KIM
cagguugaggcagg

SEQ ID NO: 2302664 - RNA, 17 nt, Yersinia pestis KIM
cagguugaaauaaauaa

SEQ ID NO: 2302665 - RNA, 13 nt, Yersinia pestis KIM
cagguucauuaca

SEQ ID NO: 2302666 - RNA, 12 nt, Yersinia pestis KIM
cauaagccgcag

SEQ ID NO: 2302667 - RNA, 19 nt, Yersinia pestis KIM
cauaagcgggguauuuuac

SEQ ID NO: 2302668 - RNA, 23 nt, Yersinia pestis KIM
cauaagcuaauagaucagccaaa

SEQ ID NO: 2302669 - RNA, 16 nt, Yersinia pestis KIM
cauaaggccaggcaau

SEQ ID NO: 2302670 - RNA, 15 nt, Yersinia pestis KIM
cauaaauaaagauac

SEQ ID NO: 2302671 - RNA, 13 nt, Yersinia pestis KIM
cauaaauaaagag

SEQ ID NO: 2302672 - RNA, 24 nt, Yersinia pestis KIM
cauaagacaccacaucacgcagcg

SEQ ID NO: 2302673 - RNA, 23 nt, Yersinia pestis KIM
cauaauaaugauuauugaccaga

SEQ ID NO: 2302674 - RNA, 18 nt, Yersinia pestis KIM
cauaauaaugauuauuga

SEQ ID NO: 2302675 - RNA, 16 nt, Yersinia pestis KIM
cauaauauagcugaau

SEQ ID NO: 2302676 - RNA, 11 nt, Yersinia pestis KIM
cauaaucaggg

SEQ ID NO: 2302677 - RNA, 23 nt, Yersinia pestis KIM
cauaaugcggcucucuuucucca

SEQ ID NO: 2302678 - RNA, 20 nt, Yersinia pestis KIM
cauaaugcauccacuuuuuc

SEQ ID NO: 2302679 - RNA, 17 nt, Yersinia pestis KIM
caguuucgucaugauaa

SEQ ID NO: 2302680 - RNA, 17 nt, Yersinia pestis KIM
caguuugagaaacugau

SEQ ID NO: 2302681 - RNA, 22 nt, Yersinia pestis KIM
caguuuauuuucccuuucucag

SEQ ID NO: 2302682 - RNA, 17 nt, Yersinia pestis KIM
caguuuauuguuauuuu

SEQ ID NO: 2302683 - RNA, 17 nt, Yersinia pestis KIM
caguuucacccucugcg

SEQ ID NO: 2302684 - RNA, 22 nt, Yersinia pestis KIM
caguuuuuaauuuaaacucuuu

SEQ ID NO: 2302685 - RNA, 18 nt, Yersinia pestis KIM
caguuuuuaauuuaaacu

SEQ ID NO: 2302686 - RNA, 13 nt, Yersinia pestis KIM
caguuuugccgug

SEQ ID NO: 2302687 - RNA, 17 nt, Yersinia pestis KIM
caguuuuuuauggcaua

SEQ ID NO: 2302688 - RNA, 23 nt, Yersinia pestis KIM
caguuuuuuauggcauaaacuga

SEQ ID NO: 2302689 - RNA, 14 nt, Yersinia pestis KIM
caguuuuuucucaa

SEQ ID NO: 2302690 - RNA, 22 nt, Yersinia pestis KIM
cauaaaaaaacggugaacauuu

SEQ ID NO: 2302691 - RNA, 19 nt, Yersinia pestis KIM
cauaaagcaucagacugcu

SEQ ID NO: 2302692 - RNA, 16 nt, Yersinia pestis KIM
cauaaaaugagccuga

SEQ ID NO: 2302693 - RNA, 20 nt, Yersinia pestis KIM
cauaaagcccgcuucaaagg

SEQ ID NO: 2302694 - RNA, 19 nt, Yersinia pestis KIM
cauaaaauaaauaauuugu

SEQ ID NO: 2302695 - RNA, 16 nt, Yersinia pestis KIM
cauaaaaggauggccc

SEQ ID NO: 2302696 - RNA, 11 nt, Yersinia pestis KIM
cauaaaagaau

SEQ ID NO: 2302697 - RNA, 13 nt, Yersinia pestis KIM
cauaaaaggaugg

SEQ ID NO: 2302698 - RNA, 17 nt, Yersinia pestis KIM
caguuauaaaaaccccu

SEQ ID NO: 2302699 - RNA, 19 nt, Yersinia pestis KIM
caguuauuauuuuuaauga

SEQ ID NO: 2302700 - RNA, 14 nt, Yersinia pestis KIM
caguuauuacaccu

SEQ ID NO: 2302701 - RNA, 21 nt, Yersinia pestis KIM
caguuauuacaccuacaggcu

SEQ ID NO: 2302702 - RNA, 22 nt, Yersinia pestis KIM
caguuaaggcuggcugugugag

SEQ ID NO: 2302703 - RNA, 14 nt, Yersinia pestis KIM
caguuaauagggcu

SEQ ID NO: 2302704 - RNA, 14 nt, Yersinia pestis KIM
caguuacaggucaa

SEQ ID NO: 2302705 - RNA, 22 nt, Yersinia pestis KIM
caguuacgguguugguuguuuu

SEQ ID NO: 2302706 - RNA, 21 nt, Yersinia pestis KIM
caguucacucuguuuuaaaaa

SEQ ID NO: 2302707 - RNA, 23 nt, Yersinia pestis KIM
caguucaagauaaaguucuucga

SEQ ID NO: 2302708 - RNA, 17 nt, Yersinia pestis KIM
caguucauuacaggccc

SEQ ID NO: 2302709 - RNA, 20 nt, Yersinia pestis KIM
caguucauuccccaucgcca

SEQ ID NO: 2302710 - RNA, 20 nt, Yersinia pestis KIM
caguucagcccccucaauac

SEQ ID NO: 2302711 - RNA, 15 nt, Yersinia pestis KIM
caguucgcgugcgcc

SEQ ID NO: 2302712 - RNA, 19 nt, Yersinia pestis KIM
caguggcuuugcaccauca

SEQ ID NO: 2302713 - RNA, 21 nt, Yersinia pestis KIM
caguggcgguucgagcggcau

SEQ ID NO: 2302714 - RNA, 20 nt, Yersinia pestis KIM
caguggcgcuacuuccccua

SEQ ID NO: 2302715 - RNA, 20 nt, Yersinia pestis KIM
cagugcucccugaacgccuu

SEQ ID NO: 2302716 - RNA, 23 nt, Yersinia pestis KIM
cagugcgguuaucgcucuugagg

SEQ ID NO: 2302717 - RNA, 22 nt, Yersinia pestis KIM
cagugccgcggcggccagcggc

SEQ ID NO: 2302718 - RNA, 15 nt, Yersinia pestis KIM
cagugcccgcggggg

SEQ ID NO: 2302719 - RNA, 23 nt, Yersinia pestis KIM
cagugcggccaccuaucuauuuu

SEQ ID NO: 2302720 - RNA, 20 nt, Yersinia pestis KIM
cagugcaaccaacaccaaug

SEQ ID NO: 2302721 - RNA, 16 nt, Yersinia pestis KIM
cagugcaacauuaaaa

SEQ ID NO: 2302722 - RNA, 16 nt, Yersinia pestis KIM
cagugauuuuaaccac

SEQ ID NO: 2302723 - RNA, 15 nt, Yersinia pestis KIM
cagugcaaaaugcuc

SEQ ID NO: 2302724 - RNA, 18 nt, Yersinia pestis KIM
cagugcaaaaugcucuuc

SEQ ID NO: 2302725 - RNA, 14 nt, Yersinia pestis KIM
cagugcaaauuuau

SEQ ID NO: 2302726 - RNA, 15 nt, Yersinia pestis KIM
cagugaucaugggaa

SEQ ID NO: 2302727 - RNA, 21 nt, Yersinia pestis KIM
cagugauucgggugagugagc

SEQ ID NO: 2302728 - RNA, 13 nt, Yersinia pestis KIM
cagucccugugcg

SEQ ID NO: 2302729 - RNA, 13 nt, Yersinia pestis KIM
cagcucucugagc

SEQ ID NO: 2302730 - RNA, 20 nt, Yersinia pestis KIM
cagcucucugagccauccag

SEQ ID NO: 2302731 - RNA, 16 nt, Yersinia pestis KIM
cagcucuucuaacacu

SEQ ID NO: 2302732 - RNA, 22 nt, Yersinia pestis KIM
cagcucuucuaacacuucauga

SEQ ID NO: 2302733 - RNA, 15 nt, Yersinia pestis KIM
cagcugacgcagcag

SEQ ID NO: 2302734 - RNA, 18 nt, Yersinia pestis KIM
cagcucacucgguaauga

SEQ ID NO: 2302735 - RNA, 14 nt, Yersinia pestis KIM
caggaaacuccagu

SEQ ID NO: 2302736 - RNA, 10 nt, Yersinia pestis KIM
cagcuuugcu

SEQ ID NO: 2302737 - RNA, 13 nt, Yersinia pestis KIM
cagcuuguugaua

SEQ ID NO: 2302738 - RNA, 16 nt, Yersinia pestis KIM
cagcuuguugauauca

SEQ ID NO: 2302739 - RNA, 13 nt, Yersinia pestis KIM
cagcuuuaacuua

SEQ ID NO: 2302740 - RNA, 21 nt, Yersinia pestis KIM
cagcuuuagcauugcagauuu

SEQ ID NO: 2302741 - RNA, 15 nt, Yersinia pestis KIM
cagcuucgccaccag

SEQ ID NO: 2302742 - RNA, 19 nt, Yersinia pestis KIM
cagcguagccguuaaauau

SEQ ID NO: 2302743 - RNA, 18 nt, Yersinia pestis KIM
cagcguauagcgccgcca

SEQ ID NO: 2302744 - RNA, 20 nt, Yersinia pestis KIM
cagcguauucaguaaaaacu

SEQ ID NO: 2302745 - RNA, 20 nt, Yersinia pestis KIM
cagcgucauggucucacugc

SEQ ID NO: 2302746 - RNA, 21 nt, Yersinia pestis KIM
cagcgucauggucucacugcg

SEQ ID NO: 2302747 - RNA, 21 nt, Yersinia pestis KIM
cagcgguaaauugcucacuca

SEQ ID NO: 2302748 - RNA, 16 nt, Yersinia pestis KIM
cacugaguucugcugc

SEQ ID NO: 2302749 - RNA, 13 nt, Yersinia pestis KIM
cacugaguucugc

SEQ ID NO: 2302750 - RNA, 17 nt, Yersinia pestis KIM
cacugauagauucauca

SEQ ID NO: 2302751 - RNA, 22 nt, Yersinia pestis KIM
cacugauagauucaucaccagu

SEQ ID NO: 2302752 - RNA, 14 nt, Yersinia pestis KIM
cacugagggugaua

SEQ ID NO: 2302753 - RNA, 22 nt, Yersinia pestis KIM
cacugagucgucugucgggaac

SEQ ID NO: 2302754 - RNA, 22 nt, Yersinia pestis KIM
cagcgugaguaucgauaagaaa

SEQ ID NO: 2302755 - RNA, 23 nt, Yersinia pestis KIM
cagcgucuuucgggcugaugaau

SEQ ID NO: 2302756 - RNA, 22 nt, Yersinia pestis KIM
cagcgucgccguaaauugcuca

SEQ ID NO: 2302757 - RNA, 18 nt, Yersinia pestis KIM
cagcguuucaccaaacag

SEQ ID NO: 2302758 - RNA, 17 nt, Yersinia pestis KIM
cagcuaaucauugcaau

SEQ ID NO: 2302759 - RNA, 20 nt, Yersinia pestis KIM
caggcgaguuucccuuuucc

SEQ ID NO: 2302760 - RNA, 18 nt, Yersinia pestis KIM
caggccuagcccaguacc

SEQ ID NO: 2302761 - RNA, 16 nt, Yersinia pestis KIM
caggcccuuucaccgc

SEQ ID NO: 2302762 - RNA, 14 nt, Yersinia pestis KIM
caggccuuuacugu

SEQ ID NO: 2302763 - RNA, 13 nt, Yersinia pestis KIM
caggccuucuuuu

SEQ ID NO: 2302764 - RNA, 17 nt, Yersinia pestis KIM
caggcugccugccugag

SEQ ID NO: 2302765 - RNA, 23 nt, Yersinia pestis KIM
caggcuggauugauuuuuauaau

SEQ ID NO: 2302766 - RNA, 21 nt, Yersinia pestis KIM
caggcuuagcgacacccacuu

SEQ ID NO: 2302767 - RNA, 17 nt, Yersinia pestis KIM
caggcuucgacaggcaa

SEQ ID NO: 2302768 - RNA, 23 nt, Yersinia pestis KIM
caggcuguaugccugagcuauug

SEQ ID NO: 2302769 - RNA, 21 nt, Yersinia pestis KIM
caggcuguucuuggaacaggc

SEQ ID NO: 2302770 - RNA, 11 nt, Yersinia pestis KIM
cagggaaaaac

SEQ ID NO: 2302771 - RNA, 12 nt, Yersinia pestis KIM
caggccauuuuc

SEQ ID NO: 2302772 - RNA, 15 nt, Yersinia pestis KIM
caggccauuggcaaa

SEQ ID NO: 2302773 - RNA, 15 nt, Yersinia pestis KIM
caggccccuuaaaua

SEQ ID NO: 2302774 - RNA, 16 nt, Yersinia pestis KIM
caggccccaucauaaa

SEQ ID NO: 2302775 - RNA, 19 nt, Yersinia pestis KIM
caggcccgcuaucacuagc

SEQ ID NO: 2302776 - RNA, 22 nt, Yersinia pestis KIM
caggcccgcuuuaaucagcccu

SEQ ID NO: 2302777 - RNA, 18 nt, Yersinia pestis KIM
caggccaagccugugcua

SEQ ID NO: 2302778 - RNA, 16 nt, Yersinia pestis KIM
caggccaagccugugc

SEQ ID NO: 2302779 - RNA, 11 nt, Yersinia pestis KIM
caggccaauag

SEQ ID NO: 2302780 - RNA, 14 nt, Yersinia pestis KIM
caggccaauagccc

SEQ ID NO: 2302781 - RNA, 14 nt, Yersinia pestis KIM
caggcauaucacua

SEQ ID NO: 2302782 - RNA, 13 nt, Yersinia pestis KIM
caggcauaucacu

SEQ ID NO: 2302783 - RNA, 21 nt, Yersinia pestis KIM
caggcaucaucugcgguaacc

SEQ ID NO: 2302784 - RNA, 21 nt, Yersinia pestis KIM
caggcauuacagacuggccaa

SEQ ID NO: 2302785 - RNA, 16 nt, Yersinia pestis KIM
caggcaaucagaaugu

SEQ ID NO: 2302786 - RNA, 20 nt, Yersinia pestis KIM
caggaaauuugcacugcagg

SEQ ID NO: 2302787 - RNA, 14 nt, Yersinia pestis KIM
caugcucaccaugu

SEQ ID NO: 2302788 - RNA, 19 nt, Yersinia pestis KIM
caugcucaaucugcaaugc

SEQ ID NO: 2302789 - RNA, 15 nt, Yersinia pestis KIM
caugcccagcguugg

SEQ ID NO: 2302790 - RNA, 12 nt, Yersinia pestis KIM
caugccauggcg

SEQ ID NO: 2302791 - RNA, 19 nt, Yersinia pestis KIM
cauggccaugaaucaaauu

SEQ ID NO: 2302792 - RNA, 18 nt, Yersinia pestis KIM
cauggcauauucaccaga

SEQ ID NO: 2302793 - RNA, 21 nt, Yersinia pestis KIM
cauggcgaaaauccuucauuu

SEQ ID NO: 2302794 - RNA, 16 nt, Yersinia pestis KIM
caugcuguagcagccu

SEQ ID NO: 2302795 - RNA, 13 nt, Yersinia pestis KIM
caugcugauagca

SEQ ID NO: 2302796 - RNA, 15 nt, Yersinia pestis KIM
caugcucccuccugc

SEQ ID NO: 2302797 - RNA, 22 nt, Yersinia pestis KIM
caugcucccuccugcccaugcu

SEQ ID NO: 2302798 - RNA, 16 nt, Yersinia pestis KIM
caugcucccuccugcg

SEQ ID NO: 2302799 - RNA, 19 nt, Yersinia pestis KIM
cauguaucccgcuugggua

SEQ ID NO: 2302800 - RNA, 21 nt, Yersinia pestis KIM
cauguaguacuuaccuuccca

SEQ ID NO: 2302801 - RNA, 23 nt, Yersinia pestis KIM
caugucagacagcacgggcuauc

SEQ ID NO: 2302802 - RNA, 11 nt, Yersinia pestis KIM
caugugguuac

SEQ ID NO: 2302803 - RNA, 15 nt, Yersinia pestis KIM
caugugguuaccauc

SEQ ID NO: 2302804 - RNA, 20 nt, Yersinia pestis KIM
caugucggcagguaaugcau

SEQ ID NO: 2302805 - RNA, 16 nt, Yersinia pestis KIM
caugucccucuguccc

SEQ ID NO: 2302806 - RNA, 21 nt, Yersinia pestis KIM
cauggcggcagcacagagcac

SEQ ID NO: 2302807 - RNA, 21 nt, Yersinia pestis KIM
cauggcggcucgccugauagc

SEQ ID NO: 2302808 - RNA, 14 nt, Yersinia pestis KIM
cauguagcacacua

SEQ ID NO: 2302809 - RNA, 16 nt, Yersinia pestis KIM
cauguagcacacuacc

SEQ ID NO: 2302810 - RNA, 15 nt, Yersinia pestis KIM
cauguacuagaucac

SEQ ID NO: 2302811 - RNA, 17 nt, Yersinia pestis KIM
cauguagccauugcgca

SEQ ID NO: 2302812 - RNA, 11 nt, Yersinia pestis KIM
cauguacaccg

SEQ ID NO: 2302813 - RNA, 17 nt, Yersinia pestis KIM
cauguaacacacagcag

SEQ ID NO: 2302814 - RNA, 22 nt, Yersinia pestis KIM
cauguaacacacagcagacagc

SEQ ID NO: 2302815 - RNA, 15 nt, Yersinia pestis KIM
cauguaacggucaua

SEQ ID NO: 2302816 - RNA, 21 nt, Yersinia pestis KIM
caugcagcauuuucagcaacu

SEQ ID NO: 2302817 - RNA, 18 nt, Yersinia pestis KIM
caugauucguagaaacau

SEQ ID NO: 2302818 - RNA, 18 nt, Yersinia pestis KIM
caugaugacaaugcguua

SEQ ID NO: 2302819 - RNA, 20 nt, Yersinia pestis KIM
caugaugaauacgauaaaga

SEQ ID NO: 2302820 - RNA, 16 nt, Yersinia pestis KIM
caugaugauaucaccu

SEQ ID NO: 2302821 - RNA, 21 nt, Yersinia pestis KIM
caugauaaaacuauucugcuu

SEQ ID NO: 2302822 - RNA, 20 nt, Yersinia pestis KIM
caugagaaccaguucuggua

SEQ ID NO: 2302823 - RNA, 13 nt, Yersinia pestis KIM
caugagaaccagu

SEQ ID NO: 2302824 - RNA, 20 nt, Yersinia pestis KIM
caugagaauacuucaggcca

SEQ ID NO: 2302825 - RNA, 14 nt, Yersinia pestis KIM
caugaguaaaagau

SEQ ID NO: 2302826 - RNA, 17 nt, Yersinia pestis KIM
caugagugaaaauaugu

SEQ ID NO: 2302827 - RNA, 17 nt, Yersinia pestis KIM
caugaacggauacccag

SEQ ID NO: 2302828 - RNA, 14 nt, Yersinia pestis KIM
caugaaugaggcug

SEQ ID NO: 2302829 - RNA, 20 nt, Yersinia pestis KIM
caugacuagugccacaacaa

SEQ ID NO: 2302830 - RNA, 23 nt, Yersinia pestis KIM
caugacagguugauaaguugaga

SEQ ID NO: 2302831 - RNA, 14 nt, Yersinia pestis KIM
caugacagguuuca

SEQ ID NO: 2302832 - RNA, 14 nt, Yersinia pestis KIM
cauuucauuaaaug

SEQ ID NO: 2302833 - RNA, 22 nt, Yersinia pestis KIM
cauuucauagaacuuaagcaau

SEQ ID NO: 2302834 - RNA, 14 nt, Yersinia pestis KIM
cauuucguagccuu

SEQ ID NO: 2302835 - RNA, 22 nt, Yersinia pestis KIM
cauuuccguuaacccaaagccc

SEQ ID NO: 2302836 - RNA, 16 nt, Yersinia pestis KIM
cauuucaaccucaauu

SEQ ID NO: 2302837 - RNA, 19 nt, Yersinia pestis KIM
cauuucaaccucaauuuac

SEQ ID NO: 2302838 - RNA, 13 nt, Yersinia pestis KIM
cauuuauuuccac

SEQ ID NO: 2302839 - RNA, 18 nt, Yersinia pestis KIM
cauuuauuacauuuacau

SEQ ID NO: 2302840 - RNA, 19 nt, Yersinia pestis KIM
cauuuaucuaaaacugccu

SEQ ID NO: 2302841 - RNA, 15 nt, Yersinia pestis KIM
cauuuagcauuauuc

SEQ ID NO: 2302842 - RNA, 20 nt, Yersinia pestis KIM
cauuguccucaagauuaucc

SEQ ID NO: 2302843 - RNA, 16 nt, Yersinia pestis KIM
cauuguagauggccau

SEQ ID NO: 2302844 - RNA, 13 nt, Yersinia pestis KIM
cauugucaccuaa

SEQ ID NO: 2302845 - RNA, 23 nt, Yersinia pestis KIM
cauugucaccuaaccaaacauug

SEQ ID NO: 2302846 - RNA, 21 nt, Yersinia pestis KIM
cauugucauggccugaugcac

SEQ ID NO: 2302847 - RNA, 19 nt, Yersinia pestis KIM
cauugcucaaacucagcau

SEQ ID NO: 2302848 - RNA, 21 nt, Yersinia pestis KIM
cauuggcuuuuugcuggaacu

SEQ ID NO: 2302849 - RNA, 18 nt, Yersinia pestis KIM
cauuggcuugguuguuuc

SEQ ID NO: 2302850 - RNA, 15 nt, Yersinia pestis KIM
cauuggcuaccccaa

SEQ ID NO: 2302851 - RNA, 14 nt, Yersinia pestis KIM
cauugguaauaaug

SEQ ID NO: 2302852 - RNA, 12 nt, Yersinia pestis KIM
cauucuugauuu

SEQ ID NO: 2302853 - RNA, 20 nt, Yersinia pestis KIM
cauugccagugaacccgcca

SEQ ID NO: 2302854 - RNA, 22 nt, Yersinia pestis KIM
cauucgcgguuacaccaauaau

SEQ ID NO: 2302855 - RNA, 15 nt, Yersinia pestis KIM
cauucgccugauaaa

SEQ ID NO: 2302856 - RNA, 19 nt, Yersinia pestis KIM
cauucgcacgggcuuuaau

SEQ ID NO: 2302857 - RNA, 17 nt, Yersinia pestis KIM
cauucgauagaaacauc

SEQ ID NO: 2302858 - RNA, 23 nt, Yersinia pestis KIM
cauucgcacaguuuucuuaaaau

SEQ ID NO: 2302859 - RNA, 15 nt, Yersinia pestis KIM
cauuccugguuuuac

SEQ ID NO: 2302860 - RNA, 21 nt, Yersinia pestis KIM
cauuccugguuuuaccaucac

SEQ ID NO: 2302861 - RNA, 21 nt, Yersinia pestis KIM
cauucccccggauauuuuuuu

SEQ ID NO: 2302862 - RNA, 17 nt, Yersinia pestis KIM
cauucccgagauaacca

SEQ ID NO: 2302863 - RNA, 17 nt, Yersinia pestis KIM
cauuccguuuaaacucc

SEQ ID NO: 2302864 - RNA, 18 nt, Yersinia pestis KIM
cauucagcgucuucaauu

SEQ ID NO: 2302865 - RNA, 14 nt, Yersinia pestis KIM
cauucacugcuaac

SEQ ID NO: 2302866 - RNA, 15 nt, Yersinia pestis KIM
cauucaguacauaaa

SEQ ID NO: 2302867 - RNA, 15 nt, Yersinia pestis KIM
cauucaucaccuuau

SEQ ID NO: 2302868 - RNA, 18 nt, Yersinia pestis KIM
cauucauaauugaagagu

SEQ ID NO: 2302869 - RNA, 22 nt, Yersinia pestis KIM
cauucaugaggcuucuuaauuc

SEQ ID NO: 2302870 - RNA, 14 nt, Yersinia pestis KIM
cauucauuuuaaaa

SEQ ID NO: 2302871 - RNA, 16 nt, Yersinia pestis KIM
cauucauuuuaaaaaa

SEQ ID NO: 2302872 - RNA, 16 nt, Yersinia pestis KIM
cauuacguuaaacgca

SEQ ID NO: 2302873 - RNA, 14 nt, Yersinia pestis KIM
cauuauauagauuu

SEQ ID NO: 2302874 - RNA, 16 nt, Yersinia pestis KIM
cauuauaaauaauuaa

SEQ ID NO: 2302875 - RNA, 18 nt, Yersinia pestis KIM
cauuauaaggaauauacu

SEQ ID NO: 2302876 - RNA, 22 nt, Yersinia pestis KIM
cauuauaaggaauauacuuuac

SEQ ID NO: 2302877 - RNA, 19 nt, Yersinia pestis KIM
cauguucacccaguaacug

SEQ ID NO: 2302878 - RNA, 14 nt, Yersinia pestis KIM
cauguguguucuug

SEQ ID NO: 2302879 - RNA, 23 nt, Yersinia pestis KIM
cauguguauuagguuuggccuaa

SEQ ID NO: 2302880 - RNA, 11 nt, Yersinia pestis KIM
cauguucaucu

SEQ ID NO: 2302881 - RNA, 14 nt, Yersinia pestis KIM
cauucaauguaaaa

SEQ ID NO: 2302882 - RNA, 12 nt, Yersinia pestis KIM
cauucaaguaaa

SEQ ID NO: 2302883 - RNA, 14 nt, Yersinia pestis KIM
cauucaaguaaaug

SEQ ID NO: 2302884 - RNA, 23 nt, Yersinia pestis KIM
cauucaccugcccgucacucaga

SEQ ID NO: 2302885 - RNA, 17 nt, Yersinia pestis KIM
cauucaauggaauguuc

SEQ ID NO: 2302886 - RNA, 17 nt, Yersinia pestis KIM
cauuauuauguauuuuu

SEQ ID NO: 2302887 - RNA, 15 nt, Yersinia pestis KIM
cauuauauuauuuau

SEQ ID NO: 2302888 - RNA, 21 nt, Yersinia pestis KIM
cauuauuauguauuuuuaugc

SEQ ID NO: 2302889 - RNA, 15 nt, Yersinia pestis KIM
cauuauuaaacugau

SEQ ID NO: 2302890 - RNA, 19 nt, Yersinia pestis KIM
cauuauucuaggcaugaau

SEQ ID NO: 2302891 - RNA, 20 nt, Yersinia pestis KIM
cauuauucaugaugccgagu

SEQ ID NO: 2302892 - RNA, 19 nt, Yersinia pestis KIM
cauagauuauuuuuauaca

SEQ ID NO: 2302893 - RNA, 16 nt, Yersinia pestis KIM
cauagauuaagaaaac

SEQ ID NO: 2302894 - RNA, 19 nt, Yersinia pestis KIM
cauagaguucguguugugc

SEQ ID NO: 2302895 - RNA, 17 nt, Yersinia pestis KIM
cauagcgcauuauaagg

SEQ ID NO: 2302896 - RNA, 15 nt, Yersinia pestis KIM
cauagacaugagaca

SEQ ID NO: 2302897 - RNA, 15 nt, Yersinia pestis KIM
cauagacgaaggcac

SEQ ID NO: 2302898 - RNA, 16 nt, Yersinia pestis KIM
cauaauuccacauaaa

SEQ ID NO: 2302899 - RNA, 18 nt, Yersinia pestis KIM
cauaauuccacauaaaau

SEQ ID NO: 2302900 - RNA, 15 nt, Yersinia pestis KIM
cauacaaccauuuca

SEQ ID NO: 2302901 - RNA, 15 nt, Yersinia pestis KIM
cauauacuggagcua

SEQ ID NO: 2302902 - RNA, 18 nt, Yersinia pestis KIM
cauaucagcaaugacggu

SEQ ID NO: 2302903 - RNA, 15 nt, Yersinia pestis KIM
cauaguccaacgcac

SEQ ID NO: 2302904 - RNA, 22 nt, Yersinia pestis KIM
cauaguccaacgcacugguugc

SEQ ID NO: 2302905 - RNA, 19 nt, Yersinia pestis KIM
cauagugauuauuuaaaca

SEQ ID NO: 2302906 - RNA, 14 nt, Yersinia pestis KIM
cauauaaaaaagca

SEQ ID NO: 2302907 - RNA, 21 nt, Yersinia pestis KIM
cauaguuucaauaugcucugc

SEQ ID NO: 2302908 - RNA, 14 nt, Yersinia pestis KIM
cauagcuaaccuua

SEQ ID NO: 2302909 - RNA, 17 nt, Yersinia pestis KIM
cauagcuaacaccgcug

SEQ ID NO: 2302910 - RNA, 19 nt, Yersinia pestis KIM
cauagcuaacaccgcugua

SEQ ID NO: 2302911 - RNA, 14 nt, Yersinia pestis KIM
cauagcuaaaauaa

SEQ ID NO: 2302912 - RNA, 19 nt, Yersinia pestis KIM
cauagcuggcuucaaaauc

SEQ ID NO: 2302913 - RNA, 17 nt, Yersinia pestis KIM
cauagcuggcuucaaaa

SEQ ID NO: 2302914 - RNA, 14 nt, Yersinia pestis KIM
cauagguugcgcca

SEQ ID NO: 2302915 - RNA, 14 nt, Yersinia pestis KIM
cauaucgaccauga

SEQ ID NO: 2302916 - RNA, 18 nt, Yersinia pestis KIM
cauauccguuuucaccca

SEQ ID NO: 2302917 - RNA, 17 nt, Yersinia pestis KIM
cauauccucgagaugua

SEQ ID NO: 2302918 - RNA, 13 nt, Yersinia pestis KIM
cauauccugugcc

SEQ ID NO: 2302919 - RNA, 14 nt, Yersinia pestis KIM
cauauccaguugcc

SEQ ID NO: 2302920 - RNA, 17 nt, Yersinia pestis KIM
cauauuggccaguugcc

SEQ ID NO: 2302921 - RNA, 18 nt, Yersinia pestis KIM
cauauuguccaaaggaag

SEQ ID NO: 2302922 - RNA, 13 nt, Yersinia pestis KIM
cauauuucaggcu

SEQ ID NO: 2302923 - RNA, 11 nt, Yersinia pestis KIM
caucaaaggag

SEQ ID NO: 2302924 - RNA, 20 nt, Yersinia pestis KIM
caucaaaggagugcccggca

SEQ ID NO: 2302925 - RNA, 14 nt, Yersinia pestis KIM
caucaacaaccagu

SEQ ID NO: 2302926 - RNA, 21 nt, Yersinia pestis KIM
caucaaauacacauaaccauc

SEQ ID NO: 2302927 - RNA, 17 nt, Yersinia pestis KIM
caucaauagguguugcc

SEQ ID NO: 2302928 - RNA, 22 nt, Yersinia pestis KIM
caucaauagugcgaucaaaaac

SEQ ID NO: 2302929 - RNA, 18 nt, Yersinia pestis KIM
caucaauacuguuaucac

SEQ ID NO: 2302930 - RNA, 13 nt, Yersinia pestis KIM
caucagaugauga

SEQ ID NO: 2302931 - RNA, 16 nt, Yersinia pestis KIM
caucagaggcucaucc

SEQ ID NO: 2302932 - RNA, 18 nt, Yersinia pestis KIM
caucagaguccaauagcu

SEQ ID NO: 2302933 - RNA, 18 nt, Yersinia pestis KIM
caucagcaaaguauuuau

SEQ ID NO: 2302934 - RNA, 11 nt, Yersinia pestis KIM
caucagcaauu

SEQ ID NO: 2302935 - RNA, 21 nt, Yersinia pestis KIM
caucagcagugacgucaucgu

SEQ ID NO: 2302936 - RNA, 23 nt, Yersinia pestis KIM
caucagcauauuacccaguacug

SEQ ID NO: 2302937 - RNA, 16 nt, Yersinia pestis KIM
caucagcagcaggaau

SEQ ID NO: 2302938 - RNA, 15 nt, Yersinia pestis KIM
caucagcgcccagcu

SEQ ID NO: 2302939 - RNA, 14 nt, Yersinia pestis KIM
caucagcgcuggcu

SEQ ID NO: 2302940 - RNA, 19 nt, Yersinia pestis KIM
caucacugucuauuuuuau

SEQ ID NO: 2302941 - RNA, 18 nt, Yersinia pestis KIM
caucacuuccagcgcccg

SEQ ID NO: 2302942 - RNA, 14 nt, Yersinia pestis KIM
caucagacagccau

SEQ ID NO: 2302943 - RNA, 22 nt, Yersinia pestis KIM
caucagacacguaaaacaggga

SEQ ID NO: 2302944 - RNA, 13 nt, Yersinia pestis KIM
caucagacauauu

SEQ ID NO: 2302945 - RNA, 22 nt, Yersinia pestis KIM
caucagacugcucuuucccuuc

SEQ ID NO: 2302946 - RNA, 14 nt, Yersinia pestis KIM
caucacaccgcgau

SEQ ID NO: 2302947 - RNA, 23 nt, Yersinia pestis KIM
caucacaaauauuggcccacugg

SEQ ID NO: 2302948 - RNA, 13 nt, Yersinia pestis KIM
caucaauuuggca

SEQ ID NO: 2302949 - RNA, 19 nt, Yersinia pestis KIM
caucaauguuggcccaaga

SEQ ID NO: 2302950 - RNA, 16 nt, Yersinia pestis KIM
caucccguaggcuugg

SEQ ID NO: 2302951 - RNA, 20 nt, Yersinia pestis KIM
caucccggcgacggcuggaa

SEQ ID NO: 2302952 - RNA, 16 nt, Yersinia pestis KIM
cauccccggcaacacc

SEQ ID NO: 2302953 - RNA, 19 nt, Yersinia pestis KIM
cauccccggcaacacccug

SEQ ID NO: 2302954 - RNA, 20 nt, Yersinia pestis KIM
cauccauguaggcucgagcc

SEQ ID NO: 2302955 - RNA, 16 nt, Yersinia pestis KIM
cauccauuacauccuu

SEQ ID NO: 2302956 - RNA, 13 nt, Yersinia pestis KIM
cauccauuguauu

SEQ ID NO: 2302957 - RNA, 14 nt, Yersinia pestis KIM
cauccauuguauug

SEQ ID NO: 2302958 - RNA, 20 nt, Yersinia pestis KIM
cauccauuguauugcucagg

SEQ ID NO: 2302959 - RNA, 22 nt, Yersinia pestis KIM
cauccauuguauugcucagggc

SEQ ID NO: 2302960 - RNA, 13 nt, Yersinia pestis KIM
caucccaacaauu

SEQ ID NO: 2302961 - RNA, 11 nt, Yersinia pestis KIM
caucccagcac

SEQ ID NO: 2302962 - RNA, 19 nt, Yersinia pestis KIM
cauccccacuuguaccugu

SEQ ID NO: 2302963 - RNA, 22 nt, Yersinia pestis KIM
cauccccaaacgcugaccaugg

SEQ ID NO: 2302964 - RNA, 14 nt, Yersinia pestis KIM
caucccuuaaccac

SEQ ID NO: 2302965 - RNA, 14 nt, Yersinia pestis KIM
cauccugcaaauuu

SEQ ID NO: 2302966 - RNA, 15 nt, Yersinia pestis KIM
cauccaguaagcugu

SEQ ID NO: 2302967 - RNA, 23 nt, Yersinia pestis KIM
cauccagcguaaacaguagcagg

SEQ ID NO: 2302968 - RNA, 16 nt, Yersinia pestis KIM
cauccagauauggcau

SEQ ID NO: 2302969 - RNA, 21 nt, Yersinia pestis KIM
cauccaacaacugccaaauuu

SEQ ID NO: 2302970 - RNA, 19 nt, Yersinia pestis KIM
cauccaaccugcaaugccu

SEQ ID NO: 2302971 - RNA, 22 nt, Yersinia pestis KIM
caucauucauuuuaaaaaaauu

SEQ ID NO: 2302972 - RNA, 14 nt, Yersinia pestis KIM
cauccaaacggaau

SEQ ID NO: 2302973 - RNA, 15 nt, Yersinia pestis KIM
caucauuauuaugua

SEQ ID NO: 2302974 - RNA, 16 nt, Yersinia pestis KIM
cauccaagccaucauu

SEQ ID NO: 2302975 - RNA, 17 nt, Yersinia pestis KIM
cauccaagccaucauua

SEQ ID NO: 2302976 - RNA, 21 nt, Yersinia pestis KIM
caucagcguagccguuaaaua

SEQ ID NO: 2302977 - RNA, 20 nt, Yersinia pestis KIM
cauccugcgggccagcgcug

SEQ ID NO: 2302978 - RNA, 15 nt, Yersinia pestis KIM
caucgcacugauagc

SEQ ID NO: 2302979 - RNA, 17 nt, Yersinia pestis KIM
caucgccacuucuaaca

SEQ ID NO: 2302980 - RNA, 21 nt, Yersinia pestis KIM
caucgccgacaaaauccccca

SEQ ID NO: 2302981 - RNA, 22 nt, Yersinia pestis KIM
caucggauugcaacaacgccag

SEQ ID NO: 2302982 - RNA, 15 nt, Yersinia pestis KIM
caucggauaauguua

SEQ ID NO: 2302983 - RNA, 21 nt, Yersinia pestis KIM
caucgcuggacgcaucagauc

SEQ ID NO: 2302984 - RNA, 17 nt, Yersinia pestis KIM
caucggccugcgcugcu

SEQ ID NO: 2302985 - RNA, 22 nt, Yersinia pestis KIM
caucguugcggguuaacucuuc

SEQ ID NO: 2302986 - RNA, 12 nt, Yersinia pestis KIM
caucguggcuuu

SEQ ID NO: 2302987 - RNA, 23 nt, Yersinia pestis KIM
caucguggucaccgccaaaugaa

SEQ ID NO: 2302988 - RNA, 19 nt, Yersinia pestis KIM
caucuccagaauauaaaag

SEQ ID NO: 2302989 - RNA, 16 nt, Yersinia pestis KIM
caucuccagaauauaa

SEQ ID NO: 2302990 - RNA, 18 nt, Yersinia pestis KIM
caucucggcguaaacaau

SEQ ID NO: 2302991 - RNA, 12 nt, Yersinia pestis KIM
caucucggcuuu

SEQ ID NO: 2302992 - RNA, 20 nt, Yersinia pestis KIM
caaaaugccguacaacaaua

SEQ ID NO: 2302993 - RNA, 15 nt, Yersinia pestis KIM
caaaaugcguaaaaa

SEQ ID NO: 2302994 - RNA, 14 nt, Yersinia pestis KIM
caaaaugagccugu

SEQ ID NO: 2302995 - RNA, 23 nt, Yersinia pestis KIM
caaaaugaucaucagcagcagga

SEQ ID NO: 2302996 - RNA, 15 nt, Yersinia pestis KIM
caaaaugugaaaagc

SEQ ID NO: 2302997 - RNA, 16 nt, Yersinia pestis KIM
caaaauccgugcuggu

SEQ ID NO: 2302998 - RNA, 18 nt, Yersinia pestis KIM
caaaaucccaaaauauga

SEQ ID NO: 2302999 - RNA, 16 nt, Yersinia pestis KIM
caaacaaccuaaaaaa

SEQ ID NO: 2303000 - RNA, 17 nt, Yersinia pestis KIM
caaacaaccuaaaaaaa

SEQ ID NO: 2303001 - RNA, 19 nt, Yersinia pestis KIM
caaacaaccuaaaaaaaac

SEQ ID NO: 2303002 - RNA, 15 nt, Yersinia pestis KIM
caaacaaggccacca

SEQ ID NO: 2303003 - RNA, 22 nt, Yersinia pestis KIM
caaaauugagauaacgcugaug

SEQ ID NO: 2303004 - RNA, 23 nt, Yersinia pestis KIM
caaaauuaugccagucuuccaug

SEQ ID NO: 2303005 - RNA, 21 nt, Yersinia pestis KIM
caaaauacuuaacaaucagug

SEQ ID NO: 2303006 - RNA, 19 nt, Yersinia pestis KIM
caaaauagaaaacagcaau

SEQ ID NO: 2303007 - RNA, 20 nt, Yersinia pestis KIM
caaaauacggccagucaaaa

SEQ ID NO: 2303008 - RNA, 22 nt, Yersinia pestis KIM
caaaauacggccagucaaaaga

SEQ ID NO: 2303009 - RNA, 23 nt, Yersinia pestis KIM
caaaauagaggaaauaaaugacu

SEQ ID NO: 2303010 - RNA, 23 nt, Yersinia pestis KIM
caaaauagggccguuuaccuugu

SEQ ID NO: 2303011 - RNA, 17 nt, Yersinia pestis KIM
caaaauagggaaggugu

SEQ ID NO: 2303012 - RNA, 19 nt, Yersinia pestis KIM
caaaauagggaagguguuu

SEQ ID NO: 2303013 - RNA, 14 nt, Yersinia pestis KIM
caaaauaauauaau

SEQ ID NO: 2303014 - RNA, 12 nt, Yersinia pestis KIM
caaaauacccau

SEQ ID NO: 2303015 - RNA, 21 nt, Yersinia pestis KIM
caaaauaucgcgcuucagguc

SEQ ID NO: 2303016 - RNA, 22 nt, Yersinia pestis KIM
caaaauauucgcauugugcuuu

SEQ ID NO: 2303017 - RNA, 20 nt, Yersinia pestis KIM
caaaauaugauaguguaaaa

SEQ ID NO: 2303018 - RNA, 12 nt, Yersinia pestis KIM
caaaauauguuc

SEQ ID NO: 2303019 - RNA, 22 nt, Yersinia pestis KIM
caaaaucaccccacuagaaaua

SEQ ID NO: 2303020 - RNA, 19 nt, Yersinia pestis KIM
auuuuuauguuuaucaccc

SEQ ID NO: 2303021 - RNA, 18 nt, Yersinia pestis KIM
auuuuuaucaauggggau

SEQ ID NO: 2303022 - RNA, 13 nt, Yersinia pestis KIM
auuuuuauauuuu

SEQ ID NO: 2303023 - RNA, 14 nt, Yersinia pestis KIM
auuuuuaugccauu

SEQ ID NO: 2303024 - RNA, 18 nt, Yersinia pestis KIM
auuuuuauaaucaucuac

SEQ ID NO: 2303025 - RNA, 14 nt, Yersinia pestis KIM
auuuuuagccgcaa

SEQ ID NO: 2303026 - RNA, 12 nt, Yersinia pestis KIM
caaaauaaaaau

SEQ ID NO: 2303027 - RNA, 21 nt, Yersinia pestis KIM
caaaagugacgaaugagcagu

SEQ ID NO: 2303028 - RNA, 14 nt, Yersinia pestis KIM
caaacucauacacu

SEQ ID NO: 2303029 - RNA, 20 nt, Yersinia pestis KIM
caaacucagccaucaguuca

SEQ ID NO: 2303030 - RNA, 19 nt, Yersinia pestis KIM
caaacucagcgaauaaaua

SEQ ID NO: 2303031 - RNA, 16 nt, Yersinia pestis KIM
caaacggugugcaaug

SEQ ID NO: 2303032 - RNA, 17 nt, Yersinia pestis KIM
caaacgugcuacuuaau

SEQ ID NO: 2303033 - RNA, 24 nt, Yersinia pestis KIM
caaacgugaugugcccuuguuuau

SEQ ID NO: 2303034 - RNA, 17 nt, Yersinia pestis KIM
caaacgggugcgccaau

SEQ ID NO: 2303035 - RNA, 14 nt, Yersinia pestis KIM
caaacguuuuauuc

SEQ ID NO: 2303036 - RNA, 22 nt, Yersinia pestis KIM
caaacgccucguuuaacucaaa

SEQ ID NO: 2303037 - RNA, 16 nt, Yersinia pestis KIM
caaacggauaauguug

SEQ ID NO: 2303038 - RNA, 22 nt, Yersinia pestis KIM
caaacgcguuaauuaagacccu

SEQ ID NO: 2303039 - RNA, 17 nt, Yersinia pestis KIM
caaaccgcuaagcugcg

SEQ ID NO: 2303040 - RNA, 19 nt, Yersinia pestis KIM
caaacaguucauaucgaua

SEQ ID NO: 2303041 - RNA, 18 nt, Yersinia pestis KIM
caaacagugcacaucaau

SEQ ID NO: 2303042 - RNA, 12 nt, Yersinia pestis KIM
caaacauaaccu

SEQ ID NO: 2303043 - RNA, 14 nt, Yersinia pestis KIM
caaacagauacauc

SEQ ID NO: 2303044 - RNA, 17 nt, Yersinia pestis KIM
caaacauugucaccuga

SEQ ID NO: 2303045 - RNA, 20 nt, Yersinia pestis KIM
caaaccccgccucuucuaau

SEQ ID NO: 2303046 - RNA, 23 nt, Yersinia pestis KIM
caaaccccgaugacucgaacuga

SEQ ID NO: 2303047 - RNA, 18 nt, Yersinia pestis KIM
caaaccccgccucuucua

SEQ ID NO: 2303048 - RNA, 15 nt, Yersinia pestis KIM
caaaccagcccuguu

SEQ ID NO: 2303049 - RNA, 17 nt, Yersinia pestis KIM
caaaccccacuaacgcu

SEQ ID NO: 2303050 - RNA, 12 nt, Yersinia pestis KIM
caaaccauggcg

SEQ ID NO: 2303051 - RNA, 21 nt, Yersinia pestis KIM
caaagaucucucgaacccgca

SEQ ID NO: 2303052 - RNA, 23 nt, Yersinia pestis KIM
caaagauaauacauaaaaucaau

SEQ ID NO: 2303053 - RNA, 16 nt, Yersinia pestis KIM
caaagauacagugcgc

SEQ ID NO: 2303054 - RNA, 12 nt, Yersinia pestis KIM
caaagcuauuuu

SEQ ID NO: 2303055 - RNA, 15 nt, Yersinia pestis KIM
caaagcgcucagcgc

SEQ ID NO: 2303056 - RNA, 11 nt, Yersinia pestis KIM
caaagcuucca

SEQ ID NO: 2303057 - RNA, 13 nt, Yersinia pestis KIM
caaagcuauuuuu

SEQ ID NO: 2303058 - RNA, 20 nt, Yersinia pestis KIM
caaacuugaucagcgccugc

SEQ ID NO: 2303059 - RNA, 15 nt, Yersinia pestis KIM
caaacuggcccagcu

SEQ ID NO: 2303060 - RNA, 17 nt, Yersinia pestis KIM
caaagagucgcaaaacu

SEQ ID NO: 2303061 - RNA, 22 nt, Yersinia pestis KIM
caaagagaacgggcaaccugua

SEQ ID NO: 2303062 - RNA, 21 nt, Yersinia pestis KIM
caaagagaacgggcaaccugu

SEQ ID NO: 2303063 - RNA, 20 nt, Yersinia pestis KIM
caaagacuuuauucacagca

SEQ ID NO: 2303064 - RNA, 20 nt, Yersinia pestis KIM
caaagaccacaucaaccuga

SEQ ID NO: 2303065 - RNA, 19 nt, Yersinia pestis KIM
caaauaaggcguuuaauuc

SEQ ID NO: 2303066 - RNA, 22 nt, Yersinia pestis KIM
caaauacccuaauucagauguu

SEQ ID NO: 2303067 - RNA, 18 nt, Yersinia pestis KIM
caaaggggagccaaugua

SEQ ID NO: 2303068 - RNA, 16 nt, Yersinia pestis KIM
caaaggaagccgagcu

SEQ ID NO: 2303069 - RNA, 21 nt, Yersinia pestis KIM
caaaggagacuucgccaaucu

SEQ ID NO: 2303070 - RNA, 14 nt, Yersinia pestis KIM
caaaggcuauuuaa

SEQ ID NO: 2303071 - RNA, 18 nt, Yersinia pestis KIM
caaaucauuuaauuuauc

SEQ ID NO: 2303072 - RNA, 22 nt, Yersinia pestis KIM
caaaucccguuccgcuuccccu

SEQ ID NO: 2303073 - RNA, 23 nt, Yersinia pestis KIM
caaauccgacugauagcaaacaa

SEQ ID NO: 2303074 - RNA, 23 nt, Yersinia pestis KIM
caaaucaucgcugacaauuuaca

SEQ ID NO: 2303075 - RNA, 22 nt, Yersinia pestis KIM
caaaucaugcucaaucugcaau

SEQ ID NO: 2303076 - RNA, 18 nt, Yersinia pestis KIM
caaauagauagcaaucaa

SEQ ID NO: 2303077 - RNA, 20 nt, Yersinia pestis KIM
caaauagauagcaaucaaua

SEQ ID NO: 2303078 - RNA, 14 nt, Yersinia pestis KIM
caaauagagcacca

SEQ ID NO: 2303079 - RNA, 15 nt, Yersinia pestis KIM
caaauagagcaccaa

SEQ ID NO: 2303080 - RNA, 18 nt, Yersinia pestis KIM
caaauaucauuauuuuga

SEQ ID NO: 2303081 - RNA, 22 nt, Yersinia pestis KIM
caaauacgaccgucaccaaaua

SEQ ID NO: 2303082 - RNA, 20 nt, Yersinia pestis KIM
caaauacggcgaaauauaaa

SEQ ID NO: 2303083 - RNA, 14 nt, Yersinia pestis KIM
caaauacugcugug

SEQ ID NO: 2303084 - RNA, 23 nt, Yersinia pestis KIM
caacaaaaucgcgaccagcagaa

SEQ ID NO: 2303085 - RNA, 14 nt, Yersinia pestis KIM
caaauucaccagca

SEQ ID NO: 2303086 - RNA, 23 nt, Yersinia pestis KIM
caaauuccgcuucucagucgcga

SEQ ID NO: 2303087 - RNA, 20 nt, Yersinia pestis KIM
caaaugggugugaacaguga

SEQ ID NO: 2303088 - RNA, 13 nt, Yersinia pestis KIM
caaauuaaauaac

SEQ ID NO: 2303089 - RNA, 22 nt, Yersinia pestis KIM
caaaugucaggggguuauccaa

SEQ ID NO: 2303090 - RNA, 15 nt, Yersinia pestis KIM
caaaugaaaauauuc

SEQ ID NO: 2303091 - RNA, 22 nt, Yersinia pestis KIM
caaaucuuccagcggcaaauag

SEQ ID NO: 2303092 - RNA, 22 nt, Yersinia pestis KIM
caaaucugacgguuauuuucug

SEQ ID NO: 2303093 - RNA, 20 nt, Yersinia pestis KIM
caaaucugcccccagcgugc

SEQ ID NO: 2303094 - RNA, 14 nt, Yersinia pestis KIM
caacagauaaagcu

SEQ ID NO: 2303095 - RNA, 22 nt, Yersinia pestis KIM
caacaccggguaagguaaagaa

SEQ ID NO: 2303096 - RNA, 15 nt, Yersinia pestis KIM
caacaccguaacgcc

SEQ ID NO: 2303097 - RNA, 15 nt, Yersinia pestis KIM
caacaacggugaaca

SEQ ID NO: 2303098 - RNA, 17 nt, Yersinia pestis KIM
caacaaauucaccagca

SEQ ID NO: 2303099 - RNA, 17 nt, Yersinia pestis KIM
caacaacggugaacaga

SEQ ID NO: 2303100 - RNA, 19 nt, Yersinia pestis KIM
caacaacugccaaauuugg

SEQ ID NO: 2303101 - RNA, 18 nt, Yersinia pestis KIM
caacaagaaaucaaaagg

SEQ ID NO: 2303102 - RNA, 22 nt, Yersinia pestis KIM
caacaagaucccaagcaggaaa

SEQ ID NO: 2303103 - RNA, 12 nt, Yersinia pestis KIM
caacaagccucg

SEQ ID NO: 2303104 - RNA, 15 nt, Yersinia pestis KIM
caacagugaacgggc

SEQ ID NO: 2303105 - RNA, 23 nt, Yersinia pestis KIM
caacaguacugccaaccaccaaa

SEQ ID NO: 2303106 - RNA, 15 nt, Yersinia pestis KIM
caacaguaccuucua

SEQ ID NO: 2303107 - RNA, 14 nt, Yersinia pestis KIM
caacauaaguaaua

SEQ ID NO: 2303108 - RNA, 15 nt, Yersinia pestis KIM
caacauaaucaaucc

SEQ ID NO: 2303109 - RNA, 21 nt, Yersinia pestis KIM
caacagauaauuggcaauaau

SEQ ID NO: 2303110 - RNA, 22 nt, Yersinia pestis KIM
caacagauaugcauuauugaug

SEQ ID NO: 2303111 - RNA, 16 nt, Yersinia pestis KIM
caacagccauauuuuu

SEQ ID NO: 2303112 - RNA, 15 nt, Yersinia pestis KIM
caagauggucauaaa

SEQ ID NO: 2303113 - RNA, 20 nt, Yersinia pestis KIM
caagcaaccuuguuuuaucg

SEQ ID NO: 2303114 - RNA, 15 nt, Yersinia pestis KIM
caagcaagcggcagc

SEQ ID NO: 2303115 - RNA, 18 nt, Yersinia pestis KIM
caagauuuuguagcccac

SEQ ID NO: 2303116 - RNA, 23 nt, Yersinia pestis KIM
caagcuacggccuguaccaccac

SEQ ID NO: 2303117 - RNA, 13 nt, Yersinia pestis KIM
caagcuacaugug

SEQ ID NO: 2303118 - RNA, 18 nt, Yersinia pestis KIM
caagcgcgguuacuguua

SEQ ID NO: 2303119 - RNA, 23 nt, Yersinia pestis KIM
caagccuucauucaauugaucua

SEQ ID NO: 2303120 - RNA, 16 nt, Yersinia pestis KIM
caagccugugcuaaau

SEQ ID NO: 2303121 - RNA, 22 nt, Yersinia pestis KIM
caagcuuaguauccgcgccaga

SEQ ID NO: 2303122 - RNA, 23 nt, Yersinia pestis KIM
caagcuuaguauccgcgccagac

SEQ ID NO: 2303123 - RNA, 19 nt, Yersinia pestis KIM
caagcuuuugccacauuuc

SEQ ID NO: 2303124 - RNA, 17 nt, Yersinia pestis KIM
caaggauggggcugcca

SEQ ID NO: 2303125 - RNA, 19 nt, Yersinia pestis KIM
caaggcagcaagcaaacga

SEQ ID NO: 2303126 - RNA, 14 nt, Yersinia pestis KIM
caagcuuaauauua

SEQ ID NO: 2303127 - RNA, 20 nt, Yersinia pestis KIM
caagcucucacccaauaaga

SEQ ID NO: 2303128 - RNA, 9 nt, Yersinia pestis KIM
caagucccg

SEQ ID NO: 2303129 - RNA, 19 nt, Yersinia pestis KIM
caaggcucuggcaauggcu

SEQ ID NO: 2303130 - RNA, 23 nt, Yersinia pestis KIM
caaguuacuuuuuuauuuuacuu

SEQ ID NO: 2303131 - RNA, 12 nt, Yersinia pestis KIM
caaguuaaauac

SEQ ID NO: 2303132 - RNA, 23 nt, Yersinia pestis KIM
caaguuaaauacugcacguuuaa

SEQ ID NO: 2303133 - RNA, 23 nt, Yersinia pestis KIM
caagugcuucaaauccucggguu

SEQ ID NO: 2303134 - RNA, 19 nt, Yersinia pestis KIM
caaguggguaauguugcaa

SEQ ID NO: 2303135 - RNA, 14 nt, Yersinia pestis KIM
caagugaacgaggc

SEQ ID NO: 2303136 - RNA, 23 nt, Yersinia pestis KIM
caauaacuuuggguauaugacug

SEQ ID NO: 2303137 - RNA, 22 nt, Yersinia pestis KIM
caauaagccacgcugugucaau

SEQ ID NO: 2303138 - RNA, 15 nt, Yersinia pestis KIM
caauaaccucagccu

SEQ ID NO: 2303139 - RNA, 17 nt, Yersinia pestis KIM
caauaaccucagccuca

SEQ ID NO: 2303140 - RNA, 22 nt, Yersinia pestis KIM
caauaaccucagccucauucau

SEQ ID NO: 2303141 - RNA, 15 nt, Yersinia pestis KIM
caauaaccucagggc

SEQ ID NO: 2303142 - RNA, 22 nt, Yersinia pestis KIM
caauaaccucagggcgucucua

SEQ ID NO: 2303143 - RNA, 20 nt, Yersinia pestis KIM
caauaaccucaaaaggaugg

SEQ ID NO: 2303144 - RNA, 20 nt, Yersinia pestis KIM
caauaacggaaaaucaucgc

SEQ ID NO: 2303145 - RNA, 19 nt, Yersinia pestis KIM
caauaacguccugaugaug

SEQ ID NO: 2303146 - RNA, 18 nt, Yersinia pestis KIM
caaguuguggauccagca

SEQ ID NO: 2303147 - RNA, 16 nt, Yersinia pestis KIM
caauaccgccacacaa

SEQ ID NO: 2303148 - RNA, 14 nt, Yersinia pestis KIM
caauaccauuuugc

SEQ ID NO: 2303149 - RNA, 14 nt, Yersinia pestis KIM
caauacauagaagc

SEQ ID NO: 2303150 - RNA, 18 nt, Yersinia pestis KIM
caauaauuaauuucacug

SEQ ID NO: 2303151 - RNA, 12 nt, Yersinia pestis KIM
caauacagcaaa

SEQ ID NO: 2303152 - RNA, 15 nt, Yersinia pestis KIM
caauacagcaaauag

SEQ ID NO: 2303153 - RNA, 14 nt, Yersinia pestis KIM
caauaaucucagca

SEQ ID NO: 2303154 - RNA, 22 nt, Yersinia pestis KIM
caauaugaauacgaauuuuuuc

SEQ ID NO: 2303155 - RNA, 18 nt, Yersinia pestis KIM
caauauaaggcuuuauau

SEQ ID NO: 2303156 - RNA, 20 nt, Yersinia pestis KIM
caauauaaggcuuuauauug

SEQ ID NO: 2303157 - RNA, 13 nt, Yersinia pestis KIM
caauauaagagaa

SEQ ID NO: 2303158 - RNA, 13 nt, Yersinia pestis KIM
caauauaauaacu

SEQ ID NO: 2303159 - RNA, 13 nt, Yersinia pestis KIM
caauagaaaagcg

SEQ ID NO: 2303160 - RNA, 15 nt, Yersinia pestis KIM
caauagacaaaagug

SEQ ID NO: 2303161 - RNA, 15 nt, Yersinia pestis KIM
caauaccuuacugca

SEQ ID NO: 2303162 - RNA, 19 nt, Yersinia pestis KIM
caauagcauaaauaucagu

SEQ ID NO: 2303163 - RNA, 14 nt, Yersinia pestis KIM
caauagauaacuga

SEQ ID NO: 2303164 - RNA, 17 nt, Yersinia pestis KIM
caaucaauugcccccau

SEQ ID NO: 2303165 - RNA, 19 nt, Yersinia pestis KIM
caaucaauguauugcucca

SEQ ID NO: 2303166 - RNA, 23 nt, Yersinia pestis KIM
caaucaccggcuggcauuuuuau

SEQ ID NO: 2303167 - RNA, 20 nt, Yersinia pestis KIM
caaucacgguuuaucccccu

SEQ ID NO: 2303168 - RNA, 17 nt, Yersinia pestis KIM
caaucaagcaauaauug

SEQ ID NO: 2303169 - RNA, 16 nt, Yersinia pestis KIM
caaucaauacacuggc

SEQ ID NO: 2303170 - RNA, 16 nt, Yersinia pestis KIM
caaucaauaagcuaca

SEQ ID NO: 2303171 - RNA, 20 nt, Yersinia pestis KIM
caauauguuagcagcacaag

SEQ ID NO: 2303172 - RNA, 16 nt, Yersinia pestis KIM
caauauggguauuagg

SEQ ID NO: 2303173 - RNA, 15 nt, Yersinia pestis KIM
caauaugcaguuuuc

SEQ ID NO: 2303174 - RNA, 23 nt, Yersinia pestis KIM
caagacaacaaacaguaacccag

SEQ ID NO: 2303175 - RNA, 21 nt, Yersinia pestis KIM
caagacgauaucgacgccugu

SEQ ID NO: 2303176 - RNA, 15 nt, Yersinia pestis KIM
caagaugcgugaaau

SEQ ID NO: 2303177 - RNA, 13 nt, Yersinia pestis KIM
caagaugcauauu

SEQ ID NO: 2303178 - RNA, 20 nt, Yersinia pestis KIM
caagaugccuauuugcagaa

SEQ ID NO: 2303179 - RNA, 13 nt, Yersinia pestis KIM
caagaucccaagc

SEQ ID NO: 2303180 - RNA, 17 nt, Yersinia pestis KIM
caagauauuacuucuuu

SEQ ID NO: 2303181 - RNA, 15 nt, Yersinia pestis KIM
caagagugagucauc

SEQ ID NO: 2303182 - RNA, 22 nt, Yersinia pestis KIM
caagagugagucaucgggguuu

SEQ ID NO: 2303183 - RNA, 22 nt, Yersinia pestis KIM
caagaguacuaacgucaacaga

SEQ ID NO: 2303184 - RNA, 14 nt, Yersinia pestis KIM
caagagugagucau

SEQ ID NO: 2303185 - RNA, 13 nt, Yersinia pestis KIM
caagauaaaguuc

SEQ ID NO: 2303186 - RNA, 22 nt, Yersinia pestis KIM
caagagcgauaaccgcacugag

SEQ ID NO: 2303187 - RNA, 16 nt, Yersinia pestis KIM
caacuuuggccaccgc

SEQ ID NO: 2303188 - RNA, 23 nt, Yersinia pestis KIM
caacuuuaauaugcaaaaaaaga

SEQ ID NO: 2303189 - RNA, 14 nt, Yersinia pestis KIM
caagaaaagcaccg

SEQ ID NO: 2303190 - RNA, 18 nt, Yersinia pestis KIM
caacuuuuauuggcauua

SEQ ID NO: 2303191 - RNA, 22 nt, Yersinia pestis KIM
caacucguuaucuucauauaca

SEQ ID NO: 2303192 - RNA, 20 nt, Yersinia pestis KIM
caacucuagcgccagcaauu

SEQ ID NO: 2303193 - RNA, 13 nt, Yersinia pestis KIM
caacuugcuggca

SEQ ID NO: 2303194 - RNA, 22 nt, Yersinia pestis KIM
caacuugugacgccggagaaau

SEQ ID NO: 2303195 - RNA, 22 nt, Yersinia pestis KIM
caagaaacuucauuucagguaa

SEQ ID NO: 2303196 - RNA, 15 nt, Yersinia pestis KIM
caagaaagaaaaaua

SEQ ID NO: 2303197 - RNA, 18 nt, Yersinia pestis KIM
caagaaagaaaaauagac

SEQ ID NO: 2303198 - RNA, 18 nt, Yersinia pestis KIM
caagaaauuuaaaaaccc

SEQ ID NO: 2303199 - RNA, 16 nt, Yersinia pestis KIM
caagaagauaacuuuu

SEQ ID NO: 2303200 - RNA, 15 nt, Yersinia pestis KIM
caagaagauaacuuu

SEQ ID NO: 2303201 - RNA, 19 nt, Yersinia pestis KIM
caagaagacuaaacgcuac

SEQ ID NO: 2303202 - RNA, 22 nt, Yersinia pestis KIM
caagaagcgggcggccucugcu

SEQ ID NO: 2303203 - RNA, 19 nt, Yersinia pestis KIM
caacgguagguucaaccca

SEQ ID NO: 2303204 - RNA, 14 nt, Yersinia pestis KIM
caacggugaacaga

SEQ ID NO: 2303205 - RNA, 23 nt, Yersinia pestis KIM
caacgcauuaccccguugcucua

SEQ ID NO: 2303206 - RNA, 16 nt, Yersinia pestis KIM
caacgccucaucuuca

SEQ ID NO: 2303207 - RNA, 14 nt, Yersinia pestis KIM
caacgcacugaaga

SEQ ID NO: 2303208 - RNA, 18 nt, Yersinia pestis KIM
caacgcgcagugccguca

SEQ ID NO: 2303209 - RNA, 18 nt, Yersinia pestis KIM
caacuccuuaccacugcu

SEQ ID NO: 2303210 - RNA, 21 nt, Yersinia pestis KIM
caacuccuuaccacugcucac

SEQ ID NO: 2303211 - RNA, 22 nt, Yersinia pestis KIM
caacuccuuaccacugcucacu

SEQ ID NO: 2303212 - RNA, 20 nt, Yersinia pestis KIM
caacuccugccuacgcuggc

SEQ ID NO: 2303213 - RNA, 18 nt, Yersinia pestis KIM
caacucgagcauuugacc

SEQ ID NO: 2303214 - RNA, 22 nt, Yersinia pestis KIM
caacuccaucgccacuucuaac

SEQ ID NO: 2303215 - RNA, 17 nt, Yersinia pestis KIM
caacucagcggccuggg

SEQ ID NO: 2303216 - RNA, 17 nt, Yersinia pestis KIM
caacucagugaaaccau

SEQ ID NO: 2303217 - RNA, 23 nt, Yersinia pestis KIM
caacucaucggcguuacaguaag

SEQ ID NO: 2303218 - RNA, 22 nt, Yersinia pestis KIM
caacuauugcaucuuuaauuaa

SEQ ID NO: 2303219 - RNA, 18 nt, Yersinia pestis KIM
caacuauugcaucuuuaa

SEQ ID NO: 2303220 - RNA, 20 nt, Yersinia pestis KIM
caacuaaacagggcagaaaa

SEQ ID NO: 2303221 - RNA, 16 nt, Yersinia pestis KIM
caacgcacaugcaacu

SEQ ID NO: 2303222 - RNA, 21 nt, Yersinia pestis KIM
caacgcaggcacugcagaaaa

SEQ ID NO: 2303223 - RNA, 21 nt, Yersinia pestis KIM
caacgaaaugucgaaagauag

SEQ ID NO: 2303224 - RNA, 22 nt, Yersinia pestis KIM
caaccuuuuccgccaugagaac

SEQ ID NO: 2303225 - RNA, 20 nt, Yersinia pestis KIM
caaccuuuuccgccaugaga

SEQ ID NO: 2303226 - RNA, 17 nt, Yersinia pestis KIM
caacgaauaaaaaagcc

SEQ ID NO: 2303227 - RNA, 14 nt, Yersinia pestis KIM
caacgacagcagca

SEQ ID NO: 2303228 - RNA, 17 nt, Yersinia pestis KIM
caacgaccucaucaccc

SEQ ID NO: 2303229 - RNA, 14 nt, Yersinia pestis KIM
caacgacuccauca

SEQ ID NO: 2303230 - RNA, 19 nt, Yersinia pestis KIM
caaccuguagcucauacuc

SEQ ID NO: 2303231 - RNA, 18 nt, Yersinia pestis KIM
caaccugguuaucggcca

SEQ ID NO: 2303232 - RNA, 16 nt, Yersinia pestis KIM
caaccugcgccaccca

SEQ ID NO: 2303233 - RNA, 19 nt, Yersinia pestis KIM
caaccugaucacgcugaau

SEQ ID NO: 2303234 - RNA, 15 nt, Yersinia pestis KIM
caaccugcaaugccu

SEQ ID NO: 2303235 - RNA, 22 nt, Yersinia pestis KIM
caaccugcaaugccuaaagcca

SEQ ID NO: 2303236 - RNA, 21 nt, Yersinia pestis KIM
caaccuuggugaagaucaaug

SEQ ID NO: 2303237 - RNA, 23 nt, Yersinia pestis KIM
caaccuguuguggaauuaccaca

SEQ ID NO: 2303238 - RNA, 14 nt, Yersinia pestis KIM
caacaucaaaugaa

SEQ ID NO: 2303239 - RNA, 18 nt, Yersinia pestis KIM
caacauaguugaauaacu

SEQ ID NO: 2303240 - RNA, 19 nt, Yersinia pestis KIM
caacauagguuuuuucacu

SEQ ID NO: 2303241 - RNA, 15 nt, Yersinia pestis KIM
caacaucauauauua

SEQ ID NO: 2303242 - RNA, 18 nt, Yersinia pestis KIM
caacauccagauauggca

SEQ ID NO: 2303243 - RNA, 21 nt, Yersinia pestis KIM
auuuuauccucuuccaauugg

SEQ ID NO: 2303244 - RNA, 18 nt, Yersinia pestis KIM
auuuuagguccaggcgcu

SEQ ID NO: 2303245 - RNA, 17 nt, Yersinia pestis KIM
auuuuagugaugauauu

SEQ ID NO: 2303246 - RNA, 20 nt, Yersinia pestis KIM
auuuuagugaugauauuuau

SEQ ID NO: 2303247 - RNA, 12 nt, Yersinia pestis KIM
auuuuaccaaca

SEQ ID NO: 2303248 - RNA, 13 nt, Yersinia pestis KIM
auuuuaccuauuu

SEQ ID NO: 2303249 - RNA, 14 nt, Yersinia pestis KIM
auuuucccucugcc

SEQ ID NO: 2303250 - RNA, 15 nt, Yersinia pestis KIM
auuuucccugugcaa

SEQ ID NO: 2303251 - RNA, 19 nt, Yersinia pestis KIM
auuuucccugugcaaucaa

SEQ ID NO: 2303252 - RNA, 21 nt, Yersinia pestis KIM
auuuucccagugcguacgcca

SEQ ID NO: 2303253 - RNA, 20 nt, Yersinia pestis KIM
auuuuccgcagcucaccuag

SEQ ID NO: 2303254 - RNA, 14 nt, Yersinia pestis KIM
auuuucccuuucuc

SEQ ID NO: 2303255 - RNA, 19 nt, Yersinia pestis KIM
auuuuccgcagcucaccua

SEQ ID NO: 2303256 - RNA, 15 nt, Yersinia pestis KIM
auuuucauuuuaaca

SEQ ID NO: 2303257 - RNA, 16 nt, Yersinia pestis KIM
auuuucauuuuaacaa

SEQ ID NO: 2303258 - RNA, 13 nt, Yersinia pestis KIM
auuuugcugccag

SEQ ID NO: 2303259 - RNA, 23 nt, Yersinia pestis KIM
auuuucuaucucauccagcaacu

SEQ ID NO: 2303260 - RNA, 16 nt, Yersinia pestis KIM
auuuucuacugaauaa

SEQ ID NO: 2303261 - RNA, 18 nt, Yersinia pestis KIM
auuuucuauaccaauuga

SEQ ID NO: 2303262 - RNA, 16 nt, Yersinia pestis KIM
auuuugggcuaaaacu

SEQ ID NO: 2303263 - RNA, 15 nt, Yersinia pestis KIM
auuuugggcaauuua

SEQ ID NO: 2303264 - RNA, 19 nt, Yersinia pestis KIM
auuuugggcaauuuaucaa

SEQ ID NO: 2303265 - RNA, 18 nt, Yersinia pestis KIM
auuuuuaacgucagauaa

SEQ ID NO: 2303266 - RNA, 14 nt, Yersinia pestis KIM
auuuuggcuuucag

SEQ ID NO: 2303267 - RNA, 14 nt, Yersinia pestis KIM
auuuuuaauaaugu

SEQ ID NO: 2303268 - RNA, 16 nt, Yersinia pestis KIM
auuucuguuccaggca

SEQ ID NO: 2303269 - RNA, 13 nt, Yersinia pestis KIM
auuucugccacac

SEQ ID NO: 2303270 - RNA, 21 nt, Yersinia pestis KIM
auuucugguagccugcacuuc

SEQ ID NO: 2303271 - RNA, 16 nt, Yersinia pestis KIM
auuucucuguauuuuc

SEQ ID NO: 2303272 - RNA, 21 nt, Yersinia pestis KIM
auuucucugaugaacggagau

SEQ ID NO: 2303273 - RNA, 15 nt, Yersinia pestis KIM
auuucggcuauuuca

SEQ ID NO: 2303274 - RNA, 15 nt, Yersinia pestis KIM
auuucgguaggaaua

SEQ ID NO: 2303275 - RNA, 19 nt, Yersinia pestis KIM
auuucuacgccgucaucau

SEQ ID NO: 2303276 - RNA, 15 nt, Yersinia pestis KIM
auuugcacauagccc

SEQ ID NO: 2303277 - RNA, 20 nt, Yersinia pestis KIM
auuugaguaagacaacuuau

SEQ ID NO: 2303278 - RNA, 20 nt, Yersinia pestis KIM
auuugaccuccguaggccaa

SEQ ID NO: 2303279 - RNA, 15 nt, Yersinia pestis KIM
auuugcuucguuucc

SEQ ID NO: 2303280 - RNA, 19 nt, Yersinia pestis KIM
auuugcugcugcugugggu

SEQ ID NO: 2303281 - RNA, 17 nt, Yersinia pestis KIM
auuugcugccuguucuc

SEQ ID NO: 2303282 - RNA, 22 nt, Yersinia pestis KIM
auuugccagauugugcuccagc

SEQ ID NO: 2303283 - RNA, 18 nt, Yersinia pestis KIM
auuuuaaucucuccauga

SEQ ID NO: 2303284 - RNA, 23 nt, Yersinia pestis KIM
auuuguuuuugaaucauaauggu

SEQ ID NO: 2303285 - RNA, 19 nt, Yersinia pestis KIM
auuugguuauaucccaaua

SEQ ID NO: 2303286 - RNA, 12 nt, Yersinia pestis KIM
auuuagccgcaa

SEQ ID NO: 2303287 - RNA, 14 nt, Yersinia pestis KIM
auuuaggcgcugag

SEQ ID NO: 2303288 - RNA, 17 nt, Yersinia pestis KIM
auuuacuuauaaacacu

SEQ ID NO: 2303289 - RNA, 14 nt, Yersinia pestis KIM
auuuaucaguagcu

SEQ ID NO: 2303290 - RNA, 21 nt, Yersinia pestis KIM
auuuaucauauuaacauauca

SEQ ID NO: 2303291 - RNA, 22 nt, Yersinia pestis KIM
auuuauauucauauuucacugu

SEQ ID NO: 2303292 - RNA, 16 nt, Yersinia pestis KIM
auuuagguaguuuuau

SEQ ID NO: 2303293 - RNA, 17 nt, Yersinia pestis KIM
auuuagguaguuuuauu

SEQ ID NO: 2303294 - RNA, 22 nt, Yersinia pestis KIM
auuuagguaguuuuauucagag

SEQ ID NO: 2303295 - RNA, 20 nt, Yersinia pestis KIM
auuuacugcauucugagcac

SEQ ID NO: 2303296 - RNA, 13 nt, Yersinia pestis KIM
auuuacucucuuu

SEQ ID NO: 2303297 - RNA, 15 nt, Yersinia pestis KIM
auuuacucucuuuga

SEQ ID NO: 2303298 - RNA, 18 nt, Yersinia pestis KIM
auuuacucguuuuacauu

SEQ ID NO: 2303299 - RNA, 17 nt, Yersinia pestis KIM
auuuacucguuuugcua

SEQ ID NO: 2303300 - RNA, 22 nt, Yersinia pestis KIM
auuuacgcuucgcuguguuuug

SEQ ID NO: 2303301 - RNA, 17 nt, Yersinia pestis KIM
auuuaccuguuugcaac

SEQ ID NO: 2303302 - RNA, 19 nt, Yersinia pestis KIM
auuuaccuguuugcaacau

SEQ ID NO: 2303303 - RNA, 21 nt, Yersinia pestis KIM
auuuaccuguuugcaacauua

SEQ ID NO: 2303304 - RNA, 23 nt, Yersinia pestis KIM
auuuaccuguuugcaacauuauc

SEQ ID NO: 2303305 - RNA, 12 nt, Yersinia pestis KIM
auuuaccugcuc

SEQ ID NO: 2303306 - RNA, 18 nt, Yersinia pestis KIM
auuuaccugcucaacugc

SEQ ID NO: 2303307 - RNA, 20 nt, Yersinia pestis KIM
auuuacaccgugcaauagcu

SEQ ID NO: 2303308 - RNA, 17 nt, Yersinia pestis KIM
auuuacaagccaacauu

SEQ ID NO: 2303309 - RNA, 14 nt, Yersinia pestis KIM
auuuaauguucauu

SEQ ID NO: 2303310 - RNA, 14 nt, Yersinia pestis KIM
auuuaauaacuuaa

SEQ ID NO: 2303311 - RNA, 13 nt, Yersinia pestis KIM
auuuacaaauaac

SEQ ID NO: 2303312 - RNA, 23 nt, Yersinia pestis KIM
auuuacaaauaaccgccaaaaua

SEQ ID NO: 2303313 - RNA, 18 nt, Yersinia pestis KIM
auuuaauuuauccaacug

SEQ ID NO: 2303314 - RNA, 14 nt, Yersinia pestis KIM
auuuaauuucugga

SEQ ID NO: 2303315 - RNA, 12 nt, Yersinia pestis KIM
auuuaagaaauc

SEQ ID NO: 2303316 - RNA, 19 nt, Yersinia pestis KIM
auuuaacuuuaaauccauc

SEQ ID NO: 2303317 - RNA, 19 nt, Yersinia pestis KIM
auuuaagcugaaauuuuuu

SEQ ID NO: 2303318 - RNA, 20 nt, Yersinia pestis KIM
auuuaagcugaaauuuuuua

SEQ ID NO: 2303319 - RNA, 22 nt, Yersinia pestis KIM
auuuaagcugaaauuuuuuaau

SEQ ID NO: 2303320 - RNA, 20 nt, Yersinia pestis KIM
auuguuuucguuuaaaaaau

SEQ ID NO: 2303321 - RNA, 16 nt, Yersinia pestis KIM
auugguuauccuauuc

SEQ ID NO: 2303322 - RNA, 16 nt, Yersinia pestis KIM
auuguuuugacuaaaa

SEQ ID NO: 2303323 - RNA, 17 nt, Yersinia pestis KIM
auuguuuugacuaaaau

SEQ ID NO: 2303324 - RNA, 12 nt, Yersinia pestis KIM
auuuaaaauacu

SEQ ID NO: 2303325 - RNA, 21 nt, Yersinia pestis KIM
auuggucaugaugaauacgau

SEQ ID NO: 2303326 - RNA, 19 nt, Yersinia pestis KIM
auugguacgguuagccuug

SEQ ID NO: 2303327 - RNA, 15 nt, Yersinia pestis KIM
auuggucaauaaaau

SEQ ID NO: 2303328 - RNA, 14 nt, Yersinia pestis KIM
auuggcuagaaauc

SEQ ID NO: 2303329 - RNA, 21 nt, Yersinia pestis KIM
auuggcuagaaaucacacugg

SEQ ID NO: 2303330 - RNA, 20 nt, Yersinia pestis KIM
auugguguuacagcaaggca

SEQ ID NO: 2303331 - RNA, 14 nt, Yersinia pestis KIM
auugguuaacuuau

SEQ ID NO: 2303332 - RNA, 12 nt, Yersinia pestis KIM
auugguuaaguu

SEQ ID NO: 2303333 - RNA, 23 nt, Yersinia pestis KIM
auugguuacccuaagaauugguu

SEQ ID NO: 2303334 - RNA, 16 nt, Yersinia pestis KIM
auuggucgcuuuuuac

SEQ ID NO: 2303335 - RNA, 13 nt, Yersinia pestis KIM
auuucgcccugca

SEQ ID NO: 2303336 - RNA, 14 nt, Yersinia pestis KIM
auuucgaaaacuca

SEQ ID NO: 2303337 - RNA, 14 nt, Yersinia pestis KIM
auuucgaagcaguc

SEQ ID NO: 2303338 - RNA, 22 nt, Yersinia pestis KIM
auuuccuuguggauccagcacc

SEQ ID NO: 2303339 - RNA, 23 nt, Yersinia pestis KIM
auuuccuuucgcacuuuaaauac

SEQ ID NO: 2303340 - RNA, 21 nt, Yersinia pestis KIM
auuuccuuucgcacuuuaaau

SEQ ID NO: 2303341 - RNA, 20 nt, Yersinia pestis KIM
auuuccuuggcagcaauagc

SEQ ID NO: 2303342 - RNA, 13 nt, Yersinia pestis KIM
auuuaugaacacu

SEQ ID NO: 2303343 - RNA, 14 nt, Yersinia pestis KIM
auuuaugaacacuc

SEQ ID NO: 2303344 - RNA, 19 nt, Yersinia pestis KIM
auuucaauucucccauuua

SEQ ID NO: 2303345 - RNA, 20 nt, Yersinia pestis KIM
auuucacacuguuuaguuca

SEQ ID NO: 2303346 - RNA, 17 nt, Yersinia pestis KIM
auuucaccuauaauuaa

SEQ ID NO: 2303347 - RNA, 17 nt, Yersinia pestis KIM
auuucacgcuaauuauu

SEQ ID NO: 2303348 - RNA, 16 nt, Yersinia pestis KIM
auuucacuuccauucc

SEQ ID NO: 2303349 - RNA, 17 nt, Yersinia pestis KIM
auuucacuggcaccgcu

SEQ ID NO: 2303350 - RNA, 13 nt, Yersinia pestis KIM
auuucacguucau

SEQ ID NO: 2303351 - RNA, 19 nt, Yersinia pestis KIM
auuucacguucaucaauac

SEQ ID NO: 2303352 - RNA, 17 nt, Yersinia pestis KIM
auuucaguaaucguuua

SEQ ID NO: 2303353 - RNA, 15 nt, Yersinia pestis KIM
auuucaguuuuuagg

SEQ ID NO: 2303354 - RNA, 23 nt, Yersinia pestis KIM
auuucaguuuuuaggucaauauc

SEQ ID NO: 2303355 - RNA, 17 nt, Yersinia pestis KIM
auuucaguagcaaauaa

SEQ ID NO: 2303356 - RNA, 20 nt, Yersinia pestis KIM
auuucauuuuaaaaucguau

SEQ ID NO: 2303357 - RNA, 15 nt, Yersinia pestis KIM
auucgcgaccagcag

SEQ ID NO: 2303358 - RNA, 19 nt, Yersinia pestis KIM
auucgcggaacaacgccuc

SEQ ID NO: 2303359 - RNA, 13 nt, Yersinia pestis KIM
auucgccagauac

SEQ ID NO: 2303360 - RNA, 21 nt, Yersinia pestis KIM
auucgcaucuuccaaaggaag

SEQ ID NO: 2303361 - RNA, 12 nt, Yersinia pestis KIM
auucgccagggc

SEQ ID NO: 2303362 - RNA, 22 nt, Yersinia pestis KIM
auuccuggccgguguuggauaa

SEQ ID NO: 2303363 - RNA, 15 nt, Yersinia pestis KIM
auucccgccagguuu

SEQ ID NO: 2303364 - RNA, 16 nt, Yersinia pestis KIM
auucccccaguagcac

SEQ ID NO: 2303365 - RNA, 13 nt, Yersinia pestis KIM
auuccccagccca

SEQ ID NO: 2303366 - RNA, 21 nt, Yersinia pestis KIM
auucccguuuuauuacugaua

SEQ ID NO: 2303367 - RNA, 15 nt, Yersinia pestis KIM
auucccguuguuuau

SEQ ID NO: 2303368 - RNA, 14 nt, Yersinia pestis KIM
auucccucaauagc

SEQ ID NO: 2303369 - RNA, 14 nt, Yersinia pestis KIM
auuccgcgccuggg

SEQ ID NO: 2303370 - RNA, 17 nt, Yersinia pestis KIM
auuccgccuguuuucag

SEQ ID NO: 2303371 - RNA, 14 nt, Yersinia pestis KIM
auuccgaugcuugg

SEQ ID NO: 2303372 - RNA, 22 nt, Yersinia pestis KIM
auuccgucgauaucuaagucca

SEQ ID NO: 2303373 - RNA, 16 nt, Yersinia pestis KIM
auuccuauaaauuuua

SEQ ID NO: 2303374 - RNA, 14 nt, Yersinia pestis KIM
auuccuaagcaaau

SEQ ID NO: 2303375 - RNA, 18 nt, Yersinia pestis KIM
auuccucucugaaucacu

SEQ ID NO: 2303376 - RNA, 18 nt, Yersinia pestis KIM
auguugccaaugggccaa

SEQ ID NO: 2303377 - RNA, 17 nt, Yersinia pestis KIM
auucaguacauaaaccg

SEQ ID NO: 2303378 - RNA, 19 nt, Yersinia pestis KIM
auguugcaaacagguaaau

SEQ ID NO: 2303379 - RNA, 15 nt, Yersinia pestis KIM
auguugcauucccaa

SEQ ID NO: 2303380 - RNA, 16 nt, Yersinia pestis KIM
auguugaccaaacaga

SEQ ID NO: 2303381 - RNA, 12 nt, Yersinia pestis KIM
auguucugccaa

SEQ ID NO: 2303382 - RNA, 13 nt, Yersinia pestis KIM
auguucuuuaggu

SEQ ID NO: 2303383 - RNA, 19 nt, Yersinia pestis KIM
auucauaccgcagauaaaa

SEQ ID NO: 2303384 - RNA, 21 nt, Yersinia pestis KIM
auucauacggcgauauuuauu

SEQ ID NO: 2303385 - RNA, 15 nt, Yersinia pestis KIM
auucauagguagaau

SEQ ID NO: 2303386 - RNA, 13 nt, Yersinia pestis KIM
auucauaaaaaaa

SEQ ID NO: 2303387 - RNA, 21 nt, Yersinia pestis KIM
auucaucaccuuauccaauag

SEQ ID NO: 2303388 - RNA, 13 nt, Yersinia pestis KIM
auucaucagcaau

SEQ ID NO: 2303389 - RNA, 14 nt, Yersinia pestis KIM
auucaucagcaauu

SEQ ID NO: 2303390 - RNA, 18 nt, Yersinia pestis KIM
auucaucggcgucaaggu

SEQ ID NO: 2303391 - RNA, 15 nt, Yersinia pestis KIM
auucaucccuaaaau

SEQ ID NO: 2303392 - RNA, 18 nt, Yersinia pestis KIM
auucaucccuaaaaucau

SEQ ID NO: 2303393 - RNA, 20 nt, Yersinia pestis KIM
auucaucagcaauuugcuug

SEQ ID NO: 2303394 - RNA, 18 nt, Yersinia pestis KIM
auucauaucgcucaucau

SEQ ID NO: 2303395 - RNA, 18 nt, Yersinia pestis KIM
auucauaugacaaauaag

SEQ ID NO: 2303396 - RNA, 22 nt, Yersinia pestis KIM
auucaucaacugguugagauaa

SEQ ID NO: 2303397 - RNA, 13 nt, Yersinia pestis KIM
auucaugaggcuc

SEQ ID NO: 2303398 - RNA, 13 nt, Yersinia pestis KIM
auucaugaggcuu

SEQ ID NO: 2303399 - RNA, 14 nt, Yersinia pestis KIM
auucaucuagcuua

SEQ ID NO: 2303400 - RNA, 19 nt, Yersinia pestis KIM
auucaucuuuaacaacaac

SEQ ID NO: 2303401 - RNA, 15 nt, Yersinia pestis KIM
auucaucuuuaacaa

SEQ ID NO: 2303402 - RNA, 20 nt, Yersinia pestis KIM
auucaugugagauaacacau

SEQ ID NO: 2303403 - RNA, 13 nt, Yersinia pestis KIM
auucauugagcaa

SEQ ID NO: 2303404 - RNA, 17 nt, Yersinia pestis KIM
auucauuuuaaaaaaau

SEQ ID NO: 2303405 - RNA, 20 nt, Yersinia pestis KIM
auucauuuuaaaaaaauuaa

SEQ ID NO: 2303406 - RNA, 15 nt, Yersinia pestis KIM
auucauuuuaaaaaa

SEQ ID NO: 2303407 - RNA, 13 nt, Yersinia pestis KIM
auuccaaugaucu

SEQ ID NO: 2303408 - RNA, 15 nt, Yersinia pestis KIM
auucauuuugcugga

SEQ ID NO: 2303409 - RNA, 15 nt, Yersinia pestis KIM
auuccaaaauugcau

SEQ ID NO: 2303410 - RNA, 19 nt, Yersinia pestis KIM
auuccacauaaaauagccc

SEQ ID NO: 2303411 - RNA, 20 nt, Yersinia pestis KIM
auuccaguagggaaucacgc

SEQ ID NO: 2303412 - RNA, 18 nt, Yersinia pestis KIM
auucucaauggcuuuuuu

SEQ ID NO: 2303413 - RNA, 12 nt, Yersinia pestis KIM
auucucaauauu

SEQ ID NO: 2303414 - RNA, 12 nt, Yersinia pestis KIM
auucuagcaaca

SEQ ID NO: 2303415 - RNA, 13 nt, Yersinia pestis KIM
auucuagcaacau

SEQ ID NO: 2303416 - RNA, 17 nt, Yersinia pestis KIM
auucucuggugauacca

SEQ ID NO: 2303417 - RNA, 23 nt, Yersinia pestis KIM
auucucucuuuugagaguucacu

SEQ ID NO: 2303418 - RNA, 22 nt, Yersinia pestis KIM
auucucuauucugcuuuuugcu

SEQ ID NO: 2303419 - RNA, 17 nt, Yersinia pestis KIM
auucugaaucgcugcca

SEQ ID NO: 2303420 - RNA, 18 nt, Yersinia pestis KIM
auucugaaucgcugccau

SEQ ID NO: 2303421 - RNA, 23 nt, Yersinia pestis KIM
auucgugccauaaaguuuuuccu

SEQ ID NO: 2303422 - RNA, 21 nt, Yersinia pestis KIM
auucgugcucaucaaccucag

SEQ ID NO: 2303423 - RNA, 18 nt, Yersinia pestis KIM
auucgugcucaucaaccu

SEQ ID NO: 2303424 - RNA, 13 nt, Yersinia pestis KIM
auucgucugccau

SEQ ID NO: 2303425 - RNA, 18 nt, Yersinia pestis KIM
auucgucaccaucaauau

SEQ ID NO: 2303426 - RNA, 14 nt, Yersinia pestis KIM
auucugaucgaguu

SEQ ID NO: 2303427 - RNA, 23 nt, Yersinia pestis KIM
auucugagcaccacaauaccauu

SEQ ID NO: 2303428 - RNA, 22 nt, Yersinia pestis KIM
auucugagggacagagagauaa

SEQ ID NO: 2303429 - RNA, 20 nt, Yersinia pestis KIM
auucugacggcacucuauuu

SEQ ID NO: 2303430 - RNA, 16 nt, Yersinia pestis KIM
auucuuggguguuuau

SEQ ID NO: 2303431 - RNA, 12 nt, Yersinia pestis KIM
auugaacaugau

SEQ ID NO: 2303432 - RNA, 23 nt, Yersinia pestis KIM
auuggaaguacuuauuugaaaca

SEQ ID NO: 2303433 - RNA, 14 nt, Yersinia pestis KIM
auuggaaugaaaua

SEQ ID NO: 2303434 - RNA, 24 nt, Yersinia pestis KIM
auuggcggaagacuuccagcacca

SEQ ID NO: 2303435 - RNA, 22 nt, Yersinia pestis KIM
auuggccgccaagguugcauug

SEQ ID NO: 2303436 - RNA, 16 nt, Yersinia pestis KIM
auugcugaugucauuc

SEQ ID NO: 2303437 - RNA, 23 nt, Yersinia pestis KIM
auugcugcuguuauuacugucau

SEQ ID NO: 2303438 - RNA, 18 nt, Yersinia pestis KIM
auugcugcuguuauuacu

SEQ ID NO: 2303439 - RNA, 22 nt, Yersinia pestis KIM
auugcugcuguuauuacuguca

SEQ ID NO: 2303440 - RNA, 14 nt, Yersinia pestis KIM
auugcggaguaaca

SEQ ID NO: 2303441 - RNA, 16 nt, Yersinia pestis KIM
auugcugaaaaaaaac

SEQ ID NO: 2303442 - RNA, 22 nt, Yersinia pestis KIM
auugccaucgggcaauugaaaa

SEQ ID NO: 2303443 - RNA, 18 nt, Yersinia pestis KIM
auugccaaaugcaaacca

SEQ ID NO: 2303444 - RNA, 14 nt, Yersinia pestis KIM
auugccacggcauu

SEQ ID NO: 2303445 - RNA, 13 nt, Yersinia pestis KIM
auugccaaaugca

SEQ ID NO: 2303446 - RNA, 13 nt, Yersinia pestis KIM
auugcauauugcu

SEQ ID NO: 2303447 - RNA, 16 nt, Yersinia pestis KIM
auugcauccgcuuuca

SEQ ID NO: 2303448 - RNA, 23 nt, Yersinia pestis KIM
auugcauccgcuuucacauuacc

SEQ ID NO: 2303449 - RNA, 13 nt, Yersinia pestis KIM
auugcaucuuuaa

SEQ ID NO: 2303450 - RNA, 13 nt, Yersinia pestis KIM
auugauaccacaa

SEQ ID NO: 2303451 - RNA, 18 nt, Yersinia pestis KIM
auugauagccacaucauu

SEQ ID NO: 2303452 - RNA, 15 nt, Yersinia pestis KIM
auugaucauucucug

SEQ ID NO: 2303453 - RNA, 17 nt, Yersinia pestis KIM
auugauccaaauggcug

SEQ ID NO: 2303454 - RNA, 15 nt, Yersinia pestis KIM
auugaucacaguaaa

SEQ ID NO: 2303455 - RNA, 12 nt, Yersinia pestis KIM
auugauccaggg

SEQ ID NO: 2303456 - RNA, 23 nt, Yersinia pestis KIM
auugauccucgcgggucaugaaa

SEQ ID NO: 2303457 - RNA, 17 nt, Yersinia pestis KIM
auugaccaauaaaaugc

SEQ ID NO: 2303458 - RNA, 12 nt, Yersinia pestis KIM
auugaccacuug

SEQ ID NO: 2303459 - RNA, 15 nt, Yersinia pestis KIM
auugaccaauaaaau

SEQ ID NO: 2303460 - RNA, 16 nt, Yersinia pestis KIM
auugacaggugguucu

SEQ ID NO: 2303461 - RNA, 14 nt, Yersinia pestis KIM
auugauaaaaccac

SEQ ID NO: 2303462 - RNA, 22 nt, Yersinia pestis KIM
auugauaaaaccacugaccuau

SEQ ID NO: 2303463 - RNA, 13 nt, Yersinia pestis KIM
auugauaaaaccg

SEQ ID NO: 2303464 - RNA, 21 nt, Yersinia pestis KIM
auugaagauacccuucucuuu

SEQ ID NO: 2303465 - RNA, 11 nt, Yersinia pestis KIM
auugaagaguu

SEQ ID NO: 2303466 - RNA, 19 nt, Yersinia pestis KIM
auugaagaguuugaucaug

SEQ ID NO: 2303467 - RNA, 17 nt, Yersinia pestis KIM
auugaauuaaauuuuau

SEQ ID NO: 2303468 - RNA, 14 nt, Yersinia pestis KIM
auugacaaagugcc

SEQ ID NO: 2303469 - RNA, 19 nt, Yersinia pestis KIM
auugacaaagugccugcaa

SEQ ID NO: 2303470 - RNA, 22 nt, Yersinia pestis KIM
auugacacaauagaugcaguaa

SEQ ID NO: 2303471 - RNA, 17 nt, Yersinia pestis KIM
auugacaacgcuauucu

SEQ ID NO: 2303472 - RNA, 11 nt, Yersinia pestis KIM
auugcagauac

SEQ ID NO: 2303473 - RNA, 19 nt, Yersinia pestis KIM
auugcagagcaaaacuggg

SEQ ID NO: 2303474 - RNA, 17 nt, Yersinia pestis KIM
auugcagagcaaaacug

SEQ ID NO: 2303475 - RNA, 15 nt, Yersinia pestis KIM
auugcagagcaaaac

SEQ ID NO: 2303476 - RNA, 14 nt, Yersinia pestis KIM
auugauugcuuacc

SEQ ID NO: 2303477 - RNA, 17 nt, Yersinia pestis KIM
auugcagauaccacauc

SEQ ID NO: 2303478 - RNA, 18 nt, Yersinia pestis KIM
auugcaggaaguuaugga

SEQ ID NO: 2303479 - RNA, 19 nt, Yersinia pestis KIM
auugauggccuugaaucaa

SEQ ID NO: 2303480 - RNA, 15 nt, Yersinia pestis KIM
auugaugcacaguag

SEQ ID NO: 2303481 - RNA, 16 nt, Yersinia pestis KIM
auugaugauuugaccg

SEQ ID NO: 2303482 - RNA, 18 nt, Yersinia pestis KIM
auugaugacgcuaaccac

SEQ ID NO: 2303483 - RNA, 22 nt, Yersinia pestis KIM
cacgccggcuuuuuucucuaca

SEQ ID NO: 2303484 - RNA, 13 nt, Yersinia pestis KIM
cacgcccaauucc

SEQ ID NO: 2303485 - RNA, 15 nt, Yersinia pestis KIM
cacgcccaacucuuu

SEQ ID NO: 2303486 - RNA, 23 nt, Yersinia pestis KIM
cacgccccaacgguaacccgaua

SEQ ID NO: 2303487 - RNA, 18 nt, Yersinia pestis KIM
cacgccaguaaacagcca

SEQ ID NO: 2303488 - RNA, 14 nt, Yersinia pestis KIM
cacgccaguguuca

SEQ ID NO: 2303489 - RNA, 12 nt, Yersinia pestis KIM
cacgcaaauaaa

SEQ ID NO: 2303490 - RNA, 21 nt, Yersinia pestis KIM
cacgcaaauaaagggccugca

SEQ ID NO: 2303491 - RNA, 13 nt, Yersinia pestis KIM
cacgcaaggccag

SEQ ID NO: 2303492 - RNA, 12 nt, Yersinia pestis KIM
cacgcagcagac

SEQ ID NO: 2303493 - RNA, 15 nt, Yersinia pestis KIM
cacgcagcuuuuucu

SEQ ID NO: 2303494 - RNA, 17 nt, Yersinia pestis KIM
cacgcagugcaucuucc

SEQ ID NO: 2303495 - RNA, 22 nt, Yersinia pestis KIM
cacgauaaauucgauaaaaggc

SEQ ID NO: 2303496 - RNA, 19 nt, Yersinia pestis KIM
cacgauaaauucgauaaaa

SEQ ID NO: 2303497 - RNA, 17 nt, Yersinia pestis KIM
cacgauacgacuucuua

SEQ ID NO: 2303498 - RNA, 16 nt, Yersinia pestis KIM
cacggcuuucaauaaa

SEQ ID NO: 2303499 - RNA, 18 nt, Yersinia pestis KIM
cacggcgggcaacagaga

SEQ ID NO: 2303500 - RNA, 18 nt, Yersinia pestis KIM
cacggccgggugcagcgc

SEQ ID NO: 2303501 - RNA, 19 nt, Yersinia pestis KIM
cacggccuauugaauaaca

SEQ ID NO: 2303502 - RNA, 19 nt, Yersinia pestis KIM
cacgcuuaaagcauaacaa

SEQ ID NO: 2303503 - RNA, 14 nt, Yersinia pestis KIM
cacgcuuaaucuuu

SEQ ID NO: 2303504 - RNA, 12 nt, Yersinia pestis KIM
cacggacagcaa

SEQ ID NO: 2303505 - RNA, 20 nt, Yersinia pestis KIM
cacggauuaacuuuucuuca

SEQ ID NO: 2303506 - RNA, 13 nt, Yersinia pestis KIM
cacggauaucaac

SEQ ID NO: 2303507 - RNA, 23 nt, Yersinia pestis KIM
cacgcugggcgaucauuuucugu

SEQ ID NO: 2303508 - RNA, 19 nt, Yersinia pestis KIM
cacgcugggcgaucauuuu

SEQ ID NO: 2303509 - RNA, 15 nt, Yersinia pestis KIM
cacgcuggcgauaaa

SEQ ID NO: 2303510 - RNA, 21 nt, Yersinia pestis KIM
cacgcugaauaacaaaagccc

SEQ ID NO: 2303511 - RNA, 13 nt, Yersinia pestis KIM
cacgcuaauuauu

SEQ ID NO: 2303512 - RNA, 18 nt, Yersinia pestis KIM
cacguaaagaguuaccgu

SEQ ID NO: 2303513 - RNA, 16 nt, Yersinia pestis KIM
cacgucgauaguccuu

SEQ ID NO: 2303514 - RNA, 19 nt, Yersinia pestis KIM
cacgguguguugaaauuug

SEQ ID NO: 2303515 - RNA, 17 nt, Yersinia pestis KIM
cacggugaauaaacccu

SEQ ID NO: 2303516 - RNA, 18 nt, Yersinia pestis KIM
cacgggcgcaauggaaga

SEQ ID NO: 2303517 - RNA, 19 nt, Yersinia pestis KIM
cacgggcuuccaucaggaa

SEQ ID NO: 2303518 - RNA, 20 nt, Yersinia pestis KIM
cacgggcgguaaucugcggc

SEQ ID NO: 2303519 - RNA, 16 nt, Yersinia pestis KIM
cacuaaaucaaaagga

SEQ ID NO: 2303520 - RNA, 15 nt, Yersinia pestis KIM
cacuaaaacugaagc

SEQ ID NO: 2303521 - RNA, 15 nt, Yersinia pestis KIM
cacuacauucugaua

SEQ ID NO: 2303522 - RNA, 12 nt, Yersinia pestis KIM
cacuaauaauaa

SEQ ID NO: 2303523 - RNA, 13 nt, Yersinia pestis KIM
cacuaagugcugg

SEQ ID NO: 2303524 - RNA, 15 nt, Yersinia pestis KIM
cacuaauaauaauua

SEQ ID NO: 2303525 - RNA, 17 nt, Yersinia pestis KIM
cacuaauuagugacagu

SEQ ID NO: 2303526 - RNA, 21 nt, Yersinia pestis KIM
cacguugagugaucaccugag

SEQ ID NO: 2303527 - RNA, 20 nt, Yersinia pestis KIM
cacguuuuucagcuucuucu

SEQ ID NO: 2303528 - RNA, 22 nt, Yersinia pestis KIM
cacguucggcgucgccacccca

SEQ ID NO: 2303529 - RNA, 12 nt, Yersinia pestis KIM
cacugagcaccg

SEQ ID NO: 2303530 - RNA, 13 nt, Yersinia pestis KIM
cacugagcaaaca

SEQ ID NO: 2303531 - RNA, 14 nt, Yersinia pestis KIM
cacugagccgaaga

SEQ ID NO: 2303532 - RNA, 21 nt, Yersinia pestis KIM
cacugagccgaagaacaaauu

SEQ ID NO: 2303533 - RNA, 19 nt, Yersinia pestis KIM
cacugaccuauugauaaaa

SEQ ID NO: 2303534 - RNA, 16 nt, Yersinia pestis KIM
cacugaccuauugaua

SEQ ID NO: 2303535 - RNA, 14 nt, Yersinia pestis KIM
cacugaauaacuga

SEQ ID NO: 2303536 - RNA, 15 nt, Yersinia pestis KIM
cacucuguuuuaaaa

SEQ ID NO: 2303537 - RNA, 17 nt, Yersinia pestis KIM
cacucuguacguaaaua

SEQ ID NO: 2303538 - RNA, 14 nt, Yersinia pestis KIM
cacucugguuuugu

SEQ ID NO: 2303539 - RNA, 20 nt, Yersinia pestis KIM
cacucuggcguugccgugcu

SEQ ID NO: 2303540 - RNA, 20 nt, Yersinia pestis KIM
cacucucuucaucagucacu

SEQ ID NO: 2303541 - RNA, 18 nt, Yersinia pestis KIM
cacucuguuuuaaaaaaa

SEQ ID NO: 2303542 - RNA, 16 nt, Yersinia pestis KIM
cacuccccgucagcau

SEQ ID NO: 2303543 - RNA, 13 nt, Yersinia pestis KIM
cacuccggcauca

SEQ ID NO: 2303544 - RNA, 18 nt, Yersinia pestis KIM
cacucuagcuguguuuua

SEQ ID NO: 2303545 - RNA, 18 nt, Yersinia pestis KIM
cacucgcgacuacagaaa

SEQ ID NO: 2303546 - RNA, 19 nt, Yersinia pestis KIM
cacucgcgacuacagaaaa

SEQ ID NO: 2303547 - RNA, 20 nt, Yersinia pestis KIM
cacuagagcguuacacauca

SEQ ID NO: 2303548 - RNA, 18 nt, Yersinia pestis KIM
cacuagagcguuacacau

SEQ ID NO: 2303549 - RNA, 19 nt, Yersinia pestis KIM
cacuauaauuauuucucug

SEQ ID NO: 2303550 - RNA, 15 nt, Yersinia pestis KIM
cacuauaauuauuuc

SEQ ID NO: 2303551 - RNA, 19 nt, Yersinia pestis KIM
cacuauccccaauucacgc

SEQ ID NO: 2303552 - RNA, 18 nt, Yersinia pestis KIM
cacuauucuccaacaacu

SEQ ID NO: 2303553 - RNA, 20 nt, Yersinia pestis KIM
cacuauucuccaacaacugc

SEQ ID NO: 2303554 - RNA, 18 nt, Yersinia pestis KIM
cacucagcgacuccuggc

SEQ ID NO: 2303555 - RNA, 15 nt, Yersinia pestis KIM
cacucaauuggacua

SEQ ID NO: 2303556 - RNA, 17 nt, Yersinia pestis KIM
cacucacauaagaaagu

SEQ ID NO: 2303557 - RNA, 13 nt, Yersinia pestis KIM
cacucaaugucau

SEQ ID NO: 2303558 - RNA, 11 nt, Yersinia pestis KIM
cacucaccgcc

SEQ ID NO: 2303559 - RNA, 19 nt, Yersinia pestis KIM
cacucaauaaguagccacu

SEQ ID NO: 2303560 - RNA, 13 nt, Yersinia pestis KIM
cacucaagccagu

SEQ ID NO: 2303561 - RNA, 12 nt, Yersinia pestis KIM
cacuauuucaga

SEQ ID NO: 2303562 - RNA, 22 nt, Yersinia pestis KIM
cacuauuucguguauaucacua

SEQ ID NO: 2303563 - RNA, 18 nt, Yersinia pestis KIM
cacuauuuucuacugaau

SEQ ID NO: 2303564 - RNA, 18 nt, Yersinia pestis KIM
cacccgcccugauuuuga

SEQ ID NO: 2303565 - RNA, 20 nt, Yersinia pestis KIM
cacccuaaugaacgaguaaa

SEQ ID NO: 2303566 - RNA, 21 nt, Yersinia pestis KIM
cacccucucuuuccagcaaaa

SEQ ID NO: 2303567 - RNA, 21 nt, Yersinia pestis KIM
caccgaguaaacguggcccuu

SEQ ID NO: 2303568 - RNA, 20 nt, Yersinia pestis KIM
caccgauaaaagugaccaca

SEQ ID NO: 2303569 - RNA, 20 nt, Yersinia pestis KIM
caccgagcaugcuaacuugu

SEQ ID NO: 2303570 - RNA, 13 nt, Yersinia pestis KIM
caccgagcaccaa

SEQ ID NO: 2303571 - RNA, 14 nt, Yersinia pestis KIM
caccggcuaaccac

SEQ ID NO: 2303572 - RNA, 21 nt, Yersinia pestis KIM
caccgcuaaccuuaaccaaca

SEQ ID NO: 2303573 - RNA, 21 nt, Yersinia pestis KIM
caccgcuagcggcaguuauga

SEQ ID NO: 2303574 - RNA, 23 nt, Yersinia pestis KIM
caccgcuggucgggugcaggcca

SEQ ID NO: 2303575 - RNA, 20 nt, Yersinia pestis KIM
caccgccgucaaaccaagcc

SEQ ID NO: 2303576 - RNA, 14 nt, Yersinia pestis KIM
caccugcccgcccc

SEQ ID NO: 2303577 - RNA, 20 nt, Yersinia pestis KIM
caccuccaaaugucaggggg

SEQ ID NO: 2303578 - RNA, 15 nt, Yersinia pestis KIM
caccggggaggaugg

SEQ ID NO: 2303579 - RNA, 19 nt, Yersinia pestis KIM
caccggggugaucaacugc

SEQ ID NO: 2303580 - RNA, 21 nt, Yersinia pestis KIM
caccgguucacgugguuuugu

SEQ ID NO: 2303581 - RNA, 18 nt, Yersinia pestis KIM
caccgguuuacccugcgc

SEQ ID NO: 2303582 - RNA, 14 nt, Yersinia pestis KIM
caccgucaucucua

SEQ ID NO: 2303583 - RNA, 20 nt, Yersinia pestis KIM
caccgugguuugcucuuccc

SEQ ID NO: 2303584 - RNA, 16 nt, Yersinia pestis KIM
caccuaaaaugacgau

SEQ ID NO: 2303585 - RNA, 13 nt, Yersinia pestis KIM
caccucaaacuga

SEQ ID NO: 2303586 - RNA, 16 nt, Yersinia pestis KIM
cacgacuuuuggcccc

SEQ ID NO: 2303587 - RNA, 18 nt, Yersinia pestis KIM
cacgaguugguaaaauau

SEQ ID NO: 2303588 - RNA, 22 nt, Yersinia pestis KIM
cacgaggaaaacgccagcagac

SEQ ID NO: 2303589 - RNA, 13 nt, Yersinia pestis KIM
cacgaggacaggu

SEQ ID NO: 2303590 - RNA, 18 nt, Yersinia pestis KIM
cacgacgcagcuccagcg

SEQ ID NO: 2303591 - RNA, 18 nt, Yersinia pestis KIM
cacgaacaaucgcccccu

SEQ ID NO: 2303592 - RNA, 15 nt, Yersinia pestis KIM
cacgaaaagcagcag

SEQ ID NO: 2303593 - RNA, 16 nt, Yersinia pestis KIM
cacgacaugagcaugc

SEQ ID NO: 2303594 - RNA, 20 nt, Yersinia pestis KIM
cacgacaugagcaugccuga

SEQ ID NO: 2303595 - RNA, 17 nt, Yersinia pestis KIM
cacgaauuuugaggaua

SEQ ID NO: 2303596 - RNA, 20 nt, Yersinia pestis KIM
caccugcuuaguuacaauaa

SEQ ID NO: 2303597 - RNA, 13 nt, Yersinia pestis KIM
caccuggcccugg

SEQ ID NO: 2303598 - RNA, 14 nt, Yersinia pestis KIM
caccuguuaaaaga

SEQ ID NO: 2303599 - RNA, 18 nt, Yersinia pestis KIM
caccuuggaaaacagcaa

SEQ ID NO: 2303600 - RNA, 13 nt, Yersinia pestis KIM
caccuuuaccaug

SEQ ID NO: 2303601 - RNA, 22 nt, Yersinia pestis KIM
caccuuuaccuuuacggccgcu

SEQ ID NO: 2303602 - RNA, 18 nt, Yersinia pestis KIM
caccuucuugguuaguuc

SEQ ID NO: 2303603 - RNA, 21 nt, Yersinia pestis KIM
caccuucugcccguagcaaau

SEQ ID NO: 2303604 - RNA, 13 nt, Yersinia pestis KIM
caccuuccaaacu

SEQ ID NO: 2303605 - RNA, 12 nt, Yersinia pestis KIM
cacccgcaccaa

SEQ ID NO: 2303606 - RNA, 14 nt, Yersinia pestis KIM
cacccaguaacuga

SEQ ID NO: 2303607 - RNA, 15 nt, Yersinia pestis KIM
cacccauaccaacca

SEQ ID NO: 2303608 - RNA, 16 nt, Yersinia pestis KIM
cacccauagcucagcu

SEQ ID NO: 2303609 - RNA, 15 nt, Yersinia pestis KIM
cacccaucaauaauu

SEQ ID NO: 2303610 - RNA, 12 nt, Yersinia pestis KIM
cacccagcaaaa

SEQ ID NO: 2303611 - RNA, 21 nt, Yersinia pestis KIM
cacccauuuuauccucuucca

SEQ ID NO: 2303612 - RNA, 20 nt, Yersinia pestis KIM
cacccauuuuauccucuucc

SEQ ID NO: 2303613 - RNA, 12 nt, Yersinia pestis KIM
cacccauguauc

SEQ ID NO: 2303614 - RNA, 23 nt, Yersinia pestis KIM
cacccaugcucccuccugcccau

SEQ ID NO: 2303615 - RNA, 22 nt, Yersinia pestis KIM
cacccauugcucaaacucagca

SEQ ID NO: 2303616 - RNA, 15 nt, Yersinia pestis KIM
caccaucgcccccug

SEQ ID NO: 2303617 - RNA, 14 nt, Yersinia pestis KIM
caccaucugccugc

SEQ ID NO: 2303618 - RNA, 15 nt, Yersinia pestis KIM
caccaucugccugca

SEQ ID NO: 2303619 - RNA, 17 nt, Yersinia pestis KIM
caccaugaugaaucugu

SEQ ID NO: 2303620 - RNA, 21 nt, Yersinia pestis KIM
caccauguacauggccgugcu

SEQ ID NO: 2303621 - RNA, 15 nt, Yersinia pestis KIM
caccauggaaaauau

SEQ ID NO: 2303622 - RNA, 15 nt, Yersinia pestis KIM
cacccaauaauaaaa

SEQ ID NO: 2303623 - RNA, 21 nt, Yersinia pestis KIM
cacccaauaauaaaaaaaaau

SEQ ID NO: 2303624 - RNA, 14 nt, Yersinia pestis KIM
cacccaauggcaac

SEQ ID NO: 2303625 - RNA, 18 nt, Yersinia pestis KIM
cacccaauggcaacaaaa

SEQ ID NO: 2303626 - RNA, 21 nt, Yersinia pestis KIM
cacccacggcgggcaacagag

SEQ ID NO: 2303627 - RNA, 14 nt, Yersinia pestis KIM
cacccacuuguuca

SEQ ID NO: 2303628 - RNA, 14 nt, Yersinia pestis KIM
caccauuuccaggc

SEQ ID NO: 2303629 - RNA, 17 nt, Yersinia pestis KIM
cacccaagaauauaauu

SEQ ID NO: 2303630 - RNA, 19 nt, Yersinia pestis KIM
cacccaagaauauaauuuc

SEQ ID NO: 2303631 - RNA, 15 nt, Yersinia pestis KIM
caccauuaucuucca

SEQ ID NO: 2303632 - RNA, 13 nt, Yersinia pestis KIM
caccauugaccag

SEQ ID NO: 2303633 - RNA, 16 nt, Yersinia pestis KIM
caccauuaauaauaac

SEQ ID NO: 2303634 - RNA, 21 nt, Yersinia pestis KIM
caccaggcucucauauccccc

SEQ ID NO: 2303635 - RNA, 14 nt, Yersinia pestis KIM
caccagugggaucc

SEQ ID NO: 2303636 - RNA, 23 nt, Yersinia pestis KIM
caccagugccaauccccaccaaa

SEQ ID NO: 2303637 - RNA, 15 nt, Yersinia pestis KIM
caccaguagcccagc

SEQ ID NO: 2303638 - RNA, 14 nt, Yersinia pestis KIM
caccaucaauauaa

SEQ ID NO: 2303639 - RNA, 15 nt, Yersinia pestis KIM
caccauauucccagc

SEQ ID NO: 2303640 - RNA, 21 nt, Yersinia pestis KIM
caccauauucccagccaacuc

SEQ ID NO: 2303641 - RNA, 16 nt, Yersinia pestis KIM
caccauaucagcgccu

SEQ ID NO: 2303642 - RNA, 21 nt, Yersinia pestis KIM
caccauagauuaagaaaacau

SEQ ID NO: 2303643 - RNA, 13 nt, Yersinia pestis KIM
caccauagccacg

SEQ ID NO: 2303644 - RNA, 20 nt, Yersinia pestis KIM
caccaguugaccauuuuuau

SEQ ID NO: 2303645 - RNA, 22 nt, Yersinia pestis KIM
caccauaaaaacuucagagcca

SEQ ID NO: 2303646 - RNA, 21 nt, Yersinia pestis KIM
caccauaaaaacuucagagcc

SEQ ID NO: 2303647 - RNA, 16 nt, Yersinia pestis KIM
caccauaaugugccuc

SEQ ID NO: 2303648 - RNA, 18 nt, Yersinia pestis KIM
caccacugauaggucaua

SEQ ID NO: 2303649 - RNA, 16 nt, Yersinia pestis KIM
caccagaaucaucaga

SEQ ID NO: 2303650 - RNA, 14 nt, Yersinia pestis KIM
caccacuuuccagg

SEQ ID NO: 2303651 - RNA, 13 nt, Yersinia pestis KIM
caccagacaacca

SEQ ID NO: 2303652 - RNA, 22 nt, Yersinia pestis KIM
caccagacaccugauaggcaaa

SEQ ID NO: 2303653 - RNA, 21 nt, Yersinia pestis KIM
caccagacucugcuaccagga

SEQ ID NO: 2303654 - RNA, 16 nt, Yersinia pestis KIM
caccagauugccguca

SEQ ID NO: 2303655 - RNA, 20 nt, Yersinia pestis KIM
caccagauggcgaucaaggu

SEQ ID NO: 2303656 - RNA, 23 nt, Yersinia pestis KIM
caccacggcuuucaauaaaacuc

SEQ ID NO: 2303657 - RNA, 12 nt, Yersinia pestis KIM
caccacggucag

SEQ ID NO: 2303658 - RNA, 18 nt, Yersinia pestis KIM
caccacuaguuaaaacca

SEQ ID NO: 2303659 - RNA, 14 nt, Yersinia pestis KIM
caccacaauauggg

SEQ ID NO: 2303660 - RNA, 14 nt, Yersinia pestis KIM
caccaaugcaucca

SEQ ID NO: 2303661 - RNA, 17 nt, Yersinia pestis KIM
caccaaugcauccaagc

SEQ ID NO: 2303662 - RNA, 20 nt, Yersinia pestis KIM
caccaaugcauccaagccau

SEQ ID NO: 2303663 - RNA, 21 nt, Yersinia pestis KIM
caccaauggcuaaaucaucau

SEQ ID NO: 2303664 - RNA, 15 nt, Yersinia pestis KIM
caccacaaaggcaaa

SEQ ID NO: 2303665 - RNA, 12 nt, Yersinia pestis KIM
cacaucaggccg

SEQ ID NO: 2303666 - RNA, 14 nt, Yersinia pestis KIM
cacaucaauauaaa

SEQ ID NO: 2303667 - RNA, 14 nt, Yersinia pestis KIM
cacaucaaccugau

SEQ ID NO: 2303668 - RNA, 13 nt, Yersinia pestis KIM
cacauaugcagcu

SEQ ID NO: 2303669 - RNA, 22 nt, Yersinia pestis KIM
cacaucccggcagcaguuguca

SEQ ID NO: 2303670 - RNA, 18 nt, Yersinia pestis KIM
cacaucgcccugcucuuc

SEQ ID NO: 2303671 - RNA, 21 nt, Yersinia pestis KIM
cacaucggucaauaccauauc

SEQ ID NO: 2303672 - RNA, 18 nt, Yersinia pestis KIM
cacaucucggcguaaaca

SEQ ID NO: 2303673 - RNA, 19 nt, Yersinia pestis KIM
cacauuaacuucagguuca

SEQ ID NO: 2303674 - RNA, 14 nt, Yersinia pestis KIM
cacauuaauuuauc

SEQ ID NO: 2303675 - RNA, 19 nt, Yersinia pestis KIM
cacaugguuucaaugagca

SEQ ID NO: 2303676 - RNA, 21 nt, Yersinia pestis KIM
cacaugguuucaaugagcaua

SEQ ID NO: 2303677 - RNA, 16 nt, Yersinia pestis KIM
caccaacggccccuca

SEQ ID NO: 2303678 - RNA, 14 nt, Yersinia pestis KIM
caccaacuccugcc

SEQ ID NO: 2303679 - RNA, 15 nt, Yersinia pestis KIM
caccaacuccugccu

SEQ ID NO: 2303680 - RNA, 14 nt, Yersinia pestis KIM
caccaacaccacac

SEQ ID NO: 2303681 - RNA, 14 nt, Yersinia pestis KIM
caccaaaucuucca

SEQ ID NO: 2303682 - RNA, 16 nt, Yersinia pestis KIM
caccaaaucuuccagc

SEQ ID NO: 2303683 - RNA, 18 nt, Yersinia pestis KIM
caccaaaucuuccagcgg

SEQ ID NO: 2303684 - RNA, 19 nt, Yersinia pestis KIM
caccaaaucuuccagcggc

SEQ ID NO: 2303685 - RNA, 17 nt, Yersinia pestis KIM
caccaaaggaagccgag

SEQ ID NO: 2303686 - RNA, 21 nt, Yersinia pestis KIM
caccaauagcgaucagcaacg

SEQ ID NO: 2303687 - RNA, 21 nt, Yersinia pestis KIM
caccaaucauuacaucaucuu

SEQ ID NO: 2303688 - RNA, 16 nt, Yersinia pestis KIM
caccaaugaaugcagg

SEQ ID NO: 2303689 - RNA, 21 nt, Yersinia pestis KIM
caccaauacaaacagggcagc

SEQ ID NO: 2303690 - RNA, 13 nt, Yersinia pestis KIM
caccaagaccagu

SEQ ID NO: 2303691 - RNA, 21 nt, Yersinia pestis KIM
caccaagaccaguucagguau

SEQ ID NO: 2303692 - RNA, 14 nt, Yersinia pestis KIM
cacauucagucacu

SEQ ID NO: 2303693 - RNA, 13 nt, Yersinia pestis KIM
cacauucaggccg

SEQ ID NO: 2303694 - RNA, 12 nt, Yersinia pestis KIM
cacauuauucug

SEQ ID NO: 2303695 - RNA, 19 nt, Yersinia pestis KIM
cacauuccaguaaaaaaau

SEQ ID NO: 2303696 - RNA, 15 nt, Yersinia pestis KIM
cacauugaccagauu

SEQ ID NO: 2303697 - RNA, 17 nt, Yersinia pestis KIM
cacauuucccuuacugu

SEQ ID NO: 2303698 - RNA, 17 nt, Yersinia pestis KIM
caccaaaaacuucaucg

SEQ ID NO: 2303699 - RNA, 20 nt, Yersinia pestis KIM
cacacccucucuuuccagca

SEQ ID NO: 2303700 - RNA, 20 nt, Yersinia pestis KIM
cacaccaucaguacgguuca

SEQ ID NO: 2303701 - RNA, 11 nt, Yersinia pestis KIM
cacaccaucag

SEQ ID NO: 2303702 - RNA, 20 nt, Yersinia pestis KIM
cacacgauuaccugcauauc

SEQ ID NO: 2303703 - RNA, 13 nt, Yersinia pestis KIM
cacaccggcugca

SEQ ID NO: 2303704 - RNA, 15 nt, Yersinia pestis KIM
cacacugagcaccgc

SEQ ID NO: 2303705 - RNA, 22 nt, Yersinia pestis KIM
cacacguguacucauauugucc

SEQ ID NO: 2303706 - RNA, 15 nt, Yersinia pestis KIM
cacacguuaaacccu

SEQ ID NO: 2303707 - RNA, 18 nt, Yersinia pestis KIM
cacacuggcggacaucuu

SEQ ID NO: 2303708 - RNA, 14 nt, Yersinia pestis KIM
cacaauaaaauaag

SEQ ID NO: 2303709 - RNA, 17 nt, Yersinia pestis KIM
cacaauacauagaagcu

SEQ ID NO: 2303710 - RNA, 22 nt, Yersinia pestis KIM
cacaauagcuaccccuucaguc

SEQ ID NO: 2303711 - RNA, 21 nt, Yersinia pestis KIM
cacaaucagggcacucugcuu

SEQ ID NO: 2303712 - RNA, 12 nt, Yersinia pestis KIM
cacaaucuucuu

SEQ ID NO: 2303713 - RNA, 11 nt, Yersinia pestis KIM
cacaaugaauu

SEQ ID NO: 2303714 - RNA, 17 nt, Yersinia pestis KIM
cacacagaaucaccaac

SEQ ID NO: 2303715 - RNA, 19 nt, Yersinia pestis KIM
cacacagcguagacaauga

SEQ ID NO: 2303716 - RNA, 14 nt, Yersinia pestis KIM
cacacagaaucacc

SEQ ID NO: 2303717 - RNA, 12 nt, Yersinia pestis KIM
cacacacuaaua

SEQ ID NO: 2303718 - RNA, 23 nt, Yersinia pestis KIM
cacacacuaauaauaauuaaucu

SEQ ID NO: 2303719 - RNA, 21 nt, Yersinia pestis KIM
cacaauuucaccccgacauuc

SEQ ID NO: 2303720 - RNA, 22 nt, Yersinia pestis KIM
cacaaugcuguuuugucauaaa

SEQ ID NO: 2303721 - RNA, 18 nt, Yersinia pestis KIM
cacaaugccuaaaauggc

SEQ ID NO: 2303722 - RNA, 13 nt, Yersinia pestis KIM
cacaauguugaua

SEQ ID NO: 2303723 - RNA, 23 nt, Yersinia pestis KIM
cacagccugccgggaugacuuuu

SEQ ID NO: 2303724 - RNA, 14 nt, Yersinia pestis KIM
cacagcucucugag

SEQ ID NO: 2303725 - RNA, 16 nt, Yersinia pestis KIM
cacagcccugccuggc

SEQ ID NO: 2303726 - RNA, 14 nt, Yersinia pestis KIM
cacagauaaacaag

SEQ ID NO: 2303727 - RNA, 16 nt, Yersinia pestis KIM
cacagaaucaccaaca

SEQ ID NO: 2303728 - RNA, 13 nt, Yersinia pestis KIM
cacagaaucacca

SEQ ID NO: 2303729 - RNA, 15 nt, Yersinia pestis KIM
cacagauaaauaaaa

SEQ ID NO: 2303730 - RNA, 18 nt, Yersinia pestis KIM
cacagauaaauaaaauaa

SEQ ID NO: 2303731 - RNA, 20 nt, Yersinia pestis KIM
cacagcaaauugcugaaaaa

SEQ ID NO: 2303732 - RNA, 12 nt, Yersinia pestis KIM
cacagcaacagg

SEQ ID NO: 2303733 - RNA, 17 nt, Yersinia pestis KIM
cacagcacgguaaccuu

SEQ ID NO: 2303734 - RNA, 17 nt, Yersinia pestis KIM
cacaggcuuucaggacu

SEQ ID NO: 2303735 - RNA, 19 nt, Yersinia pestis KIM
cacaggcuucgacaggcaa

SEQ ID NO: 2303736 - RNA, 20 nt, Yersinia pestis KIM
cacaggggcgaugucaccau

SEQ ID NO: 2303737 - RNA, 14 nt, Yersinia pestis KIM
cacaguacaaaaaa

SEQ ID NO: 2303738 - RNA, 19 nt, Yersinia pestis KIM
cacagguucccaucccuuu

SEQ ID NO: 2303739 - RNA, 18 nt, Yersinia pestis KIM
cacaggcaggcuguaugc

SEQ ID NO: 2303740 - RNA, 23 nt, Yersinia pestis KIM
cacagucaguucauuacaggccc

SEQ ID NO: 2303741 - RNA, 21 nt, Yersinia pestis KIM
cacaguagaagcuaccagcac

SEQ ID NO: 2303742 - RNA, 22 nt, Yersinia pestis KIM
cacagucugucguacuuuccuu

SEQ ID NO: 2303743 - RNA, 20 nt, Yersinia pestis KIM
cacaguuuucuuaaaauacu

SEQ ID NO: 2303744 - RNA, 17 nt, Yersinia pestis KIM
cacaaacauggcggcag

SEQ ID NO: 2303745 - RNA, 12 nt, Yersinia pestis KIM
cacaaacauggc

SEQ ID NO: 2303746 - RNA, 19 nt, Yersinia pestis KIM
cacaacuuuuauuggcauu

SEQ ID NO: 2303747 - RNA, 19 nt, Yersinia pestis KIM
cacaacgcaucaguaaugu

SEQ ID NO: 2303748 - RNA, 19 nt, Yersinia pestis KIM
cacaacggaaggcccagcc

SEQ ID NO: 2303749 - RNA, 22 nt, Yersinia pestis KIM
cacaacccccccgacccacgcc

SEQ ID NO: 2303750 - RNA, 15 nt, Yersinia pestis KIM
cacaacccgauccag

SEQ ID NO: 2303751 - RNA, 21 nt, Yersinia pestis KIM
caauuucaugcgaauacuuug

SEQ ID NO: 2303752 - RNA, 14 nt, Yersinia pestis KIM
caauuucauuuacg

SEQ ID NO: 2303753 - RNA, 23 nt, Yersinia pestis KIM
caauuucacgcucgcccaugacc

SEQ ID NO: 2303754 - RNA, 17 nt, Yersinia pestis KIM
caauuuacgguccauaa

SEQ ID NO: 2303755 - RNA, 13 nt, Yersinia pestis KIM
caauuuagacagc

SEQ ID NO: 2303756 - RNA, 23 nt, Yersinia pestis KIM
caauuuagacagcuuaaaaucug

SEQ ID NO: 2303757 - RNA, 12 nt, Yersinia pestis KIM
caauuuggccaa

SEQ ID NO: 2303758 - RNA, 14 nt, Yersinia pestis KIM
caauuugcccaucu

SEQ ID NO: 2303759 - RNA, 23 nt, Yersinia pestis KIM
cacaaaaaccggcguaaauaaaa

SEQ ID NO: 2303760 - RNA, 20 nt, Yersinia pestis KIM
caauuuuuugguguccccac

SEQ ID NO: 2303761 - RNA, 13 nt, Yersinia pestis KIM
caauuaaaauugc

SEQ ID NO: 2303762 - RNA, 21 nt, Yersinia pestis KIM
caauuagguugcagcuaaaca

SEQ ID NO: 2303763 - RNA, 16 nt, Yersinia pestis KIM
caauuauuuagccugc

SEQ ID NO: 2303764 - RNA, 20 nt, Yersinia pestis KIM
caauuauuuagccugccaau

SEQ ID NO: 2303765 - RNA, 20 nt, Yersinia pestis KIM
caauuaugacguucaguagu

SEQ ID NO: 2303766 - RNA, 14 nt, Yersinia pestis KIM
caauucacccauac

SEQ ID NO: 2303767 - RNA, 17 nt, Yersinia pestis KIM
caauucagaagacaaua

SEQ ID NO: 2303768 - RNA, 22 nt, Yersinia pestis KIM
caauucuuaggguaaccaaugu

SEQ ID NO: 2303769 - RNA, 15 nt, Yersinia pestis KIM
caauucgcaagaagc

SEQ ID NO: 2303770 - RNA, 20 nt, Yersinia pestis KIM
caauucguuuuucauuuuuc

SEQ ID NO: 2303771 - RNA, 18 nt, Yersinia pestis KIM
caauucauguugccaaug

SEQ ID NO: 2303772 - RNA, 19 nt, Yersinia pestis KIM
caauucaucagcgcuggcu

SEQ ID NO: 2303773 - RNA, 11 nt, Yersinia pestis KIM
caauucaguuu

SEQ ID NO: 2303774 - RNA, 22 nt, Yersinia pestis KIM
caauucccguuagguucaauuc

SEQ ID NO: 2303775 - RNA, 19 nt, Yersinia pestis KIM
caauugaugucaugauaaa

SEQ ID NO: 2303776 - RNA, 20 nt, Yersinia pestis KIM
caauugaguaacugauuaau

SEQ ID NO: 2303777 - RNA, 20 nt, Yersinia pestis KIM
caauuguccguggauuggcu

SEQ ID NO: 2303778 - RNA, 16 nt, Yersinia pestis KIM
aucgacgcgaaauuca

SEQ ID NO: 2303779 - RNA, 19 nt, Yersinia pestis KIM
aucgaccgaguguaaaaag

SEQ ID NO: 2303780 - RNA, 20 nt, Yersinia pestis KIM
aucgaccgaguguaaaaagc

SEQ ID NO: 2303781 - RNA, 23 nt, Yersinia pestis KIM
aucgaccgaguguaaaaagcagu

SEQ ID NO: 2303782 - RNA, 12 nt, Yersinia pestis KIM
aucgaaugauca

SEQ ID NO: 2303783 - RNA, 17 nt, Yersinia pestis KIM
auccuucauuucaggac

SEQ ID NO: 2303784 - RNA, 19 nt, Yersinia pestis KIM
auccuucaagaugcagggc

SEQ ID NO: 2303785 - RNA, 16 nt, Yersinia pestis KIM
auccuugaucgccaaa

SEQ ID NO: 2303786 - RNA, 19 nt, Yersinia pestis KIM
auccuugcuaguuauauaa

SEQ ID NO: 2303787 - RNA, 19 nt, Yersinia pestis KIM
auccuugggucaguuuuau

SEQ ID NO: 2303788 - RNA, 20 nt, Yersinia pestis KIM
auccuuuagcgcugcaucug

SEQ ID NO: 2303789 - RNA, 17 nt, Yersinia pestis KIM
aucgccugaugcuuuuc

SEQ ID NO: 2303790 - RNA, 19 nt, Yersinia pestis KIM
aucgccugaugcuuuucuu

SEQ ID NO: 2303791 - RNA, 16 nt, Yersinia pestis KIM
aucgccagcugcaauu

SEQ ID NO: 2303792 - RNA, 20 nt, Yersinia pestis KIM
aucgacgugaagugagcuga

SEQ ID NO: 2303793 - RNA, 13 nt, Yersinia pestis KIM
aucgagaagaauu

SEQ ID NO: 2303794 - RNA, 20 nt, Yersinia pestis KIM
aucgaucuggauauauuuac

SEQ ID NO: 2303795 - RNA, 22 nt, Yersinia pestis KIM
aucgaugacagcauuauauuau

SEQ ID NO: 2303796 - RNA, 14 nt, Yersinia pestis KIM
aucgccaaagccgu

SEQ ID NO: 2303797 - RNA, 12 nt, Yersinia pestis KIM
aucgccaacacu

SEQ ID NO: 2303798 - RNA, 19 nt, Yersinia pestis KIM
aucgccaauuggucaugau

SEQ ID NO: 2303799 - RNA, 20 nt, Yersinia pestis KIM
aucgcucugcguuuuucccu

SEQ ID NO: 2303800 - RNA, 21 nt, Yersinia pestis KIM
aucgcucugcguuuuucccug

SEQ ID NO: 2303801 - RNA, 11 nt, Yersinia pestis KIM
aucgcuguaug

SEQ ID NO: 2303802 - RNA, 15 nt, Yersinia pestis KIM
aucgcuguaugguau

SEQ ID NO: 2303803 - RNA, 22 nt, Yersinia pestis KIM
aucgccuggcuugaccuugccu

SEQ ID NO: 2303804 - RNA, 13 nt, Yersinia pestis KIM
aucggcagugcca

SEQ ID NO: 2303805 - RNA, 15 nt, Yersinia pestis KIM
aucuaacuaauaaua

SEQ ID NO: 2303806 - RNA, 12 nt, Yersinia pestis KIM
aucguuuuaugg

SEQ ID NO: 2303807 - RNA, 16 nt, Yersinia pestis KIM
aucgucagaaccugca

SEQ ID NO: 2303808 - RNA, 17 nt, Yersinia pestis KIM
aucgucacgaucaacca

SEQ ID NO: 2303809 - RNA, 23 nt, Yersinia pestis KIM
aucgguuugccaucacgcagcag

SEQ ID NO: 2303810 - RNA, 20 nt, Yersinia pestis KIM
aucggcuguuaccaaacauu

SEQ ID NO: 2303811 - RNA, 22 nt, Yersinia pestis KIM
aucggcguuacaguaaggcagc

SEQ ID NO: 2303812 - RNA, 17 nt, Yersinia pestis KIM
auccugccgccucugcu

SEQ ID NO: 2303813 - RNA, 15 nt, Yersinia pestis KIM
auccugcgggccagc

SEQ ID NO: 2303814 - RNA, 16 nt, Yersinia pestis KIM
auccugcaacccacgc

SEQ ID NO: 2303815 - RNA, 22 nt, Yersinia pestis KIM
auccuggccguguuuuucccua

SEQ ID NO: 2303816 - RNA, 20 nt, Yersinia pestis KIM
auccuggccguguuuuuccc

SEQ ID NO: 2303817 - RNA, 23 nt, Yersinia pestis KIM
auccugaacgaggacuuccugcc

SEQ ID NO: 2303818 - RNA, 15 nt, Yersinia pestis KIM
auccugaauccccgc

SEQ ID NO: 2303819 - RNA, 17 nt, Yersinia pestis KIM
auccugauuacguucca

SEQ ID NO: 2303820 - RNA, 15 nt, Yersinia pestis KIM
auccucaucacugcc

SEQ ID NO: 2303821 - RNA, 12 nt, Yersinia pestis KIM
auccucuuccaa

SEQ ID NO: 2303822 - RNA, 17 nt, Yersinia pestis KIM
auccucugaauaaaaaa

SEQ ID NO: 2303823 - RNA, 16 nt, Yersinia pestis KIM
auccgggaaaaaauac

SEQ ID NO: 2303824 - RNA, 22 nt, Yersinia pestis KIM
auccgggaaccccuucaggcca

SEQ ID NO: 2303825 - RNA, 13 nt, Yersinia pestis KIM
auccguagacauu

SEQ ID NO: 2303826 - RNA, 15 nt, Yersinia pestis KIM
auccggugaagaauu

SEQ ID NO: 2303827 - RNA, 16 nt, Yersinia pestis KIM
auccggugaagaauuc

SEQ ID NO: 2303828 - RNA, 19 nt, Yersinia pestis KIM
auccgugcugguccuuuug

SEQ ID NO: 2303829 - RNA, 17 nt, Yersinia pestis KIM
auccguucccacuucca

SEQ ID NO: 2303830 - RNA, 15 nt, Yersinia pestis KIM
auccguuugcaacag

SEQ ID NO: 2303831 - RNA, 22 nt, Yersinia pestis KIM
auccguuuuaacgcugcccaau

SEQ ID NO: 2303832 - RNA, 17 nt, Yersinia pestis KIM
auccguuuuaacgcugc

SEQ ID NO: 2303833 - RNA, 17 nt, Yersinia pestis KIM
auccuacaauaucuucc

SEQ ID NO: 2303834 - RNA, 18 nt, Yersinia pestis KIM
auccucaccguucaagau

SEQ ID NO: 2303835 - RNA, 13 nt, Yersinia pestis KIM
auccucaguaaaa

SEQ ID NO: 2303836 - RNA, 13 nt, Yersinia pestis KIM
auccuauauacaa

SEQ ID NO: 2303837 - RNA, 18 nt, Yersinia pestis KIM
auccuagcguuucuacaa

SEQ ID NO: 2303838 - RNA, 23 nt, Yersinia pestis KIM
auccgcgauaacguuguuucuga

SEQ ID NO: 2303839 - RNA, 16 nt, Yersinia pestis KIM
auccgcagcuuagguu

SEQ ID NO: 2303840 - RNA, 15 nt, Yersinia pestis KIM
auccgcaggaagcaa

SEQ ID NO: 2303841 - RNA, 13 nt, Yersinia pestis KIM
auccgcaccgcua

SEQ ID NO: 2303842 - RNA, 16 nt, Yersinia pestis KIM
auccgcaaaaugggua

SEQ ID NO: 2303843 - RNA, 17 nt, Yersinia pestis KIM
auccgaguuauugauau

SEQ ID NO: 2303844 - RNA, 13 nt, Yersinia pestis KIM
auccgaaaaauau

SEQ ID NO: 2303845 - RNA, 17 nt, Yersinia pestis KIM
auccgaauuuaucuuuu

SEQ ID NO: 2303846 - RNA, 22 nt, Yersinia pestis KIM
aucccugccagaaucagcccca

SEQ ID NO: 2303847 - RNA, 18 nt, Yersinia pestis KIM
aucccugcgguauccuua

SEQ ID NO: 2303848 - RNA, 17 nt, Yersinia pestis KIM
aucccuuacgaucacuu

SEQ ID NO: 2303849 - RNA, 17 nt, Yersinia pestis KIM
aucccuuguucaggcag

SEQ ID NO: 2303850 - RNA, 15 nt, Yersinia pestis KIM
aucccuugacugacc

SEQ ID NO: 2303851 - RNA, 23 nt, Yersinia pestis KIM
aucccuucugaaacuucaaaauc

SEQ ID NO: 2303852 - RNA, 20 nt, Yersinia pestis KIM
aucccuucggcaugcaacuu

SEQ ID NO: 2303853 - RNA, 23 nt, Yersinia pestis KIM
auccccacuuguaccugugccag

SEQ ID NO: 2303854 - RNA, 19 nt, Yersinia pestis KIM
auccccaaacgcugaccau

SEQ ID NO: 2303855 - RNA, 20 nt, Yersinia pestis KIM
auccccaucgccaauacaau

SEQ ID NO: 2303856 - RNA, 17 nt, Yersinia pestis KIM
auccccauggcuuucag

SEQ ID NO: 2303857 - RNA, 12 nt, Yersinia pestis KIM
aucccgagaaac

SEQ ID NO: 2303858 - RNA, 15 nt, Yersinia pestis KIM
auccccuuucugcuc

SEQ ID NO: 2303859 - RNA, 12 nt, Yersinia pestis KIM
auccccugauaa

SEQ ID NO: 2303860 - RNA, 13 nt, Yersinia pestis KIM
aucccgauauaaa

SEQ ID NO: 2303861 - RNA, 14 nt, Yersinia pestis KIM
aucccgugccagau

SEQ ID NO: 2303862 - RNA, 18 nt, Yersinia pestis KIM
aucccgugugauuuccau

SEQ ID NO: 2303863 - RNA, 15 nt, Yersinia pestis KIM
aucccguuccgcuuc

SEQ ID NO: 2303864 - RNA, 15 nt, Yersinia pestis KIM
aucccuauuuuuucc

SEQ ID NO: 2303865 - RNA, 24 nt, Yersinia pestis KIM
auccaguuucaguggcuucucuuc

SEQ ID NO: 2303866 - RNA, 14 nt, Yersinia pestis KIM
auccagugccaacc

SEQ ID NO: 2303867 - RNA, 16 nt, Yersinia pestis KIM
auccaguccggccacg

SEQ ID NO: 2303868 - RNA, 18 nt, Yersinia pestis KIM
auccaggaugguuaucaa

SEQ ID NO: 2303869 - RNA, 15 nt, Yersinia pestis KIM
auccagcgccaucag

SEQ ID NO: 2303870 - RNA, 21 nt, Yersinia pestis KIM
auccagcguaaacaguagcag

SEQ ID NO: 2303871 - RNA, 16 nt, Yersinia pestis KIM
auccagcuacgcaggc

SEQ ID NO: 2303872 - RNA, 23 nt, Yersinia pestis KIM
auccaucauugcuaaauuuugua

SEQ ID NO: 2303873 - RNA, 13 nt, Yersinia pestis KIM
auccaucggaaac

SEQ ID NO: 2303874 - RNA, 20 nt, Yersinia pestis KIM
auccaucccaacaauuugcg

SEQ ID NO: 2303875 - RNA, 22 nt, Yersinia pestis KIM
auccaucugaugaguguuuauu

SEQ ID NO: 2303876 - RNA, 21 nt, Yersinia pestis KIM
auccauauuuggcauguucac

SEQ ID NO: 2303877 - RNA, 22 nt, Yersinia pestis KIM
auccauauuuggcauguucaca

SEQ ID NO: 2303878 - RNA, 17 nt, Yersinia pestis KIM
auccaugagaugauuag

SEQ ID NO: 2303879 - RNA, 23 nt, Yersinia pestis KIM
auccaugccauggcgaaaauccu

SEQ ID NO: 2303880 - RNA, 23 nt, Yersinia pestis KIM
auccauguaggcucgagccgcgc

SEQ ID NO: 2303881 - RNA, 18 nt, Yersinia pestis KIM
auccauuguauugcucag

SEQ ID NO: 2303882 - RNA, 15 nt, Yersinia pestis KIM
aucccaaugaauauu

SEQ ID NO: 2303883 - RNA, 14 nt, Yersinia pestis KIM
aucccaauauugac

SEQ ID NO: 2303884 - RNA, 15 nt, Yersinia pestis KIM
aucccaaucaucauc

SEQ ID NO: 2303885 - RNA, 12 nt, Yersinia pestis KIM
aucccaauauua

SEQ ID NO: 2303886 - RNA, 19 nt, Yersinia pestis KIM
aucccaccaaaccauuggu

SEQ ID NO: 2303887 - RNA, 15 nt, Yersinia pestis KIM
auccauuuucugcca

SEQ ID NO: 2303888 - RNA, 16 nt, Yersinia pestis KIM
auccauuuucugccaa

SEQ ID NO: 2303889 - RNA, 19 nt, Yersinia pestis KIM
aucccacucuguaccgccc

SEQ ID NO: 2303890 - RNA, 14 nt, Yersinia pestis KIM
aucccacugcccga

SEQ ID NO: 2303891 - RNA, 23 nt, Yersinia pestis KIM
aucccacccugaaggcugauuaa

SEQ ID NO: 2303892 - RNA, 14 nt, Yersinia pestis KIM
auccacauucugug

SEQ ID NO: 2303893 - RNA, 15 nt, Yersinia pestis KIM
auccacauaaaaaga

SEQ ID NO: 2303894 - RNA, 23 nt, Yersinia pestis KIM
auccacauauauagagaaaucua

SEQ ID NO: 2303895 - RNA, 12 nt, Yersinia pestis KIM
auccacagcaug

SEQ ID NO: 2303896 - RNA, 15 nt, Yersinia pestis KIM
auccaccauuugggg

SEQ ID NO: 2303897 - RNA, 13 nt, Yersinia pestis KIM
auccaauucagua

SEQ ID NO: 2303898 - RNA, 14 nt, Yersinia pestis KIM
auccaauucaguac

SEQ ID NO: 2303899 - RNA, 19 nt, Yersinia pestis KIM
auccacacaguauucugcu

SEQ ID NO: 2303900 - RNA, 22 nt, Yersinia pestis KIM
auccaaggcggaauagaggaag

SEQ ID NO: 2303901 - RNA, 17 nt, Yersinia pestis KIM
auccaccuggguuccau

SEQ ID NO: 2303902 - RNA, 20 nt, Yersinia pestis KIM
auccagaauuucauugugga

SEQ ID NO: 2303903 - RNA, 21 nt, Yersinia pestis KIM
auccagaauagagaaaucaaa

SEQ ID NO: 2303904 - RNA, 13 nt, Yersinia pestis KIM
auccagaagccau

SEQ ID NO: 2303905 - RNA, 14 nt, Yersinia pestis KIM
auccagaacaccaa

SEQ ID NO: 2303906 - RNA, 13 nt, Yersinia pestis KIM
aucauuggcuuca

SEQ ID NO: 2303907 - RNA, 20 nt, Yersinia pestis KIM
aucauuggcuaucacacaga

SEQ ID NO: 2303908 - RNA, 13 nt, Yersinia pestis KIM
aucauuggcaacu

SEQ ID NO: 2303909 - RNA, 21 nt, Yersinia pestis KIM
aucauugguacagaaaauacu

SEQ ID NO: 2303910 - RNA, 16 nt, Yersinia pestis KIM
aucauucugucaucaa

SEQ ID NO: 2303911 - RNA, 19 nt, Yersinia pestis KIM
aucauugagaucaguucag

SEQ ID NO: 2303912 - RNA, 15 nt, Yersinia pestis KIM
aucauucauuuuaaa

SEQ ID NO: 2303913 - RNA, 22 nt, Yersinia pestis KIM
auccaagccaccaccacggcca

SEQ ID NO: 2303914 - RNA, 15 nt, Yersinia pestis KIM
auccaaggcagauau

SEQ ID NO: 2303915 - RNA, 14 nt, Yersinia pestis KIM
auccaaccaaccau

SEQ ID NO: 2303916 - RNA, 14 nt, Yersinia pestis KIM
auccaaaauaauuc

SEQ ID NO: 2303917 - RNA, 14 nt, Yersinia pestis KIM
auccaaaaagcgcu

SEQ ID NO: 2303918 - RNA, 21 nt, Yersinia pestis KIM
aucauuuucccgccaggaaau

SEQ ID NO: 2303919 - RNA, 12 nt, Yersinia pestis KIM
aucauuuuccug

SEQ ID NO: 2303920 - RNA, 17 nt, Yersinia pestis KIM
aucauuuuccugcauau

SEQ ID NO: 2303921 - RNA, 18 nt, Yersinia pestis KIM
aucauuuuccugcauauu

SEQ ID NO: 2303922 - RNA, 16 nt, Yersinia pestis KIM
aucauuuguuuuuaau

SEQ ID NO: 2303923 - RNA, 13 nt, Yersinia pestis KIM
aucauucaagaaa

SEQ ID NO: 2303924 - RNA, 17 nt, Yersinia pestis KIM
aucauucaauuccugau

SEQ ID NO: 2303925 - RNA, 21 nt, Yersinia pestis KIM
aucauuauuauguauuuuuau

SEQ ID NO: 2303926 - RNA, 13 nt, Yersinia pestis KIM
aucauuauuaugu

SEQ ID NO: 2303927 - RNA, 15 nt, Yersinia pestis KIM
aucauuauagaauuc

SEQ ID NO: 2303928 - RNA, 21 nt, Yersinia pestis KIM
aucauuacguaaucccagaaa

SEQ ID NO: 2303929 - RNA, 15 nt, Yersinia pestis KIM
aucauuacaucaucu

SEQ ID NO: 2303930 - RNA, 20 nt, Yersinia pestis KIM
aucauguaaggcaauaccaa

SEQ ID NO: 2303931 - RNA, 15 nt, Yersinia pestis KIM
aucaugagauaaaua

SEQ ID NO: 2303932 - RNA, 19 nt, Yersinia pestis KIM
aucaugagauaaauauuua

SEQ ID NO: 2303933 - RNA, 21 nt, Yersinia pestis KIM
aucaugaguaaaagauucaua

SEQ ID NO: 2303934 - RNA, 20 nt, Yersinia pestis KIM
aucaugaauaggauagacag

SEQ ID NO: 2303935 - RNA, 22 nt, Yersinia pestis KIM
aucaugaauaggauagacagua

SEQ ID NO: 2303936 - RNA, 18 nt, Yersinia pestis KIM
aucaugcucaaucugcaa

SEQ ID NO: 2303937 - RNA, 15 nt, Yersinia pestis KIM
aucaugcucaccaug

SEQ ID NO: 2303938 - RNA, 19 nt, Yersinia pestis KIM
aucauggcucagauugaac

SEQ ID NO: 2303939 - RNA, 16 nt, Yersinia pestis KIM
aucauccauaaagacg

SEQ ID NO: 2303940 - RNA, 20 nt, Yersinia pestis KIM
aucauccaguuuggcugcca

SEQ ID NO: 2303941 - RNA, 13 nt, Yersinia pestis KIM
aucaucaucacaa

SEQ ID NO: 2303942 - RNA, 19 nt, Yersinia pestis KIM
aucaucaucuuuaauaaua

SEQ ID NO: 2303943 - RNA, 12 nt, Yersinia pestis KIM
aucaucaucaau

SEQ ID NO: 2303944 - RNA, 14 nt, Yersinia pestis KIM
aucaucacaaauaa

SEQ ID NO: 2303945 - RNA, 21 nt, Yersinia pestis KIM
aucaucacauucaaacacuua

SEQ ID NO: 2303946 - RNA, 16 nt, Yersinia pestis KIM
aucaucagacagccau

SEQ ID NO: 2303947 - RNA, 16 nt, Yersinia pestis KIM
aucaucaaauucaggu

SEQ ID NO: 2303948 - RNA, 16 nt, Yersinia pestis KIM
aucaucgcugacaauu

SEQ ID NO: 2303949 - RNA, 23 nt, Yersinia pestis KIM
aucaucgacuugaugaaguuauu

SEQ ID NO: 2303950 - RNA, 13 nt, Yersinia pestis KIM
aucaucgaugccc

SEQ ID NO: 2303951 - RNA, 17 nt, Yersinia pestis KIM
aucauccccuauauacc

SEQ ID NO: 2303952 - RNA, 17 nt, Yersinia pestis KIM
aucaucgguaccgccag

SEQ ID NO: 2303953 - RNA, 14 nt, Yersinia pestis KIM
aucaucuucuucau

SEQ ID NO: 2303954 - RNA, 13 nt, Yersinia pestis KIM
aucauagaaggcg

SEQ ID NO: 2303955 - RNA, 11 nt, Yersinia pestis KIM
aucauauauua

SEQ ID NO: 2303956 - RNA, 13 nt, Yersinia pestis KIM
aucauauauuaaa

SEQ ID NO: 2303957 - RNA, 14 nt, Yersinia pestis KIM
aucauaucaaaaua

SEQ ID NO: 2303958 - RNA, 14 nt, Yersinia pestis KIM
aucauauuaacaua

SEQ ID NO: 2303959 - RNA, 19 nt, Yersinia pestis KIM
aucauauguucgaucaaaa

SEQ ID NO: 2303960 - RNA, 15 nt, Yersinia pestis KIM
aucaguugcaguugg

SEQ ID NO: 2303961 - RNA, 19 nt, Yersinia pestis KIM
aucaguucguucccuguau

SEQ ID NO: 2303962 - RNA, 14 nt, Yersinia pestis KIM
aucauaaaaauaca

SEQ ID NO: 2303963 - RNA, 23 nt, Yersinia pestis KIM
aucagugcaauaaauucaaaaua

SEQ ID NO: 2303964 - RNA, 19 nt, Yersinia pestis KIM
aucaguggcugaaggggcu

SEQ ID NO: 2303965 - RNA, 16 nt, Yersinia pestis KIM
aucagugaagagauaa

SEQ ID NO: 2303966 - RNA, 14 nt, Yersinia pestis KIM
aucagugaagagau

SEQ ID NO: 2303967 - RNA, 16 nt, Yersinia pestis KIM
aucaaucucaucaauc

SEQ ID NO: 2303968 - RNA, 17 nt, Yersinia pestis KIM
aucaauccuacauucag

SEQ ID NO: 2303969 - RNA, 16 nt, Yersinia pestis KIM
aucaaucgagaagaau

SEQ ID NO: 2303970 - RNA, 14 nt, Yersinia pestis KIM
aucaggaucaccag

SEQ ID NO: 2303971 - RNA, 20 nt, Yersinia pestis KIM
aucaggcauuacagacuggc

SEQ ID NO: 2303972 - RNA, 22 nt, Yersinia pestis KIM
aucaggugaacguuggcuucac

SEQ ID NO: 2303973 - RNA, 21 nt, Yersinia pestis KIM
aucaggucgucaguggauggc

SEQ ID NO: 2303974 - RNA, 19 nt, Yersinia pestis KIM
aucaggccuucuuuucucc

SEQ ID NO: 2303975 - RNA, 16 nt, Yersinia pestis KIM
aucaggccuucuuuuc

SEQ ID NO: 2303976 - RNA, 17 nt, Yersinia pestis KIM
aucaggcuuauauuuau

SEQ ID NO: 2303977 - RNA, 19 nt, Yersinia pestis KIM
aucaggcuuauauuuaugc

SEQ ID NO: 2303978 - RNA, 15 nt, Yersinia pestis KIM
aucaggcuguucuug

SEQ ID NO: 2303979 - RNA, 17 nt, Yersinia pestis KIM
augcgcgcgucacuaaa

SEQ ID NO: 2303980 - RNA, 14 nt, Yersinia pestis KIM
augcggaagaaggc

SEQ ID NO: 2303981 - RNA, 22 nt, Yersinia pestis KIM
augcgauacgcccgccccagca

SEQ ID NO: 2303982 - RNA, 14 nt, Yersinia pestis KIM
augcgagcaaggca

SEQ ID NO: 2303983 - RNA, 13 nt, Yersinia pestis KIM
augcgagcaguga

SEQ ID NO: 2303984 - RNA, 13 nt, Yersinia pestis KIM
augcauuauaagg

SEQ ID NO: 2303985 - RNA, 15 nt, Yersinia pestis KIM
augcguuguaauaac

SEQ ID NO: 2303986 - RNA, 17 nt, Yersinia pestis KIM
augcguugaugcucuuc

SEQ ID NO: 2303987 - RNA, 12 nt, Yersinia pestis KIM
augcuaaaaaac

SEQ ID NO: 2303988 - RNA, 19 nt, Yersinia pestis KIM
augcgucuuuagauuucac

SEQ ID NO: 2303989 - RNA, 15 nt, Yersinia pestis KIM
augcguagagucagu

SEQ ID NO: 2303990 - RNA, 21 nt, Yersinia pestis KIM
augcucggugcgguaucaaca

SEQ ID NO: 2303991 - RNA, 17 nt, Yersinia pestis KIM
augcucuucuucacuga

SEQ ID NO: 2303992 - RNA, 21 nt, Yersinia pestis KIM
augcucgcuaaucaagccuuc

SEQ ID NO: 2303993 - RNA, 18 nt, Yersinia pestis KIM
augcuaaccgaauaaaac

SEQ ID NO: 2303994 - RNA, 18 nt, Yersinia pestis KIM
augcuacggauugcaaau

SEQ ID NO: 2303995 - RNA, 11 nt, Yersinia pestis KIM
augcuauauuu

SEQ ID NO: 2303996 - RNA, 12 nt, Yersinia pestis KIM
augcuauauuug

SEQ ID NO: 2303997 - RNA, 21 nt, Yersinia pestis KIM
augcuauauuuggcuuucagc

SEQ ID NO: 2303998 - RNA, 18 nt, Yersinia pestis KIM
augcuauuuacugcauuc

SEQ ID NO: 2303999 - RNA, 14 nt, Yersinia pestis KIM
augcucauuuaaaa

SEQ ID NO: 2304000 - RNA, 11 nt, Yersinia pestis KIM
augcuccagau

SEQ ID NO: 2304001 - RNA, 19 nt, Yersinia pestis KIM
augcuggguauauauacag

SEQ ID NO: 2304002 - RNA, 17 nt, Yersinia pestis KIM
augcuggguauauauac

SEQ ID NO: 2304003 - RNA, 21 nt, Yersinia pestis KIM
augcugaccccaaauuugaau

SEQ ID NO: 2304004 - RNA, 22 nt, Yersinia pestis KIM
augcugaaucuguaagucauuc

SEQ ID NO: 2304005 - RNA, 17 nt, Yersinia pestis KIM
augcugaggauaggccg

SEQ ID NO: 2304006 - RNA, 22 nt, Yersinia pestis KIM
augcugcaguucgacuaucuca

SEQ ID NO: 2304007 - RNA, 22 nt, Yersinia pestis KIM
augcuguuuuuuaguuaaauaa

SEQ ID NO: 2304008 - RNA, 23 nt, Yersinia pestis KIM
augcuguuuuuuaguuaaauaau

SEQ ID NO: 2304009 - RNA, 18 nt, Yersinia pestis KIM
augcuguagcagccugua

SEQ ID NO: 2304010 - RNA, 21 nt, Yersinia pestis KIM
augcuguagcagccuguaggc

SEQ ID NO: 2304011 - RNA, 21 nt, Yersinia pestis KIM
auggaaaauauucuaaguaaa

SEQ ID NO: 2304012 - RNA, 20 nt, Yersinia pestis KIM
auggaaaaauuagccaagca

SEQ ID NO: 2304013 - RNA, 19 nt, Yersinia pestis KIM
auggaaaaaauacaggugu

SEQ ID NO: 2304014 - RNA, 15 nt, Yersinia pestis KIM
augcuuuucuuuccc

SEQ ID NO: 2304015 - RNA, 13 nt, Yersinia pestis KIM
augcuuucaucuu

SEQ ID NO: 2304016 - RNA, 17 nt, Yersinia pestis KIM
auggaaguuaaaaaaau

SEQ ID NO: 2304017 - RNA, 22 nt, Yersinia pestis KIM
auggaauguucauucaaguaaa

SEQ ID NO: 2304018 - RNA, 15 nt, Yersinia pestis KIM
auggaaauagcucaa

SEQ ID NO: 2304019 - RNA, 24 nt, Yersinia pestis KIM
auggaagaaucaccgaaagaagac

SEQ ID NO: 2304020 - RNA, 13 nt, Yersinia pestis KIM
auggacgaacagc

SEQ ID NO: 2304021 - RNA, 17 nt, Yersinia pestis KIM
auggacgaacagcccca

SEQ ID NO: 2304022 - RNA, 14 nt, Yersinia pestis KIM
auggacggcauaua

SEQ ID NO: 2304023 - RNA, 14 nt, Yersinia pestis KIM
auggagagauguug

SEQ ID NO: 2304024 - RNA, 12 nt, Yersinia pestis KIM
auggagaggcgc

SEQ ID NO: 2304025 - RNA, 17 nt, Yersinia pestis KIM
auggagauuuuuuaugu

SEQ ID NO: 2304026 - RNA, 13 nt, Yersinia pestis KIM
auggaucacccgu

SEQ ID NO: 2304027 - RNA, 14 nt, Yersinia pestis KIM
auggauaaugcuga

SEQ ID NO: 2304028 - RNA, 17 nt, Yersinia pestis KIM
auggauggucauaaaau

SEQ ID NO: 2304029 - RNA, 14 nt, Yersinia pestis KIM
auggaugaccaaug

SEQ ID NO: 2304030 - RNA, 12 nt, Yersinia pestis KIM
augugcccuugu

SEQ ID NO: 2304031 - RNA, 14 nt, Yersinia pestis KIM
augugguguuggcg

SEQ ID NO: 2304032 - RNA, 22 nt, Yersinia pestis KIM
augugguguuggcgauaaagcg

SEQ ID NO: 2304033 - RNA, 20 nt, Yersinia pestis KIM
auguguaguugaaguucaca

SEQ ID NO: 2304034 - RNA, 17 nt, Yersinia pestis KIM
auguguaccaaauaaac

SEQ ID NO: 2304035 - RNA, 19 nt, Yersinia pestis KIM
augucucuauucacuauuu

SEQ ID NO: 2304036 - RNA, 20 nt, Yersinia pestis KIM
augucucaggauacaaauga

SEQ ID NO: 2304037 - RNA, 18 nt, Yersinia pestis KIM
augucgucaauuaaaauu

SEQ ID NO: 2304038 - RNA, 20 nt, Yersinia pestis KIM
auguucgcacugcucugccc

SEQ ID NO: 2304039 - RNA, 19 nt, Yersinia pestis KIM
auguucgcacugcucugcc

SEQ ID NO: 2304040 - RNA, 22 nt, Yersinia pestis KIM
auguucgcucccccggaucacu

SEQ ID NO: 2304041 - RNA, 20 nt, Yersinia pestis KIM
auguucucuggguaagaaca

SEQ ID NO: 2304042 - RNA, 21 nt, Yersinia pestis KIM
auguuccugaauggcaucacc

SEQ ID NO: 2304043 - RNA, 20 nt, Yersinia pestis KIM
auguuaucgccaacacuauu

SEQ ID NO: 2304044 - RNA, 14 nt, Yersinia pestis KIM
auguacauuauuca

SEQ ID NO: 2304045 - RNA, 16 nt, Yersinia pestis KIM
auguacacauuauuua

SEQ ID NO: 2304046 - RNA, 15 nt, Yersinia pestis KIM
auguaacacacagca

SEQ ID NO: 2304047 - RNA, 12 nt, Yersinia pestis KIM
auguagccuaug

SEQ ID NO: 2304048 - RNA, 21 nt, Yersinia pestis KIM
auguacgcaaguaucuuaccg

SEQ ID NO: 2304049 - RNA, 23 nt, Yersinia pestis KIM
augucgcuguagcgccagguaag

SEQ ID NO: 2304050 - RNA, 21 nt, Yersinia pestis KIM
augucgcgacucaagccucua

SEQ ID NO: 2304051 - RNA, 21 nt, Yersinia pestis KIM
augucaguggcgguucgcuga

SEQ ID NO: 2304052 - RNA, 15 nt, Yersinia pestis KIM
augucacguuaaguu

SEQ ID NO: 2304053 - RNA, 18 nt, Yersinia pestis KIM
augucaccuccacuucaa

SEQ ID NO: 2304054 - RNA, 13 nt, Yersinia pestis KIM
augucaccuccac

SEQ ID NO: 2304055 - RNA, 12 nt, Yersinia pestis KIM
auggcaacaaaa

SEQ ID NO: 2304056 - RNA, 20 nt, Yersinia pestis KIM
auggauuggcauuuaaaagg

SEQ ID NO: 2304057 - RNA, 18 nt, Yersinia pestis KIM
auggcgaaaauccuucau

SEQ ID NO: 2304058 - RNA, 20 nt, Yersinia pestis KIM
auggcgcaguguaaaaccug

SEQ ID NO: 2304059 - RNA, 18 nt, Yersinia pestis KIM
auggcgaugaugauuauu

SEQ ID NO: 2304060 - RNA, 19 nt, Yersinia pestis KIM
auggcguauugagugucau

SEQ ID NO: 2304061 - RNA, 16 nt, Yersinia pestis KIM
auggcguuguagggag

SEQ ID NO: 2304062 - RNA, 16 nt, Yersinia pestis KIM
auggcugccaucagga

SEQ ID NO: 2304063 - RNA, 19 nt, Yersinia pestis KIM
auggucaggaacccauuug

SEQ ID NO: 2304064 - RNA, 19 nt, Yersinia pestis KIM
auggucaguuguucaccua

SEQ ID NO: 2304065 - RNA, 18 nt, Yersinia pestis KIM
auggucauaaaaucgaua

SEQ ID NO: 2304066 - RNA, 14 nt, Yersinia pestis KIM
auggucauccacaa

SEQ ID NO: 2304067 - RNA, 15 nt, Yersinia pestis KIM
auggucauccacaac

SEQ ID NO: 2304068 - RNA, 18 nt, Yersinia pestis KIM
auggucaggaacccauuu

SEQ ID NO: 2304069 - RNA, 13 nt, Yersinia pestis KIM
auggucacccuca

SEQ ID NO: 2304070 - RNA, 22 nt, Yersinia pestis KIM
auggucaacuaaacagaucacc

SEQ ID NO: 2304071 - RNA, 15 nt, Yersinia pestis KIM
auggcuuauuucacu

SEQ ID NO: 2304072 - RNA, 15 nt, Yersinia pestis KIM
auggcugucugauga

SEQ ID NO: 2304073 - RNA, 20 nt, Yersinia pestis KIM
auggggccaccuaauccaag

SEQ ID NO: 2304074 - RNA, 17 nt, Yersinia pestis KIM
auggcuuuggugaucau

SEQ ID NO: 2304075 - RNA, 20 nt, Yersinia pestis KIM
augggguucgcuauccccac

SEQ ID NO: 2304076 - RNA, 20 nt, Yersinia pestis KIM
augggguaaucccgaaucaa

SEQ ID NO: 2304077 - RNA, 14 nt, Yersinia pestis KIM
auggugaugaucau

SEQ ID NO: 2304078 - RNA, 20 nt, Yersinia pestis KIM
auggugaugaucaugcucac

SEQ ID NO: 2304079 - RNA, 18 nt, Yersinia pestis KIM
augguucaucauuuuuua

SEQ ID NO: 2304080 - RNA, 17 nt, Yersinia pestis KIM
augguugaaugaccaag

SEQ ID NO: 2304081 - RNA, 18 nt, Yersinia pestis KIM
augguugaaugaccaagg

SEQ ID NO: 2304082 - RNA, 23 nt, Yersinia pestis KIM
augaucaaauuauauaagagaug

SEQ ID NO: 2304083 - RNA, 14 nt, Yersinia pestis KIM
augaucaaauuaua

SEQ ID NO: 2304084 - RNA, 20 nt, Yersinia pestis KIM
augaugcuggguauauauac

SEQ ID NO: 2304085 - RNA, 19 nt, Yersinia pestis KIM
augaugcuggguauauaua

SEQ ID NO: 2304086 - RNA, 22 nt, Yersinia pestis KIM
augauuaggcauaaauaauaaa

SEQ ID NO: 2304087 - RNA, 22 nt, Yersinia pestis KIM
augauuauuuauuuacagccac

SEQ ID NO: 2304088 - RNA, 15 nt, Yersinia pestis KIM
augauuauuuuaugg

SEQ ID NO: 2304089 - RNA, 14 nt, Yersinia pestis KIM
augaugauuauuuu

SEQ ID NO: 2304090 - RNA, 17 nt, Yersinia pestis KIM
augaucuugauaaacau

SEQ ID NO: 2304091 - RNA, 15 nt, Yersinia pestis KIM
augaugauaucaccu

SEQ ID NO: 2304092 - RNA, 18 nt, Yersinia pestis KIM
augaucugaugaucaucu

SEQ ID NO: 2304093 - RNA, 14 nt, Yersinia pestis KIM
augcacuccacuau

SEQ ID NO: 2304094 - RNA, 14 nt, Yersinia pestis KIM
augcacuucaccug

SEQ ID NO: 2304095 - RNA, 16 nt, Yersinia pestis KIM
augcagacucuuauau

SEQ ID NO: 2304096 - RNA, 16 nt, Yersinia pestis KIM
augcagauuuuugcuu

SEQ ID NO: 2304097 - RNA, 12 nt, Yersinia pestis KIM
augcauccaagc

SEQ ID NO: 2304098 - RNA, 12 nt, Yersinia pestis KIM
augcauauguag

SEQ ID NO: 2304099 - RNA, 16 nt, Yersinia pestis KIM
augauugaaaaacaga

SEQ ID NO: 2304100 - RNA, 15 nt, Yersinia pestis KIM
augauugauuaucaa

SEQ ID NO: 2304101 - RNA, 16 nt, Yersinia pestis KIM
augcaccuacaaauuu

SEQ ID NO: 2304102 - RNA, 17 nt, Yersinia pestis KIM
augcacccaauggcaac

SEQ ID NO: 2304103 - RNA, 12 nt, Yersinia pestis KIM
augauuuuuaac

SEQ ID NO: 2304104 - RNA, 23 nt, Yersinia pestis KIM
augcaaaauaugguagaauuuac

SEQ ID NO: 2304105 - RNA, 16 nt, Yersinia pestis KIM
augagcuuaugcgucu

SEQ ID NO: 2304106 - RNA, 14 nt, Yersinia pestis KIM
augagcuguagaac

SEQ ID NO: 2304107 - RNA, 19 nt, Yersinia pestis KIM
augagcuggcaaaacucag

SEQ ID NO: 2304108 - RNA, 13 nt, Yersinia pestis KIM
augagcugaguaa

SEQ ID NO: 2304109 - RNA, 15 nt, Yersinia pestis KIM
augagcgcuguugca

SEQ ID NO: 2304110 - RNA, 17 nt, Yersinia pestis KIM
augacuccugaaauaaa

SEQ ID NO: 2304111 - RNA, 13 nt, Yersinia pestis KIM
augacuagcgagc

SEQ ID NO: 2304112 - RNA, 19 nt, Yersinia pestis KIM
augacuagguuauaauucc

SEQ ID NO: 2304113 - RNA, 21 nt, Yersinia pestis KIM
augacuaauugugcagcauca

SEQ ID NO: 2304114 - RNA, 18 nt, Yersinia pestis KIM
augacuaauugugcagca

SEQ ID NO: 2304115 - RNA, 17 nt, Yersinia pestis KIM
augauagcgcgagagcg

SEQ ID NO: 2304116 - RNA, 18 nt, Yersinia pestis KIM
augauagcgacacccuca

SEQ ID NO: 2304117 - RNA, 19 nt, Yersinia pestis KIM
augauauacccaccagaga

SEQ ID NO: 2304118 - RNA, 13 nt, Yersinia pestis KIM
augauauagcugu

SEQ ID NO: 2304119 - RNA, 13 nt, Yersinia pestis KIM
augaggcucagac

SEQ ID NO: 2304120 - RNA, 21 nt, Yersinia pestis KIM
augaggcucuucugggcugaa

SEQ ID NO: 2304121 - RNA, 23 nt, Yersinia pestis KIM
augauaagugaauaaaucaaagc

SEQ ID NO: 2304122 - RNA, 23 nt, Yersinia pestis KIM
augaccccgcgugcgcaucaaug

SEQ ID NO: 2304123 - RNA, 16 nt, Yersinia pestis KIM
augacggugauguccg

SEQ ID NO: 2304124 - RNA, 17 nt, Yersinia pestis KIM
augacgggaauauuuac

SEQ ID NO: 2304125 - RNA, 19 nt, Yersinia pestis KIM
augacgggaauauuuacac

SEQ ID NO: 2304126 - RNA, 17 nt, Yersinia pestis KIM
augacggguauauuuau

SEQ ID NO: 2304127 - RNA, 23 nt, Yersinia pestis KIM
augaccuggaagaacagcuuugc

SEQ ID NO: 2304128 - RNA, 23 nt, Yersinia pestis KIM
augacgcuaaccaccgucaccaa

SEQ ID NO: 2304129 - RNA, 18 nt, Yersinia pestis KIM
augaacggauacccagca

SEQ ID NO: 2304130 - RNA, 12 nt, Yersinia pestis KIM
augacaaauaag

SEQ ID NO: 2304131 - RNA, 23 nt, Yersinia pestis KIM
augacaaguugucuguaauaaua

SEQ ID NO: 2304132 - RNA, 15 nt, Yersinia pestis KIM
augacacaauucccg

SEQ ID NO: 2304133 - RNA, 14 nt, Yersinia pestis KIM
augacacaauuccc

SEQ ID NO: 2304134 - RNA, 17 nt, Yersinia pestis KIM
aucuucgguaaauuuau

SEQ ID NO: 2304135 - RNA, 15 nt, Yersinia pestis KIM
aucuuccuuuccauu

SEQ ID NO: 2304136 - RNA, 15 nt, Yersinia pestis KIM
aucuuccaaaggaag

SEQ ID NO: 2304137 - RNA, 16 nt, Yersinia pestis KIM
aucuuccaaaggaagg

SEQ ID NO: 2304138 - RNA, 17 nt, Yersinia pestis KIM
aucuucauugccuucua

SEQ ID NO: 2304139 - RNA, 21 nt, Yersinia pestis KIM
aucuuccagcggcaaauagag

SEQ ID NO: 2304140 - RNA, 19 nt, Yersinia pestis KIM
aucuugcgccgaaauaaaa

SEQ ID NO: 2304141 - RNA, 18 nt, Yersinia pestis KIM
aucuugcaacaacgccuc

SEQ ID NO: 2304142 - RNA, 22 nt, Yersinia pestis KIM
aucuugauucguuuucggugca

SEQ ID NO: 2304143 - RNA, 19 nt, Yersinia pestis KIM
aucuugggcgggaucucca

SEQ ID NO: 2304144 - RNA, 16 nt, Yersinia pestis KIM
aucuuguaguaaccac

SEQ ID NO: 2304145 - RNA, 16 nt, Yersinia pestis KIM
aucuugucguuauuuu

SEQ ID NO: 2304146 - RNA, 17 nt, Yersinia pestis KIM
aucuugugaugaaauua

SEQ ID NO: 2304147 - RNA, 21 nt, Yersinia pestis KIM
aucuugugaugcauauuauaa

SEQ ID NO: 2304148 - RNA, 18 nt, Yersinia pestis KIM
aucuugugucaguaucac

SEQ ID NO: 2304149 - RNA, 19 nt, Yersinia pestis KIM
aucuugugucaguaucacc

SEQ ID NO: 2304150 - RNA, 16 nt, Yersinia pestis KIM
aucuuguuaauuuaaa

SEQ ID NO: 2304151 - RNA, 17 nt, Yersinia pestis KIM
aucuuuauugcuccuua

SEQ ID NO: 2304152 - RNA, 17 nt, Yersinia pestis KIM
aucuuuauuauuauuua

SEQ ID NO: 2304153 - RNA, 13 nt, Yersinia pestis KIM
aucuuuacugcau

SEQ ID NO: 2304154 - RNA, 12 nt, Yersinia pestis KIM
augaaauuaaaa

SEQ ID NO: 2304155 - RNA, 23 nt, Yersinia pestis KIM
aucugguuuuuuuauaaauuacu

SEQ ID NO: 2304156 - RNA, 14 nt, Yersinia pestis KIM
aucuguggugacau

SEQ ID NO: 2304157 - RNA, 12 nt, Yersinia pestis KIM
aucugugauaac

SEQ ID NO: 2304158 - RNA, 23 nt, Yersinia pestis KIM
aucugucuaagugccaguuaaua

SEQ ID NO: 2304159 - RNA, 19 nt, Yersinia pestis KIM
aucugcuuuacugcuuuuc

SEQ ID NO: 2304160 - RNA, 21 nt, Yersinia pestis KIM
aucugcuuuacugcuuuucua

SEQ ID NO: 2304161 - RNA, 23 nt, Yersinia pestis KIM
aucugcuuuugaaacuguuugca

SEQ ID NO: 2304162 - RNA, 15 nt, Yersinia pestis KIM
aucuggauauauuua

SEQ ID NO: 2304163 - RNA, 23 nt, Yersinia pestis KIM
aucugcucauuaccaauaccauu

SEQ ID NO: 2304164 - RNA, 20 nt, Yersinia pestis KIM
aucugcuccaggcgcucagg

SEQ ID NO: 2304165 - RNA, 22 nt, Yersinia pestis KIM
aucugcugcuuuaggugguuca

SEQ ID NO: 2304166 - RNA, 18 nt, Yersinia pestis KIM
aucuaacucauucauaau

SEQ ID NO: 2304167 - RNA, 13 nt, Yersinia pestis KIM
aucuaacucuucc

SEQ ID NO: 2304168 - RNA, 20 nt, Yersinia pestis KIM
aucuaacuggcccucuuuuu

SEQ ID NO: 2304169 - RNA, 14 nt, Yersinia pestis KIM
aucuaaguccaaga

SEQ ID NO: 2304170 - RNA, 18 nt, Yersinia pestis KIM
aucuaaugguuguuaauu

SEQ ID NO: 2304171 - RNA, 22 nt, Yersinia pestis KIM
aucuaauguauuuauucaaaaa

SEQ ID NO: 2304172 - RNA, 14 nt, Yersinia pestis KIM
aucuuaaucacgau

SEQ ID NO: 2304173 - RNA, 17 nt, Yersinia pestis KIM
aucuguuuuugccaccu

SEQ ID NO: 2304174 - RNA, 13 nt, Yersinia pestis KIM
aucuuaaaaauaa

SEQ ID NO: 2304175 - RNA, 14 nt, Yersinia pestis KIM
aucuguuucaaaua

SEQ ID NO: 2304176 - RNA, 16 nt, Yersinia pestis KIM
aucuguuucaaauaag

SEQ ID NO: 2304177 - RNA, 12 nt, Yersinia pestis KIM
aucuguuauaaa

SEQ ID NO: 2304178 - RNA, 21 nt, Yersinia pestis KIM
aucuucauauacagaagagua

SEQ ID NO: 2304179 - RNA, 22 nt, Yersinia pestis KIM
aucuucagaaacggugaaaaua

SEQ ID NO: 2304180 - RNA, 17 nt, Yersinia pestis KIM
aucuuauccacagcaug

SEQ ID NO: 2304181 - RNA, 13 nt, Yersinia pestis KIM
auauauccaaaau

SEQ ID NO: 2304182 - RNA, 15 nt, Yersinia pestis KIM
auauauccaaaauaa

SEQ ID NO: 2304183 - RNA, 17 nt, Yersinia pestis KIM
auauauccaaaauaauu

SEQ ID NO: 2304184 - RNA, 19 nt, Yersinia pestis KIM
auauauccaggcacugcca

SEQ ID NO: 2304185 - RNA, 18 nt, Yersinia pestis KIM
auaucccaauaauagcua

SEQ ID NO: 2304186 - RNA, 18 nt, Yersinia pestis KIM
auaucauggccauggaaa

SEQ ID NO: 2304187 - RNA, 16 nt, Yersinia pestis KIM
auaucgcuaaaacaca

SEQ ID NO: 2304188 - RNA, 20 nt, Yersinia pestis KIM
auauccugcgucucuaaccc

SEQ ID NO: 2304189 - RNA, 17 nt, Yersinia pestis KIM
auauccugcucagcuaa

SEQ ID NO: 2304190 - RNA, 20 nt, Yersinia pestis KIM
auauccgugauuaaccuuaa

SEQ ID NO: 2304191 - RNA, 17 nt, Yersinia pestis KIM
auauccggugucaggau

SEQ ID NO: 2304192 - RNA, 20 nt, Yersinia pestis KIM
auaugcgccuauaaggcucu

SEQ ID NO: 2304193 - RNA, 22 nt, Yersinia pestis KIM
auaugcgcuggcucuauuuucc

SEQ ID NO: 2304194 - RNA, 17 nt, Yersinia pestis KIM
auaugcggcauaacuga

SEQ ID NO: 2304195 - RNA, 13 nt, Yersinia pestis KIM
auaugcuuauaaa

SEQ ID NO: 2304196 - RNA, 16 nt, Yersinia pestis KIM
auaugcuuauaaaccu

SEQ ID NO: 2304197 - RNA, 12 nt, Yersinia pestis KIM
auaugcugaaua

SEQ ID NO: 2304198 - RNA, 22 nt, Yersinia pestis KIM
auauggaugaugcacagcugga

SEQ ID NO: 2304199 - RNA, 22 nt, Yersinia pestis KIM
auauggauuggcauuuaaaagg

SEQ ID NO: 2304200 - RNA, 16 nt, Yersinia pestis KIM
auaugaagcacaaaaa

SEQ ID NO: 2304201 - RNA, 16 nt, Yersinia pestis KIM
auaucucaguugaaac

SEQ ID NO: 2304202 - RNA, 13 nt, Yersinia pestis KIM
auaucuauuucca

SEQ ID NO: 2304203 - RNA, 14 nt, Yersinia pestis KIM
auaucuccguugaa

SEQ ID NO: 2304204 - RNA, 19 nt, Yersinia pestis KIM
auaucugccaauucaaggc

SEQ ID NO: 2304205 - RNA, 14 nt, Yersinia pestis KIM
auaucugcauaacu

SEQ ID NO: 2304206 - RNA, 13 nt, Yersinia pestis KIM
auaucucuuuauc

SEQ ID NO: 2304207 - RNA, 14 nt, Yersinia pestis KIM
auagucguuauaua

SEQ ID NO: 2304208 - RNA, 21 nt, Yersinia pestis KIM
auaguuaugaugaguaacaua

SEQ ID NO: 2304209 - RNA, 17 nt, Yersinia pestis KIM
auaguuaaucgcagcag

SEQ ID NO: 2304210 - RNA, 21 nt, Yersinia pestis KIM
auagucuuuuuaauaugugac

SEQ ID NO: 2304211 - RNA, 17 nt, Yersinia pestis KIM
auagucuuggaugcguu

SEQ ID NO: 2304212 - RNA, 15 nt, Yersinia pestis KIM
auauaaaccagccag

SEQ ID NO: 2304213 - RNA, 12 nt, Yersinia pestis KIM
auauaaauaaaa

SEQ ID NO: 2304214 - RNA, 15 nt, Yersinia pestis KIM
auauaaacauaaaaa

SEQ ID NO: 2304215 - RNA, 14 nt, Yersinia pestis KIM
auauaaaccagcca

SEQ ID NO: 2304216 - RNA, 15 nt, Yersinia pestis KIM
auagucaucuuucca

SEQ ID NO: 2304217 - RNA, 19 nt, Yersinia pestis KIM
auagucauauauuuuucuu

SEQ ID NO: 2304218 - RNA, 13 nt, Yersinia pestis KIM
auagucaucuuuc

SEQ ID NO: 2304219 - RNA, 13 nt, Yersinia pestis KIM
auagccuuuuugc

SEQ ID NO: 2304220 - RNA, 19 nt, Yersinia pestis KIM
auagcgcaauucagccuca

SEQ ID NO: 2304221 - RNA, 17 nt, Yersinia pestis KIM
auagcgcauccaaccug

SEQ ID NO: 2304222 - RNA, 19 nt, Yersinia pestis KIM
auagcgcauccaaccugca

SEQ ID NO: 2304223 - RNA, 13 nt, Yersinia pestis KIM
auauauagaaaua

SEQ ID NO: 2304224 - RNA, 14 nt, Yersinia pestis KIM
auauauagaaauaa

SEQ ID NO: 2304225 - RNA, 22 nt, Yersinia pestis KIM
auauaggaaaugucguacaucu

SEQ ID NO: 2304226 - RNA, 13 nt, Yersinia pestis KIM
auauaggcgucau

SEQ ID NO: 2304227 - RNA, 18 nt, Yersinia pestis KIM
auauacauauucacuaua

SEQ ID NO: 2304228 - RNA, 22 nt, Yersinia pestis KIM
auauacccgucauaaauaaaga

SEQ ID NO: 2304229 - RNA, 14 nt, Yersinia pestis KIM
auauacccaccaga

SEQ ID NO: 2304230 - RNA, 23 nt, Yersinia pestis KIM
auauagagcucagcuucaggcca

SEQ ID NO: 2304231 - RNA, 13 nt, Yersinia pestis KIM
auauagagcucag

SEQ ID NO: 2304232 - RNA, 14 nt, Yersinia pestis KIM
auauagagaaaucu

SEQ ID NO: 2304233 - RNA, 14 nt, Yersinia pestis KIM
auauagagauaaaa

SEQ ID NO: 2304234 - RNA, 21 nt, Yersinia pestis KIM
auauacggcggcuacugguag

SEQ ID NO: 2304235 - RNA, 17 nt, Yersinia pestis KIM
auauaaugcugaaugaa

SEQ ID NO: 2304236 - RNA, 14 nt, Yersinia pestis KIM
auauaaauaaaaua

SEQ ID NO: 2304237 - RNA, 17 nt, Yersinia pestis KIM
auauaaaugauugcuau

SEQ ID NO: 2304238 - RNA, 17 nt, Yersinia pestis KIM
auauuacucucuauuga

SEQ ID NO: 2304239 - RNA, 21 nt, Yersinia pestis KIM
auauuacggcccuccugacga

SEQ ID NO: 2304240 - RNA, 16 nt, Yersinia pestis KIM
auauuacaguuuaauu

SEQ ID NO: 2304241 - RNA, 18 nt, Yersinia pestis KIM
auauuaacauaucaauaa

SEQ ID NO: 2304242 - RNA, 12 nt, Yersinia pestis KIM
auauuaaaauag

SEQ ID NO: 2304243 - RNA, 22 nt, Yersinia pestis KIM
auauuaaaugcauuauaaggaa

SEQ ID NO: 2304244 - RNA, 15 nt, Yersinia pestis KIM
auauggguuaaugcu

SEQ ID NO: 2304245 - RNA, 15 nt, Yersinia pestis KIM
auauggguuaaaaac

SEQ ID NO: 2304246 - RNA, 15 nt, Yersinia pestis KIM
auaugggcauccauc

SEQ ID NO: 2304247 - RNA, 20 nt, Yersinia pestis KIM
auaugucagauagaccaaug

SEQ ID NO: 2304248 - RNA, 16 nt, Yersinia pestis KIM
auauuaaaaaagggag

SEQ ID NO: 2304249 - RNA, 13 nt, Yersinia pestis KIM
auauuuacgcaua

SEQ ID NO: 2304250 - RNA, 18 nt, Yersinia pestis KIM
auauuuaauugagaauua

SEQ ID NO: 2304251 - RNA, 17 nt, Yersinia pestis KIM
auauuuauccauuuaau

SEQ ID NO: 2304252 - RNA, 16 nt, Yersinia pestis KIM
auauugcucugccgca

SEQ ID NO: 2304253 - RNA, 18 nt, Yersinia pestis KIM
auauuggauaauaaccug

SEQ ID NO: 2304254 - RNA, 15 nt, Yersinia pestis KIM
auauuggcaacaaca

SEQ ID NO: 2304255 - RNA, 23 nt, Yersinia pestis KIM
auauuggcaacaacagauaaagc

SEQ ID NO: 2304256 - RNA, 19 nt, Yersinia pestis KIM
auauuggggggcaguuuuu

SEQ ID NO: 2304257 - RNA, 19 nt, Yersinia pestis KIM
auauugggccggagauaga

SEQ ID NO: 2304258 - RNA, 14 nt, Yersinia pestis KIM
auauucauuaaaaa

SEQ ID NO: 2304259 - RNA, 19 nt, Yersinia pestis KIM
auauucauuaaaaaauaau

SEQ ID NO: 2304260 - RNA, 13 nt, Yersinia pestis KIM
auauucauuagag

SEQ ID NO: 2304261 - RNA, 12 nt, Yersinia pestis KIM
auauucauucuu

SEQ ID NO: 2304262 - RNA, 14 nt, Yersinia pestis KIM
auauucauucuuau

SEQ ID NO: 2304263 - RNA, 13 nt, Yersinia pestis KIM
auauuccaaaaaa

SEQ ID NO: 2304264 - RNA, 16 nt, Yersinia pestis KIM
auauuccaaaaaauag

SEQ ID NO: 2304265 - RNA, 14 nt, Yersinia pestis KIM
auauuauaaugaaa

SEQ ID NO: 2304266 - RNA, 17 nt, Yersinia pestis KIM
auauuauaaugaaauag

SEQ ID NO: 2304267 - RNA, 16 nt, Yersinia pestis KIM
auauuaucauucaaga

SEQ ID NO: 2304268 - RNA, 16 nt, Yersinia pestis KIM
auauuaucuauacuaa

SEQ ID NO: 2304269 - RNA, 20 nt, Yersinia pestis KIM
auauugaauaaccuacucca

SEQ ID NO: 2304270 - RNA, 17 nt, Yersinia pestis KIM
auauugaauuaaauuuu

SEQ ID NO: 2304271 - RNA, 18 nt, Yersinia pestis KIM
auauugaauuaaauuuua

SEQ ID NO: 2304272 - RNA, 14 nt, Yersinia pestis KIM
auauucccagccaa

SEQ ID NO: 2304273 - RNA, 21 nt, Yersinia pestis KIM
aucaacugccuguucuggcaa

SEQ ID NO: 2304274 - RNA, 20 nt, Yersinia pestis KIM
aucaacguagcugaauugcu

SEQ ID NO: 2304275 - RNA, 14 nt, Yersinia pestis KIM
aucaacaggccacc

SEQ ID NO: 2304276 - RNA, 16 nt, Yersinia pestis KIM
aucaacagauuuucca

SEQ ID NO: 2304277 - RNA, 13 nt, Yersinia pestis KIM
aucaacacugccu

SEQ ID NO: 2304278 - RNA, 20 nt, Yersinia pestis KIM
aucaacagaacuaaacgcca

SEQ ID NO: 2304279 - RNA, 20 nt, Yersinia pestis KIM
aucaauaccuuacugcauca

SEQ ID NO: 2304280 - RNA, 16 nt, Yersinia pestis KIM
aucaauacugcaaaug

SEQ ID NO: 2304281 - RNA, 16 nt, Yersinia pestis KIM
aucaauaccuuacugc

SEQ ID NO: 2304282 - RNA, 16 nt, Yersinia pestis KIM
aucaauaaagcuggcu

SEQ ID NO: 2304283 - RNA, 13 nt, Yersinia pestis KIM
aucaauaaccuga

SEQ ID NO: 2304284 - RNA, 13 nt, Yersinia pestis KIM
aucaagaucaaaa

SEQ ID NO: 2304285 - RNA, 17 nt, Yersinia pestis KIM
aucaacuuugguuuuug

SEQ ID NO: 2304286 - RNA, 16 nt, Yersinia pestis KIM
aucaacuuucaccccu

SEQ ID NO: 2304287 - RNA, 19 nt, Yersinia pestis KIM
aucaagaaaacagguaaug

SEQ ID NO: 2304288 - RNA, 11 nt, Yersinia pestis KIM
auauuucucuu

SEQ ID NO: 2304289 - RNA, 15 nt, Yersinia pestis KIM
aucaaaagcaagacc

SEQ ID NO: 2304290 - RNA, 14 nt, Yersinia pestis KIM
aucaaaauaucggu

SEQ ID NO: 2304291 - RNA, 12 nt, Yersinia pestis KIM
aucaaaaugacc

SEQ ID NO: 2304292 - RNA, 17 nt, Yersinia pestis KIM
aucaaaacugauuaaua

SEQ ID NO: 2304293 - RNA, 17 nt, Yersinia pestis KIM
aucaaaggcgaccaaug

SEQ ID NO: 2304294 - RNA, 16 nt, Yersinia pestis KIM
aucaaaggagugcccg

SEQ ID NO: 2304295 - RNA, 19 nt, Yersinia pestis KIM
auacaccucaacgugauau

SEQ ID NO: 2304296 - RNA, 21 nt, Yersinia pestis KIM
auacaccuucuuuaucugucc

SEQ ID NO: 2304297 - RNA, 23 nt, Yersinia pestis KIM
auacaauuuuuggucguauucau

SEQ ID NO: 2304298 - RNA, 11 nt, Yersinia pestis KIM
auacaauuuuu

SEQ ID NO: 2304299 - RNA, 20 nt, Yersinia pestis KIM
auacaauugccugauuuuua

SEQ ID NO: 2304300 - RNA, 17 nt, Yersinia pestis KIM
auacaccauuuccaggc

SEQ ID NO: 2304301 - RNA, 23 nt, Yersinia pestis KIM
auacaccauuuccaggcuaccaa

SEQ ID NO: 2304302 - RNA, 23 nt, Yersinia pestis KIM
auacacagcacggcaacaggcuu

SEQ ID NO: 2304303 - RNA, 17 nt, Yersinia pestis KIM
auacacaugaaaaucaa

SEQ ID NO: 2304304 - RNA, 21 nt, Yersinia pestis KIM
auaauuuuuacgauaucacca

SEQ ID NO: 2304305 - RNA, 18 nt, Yersinia pestis KIM
auacaaaaagcgacuaau

SEQ ID NO: 2304306 - RNA, 18 nt, Yersinia pestis KIM
auacaaccaacaaacaau

SEQ ID NO: 2304307 - RNA, 21 nt, Yersinia pestis KIM
auacaaauauuacgaaugagu

SEQ ID NO: 2304308 - RNA, 18 nt, Yersinia pestis KIM
auacaaggcacaucucca

SEQ ID NO: 2304309 - RNA, 15 nt, Yersinia pestis KIM
auacauaucaacacu

SEQ ID NO: 2304310 - RNA, 18 nt, Yersinia pestis KIM
auacauauaaccaucaaa

SEQ ID NO: 2304311 - RNA, 17 nt, Yersinia pestis KIM
auacauagaagcucaua

SEQ ID NO: 2304312 - RNA, 21 nt, Yersinia pestis KIM
auacaucgccaguguugccau

SEQ ID NO: 2304313 - RNA, 16 nt, Yersinia pestis KIM
auacaucaauggguuu

SEQ ID NO: 2304314 - RNA, 19 nt, Yersinia pestis KIM
auacauccauguaggcucg

SEQ ID NO: 2304315 - RNA, 19 nt, Yersinia pestis KIM
auacaggugucaucaaggc

SEQ ID NO: 2304316 - RNA, 21 nt, Yersinia pestis KIM
auacaggugucaucaaggcaa

SEQ ID NO: 2304317 - RNA, 18 nt, Yersinia pestis KIM
auacaggugucaucaagg

SEQ ID NO: 2304318 - RNA, 14 nt, Yersinia pestis KIM
auacaguuuugccg

SEQ ID NO: 2304319 - RNA, 12 nt, Yersinia pestis KIM
auacaguuuuuu

SEQ ID NO: 2304320 - RNA, 18 nt, Yersinia pestis KIM
auacauaaaaucaauauc

SEQ ID NO: 2304321 - RNA, 22 nt, Yersinia pestis KIM
auacauaacaugguuacacaca

SEQ ID NO: 2304322 - RNA, 16 nt, Yersinia pestis KIM
auacagcauauaaaaa

SEQ ID NO: 2304323 - RNA, 17 nt, Yersinia pestis KIM
auacagcauauaaaaaa

SEQ ID NO: 2304324 - RNA, 18 nt, Yersinia pestis KIM
auaacgcgaucugaagau

SEQ ID NO: 2304325 - RNA, 14 nt, Yersinia pestis KIM
auaacgccugcaau

SEQ ID NO: 2304326 - RNA, 19 nt, Yersinia pestis KIM
auaaucaucuacaacauca

SEQ ID NO: 2304327 - RNA, 12 nt, Yersinia pestis KIM
auaauccaaaau

SEQ ID NO: 2304328 - RNA, 20 nt, Yersinia pestis KIM
auaauccgguuagcaaaaaa

SEQ ID NO: 2304329 - RNA, 14 nt, Yersinia pestis KIM
auaaugagccauaa

SEQ ID NO: 2304330 - RNA, 13 nt, Yersinia pestis KIM
auaaugaugaacu

SEQ ID NO: 2304331 - RNA, 13 nt, Yersinia pestis KIM
auaaugacauaau

SEQ ID NO: 2304332 - RNA, 16 nt, Yersinia pestis KIM
auaaucuuaaguaaau

SEQ ID NO: 2304333 - RNA, 20 nt, Yersinia pestis KIM
auaaucuggaugaguauuac

SEQ ID NO: 2304334 - RNA, 19 nt, Yersinia pestis KIM
auaaucugggguuccaggc

SEQ ID NO: 2304335 - RNA, 22 nt, Yersinia pestis KIM
auaauucccccgguuaaugcca

SEQ ID NO: 2304336 - RNA, 12 nt, Yersinia pestis KIM
auaauucauuuu

SEQ ID NO: 2304337 - RNA, 21 nt, Yersinia pestis KIM
auaauucagcaucaaauuauu

SEQ ID NO: 2304338 - RNA, 12 nt, Yersinia pestis KIM
auaauucagcau

SEQ ID NO: 2304339 - RNA, 15 nt, Yersinia pestis KIM
auaauucgugaaaac

SEQ ID NO: 2304340 - RNA, 22 nt, Yersinia pestis KIM
auaauucgcaugguuaaaacuc

SEQ ID NO: 2304341 - RNA, 17 nt, Yersinia pestis KIM
auaaugguauuugaaau

SEQ ID NO: 2304342 - RNA, 20 nt, Yersinia pestis KIM
auaaugguauuugaaauauu

SEQ ID NO: 2304343 - RNA, 13 nt, Yersinia pestis KIM
auaauguccuauu

SEQ ID NO: 2304344 - RNA, 16 nt, Yersinia pestis KIM
auaauuaugaaaguaa

SEQ ID NO: 2304345 - RNA, 22 nt, Yersinia pestis KIM
auaauuauccauuuucugccaa

SEQ ID NO: 2304346 - RNA, 19 nt, Yersinia pestis KIM
auaaugucgucaauuaaaa

SEQ ID NO: 2304347 - RNA, 17 nt, Yersinia pestis KIM
auaauuggcaauaaugu

SEQ ID NO: 2304348 - RNA, 15 nt, Yersinia pestis KIM
auaauuuagcaaagc

SEQ ID NO: 2304349 - RNA, 15 nt, Yersinia pestis KIM
auaauugaagauuua

SEQ ID NO: 2304350 - RNA, 11 nt, Yersinia pestis KIM
auaauugaaga

SEQ ID NO: 2304351 - RNA, 16 nt, Yersinia pestis KIM
auaauuucagcagcac

SEQ ID NO: 2304352 - RNA, 13 nt, Yersinia pestis KIM
auaauuucagcag

SEQ ID NO: 2304353 - RNA, 14 nt, Yersinia pestis KIM
auaauuuauacaua

SEQ ID NO: 2304354 - RNA, 14 nt, Yersinia pestis KIM
auaauuuauuucag

SEQ ID NO: 2304355 - RNA, 21 nt, Yersinia pestis KIM
auaauuucuacgccgucauca

SEQ ID NO: 2304356 - RNA, 23 nt, Yersinia pestis KIM
auaauuucuacgccgucaucauc

SEQ ID NO: 2304357 - RNA, 14 nt, Yersinia pestis KIM
auaauuugccuggc

SEQ ID NO: 2304358 - RNA, 12 nt, Yersinia pestis KIM
auaccagagacg

SEQ ID NO: 2304359 - RNA, 14 nt, Yersinia pestis KIM
auaccagaugcaua

SEQ ID NO: 2304360 - RNA, 11 nt, Yersinia pestis KIM
auaccagcaag

SEQ ID NO: 2304361 - RNA, 16 nt, Yersinia pestis KIM
auaccacaucaaaccg

SEQ ID NO: 2304362 - RNA, 14 nt, Yersinia pestis KIM
auaccaccaccaca

SEQ ID NO: 2304363 - RNA, 16 nt, Yersinia pestis KIM
auaccacaauccggug

SEQ ID NO: 2304364 - RNA, 19 nt, Yersinia pestis KIM
auaccaacucugaaguaaa

SEQ ID NO: 2304365 - RNA, 17 nt, Yersinia pestis KIM
auacccuucaggauuau

SEQ ID NO: 2304366 - RNA, 19 nt, Yersinia pestis KIM
auacccuuuggucaauaaa

SEQ ID NO: 2304367 - RNA, 24 nt, Yersinia pestis KIM
auacccacuaauacucuguuacca

SEQ ID NO: 2304368 - RNA, 20 nt, Yersinia pestis KIM
auacccagcuucuuuuaaag

SEQ ID NO: 2304369 - RNA, 15 nt, Yersinia pestis KIM
auaccccccaccaau

SEQ ID NO: 2304370 - RNA, 22 nt, Yersinia pestis KIM
auaccauucucugucuuccauu

SEQ ID NO: 2304371 - RNA, 23 nt, Yersinia pestis KIM
auacgcgcaccggcuaaccacag

SEQ ID NO: 2304372 - RNA, 20 nt, Yersinia pestis KIM
auacgaccgucaccaaauag

SEQ ID NO: 2304373 - RNA, 19 nt, Yersinia pestis KIM
auacgaccgucaccaaaua

SEQ ID NO: 2304374 - RNA, 17 nt, Yersinia pestis KIM
auacgcuuccugcgcca

SEQ ID NO: 2304375 - RNA, 12 nt, Yersinia pestis KIM
auacuaaaacag

SEQ ID NO: 2304376 - RNA, 22 nt, Yersinia pestis KIM
auaccucacuggcuuuauuaua

SEQ ID NO: 2304377 - RNA, 14 nt, Yersinia pestis KIM
auaccguuuuguac

SEQ ID NO: 2304378 - RNA, 15 nt, Yersinia pestis KIM
auagcaaaaaaaaag

SEQ ID NO: 2304379 - RNA, 14 nt, Yersinia pestis KIM
auagauuuuuauag

SEQ ID NO: 2304380 - RNA, 15 nt, Yersinia pestis KIM
auagauuuuaaugaa

SEQ ID NO: 2304381 - RNA, 17 nt, Yersinia pestis KIM
auagauuuuaaugaaaa

SEQ ID NO: 2304382 - RNA, 21 nt, Yersinia pestis KIM
auagcaaccggauacaaagug

SEQ ID NO: 2304383 - RNA, 19 nt, Yersinia pestis KIM
auagcaucauccagcucaa

SEQ ID NO: 2304384 - RNA, 17 nt, Yersinia pestis KIM
auagccggcucuucucg

SEQ ID NO: 2304385 - RNA, 15 nt, Yersinia pestis KIM
auagccaaaauaauu

SEQ ID NO: 2304386 - RNA, 18 nt, Yersinia pestis KIM
auagcauuggcacaaagu

SEQ ID NO: 2304387 - RNA, 17 nt, Yersinia pestis KIM
auagacucaucuaauuu

SEQ ID NO: 2304388 - RNA, 15 nt, Yersinia pestis KIM
auagacgaaggcacg

SEQ ID NO: 2304389 - RNA, 23 nt, Yersinia pestis KIM
auagacaauacuacuuucucuug

SEQ ID NO: 2304390 - RNA, 14 nt, Yersinia pestis KIM
auagacaccuuccc

SEQ ID NO: 2304391 - RNA, 14 nt, Yersinia pestis KIM
auagaccccuucuu

SEQ ID NO: 2304392 - RNA, 17 nt, Yersinia pestis KIM
auagauaucgaaacaca

SEQ ID NO: 2304393 - RNA, 16 nt, Yersinia pestis KIM
auagauaacaaacuac

SEQ ID NO: 2304394 - RNA, 21 nt, Yersinia pestis KIM
auagauacacuccauuaauuu

SEQ ID NO: 2304395 - RNA, 16 nt, Yersinia pestis KIM
auacuucaagcugcau

SEQ ID NO: 2304396 - RNA, 13 nt, Yersinia pestis KIM
auagaaacaucag

SEQ ID NO: 2304397 - RNA, 17 nt, Yersinia pestis KIM
auagaaaagcgaaucug

SEQ ID NO: 2304398 - RNA, 15 nt, Yersinia pestis KIM
auacuuaaguugagu

SEQ ID NO: 2304399 - RNA, 12 nt, Yersinia pestis KIM
auacuguuuggu

SEQ ID NO: 2304400 - RNA, 17 nt, Yersinia pestis KIM
auacuaauuucuaauuc

SEQ ID NO: 2304401 - RNA, 13 nt, Yersinia pestis KIM
auagaaauagcca

SEQ ID NO: 2304402 - RNA, 15 nt, Yersinia pestis KIM
auagaagagaggcaa

SEQ ID NO: 2304403 - RNA, 21 nt, Yersinia pestis KIM
auagaagguaaucagacugcu

SEQ ID NO: 2304404 - RNA, 20 nt, Yersinia pestis KIM
auagaagguaaucagacugc

SEQ ID NO: 2304405 - RNA, 18 nt, Yersinia pestis KIM
aguuucaauaugcucugc

SEQ ID NO: 2304406 - RNA, 20 nt, Yersinia pestis KIM
aguuugguaauacugagacc

SEQ ID NO: 2304407 - RNA, 16 nt, Yersinia pestis KIM
aguuuggcugccaugg

SEQ ID NO: 2304408 - RNA, 22 nt, Yersinia pestis KIM
aguuugcggucuggcaacugca

SEQ ID NO: 2304409 - RNA, 23 nt, Yersinia pestis KIM
aguuugcggucuggcaacugcaa

SEQ ID NO: 2304410 - RNA, 11 nt, Yersinia pestis KIM
aguuuuauuca

SEQ ID NO: 2304411 - RNA, 17 nt, Yersinia pestis KIM
aguuuuccucccugcca

SEQ ID NO: 2304412 - RNA, 19 nt, Yersinia pestis KIM
auaaaaacauuuaaauaug

SEQ ID NO: 2304413 - RNA, 19 nt, Yersinia pestis KIM
auaaaaaccauuuuuaugc

SEQ ID NO: 2304414 - RNA, 23 nt, Yersinia pestis KIM
auaaaaaccauuuuuaugccauu

SEQ ID NO: 2304415 - RNA, 13 nt, Yersinia pestis KIM
auaaaaaccccuu

SEQ ID NO: 2304416 - RNA, 21 nt, Yersinia pestis KIM
auaaaaaagcugucauaaaaa

SEQ ID NO: 2304417 - RNA, 17 nt, Yersinia pestis KIM
aguugucuauuuucauu

SEQ ID NO: 2304418 - RNA, 15 nt, Yersinia pestis KIM
aguuuacgcagugcu

SEQ ID NO: 2304419 - RNA, 20 nt, Yersinia pestis KIM
aguugucuauuuucauuauu

SEQ ID NO: 2304420 - RNA, 18 nt, Yersinia pestis KIM
aguugucuauuuucauua

SEQ ID NO: 2304421 - RNA, 19 nt, Yersinia pestis KIM
aguugucuguaauaauaau

SEQ ID NO: 2304422 - RNA, 15 nt, Yersinia pestis KIM
aguuuauuuucccuu

SEQ ID NO: 2304423 - RNA, 19 nt, Yersinia pestis KIM
aguuuauuuucccuuucuc

SEQ ID NO: 2304424 - RNA, 14 nt, Yersinia pestis KIM
aguuuauuuaagcu

SEQ ID NO: 2304425 - RNA, 20 nt, Yersinia pestis KIM
aguuuauuugaguaagacaa

SEQ ID NO: 2304426 - RNA, 13 nt, Yersinia pestis KIM
aguuuauaugcuu

SEQ ID NO: 2304427 - RNA, 17 nt, Yersinia pestis KIM
aguugauaaacaauaaa

SEQ ID NO: 2304428 - RNA, 14 nt, Yersinia pestis KIM
aguugaugcaguga

SEQ ID NO: 2304429 - RNA, 18 nt, Yersinia pestis KIM
aguugauaaaagucuaua

SEQ ID NO: 2304430 - RNA, 20 nt, Yersinia pestis KIM
aguucuucugauaaaacagu

SEQ ID NO: 2304431 - RNA, 18 nt, Yersinia pestis KIM
aguucuucugauaaaaca

SEQ ID NO: 2304432 - RNA, 16 nt, Yersinia pestis KIM
aguucuucgcaaugau

SEQ ID NO: 2304433 - RNA, 17 nt, Yersinia pestis KIM
aguucagguugaaauaa

SEQ ID NO: 2304434 - RNA, 16 nt, Yersinia pestis KIM
aguucauggccaugaa

SEQ ID NO: 2304435 - RNA, 19 nt, Yersinia pestis KIM
aguucgauauuauucucua

SEQ ID NO: 2304436 - RNA, 16 nt, Yersinia pestis KIM
aguuaaagguaaaagg

SEQ ID NO: 2304437 - RNA, 13 nt, Yersinia pestis KIM
aguuaaaugaagg

SEQ ID NO: 2304438 - RNA, 17 nt, Yersinia pestis KIM
aguuaaaucccugugcu

SEQ ID NO: 2304439 - RNA, 15 nt, Yersinia pestis KIM
aguggcaucaauaua

SEQ ID NO: 2304440 - RNA, 20 nt, Yersinia pestis KIM
aguuaacacgaaaagcagca

SEQ ID NO: 2304441 - RNA, 20 nt, Yersinia pestis KIM
aguuaacccuaccuaggcca

SEQ ID NO: 2304442 - RNA, 22 nt, Yersinia pestis KIM
aguuaacccuauuuuugccaau

SEQ ID NO: 2304443 - RNA, 12 nt, Yersinia pestis KIM
aguuaacaccau

SEQ ID NO: 2304444 - RNA, 22 nt, Yersinia pestis KIM
aguuaacggaaaugauaucuga

SEQ ID NO: 2304445 - RNA, 14 nt, Yersinia pestis KIM
aguuaaucgcagca

SEQ ID NO: 2304446 - RNA, 12 nt, Yersinia pestis KIM
aguuaauguuua

SEQ ID NO: 2304447 - RNA, 18 nt, Yersinia pestis KIM
aguuacaggucaacaccg

SEQ ID NO: 2304448 - RNA, 22 nt, Yersinia pestis KIM
aguuacaguagugaagauaaua

SEQ ID NO: 2304449 - RNA, 14 nt, Yersinia pestis KIM
aguuacagcaaaua

SEQ ID NO: 2304450 - RNA, 17 nt, Yersinia pestis KIM
aguuauccucgcucaca

SEQ ID NO: 2304451 - RNA, 21 nt, Yersinia pestis KIM
aguuaucucccauuaauuaau

SEQ ID NO: 2304452 - RNA, 20 nt, Yersinia pestis KIM
aguuaucuguuucaaauaag

SEQ ID NO: 2304453 - RNA, 19 nt, Yersinia pestis KIM
aguuaucauugcuccugua

SEQ ID NO: 2304454 - RNA, 20 nt, Yersinia pestis KIM
aguuaugauccuuuagcgcu

SEQ ID NO: 2304455 - RNA, 17 nt, Yersinia pestis KIM
aguucacgaauuugcug

SEQ ID NO: 2304456 - RNA, 22 nt, Yersinia pestis KIM
aguucacucuguuuuaaaaaaa

SEQ ID NO: 2304457 - RNA, 15 nt, Yersinia pestis KIM
aguucacaugaugaa

SEQ ID NO: 2304458 - RNA, 21 nt, Yersinia pestis KIM
aguucaccagcuugggugaag

SEQ ID NO: 2304459 - RNA, 19 nt, Yersinia pestis KIM
aguucagcccccucaauac

SEQ ID NO: 2304460 - RNA, 23 nt, Yersinia pestis KIM
auaaaaccuuuacaauuacacac

SEQ ID NO: 2304461 - RNA, 18 nt, Yersinia pestis KIM
auaaaaccuuuacaauua

SEQ ID NO: 2304462 - RNA, 17 nt, Yersinia pestis KIM
auaaaaccuuuacaauu

SEQ ID NO: 2304463 - RNA, 18 nt, Yersinia pestis KIM
auaaaaccgcuuaucccu

SEQ ID NO: 2304464 - RNA, 12 nt, Yersinia pestis KIM
auaaaaccaucu

SEQ ID NO: 2304465 - RNA, 23 nt, Yersinia pestis KIM
auaaaaccgcccuugaccucauu

SEQ ID NO: 2304466 - RNA, 19 nt, Yersinia pestis KIM
auaaaaccacugaccuauu

SEQ ID NO: 2304467 - RNA, 15 nt, Yersinia pestis KIM
auaaaaccacugacc

SEQ ID NO: 2304468 - RNA, 11 nt, Yersinia pestis KIM
auaaaacaaua

SEQ ID NO: 2304469 - RNA, 22 nt, Yersinia pestis KIM
auaaaaauauccagcaacgaau

SEQ ID NO: 2304470 - RNA, 19 nt, Yersinia pestis KIM
auaaaaaucccggcauauu

SEQ ID NO: 2304471 - RNA, 17 nt, Yersinia pestis KIM
auaaaaggcuauuuaaa

SEQ ID NO: 2304472 - RNA, 19 nt, Yersinia pestis KIM
auaaaacugcucacuggag

SEQ ID NO: 2304473 - RNA, 21 nt, Yersinia pestis KIM
auaaaaggauggcccaagcca

SEQ ID NO: 2304474 - RNA, 23 nt, Yersinia pestis KIM
auaaaaggauggcccaagccauc

SEQ ID NO: 2304475 - RNA, 20 nt, Yersinia pestis KIM
auaaacaucaugacaaaaau

SEQ ID NO: 2304476 - RNA, 18 nt, Yersinia pestis KIM
auaaacauuuacuuauaa

SEQ ID NO: 2304477 - RNA, 20 nt, Yersinia pestis KIM
auaaacaccgugcuggguaa

SEQ ID NO: 2304478 - RNA, 19 nt, Yersinia pestis KIM
auaaacacugauuuauaaa

SEQ ID NO: 2304479 - RNA, 23 nt, Yersinia pestis KIM
auaaacacuuaccuauaaacauu

SEQ ID NO: 2304480 - RNA, 16 nt, Yersinia pestis KIM
auaaacagacaaaaaa

SEQ ID NO: 2304481 - RNA, 15 nt, Yersinia pestis KIM
auaaacacccaagaa

SEQ ID NO: 2304482 - RNA, 20 nt, Yersinia pestis KIM
auaaacggaacucaucuuuc

SEQ ID NO: 2304483 - RNA, 21 nt, Yersinia pestis KIM
auaaacgaccauuucucugau

SEQ ID NO: 2304484 - RNA, 11 nt, Yersinia pestis KIM
auaaaccaaau

SEQ ID NO: 2304485 - RNA, 19 nt, Yersinia pestis KIM
auaaacuuuuaugcaucuu

SEQ ID NO: 2304486 - RNA, 23 nt, Yersinia pestis KIM
auaaacgggugcaguaacauaau

SEQ ID NO: 2304487 - RNA, 21 nt, Yersinia pestis KIM
auaaaaucgaacccuucagca

SEQ ID NO: 2304488 - RNA, 16 nt, Yersinia pestis KIM
auaaaaucgaacccuu

SEQ ID NO: 2304489 - RNA, 11 nt, Yersinia pestis KIM
auaaaauagcc

SEQ ID NO: 2304490 - RNA, 19 nt, Yersinia pestis KIM
auaaaaugggccugagugg

SEQ ID NO: 2304491 - RNA, 22 nt, Yersinia pestis KIM
auaaaauucguuucucuaaaau

SEQ ID NO: 2304492 - RNA, 23 nt, Yersinia pestis KIM
auaaauagagugaaguaucacca

SEQ ID NO: 2304493 - RNA, 14 nt, Yersinia pestis KIM
auaaauaccgccaa

SEQ ID NO: 2304494 - RNA, 11 nt, Yersinia pestis KIM
auaaauagucg

SEQ ID NO: 2304495 - RNA, 20 nt, Yersinia pestis KIM
auaaauagucguuauauaaa

SEQ ID NO: 2304496 - RNA, 21 nt, Yersinia pestis KIM
auaaauagucguuauauaaau

SEQ ID NO: 2304497 - RNA, 17 nt, Yersinia pestis KIM
auaaagaauaaugggua

SEQ ID NO: 2304498 - RNA, 22 nt, Yersinia pestis KIM
auaaaugaccaacuguaaaauc

SEQ ID NO: 2304499 - RNA, 14 nt, Yersinia pestis KIM
auaaaucagggcag

SEQ ID NO: 2304500 - RNA, 15 nt, Yersinia pestis KIM
auaaauggcauuuuu

SEQ ID NO: 2304501 - RNA, 17 nt, Yersinia pestis KIM
auaaauggucaguuuaa

SEQ ID NO: 2304502 - RNA, 20 nt, Yersinia pestis KIM
auaaaugguuauuauguaaa

SEQ ID NO: 2304503 - RNA, 21 nt, Yersinia pestis KIM
auaaaugguuauuauguaaau

SEQ ID NO: 2304504 - RNA, 17 nt, Yersinia pestis KIM
auaaauucaaauaucau

SEQ ID NO: 2304505 - RNA, 23 nt, Yersinia pestis KIM
auaaauucaaauaucauuauuuu

SEQ ID NO: 2304506 - RNA, 22 nt, Yersinia pestis KIM
auaaauucaaaauagaggaaau

SEQ ID NO: 2304507 - RNA, 14 nt, Yersinia pestis KIM
auaaauucaaaaua

SEQ ID NO: 2304508 - RNA, 18 nt, Yersinia pestis KIM
auaaccauuaauugguuu

SEQ ID NO: 2304509 - RNA, 16 nt, Yersinia pestis KIM
auaaccaucaaauaca

SEQ ID NO: 2304510 - RNA, 16 nt, Yersinia pestis KIM
auaacgcaaaaaucac

SEQ ID NO: 2304511 - RNA, 23 nt, Yersinia pestis KIM
auaacgauuaauuaguuuuaaua

SEQ ID NO: 2304512 - RNA, 21 nt, Yersinia pestis KIM
auaacgaauuucauuuuaaaa

SEQ ID NO: 2304513 - RNA, 18 nt, Yersinia pestis KIM
auaaccagaauaauccaa

SEQ ID NO: 2304514 - RNA, 20 nt, Yersinia pestis KIM
auaaccagaauaauccaagc

SEQ ID NO: 2304515 - RNA, 12 nt, Yersinia pestis KIM
auaaccagcagc

SEQ ID NO: 2304516 - RNA, 18 nt, Yersinia pestis KIM
auaaccaauccaugccag

SEQ ID NO: 2304517 - RNA, 17 nt, Yersinia pestis KIM
auaaccaauccaugcca

SEQ ID NO: 2304518 - RNA, 13 nt, Yersinia pestis KIM
auaaccacuucaa

SEQ ID NO: 2304519 - RNA, 17 nt, Yersinia pestis KIM
auaacaguaucaaguau

SEQ ID NO: 2304520 - RNA, 21 nt, Yersinia pestis KIM
auaacaguaucaaguauguuu

SEQ ID NO: 2304521 - RNA, 17 nt, Yersinia pestis KIM
auaacaguuuacgguga

SEQ ID NO: 2304522 - RNA, 18 nt, Yersinia pestis KIM
auaacauaauaaauuaau

SEQ ID NO: 2304523 - RNA, 22 nt, Yersinia pestis KIM
auaaauugcuuugucaucaacc

SEQ ID NO: 2304524 - RNA, 23 nt, Yersinia pestis KIM
auaacagcuaaucauugcaaugc

SEQ ID NO: 2304525 - RNA, 22 nt, Yersinia pestis KIM
auaacaauggccggacucauua

SEQ ID NO: 2304526 - RNA, 20 nt, Yersinia pestis KIM
auaacaaguuacauuuuuaa

SEQ ID NO: 2304527 - RNA, 22 nt, Yersinia pestis KIM
auaacaaguuacauuuuuaaca

SEQ ID NO: 2304528 - RNA, 18 nt, Yersinia pestis KIM
auaacaacgacuccauca

SEQ ID NO: 2304529 - RNA, 15 nt, Yersinia pestis KIM
auaacaacacaauua

SEQ ID NO: 2304530 - RNA, 21 nt, Yersinia pestis KIM
auaacaacacaauuaauaugc

SEQ ID NO: 2304531 - RNA, 21 nt, Yersinia pestis KIM
agugcccgcgacggagagaac

SEQ ID NO: 2304532 - RNA, 18 nt, Yersinia pestis KIM
agugcccgcgggggcccc

SEQ ID NO: 2304533 - RNA, 17 nt, Yersinia pestis KIM
agugcacagucacucaa

SEQ ID NO: 2304534 - RNA, 15 nt, Yersinia pestis KIM
agugccaauccccac

SEQ ID NO: 2304535 - RNA, 19 nt, Yersinia pestis KIM
agugccaaucccgcagcau

SEQ ID NO: 2304536 - RNA, 12 nt, Yersinia pestis KIM
agugcacugaac

SEQ ID NO: 2304537 - RNA, 17 nt, Yersinia pestis KIM
agugcaacauuaaaaau

SEQ ID NO: 2304538 - RNA, 19 nt, Yersinia pestis KIM
agugcaaccaacaccaaug

SEQ ID NO: 2304539 - RNA, 13 nt, Yersinia pestis KIM
agugauuucagug

SEQ ID NO: 2304540 - RNA, 16 nt, Yersinia pestis KIM
agugauuucuuacagu

SEQ ID NO: 2304541 - RNA, 16 nt, Yersinia pestis KIM
agugauuguuugauua

SEQ ID NO: 2304542 - RNA, 18 nt, Yersinia pestis KIM
agugauucgagugcguga

SEQ ID NO: 2304543 - RNA, 18 nt, Yersinia pestis KIM
agugauucgggugaguga

SEQ ID NO: 2304544 - RNA, 19 nt, Yersinia pestis KIM
agugauucgggugagugaa

SEQ ID NO: 2304545 - RNA, 22 nt, Yersinia pestis KIM
agugauucgggugagugagcgc

SEQ ID NO: 2304546 - RNA, 18 nt, Yersinia pestis KIM
agugauuagcaucugcaa

SEQ ID NO: 2304547 - RNA, 22 nt, Yersinia pestis KIM
agugcugccgcaacggcaccuc

SEQ ID NO: 2304548 - RNA, 16 nt, Yersinia pestis KIM
agugcuuaacccacca

SEQ ID NO: 2304549 - RNA, 12 nt, Yersinia pestis KIM
agugcggccacc

SEQ ID NO: 2304550 - RNA, 23 nt, Yersinia pestis KIM
agugcggccaccuaucuauuuuu

SEQ ID NO: 2304551 - RNA, 13 nt, Yersinia pestis KIM
agugcgguaacca

SEQ ID NO: 2304552 - RNA, 22 nt, Yersinia pestis KIM
agugcgguaaccagcaucagua

SEQ ID NO: 2304553 - RNA, 22 nt, Yersinia pestis KIM
agugcgcuacgcaugaugcugc

SEQ ID NO: 2304554 - RNA, 22 nt, Yersinia pestis KIM
agugccgcggcggccagcggca

SEQ ID NO: 2304555 - RNA, 16 nt, Yersinia pestis KIM
agugaaucaucaauac

SEQ ID NO: 2304556 - RNA, 13 nt, Yersinia pestis KIM
agugaaucagcca

SEQ ID NO: 2304557 - RNA, 16 nt, Yersinia pestis KIM
agugaacccacgacua

SEQ ID NO: 2304558 - RNA, 17 nt, Yersinia pestis KIM
agugaacguagcuaaca

SEQ ID NO: 2304559 - RNA, 21 nt, Yersinia pestis KIM
agugaacauagcuaacaccgc

SEQ ID NO: 2304560 - RNA, 14 nt, Yersinia pestis KIM
agugauaaaaagag

SEQ ID NO: 2304561 - RNA, 21 nt, Yersinia pestis KIM
agugagucaguaacuggauau

SEQ ID NO: 2304562 - RNA, 16 nt, Yersinia pestis KIM
agugaaaacguuaacu

SEQ ID NO: 2304563 - RNA, 16 nt, Yersinia pestis KIM
agugaaaagguuaacu

SEQ ID NO: 2304564 - RNA, 21 nt, Yersinia pestis KIM
agugaaaacguuaacugcagu

SEQ ID NO: 2304565 - RNA, 16 nt, Yersinia pestis KIM
agucuauugaaaaaau

SEQ ID NO: 2304566 - RNA, 22 nt, Yersinia pestis KIM
agucucacuaaaucaaaaggaa

SEQ ID NO: 2304567 - RNA, 15 nt, Yersinia pestis KIM
agucucaucaaggaa

SEQ ID NO: 2304568 - RNA, 16 nt, Yersinia pestis KIM
agucuccaaauucauu

SEQ ID NO: 2304569 - RNA, 21 nt, Yersinia pestis KIM
agucgcuuuuuguauuuuugu

SEQ ID NO: 2304570 - RNA, 20 nt, Yersinia pestis KIM
agucgguagaacggcggacu

SEQ ID NO: 2304571 - RNA, 19 nt, Yersinia pestis KIM
agucccugugcgcccacgc

SEQ ID NO: 2304572 - RNA, 23 nt, Yersinia pestis KIM
aguccugauucgcgaccagcaga

SEQ ID NO: 2304573 - RNA, 18 nt, Yersinia pestis KIM
aguccuccuugagauccu

SEQ ID NO: 2304574 - RNA, 19 nt, Yersinia pestis KIM
agucauauauuuuucuuuc

SEQ ID NO: 2304575 - RNA, 21 nt, Yersinia pestis KIM
agucauauauuuuucuuucuc

SEQ ID NO: 2304576 - RNA, 18 nt, Yersinia pestis KIM
agucauagugauaaaaag

SEQ ID NO: 2304577 - RNA, 24 nt, Yersinia pestis KIM
agucauauauuuuucuuucucgau

SEQ ID NO: 2304578 - RNA, 23 nt, Yersinia pestis KIM
agucaucgccuucuggcaaaccg

SEQ ID NO: 2304579 - RNA, 20 nt, Yersinia pestis KIM
agucauuaacuguuaaaaca

SEQ ID NO: 2304580 - RNA, 22 nt, Yersinia pestis KIM
agucaugguacaacugcggcgu

SEQ ID NO: 2304581 - RNA, 17 nt, Yersinia pestis KIM
aguccaaaaaacugcgg

SEQ ID NO: 2304582 - RNA, 21 nt, Yersinia pestis KIM
agucauuugcucgauuucacu

SEQ ID NO: 2304583 - RNA, 23 nt, Yersinia pestis KIM
aguccaagacagaacuuaagaua

SEQ ID NO: 2304584 - RNA, 16 nt, Yersinia pestis KIM
aguaugguuaaucuac

SEQ ID NO: 2304585 - RNA, 17 nt, Yersinia pestis KIM
aguauuccccacuguaa

SEQ ID NO: 2304586 - RNA, 14 nt, Yersinia pestis KIM
aguauuccaauaau

SEQ ID NO: 2304587 - RNA, 14 nt, Yersinia pestis KIM
aguauuuguaguga

SEQ ID NO: 2304588 - RNA, 13 nt, Yersinia pestis KIM
aguauuugcagug

SEQ ID NO: 2304589 - RNA, 20 nt, Yersinia pestis KIM
aguaucagcgauuuuaaaaa

SEQ ID NO: 2304590 - RNA, 22 nt, Yersinia pestis KIM
aguaucagcgauuuuaaaaaau

SEQ ID NO: 2304591 - RNA, 17 nt, Yersinia pestis KIM
aguaucgaagacaaaca

SEQ ID NO: 2304592 - RNA, 23 nt, Yersinia pestis KIM
aguaucgcuaucaccggaugaaa

SEQ ID NO: 2304593 - RNA, 19 nt, Yersinia pestis KIM
aguaugcguggguucuuca

SEQ ID NO: 2304594 - RNA, 12 nt, Yersinia pestis KIM
aguaugcaacag

SEQ ID NO: 2304595 - RNA, 18 nt, Yersinia pestis KIM
aguaucugggugagaggu

SEQ ID NO: 2304596 - RNA, 19 nt, Yersinia pestis KIM
aguaucugggugagagguu

SEQ ID NO: 2304597 - RNA, 15 nt, Yersinia pestis KIM
agucagggagucagg

SEQ ID NO: 2304598 - RNA, 17 nt, Yersinia pestis KIM
agucagggagucaggga

SEQ ID NO: 2304599 - RNA, 15 nt, Yersinia pestis KIM
agucauaagguuaau

SEQ ID NO: 2304600 - RNA, 21 nt, Yersinia pestis KIM
agucauaagguuaaugagcgu

SEQ ID NO: 2304601 - RNA, 15 nt, Yersinia pestis KIM
agucagggugaaagc

SEQ ID NO: 2304602 - RNA, 18 nt, Yersinia pestis KIM
agucagugauucggguga

SEQ ID NO: 2304603 - RNA, 16 nt, Yersinia pestis KIM
agucacgucuucacca

SEQ ID NO: 2304604 - RNA, 13 nt, Yersinia pestis KIM
agucacuaaacca

SEQ ID NO: 2304605 - RNA, 13 nt, Yersinia pestis KIM
agucacuggccgc

SEQ ID NO: 2304606 - RNA, 16 nt, Yersinia pestis KIM
agucacuggccgcagg

SEQ ID NO: 2304607 - RNA, 23 nt, Yersinia pestis KIM
agucacuggggugaaucaaaacc

SEQ ID NO: 2304608 - RNA, 14 nt, Yersinia pestis KIM
agucacugcugcac

SEQ ID NO: 2304609 - RNA, 16 nt, Yersinia pestis KIM
agucagauugucagac

SEQ ID NO: 2304610 - RNA, 16 nt, Yersinia pestis KIM
agucagcaaaucaaac

SEQ ID NO: 2304611 - RNA, 20 nt, Yersinia pestis KIM
agucagcaaggugagcacuu

SEQ ID NO: 2304612 - RNA, 14 nt, Yersinia pestis KIM
agucaaaaugaaau

SEQ ID NO: 2304613 - RNA, 15 nt, Yersinia pestis KIM
agucaaaaugaaauu

SEQ ID NO: 2304614 - RNA, 22 nt, Yersinia pestis KIM
agucaaaucgauuugcugcugc

SEQ ID NO: 2304615 - RNA, 16 nt, Yersinia pestis KIM
agucaaaagaaacugc

SEQ ID NO: 2304616 - RNA, 12 nt, Yersinia pestis KIM
agucaaaacaau

SEQ ID NO: 2304617 - RNA, 20 nt, Yersinia pestis KIM
agucaaaacaauaucuauuu

SEQ ID NO: 2304618 - RNA, 18 nt, Yersinia pestis KIM
agucaauaaauaaaaacg

SEQ ID NO: 2304619 - RNA, 14 nt, Yersinia pestis KIM
agucaauugagaau

SEQ ID NO: 2304620 - RNA, 13 nt, Yersinia pestis KIM
agucaauuucagc

SEQ ID NO: 2304621 - RNA, 15 nt, Yersinia pestis KIM
agucacauuuuuaau

SEQ ID NO: 2304622 - RNA, 19 nt, Yersinia pestis KIM
agucacaucgcgcuuuuua

SEQ ID NO: 2304623 - RNA, 21 nt, Yersinia pestis KIM
agucaccuuuuuagcgagugc

SEQ ID NO: 2304624 - RNA, 19 nt, Yersinia pestis KIM
aguauacggucaaaagcug

SEQ ID NO: 2304625 - RNA, 14 nt, Yersinia pestis KIM
aguauacuaaaaca

SEQ ID NO: 2304626 - RNA, 16 nt, Yersinia pestis KIM
aguauacuaaaacagc

SEQ ID NO: 2304627 - RNA, 22 nt, Yersinia pestis KIM
aguaggggccaccaaauaaaac

SEQ ID NO: 2304628 - RNA, 21 nt, Yersinia pestis KIM
aguaggcaucugccacacuga

SEQ ID NO: 2304629 - RNA, 15 nt, Yersinia pestis KIM
aguagcuaauaaaau

SEQ ID NO: 2304630 - RNA, 11 nt, Yersinia pestis KIM
aguagcccagc

SEQ ID NO: 2304631 - RNA, 23 nt, Yersinia pestis KIM
aguagcccagccggaacauguac

SEQ ID NO: 2304632 - RNA, 19 nt, Yersinia pestis KIM
aguagcauaaaaaucaaua

SEQ ID NO: 2304633 - RNA, 18 nt, Yersinia pestis KIM
aguagcaggcgcacguua

SEQ ID NO: 2304634 - RNA, 22 nt, Yersinia pestis KIM
aguagcaauaaggugccacaca

SEQ ID NO: 2304635 - RNA, 22 nt, Yersinia pestis KIM
aguacguagcgauaacagauau

SEQ ID NO: 2304636 - RNA, 14 nt, Yersinia pestis KIM
aguacgcuggccag

SEQ ID NO: 2304637 - RNA, 17 nt, Yersinia pestis KIM
agcuggcggauaaaaau

SEQ ID NO: 2304638 - RNA, 16 nt, Yersinia pestis KIM
aguacuuaccuuccca

SEQ ID NO: 2304639 - RNA, 22 nt, Yersinia pestis KIM
aguagacgacacaaaugcugug

SEQ ID NO: 2304640 - RNA, 18 nt, Yersinia pestis KIM
agccguaauucagauaag

SEQ ID NO: 2304641 - RNA, 21 nt, Yersinia pestis KIM
agccguuaaaaagucauuaac

SEQ ID NO: 2304642 - RNA, 13 nt, Yersinia pestis KIM
agccugccgggau

SEQ ID NO: 2304643 - RNA, 12 nt, Yersinia pestis KIM
agccugccggga

SEQ ID NO: 2304644 - RNA, 15 nt, Yersinia pestis KIM
agccugcccccgacg

SEQ ID NO: 2304645 - RNA, 17 nt, Yersinia pestis KIM
agccugcacggcucagg

SEQ ID NO: 2304646 - RNA, 20 nt, Yersinia pestis KIM
agccugcacggcucaggugc

SEQ ID NO: 2304647 - RNA, 22 nt, Yersinia pestis KIM
agccugcacuucuacagggcau

SEQ ID NO: 2304648 - RNA, 15 nt, Yersinia pestis KIM
agccugcaccucauc

SEQ ID NO: 2304649 - RNA, 22 nt, Yersinia pestis KIM
agccugagcauucgaguuaacu

SEQ ID NO: 2304650 - RNA, 21 nt, Yersinia pestis KIM
agccucuagcuaacagugacc

SEQ ID NO: 2304651 - RNA, 19 nt, Yersinia pestis KIM
agccucgugagugaagggu

SEQ ID NO: 2304652 - RNA, 15 nt, Yersinia pestis KIM
agccucggucacugc

SEQ ID NO: 2304653 - RNA, 22 nt, Yersinia pestis KIM
agccucggucacugccugcaca

SEQ ID NO: 2304654 - RNA, 12 nt, Yersinia pestis KIM
agccugaauucu

SEQ ID NO: 2304655 - RNA, 16 nt, Yersinia pestis KIM
agccucuugcgcucca

SEQ ID NO: 2304656 - RNA, 18 nt, Yersinia pestis KIM
agccuacuacauggaugu

SEQ ID NO: 2304657 - RNA, 20 nt, Yersinia pestis KIM
agccuacauggauguauuua

SEQ ID NO: 2304658 - RNA, 17 nt, Yersinia pestis KIM
agccucaugaaugaggc

SEQ ID NO: 2304659 - RNA, 15 nt, Yersinia pestis KIM
agccucaugaaugag

SEQ ID NO: 2304660 - RNA, 19 nt, Yersinia pestis KIM
agccuauggcgguuccaaa

SEQ ID NO: 2304661 - RNA, 23 nt, Yersinia pestis KIM
agccucauacaagccgugaccaa

SEQ ID NO: 2304662 - RNA, 21 nt, Yersinia pestis KIM
agcgagggccuuucugaacaa

SEQ ID NO: 2304663 - RNA, 14 nt, Yersinia pestis KIM
agcgaggcuucuca

SEQ ID NO: 2304664 - RNA, 18 nt, Yersinia pestis KIM
agcgaccaaauggacgaa

SEQ ID NO: 2304665 - RNA, 22 nt, Yersinia pestis KIM
agcgacgucccuaaagccaucg

SEQ ID NO: 2304666 - RNA, 20 nt, Yersinia pestis KIM
agcgacgucccuaaagccau

SEQ ID NO: 2304667 - RNA, 16 nt, Yersinia pestis KIM
agcgacaaccuguagc

SEQ ID NO: 2304668 - RNA, 14 nt, Yersinia pestis KIM
agcgacacuuauug

SEQ ID NO: 2304669 - RNA, 12 nt, Yersinia pestis KIM
agcgaauaaaua

SEQ ID NO: 2304670 - RNA, 15 nt, Yersinia pestis KIM
agccugucuuaggug

SEQ ID NO: 2304671 - RNA, 13 nt, Yersinia pestis KIM
agccugugcccaa

SEQ ID NO: 2304672 - RNA, 17 nt, Yersinia pestis KIM
agccugguguaaaaacu

SEQ ID NO: 2304673 - RNA, 21 nt, Yersinia pestis KIM
agccugguuuuuuaaaaaagu

SEQ ID NO: 2304674 - RNA, 14 nt, Yersinia pestis KIM
agccuguuaauaau

SEQ ID NO: 2304675 - RNA, 14 nt, Yersinia pestis KIM
agccuucagaugaa

SEQ ID NO: 2304676 - RNA, 12 nt, Yersinia pestis KIM
agccuucccugg

SEQ ID NO: 2304677 - RNA, 15 nt, Yersinia pestis KIM
agccuucuaauauua

SEQ ID NO: 2304678 - RNA, 16 nt, Yersinia pestis KIM
agccuugauucagcuc

SEQ ID NO: 2304679 - RNA, 21 nt, Yersinia pestis KIM
agccuuguugaaucagauacg

SEQ ID NO: 2304680 - RNA, 20 nt, Yersinia pestis KIM
agccccuaaauccugcaaug

SEQ ID NO: 2304681 - RNA, 20 nt, Yersinia pestis KIM
agccccuuugaacugcaccc

SEQ ID NO: 2304682 - RNA, 14 nt, Yersinia pestis KIM
agcccgaaauucag

SEQ ID NO: 2304683 - RNA, 21 nt, Yersinia pestis KIM
agcccgguguuaaccgcccca

SEQ ID NO: 2304684 - RNA, 16 nt, Yersinia pestis KIM
agcccguucggucaca

SEQ ID NO: 2304685 - RNA, 22 nt, Yersinia pestis KIM
agcccuacauccgcuuguucuu

SEQ ID NO: 2304686 - RNA, 16 nt, Yersinia pestis KIM
agcccaacugacugaa

SEQ ID NO: 2304687 - RNA, 15 nt, Yersinia pestis KIM
agccauuuuuuauaa

SEQ ID NO: 2304688 - RNA, 17 nt, Yersinia pestis KIM
agccauuuuuuauaaac

SEQ ID NO: 2304689 - RNA, 22 nt, Yersinia pestis KIM
agccauuuuuuauaaacacuua

SEQ ID NO: 2304690 - RNA, 21 nt, Yersinia pestis KIM
agcccaauucguauuccucaa

SEQ ID NO: 2304691 - RNA, 16 nt, Yersinia pestis KIM
agccauuucaccaaua

SEQ ID NO: 2304692 - RNA, 22 nt, Yersinia pestis KIM
agccauugagcgaagaagagau

SEQ ID NO: 2304693 - RNA, 17 nt, Yersinia pestis KIM
agccauucugaaucgcu

SEQ ID NO: 2304694 - RNA, 13 nt, Yersinia pestis KIM
agcccagcguucu

SEQ ID NO: 2304695 - RNA, 17 nt, Yersinia pestis KIM
agcccaggcgacgcagu

SEQ ID NO: 2304696 - RNA, 13 nt, Yersinia pestis KIM
agcccccagggaa

SEQ ID NO: 2304697 - RNA, 18 nt, Yersinia pestis KIM
agcccccagggagggcua

SEQ ID NO: 2304698 - RNA, 20 nt, Yersinia pestis KIM
agcccagguuacugcccugg

SEQ ID NO: 2304699 - RNA, 15 nt, Yersinia pestis KIM
agcccaguaaagcaa

SEQ ID NO: 2304700 - RNA, 16 nt, Yersinia pestis KIM
agcccaguauugcaga

SEQ ID NO: 2304701 - RNA, 19 nt, Yersinia pestis KIM
agcccaguauugcagagca

SEQ ID NO: 2304702 - RNA, 21 nt, Yersinia pestis KIM
agcccauaucuuuaaaaaccc

SEQ ID NO: 2304703 - RNA, 21 nt, Yersinia pestis KIM
agcccauagaugggccaggca

SEQ ID NO: 2304704 - RNA, 13 nt, Yersinia pestis KIM
agcccauugcugu

SEQ ID NO: 2304705 - RNA, 12 nt, Yersinia pestis KIM
agcccauugcug

SEQ ID NO: 2304706 - RNA, 22 nt, Yersinia pestis KIM
agcccaucuuaugcauguuccu

SEQ ID NO: 2304707 - RNA, 13 nt, Yersinia pestis KIM
agccgcgcccucc

SEQ ID NO: 2304708 - RNA, 17 nt, Yersinia pestis KIM
agccgcgaaaaaccaug

SEQ ID NO: 2304709 - RNA, 21 nt, Yersinia pestis KIM
agccgccagucauucaccugc

SEQ ID NO: 2304710 - RNA, 14 nt, Yersinia pestis KIM
agccgccgcccuga

SEQ ID NO: 2304711 - RNA, 14 nt, Yersinia pestis KIM
agccggagagucgg

SEQ ID NO: 2304712 - RNA, 19 nt, Yersinia pestis KIM
agccgcuuuaaucgccuga

SEQ ID NO: 2304713 - RNA, 18 nt, Yersinia pestis KIM
agccgcuuuaaucgccug

SEQ ID NO: 2304714 - RNA, 21 nt, Yersinia pestis KIM
agccgauaaucccugccagaa

SEQ ID NO: 2304715 - RNA, 16 nt, Yersinia pestis KIM
agccgauuuagacaag

SEQ ID NO: 2304716 - RNA, 15 nt, Yersinia pestis KIM
agccgaauaucccac

SEQ ID NO: 2304717 - RNA, 12 nt, Yersinia pestis KIM
agccgaagaaug

SEQ ID NO: 2304718 - RNA, 20 nt, Yersinia pestis KIM
agcccuuugaccauuuguuu

SEQ ID NO: 2304719 - RNA, 21 nt, Yersinia pestis KIM
agcccuuugaccauuuguuuu

SEQ ID NO: 2304720 - RNA, 18 nt, Yersinia pestis KIM
agcccuuugcuuucagga

SEQ ID NO: 2304721 - RNA, 23 nt, Yersinia pestis KIM
agcccuuuggcaaucacaacccc

SEQ ID NO: 2304722 - RNA, 15 nt, Yersinia pestis KIM
agccgaagaacaaau

SEQ ID NO: 2304723 - RNA, 18 nt, Yersinia pestis KIM
agcgccgacacccagcca

SEQ ID NO: 2304724 - RNA, 22 nt, Yersinia pestis KIM
agcgccgauggugugcagcaag

SEQ ID NO: 2304725 - RNA, 17 nt, Yersinia pestis KIM
agcgcccgcaguuuauc

SEQ ID NO: 2304726 - RNA, 20 nt, Yersinia pestis KIM
agcgcccggcugaccuguug

SEQ ID NO: 2304727 - RNA, 13 nt, Yersinia pestis KIM
agcgccugcccuc

SEQ ID NO: 2304728 - RNA, 16 nt, Yersinia pestis KIM
agcgcguaaugccugg

SEQ ID NO: 2304729 - RNA, 17 nt, Yersinia pestis KIM
agcgcgucgccugggaa

SEQ ID NO: 2304730 - RNA, 18 nt, Yersinia pestis KIM
agcgccuguuguuuuuca

SEQ ID NO: 2304731 - RNA, 21 nt, Yersinia pestis KIM
agcgcuauguuggcaaauaau

SEQ ID NO: 2304732 - RNA, 14 nt, Yersinia pestis KIM
agcgcucagcgcca

SEQ ID NO: 2304733 - RNA, 15 nt, Yersinia pestis KIM
agcgcuugcugguau

SEQ ID NO: 2304734 - RNA, 18 nt, Yersinia pestis KIM
agcgcuuuaaccaaagaa

SEQ ID NO: 2304735 - RNA, 15 nt, Yersinia pestis KIM
agcgcuuuaggcaag

SEQ ID NO: 2304736 - RNA, 19 nt, Yersinia pestis KIM
agcgcuuuuucgggaaaaa

SEQ ID NO: 2304737 - RNA, 21 nt, Yersinia pestis KIM
agcgcuuuuucgggaaaaaau

SEQ ID NO: 2304738 - RNA, 16 nt, Yersinia pestis KIM
agcgauuuuaaaaaau

SEQ ID NO: 2304739 - RNA, 16 nt, Yersinia pestis KIM
agcgcacugucugagc

SEQ ID NO: 2304740 - RNA, 18 nt, Yersinia pestis KIM
agcgauguucgcuccccc

SEQ ID NO: 2304741 - RNA, 18 nt, Yersinia pestis KIM
agcgauuaaaauaaagcg

SEQ ID NO: 2304742 - RNA, 20 nt, Yersinia pestis KIM
agcgaucucauuuagcauua

SEQ ID NO: 2304743 - RNA, 17 nt, Yersinia pestis KIM
agcgauaucguuaucaa

SEQ ID NO: 2304744 - RNA, 18 nt, Yersinia pestis KIM
agcgaucaauacaccaga

SEQ ID NO: 2304745 - RNA, 14 nt, Yersinia pestis KIM
agcgaucagcaacg

SEQ ID NO: 2304746 - RNA, 14 nt, Yersinia pestis KIM
agcgaucagcaaua

SEQ ID NO: 2304747 - RNA, 14 nt, Yersinia pestis KIM
agcgauagccugau

SEQ ID NO: 2304748 - RNA, 12 nt, Yersinia pestis KIM
agcgauauccuu

SEQ ID NO: 2304749 - RNA, 14 nt, Yersinia pestis KIM
agcgcagugcucau

SEQ ID NO: 2304750 - RNA, 17 nt, Yersinia pestis KIM
agcgcauaaaaauacau

SEQ ID NO: 2304751 - RNA, 23 nt, Yersinia pestis KIM
agcgcauccaaccugcaaugccu

SEQ ID NO: 2304752 - RNA, 17 nt, Yersinia pestis KIM
agcgccaugcgcuuuca

SEQ ID NO: 2304753 - RNA, 21 nt, Yersinia pestis KIM
agcguauuuugucaugaaaau

SEQ ID NO: 2304754 - RNA, 16 nt, Yersinia pestis KIM
agcgucacggaaagca

SEQ ID NO: 2304755 - RNA, 18 nt, Yersinia pestis KIM
agcgguuucauggcuggg

SEQ ID NO: 2304756 - RNA, 15 nt, Yersinia pestis KIM
agcguccauaaaccc

SEQ ID NO: 2304757 - RNA, 18 nt, Yersinia pestis KIM
agcggguuggcaucaaau

SEQ ID NO: 2304758 - RNA, 21 nt, Yersinia pestis KIM
agcggcaguuaugacgagauc

SEQ ID NO: 2304759 - RNA, 13 nt, Yersinia pestis KIM
agcggcaauaaca

SEQ ID NO: 2304760 - RNA, 17 nt, Yersinia pestis KIM
agcgugauuuuuauauu

SEQ ID NO: 2304761 - RNA, 19 nt, Yersinia pestis KIM
agcgugauuuuuauauuuu

SEQ ID NO: 2304762 - RNA, 14 nt, Yersinia pestis KIM
agcguuuacucgcu

SEQ ID NO: 2304763 - RNA, 15 nt, Yersinia pestis KIM
agcguuuacuuuaaa

SEQ ID NO: 2304764 - RNA, 17 nt, Yersinia pestis KIM
agcguuuacuuuaaauu

SEQ ID NO: 2304765 - RNA, 14 nt, Yersinia pestis KIM
agcguuucaccaaa

SEQ ID NO: 2304766 - RNA, 21 nt, Yersinia pestis KIM
agcguucuucugauucaauuu

SEQ ID NO: 2304767 - RNA, 18 nt, Yersinia pestis KIM
agcguugacuuucuaagc

SEQ ID NO: 2304768 - RNA, 19 nt, Yersinia pestis KIM
agcuacugcacgcauucuu

SEQ ID NO: 2304769 - RNA, 22 nt, Yersinia pestis KIM
agcuagaauaaguugaugcagu

SEQ ID NO: 2304770 - RNA, 13 nt, Yersinia pestis KIM
agcuagccugccc

SEQ ID NO: 2304771 - RNA, 17 nt, Yersinia pestis KIM
agcuacgccaagagggc

SEQ ID NO: 2304772 - RNA, 21 nt, Yersinia pestis KIM
agcuacggccuguaccaccac

SEQ ID NO: 2304773 - RNA, 17 nt, Yersinia pestis KIM
agcuacggccuguacca

SEQ ID NO: 2304774 - RNA, 23 nt, Yersinia pestis KIM
agcuacagcaccauuaucuucca

SEQ ID NO: 2304775 - RNA, 19 nt, Yersinia pestis KIM
agcugauggcgaucaaaau

SEQ ID NO: 2304776 - RNA, 15 nt, Yersinia pestis KIM
agcugagauaagccu

SEQ ID NO: 2304777 - RNA, 16 nt, Yersinia pestis KIM
agcugaguaaagaucc

SEQ ID NO: 2304778 - RNA, 16 nt, Yersinia pestis KIM
agcugcugcuuucagu

SEQ ID NO: 2304779 - RNA, 13 nt, Yersinia pestis KIM
agcugacgcagca

SEQ ID NO: 2304780 - RNA, 17 nt, Yersinia pestis KIM
agcucuuuaucacuggg

SEQ ID NO: 2304781 - RNA, 15 nt, Yersinia pestis KIM
agcucuucuaacacu

SEQ ID NO: 2304782 - RNA, 15 nt, Yersinia pestis KIM
agcucuggccagauu

SEQ ID NO: 2304783 - RNA, 19 nt, Yersinia pestis KIM
agcucauuaauccccgguc

SEQ ID NO: 2304784 - RNA, 17 nt, Yersinia pestis KIM
agcucgcuguggcuacc

SEQ ID NO: 2304785 - RNA, 19 nt, Yersinia pestis KIM
agcucgcuguggcuaccau

SEQ ID NO: 2304786 - RNA, 20 nt, Yersinia pestis KIM
agcaagauuuuguagcccac

SEQ ID NO: 2304787 - RNA, 20 nt, Yersinia pestis KIM
agcaaggcggcaagcaagca

SEQ ID NO: 2304788 - RNA, 11 nt, Yersinia pestis KIM
agcaaggcagc

SEQ ID NO: 2304789 - RNA, 23 nt, Yersinia pestis KIM
agcaaggauuccccccagucacu

SEQ ID NO: 2304790 - RNA, 14 nt, Yersinia pestis KIM
agcaaggauucccc

SEQ ID NO: 2304791 - RNA, 11 nt, Yersinia pestis KIM
agcaagugaac

SEQ ID NO: 2304792 - RNA, 21 nt, Yersinia pestis KIM
agcaaguuagcgauaucugcg

SEQ ID NO: 2304793 - RNA, 19 nt, Yersinia pestis KIM
agcaaugcaccgacaaaga

SEQ ID NO: 2304794 - RNA, 11 nt, Yersinia pestis KIM
agcaaucuggc

SEQ ID NO: 2304795 - RNA, 14 nt, Yersinia pestis KIM
agcaaucuggcggc

SEQ ID NO: 2304796 - RNA, 22 nt, Yersinia pestis KIM
agcaacgguaucccggugauca

SEQ ID NO: 2304797 - RNA, 23 nt, Yersinia pestis KIM
agcaacgaaaugucgaaagauag

SEQ ID NO: 2304798 - RNA, 21 nt, Yersinia pestis KIM
agcaaauuuaucaguagcuag

SEQ ID NO: 2304799 - RNA, 14 nt, Yersinia pestis KIM
agcaaauugcugaa

SEQ ID NO: 2304800 - RNA, 22 nt, Yersinia pestis KIM
agcaacaugguuaagagauccc

SEQ ID NO: 2304801 - RNA, 22 nt, Yersinia pestis KIM
agauaauuggcaauaaugucac

SEQ ID NO: 2304802 - RNA, 17 nt, Yersinia pestis KIM
agauuguaaguaacuaa

SEQ ID NO: 2304803 - RNA, 20 nt, Yersinia pestis KIM
agauaauuauccauuuucug

SEQ ID NO: 2304804 - RNA, 22 nt, Yersinia pestis KIM
agauaaugugacugauuaaauc

SEQ ID NO: 2304805 - RNA, 23 nt, Yersinia pestis KIM
agauaauguucguuuuuuggguu

SEQ ID NO: 2304806 - RNA, 17 nt, Yersinia pestis KIM
agauuguuuauaaauua

SEQ ID NO: 2304807 - RNA, 21 nt, Yersinia pestis KIM
agauuguuuauaaauuaaaaa

SEQ ID NO: 2304808 - RNA, 15 nt, Yersinia pestis KIM
agauugugcuccagc

SEQ ID NO: 2304809 - RNA, 19 nt, Yersinia pestis KIM
agauaaggggauugcugcc

SEQ ID NO: 2304810 - RNA, 18 nt, Yersinia pestis KIM
agauaaggcauauacaac

SEQ ID NO: 2304811 - RNA, 15 nt, Yersinia pestis KIM
agauuucaaacgcau

SEQ ID NO: 2304812 - RNA, 19 nt, Yersinia pestis KIM
agauuucagacugcugaca

SEQ ID NO: 2304813 - RNA, 14 nt, Yersinia pestis KIM
agauuucagacugc

SEQ ID NO: 2304814 - RNA, 12 nt, Yersinia pestis KIM
agauuuaccaug

SEQ ID NO: 2304815 - RNA, 20 nt, Yersinia pestis KIM
agauuucgguuaauauugaa

SEQ ID NO: 2304816 - RNA, 15 nt, Yersinia pestis KIM
agcaaacgaacgaau

SEQ ID NO: 2304817 - RNA, 16 nt, Yersinia pestis KIM
agcaaacgaacgaaua

SEQ ID NO: 2304818 - RNA, 20 nt, Yersinia pestis KIM
agcaaacgauccgaauuuau

SEQ ID NO: 2304819 - RNA, 18 nt, Yersinia pestis KIM
agcaaacggguggccaca

SEQ ID NO: 2304820 - RNA, 14 nt, Yersinia pestis KIM
agcaaaggcccgcu

SEQ ID NO: 2304821 - RNA, 17 nt, Yersinia pestis KIM
agcaaaguauuuauaca

SEQ ID NO: 2304822 - RNA, 23 nt, Yersinia pestis KIM
agcaaagucccggcuaggaggcc

SEQ ID NO: 2304823 - RNA, 16 nt, Yersinia pestis KIM
agcaaauaaacaaaau

SEQ ID NO: 2304824 - RNA, 15 nt, Yersinia pestis KIM
agcaaaucauuuaau

SEQ ID NO: 2304825 - RNA, 17 nt, Yersinia pestis KIM
agcaaaaaaaaagccug

SEQ ID NO: 2304826 - RNA, 17 nt, Yersinia pestis KIM
agauuuuuuaugucaga

SEQ ID NO: 2304827 - RNA, 17 nt, Yersinia pestis KIM
agauuuuccauccccug

SEQ ID NO: 2304828 - RNA, 14 nt, Yersinia pestis KIM
agcaaaaaggcugc

SEQ ID NO: 2304829 - RNA, 13 nt, Yersinia pestis KIM
agcaaaaagccag

SEQ ID NO: 2304830 - RNA, 19 nt, Yersinia pestis KIM
agcacuuuacgauuucgcu

SEQ ID NO: 2304831 - RNA, 16 nt, Yersinia pestis KIM
agcacuugcagauuau

SEQ ID NO: 2304832 - RNA, 12 nt, Yersinia pestis KIM
agcagaacaaaa

SEQ ID NO: 2304833 - RNA, 14 nt, Yersinia pestis KIM
agcagaaagcagca

SEQ ID NO: 2304834 - RNA, 17 nt, Yersinia pestis KIM
agcagaaagcagcagcu

SEQ ID NO: 2304835 - RNA, 13 nt, Yersinia pestis KIM
agcagacuugaac

SEQ ID NO: 2304836 - RNA, 18 nt, Yersinia pestis KIM
agcagacuuacgcgaugc

SEQ ID NO: 2304837 - RNA, 21 nt, Yersinia pestis KIM
agcagacaacugacaacauca

SEQ ID NO: 2304838 - RNA, 13 nt, Yersinia pestis KIM
agcagaauacugu

SEQ ID NO: 2304839 - RNA, 19 nt, Yersinia pestis KIM
agcagagauccggugaaga

SEQ ID NO: 2304840 - RNA, 18 nt, Yersinia pestis KIM
agcagagucgcaaaaaau

SEQ ID NO: 2304841 - RNA, 22 nt, Yersinia pestis KIM
agcagauggucaacuaaacaga

SEQ ID NO: 2304842 - RNA, 14 nt, Yersinia pestis KIM
agcagcaacuguuu

SEQ ID NO: 2304843 - RNA, 21 nt, Yersinia pestis KIM
agcacgguguguugaaauuug

SEQ ID NO: 2304844 - RNA, 23 nt, Yersinia pestis KIM
agcacgguguguugaaauuuguu

SEQ ID NO: 2304845 - RNA, 14 nt, Yersinia pestis KIM
agcacguaccgcug

SEQ ID NO: 2304846 - RNA, 21 nt, Yersinia pestis KIM
agcacuaagugcuggccuagg

SEQ ID NO: 2304847 - RNA, 17 nt, Yersinia pestis KIM
agcacuauuuucuacug

SEQ ID NO: 2304848 - RNA, 13 nt, Yersinia pestis KIM
agcacucaguaca

SEQ ID NO: 2304849 - RNA, 15 nt, Yersinia pestis KIM
agcacucauaaugcu

SEQ ID NO: 2304850 - RNA, 22 nt, Yersinia pestis KIM
agcacugcgcgaucccagaaug

SEQ ID NO: 2304851 - RNA, 21 nt, Yersinia pestis KIM
agcacugcuagguuuacuguu

SEQ ID NO: 2304852 - RNA, 12 nt, Yersinia pestis KIM
agcacugccccg

SEQ ID NO: 2304853 - RNA, 21 nt, Yersinia pestis KIM
agcacugccccgaagcucaag

SEQ ID NO: 2304854 - RNA, 18 nt, Yersinia pestis KIM
agcacugcgcgaucccag

SEQ ID NO: 2304855 - RNA, 22 nt, Yersinia pestis KIM
agcacgaauuuuauucagcaag

SEQ ID NO: 2304856 - RNA, 20 nt, Yersinia pestis KIM
agcacgaaccugagcgauca

SEQ ID NO: 2304857 - RNA, 17 nt, Yersinia pestis KIM
agcacggcaggcgguua

SEQ ID NO: 2304858 - RNA, 16 nt, Yersinia pestis KIM
agcacgcuuuccagcu

SEQ ID NO: 2304859 - RNA, 16 nt, Yersinia pestis KIM
agcaccauuaucuucc

SEQ ID NO: 2304860 - RNA, 16 nt, Yersinia pestis KIM
agcaccauucaaugua

SEQ ID NO: 2304861 - RNA, 20 nt, Yersinia pestis KIM
agcaccuaucgccgccgcca

SEQ ID NO: 2304862 - RNA, 17 nt, Yersinia pestis KIM
agcaccggauggucacc

SEQ ID NO: 2304863 - RNA, 16 nt, Yersinia pestis KIM
agcacagacaaacaac

SEQ ID NO: 2304864 - RNA, 20 nt, Yersinia pestis KIM
agcacagccugccgggauga

SEQ ID NO: 2304865 - RNA, 17 nt, Yersinia pestis KIM
agcacagccugccggga

SEQ ID NO: 2304866 - RNA, 14 nt, Yersinia pestis KIM
agcacauuaacaca

SEQ ID NO: 2304867 - RNA, 14 nt, Yersinia pestis KIM
agcaccaaaucuuc

SEQ ID NO: 2304868 - RNA, 18 nt, Yersinia pestis KIM
agcaccagaaaguuguuc

SEQ ID NO: 2304869 - RNA, 12 nt, Yersinia pestis KIM
agcaccacaaug

SEQ ID NO: 2304870 - RNA, 16 nt, Yersinia pestis KIM
agcaccacaauggcag

SEQ ID NO: 2304871 - RNA, 18 nt, Yersinia pestis KIM
agcacaccggccaaaauc

SEQ ID NO: 2304872 - RNA, 19 nt, Yersinia pestis KIM
agcacaccggccaaaauca

SEQ ID NO: 2304873 - RNA, 21 nt, Yersinia pestis KIM
agcacaagcgccugcgacagc

SEQ ID NO: 2304874 - RNA, 22 nt, Yersinia pestis KIM
agcacaacgcucuaacgucaga

SEQ ID NO: 2304875 - RNA, 17 nt, Yersinia pestis KIM
agcacacaggcagcuug

SEQ ID NO: 2304876 - RNA, 23 nt, Yersinia pestis KIM
agcacaaacauggcggcagcaca

SEQ ID NO: 2304877 - RNA, 23 nt, Yersinia pestis KIM
agcaggggguuuucugaauacca

SEQ ID NO: 2304878 - RNA, 20 nt, Yersinia pestis KIM
agcaggcugugaucugccag

SEQ ID NO: 2304879 - RNA, 14 nt, Yersinia pestis KIM
agcaggcugcaccc

SEQ ID NO: 2304880 - RNA, 20 nt, Yersinia pestis KIM
agcaguaaacauuuugacuu

SEQ ID NO: 2304881 - RNA, 21 nt, Yersinia pestis KIM
agcaguaaguuaaaaagaaaa

SEQ ID NO: 2304882 - RNA, 21 nt, Yersinia pestis KIM
agcaggaaacaugcugaagcc

SEQ ID NO: 2304883 - RNA, 16 nt, Yersinia pestis KIM
agcaggcagagcaagg

SEQ ID NO: 2304884 - RNA, 14 nt, Yersinia pestis KIM
agcagcucaaaauc

SEQ ID NO: 2304885 - RNA, 22 nt, Yersinia pestis KIM
agcagccucuaacauacucaga

SEQ ID NO: 2304886 - RNA, 22 nt, Yersinia pestis KIM
agcagcccaacacuuuuaagga

SEQ ID NO: 2304887 - RNA, 12 nt, Yersinia pestis KIM
agcagccuguag

SEQ ID NO: 2304888 - RNA, 18 nt, Yersinia pestis KIM
agcagcgcauaaaaauac

SEQ ID NO: 2304889 - RNA, 17 nt, Yersinia pestis KIM
agcagccaacacaccug

SEQ ID NO: 2304890 - RNA, 21 nt, Yersinia pestis KIM
agcagcaucuggcgcagagua

SEQ ID NO: 2304891 - RNA, 14 nt, Yersinia pestis KIM
agcagucugauauc

SEQ ID NO: 2304892 - RNA, 17 nt, Yersinia pestis KIM
agcagucugagccucau

SEQ ID NO: 2304893 - RNA, 18 nt, Yersinia pestis KIM
agcagucugaggcccgcu

SEQ ID NO: 2304894 - RNA, 17 nt, Yersinia pestis KIM
agcaguaauagcaaaaa

SEQ ID NO: 2304895 - RNA, 16 nt, Yersinia pestis KIM
agcagucaaaaugaaa

SEQ ID NO: 2304896 - RNA, 13 nt, Yersinia pestis KIM
agcagugauuucu

SEQ ID NO: 2304897 - RNA, 20 nt, Yersinia pestis KIM
agcagugauuucuuacagug

SEQ ID NO: 2304898 - RNA, 15 nt, Yersinia pestis KIM
agcagugauuucagu

SEQ ID NO: 2304899 - RNA, 21 nt, Yersinia pestis KIM
agcagugucagggcaauaaca

SEQ ID NO: 2304900 - RNA, 23 nt, Yersinia pestis KIM
agcagugucagggcaauaacaaa

SEQ ID NO: 2304901 - RNA, 20 nt, Yersinia pestis KIM
agcaguucuggcucugcgac

SEQ ID NO: 2304902 - RNA, 18 nt, Yersinia pestis KIM
agcaguucuggcucugcg

SEQ ID NO: 2304903 - RNA, 16 nt, Yersinia pestis KIM
agcaguucacucuguu

SEQ ID NO: 2304904 - RNA, 12 nt, Yersinia pestis KIM
agcauaaauauc

SEQ ID NO: 2304905 - RNA, 20 nt, Yersinia pestis KIM
agcauaacgguuguauacaa

SEQ ID NO: 2304906 - RNA, 18 nt, Yersinia pestis KIM
agcauauacagcccggua

SEQ ID NO: 2304907 - RNA, 19 nt, Yersinia pestis KIM
agcauacguugccagccau

SEQ ID NO: 2304908 - RNA, 19 nt, Yersinia pestis KIM
agcauacuguuggcaauuu

SEQ ID NO: 2304909 - RNA, 22 nt, Yersinia pestis KIM
agcauagaagaagaauugcaga

SEQ ID NO: 2304910 - RNA, 23 nt, Yersinia pestis KIM
agcauaccgguuugggcaucaac

SEQ ID NO: 2304911 - RNA, 23 nt, Yersinia pestis KIM
agcaucuuuaauaaauuuucuaa

SEQ ID NO: 2304912 - RNA, 20 nt, Yersinia pestis KIM
agcaucuccgcgaccacaug

SEQ ID NO: 2304913 - RNA, 13 nt, Yersinia pestis KIM
agcaucaauaacg

SEQ ID NO: 2304914 - RNA, 22 nt, Yersinia pestis KIM
agcaucaauaacgguaaggccg

SEQ ID NO: 2304915 - RNA, 20 nt, Yersinia pestis KIM
agcaucacgauagccaguga

SEQ ID NO: 2304916 - RNA, 12 nt, Yersinia pestis KIM
agcaucaccaaa

SEQ ID NO: 2304917 - RNA, 15 nt, Yersinia pestis KIM
agcaucaacauggau

SEQ ID NO: 2304918 - RNA, 15 nt, Yersinia pestis KIM
agcaucaaacuuccc

SEQ ID NO: 2304919 - RNA, 18 nt, Yersinia pestis KIM
agcauauuacccaguacu

SEQ ID NO: 2304920 - RNA, 17 nt, Yersinia pestis KIM
agcauccaauaccacca

SEQ ID NO: 2304921 - RNA, 23 nt, Yersinia pestis KIM
agcauccagcucauauaaucaua

SEQ ID NO: 2304922 - RNA, 18 nt, Yersinia pestis KIM
agcaucaguaauuuuuug

SEQ ID NO: 2304923 - RNA, 15 nt, Yersinia pestis KIM
agcaucauccagcuc

SEQ ID NO: 2304924 - RNA, 16 nt, Yersinia pestis KIM
agcaucacugucuauu

SEQ ID NO: 2304925 - RNA, 13 nt, Yersinia pestis KIM
agcauuaaacaga

SEQ ID NO: 2304926 - RNA, 21 nt, Yersinia pestis KIM
agcauucaggcuuuuuucuag

SEQ ID NO: 2304927 - RNA, 14 nt, Yersinia pestis KIM
agcaugggcuugca

SEQ ID NO: 2304928 - RNA, 15 nt, Yersinia pestis KIM
agcaugcccagccuc

SEQ ID NO: 2304929 - RNA, 17 nt, Yersinia pestis KIM
agcaugccauccugcca

SEQ ID NO: 2304930 - RNA, 13 nt, Yersinia pestis KIM
agcaugcccagcc

SEQ ID NO: 2304931 - RNA, 20 nt, Yersinia pestis KIM
agcaugauggucaucauaua

SEQ ID NO: 2304932 - RNA, 13 nt, Yersinia pestis KIM
agcaugcauccau

SEQ ID NO: 2304933 - RNA, 15 nt, Yersinia pestis KIM
agccaacgauaauga

SEQ ID NO: 2304934 - RNA, 16 nt, Yersinia pestis KIM
agccaacuccuugaau

SEQ ID NO: 2304935 - RNA, 21 nt, Yersinia pestis KIM
agccaacuccuugaauauuuu

SEQ ID NO: 2304936 - RNA, 19 nt, Yersinia pestis KIM
agccaacacgaccugugca

SEQ ID NO: 2304937 - RNA, 22 nt, Yersinia pestis KIM
agccaaauuacgugcccaaaaa

SEQ ID NO: 2304938 - RNA, 11 nt, Yersinia pestis KIM
agccaaaugag

SEQ ID NO: 2304939 - RNA, 16 nt, Yersinia pestis KIM
agccaaaccccgccuc

SEQ ID NO: 2304940 - RNA, 21 nt, Yersinia pestis KIM
agccaaaccccgccucuucua

SEQ ID NO: 2304941 - RNA, 19 nt, Yersinia pestis KIM
agcauuuuucggugaacca

SEQ ID NO: 2304942 - RNA, 21 nt, Yersinia pestis KIM
agccaaacaaaugaacccuuu

SEQ ID NO: 2304943 - RNA, 18 nt, Yersinia pestis KIM
agccaaaauaaucaccag

SEQ ID NO: 2304944 - RNA, 21 nt, Yersinia pestis KIM
agccaaaauaaucaccagaca

SEQ ID NO: 2304945 - RNA, 14 nt, Yersinia pestis KIM
agccaaaauaauca

SEQ ID NO: 2304946 - RNA, 13 nt, Yersinia pestis KIM
agcauuuuccaau

SEQ ID NO: 2304947 - RNA, 23 nt, Yersinia pestis KIM
agcauuuuagugaugauauuuau

SEQ ID NO: 2304948 - RNA, 14 nt, Yersinia pestis KIM
agccaccagccaac

SEQ ID NO: 2304949 - RNA, 20 nt, Yersinia pestis KIM
agccaccccguggcaggccu

SEQ ID NO: 2304950 - RNA, 11 nt, Yersinia pestis KIM
agccaccagau

SEQ ID NO: 2304951 - RNA, 22 nt, Yersinia pestis KIM
agccaccaccacggccagaauc

SEQ ID NO: 2304952 - RNA, 20 nt, Yersinia pestis KIM
agccacacauucagucacuu

SEQ ID NO: 2304953 - RNA, 14 nt, Yersinia pestis KIM
agccacaauaauua

SEQ ID NO: 2304954 - RNA, 23 nt, Yersinia pestis KIM
agccacaaaaguucacaugauga

SEQ ID NO: 2304955 - RNA, 15 nt, Yersinia pestis KIM
agccacaaaccacgu

SEQ ID NO: 2304956 - RNA, 17 nt, Yersinia pestis KIM
agccacaacgcacugaa

SEQ ID NO: 2304957 - RNA, 16 nt, Yersinia pestis KIM
agccaagcaaccuugu

SEQ ID NO: 2304958 - RNA, 23 nt, Yersinia pestis KIM
agccaagcaagcggcagcgcugg

SEQ ID NO: 2304959 - RNA, 15 nt, Yersinia pestis KIM
agccaagccuuguaa

SEQ ID NO: 2304960 - RNA, 17 nt, Yersinia pestis KIM
agccaauccccagaagc

SEQ ID NO: 2304961 - RNA, 20 nt, Yersinia pestis KIM
agccaauacaggcaucggua

SEQ ID NO: 2304962 - RNA, 13 nt, Yersinia pestis KIM
agccaauaauaua

SEQ ID NO: 2304963 - RNA, 18 nt, Yersinia pestis KIM
agccauaaagugcguagg

SEQ ID NO: 2304964 - RNA, 14 nt, Yersinia pestis KIM
agccagucaggguu

SEQ ID NO: 2304965 - RNA, 23 nt, Yersinia pestis KIM
agccagucaggguuagccgacug

SEQ ID NO: 2304966 - RNA, 17 nt, Yersinia pestis KIM
agccauauguugccacc

SEQ ID NO: 2304967 - RNA, 14 nt, Yersinia pestis KIM
agccauaauaaugc

SEQ ID NO: 2304968 - RNA, 18 nt, Yersinia pestis KIM
agccauccuucagacugc

SEQ ID NO: 2304969 - RNA, 15 nt, Yersinia pestis KIM
agccauccaggcaag

SEQ ID NO: 2304970 - RNA, 18 nt, Yersinia pestis KIM
agccacucggguucuaaa

SEQ ID NO: 2304971 - RNA, 14 nt, Yersinia pestis KIM
agccaccgcacacu

SEQ ID NO: 2304972 - RNA, 14 nt, Yersinia pestis KIM
agccacgaguuuuc

SEQ ID NO: 2304973 - RNA, 20 nt, Yersinia pestis KIM
agccaccgcucgucacacug

SEQ ID NO: 2304974 - RNA, 11 nt, Yersinia pestis KIM
agccaccucac

SEQ ID NO: 2304975 - RNA, 16 nt, Yersinia pestis KIM
agccacgcugugucaa

SEQ ID NO: 2304976 - RNA, 20 nt, Yersinia pestis KIM
agccagccacugggcuaccc

SEQ ID NO: 2304977 - RNA, 13 nt, Yersinia pestis KIM
agccagccuuaac

SEQ ID NO: 2304978 - RNA, 17 nt, Yersinia pestis KIM
agccagccuuaacugca

SEQ ID NO: 2304979 - RNA, 16 nt, Yersinia pestis KIM
agccagccaccgcaca

SEQ ID NO: 2304980 - RNA, 16 nt, Yersinia pestis KIM
agccagcacacagaug

SEQ ID NO: 2304981 - RNA, 17 nt, Yersinia pestis KIM
agccagcacacagaugc

SEQ ID NO: 2304982 - RNA, 14 nt, Yersinia pestis KIM
acuuggacaucugc

SEQ ID NO: 2304983 - RNA, 20 nt, Yersinia pestis KIM
acuuggcuaauugucacaga

SEQ ID NO: 2304984 - RNA, 16 nt, Yersinia pestis KIM
acuugggggaagggcu

SEQ ID NO: 2304985 - RNA, 18 nt, Yersinia pestis KIM
acuuguaccugugccagu

SEQ ID NO: 2304986 - RNA, 14 nt, Yersinia pestis KIM
acuugauucaccag

SEQ ID NO: 2304987 - RNA, 19 nt, Yersinia pestis KIM
acuugauuaacaucgccac

SEQ ID NO: 2304988 - RNA, 15 nt, Yersinia pestis KIM
acuugcccugagugu

SEQ ID NO: 2304989 - RNA, 15 nt, Yersinia pestis KIM
acuugcccaauggca

SEQ ID NO: 2304990 - RNA, 19 nt, Yersinia pestis KIM
acuugccacaacugaaugu

SEQ ID NO: 2304991 - RNA, 16 nt, Yersinia pestis KIM
acuuccauaaacggaa

SEQ ID NO: 2304992 - RNA, 21 nt, Yersinia pestis KIM
acuucggauuaccggcacugg

SEQ ID NO: 2304993 - RNA, 16 nt, Yersinia pestis KIM
acuucguagugacugg

SEQ ID NO: 2304994 - RNA, 20 nt, Yersinia pestis KIM
acuucggggcguaaaugaug

SEQ ID NO: 2304995 - RNA, 16 nt, Yersinia pestis KIM
acuucuacagggcaua

SEQ ID NO: 2304996 - RNA, 13 nt, Yersinia pestis KIM
acuucgucugccc

SEQ ID NO: 2304997 - RNA, 18 nt, Yersinia pestis KIM
acuucugcgaccugaucc

SEQ ID NO: 2304998 - RNA, 19 nt, Yersinia pestis KIM
acuucuuauuaaucaagau

SEQ ID NO: 2304999 - RNA, 15 nt, Yersinia pestis KIM
acuucuuucacuaau

SEQ ID NO: 2305000 - RNA, 14 nt, Yersinia pestis KIM
acuguccaagaagc

SEQ ID NO: 2305001 - RNA, 18 nt, Yersinia pestis KIM
acugucauugcuguuguu

SEQ ID NO: 2305002 - RNA, 14 nt, Yersinia pestis KIM
acugucauugcugu

SEQ ID NO: 2305003 - RNA, 13 nt, Yersinia pestis KIM
acugucauugcug

SEQ ID NO: 2305004 - RNA, 14 nt, Yersinia pestis KIM
acugucaaaauccg

SEQ ID NO: 2305005 - RNA, 19 nt, Yersinia pestis KIM
acugucaaucgaugagcug

SEQ ID NO: 2305006 - RNA, 23 nt, Yersinia pestis KIM
acugucaccuagauaaucaagua

SEQ ID NO: 2305007 - RNA, 17 nt, Yersinia pestis KIM
acugucagucaaaagaa

SEQ ID NO: 2305008 - RNA, 19 nt, Yersinia pestis KIM
acugacgauuguccaggcu

SEQ ID NO: 2305009 - RNA, 18 nt, Yersinia pestis KIM
acugacguaguguauuca

SEQ ID NO: 2305010 - RNA, 18 nt, Yersinia pestis KIM
acugacggcagacaacca

SEQ ID NO: 2305011 - RNA, 20 nt, Yersinia pestis KIM
acuguacugggaugaagaaa

SEQ ID NO: 2305012 - RNA, 14 nt, Yersinia pestis KIM
acugugcugaauug

SEQ ID NO: 2305013 - RNA, 22 nt, Yersinia pestis KIM
acugugcgcggcuagccaccuc

SEQ ID NO: 2305014 - RNA, 12 nt, Yersinia pestis KIM
acuguugcaaac

SEQ ID NO: 2305015 - RNA, 15 nt, Yersinia pestis KIM
acuguugcaaacgga

SEQ ID NO: 2305016 - RNA, 22 nt, Yersinia pestis KIM
acugugauaaaccccaugguga

SEQ ID NO: 2305017 - RNA, 15 nt, Yersinia pestis KIM
acuuaauuucaguca

SEQ ID NO: 2305018 - RNA, 12 nt, Yersinia pestis KIM
acuucauaaaua

SEQ ID NO: 2305019 - RNA, 16 nt, Yersinia pestis KIM
acuuauuggaaguacu

SEQ ID NO: 2305020 - RNA, 11 nt, Yersinia pestis KIM
acuuauugguc

SEQ ID NO: 2305021 - RNA, 12 nt, Yersinia pestis KIM
acuuauuugaaa

SEQ ID NO: 2305022 - RNA, 15 nt, Yersinia pestis KIM
acuuauuugaaacac

SEQ ID NO: 2305023 - RNA, 13 nt, Yersinia pestis KIM
acuucaucaucaa

SEQ ID NO: 2305024 - RNA, 14 nt, Yersinia pestis KIM
acuucaucaucaac

SEQ ID NO: 2305025 - RNA, 21 nt, Yersinia pestis KIM
acuucaucauucauuuuaaaa

SEQ ID NO: 2305026 - RNA, 17 nt, Yersinia pestis KIM
acuucaucuuuuuuaau

SEQ ID NO: 2305027 - RNA, 19 nt, Yersinia pestis KIM
acuucaugacuaccuugcu

SEQ ID NO: 2305028 - RNA, 14 nt, Yersinia pestis KIM
acuuacgucuuuaa

SEQ ID NO: 2305029 - RNA, 20 nt, Yersinia pestis KIM
acuuacaggcugccugccug

SEQ ID NO: 2305030 - RNA, 14 nt, Yersinia pestis KIM
acuuauggguuuuu

SEQ ID NO: 2305031 - RNA, 23 nt, Yersinia pestis KIM
acuuaugaugugauuauuuuguu

SEQ ID NO: 2305032 - RNA, 12 nt, Yersinia pestis KIM
acuuauggguuu

SEQ ID NO: 2305033 - RNA, 15 nt, Yersinia pestis KIM
acuuauggguuuuua

SEQ ID NO: 2305034 - RNA, 20 nt, Yersinia pestis KIM
acuuauuacaccuuaaaaca

SEQ ID NO: 2305035 - RNA, 22 nt, Yersinia pestis KIM
acuuauuacaccuuaaaacagc

SEQ ID NO: 2305036 - RNA, 20 nt, Yersinia pestis KIM
acuuauucccacuuauuaua

SEQ ID NO: 2305037 - RNA, 15 nt, Yersinia pestis KIM
acuuuaagcugcaga

SEQ ID NO: 2305038 - RNA, 17 nt, Yersinia pestis KIM
acuuuaagcugcagagg

SEQ ID NO: 2305039 - RNA, 15 nt, Yersinia pestis KIM
acuuuaaauccaucg

SEQ ID NO: 2305040 - RNA, 23 nt, Yersinia pestis KIM
acuuuaaaaaaauuaucaucaau

SEQ ID NO: 2305041 - RNA, 22 nt, Yersinia pestis KIM
acuuguggcccggcauggacga

SEQ ID NO: 2305042 - RNA, 14 nt, Yersinia pestis KIM
acuuguucagagau

SEQ ID NO: 2305043 - RNA, 19 nt, Yersinia pestis KIM
acuuguucagagauaauca

SEQ ID NO: 2305044 - RNA, 22 nt, Yersinia pestis KIM
acuuuauucacagcagaacaaa

SEQ ID NO: 2305045 - RNA, 14 nt, Yersinia pestis KIM
acuuuaucugccaa

SEQ ID NO: 2305046 - RNA, 17 nt, Yersinia pestis KIM
acuuuauuuaaaauuaa

SEQ ID NO: 2305047 - RNA, 13 nt, Yersinia pestis KIM
acuuugcauuuuc

SEQ ID NO: 2305048 - RNA, 13 nt, Yersinia pestis KIM
acuuugcucuaau

SEQ ID NO: 2305049 - RNA, 17 nt, Yersinia pestis KIM
acuuuggcgcagaugau

SEQ ID NO: 2305050 - RNA, 22 nt, Yersinia pestis KIM
acuuuggguuaucccuaccaaa

SEQ ID NO: 2305051 - RNA, 20 nt, Yersinia pestis KIM
acuuuguacccgagccgcac

SEQ ID NO: 2305052 - RNA, 20 nt, Yersinia pestis KIM
acuuuguauuuugcacaaag

SEQ ID NO: 2305053 - RNA, 20 nt, Yersinia pestis KIM
acuuuuauaccgcagcauaa

SEQ ID NO: 2305054 - RNA, 16 nt, Yersinia pestis KIM
acuuuuauauccgcca

SEQ ID NO: 2305055 - RNA, 23 nt, Yersinia pestis KIM
acuuuuauauccgccauccuuca

SEQ ID NO: 2305056 - RNA, 22 nt, Yersinia pestis KIM
acuuugucaauaaccucagccu

SEQ ID NO: 2305057 - RNA, 19 nt, Yersinia pestis KIM
acuuugucaauaaccucag

SEQ ID NO: 2305058 - RNA, 21 nt, Yersinia pestis KIM
acuuugucaauaaccucagag

SEQ ID NO: 2305059 - RNA, 17 nt, Yersinia pestis KIM
acuuugucaauaaccuc

SEQ ID NO: 2305060 - RNA, 16 nt, Yersinia pestis KIM
acuuuccccagaugaa

SEQ ID NO: 2305061 - RNA, 13 nt, Yersinia pestis KIM
acuuuccuuccuc

SEQ ID NO: 2305062 - RNA, 12 nt, Yersinia pestis KIM
acuuugaaauua

SEQ ID NO: 2305063 - RNA, 19 nt, Yersinia pestis KIM
agaaaaccuucagcaaaga

SEQ ID NO: 2305064 - RNA, 18 nt, Yersinia pestis KIM
agaaaaccuucagcaaag

SEQ ID NO: 2305065 - RNA, 16 nt, Yersinia pestis KIM
acuuuuauuugauucg

SEQ ID NO: 2305066 - RNA, 21 nt, Yersinia pestis KIM
acuuuucaucgcauaggccaa

SEQ ID NO: 2305067 - RNA, 20 nt, Yersinia pestis KIM
agaaaaccuucagcaaagag

SEQ ID NO: 2305068 - RNA, 16 nt, Yersinia pestis KIM
agaaaagguauauuuu

SEQ ID NO: 2305069 - RNA, 13 nt, Yersinia pestis KIM
agaaauagcacca

SEQ ID NO: 2305070 - RNA, 19 nt, Yersinia pestis KIM
agaaauaaguugaaccaua

SEQ ID NO: 2305071 - RNA, 14 nt, Yersinia pestis KIM
agaaauaauaucaa

SEQ ID NO: 2305072 - RNA, 15 nt, Yersinia pestis KIM
agaaauaaucauauc

SEQ ID NO: 2305073 - RNA, 16 nt, Yersinia pestis KIM
agaaauacagaaaaau

SEQ ID NO: 2305074 - RNA, 15 nt, Yersinia pestis KIM
agaaauacuguuggu

SEQ ID NO: 2305075 - RNA, 22 nt, Yersinia pestis KIM
agaaauacuguugguaaauaac

SEQ ID NO: 2305076 - RNA, 17 nt, Yersinia pestis KIM
agaaauaaguugaacca

SEQ ID NO: 2305077 - RNA, 14 nt, Yersinia pestis KIM
agaaauaaauucau

SEQ ID NO: 2305078 - RNA, 18 nt, Yersinia pestis KIM
agaaacauccuaaaaagc

SEQ ID NO: 2305079 - RNA, 17 nt, Yersinia pestis KIM
agauaaauaaaauaaua

SEQ ID NO: 2305080 - RNA, 14 nt, Yersinia pestis KIM
agauaaauauuuaa

SEQ ID NO: 2305081 - RNA, 17 nt, Yersinia pestis KIM
agauaaacaaacaucau

SEQ ID NO: 2305082 - RNA, 20 nt, Yersinia pestis KIM
agauaaaaauaaucaaugac

SEQ ID NO: 2305083 - RNA, 13 nt, Yersinia pestis KIM
agauaaaaaauaa

SEQ ID NO: 2305084 - RNA, 21 nt, Yersinia pestis KIM
agauaaaaacauuuaaauaug

SEQ ID NO: 2305085 - RNA, 12 nt, Yersinia pestis KIM
agauaacaacaa

SEQ ID NO: 2305086 - RNA, 13 nt, Yersinia pestis KIM
agauaacaacaaa

SEQ ID NO: 2305087 - RNA, 23 nt, Yersinia pestis KIM
agauaaccacuucaauugccaug

SEQ ID NO: 2305088 - RNA, 21 nt, Yersinia pestis KIM
agauaaccggcuggaaauuca

SEQ ID NO: 2305089 - RNA, 21 nt, Yersinia pestis KIM
agauaacgauaacuccagggu

SEQ ID NO: 2305090 - RNA, 19 nt, Yersinia pestis KIM
agauaacguaaaaaccaac

SEQ ID NO: 2305091 - RNA, 21 nt, Yersinia pestis KIM
agauaacguaaaaaccaaccg

SEQ ID NO: 2305092 - RNA, 20 nt, Yersinia pestis KIM
agauaacuuuuuauuucuuu

SEQ ID NO: 2305093 - RNA, 13 nt, Yersinia pestis KIM
agaguaaccaguc

SEQ ID NO: 2305094 - RNA, 22 nt, Yersinia pestis KIM
agagggccccgauuaaggagcc

SEQ ID NO: 2305095 - RNA, 23 nt, Yersinia pestis KIM
agaggcugaaggcgcuccccugc

SEQ ID NO: 2305096 - RNA, 24 nt, Yersinia pestis KIM
agagugcuggcaagcccugaguac

SEQ ID NO: 2305097 - RNA, 13 nt, Yersinia pestis KIM
agaguuagggcug

SEQ ID NO: 2305098 - RNA, 17 nt, Yersinia pestis KIM
agaguguucauaaauua

SEQ ID NO: 2305099 - RNA, 21 nt, Yersinia pestis KIM
agaguguucauaaauuaaaac

SEQ ID NO: 2305100 - RNA, 13 nt, Yersinia pestis KIM
agaggaaagagag

SEQ ID NO: 2305101 - RNA, 13 nt, Yersinia pestis KIM
agaggaaauaaau

SEQ ID NO: 2305102 - RNA, 17 nt, Yersinia pestis KIM
agagcguccugauuuag

SEQ ID NO: 2305103 - RNA, 18 nt, Yersinia pestis KIM
agagcggucgacaaaaug

SEQ ID NO: 2305104 - RNA, 16 nt, Yersinia pestis KIM
agaggcgcuagucucu

SEQ ID NO: 2305105 - RNA, 13 nt, Yersinia pestis KIM
agagaccacagau

SEQ ID NO: 2305106 - RNA, 22 nt, Yersinia pestis KIM
agagcaguaaguuaaaaagaaa

SEQ ID NO: 2305107 - RNA, 13 nt, Yersinia pestis KIM
agagccaccagaa

SEQ ID NO: 2305108 - RNA, 17 nt, Yersinia pestis KIM
agagaacgggcaaccug

SEQ ID NO: 2305109 - RNA, 20 nt, Yersinia pestis KIM
agagacaaaaauagaaggcc

SEQ ID NO: 2305110 - RNA, 20 nt, Yersinia pestis KIM
agacuuuauucacagcagaa

SEQ ID NO: 2305111 - RNA, 19 nt, Yersinia pestis KIM
agacuucgguauggcgcuu

SEQ ID NO: 2305112 - RNA, 19 nt, Yersinia pestis KIM
agacuuggguaaccaauca

SEQ ID NO: 2305113 - RNA, 22 nt, Yersinia pestis KIM
agagaaaagcagacuugaacuu

SEQ ID NO: 2305114 - RNA, 19 nt, Yersinia pestis KIM
agagaaauacagaaaaaua

SEQ ID NO: 2305115 - RNA, 16 nt, Yersinia pestis KIM
agacgccggcuucccu

SEQ ID NO: 2305116 - RNA, 21 nt, Yersinia pestis KIM
agacucaucgggacuaugagc

SEQ ID NO: 2305117 - RNA, 22 nt, Yersinia pestis KIM
agacugaaguuuaccgcaugaa

SEQ ID NO: 2305118 - RNA, 16 nt, Yersinia pestis KIM
agacugacgcagagcu

SEQ ID NO: 2305119 - RNA, 20 nt, Yersinia pestis KIM
agacugacgcagagcuaaau

SEQ ID NO: 2305120 - RNA, 22 nt, Yersinia pestis KIM
agacugacgcagagcuaaaugu

SEQ ID NO: 2305121 - RNA, 20 nt, Yersinia pestis KIM
agacugaaaguagaaauaaa

SEQ ID NO: 2305122 - RNA, 16 nt, Yersinia pestis KIM
agacugcucuuucccu

SEQ ID NO: 2305123 - RNA, 13 nt, Yersinia pestis KIM
agacugcugacaa

SEQ ID NO: 2305124 - RNA, 20 nt, Yersinia pestis KIM
agacugcugacaaaccccga

SEQ ID NO: 2305125 - RNA, 15 nt, Yersinia pestis KIM
agacugcugacaacc

SEQ ID NO: 2305126 - RNA, 23 nt, Yersinia pestis KIM
agaauuuuuuuagauaucagaaa

SEQ ID NO: 2305127 - RNA, 14 nt, Yersinia pestis KIM
agacaaacaaccua

SEQ ID NO: 2305128 - RNA, 22 nt, Yersinia pestis KIM
agacaaccacccgacaucaaga

SEQ ID NO: 2305129 - RNA, 23 nt, Yersinia pestis KIM
agaauuuucucauuaauaaugau

SEQ ID NO: 2305130 - RNA, 18 nt, Yersinia pestis KIM
agaauuauaacuauuauc

SEQ ID NO: 2305131 - RNA, 16 nt, Yersinia pestis KIM
agacacaagauaaaua

SEQ ID NO: 2305132 - RNA, 22 nt, Yersinia pestis KIM
agacaccuucccuauucaaaau

SEQ ID NO: 2305133 - RNA, 16 nt, Yersinia pestis KIM
agacaguaacuaaagc

SEQ ID NO: 2305134 - RNA, 13 nt, Yersinia pestis KIM
agacaguaacuaa

SEQ ID NO: 2305135 - RNA, 17 nt, Yersinia pestis KIM
agacaguaaauccugau

SEQ ID NO: 2305136 - RNA, 13 nt, Yersinia pestis KIM
agacccgauuuca

SEQ ID NO: 2305137 - RNA, 16 nt, Yersinia pestis KIM
agaccccugcgauaau

SEQ ID NO: 2305138 - RNA, 16 nt, Yersinia pestis KIM
agacccggcaaauaaa

SEQ ID NO: 2305139 - RNA, 17 nt, Yersinia pestis KIM
agacccggcaaauaaau

SEQ ID NO: 2305140 - RNA, 14 nt, Yersinia pestis KIM
agaccacagauaaa

SEQ ID NO: 2305141 - RNA, 20 nt, Yersinia pestis KIM
agaccaaauagcaagccaaa

SEQ ID NO: 2305142 - RNA, 19 nt, Yersinia pestis KIM
agaccggacauuaauuauu

SEQ ID NO: 2305143 - RNA, 16 nt, Yersinia pestis KIM
agaaguucagaccagc

SEQ ID NO: 2305144 - RNA, 17 nt, Yersinia pestis KIM
agaaggccaguaguaaa

SEQ ID NO: 2305145 - RNA, 22 nt, Yersinia pestis KIM
agaagccauuagccccaaaugc

SEQ ID NO: 2305146 - RNA, 20 nt, Yersinia pestis KIM
agaagcccugaguuaaguaa

SEQ ID NO: 2305147 - RNA, 15 nt, Yersinia pestis KIM
agaagccucaugaau

SEQ ID NO: 2305148 - RNA, 18 nt, Yersinia pestis KIM
agaagccucaugaaugag

SEQ ID NO: 2305149 - RNA, 19 nt, Yersinia pestis KIM
agaagccucaugaaugagg

SEQ ID NO: 2305150 - RNA, 22 nt, Yersinia pestis KIM
agaagccucaugaaugaggcug

SEQ ID NO: 2305151 - RNA, 16 nt, Yersinia pestis KIM
agaagcgcacaucggu

SEQ ID NO: 2305152 - RNA, 15 nt, Yersinia pestis KIM
agaaggauugaccaa

SEQ ID NO: 2305153 - RNA, 16 nt, Yersinia pestis KIM
agaagcguaaagcacc

SEQ ID NO: 2305154 - RNA, 21 nt, Yersinia pestis KIM
agaaauucaacuugccugaaa

SEQ ID NO: 2305155 - RNA, 19 nt, Yersinia pestis KIM
agaagacgaguaaugaaau

SEQ ID NO: 2305156 - RNA, 19 nt, Yersinia pestis KIM
agaaucacugucaaaaagc

SEQ ID NO: 2305157 - RNA, 14 nt, Yersinia pestis KIM
agaaucaguagguu

SEQ ID NO: 2305158 - RNA, 22 nt, Yersinia pestis KIM
agaauccaacccguacucugac

SEQ ID NO: 2305159 - RNA, 18 nt, Yersinia pestis KIM
agaauccacauaaaaaga

SEQ ID NO: 2305160 - RNA, 15 nt, Yersinia pestis KIM
agaauguuaaacccc

SEQ ID NO: 2305161 - RNA, 16 nt, Yersinia pestis KIM
agaauguguaguugaa

SEQ ID NO: 2305162 - RNA, 20 nt, Yersinia pestis KIM
agaaugcaaccaguuaaaga

SEQ ID NO: 2305163 - RNA, 14 nt, Yersinia pestis KIM
agaauaucuuccac

SEQ ID NO: 2305164 - RNA, 23 nt, Yersinia pestis KIM
agaauaauccccacggccagagc

SEQ ID NO: 2305165 - RNA, 17 nt, Yersinia pestis KIM
agaauaggcaggggagu

SEQ ID NO: 2305166 - RNA, 16 nt, Yersinia pestis KIM
acgcuuuacuccucug

SEQ ID NO: 2305167 - RNA, 23 nt, Yersinia pestis KIM
acgcuuuacuccucugccuaucc

SEQ ID NO: 2305168 - RNA, 22 nt, Yersinia pestis KIM
acgcuuuaaaacuguggcugaa

SEQ ID NO: 2305169 - RNA, 19 nt, Yersinia pestis KIM
acgcugcaccgcugauaac

SEQ ID NO: 2305170 - RNA, 20 nt, Yersinia pestis KIM
acgcugcccgucaauaucau

SEQ ID NO: 2305171 - RNA, 14 nt, Yersinia pestis KIM
acggcagcaacgaa

SEQ ID NO: 2305172 - RNA, 15 nt, Yersinia pestis KIM
acggcagcaacgaaa

SEQ ID NO: 2305173 - RNA, 18 nt, Yersinia pestis KIM
acggcacucuauuuucgu

SEQ ID NO: 2305174 - RNA, 19 nt, Yersinia pestis KIM
acggauacgcaaaccaugg

SEQ ID NO: 2305175 - RNA, 23 nt, Yersinia pestis KIM
acgcuuucagggaguaacuugac

SEQ ID NO: 2305176 - RNA, 22 nt, Yersinia pestis KIM
acgcuuucaggagugaauuucu

SEQ ID NO: 2305177 - RNA, 17 nt, Yersinia pestis KIM
acgcuuugacuuuggcu

SEQ ID NO: 2305178 - RNA, 13 nt, Yersinia pestis KIM
acggagaagagga

SEQ ID NO: 2305179 - RNA, 19 nt, Yersinia pestis KIM
acggacuaauacggguuuc

SEQ ID NO: 2305180 - RNA, 20 nt, Yersinia pestis KIM
acggagagucagcaagguga

SEQ ID NO: 2305181 - RNA, 18 nt, Yersinia pestis KIM
acggagcguacacgcagu

SEQ ID NO: 2305182 - RNA, 16 nt, Yersinia pestis KIM
acggcagcgagcacug

SEQ ID NO: 2305183 - RNA, 21 nt, Yersinia pestis KIM
acggcagugaucgcacuucaa

SEQ ID NO: 2305184 - RNA, 19 nt, Yersinia pestis KIM
acggcauagaguaaccagu

SEQ ID NO: 2305185 - RNA, 22 nt, Yersinia pestis KIM
acggcaucgaguccguuaaaaa

SEQ ID NO: 2305186 - RNA, 15 nt, Yersinia pestis KIM
acggcauuagugaau

SEQ ID NO: 2305187 - RNA, 22 nt, Yersinia pestis KIM
acggcgguuaaucggaugguca

SEQ ID NO: 2305188 - RNA, 20 nt, Yersinia pestis KIM
acggcgcagggcgauaucca

SEQ ID NO: 2305189 - RNA, 17 nt, Yersinia pestis KIM
acggcucaucacaccgc

SEQ ID NO: 2305190 - RNA, 14 nt, Yersinia pestis KIM
acggcucaggugcu

SEQ ID NO: 2305191 - RNA, 14 nt, Yersinia pestis KIM
acggcgucuuuacg

SEQ ID NO: 2305192 - RNA, 22 nt, Yersinia pestis KIM
acgcgguuaacgacgcauuaau

SEQ ID NO: 2305193 - RNA, 20 nt, Yersinia pestis KIM
acgcuaccaugagugaaaau

SEQ ID NO: 2305194 - RNA, 21 nt, Yersinia pestis KIM
acgcuaauuauuuuauuuaaa

SEQ ID NO: 2305195 - RNA, 12 nt, Yersinia pestis KIM
acgcuaauuaaa

SEQ ID NO: 2305196 - RNA, 22 nt, Yersinia pestis KIM
acgcuccgguuuucacccccac

SEQ ID NO: 2305197 - RNA, 15 nt, Yersinia pestis KIM
acgcuccucacuuug

SEQ ID NO: 2305198 - RNA, 18 nt, Yersinia pestis KIM
acgcucgcugcuggaagu

SEQ ID NO: 2305199 - RNA, 18 nt, Yersinia pestis KIM
acgcggcuuuuaucuucc

SEQ ID NO: 2305200 - RNA, 19 nt, Yersinia pestis KIM
acgcggcguuccucuugag

SEQ ID NO: 2305201 - RNA, 14 nt, Yersinia pestis KIM
acgcgggauauaag

SEQ ID NO: 2305202 - RNA, 22 nt, Yersinia pestis KIM
acgcgccuccaguuuuccagag

SEQ ID NO: 2305203 - RNA, 14 nt, Yersinia pestis KIM
acgcgccgcagcag

SEQ ID NO: 2305204 - RNA, 14 nt, Yersinia pestis KIM
acgccgaugaaggu

SEQ ID NO: 2305205 - RNA, 15 nt, Yersinia pestis KIM
acgccgcucaauuaa

SEQ ID NO: 2305206 - RNA, 17 nt, Yersinia pestis KIM
acgcccaggccauagca

SEQ ID NO: 2305207 - RNA, 22 nt, Yersinia pestis KIM
acgcccgcagcggcuagcagca

SEQ ID NO: 2305208 - RNA, 13 nt, Yersinia pestis KIM
acgccuauccuca

SEQ ID NO: 2305209 - RNA, 16 nt, Yersinia pestis KIM
acgccggcuucccugu

SEQ ID NO: 2305210 - RNA, 22 nt, Yersinia pestis KIM
acgccgggguggauuaccggcg

SEQ ID NO: 2305211 - RNA, 22 nt, Yersinia pestis KIM
acgccuuggcguuucugaagau

SEQ ID NO: 2305212 - RNA, 16 nt, Yersinia pestis KIM
acgcgaauaucaggca

SEQ ID NO: 2305213 - RNA, 15 nt, Yersinia pestis KIM
accggauaaaacaau

SEQ ID NO: 2305214 - RNA, 12 nt, Yersinia pestis KIM
accggauacaaa

SEQ ID NO: 2305215 - RNA, 15 nt, Yersinia pestis KIM
acgcaccauccagca

SEQ ID NO: 2305216 - RNA, 16 nt, Yersinia pestis KIM
acgcaccauccagcaa

SEQ ID NO: 2305217 - RNA, 21 nt, Yersinia pestis KIM
acgcacacgaaucaggcggcu

SEQ ID NO: 2305218 - RNA, 19 nt, Yersinia pestis KIM
acgcagaauaacggcagua

SEQ ID NO: 2305219 - RNA, 16 nt, Yersinia pestis KIM
acgcacucgaaucacu

SEQ ID NO: 2305220 - RNA, 15 nt, Yersinia pestis KIM
acgcagauaaaucag

SEQ ID NO: 2305221 - RNA, 22 nt, Yersinia pestis KIM
acgccaugcagcuaaaagaugc

SEQ ID NO: 2305222 - RNA, 13 nt, Yersinia pestis KIM
acgccauccacuc

SEQ ID NO: 2305223 - RNA, 19 nt, Yersinia pestis KIM
acgccaguaaacagccagc

SEQ ID NO: 2305224 - RNA, 22 nt, Yersinia pestis KIM
acgccaguaaacagccagcauc

SEQ ID NO: 2305225 - RNA, 14 nt, Yersinia pestis KIM
acgccauaaaagaa

SEQ ID NO: 2305226 - RNA, 16 nt, Yersinia pestis KIM
acgccagccucugcgc

SEQ ID NO: 2305227 - RNA, 16 nt, Yersinia pestis KIM
acgccacuuaucccaa

SEQ ID NO: 2305228 - RNA, 16 nt, Yersinia pestis KIM
acgcaucacaucuugc

SEQ ID NO: 2305229 - RNA, 15 nt, Yersinia pestis KIM
acgcaucaauaauaa

SEQ ID NO: 2305230 - RNA, 23 nt, Yersinia pestis KIM
acucacucucaucugaacuauug

SEQ ID NO: 2305231 - RNA, 22 nt, Yersinia pestis KIM
acucagaaaacagccaccagcc

SEQ ID NO: 2305232 - RNA, 23 nt, Yersinia pestis KIM
acucagaaaacagccaccagcca

SEQ ID NO: 2305233 - RNA, 12 nt, Yersinia pestis KIM
acucagaucacc

SEQ ID NO: 2305234 - RNA, 15 nt, Yersinia pestis KIM
acucagacaaucaug

SEQ ID NO: 2305235 - RNA, 21 nt, Yersinia pestis KIM
acucagcauccuccugaucuu

SEQ ID NO: 2305236 - RNA, 18 nt, Yersinia pestis KIM
acucaggcccugagauuc

SEQ ID NO: 2305237 - RNA, 20 nt, Yersinia pestis KIM
acucagcgacuccuggcaau

SEQ ID NO: 2305238 - RNA, 16 nt, Yersinia pestis KIM
acucaguucagccccc

SEQ ID NO: 2305239 - RNA, 21 nt, Yersinia pestis KIM
acucauacacuaauggcacgc

SEQ ID NO: 2305240 - RNA, 18 nt, Yersinia pestis KIM
acucaccuaaaucauaca

SEQ ID NO: 2305241 - RNA, 18 nt, Yersinia pestis KIM
acucaccuucuugguuag

SEQ ID NO: 2305242 - RNA, 16 nt, Yersinia pestis KIM
acucaccgccagcaau

SEQ ID NO: 2305243 - RNA, 21 nt, Yersinia pestis KIM
acucaccgccgaccaguggug

SEQ ID NO: 2305244 - RNA, 18 nt, Yersinia pestis KIM
acucacacagccagccuu

SEQ ID NO: 2305245 - RNA, 15 nt, Yersinia pestis KIM
acucauuauggauaa

SEQ ID NO: 2305246 - RNA, 22 nt, Yersinia pestis KIM
acucauguccagggcaaucagg

SEQ ID NO: 2305247 - RNA, 12 nt, Yersinia pestis KIM
acucauuuuuug

SEQ ID NO: 2305248 - RNA, 13 nt, Yersinia pestis KIM
acucauuuuuaag

SEQ ID NO: 2305249 - RNA, 19 nt, Yersinia pestis KIM
acucauuccgccuguuuuc

SEQ ID NO: 2305250 - RNA, 19 nt, Yersinia pestis KIM
acucauauuguccaaagga

SEQ ID NO: 2305251 - RNA, 13 nt, Yersinia pestis KIM
acucaucaaaaca

SEQ ID NO: 2305252 - RNA, 14 nt, Yersinia pestis KIM
acucaucaaaacaa

SEQ ID NO: 2305253 - RNA, 15 nt, Yersinia pestis KIM
acucaucuaauuuuc

SEQ ID NO: 2305254 - RNA, 20 nt, Yersinia pestis KIM
acucauccuaccgccagcug

SEQ ID NO: 2305255 - RNA, 17 nt, Yersinia pestis KIM
acuccacuuccucauuc

SEQ ID NO: 2305256 - RNA, 20 nt, Yersinia pestis KIM
acuccaucgccacuucuaac

SEQ ID NO: 2305257 - RNA, 21 nt, Yersinia pestis KIM
acucuucagccuauccucacc

SEQ ID NO: 2305258 - RNA, 23 nt, Yersinia pestis KIM
acucuccgggcauaaaugcaaua

SEQ ID NO: 2305259 - RNA, 15 nt, Yersinia pestis KIM
acucucccucaguga

SEQ ID NO: 2305260 - RNA, 13 nt, Yersinia pestis KIM
acucuucagccua

SEQ ID NO: 2305261 - RNA, 18 nt, Yersinia pestis KIM
acucuucagccuauccuc

SEQ ID NO: 2305262 - RNA, 19 nt, Yersinia pestis KIM
acucuucagccuauccuca

SEQ ID NO: 2305263 - RNA, 21 nt, Yersinia pestis KIM
acucuuaguuaugauccuuua

SEQ ID NO: 2305264 - RNA, 20 nt, Yersinia pestis KIM
acucuucuguauaugaagau

SEQ ID NO: 2305265 - RNA, 22 nt, Yersinia pestis KIM
acucuucuguauaugaagauaa

SEQ ID NO: 2305266 - RNA, 19 nt, Yersinia pestis KIM
acucuucggccuaucauca

SEQ ID NO: 2305267 - RNA, 15 nt, Yersinia pestis KIM
acucuuccuugcucu

SEQ ID NO: 2305268 - RNA, 21 nt, Yersinia pestis KIM
acugacauucuggcuuuucau

SEQ ID NO: 2305269 - RNA, 20 nt, Yersinia pestis KIM
acugaccgggaacaacgaaa

SEQ ID NO: 2305270 - RNA, 15 nt, Yersinia pestis KIM
acugaccgugcaggg

SEQ ID NO: 2305271 - RNA, 12 nt, Yersinia pestis KIM
acugaccuauug

SEQ ID NO: 2305272 - RNA, 19 nt, Yersinia pestis KIM
acugacaacaucaaaugaa

SEQ ID NO: 2305273 - RNA, 16 nt, Yersinia pestis KIM
acugacaacaucaaau

SEQ ID NO: 2305274 - RNA, 14 nt, Yersinia pestis KIM
acugacaacaucaa

SEQ ID NO: 2305275 - RNA, 17 nt, Yersinia pestis KIM
acugacaaguuuuuaag

SEQ ID NO: 2305276 - RNA, 17 nt, Yersinia pestis KIM
acugaacgccgaccuga

SEQ ID NO: 2305277 - RNA, 22 nt, Yersinia pestis KIM
acugaauggaucacaucacagu

SEQ ID NO: 2305278 - RNA, 15 nt, Yersinia pestis KIM
acugaauggcuauuu

SEQ ID NO: 2305279 - RNA, 12 nt, Yersinia pestis KIM
acugaaugugaa

SEQ ID NO: 2305280 - RNA, 17 nt, Yersinia pestis KIM
acugaaucccagaaccu

SEQ ID NO: 2305281 - RNA, 12 nt, Yersinia pestis KIM
acugaaguuauu

SEQ ID NO: 2305282 - RNA, 16 nt, Yersinia pestis KIM
acugaauaaacaccau

SEQ ID NO: 2305283 - RNA, 16 nt, Yersinia pestis KIM
acucgguccaucugaa

SEQ ID NO: 2305284 - RNA, 22 nt, Yersinia pestis KIM
acucggcgguuugagccaccgc

SEQ ID NO: 2305285 - RNA, 15 nt, Yersinia pestis KIM
acucguauaaaaaau

SEQ ID NO: 2305286 - RNA, 12 nt, Yersinia pestis KIM
acucguuuuaca

SEQ ID NO: 2305287 - RNA, 20 nt, Yersinia pestis KIM
acucguucucaaccaaauag

SEQ ID NO: 2305288 - RNA, 17 nt, Yersinia pestis KIM
acucuauuuucguaucc

SEQ ID NO: 2305289 - RNA, 18 nt, Yersinia pestis KIM
acucgcgacuacagaaaa

SEQ ID NO: 2305290 - RNA, 18 nt, Yersinia pestis KIM
acuccccgucagcaucau

SEQ ID NO: 2305291 - RNA, 17 nt, Yersinia pestis KIM
acucccguccugagcug

SEQ ID NO: 2305292 - RNA, 15 nt, Yersinia pestis KIM
acucccugacucccu

SEQ ID NO: 2305293 - RNA, 17 nt, Yersinia pestis KIM
acucccgccaagaaacg

SEQ ID NO: 2305294 - RNA, 13 nt, Yersinia pestis KIM
acucccuguuacg

SEQ ID NO: 2305295 - RNA, 16 nt, Yersinia pestis KIM
acuaacagaauauuga

SEQ ID NO: 2305296 - RNA, 16 nt, Yersinia pestis KIM
acuaaccucugcaaug

SEQ ID NO: 2305297 - RNA, 21 nt, Yersinia pestis KIM
acuaaaucgcaggcuuugguu

SEQ ID NO: 2305298 - RNA, 15 nt, Yersinia pestis KIM
acuaaauuagaaaac

SEQ ID NO: 2305299 - RNA, 23 nt, Yersinia pestis KIM
acuaaauggcuuucgaucaucac

SEQ ID NO: 2305300 - RNA, 15 nt, Yersinia pestis KIM
acuaaauuaaaugca

SEQ ID NO: 2305301 - RNA, 15 nt, Yersinia pestis KIM
acguugcacccugcu

SEQ ID NO: 2305302 - RNA, 14 nt, Yersinia pestis KIM
acguugccagccau

SEQ ID NO: 2305303 - RNA, 12 nt, Yersinia pestis KIM
acguucugccaa

SEQ ID NO: 2305304 - RNA, 21 nt, Yersinia pestis KIM
acuaauaauaauuaaucuuaa

SEQ ID NO: 2305305 - RNA, 17 nt, Yersinia pestis KIM
acuaauaucaacagaac

SEQ ID NO: 2305306 - RNA, 18 nt, Yersinia pestis KIM
acuaauaucaacagaacu

SEQ ID NO: 2305307 - RNA, 15 nt, Yersinia pestis KIM
acuaauagcauuuuu

SEQ ID NO: 2305308 - RNA, 17 nt, Yersinia pestis KIM
acuaauagcauuuuucg

SEQ ID NO: 2305309 - RNA, 22 nt, Yersinia pestis KIM
acuaacguuuuguaaucaacac

SEQ ID NO: 2305310 - RNA, 15 nt, Yersinia pestis KIM
acuaacgucccauuc

SEQ ID NO: 2305311 - RNA, 23 nt, Yersinia pestis KIM
acuaacgauugacggaaaauuaa

SEQ ID NO: 2305312 - RNA, 22 nt, Yersinia pestis KIM
acuaacaucagcgauucauuga

SEQ ID NO: 2305313 - RNA, 21 nt, Yersinia pestis KIM
acuauauucucauugcccccu

SEQ ID NO: 2305314 - RNA, 20 nt, Yersinia pestis KIM
acuagcggauuuauaaggaa

SEQ ID NO: 2305315 - RNA, 22 nt, Yersinia pestis KIM
acuacguuguuaucaucaccac

SEQ ID NO: 2305316 - RNA, 21 nt, Yersinia pestis KIM
acuacugcaagccguaauuca

SEQ ID NO: 2305317 - RNA, 19 nt, Yersinia pestis KIM
acguguuggcuaagcaugc

SEQ ID NO: 2305318 - RNA, 16 nt, Yersinia pestis KIM
acguuaaguucaagaa

SEQ ID NO: 2305319 - RNA, 12 nt, Yersinia pestis KIM
acguucaccaaa

SEQ ID NO: 2305320 - RNA, 22 nt, Yersinia pestis KIM
acguguacucauauuguccaaa

SEQ ID NO: 2305321 - RNA, 15 nt, Yersinia pestis KIM
acgugguugcggcac

SEQ ID NO: 2305322 - RNA, 22 nt, Yersinia pestis KIM
acgugggcgauaguaauuuuua

SEQ ID NO: 2305323 - RNA, 13 nt, Yersinia pestis KIM
acguggcguucac

SEQ ID NO: 2305324 - RNA, 11 nt, Yersinia pestis KIM
acgugaagaua

SEQ ID NO: 2305325 - RNA, 21 nt, Yersinia pestis KIM
acgugaagugagcugaacuga

SEQ ID NO: 2305326 - RNA, 13 nt, Yersinia pestis KIM
acguggaccauuu

SEQ ID NO: 2305327 - RNA, 20 nt, Yersinia pestis KIM
acgugcagcgcgcagccaac

SEQ ID NO: 2305328 - RNA, 23 nt, Yersinia pestis KIM
acgugaucgccgcuaauuuuccc

SEQ ID NO: 2305329 - RNA, 16 nt, Yersinia pestis KIM
acgugagaauugcugc

SEQ ID NO: 2305330 - RNA, 14 nt, Yersinia pestis KIM
acguagcuaacacc

SEQ ID NO: 2305331 - RNA, 13 nt, Yersinia pestis KIM
acgggcaaacucc

SEQ ID NO: 2305332 - RNA, 21 nt, Yersinia pestis KIM
acgggaucgagaguugcucac

SEQ ID NO: 2305333 - RNA, 17 nt, Yersinia pestis KIM
acgucaccgccaaaaua

SEQ ID NO: 2305334 - RNA, 14 nt, Yersinia pestis KIM
acgucaacagaacu

SEQ ID NO: 2305335 - RNA, 13 nt, Yersinia pestis KIM
acguauggcauga

SEQ ID NO: 2305336 - RNA, 18 nt, Yersinia pestis KIM
acguauucgucaccauca

SEQ ID NO: 2305337 - RNA, 19 nt, Yersinia pestis KIM
acguauuuucauuuuaaca

SEQ ID NO: 2305338 - RNA, 22 nt, Yersinia pestis KIM
acgucauugguguuacagcaag

SEQ ID NO: 2305339 - RNA, 18 nt, Yersinia pestis KIM
acgucagauaaacaaaca

SEQ ID NO: 2305340 - RNA, 17 nt, Yersinia pestis KIM
acgucaguaaugagggu

SEQ ID NO: 2305341 - RNA, 20 nt, Yersinia pestis KIM
accaugccaucaauguucgg

SEQ ID NO: 2305342 - RNA, 22 nt, Yersinia pestis KIM
accauggcggcucgccugauag

SEQ ID NO: 2305343 - RNA, 17 nt, Yersinia pestis KIM
accauuaauaauaugca

SEQ ID NO: 2305344 - RNA, 14 nt, Yersinia pestis KIM
accauguacauggc

SEQ ID NO: 2305345 - RNA, 14 nt, Yersinia pestis KIM
accauuugcccugg

SEQ ID NO: 2305346 - RNA, 14 nt, Yersinia pestis KIM
acccaaaggggagc

SEQ ID NO: 2305347 - RNA, 15 nt, Yersinia pestis KIM
acccaguaacugagc

SEQ ID NO: 2305348 - RNA, 18 nt, Yersinia pestis KIM
acccauauuacucacaca

SEQ ID NO: 2305349 - RNA, 20 nt, Yersinia pestis KIM
acccauauuggcaauauuca

SEQ ID NO: 2305350 - RNA, 18 nt, Yersinia pestis KIM
acccauacgaucagcaag

SEQ ID NO: 2305351 - RNA, 20 nt, Yersinia pestis KIM
acccauacgaucagcaagau

SEQ ID NO: 2305352 - RNA, 21 nt, Yersinia pestis KIM
acccagcuucuuuuaaagaag

SEQ ID NO: 2305353 - RNA, 14 nt, Yersinia pestis KIM
acccaccugaaucu

SEQ ID NO: 2305354 - RNA, 13 nt, Yersinia pestis KIM
acccacguucaga

SEQ ID NO: 2305355 - RNA, 15 nt, Yersinia pestis KIM
accaucugcuuaguu

SEQ ID NO: 2305356 - RNA, 17 nt, Yersinia pestis KIM
accaucugccugcaaau

SEQ ID NO: 2305357 - RNA, 15 nt, Yersinia pestis KIM
accaugaugacaaug

SEQ ID NO: 2305358 - RNA, 21 nt, Yersinia pestis KIM
accaugagugaaaauauguag

SEQ ID NO: 2305359 - RNA, 14 nt, Yersinia pestis KIM
accaugagaaugcg

SEQ ID NO: 2305360 - RNA, 22 nt, Yersinia pestis KIM
accaucuugucauuaccaaugg

SEQ ID NO: 2305361 - RNA, 14 nt, Yersinia pestis KIM
accagcuuggguga

SEQ ID NO: 2305362 - RNA, 15 nt, Yersinia pestis KIM
accaggaagcggcca

SEQ ID NO: 2305363 - RNA, 17 nt, Yersinia pestis KIM
accaggaagcggccagg

SEQ ID NO: 2305364 - RNA, 19 nt, Yersinia pestis KIM
accaucaauauaagagaaa

SEQ ID NO: 2305365 - RNA, 12 nt, Yersinia pestis KIM
accaucaauaua

SEQ ID NO: 2305366 - RNA, 15 nt, Yersinia pestis KIM
accaucaccauauca

SEQ ID NO: 2305367 - RNA, 17 nt, Yersinia pestis KIM
accauccccagaacagc

SEQ ID NO: 2305368 - RNA, 15 nt, Yersinia pestis KIM
accaucaaaauaugu

SEQ ID NO: 2305369 - RNA, 21 nt, Yersinia pestis KIM
accauauucccagccaacucc

SEQ ID NO: 2305370 - RNA, 22 nt, Yersinia pestis KIM
accaucaaauacacauaaccau

SEQ ID NO: 2305371 - RNA, 21 nt, Yersinia pestis KIM
accaucaauagcauuggcaca

SEQ ID NO: 2305372 - RNA, 17 nt, Yersinia pestis KIM
acccguaaacacaaaau

SEQ ID NO: 2305373 - RNA, 20 nt, Yersinia pestis KIM
acccguaggcccacaaucaa

SEQ ID NO: 2305374 - RNA, 18 nt, Yersinia pestis KIM
acccggugacccgugcgg

SEQ ID NO: 2305375 - RNA, 15 nt, Yersinia pestis KIM
acccggcaucaacca

SEQ ID NO: 2305376 - RNA, 18 nt, Yersinia pestis KIM
acccgcucugucagcccu

SEQ ID NO: 2305377 - RNA, 19 nt, Yersinia pestis KIM
acccgcucugucagcccua

SEQ ID NO: 2305378 - RNA, 17 nt, Yersinia pestis KIM
acccgcuggcgaccacu

SEQ ID NO: 2305379 - RNA, 17 nt, Yersinia pestis KIM
acccgcugcguacggac

SEQ ID NO: 2305380 - RNA, 17 nt, Yersinia pestis KIM
acccgcuugucuugaaa

SEQ ID NO: 2305381 - RNA, 20 nt, Yersinia pestis KIM
acccgcuucguccgcuuagc

SEQ ID NO: 2305382 - RNA, 15 nt, Yersinia pestis KIM
acccgcuguuucucu

SEQ ID NO: 2305383 - RNA, 14 nt, Yersinia pestis KIM
acccggcaaauaaa

SEQ ID NO: 2305384 - RNA, 23 nt, Yersinia pestis KIM
acccggcaaauaaauaccggcag

SEQ ID NO: 2305385 - RNA, 17 nt, Yersinia pestis KIM
acccgcgcagccuaaaa

SEQ ID NO: 2305386 - RNA, 16 nt, Yersinia pestis KIM
acccgcgggagucagu

SEQ ID NO: 2305387 - RNA, 16 nt, Yersinia pestis KIM
acccgccucuaaaucu

SEQ ID NO: 2305388 - RNA, 20 nt, Yersinia pestis KIM
acccauuucccugccgggac

SEQ ID NO: 2305389 - RNA, 15 nt, Yersinia pestis KIM
acccaucaauaauua

SEQ ID NO: 2305390 - RNA, 14 nt, Yersinia pestis KIM
accccuuuugauuu

SEQ ID NO: 2305391 - RNA, 13 nt, Yersinia pestis KIM
acccgauuucacg

SEQ ID NO: 2305392 - RNA, 18 nt, Yersinia pestis KIM
acccgccaucaggcaaaa

SEQ ID NO: 2305393 - RNA, 22 nt, Yersinia pestis KIM
accgcccgacuugcugaaucaa

SEQ ID NO: 2305394 - RNA, 12 nt, Yersinia pestis KIM
accgcccucuug

SEQ ID NO: 2305395 - RNA, 19 nt, Yersinia pestis KIM
accgccagcaauaagccac

SEQ ID NO: 2305396 - RNA, 23 nt, Yersinia pestis KIM
accgccagcaauaagccacgcug

SEQ ID NO: 2305397 - RNA, 18 nt, Yersinia pestis KIM
accgcaaccuguugugga

SEQ ID NO: 2305398 - RNA, 18 nt, Yersinia pestis KIM
accgcagauauccuuuuu

SEQ ID NO: 2305399 - RNA, 16 nt, Yersinia pestis KIM
accgaggcgcugacau

SEQ ID NO: 2305400 - RNA, 17 nt, Yersinia pestis KIM
accgaggcgcugacaua

SEQ ID NO: 2305401 - RNA, 20 nt, Yersinia pestis KIM
accgaggcgggucagaaaca

SEQ ID NO: 2305402 - RNA, 21 nt, Yersinia pestis KIM
accgaggcucgacgggaacga

SEQ ID NO: 2305403 - RNA, 17 nt, Yersinia pestis KIM
accgaggucauucaggu

SEQ ID NO: 2305404 - RNA, 19 nt, Yersinia pestis KIM
accgauaauaaauauccuc

SEQ ID NO: 2305405 - RNA, 17 nt, Yersinia pestis KIM
accgaguguaaaaagca

SEQ ID NO: 2305406 - RNA, 19 nt, Yersinia pestis KIM
accgccggcaacagcgccu

SEQ ID NO: 2305407 - RNA, 14 nt, Yersinia pestis KIM
accgcgaucacaau

SEQ ID NO: 2305408 - RNA, 21 nt, Yersinia pestis KIM
accggaaaaugcgccagccaa

SEQ ID NO: 2305409 - RNA, 17 nt, Yersinia pestis KIM
accggaauaaaucagug

SEQ ID NO: 2305410 - RNA, 15 nt, Yersinia pestis KIM
accgcuauaucauca

SEQ ID NO: 2305411 - RNA, 17 nt, Yersinia pestis KIM
accgagcgugaagagcg

SEQ ID NO: 2305412 - RNA, 18 nt, Yersinia pestis KIM
accgacgauaaucaggcu

SEQ ID NO: 2305413 - RNA, 17 nt, Yersinia pestis KIM
accgacgagggcuucug

SEQ ID NO: 2305414 - RNA, 22 nt, Yersinia pestis KIM
accgacagguuaggggugaugu

SEQ ID NO: 2305415 - RNA, 23 nt, Yersinia pestis KIM
accgaaauauucgucucaucaau

SEQ ID NO: 2305416 - RNA, 16 nt, Yersinia pestis KIM
accgaaagaagacaua

SEQ ID NO: 2305417 - RNA, 21 nt, Yersinia pestis KIM
acccugaaggcugauuaauau

SEQ ID NO: 2305418 - RNA, 21 nt, Yersinia pestis KIM
acccucugucggcaagcgaua

SEQ ID NO: 2305419 - RNA, 16 nt, Yersinia pestis KIM
acccucuuaaugaaug

SEQ ID NO: 2305420 - RNA, 23 nt, Yersinia pestis KIM
acccuugagguuauugacaaagu

SEQ ID NO: 2305421 - RNA, 18 nt, Yersinia pestis KIM
acccuugauuuuaccaac

SEQ ID NO: 2305422 - RNA, 22 nt, Yersinia pestis KIM
acccuccaauaauucgugaaaa

SEQ ID NO: 2305423 - RNA, 20 nt, Yersinia pestis KIM
acccuaauaccaacagcagg

SEQ ID NO: 2305424 - RNA, 17 nt, Yersinia pestis KIM
acccguugcauuuuucu

SEQ ID NO: 2305425 - RNA, 13 nt, Yersinia pestis KIM
acccuaauaccaa

SEQ ID NO: 2305426 - RNA, 14 nt, Yersinia pestis KIM
acccguuauauuuc

SEQ ID NO: 2305427 - RNA, 16 nt, Yersinia pestis KIM
accagcacauaaagcg

SEQ ID NO: 2305428 - RNA, 14 nt, Yersinia pestis KIM
accagcaagaaucc

SEQ ID NO: 2305429 - RNA, 17 nt, Yersinia pestis KIM
accagcaagaaucccau

SEQ ID NO: 2305430 - RNA, 21 nt, Yersinia pestis KIM
accagcaaagccucuaccaau

SEQ ID NO: 2305431 - RNA, 16 nt, Yersinia pestis KIM
accaccggguuuagua

SEQ ID NO: 2305432 - RNA, 16 nt, Yersinia pestis KIM
accaccgucaagacaa

SEQ ID NO: 2305433 - RNA, 19 nt, Yersinia pestis KIM
accaccuaauacagcacca

SEQ ID NO: 2305434 - RNA, 18 nt, Yersinia pestis KIM
accacgcaucaauaauaa

SEQ ID NO: 2305435 - RNA, 16 nt, Yersinia pestis KIM
accacgauuagccaua

SEQ ID NO: 2305436 - RNA, 14 nt, Yersinia pestis KIM
accacuaguuaaaa

SEQ ID NO: 2305437 - RNA, 15 nt, Yersinia pestis KIM
accacguugaauauu

SEQ ID NO: 2305438 - RNA, 16 nt, Yersinia pestis KIM
accacuuaguggcauu

SEQ ID NO: 2305439 - RNA, 15 nt, Yersinia pestis KIM
accacugugauaaac

SEQ ID NO: 2305440 - RNA, 13 nt, Yersinia pestis KIM
acauuuuucuauu

SEQ ID NO: 2305441 - RNA, 23 nt, Yersinia pestis KIM
acauuuugguuucuccaagcaca

SEQ ID NO: 2305442 - RNA, 17 nt, Yersinia pestis KIM
accaaaaguaucuuuca

SEQ ID NO: 2305443 - RNA, 14 nt, Yersinia pestis KIM
accaaaaugacaau

SEQ ID NO: 2305444 - RNA, 12 nt, Yersinia pestis KIM
accaaacauugu

SEQ ID NO: 2305445 - RNA, 13 nt, Yersinia pestis KIM
accaaacauuguc

SEQ ID NO: 2305446 - RNA, 19 nt, Yersinia pestis KIM
accaaacauuuucaucuga

SEQ ID NO: 2305447 - RNA, 20 nt, Yersinia pestis KIM
accaaacagaccccagaaga

SEQ ID NO: 2305448 - RNA, 13 nt, Yersinia pestis KIM
accaaauccaacu

SEQ ID NO: 2305449 - RNA, 21 nt, Yersinia pestis KIM
accaacaacuccacuuccuca

SEQ ID NO: 2305450 - RNA, 21 nt, Yersinia pestis KIM
accaaaucugacgguuauuuu

SEQ ID NO: 2305451 - RNA, 16 nt, Yersinia pestis KIM
accaaauuccccagcc

SEQ ID NO: 2305452 - RNA, 18 nt, Yersinia pestis KIM
accaaaucuuccagcggc

SEQ ID NO: 2305453 - RNA, 11 nt, Yersinia pestis KIM
accaaauucag

SEQ ID NO: 2305454 - RNA, 20 nt, Yersinia pestis KIM
acauuuggggugcaguucaa

SEQ ID NO: 2305455 - RNA, 20 nt, Yersinia pestis KIM
acauuuuacucccugacucc

SEQ ID NO: 2305456 - RNA, 14 nt, Yersinia pestis KIM
acauuucuuuuuau

SEQ ID NO: 2305457 - RNA, 18 nt, Yersinia pestis KIM
acauuucuuuuuauguua

SEQ ID NO: 2305458 - RNA, 18 nt, Yersinia pestis KIM
acauugucuaacaacugg

SEQ ID NO: 2305459 - RNA, 23 nt, Yersinia pestis KIM
acauugucaccuaaccaaacauu

SEQ ID NO: 2305460 - RNA, 16 nt, Yersinia pestis KIM
acauuguuauauuaac

SEQ ID NO: 2305461 - RNA, 22 nt, Yersinia pestis KIM
acauuuccuuguggauccagca

SEQ ID NO: 2305462 - RNA, 12 nt, Yersinia pestis KIM
accaagaacgcc

SEQ ID NO: 2305463 - RNA, 14 nt, Yersinia pestis KIM
accaacaccaaugg

SEQ ID NO: 2305464 - RNA, 14 nt, Yersinia pestis KIM
accaacaccaccau

SEQ ID NO: 2305465 - RNA, 17 nt, Yersinia pestis KIM
accaagaggaaaugccg

SEQ ID NO: 2305466 - RNA, 21 nt, Yersinia pestis KIM
accaagcccaguaaagcaaau

SEQ ID NO: 2305467 - RNA, 18 nt, Yersinia pestis KIM
accaagaggaaaugccgc

SEQ ID NO: 2305468 - RNA, 12 nt, Yersinia pestis KIM
accaagaggcug

SEQ ID NO: 2305469 - RNA, 24 nt, Yersinia pestis KIM
accaauaaucgggaaauugugauu

SEQ ID NO: 2305470 - RNA, 13 nt, Yersinia pestis KIM
accaauaauuaau

SEQ ID NO: 2305471 - RNA, 12 nt, Yersinia pestis KIM
accaauaagcug

SEQ ID NO: 2305472 - RNA, 18 nt, Yersinia pestis KIM
accaaugacuaauugugc

SEQ ID NO: 2305473 - RNA, 22 nt, Yersinia pestis KIM
accaaugaauuacguuuuggau

SEQ ID NO: 2305474 - RNA, 15 nt, Yersinia pestis KIM
accaaugacgauauu

SEQ ID NO: 2305475 - RNA, 10 nt, Yersinia pestis KIM
accaauggug

SEQ ID NO: 2305476 - RNA, 19 nt, Yersinia pestis KIM
accaauggcuaaaucauca

SEQ ID NO: 2305477 - RNA, 19 nt, Yersinia pestis KIM
accaauggacggaacacgu

SEQ ID NO: 2305478 - RNA, 13 nt, Yersinia pestis KIM
accaaugauuaac

SEQ ID NO: 2305479 - RNA, 20 nt, Yersinia pestis KIM
accaauguugggguagccaa

SEQ ID NO: 2305480 - RNA, 19 nt, Yersinia pestis KIM
accacagcgaucucauuua

SEQ ID NO: 2305481 - RNA, 14 nt, Yersinia pestis KIM
accacacuggaugc

SEQ ID NO: 2305482 - RNA, 19 nt, Yersinia pestis KIM
accacacugagcaccgcag

SEQ ID NO: 2305483 - RNA, 19 nt, Yersinia pestis KIM
acauaaccugcaacgcgga

SEQ ID NO: 2305484 - RNA, 18 nt, Yersinia pestis KIM
acauaacguuauaacuca

SEQ ID NO: 2305485 - RNA, 21 nt, Yersinia pestis KIM
acauaacguuauaacucaagc

SEQ ID NO: 2305486 - RNA, 13 nt, Yersinia pestis KIM
acauaaggcuaga

SEQ ID NO: 2305487 - RNA, 14 nt, Yersinia pestis KIM
acauaccagcaaga

SEQ ID NO: 2305488 - RNA, 21 nt, Yersinia pestis KIM
acauaccccauuuaucgccaa

SEQ ID NO: 2305489 - RNA, 15 nt, Yersinia pestis KIM
acauaaaaaagagua

SEQ ID NO: 2305490 - RNA, 15 nt, Yersinia pestis KIM
acauaaaaauagcuu

SEQ ID NO: 2305491 - RNA, 24 nt, Yersinia pestis KIM
acauaaaaagaaaaaaacagacua

SEQ ID NO: 2305492 - RNA, 21 nt, Yersinia pestis KIM
acagcauuuugcggaucacau

SEQ ID NO: 2305493 - RNA, 22 nt, Yersinia pestis KIM
acaguuuaucucgcugugcccu

SEQ ID NO: 2305494 - RNA, 22 nt, Yersinia pestis KIM
acauagcccggcucauccgcca

SEQ ID NO: 2305495 - RNA, 14 nt, Yersinia pestis KIM
acauagcuaacacc

SEQ ID NO: 2305496 - RNA, 22 nt, Yersinia pestis KIM
acauagcugcgauaauccgcca

SEQ ID NO: 2305497 - RNA, 17 nt, Yersinia pestis KIM
acauaguugaauaacuu

SEQ ID NO: 2305498 - RNA, 23 nt, Yersinia pestis KIM
acauaguuaugaugaguaacaua

SEQ ID NO: 2305499 - RNA, 20 nt, Yersinia pestis KIM
acauauaaaccagccaguga

SEQ ID NO: 2305500 - RNA, 22 nt, Yersinia pestis KIM
acauauaauccaaaauaauaua

SEQ ID NO: 2305501 - RNA, 20 nt, Yersinia pestis KIM
acauaccuucgguaaucaau

SEQ ID NO: 2305502 - RNA, 21 nt, Yersinia pestis KIM
acauaccuucgguaaucaauu

SEQ ID NO: 2305503 - RNA, 20 nt, Yersinia pestis KIM
acaucaugaguaaaagauuc

SEQ ID NO: 2305504 - RNA, 13 nt, Yersinia pestis KIM
acaucaugacaaa

SEQ ID NO: 2305505 - RNA, 15 nt, Yersinia pestis KIM
acauccauguaggcu

SEQ ID NO: 2305506 - RNA, 17 nt, Yersinia pestis KIM
acauccauguaggcucg

SEQ ID NO: 2305507 - RNA, 17 nt, Yersinia pestis KIM
acauccuaaauaauucc

SEQ ID NO: 2305508 - RNA, 20 nt, Yersinia pestis KIM
acauauccugugccaacauc

SEQ ID NO: 2305509 - RNA, 10 nt, Yersinia pestis KIM
acauauguug

SEQ ID NO: 2305510 - RNA, 15 nt, Yersinia pestis KIM
acauaucaacacugc

SEQ ID NO: 2305511 - RNA, 19 nt, Yersinia pestis KIM
acauaucaacacugccuga

SEQ ID NO: 2305512 - RNA, 17 nt, Yersinia pestis KIM
acauaucaaacagcugu

SEQ ID NO: 2305513 - RNA, 16 nt, Yersinia pestis KIM
acauauaaccaucaaa

SEQ ID NO: 2305514 - RNA, 22 nt, Yersinia pestis KIM
acaucaggcuguugacauaaac

SEQ ID NO: 2305515 - RNA, 17 nt, Yersinia pestis KIM
acaucaauguuggccca

SEQ ID NO: 2305516 - RNA, 18 nt, Yersinia pestis KIM
acaugaacucaacuuucu

SEQ ID NO: 2305517 - RNA, 15 nt, Yersinia pestis KIM
acaucuugcaucccc

SEQ ID NO: 2305518 - RNA, 22 nt, Yersinia pestis KIM
acaucuugcgccgaaauaaaac

SEQ ID NO: 2305519 - RNA, 17 nt, Yersinia pestis KIM
acaucuuuauaguucau

SEQ ID NO: 2305520 - RNA, 14 nt, Yersinia pestis KIM
acauuaaaugaaua

SEQ ID NO: 2305521 - RNA, 17 nt, Yersinia pestis KIM
acauuaacacauuaauu

SEQ ID NO: 2305522 - RNA, 13 nt, Yersinia pestis KIM
acauuaauuuauc

SEQ ID NO: 2305523 - RNA, 20 nt, Yersinia pestis KIM
acauuaaaaauacaaccaac

SEQ ID NO: 2305524 - RNA, 16 nt, Yersinia pestis KIM
acauuaaacccacccc

SEQ ID NO: 2305525 - RNA, 13 nt, Yersinia pestis KIM
acauuaaaugaau

SEQ ID NO: 2305526 - RNA, 22 nt, Yersinia pestis KIM
acaugcgaugcgagcaaggcau

SEQ ID NO: 2305527 - RNA, 20 nt, Yersinia pestis KIM
acauugcaguauuuuggccg

SEQ ID NO: 2305528 - RNA, 22 nt, Yersinia pestis KIM
acauugccgccgauaacauuau

SEQ ID NO: 2305529 - RNA, 23 nt, Yersinia pestis KIM
acauucugauagugauuuuuuuc

SEQ ID NO: 2305530 - RNA, 15 nt, Yersinia pestis KIM
acauugaagugauau

SEQ ID NO: 2305531 - RNA, 18 nt, Yersinia pestis KIM
acauuccaguaaaaaaau

SEQ ID NO: 2305532 - RNA, 20 nt, Yersinia pestis KIM
acauuccaguaaaaaaauag

SEQ ID NO: 2305533 - RNA, 19 nt, Yersinia pestis KIM
acauucccauuauuauaag

SEQ ID NO: 2305534 - RNA, 19 nt, Yersinia pestis KIM
acauuauccguuugcaaca

SEQ ID NO: 2305535 - RNA, 21 nt, Yersinia pestis KIM
acauuauccguuugcaacauu

SEQ ID NO: 2305536 - RNA, 22 nt, Yersinia pestis KIM
acauuauccguuugcaacauua

SEQ ID NO: 2305537 - RNA, 22 nt, Yersinia pestis KIM
acauuacgggccucgcggaaau

SEQ ID NO: 2305538 - RNA, 19 nt, Yersinia pestis KIM
acauuacccacuugcaaca

SEQ ID NO: 2305539 - RNA, 24 nt, Yersinia pestis KIM
acauuacaagugccaaauggaaua

SEQ ID NO: 2305540 - RNA, 23 nt, Yersinia pestis KIM
acauuacaagugccaaauggaau

SEQ ID NO: 2305541 - RNA, 21 nt, Yersinia pestis KIM
acauuagccgguuaggccagu

SEQ ID NO: 2305542 - RNA, 19 nt, Yersinia pestis KIM
acacucagaugaaaaacug

SEQ ID NO: 2305543 - RNA, 13 nt, Yersinia pestis KIM
acagaaaaauaac

SEQ ID NO: 2305544 - RNA, 20 nt, Yersinia pestis KIM
acacuaauggcacgccaguu

SEQ ID NO: 2305545 - RNA, 17 nt, Yersinia pestis KIM
acacuacagccggauag

SEQ ID NO: 2305546 - RNA, 16 nt, Yersinia pestis KIM
acagaagcguaaagca

SEQ ID NO: 2305547 - RNA, 11 nt, Yersinia pestis KIM
acagaacuaau

SEQ ID NO: 2305548 - RNA, 20 nt, Yersinia pestis KIM
acagaacuaauaucaacaga

SEQ ID NO: 2305549 - RNA, 22 nt, Yersinia pestis KIM
acagaacuaauaucaacagaac

SEQ ID NO: 2305550 - RNA, 11 nt, Yersinia pestis KIM
acagaaaucaa

SEQ ID NO: 2305551 - RNA, 17 nt, Yersinia pestis KIM
acacggcggugcuuuuu

SEQ ID NO: 2305552 - RNA, 14 nt, Yersinia pestis KIM
acacguugaccgac

SEQ ID NO: 2305553 - RNA, 20 nt, Yersinia pestis KIM
acacggucuggcaacgcugu

SEQ ID NO: 2305554 - RNA, 14 nt, Yersinia pestis KIM
acacggugaauaaa

SEQ ID NO: 2305555 - RNA, 17 nt, Yersinia pestis KIM
acacgguaggcuucugc

SEQ ID NO: 2305556 - RNA, 22 nt, Yersinia pestis KIM
acacgugagaauugcugcuugc

SEQ ID NO: 2305557 - RNA, 13 nt, Yersinia pestis KIM
acagcaucaauau

SEQ ID NO: 2305558 - RNA, 15 nt, Yersinia pestis KIM
acagcaucacugucu

SEQ ID NO: 2305559 - RNA, 23 nt, Yersinia pestis KIM
acagcaucugcaauggcuggcaa

SEQ ID NO: 2305560 - RNA, 15 nt, Yersinia pestis KIM
acagcagguggcuga

SEQ ID NO: 2305561 - RNA, 22 nt, Yersinia pestis KIM
acagcaggccgcgaauauggca

SEQ ID NO: 2305562 - RNA, 21 nt, Yersinia pestis KIM
acagauccugccgccucugcu

SEQ ID NO: 2305563 - RNA, 18 nt, Yersinia pestis KIM
acagauuuuccauccccu

SEQ ID NO: 2305564 - RNA, 14 nt, Yersinia pestis KIM
acagcaacaacccc

SEQ ID NO: 2305565 - RNA, 19 nt, Yersinia pestis KIM
acagcaacaggguaauaac

SEQ ID NO: 2305566 - RNA, 13 nt, Yersinia pestis KIM
acagcaaggcaga

SEQ ID NO: 2305567 - RNA, 19 nt, Yersinia pestis KIM
acagaagcguaaagcaccc

SEQ ID NO: 2305568 - RNA, 24 nt, Yersinia pestis KIM
acagaaucaccaacaccaccauca

SEQ ID NO: 2305569 - RNA, 15 nt, Yersinia pestis KIM
acagaaucaccaaca

SEQ ID NO: 2305570 - RNA, 23 nt, Yersinia pestis KIM
acagaccccagaagaucgguuca

SEQ ID NO: 2305571 - RNA, 19 nt, Yersinia pestis KIM
acagacuaaaaaccgccac

SEQ ID NO: 2305572 - RNA, 23 nt, Yersinia pestis KIM
acagacgccccgaaccauuuacc

SEQ ID NO: 2305573 - RNA, 15 nt, Yersinia pestis KIM
acagaucauuaggcc

SEQ ID NO: 2305574 - RNA, 22 nt, Yersinia pestis KIM
acagaucauuaggccacuuaac

SEQ ID NO: 2305575 - RNA, 16 nt, Yersinia pestis KIM
acagauauuacgcagc

SEQ ID NO: 2305576 - RNA, 23 nt, Yersinia pestis KIM
acagauauauccaggcacugcca

SEQ ID NO: 2305577 - RNA, 23 nt, Yersinia pestis KIM
acagauauuuucggguaucugug

SEQ ID NO: 2305578 - RNA, 19 nt, Yersinia pestis KIM
acagaucacccgcaaaacu

SEQ ID NO: 2305579 - RNA, 21 nt, Yersinia pestis KIM
acagaucacccgcaaaacuga

SEQ ID NO: 2305580 - RNA, 12 nt, Yersinia pestis KIM
acagauaaagcu

SEQ ID NO: 2305581 - RNA, 23 nt, Yersinia pestis KIM
acagauaaagcuugaucacaauc

SEQ ID NO: 2305582 - RNA, 13 nt, Yersinia pestis KIM
acagacuggugaa

SEQ ID NO: 2305583 - RNA, 14 nt, Yersinia pestis KIM
acagacuuucuuua

SEQ ID NO: 2305584 - RNA, 17 nt, Yersinia pestis KIM
acaccuugcagcacacc

SEQ ID NO: 2305585 - RNA, 14 nt, Yersinia pestis KIM
acaccuuaaaacag

SEQ ID NO: 2305586 - RNA, 15 nt, Yersinia pestis KIM
acaccuuaaaacagc

SEQ ID NO: 2305587 - RNA, 24 nt, Yersinia pestis KIM
acaccugcaacguuaaagaugaag

SEQ ID NO: 2305588 - RNA, 19 nt, Yersinia pestis KIM
acaccugggcgcucuuuac

SEQ ID NO: 2305589 - RNA, 21 nt, Yersinia pestis KIM
acacgauuccucuguaguuca

SEQ ID NO: 2305590 - RNA, 15 nt, Yersinia pestis KIM
acacgaaaagcagca

SEQ ID NO: 2305591 - RNA, 14 nt, Yersinia pestis KIM
acacgaaaagcagc

SEQ ID NO: 2305592 - RNA, 22 nt, Yersinia pestis KIM
acacccuuucguguugcuggau

SEQ ID NO: 2305593 - RNA, 20 nt, Yersinia pestis KIM
acacccuguguauuuaacca

SEQ ID NO: 2305594 - RNA, 21 nt, Yersinia pestis KIM
acacccuguguauuuaaccaa

SEQ ID NO: 2305595 - RNA, 21 nt, Yersinia pestis KIM
acacccucaacucaaaacaau

SEQ ID NO: 2305596 - RNA, 21 nt, Yersinia pestis KIM
acacccucucuuuccagcaaa

SEQ ID NO: 2305597 - RNA, 23 nt, Yersinia pestis KIM
acacccucucuuuccagcaaaag

SEQ ID NO: 2305598 - RNA, 15 nt, Yersinia pestis KIM
acaccguuguuggcg

SEQ ID NO: 2305599 - RNA, 16 nt, Yersinia pestis KIM
acaccggcaauaugaa

SEQ ID NO: 2305600 - RNA, 21 nt, Yersinia pestis KIM
acaccggccaaaaucacccca

SEQ ID NO: 2305601 - RNA, 17 nt, Yersinia pestis KIM
acaccgcuguagcguca

SEQ ID NO: 2305602 - RNA, 14 nt, Yersinia pestis KIM
acaccaccaucacu

SEQ ID NO: 2305603 - RNA, 21 nt, Yersinia pestis KIM
acaccaccgccgcaacaauaa

SEQ ID NO: 2305604 - RNA, 21 nt, Yersinia pestis KIM
acaccaagaacccuuuaucuu

SEQ ID NO: 2305605 - RNA, 13 nt, Yersinia pestis KIM
acaccaacuggcg

SEQ ID NO: 2305606 - RNA, 15 nt, Yersinia pestis KIM
acaccacacuggaug

SEQ ID NO: 2305607 - RNA, 20 nt, Yersinia pestis KIM
acaccacaucacgcagcgcu

SEQ ID NO: 2305608 - RNA, 13 nt, Yersinia pestis KIM
acacaugaaaauc

SEQ ID NO: 2305609 - RNA, 16 nt, Yersinia pestis KIM
acacaugaaaaucaag

SEQ ID NO: 2305610 - RNA, 14 nt, Yersinia pestis KIM
acacauuaauuuau

SEQ ID NO: 2305611 - RNA, 22 nt, Yersinia pestis KIM
acacauuccaguaaaaaaauag

SEQ ID NO: 2305612 - RNA, 13 nt, Yersinia pestis KIM
acaccaacacuga

SEQ ID NO: 2305613 - RNA, 15 nt, Yersinia pestis KIM
acaccaaaacucccu

SEQ ID NO: 2305614 - RNA, 23 nt, Yersinia pestis KIM
acaccaaaaguaucuuucacccu

SEQ ID NO: 2305615 - RNA, 13 nt, Yersinia pestis KIM
acaccagcauccu

SEQ ID NO: 2305616 - RNA, 14 nt, Yersinia pestis KIM
acaccaucaacaug

SEQ ID NO: 2305617 - RNA, 11 nt, Yersinia pestis KIM
acacccgcuug

SEQ ID NO: 2305618 - RNA, 22 nt, Yersinia pestis KIM
acacccgaccagacaacaguca

SEQ ID NO: 2305619 - RNA, 13 nt, Yersinia pestis KIM
acaccauuuucaa

SEQ ID NO: 2305620 - RNA, 18 nt, Yersinia pestis KIM
acaccauugauaauaaua

SEQ ID NO: 2305621 - RNA, 18 nt, Yersinia pestis KIM
acacccaauaauaaaaaa

SEQ ID NO: 2305622 - RNA, 14 nt, Yersinia pestis KIM
acaauauaauaacu

SEQ ID NO: 2305623 - RNA, 16 nt, Yersinia pestis KIM
acaauauaauaaugcu

SEQ ID NO: 2305624 - RNA, 14 nt, Yersinia pestis KIM
acaauccgaacaaa

SEQ ID NO: 2305625 - RNA, 16 nt, Yersinia pestis KIM
acaaucgucuucgguc

SEQ ID NO: 2305626 - RNA, 12 nt, Yersinia pestis KIM
acaaucgauucc

SEQ ID NO: 2305627 - RNA, 22 nt, Yersinia pestis KIM
acaaugaacuguguuuauacca

SEQ ID NO: 2305628 - RNA, 16 nt, Yersinia pestis KIM
acaaugcacagugccg

SEQ ID NO: 2305629 - RNA, 13 nt, Yersinia pestis KIM
acaaugacuuaac

SEQ ID NO: 2305630 - RNA, 14 nt, Yersinia pestis KIM
acaaugacuuaacu

SEQ ID NO: 2305631 - RNA, 23 nt, Yersinia pestis KIM
acaaugacuuaacugaaagccaa

SEQ ID NO: 2305632 - RNA, 16 nt, Yersinia pestis KIM
acaaugacuuaacuga

SEQ ID NO: 2305633 - RNA, 15 nt, Yersinia pestis KIM
acaaguugucuguaa

SEQ ID NO: 2305634 - RNA, 17 nt, Yersinia pestis KIM
acaauaccauuuugccg

SEQ ID NO: 2305635 - RNA, 16 nt, Yersinia pestis KIM
acaauaccgccacaca

SEQ ID NO: 2305636 - RNA, 21 nt, Yersinia pestis KIM
acaauaaguugaacagugguu

SEQ ID NO: 2305637 - RNA, 18 nt, Yersinia pestis KIM
acaauaauaagccgcagg

SEQ ID NO: 2305638 - RNA, 14 nt, Yersinia pestis KIM
acaauaauuaggaa

SEQ ID NO: 2305639 - RNA, 13 nt, Yersinia pestis KIM
acaauacauagaa

SEQ ID NO: 2305640 - RNA, 17 nt, Yersinia pestis KIM
acaaguuacauuuuuaa

SEQ ID NO: 2305641 - RNA, 15 nt, Yersinia pestis KIM
acaagucagugauuc

SEQ ID NO: 2305642 - RNA, 15 nt, Yersinia pestis KIM
acacaauacauagaa

SEQ ID NO: 2305643 - RNA, 22 nt, Yersinia pestis KIM
acacaauucccguuagguucaa

SEQ ID NO: 2305644 - RNA, 15 nt, Yersinia pestis KIM
acacacagcaauaca

SEQ ID NO: 2305645 - RNA, 18 nt, Yersinia pestis KIM
acacacagcaauacaugu

SEQ ID NO: 2305646 - RNA, 22 nt, Yersinia pestis KIM
acacaagggauuuaaaaucccu

SEQ ID NO: 2305647 - RNA, 19 nt, Yersinia pestis KIM
acacacagccuacgggguc

SEQ ID NO: 2305648 - RNA, 15 nt, Yersinia pestis KIM
acacagguucuccag

SEQ ID NO: 2305649 - RNA, 15 nt, Yersinia pestis KIM
acacagcacggcaac

SEQ ID NO: 2305650 - RNA, 24 nt, Yersinia pestis KIM
acacagcccugccuggcaggaagc

SEQ ID NO: 2305651 - RNA, 12 nt, Yersinia pestis KIM
acacagcccugc

SEQ ID NO: 2305652 - RNA, 20 nt, Yersinia pestis KIM
acacagcgaagcguaaauuu

SEQ ID NO: 2305653 - RNA, 13 nt, Yersinia pestis KIM
acacauauuucau

SEQ ID NO: 2305654 - RNA, 17 nt, Yersinia pestis KIM
acacaucaaaauuaggu

SEQ ID NO: 2305655 - RNA, 15 nt, Yersinia pestis KIM
acacauauauuaucu

SEQ ID NO: 2305656 - RNA, 16 nt, Yersinia pestis KIM
acacaguauucugcuu

SEQ ID NO: 2305657 - RNA, 19 nt, Yersinia pestis KIM
acacagucugucguacuuu

SEQ ID NO: 2305658 - RNA, 14 nt, Yersinia pestis KIM
acacagucuuuuuc

SEQ ID NO: 2305659 - RNA, 15 nt, Yersinia pestis KIM
acacauaaccaucaa

SEQ ID NO: 2305660 - RNA, 21 nt, Yersinia pestis KIM
acacauaccuucgguaaucaa

SEQ ID NO: 2305661 - RNA, 18 nt, Yersinia pestis KIM
acacauaaccaucaaaca

SEQ ID NO: 2305662 - RNA, 17 nt, Yersinia pestis KIM
acaaugguucaucauuu

SEQ ID NO: 2305663 - RNA, 18 nt, Yersinia pestis KIM
acaaugguugaaugacca

SEQ ID NO: 2305664 - RNA, 14 nt, Yersinia pestis KIM
acaauuauuuuuac

SEQ ID NO: 2305665 - RNA, 14 nt, Yersinia pestis KIM
acaauuauagccaa

SEQ ID NO: 2305666 - RNA, 22 nt, Yersinia pestis KIM
acaaugguugaaugaccaaggu

SEQ ID NO: 2305667 - RNA, 22 nt, Yersinia pestis KIM
acaaugugccgcgcaaccaucc

SEQ ID NO: 2305668 - RNA, 20 nt, Yersinia pestis KIM
acaauucccguuagguucaa

SEQ ID NO: 2305669 - RNA, 21 nt, Yersinia pestis KIM
acaauuugguuucuauuucua

SEQ ID NO: 2305670 - RNA, 18 nt, Yersinia pestis KIM
acaauuucgaaaacucaa

SEQ ID NO: 2305671 - RNA, 15 nt, Yersinia pestis KIM
acaauuuccauauca

SEQ ID NO: 2305672 - RNA, 17 nt, Yersinia pestis KIM
acacaaaauagaaaaca

SEQ ID NO: 2305673 - RNA, 21 nt, Yersinia pestis KIM
acaauuuugacgaaguuuuag

SEQ ID NO: 2305674 - RNA, 22 nt, Yersinia pestis KIM
aauuucuugcucgucaucuuuc

SEQ ID NO: 2305675 - RNA, 23 nt, Yersinia pestis KIM
aauuucuugaggugcuugaacaa

SEQ ID NO: 2305676 - RNA, 20 nt, Yersinia pestis KIM
aauuucgcuggucuuaauca

SEQ ID NO: 2305677 - RNA, 16 nt, Yersinia pestis KIM
aauuucgaaaacucaa

SEQ ID NO: 2305678 - RNA, 20 nt, Yersinia pestis KIM
aauuucauuguggaggaagg

SEQ ID NO: 2305679 - RNA, 23 nt, Yersinia pestis KIM
aauuucaugcgaauacuuugcua

SEQ ID NO: 2305680 - RNA, 21 nt, Yersinia pestis KIM
aauuaguugcccgaauaauug

SEQ ID NO: 2305681 - RNA, 21 nt, Yersinia pestis KIM
aauuaguuuuaauaaccauua

SEQ ID NO: 2305682 - RNA, 19 nt, Yersinia pestis KIM
aauuuuagucaaaacaaua

SEQ ID NO: 2305683 - RNA, 14 nt, Yersinia pestis KIM
aauuuuagucaaaa

SEQ ID NO: 2305684 - RNA, 21 nt, Yersinia pestis KIM
aauuuuaaguuaauguuuaua

SEQ ID NO: 2305685 - RNA, 19 nt, Yersinia pestis KIM
aauuuuaaaggcaacgaag

SEQ ID NO: 2305686 - RNA, 18 nt, Yersinia pestis KIM
aauuugucguuuacuggc

SEQ ID NO: 2305687 - RNA, 15 nt, Yersinia pestis KIM
aauuugacauuuccu

SEQ ID NO: 2305688 - RNA, 16 nt, Yersinia pestis KIM
aauuugauacagugau

SEQ ID NO: 2305689 - RNA, 13 nt, Yersinia pestis KIM
aauuugcacugca

SEQ ID NO: 2305690 - RNA, 15 nt, Yersinia pestis KIM
aauuugcuuuaaaua

SEQ ID NO: 2305691 - RNA, 13 nt, Yersinia pestis KIM
aauuuggccaaua

SEQ ID NO: 2305692 - RNA, 17 nt, Yersinia pestis KIM
acaaaauagaaaacagc

SEQ ID NO: 2305693 - RNA, 14 nt, Yersinia pestis KIM
acaaaaucccccac

SEQ ID NO: 2305694 - RNA, 19 nt, Yersinia pestis KIM
acaaaagugacgaaugagc

SEQ ID NO: 2305695 - RNA, 13 nt, Yersinia pestis KIM
acaaaaugugaaa

SEQ ID NO: 2305696 - RNA, 21 nt, Yersinia pestis KIM
acaaaaugccguacaacaaua

SEQ ID NO: 2305697 - RNA, 20 nt, Yersinia pestis KIM
acaaaaugccguacaacaau

SEQ ID NO: 2305698 - RNA, 18 nt, Yersinia pestis KIM
acaaaauggccuugccca

SEQ ID NO: 2305699 - RNA, 22 nt, Yersinia pestis KIM
acaaacaaccuaaaaaaaacaa

SEQ ID NO: 2305700 - RNA, 11 nt, Yersinia pestis KIM
acaaaaacagu

SEQ ID NO: 2305701 - RNA, 15 nt, Yersinia pestis KIM
acaaaaacgcucacg

SEQ ID NO: 2305702 - RNA, 23 nt, Yersinia pestis KIM
acaaaaaauaguuguuagccacu

SEQ ID NO: 2305703 - RNA, 16 nt, Yersinia pestis KIM
aauuuucccaaaguga

SEQ ID NO: 2305704 - RNA, 12 nt, Yersinia pestis KIM
aauuuucuaagc

SEQ ID NO: 2305705 - RNA, 14 nt, Yersinia pestis KIM
aauuuucuaagcug

SEQ ID NO: 2305706 - RNA, 12 nt, Yersinia pestis KIM
aauuuuuuuaac

SEQ ID NO: 2305707 - RNA, 15 nt, Yersinia pestis KIM
aauuuuuagccgcaa

SEQ ID NO: 2305708 - RNA, 12 nt, Yersinia pestis KIM
aauuuuucccuu

SEQ ID NO: 2305709 - RNA, 14 nt, Yersinia pestis KIM
acaaccaacaguuu

SEQ ID NO: 2305710 - RNA, 16 nt, Yersinia pestis KIM
acaaccaacaaacaau

SEQ ID NO: 2305711 - RNA, 15 nt, Yersinia pestis KIM
acaaccaacaaacaa

SEQ ID NO: 2305712 - RNA, 17 nt, Yersinia pestis KIM
acaaccaauacacagca

SEQ ID NO: 2305713 - RNA, 18 nt, Yersinia pestis KIM
acaaccacugaacaccau

SEQ ID NO: 2305714 - RNA, 21 nt, Yersinia pestis KIM
acaaccacccgacaucaagaa

SEQ ID NO: 2305715 - RNA, 18 nt, Yersinia pestis KIM
acaacccgaauuaauaaa

SEQ ID NO: 2305716 - RNA, 22 nt, Yersinia pestis KIM
acaacccgaauuaauaaaaccu

SEQ ID NO: 2305717 - RNA, 23 nt, Yersinia pestis KIM
acaacccccgaacacucgaucuu

SEQ ID NO: 2305718 - RNA, 15 nt, Yersinia pestis KIM
acaacccgcuacuga

SEQ ID NO: 2305719 - RNA, 22 nt, Yersinia pestis KIM
acaaccauuguggcuaaaccca

SEQ ID NO: 2305720 - RNA, 23 nt, Yersinia pestis KIM
acaacagugcaacauuaaaaaua

SEQ ID NO: 2305721 - RNA, 15 nt, Yersinia pestis KIM
acaacaucaucguca

SEQ ID NO: 2305722 - RNA, 12 nt, Yersinia pestis KIM
acaacaucaucg

SEQ ID NO: 2305723 - RNA, 19 nt, Yersinia pestis KIM
acaacgagggcucaaucuc

SEQ ID NO: 2305724 - RNA, 12 nt, Yersinia pestis KIM
acaacgcacuga

SEQ ID NO: 2305725 - RNA, 16 nt, Yersinia pestis KIM
acaacguccagaacaa

SEQ ID NO: 2305726 - RNA, 19 nt, Yersinia pestis KIM
acaacguccagaacaauac

SEQ ID NO: 2305727 - RNA, 14 nt, Yersinia pestis KIM
acaacguuucugga

SEQ ID NO: 2305728 - RNA, 13 nt, Yersinia pestis KIM
acaacucaccgcc

SEQ ID NO: 2305729 - RNA, 16 nt, Yersinia pestis KIM
acaacucguuaucuuc

SEQ ID NO: 2305730 - RNA, 20 nt, Yersinia pestis KIM
acaacugccaaauuuggccu

SEQ ID NO: 2305731 - RNA, 14 nt, Yersinia pestis KIM
acaacuuccacaca

SEQ ID NO: 2305732 - RNA, 11 nt, Yersinia pestis KIM
acaacuucuuc

SEQ ID NO: 2305733 - RNA, 14 nt, Yersinia pestis KIM
acaagaaaucaaaa

SEQ ID NO: 2305734 - RNA, 13 nt, Yersinia pestis KIM
acaacuuucccag

SEQ ID NO: 2305735 - RNA, 22 nt, Yersinia pestis KIM
acaagcuacagcgucagauauu

SEQ ID NO: 2305736 - RNA, 19 nt, Yersinia pestis KIM
acaagcgaccaucaugaau

SEQ ID NO: 2305737 - RNA, 16 nt, Yersinia pestis KIM
acaagcggacuucacu

SEQ ID NO: 2305738 - RNA, 20 nt, Yersinia pestis KIM
acaagccgugaccaaagugc

SEQ ID NO: 2305739 - RNA, 17 nt, Yersinia pestis KIM
acaagcgaccaucauga

SEQ ID NO: 2305740 - RNA, 14 nt, Yersinia pestis KIM
acaagcgaccauca

SEQ ID NO: 2305741 - RNA, 19 nt, Yersinia pestis KIM
acaagccagugacugagca

SEQ ID NO: 2305742 - RNA, 14 nt, Yersinia pestis KIM
acaagccauuucac

SEQ ID NO: 2305743 - RNA, 15 nt, Yersinia pestis KIM
acaagccauuucacc

SEQ ID NO: 2305744 - RNA, 19 nt, Yersinia pestis KIM
acaagauaaauaccgccaa

SEQ ID NO: 2305745 - RNA, 21 nt, Yersinia pestis KIM
acaagcacucaaugucaugca

SEQ ID NO: 2305746 - RNA, 14 nt, Yersinia pestis KIM
acaagaucccaagc

SEQ ID NO: 2305747 - RNA, 14 nt, Yersinia pestis KIM
acaagauaguccgc

SEQ ID NO: 2305748 - RNA, 18 nt, Yersinia pestis KIM
acaagacaauauguuuag

SEQ ID NO: 2305749 - RNA, 23 nt, Yersinia pestis KIM
acaaacuguuuuuuaaagaaaaa

SEQ ID NO: 2305750 - RNA, 18 nt, Yersinia pestis KIM
acaaacauggcggcagca

SEQ ID NO: 2305751 - RNA, 21 nt, Yersinia pestis KIM
acaaaggucagcauggucccu

SEQ ID NO: 2305752 - RNA, 13 nt, Yersinia pestis KIM
acaaaggcaaaau

SEQ ID NO: 2305753 - RNA, 16 nt, Yersinia pestis KIM
acaaaggcaaaaugau

SEQ ID NO: 2305754 - RNA, 23 nt, Yersinia pestis KIM
acaaagugcccgcgacgagagaa

SEQ ID NO: 2305755 - RNA, 13 nt, Yersinia pestis KIM
acaaagcauuuca

SEQ ID NO: 2305756 - RNA, 17 nt, Yersinia pestis KIM
acaaagccgcuuaauuu

SEQ ID NO: 2305757 - RNA, 15 nt, Yersinia pestis KIM
acaaagauagcguca

SEQ ID NO: 2305758 - RNA, 20 nt, Yersinia pestis KIM
acaaagauacagcccaagag

SEQ ID NO: 2305759 - RNA, 21 nt, Yersinia pestis KIM
acaaagauacagcccaagaga

SEQ ID NO: 2305760 - RNA, 22 nt, Yersinia pestis KIM
acaaaucuuaaauugaagaguu

SEQ ID NO: 2305761 - RNA, 17 nt, Yersinia pestis KIM
acaaaugagagcgcagc

SEQ ID NO: 2305762 - RNA, 17 nt, Yersinia pestis KIM
acaaaucuuaaauugaa

SEQ ID NO: 2305763 - RNA, 20 nt, Yersinia pestis KIM
acaaaucuuaaauugaagag

SEQ ID NO: 2305764 - RNA, 19 nt, Yersinia pestis KIM
acaaauauuggcccacugg

SEQ ID NO: 2305765 - RNA, 14 nt, Yersinia pestis KIM
acaaauaaaacaga

SEQ ID NO: 2305766 - RNA, 16 nt, Yersinia pestis KIM
acaaauaaaaccaaga

SEQ ID NO: 2305767 - RNA, 20 nt, Yersinia pestis KIM
acaacaagaucccaagcagg

SEQ ID NO: 2305768 - RNA, 18 nt, Yersinia pestis KIM
acaaauuugacauuuccu

SEQ ID NO: 2305769 - RNA, 23 nt, Yersinia pestis KIM
acaaauggucaggaacccauuug

SEQ ID NO: 2305770 - RNA, 22 nt, Yersinia pestis KIM
aaggccaguaguaaaaaaucua

SEQ ID NO: 2305771 - RNA, 11 nt, Yersinia pestis KIM
aaggccaggca

SEQ ID NO: 2305772 - RNA, 19 nt, Yersinia pestis KIM
aaggcccgcuaucacuagc

SEQ ID NO: 2305773 - RNA, 13 nt, Yersinia pestis KIM
aaggccccucggg

SEQ ID NO: 2305774 - RNA, 18 nt, Yersinia pestis KIM
aaggccauagaauaccca

SEQ ID NO: 2305775 - RNA, 20 nt, Yersinia pestis KIM
aaggccgcgauaaaaaauaa

SEQ ID NO: 2305776 - RNA, 14 nt, Yersinia pestis KIM
aaggccgaucaaca

SEQ ID NO: 2305777 - RNA, 21 nt, Yersinia pestis KIM
aaggcgauauuauuaguagca

SEQ ID NO: 2305778 - RNA, 13 nt, Yersinia pestis KIM
aaggcagcaagca

SEQ ID NO: 2305779 - RNA, 13 nt, Yersinia pestis KIM
aaggcagaaaauc

SEQ ID NO: 2305780 - RNA, 16 nt, Yersinia pestis KIM
aaggcagaaaaucccg

SEQ ID NO: 2305781 - RNA, 14 nt, Yersinia pestis KIM
aaggcauccacauc

SEQ ID NO: 2305782 - RNA, 16 nt, Yersinia pestis KIM
aaggcauccacaucuu

SEQ ID NO: 2305783 - RNA, 13 nt, Yersinia pestis KIM
aaggcaaagaaga

SEQ ID NO: 2305784 - RNA, 19 nt, Yersinia pestis KIM
aaggcaaccagcacacagg

SEQ ID NO: 2305785 - RNA, 20 nt, Yersinia pestis KIM
aaggauuugaagacaacucu

SEQ ID NO: 2305786 - RNA, 15 nt, Yersinia pestis KIM
aaggcaaaaugauca

SEQ ID NO: 2305787 - RNA, 21 nt, Yersinia pestis KIM
aaggcaaaaauugacgaaagu

SEQ ID NO: 2305788 - RNA, 19 nt, Yersinia pestis KIM
aaggcacccaugcucccuc

SEQ ID NO: 2305789 - RNA, 13 nt, Yersinia pestis KIM
aaggcaauaccgg

SEQ ID NO: 2305790 - RNA, 15 nt, Yersinia pestis KIM
aaggcaauaccaaua

SEQ ID NO: 2305791 - RNA, 12 nt, Yersinia pestis KIM
aagguugaccug

SEQ ID NO: 2305792 - RNA, 21 nt, Yersinia pestis KIM
aagguuggaacaccaaaagua

SEQ ID NO: 2305793 - RNA, 19 nt, Yersinia pestis KIM
aaggugugcucacaaucuu

SEQ ID NO: 2305794 - RNA, 19 nt, Yersinia pestis KIM
aaggugcgccacuguucuu

SEQ ID NO: 2305795 - RNA, 20 nt, Yersinia pestis KIM
aaggugcgccacuguucuua

SEQ ID NO: 2305796 - RNA, 18 nt, Yersinia pestis KIM
aagguauagcgauagagu

SEQ ID NO: 2305797 - RNA, 19 nt, Yersinia pestis KIM
aagguaugugccaaaaaaa

SEQ ID NO: 2305798 - RNA, 16 nt, Yersinia pestis KIM
aagguaacggaagggg

SEQ ID NO: 2305799 - RNA, 18 nt, Yersinia pestis KIM
aaggcugacggugccaga

SEQ ID NO: 2305800 - RNA, 17 nt, Yersinia pestis KIM
aaggcuucggccagacg

SEQ ID NO: 2305801 - RNA, 20 nt, Yersinia pestis KIM
aagcuuuugccacauuuccc

SEQ ID NO: 2305802 - RNA, 20 nt, Yersinia pestis KIM
aaggaauauacuuuacauau

SEQ ID NO: 2305803 - RNA, 13 nt, Yersinia pestis KIM
aaggauaagcagu

SEQ ID NO: 2305804 - RNA, 16 nt, Yersinia pestis KIM
aaggauaagcaguucu

SEQ ID NO: 2305805 - RNA, 21 nt, Yersinia pestis KIM
aaggauacgcauuacccuguu

SEQ ID NO: 2305806 - RNA, 18 nt, Yersinia pestis KIM
aagcuguuggcuuuaucu

SEQ ID NO: 2305807 - RNA, 15 nt, Yersinia pestis KIM
aagcuuacuguucac

SEQ ID NO: 2305808 - RNA, 19 nt, Yersinia pestis KIM
aagcugccuuuuuugauaa

SEQ ID NO: 2305809 - RNA, 21 nt, Yersinia pestis KIM
aagcugccugugcggcaguga

SEQ ID NO: 2305810 - RNA, 22 nt, Yersinia pestis KIM
aagcugcggcuugggagucaga

SEQ ID NO: 2305811 - RNA, 19 nt, Yersinia pestis KIM
aagcguauuuugucaugaa

SEQ ID NO: 2305812 - RNA, 12 nt, Yersinia pestis KIM
aagccaaucucu

SEQ ID NO: 2305813 - RNA, 18 nt, Yersinia pestis KIM
aagcuacagcucagacug

SEQ ID NO: 2305814 - RNA, 17 nt, Yersinia pestis KIM
aagcuacagcgucagau

SEQ ID NO: 2305815 - RNA, 21 nt, Yersinia pestis KIM
aagcuacggccuguaccacca

SEQ ID NO: 2305816 - RNA, 17 nt, Yersinia pestis KIM
aagcucuuccaauagca

SEQ ID NO: 2305817 - RNA, 18 nt, Yersinia pestis KIM
aagcucuacuaauauucc

SEQ ID NO: 2305818 - RNA, 22 nt, Yersinia pestis KIM
aagcucugacaaaaugccagaa

SEQ ID NO: 2305819 - RNA, 22 nt, Yersinia pestis KIM
aagcucugggacgugcauaaaa

SEQ ID NO: 2305820 - RNA, 20 nt, Yersinia pestis KIM
aagugaaacccgcgcagccu

SEQ ID NO: 2305821 - RNA, 15 nt, Yersinia pestis KIM
aagugaauaacgcug

SEQ ID NO: 2305822 - RNA, 13 nt, Yersinia pestis KIM
aagugaauaacgc

SEQ ID NO: 2305823 - RNA, 16 nt, Yersinia pestis KIM
aagugaauaaaucaaa

SEQ ID NO: 2305824 - RNA, 22 nt, Yersinia pestis KIM
aagugcaaacuuaaaaaucaaa

SEQ ID NO: 2305825 - RNA, 18 nt, Yersinia pestis KIM
aagugcaucgggagccac

SEQ ID NO: 2305826 - RNA, 18 nt, Yersinia pestis KIM
aagugcaaacuuaaaaau

SEQ ID NO: 2305827 - RNA, 19 nt, Yersinia pestis KIM
aagugauucgggugaguga

SEQ ID NO: 2305828 - RNA, 21 nt, Yersinia pestis KIM
aagugauucgggugagugagc

SEQ ID NO: 2305829 - RNA, 22 nt, Yersinia pestis KIM
aaguggcuaucugaaacugaga

SEQ ID NO: 2305830 - RNA, 16 nt, Yersinia pestis KIM
aaguggcugaauauca

SEQ ID NO: 2305831 - RNA, 19 nt, Yersinia pestis KIM
aaguggguaauguugcaaa

SEQ ID NO: 2305832 - RNA, 12 nt, Yersinia pestis KIM
aaguuaaaaaaa

SEQ ID NO: 2305833 - RNA, 21 nt, Yersinia pestis KIM
aaguuaaaaagccugaauucu

SEQ ID NO: 2305834 - RNA, 17 nt, Yersinia pestis KIM
aaguuaaaaagccugaa

SEQ ID NO: 2305835 - RNA, 15 nt, Yersinia pestis KIM
aaguuaaaaagccug

SEQ ID NO: 2305836 - RNA, 18 nt, Yersinia pestis KIM
aaguuaaacaauguuaaa

SEQ ID NO: 2305837 - RNA, 17 nt, Yersinia pestis KIM
aaguuaaugacaaagug

SEQ ID NO: 2305838 - RNA, 12 nt, Yersinia pestis KIM
aaguuaauguuu

SEQ ID NO: 2305839 - RNA, 22 nt, Yersinia pestis KIM
aaguaacuaacagauuguuggu

SEQ ID NO: 2305840 - RNA, 14 nt, Yersinia pestis KIM
aaguaaguuuaaac

SEQ ID NO: 2305841 - RNA, 17 nt, Yersinia pestis KIM
aaguaucugaaaauauu

SEQ ID NO: 2305842 - RNA, 13 nt, Yersinia pestis KIM
aaguaugcagggu

SEQ ID NO: 2305843 - RNA, 19 nt, Yersinia pestis KIM
aaguaucuuucacccugcg

SEQ ID NO: 2305844 - RNA, 20 nt, Yersinia pestis KIM
aaguaugacgggaauauuua

SEQ ID NO: 2305845 - RNA, 18 nt, Yersinia pestis KIM
aagucaauuucagcuuuu

SEQ ID NO: 2305846 - RNA, 20 nt, Yersinia pestis KIM
aaguccaagaagauaacuuu

SEQ ID NO: 2305847 - RNA, 23 nt, Yersinia pestis KIM
aaguccaagaagauaacuuuuua

SEQ ID NO: 2305848 - RNA, 14 nt, Yersinia pestis KIM
aaguccaucagccu

SEQ ID NO: 2305849 - RNA, 18 nt, Yersinia pestis KIM
aagucgucugauauuaaa

SEQ ID NO: 2305850 - RNA, 16 nt, Yersinia pestis KIM
aaguuuauuuaacaca

SEQ ID NO: 2305851 - RNA, 21 nt, Yersinia pestis KIM
aaguuuacuuuguauuuugca

SEQ ID NO: 2305852 - RNA, 22 nt, Yersinia pestis KIM
aaguuuaccgcaugaauauuca

SEQ ID NO: 2305853 - RNA, 23 nt, Yersinia pestis KIM
aaguuacuuuuuuauuuuacuuu

SEQ ID NO: 2305854 - RNA, 14 nt, Yersinia pestis KIM
aaguucgccuucag

SEQ ID NO: 2305855 - RNA, 22 nt, Yersinia pestis KIM
aaguucuccggcggcuucauca

SEQ ID NO: 2305856 - RNA, 19 nt, Yersinia pestis KIM
aaguucucaucaaacucau

SEQ ID NO: 2305857 - RNA, 12 nt, Yersinia pestis KIM
aaguuguucauu

SEQ ID NO: 2305858 - RNA, 22 nt, Yersinia pestis KIM
aaguugaaccaaugaaucgggc

SEQ ID NO: 2305859 - RNA, 14 nt, Yersinia pestis KIM
aauaaaacucacuu

SEQ ID NO: 2305860 - RNA, 13 nt, Yersinia pestis KIM
aauaaaacacccu

SEQ ID NO: 2305861 - RNA, 23 nt, Yersinia pestis KIM
aauaaaaagucagcuggaacaag

SEQ ID NO: 2305862 - RNA, 18 nt, Yersinia pestis KIM
aauaaaaaauuauuaaau

SEQ ID NO: 2305863 - RNA, 20 nt, Yersinia pestis KIM
aauaaaaaaggcagcguagg

SEQ ID NO: 2305864 - RNA, 13 nt, Yersinia pestis KIM
aauaaaaaaaaau

SEQ ID NO: 2305865 - RNA, 14 nt, Yersinia pestis KIM
aauaaaaaaaaaua

SEQ ID NO: 2305866 - RNA, 16 nt, Yersinia pestis KIM
aauaaaccauacauaa

SEQ ID NO: 2305867 - RNA, 16 nt, Yersinia pestis KIM
aauaaaccgaaaugau

SEQ ID NO: 2305868 - RNA, 14 nt, Yersinia pestis KIM
aauaaacaaccuuc

SEQ ID NO: 2305869 - RNA, 13 nt, Yersinia pestis KIM
aauaaacaaaaua

SEQ ID NO: 2305870 - RNA, 12 nt, Yersinia pestis KIM
aauaaaaucaaa

SEQ ID NO: 2305871 - RNA, 14 nt, Yersinia pestis KIM
aauaaaaucugcuu

SEQ ID NO: 2305872 - RNA, 11 nt, Yersinia pestis KIM
aauaaaauaag

SEQ ID NO: 2305873 - RNA, 12 nt, Yersinia pestis KIM
aagaugcauauu

SEQ ID NO: 2305874 - RNA, 20 nt, Yersinia pestis KIM
aagaugaccaccaauuucau

SEQ ID NO: 2305875 - RNA, 21 nt, Yersinia pestis KIM
aagaugccaaucaaaaaaccg

SEQ ID NO: 2305876 - RNA, 18 nt, Yersinia pestis KIM
aagaugcauauuugcaga

SEQ ID NO: 2305877 - RNA, 20 nt, Yersinia pestis KIM
aagaugccaaucaaaaaacc

SEQ ID NO: 2305878 - RNA, 15 nt, Yersinia pestis KIM
aagauugcauccgcu

SEQ ID NO: 2305879 - RNA, 16 nt, Yersinia pestis KIM
aagauucauaaaaaaa

SEQ ID NO: 2305880 - RNA, 16 nt, Yersinia pestis KIM
aagauuuuguagccca

SEQ ID NO: 2305881 - RNA, 16 nt, Yersinia pestis KIM
aagauuggcagcguaa

SEQ ID NO: 2305882 - RNA, 13 nt, Yersinia pestis KIM
aagauuuaaauaa

SEQ ID NO: 2305883 - RNA, 23 nt, Yersinia pestis KIM
aagauuucaucggcaaaaacagu

SEQ ID NO: 2305884 - RNA, 21 nt, Yersinia pestis KIM
aagauuucaucggcaaaaaca

SEQ ID NO: 2305885 - RNA, 13 nt, Yersinia pestis KIM
aagaucugcauug

SEQ ID NO: 2305886 - RNA, 16 nt, Yersinia pestis KIM
aagauccaccacauca

SEQ ID NO: 2305887 - RNA, 13 nt, Yersinia pestis KIM
aagauccaguuca

SEQ ID NO: 2305888 - RNA, 14 nt, Yersinia pestis KIM
aagauccaguucag

SEQ ID NO: 2305889 - RNA, 20 nt, Yersinia pestis KIM
aagauacccgccauaaauaa

SEQ ID NO: 2305890 - RNA, 16 nt, Yersinia pestis KIM
aagauagccacuaacu

SEQ ID NO: 2305891 - RNA, 14 nt, Yersinia pestis KIM
aagauagcaaaaga

SEQ ID NO: 2305892 - RNA, 20 nt, Yersinia pestis KIM
aagauacccuugagguuauu

SEQ ID NO: 2305893 - RNA, 13 nt, Yersinia pestis KIM
aagaucaaaagca

SEQ ID NO: 2305894 - RNA, 21 nt, Yersinia pestis KIM
aagauaggcagaaaagcaaag

SEQ ID NO: 2305895 - RNA, 14 nt, Yersinia pestis KIM
aagcagccgccgcu

SEQ ID NO: 2305896 - RNA, 15 nt, Yersinia pestis KIM
aagcagauaaagaaa

SEQ ID NO: 2305897 - RNA, 15 nt, Yersinia pestis KIM
aagcagcuuuucacg

SEQ ID NO: 2305898 - RNA, 16 nt, Yersinia pestis KIM
aagcaggaaugcgguu

SEQ ID NO: 2305899 - RNA, 22 nt, Yersinia pestis KIM
aagcagucgacaguguaaaaag

SEQ ID NO: 2305900 - RNA, 19 nt, Yersinia pestis KIM
aagcauucgcgguuacacc

SEQ ID NO: 2305901 - RNA, 13 nt, Yersinia pestis KIM
aagcauauggaug

SEQ ID NO: 2305902 - RNA, 17 nt, Yersinia pestis KIM
aagcauauggaugugau

SEQ ID NO: 2305903 - RNA, 16 nt, Yersinia pestis KIM
aagcauauaaccauuu

SEQ ID NO: 2305904 - RNA, 17 nt, Yersinia pestis KIM
aagcauacguugccagc

SEQ ID NO: 2305905 - RNA, 21 nt, Yersinia pestis KIM
aagcauacguugccagccauc

SEQ ID NO: 2305906 - RNA, 15 nt, Yersinia pestis KIM
aagcacagacaaaca

SEQ ID NO: 2305907 - RNA, 13 nt, Yersinia pestis KIM
aagcacagucgcc

SEQ ID NO: 2305908 - RNA, 22 nt, Yersinia pestis KIM
aagcaauuuagacagcuuaaaa

SEQ ID NO: 2305909 - RNA, 22 nt, Yersinia pestis KIM
aagcacuguacugggaugaaga

SEQ ID NO: 2305910 - RNA, 20 nt, Yersinia pestis KIM
aagcaauaccgacaucaaca

SEQ ID NO: 2305911 - RNA, 19 nt, Yersinia pestis KIM
aagcaagcggcagcgcugg

SEQ ID NO: 2305912 - RNA, 23 nt, Yersinia pestis KIM
aagcaaccgcaaugccgcuaggg

SEQ ID NO: 2305913 - RNA, 14 nt, Yersinia pestis KIM
aagcaaugaaauau

SEQ ID NO: 2305914 - RNA, 19 nt, Yersinia pestis KIM
aagcaaaggcccgcuauca

SEQ ID NO: 2305915 - RNA, 21 nt, Yersinia pestis KIM
aagauaacuuuuuauuucuuu

SEQ ID NO: 2305916 - RNA, 16 nt, Yersinia pestis KIM
aagagucgcaaaacuu

SEQ ID NO: 2305917 - RNA, 12 nt, Yersinia pestis KIM
aagagucacagc

SEQ ID NO: 2305918 - RNA, 20 nt, Yersinia pestis KIM
aagaguacuaacgucaacag

SEQ ID NO: 2305919 - RNA, 22 nt, Yersinia pestis KIM
aagagcggucgacaaaauguga

SEQ ID NO: 2305920 - RNA, 23 nt, Yersinia pestis KIM
aagagcgacucaauaauauggga

SEQ ID NO: 2305921 - RNA, 22 nt, Yersinia pestis KIM
aagagcgauugacugaauguga

SEQ ID NO: 2305922 - RNA, 20 nt, Yersinia pestis KIM
aagagcccgcaacgggagag

SEQ ID NO: 2305923 - RNA, 14 nt, Yersinia pestis KIM
aagaggaaaugccg

SEQ ID NO: 2305924 - RNA, 20 nt, Yersinia pestis KIM
aagacuucaugacuaccuug

SEQ ID NO: 2305925 - RNA, 15 nt, Yersinia pestis KIM
aagacuucagcccau

SEQ ID NO: 2305926 - RNA, 17 nt, Yersinia pestis KIM
aagacgccguaaauaca

SEQ ID NO: 2305927 - RNA, 16 nt, Yersinia pestis KIM
aagacgccauuaauaa

SEQ ID NO: 2305928 - RNA, 13 nt, Yersinia pestis KIM
aagacgcucuccc

SEQ ID NO: 2305929 - RNA, 14 nt, Yersinia pestis KIM
aagagaaaagcaga

SEQ ID NO: 2305930 - RNA, 15 nt, Yersinia pestis KIM
aagagaaaagcagac

SEQ ID NO: 2305931 - RNA, 21 nt, Yersinia pestis KIM
aagagaaaguugauccugggu

SEQ ID NO: 2305932 - RNA, 17 nt, Yersinia pestis KIM
aagagaugaaauuuuau

SEQ ID NO: 2305933 - RNA, 21 nt, Yersinia pestis KIM
aagagaugacccaaagucauu

SEQ ID NO: 2305934 - RNA, 14 nt, Yersinia pestis KIM
aagagauagagcag

SEQ ID NO: 2305935 - RNA, 22 nt, Yersinia pestis KIM
aagagauagauuuuaaugaaaa

SEQ ID NO: 2305936 - RNA, 18 nt, Yersinia pestis KIM
aagagauguuauuugaau

SEQ ID NO: 2305937 - RNA, 14 nt, Yersinia pestis KIM
aagagacugggcug

SEQ ID NO: 2305938 - RNA, 17 nt, Yersinia pestis KIM
aagacaauaaaucgcca

SEQ ID NO: 2305939 - RNA, 22 nt, Yersinia pestis KIM
aagacaauaaaucgccacgcca

SEQ ID NO: 2305940 - RNA, 11 nt, Yersinia pestis KIM
aagacaacuua

SEQ ID NO: 2305941 - RNA, 20 nt, Yersinia pestis KIM
aagacaacuuauuuguguaa

SEQ ID NO: 2305942 - RNA, 16 nt, Yersinia pestis KIM
aagacaacaaacagua

SEQ ID NO: 2305943 - RNA, 11 nt, Yersinia pestis KIM
aagacacccgu

SEQ ID NO: 2305944 - RNA, 23 nt, Yersinia pestis KIM
aagaauugcagauaccacaucaa

SEQ ID NO: 2305945 - RNA, 14 nt, Yersinia pestis KIM
aagacauaaagaaa

SEQ ID NO: 2305946 - RNA, 15 nt, Yersinia pestis KIM
aagacauaaagaaaa

SEQ ID NO: 2305947 - RNA, 19 nt, Yersinia pestis KIM
aagaccacaucaaccugau

SEQ ID NO: 2305948 - RNA, 23 nt, Yersinia pestis KIM
aagaaucagcgguugaaaaguuu

SEQ ID NO: 2305949 - RNA, 17 nt, Yersinia pestis KIM
aagaaucccaucaaacg

SEQ ID NO: 2305950 - RNA, 19 nt, Yersinia pestis KIM
aagaauccucugaauaaaa

SEQ ID NO: 2305951 - RNA, 19 nt, Yersinia pestis KIM
aagaaucaccgaaagaaga

SEQ ID NO: 2305952 - RNA, 18 nt, Yersinia pestis KIM
aagaaucaccgaaagaag

SEQ ID NO: 2305953 - RNA, 23 nt, Yersinia pestis KIM
aagaauguauugagauuuuccca

SEQ ID NO: 2305954 - RNA, 15 nt, Yersinia pestis KIM
aagaauguauugaga

SEQ ID NO: 2305955 - RNA, 22 nt, Yersinia pestis KIM
aagaauaaggguagguucaaua

SEQ ID NO: 2305956 - RNA, 16 nt, Yersinia pestis KIM
aagaauaaaugucacu

SEQ ID NO: 2305957 - RNA, 23 nt, Yersinia pestis KIM
aagaauaaaugucacuugcccug

SEQ ID NO: 2305958 - RNA, 14 nt, Yersinia pestis KIM
aagaauacacaaaa

SEQ ID NO: 2305959 - RNA, 14 nt, Yersinia pestis KIM
aaauugagauauuu

SEQ ID NO: 2305960 - RNA, 21 nt, Yersinia pestis KIM
aaugcuacuuaacguugagaa

SEQ ID NO: 2305961 - RNA, 16 nt, Yersinia pestis KIM
aaugccccauccugac

SEQ ID NO: 2305962 - RNA, 19 nt, Yersinia pestis KIM
aaugccccacuucacgcac

SEQ ID NO: 2305963 - RNA, 19 nt, Yersinia pestis KIM
aaugccccgcauaaauacu

SEQ ID NO: 2305964 - RNA, 17 nt, Yersinia pestis KIM
aaugcguuauaaccaug

SEQ ID NO: 2305965 - RNA, 16 nt, Yersinia pestis KIM
aaugcucgcucaucau

SEQ ID NO: 2305966 - RNA, 22 nt, Yersinia pestis KIM
aaugcacuucaucauucauuuu

SEQ ID NO: 2305967 - RNA, 18 nt, Yersinia pestis KIM
aaugcacguaaagaguua

SEQ ID NO: 2305968 - RNA, 12 nt, Yersinia pestis KIM
aaugccauucaa

SEQ ID NO: 2305969 - RNA, 16 nt, Yersinia pestis KIM
aaugccauagcugcug

SEQ ID NO: 2305970 - RNA, 18 nt, Yersinia pestis KIM
aauggcacgccaguuggg

SEQ ID NO: 2305971 - RNA, 14 nt, Yersinia pestis KIM
aauggcaacaaaau

SEQ ID NO: 2305972 - RNA, 18 nt, Yersinia pestis KIM
aauggcaacaucaggcuu

SEQ ID NO: 2305973 - RNA, 15 nt, Yersinia pestis KIM
aaugcugaugcaaua

SEQ ID NO: 2305974 - RNA, 14 nt, Yersinia pestis KIM
aaugucaggaaaug

SEQ ID NO: 2305975 - RNA, 15 nt, Yersinia pestis KIM
aauguauuuauucaa

SEQ ID NO: 2305976 - RNA, 20 nt, Yersinia pestis KIM
aauguauuuauucaaaaaau

SEQ ID NO: 2305977 - RNA, 15 nt, Yersinia pestis KIM
aaugugacugauuaa

SEQ ID NO: 2305978 - RNA, 15 nt, Yersinia pestis KIM
aaugugaugaaacua

SEQ ID NO: 2305979 - RNA, 22 nt, Yersinia pestis KIM
aaugugaugaaacuaaaauaau

SEQ ID NO: 2305980 - RNA, 18 nt, Yersinia pestis KIM
aauggugcccaucacauc

SEQ ID NO: 2305981 - RNA, 18 nt, Yersinia pestis KIM
aauggugcuauuucuggc

SEQ ID NO: 2305982 - RNA, 12 nt, Yersinia pestis KIM
aauggugaacaa

SEQ ID NO: 2305983 - RNA, 14 nt, Yersinia pestis KIM
aauggugcccauca

SEQ ID NO: 2305984 - RNA, 23 nt, Yersinia pestis KIM
aauggcuuuuuuaauaaaaaacu

SEQ ID NO: 2305985 - RNA, 18 nt, Yersinia pestis KIM
aauggcuggcaaggcacg

SEQ ID NO: 2305986 - RNA, 18 nt, Yersinia pestis KIM
aaugguauuugaaauauu

SEQ ID NO: 2305987 - RNA, 12 nt, Yersinia pestis KIM
aauggucaggaa

SEQ ID NO: 2305988 - RNA, 21 nt, Yersinia pestis KIM
aaugggugugaacagugauga

SEQ ID NO: 2305989 - RNA, 21 nt, Yersinia pestis KIM
aauggguauauuuaccaaaag

SEQ ID NO: 2305990 - RNA, 14 nt, Yersinia pestis KIM
aauguuaauauuuu

SEQ ID NO: 2305991 - RNA, 22 nt, Yersinia pestis KIM
aauguuccggacuucauaaaua

SEQ ID NO: 2305992 - RNA, 23 nt, Yersinia pestis KIM
aauguuaaacuuugcuauuaaga

SEQ ID NO: 2305993 - RNA, 21 nt, Yersinia pestis KIM
aauguguugauuaacauccau

SEQ ID NO: 2305994 - RNA, 17 nt, Yersinia pestis KIM
aauguguugaauaucca

SEQ ID NO: 2305995 - RNA, 18 nt, Yersinia pestis KIM
aaugugccguaacucacc

SEQ ID NO: 2305996 - RNA, 22 nt, Yersinia pestis KIM
aauguuucuauccgaaaaauau

SEQ ID NO: 2305997 - RNA, 21 nt, Yersinia pestis KIM
aauguuucuauccgaaaaaua

SEQ ID NO: 2305998 - RNA, 21 nt, Yersinia pestis KIM
aauguucucuggguaagaaca

SEQ ID NO: 2305999 - RNA, 16 nt, Yersinia pestis KIM
aauguugcugaauaaa

SEQ ID NO: 2306000 - RNA, 17 nt, Yersinia pestis KIM
aauuaaaacugaaaagu

SEQ ID NO: 2306001 - RNA, 19 nt, Yersinia pestis KIM
aauuaaaacugaaaaguuu

SEQ ID NO: 2306002 - RNA, 11 nt, Yersinia pestis KIM
aauuaaaaauu

SEQ ID NO: 2306003 - RNA, 15 nt, Yersinia pestis KIM
aauuaaaaauuaauu

SEQ ID NO: 2306004 - RNA, 15 nt, Yersinia pestis KIM
aauuaaaaagagugu

SEQ ID NO: 2306005 - RNA, 18 nt, Yersinia pestis KIM
aauguuuuacgaucaacc

SEQ ID NO: 2306006 - RNA, 11 nt, Yersinia pestis KIM
aauuaauaucc

SEQ ID NO: 2306007 - RNA, 12 nt, Yersinia pestis KIM
aauuaaggaaaa

SEQ ID NO: 2306008 - RNA, 13 nt, Yersinia pestis KIM
aauuaagcaaaaa

SEQ ID NO: 2306009 - RNA, 23 nt, Yersinia pestis KIM
aauuaagaagccucaugaaugag

SEQ ID NO: 2306010 - RNA, 16 nt, Yersinia pestis KIM
aauuaaaccucagaaa

SEQ ID NO: 2306011 - RNA, 12 nt, Yersinia pestis KIM
aaucugauacug

SEQ ID NO: 2306012 - RNA, 16 nt, Yersinia pestis KIM
aaucugauacugaacg

SEQ ID NO: 2306013 - RNA, 18 nt, Yersinia pestis KIM
aaucugaugaauuaaaga

SEQ ID NO: 2306014 - RNA, 19 nt, Yersinia pestis KIM
aaucucuugauuaccaaua

SEQ ID NO: 2306015 - RNA, 17 nt, Yersinia pestis KIM
aaucucuccaugauaua

SEQ ID NO: 2306016 - RNA, 18 nt, Yersinia pestis KIM
aaucucuccaugauauau

SEQ ID NO: 2306017 - RNA, 19 nt, Yersinia pestis KIM
aaucucuccaugauauauc

SEQ ID NO: 2306018 - RNA, 16 nt, Yersinia pestis KIM
aaucucuccaugauau

SEQ ID NO: 2306019 - RNA, 18 nt, Yersinia pestis KIM
aaucucugccugugauuu

SEQ ID NO: 2306020 - RNA, 12 nt, Yersinia pestis KIM
aaucucugccug

SEQ ID NO: 2306021 - RNA, 13 nt, Yersinia pestis KIM
aaucuaaaggcca

SEQ ID NO: 2306022 - RNA, 21 nt, Yersinia pestis KIM
aaucgauggccgcccuccaau

SEQ ID NO: 2306023 - RNA, 13 nt, Yersinia pestis KIM
aaucgcuuucgga

SEQ ID NO: 2306024 - RNA, 20 nt, Yersinia pestis KIM
aaucggauggucauccacaa

SEQ ID NO: 2306025 - RNA, 18 nt, Yersinia pestis KIM
aaucgaacccuucagcau

SEQ ID NO: 2306026 - RNA, 14 nt, Yersinia pestis KIM
aaucgagaagaauu

SEQ ID NO: 2306027 - RNA, 15 nt, Yersinia pestis KIM
aaucgagaagaauuu

SEQ ID NO: 2306028 - RNA, 14 nt, Yersinia pestis KIM
aaucaucaucccag

SEQ ID NO: 2306029 - RNA, 16 nt, Yersinia pestis KIM
aaucaucaucccaguc

SEQ ID NO: 2306030 - RNA, 15 nt, Yersinia pestis KIM
aaucaucaucacaaa

SEQ ID NO: 2306031 - RNA, 12 nt, Yersinia pestis KIM
aaucgaaacacc

SEQ ID NO: 2306032 - RNA, 20 nt, Yersinia pestis KIM
aaugauuauugaccagauag

SEQ ID NO: 2306033 - RNA, 15 nt, Yersinia pestis KIM
aaugauuacaucacu

SEQ ID NO: 2306034 - RNA, 23 nt, Yersinia pestis KIM
aaugauucauugaguuaucuccu

SEQ ID NO: 2306035 - RNA, 14 nt, Yersinia pestis KIM
aaugcaauuuuugc

SEQ ID NO: 2306036 - RNA, 17 nt, Yersinia pestis KIM
aaugauugauuaucaag

SEQ ID NO: 2306037 - RNA, 23 nt, Yersinia pestis KIM
aaugauugauuaucaaguuaaau

SEQ ID NO: 2306038 - RNA, 21 nt, Yersinia pestis KIM
aaugauauugaucuuuaauau

SEQ ID NO: 2306039 - RNA, 18 nt, Yersinia pestis KIM
aaugauacugcccgucgu

SEQ ID NO: 2306040 - RNA, 13 nt, Yersinia pestis KIM
aaugaggcugagg

SEQ ID NO: 2306041 - RNA, 15 nt, Yersinia pestis KIM
aaugagggaggaacg

SEQ ID NO: 2306042 - RNA, 20 nt, Yersinia pestis KIM
aaugagggaugaaaagagcu

SEQ ID NO: 2306043 - RNA, 18 nt, Yersinia pestis KIM
aaugagugauauccgcca

SEQ ID NO: 2306044 - RNA, 13 nt, Yersinia pestis KIM
aaugaguaaaaau

SEQ ID NO: 2306045 - RNA, 22 nt, Yersinia pestis KIM
aaugaguuacgucaaaacuauu

SEQ ID NO: 2306046 - RNA, 20 nt, Yersinia pestis KIM
aaugauaaaauccugaauaa

SEQ ID NO: 2306047 - RNA, 21 nt, Yersinia pestis KIM
aaugaguuucaagucaauaaa

SEQ ID NO: 2306048 - RNA, 16 nt, Yersinia pestis KIM
aaugacauugcgaaua

SEQ ID NO: 2306049 - RNA, 18 nt, Yersinia pestis KIM
aaugaccaagguuauaca

SEQ ID NO: 2306050 - RNA, 22 nt, Yersinia pestis KIM
aaugaccacugauuaagaaauu

SEQ ID NO: 2306051 - RNA, 18 nt, Yersinia pestis KIM
aaugacucgauaacccaa

SEQ ID NO: 2306052 - RNA, 16 nt, Yersinia pestis KIM
aaugacuacuaaucaa

SEQ ID NO: 2306053 - RNA, 19 nt, Yersinia pestis KIM
aaucugcccagccugguuu

SEQ ID NO: 2306054 - RNA, 17 nt, Yersinia pestis KIM
aaucugcaguuuccaac

SEQ ID NO: 2306055 - RNA, 15 nt, Yersinia pestis KIM
aaucugcgcccuuau

SEQ ID NO: 2306056 - RNA, 14 nt, Yersinia pestis KIM
aaucuucaauggug

SEQ ID NO: 2306057 - RNA, 20 nt, Yersinia pestis KIM
aaugaacuguguuuauacca

SEQ ID NO: 2306058 - RNA, 14 nt, Yersinia pestis KIM
aaugacauauucaa

SEQ ID NO: 2306059 - RNA, 15 nt, Yersinia pestis KIM
aaugacauauugugc

SEQ ID NO: 2306060 - RNA, 14 nt, Yersinia pestis KIM
aaucaacggcacca

SEQ ID NO: 2306061 - RNA, 22 nt, Yersinia pestis KIM
aaucaacgcuccgguuuucacc

SEQ ID NO: 2306062 - RNA, 17 nt, Yersinia pestis KIM
aaucaagcuacgccaag

SEQ ID NO: 2306063 - RNA, 15 nt, Yersinia pestis KIM
aaucaaggcuuuaau

SEQ ID NO: 2306064 - RNA, 14 nt, Yersinia pestis KIM
aaucaaguaaccaa

SEQ ID NO: 2306065 - RNA, 12 nt, Yersinia pestis KIM
aaucaagauauu

SEQ ID NO: 2306066 - RNA, 17 nt, Yersinia pestis KIM
aaucaaugggauauuau

SEQ ID NO: 2306067 - RNA, 15 nt, Yersinia pestis KIM
aaucaauugccccca

SEQ ID NO: 2306068 - RNA, 20 nt, Yersinia pestis KIM
aaucaauugcccccaucacu

SEQ ID NO: 2306069 - RNA, 14 nt, Yersinia pestis KIM
aaucaaguugaaug

SEQ ID NO: 2306070 - RNA, 20 nt, Yersinia pestis KIM
aaucacaucaccgacagcau

SEQ ID NO: 2306071 - RNA, 15 nt, Yersinia pestis KIM
aaucacaucaccgac

SEQ ID NO: 2306072 - RNA, 20 nt, Yersinia pestis KIM
aaucacacgggaucuacaua

SEQ ID NO: 2306073 - RNA, 12 nt, Yersinia pestis KIM
aaucaauuuuug

SEQ ID NO: 2306074 - RNA, 17 nt, Yersinia pestis KIM
aaucaccaaauccaacu

SEQ ID NO: 2306075 - RNA, 17 nt, Yersinia pestis KIM
aaucacccgcaagaaua

SEQ ID NO: 2306076 - RNA, 19 nt, Yersinia pestis KIM
aaucaccucaaacugacuu

SEQ ID NO: 2306077 - RNA, 15 nt, Yersinia pestis KIM
aaucagugacaagaa

SEQ ID NO: 2306078 - RNA, 22 nt, Yersinia pestis KIM
aaucagcgugguauaaauggca

SEQ ID NO: 2306079 - RNA, 20 nt, Yersinia pestis KIM
aaucagcgugguauaaaugg

SEQ ID NO: 2306080 - RNA, 15 nt, Yersinia pestis KIM
aaucagccccaagcu

SEQ ID NO: 2306081 - RNA, 22 nt, Yersinia pestis KIM
aaucaguguauuacuccacacg

SEQ ID NO: 2306082 - RNA, 14 nt, Yersinia pestis KIM
aaucaguauuacgg

SEQ ID NO: 2306083 - RNA, 14 nt, Yersinia pestis KIM
aaucaguuuacaug

SEQ ID NO: 2306084 - RNA, 15 nt, Yersinia pestis KIM
aaucaucagccucua

SEQ ID NO: 2306085 - RNA, 18 nt, Yersinia pestis KIM
aaucagauacggcuccag

SEQ ID NO: 2306086 - RNA, 17 nt, Yersinia pestis KIM
aaucagauacggcucca

SEQ ID NO: 2306087 - RNA, 19 nt, Yersinia pestis KIM
aaucagaggugaaaaaaua

SEQ ID NO: 2306088 - RNA, 23 nt, Yersinia pestis KIM
aaucacugaggccaaaugaaaau

SEQ ID NO: 2306089 - RNA, 14 nt, Yersinia pestis KIM
aaucacuuacuggu

SEQ ID NO: 2306090 - RNA, 14 nt, Yersinia pestis KIM
aaucacguuuccaa

SEQ ID NO: 2306091 - RNA, 22 nt, Yersinia pestis KIM
aaucacguuuccaaaacucaug

SEQ ID NO: 2306092 - RNA, 20 nt, Yersinia pestis KIM
aaucacgguuuaucccccuc

SEQ ID NO: 2306093 - RNA, 21 nt, Yersinia pestis KIM
aaucaccuuggaaaacagcaa

SEQ ID NO: 2306094 - RNA, 18 nt, Yersinia pestis KIM
aaucaccuuggaaaacag

SEQ ID NO: 2306095 - RNA, 19 nt, Yersinia pestis KIM
aaucaccuuggaaaacagc

SEQ ID NO: 2306096 - RNA, 16 nt, Yersinia pestis KIM
aaucacgacaagucau

SEQ ID NO: 2306097 - RNA, 18 nt, Yersinia pestis KIM
aaucacgauacgacuucu

SEQ ID NO: 2306098 - RNA, 15 nt, Yersinia pestis KIM
aaucacgacaaguca

SEQ ID NO: 2306099 - RNA, 17 nt, Yersinia pestis KIM
aauauuuuuaaucugcc

SEQ ID NO: 2306100 - RNA, 14 nt, Yersinia pestis KIM
aaucaaacaaaucu

SEQ ID NO: 2306101 - RNA, 12 nt, Yersinia pestis KIM
aaucaaaacagg

SEQ ID NO: 2306102 - RNA, 17 nt, Yersinia pestis KIM
aaucaaaagggaucacc

SEQ ID NO: 2306103 - RNA, 14 nt, Yersinia pestis KIM
aaucaaaaaauaaa

SEQ ID NO: 2306104 - RNA, 21 nt, Yersinia pestis KIM
aaucaacagauaugcauuauu

SEQ ID NO: 2306105 - RNA, 21 nt, Yersinia pestis KIM
aaucaaccacgguaauagcuu

SEQ ID NO: 2306106 - RNA, 19 nt, Yersinia pestis KIM
aauauugucuuaugauaua

SEQ ID NO: 2306107 - RNA, 19 nt, Yersinia pestis KIM
aauauuuacggugagaaua

SEQ ID NO: 2306108 - RNA, 12 nt, Yersinia pestis KIM
aauauugccgca

SEQ ID NO: 2306109 - RNA, 21 nt, Yersinia pestis KIM
aauauugcguuaccuaaaacu

SEQ ID NO: 2306110 - RNA, 15 nt, Yersinia pestis KIM
aauauugauccaccg

SEQ ID NO: 2306111 - RNA, 20 nt, Yersinia pestis KIM
aauauuggauaauaaccuga

SEQ ID NO: 2306112 - RNA, 14 nt, Yersinia pestis KIM
aauauugaauuaaa

SEQ ID NO: 2306113 - RNA, 23 nt, Yersinia pestis KIM
aauauucugacgggacaaucugu

SEQ ID NO: 2306114 - RNA, 22 nt, Yersinia pestis KIM
aauauuccggccagcuuuuuau

SEQ ID NO: 2306115 - RNA, 20 nt, Yersinia pestis KIM
aauauuccaaaaaauagccg

SEQ ID NO: 2306116 - RNA, 21 nt, Yersinia pestis KIM
aauauuccccaccauugcaaa

SEQ ID NO: 2306117 - RNA, 15 nt, Yersinia pestis KIM
aauauuccaaaaaau

SEQ ID NO: 2306118 - RNA, 13 nt, Yersinia pestis KIM
aauauucauuaaa

SEQ ID NO: 2306119 - RNA, 13 nt, Yersinia pestis KIM
aauauucaguaag

SEQ ID NO: 2306120 - RNA, 17 nt, Yersinia pestis KIM
aauauucaauaggguaa

SEQ ID NO: 2306121 - RNA, 16 nt, Yersinia pestis KIM
aauauuaacugcagug

SEQ ID NO: 2306122 - RNA, 20 nt, Yersinia pestis KIM
aauaugaucuugauaaacau

SEQ ID NO: 2306123 - RNA, 13 nt, Yersinia pestis KIM
aauauuaauaaug

SEQ ID NO: 2306124 - RNA, 14 nt, Yersinia pestis KIM
aauauuaauaaugc

SEQ ID NO: 2306125 - RNA, 14 nt, Yersinia pestis KIM
aauauucaagagau

SEQ ID NO: 2306126 - RNA, 15 nt, Yersinia pestis KIM
aauauucaagagauu

SEQ ID NO: 2306127 - RNA, 16 nt, Yersinia pestis KIM
aauaucaacagaacua

SEQ ID NO: 2306128 - RNA, 20 nt, Yersinia pestis KIM
aauauaaaagcacagacaaa

SEQ ID NO: 2306129 - RNA, 13 nt, Yersinia pestis KIM
aauauaacaaugu

SEQ ID NO: 2306130 - RNA, 16 nt, Yersinia pestis KIM
aauaucuuucauauca

SEQ ID NO: 2306131 - RNA, 15 nt, Yersinia pestis KIM
aauaucgguaaaaaa

SEQ ID NO: 2306132 - RNA, 14 nt, Yersinia pestis KIM
aauauccuggaagc

SEQ ID NO: 2306133 - RNA, 15 nt, Yersinia pestis KIM
aauaucgauuuuuaa

SEQ ID NO: 2306134 - RNA, 23 nt, Yersinia pestis KIM
aauaucgauuuuuaagucaauuu

SEQ ID NO: 2306135 - RNA, 17 nt, Yersinia pestis KIM
aauaucaagucuugaag

SEQ ID NO: 2306136 - RNA, 18 nt, Yersinia pestis KIM
aauaucaagucuugaaga

SEQ ID NO: 2306137 - RNA, 16 nt, Yersinia pestis KIM
aauagaggaaauaaau

SEQ ID NO: 2306138 - RNA, 13 nt, Yersinia pestis KIM
aauagaggacuau

SEQ ID NO: 2306139 - RNA, 14 nt, Yersinia pestis KIM
aauagcuaauaauu

SEQ ID NO: 2306140 - RNA, 21 nt, Yersinia pestis KIM
aauagcuaccccuucagucag

SEQ ID NO: 2306141 - RNA, 18 nt, Yersinia pestis KIM
aauagagaauagauagca

SEQ ID NO: 2306142 - RNA, 22 nt, Yersinia pestis KIM
aauagagacggaaagagccagc

SEQ ID NO: 2306143 - RNA, 13 nt, Yersinia pestis KIM
aauagagcaccaa

SEQ ID NO: 2306144 - RNA, 14 nt, Yersinia pestis KIM
aauagagcaccaaa

SEQ ID NO: 2306145 - RNA, 21 nt, Yersinia pestis KIM
aauagagccucuauuaccuca

SEQ ID NO: 2306146 - RNA, 15 nt, Yersinia pestis KIM
aauagaggaaauaaa

SEQ ID NO: 2306147 - RNA, 21 nt, Yersinia pestis KIM
aauagucagugggcuauuuau

SEQ ID NO: 2306148 - RNA, 20 nt, Yersinia pestis KIM
aauaguaauuaauuaugaua

SEQ ID NO: 2306149 - RNA, 20 nt, Yersinia pestis KIM
aauagcuuaaucaucaucac

SEQ ID NO: 2306150 - RNA, 17 nt, Yersinia pestis KIM
aauagcuuaaucaucau

SEQ ID NO: 2306151 - RNA, 18 nt, Yersinia pestis KIM
aauacgaccgucaccaaa

SEQ ID NO: 2306152 - RNA, 16 nt, Yersinia pestis KIM
aauacgaccgucacca

SEQ ID NO: 2306153 - RNA, 18 nt, Yersinia pestis KIM
aauacguucaaaugauuc

SEQ ID NO: 2306154 - RNA, 17 nt, Yersinia pestis KIM
aauacguuccaacgcac

SEQ ID NO: 2306155 - RNA, 19 nt, Yersinia pestis KIM
aauacgguagcaauaccuu

SEQ ID NO: 2306156 - RNA, 17 nt, Yersinia pestis KIM
aauacgguguaaaccgc

SEQ ID NO: 2306157 - RNA, 17 nt, Yersinia pestis KIM
aauacccagcuucuuuu

SEQ ID NO: 2306158 - RNA, 18 nt, Yersinia pestis KIM
aauacccaaaauuugcuu

SEQ ID NO: 2306159 - RNA, 14 nt, Yersinia pestis KIM
aauaccccccacca

SEQ ID NO: 2306160 - RNA, 21 nt, Yersinia pestis KIM
aauaccccccaccaauugguu

SEQ ID NO: 2306161 - RNA, 14 nt, Yersinia pestis KIM
aauaccauauaccc

SEQ ID NO: 2306162 - RNA, 18 nt, Yersinia pestis KIM
aauacuuaacaaucagug

SEQ ID NO: 2306163 - RNA, 13 nt, Yersinia pestis KIM
aauacuucaggcc

SEQ ID NO: 2306164 - RNA, 20 nt, Yersinia pestis KIM
aauacuuauuugaaacagau

SEQ ID NO: 2306165 - RNA, 22 nt, Yersinia pestis KIM
aauagaagagaggcaaugauuu

SEQ ID NO: 2306166 - RNA, 18 nt, Yersinia pestis KIM
aauagaaccggaauaaau

SEQ ID NO: 2306167 - RNA, 14 nt, Yersinia pestis KIM
aauacaucaucaaa

SEQ ID NO: 2306168 - RNA, 12 nt, Yersinia pestis KIM
aauacauccaug

SEQ ID NO: 2306169 - RNA, 20 nt, Yersinia pestis KIM
aauacauaucaacacugccu

SEQ ID NO: 2306170 - RNA, 15 nt, Yersinia pestis KIM
aauacauaucaacac

SEQ ID NO: 2306171 - RNA, 22 nt, Yersinia pestis KIM
aauacauagaagcucauaugca

SEQ ID NO: 2306172 - RNA, 19 nt, Yersinia pestis KIM
aauacauauaaccaucaaa

SEQ ID NO: 2306173 - RNA, 13 nt, Yersinia pestis KIM
aauacagcaaaua

SEQ ID NO: 2306174 - RNA, 22 nt, Yersinia pestis KIM
aauacaggggcguuauugagaa

SEQ ID NO: 2306175 - RNA, 16 nt, Yersinia pestis KIM
aauacaauuauuuuua

SEQ ID NO: 2306176 - RNA, 17 nt, Yersinia pestis KIM
aauacaauuauuuuuac

SEQ ID NO: 2306177 - RNA, 18 nt, Yersinia pestis KIM
aauacaauuauuuuuaca

SEQ ID NO: 2306178 - RNA, 12 nt, Yersinia pestis KIM
aauaaaggcugu

SEQ ID NO: 2306179 - RNA, 16 nt, Yersinia pestis KIM
aauaaaggggguuuuc

SEQ ID NO: 2306180 - RNA, 18 nt, Yersinia pestis KIM
aauaaagcgauaaauacu

SEQ ID NO: 2306181 - RNA, 19 nt, Yersinia pestis KIM
aauaaagcucugacaaaau

SEQ ID NO: 2306182 - RNA, 16 nt, Yersinia pestis KIM
aauaaagaguccccau

SEQ ID NO: 2306183 - RNA, 23 nt, Yersinia pestis KIM
aaauuagaugguuaacucauuua

SEQ ID NO: 2306184 - RNA, 23 nt, Yersinia pestis KIM
aaauuagcagggcauucgccuga

SEQ ID NO: 2306185 - RNA, 13 nt, Yersinia pestis KIM
aaauuauaaugau

SEQ ID NO: 2306186 - RNA, 14 nt, Yersinia pestis KIM
aaauuauaaugaug

SEQ ID NO: 2306187 - RNA, 23 nt, Yersinia pestis KIM
aaauuauauucuuggguguuuau

SEQ ID NO: 2306188 - RNA, 19 nt, Yersinia pestis KIM
aaauuaugccagucuucca

SEQ ID NO: 2306189 - RNA, 22 nt, Yersinia pestis KIM
aaauuacucguauaaaaaauaa

SEQ ID NO: 2306190 - RNA, 15 nt, Yersinia pestis KIM
aaauuagaaaacaag

SEQ ID NO: 2306191 - RNA, 18 nt, Yersinia pestis KIM
aaauuacgugcccaaaaa

SEQ ID NO: 2306192 - RNA, 20 nt, Yersinia pestis KIM
aaauuacgugcccaaaaacg

SEQ ID NO: 2306193 - RNA, 11 nt, Yersinia pestis KIM
uuuuuugccag

SEQ ID NO: 2306194 - RNA, 17 nt, Yersinia pestis KIM
aaauucaacuucuccug

SEQ ID NO: 2306195 - RNA, 11 nt, Yersinia pestis KIM
aaauucaauuc

SEQ ID NO: 2306196 - RNA, 15 nt, Yersinia pestis KIM
aaauucaaaauagag

SEQ ID NO: 2306197 - RNA, 12 nt, Yersinia pestis KIM
aaauucaucuuu

SEQ ID NO: 2306198 - RNA, 11 nt, Yersinia pestis KIM
aaauucaguuc

SEQ ID NO: 2306199 - RNA, 19 nt, Yersinia pestis KIM
aaauucagguugaggcagg

SEQ ID NO: 2306200 - RNA, 13 nt, Yersinia pestis KIM
aaauuccauuuaa

SEQ ID NO: 2306201 - RNA, 14 nt, Yersinia pestis KIM
aaauucauucuuuu

SEQ ID NO: 2306202 - RNA, 21 nt, Yersinia pestis KIM
aaauucuguagaguaaaacug

SEQ ID NO: 2306203 - RNA, 23 nt, Yersinia pestis KIM
aaauucucaaugauaaaauccug

SEQ ID NO: 2306204 - RNA, 23 nt, Yersinia pestis KIM
aaauucguuucucuaaaauuuua

SEQ ID NO: 2306205 - RNA, 14 nt, Yersinia pestis KIM
aaauucuaucuggu

SEQ ID NO: 2306206 - RNA, 14 nt, Yersinia pestis KIM
aaauucuaccuggc

SEQ ID NO: 2306207 - RNA, 21 nt, Yersinia pestis KIM
aaauucgggcugaguaaagcc

SEQ ID NO: 2306208 - RNA, 16 nt, Yersinia pestis KIM
aaauucgggcuuuaau

SEQ ID NO: 2306209 - RNA, 17 nt, Yersinia pestis KIM
aaauuccuauaaauuuu

SEQ ID NO: 2306210 - RNA, 14 nt, Yersinia pestis KIM
uuuuugaauaaucc

SEQ ID NO: 2306211 - RNA, 13 nt, Yersinia pestis KIM
uuuuugaaauucu

SEQ ID NO: 2306212 - RNA, 22 nt, Yersinia pestis KIM
uuuuucuguucagauuuaccau

SEQ ID NO: 2306213 - RNA, 11 nt, Yersinia pestis KIM
uuuuucucaau

SEQ ID NO: 2306214 - RNA, 14 nt, Yersinia pestis KIM
uuuuugcaauuaau

SEQ ID NO: 2306215 - RNA, 23 nt, Yersinia pestis KIM
uuuuugcgggacagaaagaaguc

SEQ ID NO: 2306216 - RNA, 21 nt, Yersinia pestis KIM
uuuuugagcucagccaggcag

SEQ ID NO: 2306217 - RNA, 14 nt, Yersinia pestis KIM
uuuuugcuggaacu

SEQ ID NO: 2306218 - RNA, 19 nt, Yersinia pestis KIM
uuuuuuaacuuccauucau

SEQ ID NO: 2306219 - RNA, 21 nt, Yersinia pestis KIM
uuuuugguuuucuauuuccac

SEQ ID NO: 2306220 - RNA, 20 nt, Yersinia pestis KIM
uuuuugucgcccugcgaggc

SEQ ID NO: 2306221 - RNA, 18 nt, Yersinia pestis KIM
uuuuuucaccaaccaauu

SEQ ID NO: 2306222 - RNA, 15 nt, Yersinia pestis KIM
uuuuuuaguuaaaua

SEQ ID NO: 2306223 - RNA, 22 nt, Yersinia pestis KIM
aaauguucaacaagaaaucaaa

SEQ ID NO: 2306224 - RNA, 23 nt, Yersinia pestis KIM
aaauguucaacaagaaaucaaaa

SEQ ID NO: 2306225 - RNA, 15 nt, Yersinia pestis KIM
aaauuaaauuauuua

SEQ ID NO: 2306226 - RNA, 13 nt, Yersinia pestis KIM
aaauuaaaauaau

SEQ ID NO: 2306227 - RNA, 12 nt, Yersinia pestis KIM
aaauuaaaaauu

SEQ ID NO: 2306228 - RNA, 13 nt, Yersinia pestis KIM
aaauuaaaacuga

SEQ ID NO: 2306229 - RNA, 15 nt, Yersinia pestis KIM
aaauuaaaacugaaa

SEQ ID NO: 2306230 - RNA, 17 nt, Yersinia pestis KIM
aaauuaaaauaaugagu

SEQ ID NO: 2306231 - RNA, 22 nt, Yersinia pestis KIM
aaauuaauuacuuuauuuaaaa

SEQ ID NO: 2306232 - RNA, 14 nt, Yersinia pestis KIM
aaauuaaucuugua

SEQ ID NO: 2306233 - RNA, 23 nt, Yersinia pestis KIM
aaauuaauaacgccgaguaaguc

SEQ ID NO: 2306234 - RNA, 12 nt, Yersinia pestis KIM
aaauuaauaggu

SEQ ID NO: 2306235 - RNA, 17 nt, Yersinia pestis KIM
uuuuggugacaaacgcu

SEQ ID NO: 2306236 - RNA, 17 nt, Yersinia pestis KIM
uuuuggucguauucaua

SEQ ID NO: 2306237 - RNA, 11 nt, Yersinia pestis KIM
uuuuguauucc

SEQ ID NO: 2306238 - RNA, 23 nt, Yersinia pestis KIM
uuuuguuacugcuuaccuuguuu

SEQ ID NO: 2306239 - RNA, 18 nt, Yersinia pestis KIM
uuuuuacaagcacucaau

SEQ ID NO: 2306240 - RNA, 12 nt, Yersinia pestis KIM
uuuuuacaagca

SEQ ID NO: 2306241 - RNA, 20 nt, Yersinia pestis KIM
uuuuuacauauaauccaaaa

SEQ ID NO: 2306242 - RNA, 21 nt, Yersinia pestis KIM
uuuuuaaugauugauuaucaa

SEQ ID NO: 2306243 - RNA, 12 nt, Yersinia pestis KIM
uuuuuaaccucu

SEQ ID NO: 2306244 - RNA, 12 nt, Yersinia pestis KIM
uuuuuaacaaac

SEQ ID NO: 2306245 - RNA, 19 nt, Yersinia pestis KIM
uuuuuaaacuuguaucaaa

SEQ ID NO: 2306246 - RNA, 11 nt, Yersinia pestis KIM
uuuuuccagcc

SEQ ID NO: 2306247 - RNA, 12 nt, Yersinia pestis KIM
uuuuuauuucuu

SEQ ID NO: 2306248 - RNA, 18 nt, Yersinia pestis KIM
uuuuucaacucagcggcu

SEQ ID NO: 2306249 - RNA, 16 nt, Yersinia pestis KIM
uuuuucauaauaauga

SEQ ID NO: 2306250 - RNA, 12 nt, Yersinia pestis KIM
uuuuucagcuuc

SEQ ID NO: 2306251 - RNA, 19 nt, Yersinia pestis KIM
uuuuuacgccuauccucau

SEQ ID NO: 2306252 - RNA, 21 nt, Yersinia pestis KIM
uuuuuacccguacaaaaauaa

SEQ ID NO: 2306253 - RNA, 17 nt, Yersinia pestis KIM
uuuuuaccugagaaaaa

SEQ ID NO: 2306254 - RNA, 20 nt, Yersinia pestis KIM
uuuuuauuucuccuuacuau

SEQ ID NO: 2306255 - RNA, 19 nt, Yersinia pestis KIM
uuuuuauaggucaucccag

SEQ ID NO: 2306256 - RNA, 20 nt, Yersinia pestis KIM
uuuugaggauauuagggcug

SEQ ID NO: 2306257 - RNA, 15 nt, Yersinia pestis KIM
uuuugccucacuguc

SEQ ID NO: 2306258 - RNA, 22 nt, Yersinia pestis KIM
uuuugcgacaggcucagcacaa

SEQ ID NO: 2306259 - RNA, 17 nt, Yersinia pestis KIM
uuuugcaucaccaucau

SEQ ID NO: 2306260 - RNA, 16 nt, Yersinia pestis KIM
uuuugccagauaaaaa

SEQ ID NO: 2306261 - RNA, 16 nt, Yersinia pestis KIM
uuuugccaauauugcc

SEQ ID NO: 2306262 - RNA, 11 nt, Yersinia pestis KIM
uuuugcugcca

SEQ ID NO: 2306263 - RNA, 19 nt, Yersinia pestis KIM
uuuugggaugaaaaauaca

SEQ ID NO: 2306264 - RNA, 14 nt, Yersinia pestis KIM
uuuugggauaaaau

SEQ ID NO: 2306265 - RNA, 14 nt, Yersinia pestis KIM
uuuuggcugauaga

SEQ ID NO: 2306266 - RNA, 20 nt, Yersinia pestis KIM
uuuucuagcuguagcaauau

SEQ ID NO: 2306267 - RNA, 13 nt, Yersinia pestis KIM
uuuucuacugaau

SEQ ID NO: 2306268 - RNA, 21 nt, Yersinia pestis KIM
uuuucuacugaauaaacacca

SEQ ID NO: 2306269 - RNA, 21 nt, Yersinia pestis KIM
uuuucuccugggcugauauau

SEQ ID NO: 2306270 - RNA, 22 nt, Yersinia pestis KIM
uuuucugcauaagcaucaguaa

SEQ ID NO: 2306271 - RNA, 17 nt, Yersinia pestis KIM
uuuucugauuuuuuacu

SEQ ID NO: 2306272 - RNA, 13 nt, Yersinia pestis KIM
uuuucugccuauc

SEQ ID NO: 2306273 - RNA, 21 nt, Yersinia pestis KIM
uuuucuggugagcaucaacau

SEQ ID NO: 2306274 - RNA, 22 nt, Yersinia pestis KIM
uuuucuggcguuuugcaucaac

SEQ ID NO: 2306275 - RNA, 22 nt, Yersinia pestis KIM
uuuucuuguauauaaaaaauga

SEQ ID NO: 2306276 - RNA, 15 nt, Yersinia pestis KIM
uuuucuuucaacugc

SEQ ID NO: 2306277 - RNA, 16 nt, Yersinia pestis KIM
uuuugaacgauauuuu

SEQ ID NO: 2306278 - RNA, 16 nt, Yersinia pestis KIM
uuuuaaacgucagauu

SEQ ID NO: 2306279 - RNA, 22 nt, Yersinia pestis KIM
uuuguugucagauaucugcuca

SEQ ID NO: 2306280 - RNA, 13 nt, Yersinia pestis KIM
uuuguugauguaa

SEQ ID NO: 2306281 - RNA, 12 nt, Yersinia pestis KIM
uuuguuauuucu

SEQ ID NO: 2306282 - RNA, 20 nt, Yersinia pestis KIM
uuuguuuggauaaaaacauu

SEQ ID NO: 2306283 - RNA, 20 nt, Yersinia pestis KIM
uuuuaaaaaaauuaaaauaa

SEQ ID NO: 2306284 - RNA, 15 nt, Yersinia pestis KIM
uuuguuuuucugaca

SEQ ID NO: 2306285 - RNA, 13 nt, Yersinia pestis KIM
uuuuaaaaaauca

SEQ ID NO: 2306286 - RNA, 14 nt, Yersinia pestis KIM
uuuuaauaaccauu

SEQ ID NO: 2306287 - RNA, 23 nt, Yersinia pestis KIM
uuuuaauaaccauuaauugguuu

SEQ ID NO: 2306288 - RNA, 13 nt, Yersinia pestis KIM
uuuuaauaaaaaa

SEQ ID NO: 2306289 - RNA, 21 nt, Yersinia pestis KIM
uuuuaacgucgcugaaaugcu

SEQ ID NO: 2306290 - RNA, 16 nt, Yersinia pestis KIM
uuuuaacguuagagca

SEQ ID NO: 2306291 - RNA, 22 nt, Yersinia pestis KIM
uuuuaacgucgcugaaaugcua

SEQ ID NO: 2306292 - RNA, 17 nt, Yersinia pestis KIM
uuuuaagaaaacugugc

SEQ ID NO: 2306293 - RNA, 16 nt, Yersinia pestis KIM
uuuuaaucucuccaug

SEQ ID NO: 2306294 - RNA, 20 nt, Yersinia pestis KIM
uuuuaaucucuccaugauau

SEQ ID NO: 2306295 - RNA, 23 nt, Yersinia pestis KIM
uuuuacaaauuugacauuuccuu

SEQ ID NO: 2306296 - RNA, 18 nt, Yersinia pestis KIM
uuuuacaggauuaaauaa

SEQ ID NO: 2306297 - RNA, 23 nt, Yersinia pestis KIM
uuuuaccuuuaacuguuuuauau

SEQ ID NO: 2306298 - RNA, 23 nt, Yersinia pestis KIM
uuugguugaacauuuccacucuu

SEQ ID NO: 2306299 - RNA, 18 nt, Yersinia pestis KIM
uuugguuggcuuuaaccc

SEQ ID NO: 2306300 - RNA, 21 nt, Yersinia pestis KIM
uuuggugaucaugauuucucg

SEQ ID NO: 2306301 - RNA, 17 nt, Yersinia pestis KIM
uuugggaacaacagcau

SEQ ID NO: 2306302 - RNA, 20 nt, Yersinia pestis KIM
uuuggccgcucaacuuugcu

SEQ ID NO: 2306303 - RNA, 18 nt, Yersinia pestis KIM
uuugcugucuggguggcu

SEQ ID NO: 2306304 - RNA, 21 nt, Yersinia pestis KIM
uuuggaauagcuguaaaauac

SEQ ID NO: 2306305 - RNA, 18 nt, Yersinia pestis KIM
uuugguuuuuucaguaca

SEQ ID NO: 2306306 - RNA, 14 nt, Yersinia pestis KIM
uuugguuuucuauu

SEQ ID NO: 2306307 - RNA, 16 nt, Yersinia pestis KIM
uuuguaaauuuuaaac

SEQ ID NO: 2306308 - RNA, 13 nt, Yersinia pestis KIM
uuuguauuuuguu

SEQ ID NO: 2306309 - RNA, 22 nt, Yersinia pestis KIM
uuuguauuuacucguuuuacau

SEQ ID NO: 2306310 - RNA, 15 nt, Yersinia pestis KIM
uuugucacaaugcug

SEQ ID NO: 2306311 - RNA, 22 nt, Yersinia pestis KIM
uuugucagcagucugagccuca

SEQ ID NO: 2306312 - RNA, 15 nt, Yersinia pestis KIM
uuugucagcaucuuu

SEQ ID NO: 2306313 - RNA, 20 nt, Yersinia pestis KIM
uuugucauguugaccaaaca

SEQ ID NO: 2306314 - RNA, 22 nt, Yersinia pestis KIM
uuugucauguugaccaaacaga

SEQ ID NO: 2306315 - RNA, 22 nt, Yersinia pestis KIM
uuugucgcauuuauuuguagug

SEQ ID NO: 2306316 - RNA, 22 nt, Yersinia pestis KIM
uuuguccggagagagacuuugu

SEQ ID NO: 2306317 - RNA, 16 nt, Yersinia pestis KIM
uuugucgcucaagccu

SEQ ID NO: 2306318 - RNA, 17 nt, Yersinia pestis KIM
uuugucgucccaggccu

SEQ ID NO: 2306319 - RNA, 13 nt, Yersinia pestis KIM
uuuuauguuaaau

SEQ ID NO: 2306320 - RNA, 17 nt, Yersinia pestis KIM
uuuuauuaccugcuauu

SEQ ID NO: 2306321 - RNA, 21 nt, Yersinia pestis KIM
uuuuauuaccugcuauuuuau

SEQ ID NO: 2306322 - RNA, 18 nt, Yersinia pestis KIM
uuuuauucgcguuucauu

SEQ ID NO: 2306323 - RNA, 20 nt, Yersinia pestis KIM
uuuuaucgcaguaauagaaa

SEQ ID NO: 2306324 - RNA, 16 nt, Yersinia pestis KIM
uuuuauauaauugaag

SEQ ID NO: 2306325 - RNA, 18 nt, Yersinia pestis KIM
uuuuauauccgccauccu

SEQ ID NO: 2306326 - RNA, 15 nt, Yersinia pestis KIM
uuuuaucaucauaaa

SEQ ID NO: 2306327 - RNA, 23 nt, Yersinia pestis KIM
uuuuaucaggcgaaugcccugcu

SEQ ID NO: 2306328 - RNA, 14 nt, Yersinia pestis KIM
uuuuacgcaaguaa

SEQ ID NO: 2306329 - RNA, 16 nt, Yersinia pestis KIM
uuuuacgggccuuuua

SEQ ID NO: 2306330 - RNA, 19 nt, Yersinia pestis KIM
uuuuacgggccuuuuaauu

SEQ ID NO: 2306331 - RNA, 22 nt, Yersinia pestis KIM
uuuuagccgcuucgcugacauu

SEQ ID NO: 2306332 - RNA, 20 nt, Yersinia pestis KIM
uuuuaguauuggaaaaauca

SEQ ID NO: 2306333 - RNA, 14 nt, Yersinia pestis KIM
uuuuaguuaaauaa

SEQ ID NO: 2306334 - RNA, 13 nt, Yersinia pestis KIM
uuuuaguuaaaua

SEQ ID NO: 2306335 - RNA, 15 nt, Yersinia pestis KIM
uuuuagcgcuuuuac

SEQ ID NO: 2306336 - RNA, 22 nt, Yersinia pestis KIM
uuuuaggcaauccaaacauaca

SEQ ID NO: 2306337 - RNA, 21 nt, Yersinia pestis KIM
uuuuauaaacacuuaccuaua

SEQ ID NO: 2306338 - RNA, 20 nt, Yersinia pestis KIM
uuuuauaccggggccaucau

SEQ ID NO: 2306339 - RNA, 15 nt, Yersinia pestis KIM
uuuuccuauaaacca

SEQ ID NO: 2306340 - RNA, 18 nt, Yersinia pestis KIM
uuuucccuguagaacacc

SEQ ID NO: 2306341 - RNA, 18 nt, Yersinia pestis KIM
uuuuccaggucaaugucu

SEQ ID NO: 2306342 - RNA, 13 nt, Yersinia pestis KIM
uuuucauuuacuu

SEQ ID NO: 2306343 - RNA, 14 nt, Yersinia pestis KIM
uuuucgaacuuaac

SEQ ID NO: 2306344 - RNA, 22 nt, Yersinia pestis KIM
uuuucgacguaaccgcauaauc

SEQ ID NO: 2306345 - RNA, 23 nt, Yersinia pestis KIM
uuuucgggccacuacggcgacuu

SEQ ID NO: 2306346 - RNA, 13 nt, Yersinia pestis KIM
uuuucguuuacuu

SEQ ID NO: 2306347 - RNA, 18 nt, Yersinia pestis KIM
uuuucgugucguaaccca

SEQ ID NO: 2306348 - RNA, 16 nt, Yersinia pestis KIM
uuuucgcgcaccaacu

SEQ ID NO: 2306349 - RNA, 14 nt, Yersinia pestis KIM
uuuucgggaaaaaa

SEQ ID NO: 2306350 - RNA, 23 nt, Yersinia pestis KIM
uuuucaguaucgaagacaaacac

SEQ ID NO: 2306351 - RNA, 19 nt, Yersinia pestis KIM
uuuucacuccggcaucauc

SEQ ID NO: 2306352 - RNA, 18 nt, Yersinia pestis KIM
uuuucacacgcccaggcc

SEQ ID NO: 2306353 - RNA, 22 nt, Yersinia pestis KIM
uuuucacccccacaucaggccg

SEQ ID NO: 2306354 - RNA, 13 nt, Yersinia pestis KIM
uuucuggaaugag

SEQ ID NO: 2306355 - RNA, 13 nt, Yersinia pestis KIM
uuucugccuaucu

SEQ ID NO: 2306356 - RNA, 14 nt, Yersinia pestis KIM
uuucuggugagcau

SEQ ID NO: 2306357 - RNA, 21 nt, Yersinia pestis KIM
uuucugaagaugccaaucaaa

SEQ ID NO: 2306358 - RNA, 23 nt, Yersinia pestis KIM
uuucucuuggagccagccauucu

SEQ ID NO: 2306359 - RNA, 19 nt, Yersinia pestis KIM
uuucucggccaacaucuuc

SEQ ID NO: 2306360 - RNA, 18 nt, Yersinia pestis KIM
uuucucucuacuucgucu

SEQ ID NO: 2306361 - RNA, 17 nt, Yersinia pestis KIM
uuucucugaugaacgga

SEQ ID NO: 2306362 - RNA, 16 nt, Yersinia pestis KIM
uuucucuaaaauuuua

SEQ ID NO: 2306363 - RNA, 16 nt, Yersinia pestis KIM
uuucuauuuucagcau

SEQ ID NO: 2306364 - RNA, 17 nt, Yersinia pestis KIM
uuucuccccacuucauc

SEQ ID NO: 2306365 - RNA, 15 nt, Yersinia pestis KIM
uuucuccaacuaauc

SEQ ID NO: 2306366 - RNA, 21 nt, Yersinia pestis KIM
uuucuccaccgggccuaauca

SEQ ID NO: 2306367 - RNA, 17 nt, Yersinia pestis KIM
uuucguuuaaaaaauau

SEQ ID NO: 2306368 - RNA, 13 nt, Yersinia pestis KIM
uuucguuuacuug

SEQ ID NO: 2306369 - RNA, 14 nt, Yersinia pestis KIM
uuucguuuacuuga

SEQ ID NO: 2306370 - RNA, 23 nt, Yersinia pestis KIM
uuucguuuacuugauggcuguuu

SEQ ID NO: 2306371 - RNA, 15 nt, Yersinia pestis KIM
uuucgucgugugaua

SEQ ID NO: 2306372 - RNA, 15 nt, Yersinia pestis KIM
uuucgggcaaaaaaa

SEQ ID NO: 2306373 - RNA, 14 nt, Yersinia pestis KIM
uuucguaacguuua

SEQ ID NO: 2306374 - RNA, 21 nt, Yersinia pestis KIM
uuucggaucagcgccugcugu

SEQ ID NO: 2306375 - RNA, 17 nt, Yersinia pestis KIM
uuucuaccgcuucagca

SEQ ID NO: 2306376 - RNA, 19 nt, Yersinia pestis KIM
uuucuacgccgucaucauc

SEQ ID NO: 2306377 - RNA, 20 nt, Yersinia pestis KIM
uuucuaauucgugggcauuu

SEQ ID NO: 2306378 - RNA, 13 nt, Yersinia pestis KIM
uuucuaagcugcc

SEQ ID NO: 2306379 - RNA, 14 nt, Yersinia pestis KIM
uuucuaagcugccu

SEQ ID NO: 2306380 - RNA, 15 nt, Yersinia pestis KIM
uuucuaagcugccug

SEQ ID NO: 2306381 - RNA, 15 nt, Yersinia pestis KIM
uuucuaucucaucca

SEQ ID NO: 2306382 - RNA, 16 nt, Yersinia pestis KIM
uuuccgccaugagaac

SEQ ID NO: 2306383 - RNA, 19 nt, Yersinia pestis KIM
uuucccgcuagcuacccga

SEQ ID NO: 2306384 - RNA, 18 nt, Yersinia pestis KIM
uuucccucagccaaagca

SEQ ID NO: 2306385 - RNA, 18 nt, Yersinia pestis KIM
uuucccugcggccaucca

SEQ ID NO: 2306386 - RNA, 14 nt, Yersinia pestis KIM
uuuccaggcuacca

SEQ ID NO: 2306387 - RNA, 13 nt, Yersinia pestis KIM
uuucccaaaguga

SEQ ID NO: 2306388 - RNA, 16 nt, Yersinia pestis KIM
uuucccgacagaacug

SEQ ID NO: 2306389 - RNA, 16 nt, Yersinia pestis KIM
uuuccucaaacgugau

SEQ ID NO: 2306390 - RNA, 14 nt, Yersinia pestis KIM
uuuccguuaaccca

SEQ ID NO: 2306391 - RNA, 18 nt, Yersinia pestis KIM
uuucgaguaguuuggcua

SEQ ID NO: 2306392 - RNA, 12 nt, Yersinia pestis KIM
uuucgaccucag

SEQ ID NO: 2306393 - RNA, 22 nt, Yersinia pestis KIM
uuucgcuggggcauuuaauuca

SEQ ID NO: 2306394 - RNA, 18 nt, Yersinia pestis KIM
uuucgcugacagcuaucu

SEQ ID NO: 2306395 - RNA, 20 nt, Yersinia pestis KIM
uuucgcgccaaauuguugca

SEQ ID NO: 2306396 - RNA, 16 nt, Yersinia pestis KIM
uuugacagucauaagg

SEQ ID NO: 2306397 - RNA, 15 nt, Yersinia pestis KIM
uuugacgaaguuuua

SEQ ID NO: 2306398 - RNA, 17 nt, Yersinia pestis KIM
uuugagcuugcugcuga

SEQ ID NO: 2306399 - RNA, 16 nt, Yersinia pestis KIM
uuugaggaaauuucag

SEQ ID NO: 2306400 - RNA, 17 nt, Yersinia pestis KIM
uuugaggaaauuucagu

SEQ ID NO: 2306401 - RNA, 20 nt, Yersinia pestis KIM
uuugaaacuguuugcaacug

SEQ ID NO: 2306402 - RNA, 21 nt, Yersinia pestis KIM
uuugaagacaacucuucuauc

SEQ ID NO: 2306403 - RNA, 15 nt, Yersinia pestis KIM
uuugaacgcgacuug

SEQ ID NO: 2306404 - RNA, 20 nt, Yersinia pestis KIM
uuugaacgugcucucauuua

SEQ ID NO: 2306405 - RNA, 20 nt, Yersinia pestis KIM
uuugaaccgcuaucugcuga

SEQ ID NO: 2306406 - RNA, 18 nt, Yersinia pestis KIM
uuugaauaagacaguuua

SEQ ID NO: 2306407 - RNA, 21 nt, Yersinia pestis KIM
uuugaauaagacaguuuauuu

SEQ ID NO: 2306408 - RNA, 15 nt, Yersinia pestis KIM
uuucuuacuaaaaua

SEQ ID NO: 2306409 - RNA, 23 nt, Yersinia pestis KIM
uuucuuacuaaaauaucacuaua

SEQ ID NO: 2306410 - RNA, 15 nt, Yersinia pestis KIM
uuucuuaauaauauc

SEQ ID NO: 2306411 - RNA, 22 nt, Yersinia pestis KIM
uuucuuccgccagcagaaccau

SEQ ID NO: 2306412 - RNA, 20 nt, Yersinia pestis KIM
uuucuuuucgcuauuucucu

SEQ ID NO: 2306413 - RNA, 18 nt, Yersinia pestis KIM
uuucuuuuaaaucagaag

SEQ ID NO: 2306414 - RNA, 14 nt, Yersinia pestis KIM
uuucuuucaguaau

SEQ ID NO: 2306415 - RNA, 15 nt, Yersinia pestis KIM
uuucuucugagauau

SEQ ID NO: 2306416 - RNA, 20 nt, Yersinia pestis KIM
uuucuugccuuuuuauaagc

SEQ ID NO: 2306417 - RNA, 19 nt, Yersinia pestis KIM
uuugcgcagcaaauaaaca

SEQ ID NO: 2306418 - RNA, 15 nt, Yersinia pestis KIM
uuugcguauuaucau

SEQ ID NO: 2306419 - RNA, 16 nt, Yersinia pestis KIM
uuugcucucguugcau

SEQ ID NO: 2306420 - RNA, 20 nt, Yersinia pestis KIM
uuugcucgggcucucuucag

SEQ ID NO: 2306421 - RNA, 21 nt, Yersinia pestis KIM
uuugcauaauuaugaaaguaa

SEQ ID NO: 2306422 - RNA, 13 nt, Yersinia pestis KIM
uuugcauccgcaa

SEQ ID NO: 2306423 - RNA, 15 nt, Yersinia pestis KIM
uuugcaucuggugac

SEQ ID NO: 2306424 - RNA, 13 nt, Yersinia pestis KIM
uuugccucugcua

SEQ ID NO: 2306425 - RNA, 16 nt, Yersinia pestis KIM
uuugccucacugucuu

SEQ ID NO: 2306426 - RNA, 19 nt, Yersinia pestis KIM
uuugccguuguuaguguau

SEQ ID NO: 2306427 - RNA, 14 nt, Yersinia pestis KIM
uuugcccauaaacc

SEQ ID NO: 2306428 - RNA, 20 nt, Yersinia pestis KIM
uuugcccgcgcuuccaggcu

SEQ ID NO: 2306429 - RNA, 22 nt, Yersinia pestis KIM
uuugcccucgaacgaagccacg

SEQ ID NO: 2306430 - RNA, 14 nt, Yersinia pestis KIM
uuugauuugaagau

SEQ ID NO: 2306431 - RNA, 21 nt, Yersinia pestis KIM
uuugauucgucugccauugcu

SEQ ID NO: 2306432 - RNA, 19 nt, Yersinia pestis KIM
uuugcaacauuauccguuu

SEQ ID NO: 2306433 - RNA, 12 nt, Yersinia pestis KIM
uuugcaauuaau

SEQ ID NO: 2306434 - RNA, 13 nt, Yersinia pestis KIM
uuugcacugcagg

SEQ ID NO: 2306435 - RNA, 20 nt, Yersinia pestis KIM
uuugcacgaucagugaagag

SEQ ID NO: 2306436 - RNA, 15 nt, Yersinia pestis KIM
uuugauacaguaauu

SEQ ID NO: 2306437 - RNA, 13 nt, Yersinia pestis KIM
uuugauacaguga

SEQ ID NO: 2306438 - RNA, 13 nt, Yersinia pestis KIM
uuugauagaaaua

SEQ ID NO: 2306439 - RNA, 20 nt, Yersinia pestis KIM
uuucacuggccuauuaagau

SEQ ID NO: 2306440 - RNA, 23 nt, Yersinia pestis KIM
uuucacuggccuauuaagauaau

SEQ ID NO: 2306441 - RNA, 11 nt, Yersinia pestis KIM
uuucagacucc

SEQ ID NO: 2306442 - RNA, 14 nt, Yersinia pestis KIM
uuucagauaaaaau

SEQ ID NO: 2306443 - RNA, 17 nt, Yersinia pestis KIM
uuucagauaaaaagcca

SEQ ID NO: 2306444 - RNA, 15 nt, Yersinia pestis KIM
uuucagcaccauaaa

SEQ ID NO: 2306445 - RNA, 15 nt, Yersinia pestis KIM
uuucagcauaucccu

SEQ ID NO: 2306446 - RNA, 15 nt, Yersinia pestis KIM
uuucauaauaaugau

SEQ ID NO: 2306447 - RNA, 22 nt, Yersinia pestis KIM
uuucauagaacuuaagcaauau

SEQ ID NO: 2306448 - RNA, 14 nt, Yersinia pestis KIM
uuucaggugacuga

SEQ ID NO: 2306449 - RNA, 19 nt, Yersinia pestis KIM
uuucagggaguaacuugac

SEQ ID NO: 2306450 - RNA, 19 nt, Yersinia pestis KIM
uuucaggagugaauuucuu

SEQ ID NO: 2306451 - RNA, 16 nt, Yersinia pestis KIM
uuucaguggcuucucu

SEQ ID NO: 2306452 - RNA, 21 nt, Yersinia pestis KIM
uuuccacgcccaacucuuuag

SEQ ID NO: 2306453 - RNA, 19 nt, Yersinia pestis KIM
uuuccagcggcguaucaaa

SEQ ID NO: 2306454 - RNA, 20 nt, Yersinia pestis KIM
uuuccagcggcguaucaaac

SEQ ID NO: 2306455 - RNA, 23 nt, Yersinia pestis KIM
uuuccaacuccaucgccacuucu

SEQ ID NO: 2306456 - RNA, 22 nt, Yersinia pestis KIM
uuuccaacugaucucaucauug

SEQ ID NO: 2306457 - RNA, 13 nt, Yersinia pestis KIM
uuucauuuacuug

SEQ ID NO: 2306458 - RNA, 14 nt, Yersinia pestis KIM
uuucauuuacuuga

SEQ ID NO: 2306459 - RNA, 18 nt, Yersinia pestis KIM
uuucaucgcugaauuuag

SEQ ID NO: 2306460 - RNA, 18 nt, Yersinia pestis KIM
uuucaucggcaaaaacag

SEQ ID NO: 2306461 - RNA, 22 nt, Yersinia pestis KIM
uuucauccuaaagauaauuaau

SEQ ID NO: 2306462 - RNA, 14 nt, Yersinia pestis KIM
uuucauuagucaau

SEQ ID NO: 2306463 - RNA, 21 nt, Yersinia pestis KIM
uuucauuccagauaaaauacu

SEQ ID NO: 2306464 - RNA, 17 nt, Yersinia pestis KIM
uuucaugauucucuauu

SEQ ID NO: 2306465 - RNA, 13 nt, Yersinia pestis KIM
uuucaugauucuc

SEQ ID NO: 2306466 - RNA, 20 nt, Yersinia pestis KIM
uuuauaccggggccaucauc

SEQ ID NO: 2306467 - RNA, 23 nt, Yersinia pestis KIM
uuuauaaauuacucguauaaaaa

SEQ ID NO: 2306468 - RNA, 15 nt, Yersinia pestis KIM
uuuauuauauauuuu

SEQ ID NO: 2306469 - RNA, 12 nt, Yersinia pestis KIM
uuuauuaucaau

SEQ ID NO: 2306470 - RNA, 18 nt, Yersinia pestis KIM
uuuauuaucaucuuucau

SEQ ID NO: 2306471 - RNA, 16 nt, Yersinia pestis KIM
uuuauucaagugcuca

SEQ ID NO: 2306472 - RNA, 14 nt, Yersinia pestis KIM
uuuauuugcugccu

SEQ ID NO: 2306473 - RNA, 13 nt, Yersinia pestis KIM
uuuauuuuacuuu

SEQ ID NO: 2306474 - RNA, 18 nt, Yersinia pestis KIM
uuucaacgcauccaaaua

SEQ ID NO: 2306475 - RNA, 15 nt, Yersinia pestis KIM
uuucacccucugcgu

SEQ ID NO: 2306476 - RNA, 13 nt, Yersinia pestis KIM
uuucacaccggcg

SEQ ID NO: 2306477 - RNA, 19 nt, Yersinia pestis KIM
uuucacacgcccaggccau

SEQ ID NO: 2306478 - RNA, 18 nt, Yersinia pestis KIM
uuucaaugccaauugacg

SEQ ID NO: 2306479 - RNA, 14 nt, Yersinia pestis KIM
uuucaaucacugcg

SEQ ID NO: 2306480 - RNA, 21 nt, Yersinia pestis KIM
uuucaauugcccccuagugau

SEQ ID NO: 2306481 - RNA, 12 nt, Yersinia pestis KIM
uuucaauugccc

SEQ ID NO: 2306482 - RNA, 14 nt, Yersinia pestis KIM
uuucaauaacaccg

SEQ ID NO: 2306483 - RNA, 17 nt, Yersinia pestis KIM
uuucaauacuauuccgu

SEQ ID NO: 2306484 - RNA, 19 nt, Yersinia pestis KIM
uuucaagcuguuacugccc

SEQ ID NO: 2306485 - RNA, 16 nt, Yersinia pestis KIM
uuucaagucaauaaau

SEQ ID NO: 2306486 - RNA, 17 nt, Yersinia pestis KIM
uuuaaacgcacaucaau

SEQ ID NO: 2306487 - RNA, 19 nt, Yersinia pestis KIM
uuuaaauuccgguguuuuu

SEQ ID NO: 2306488 - RNA, 14 nt, Yersinia pestis KIM
uuuaaauaugaucu

SEQ ID NO: 2306489 - RNA, 13 nt, Yersinia pestis KIM
uuuaaauacaaaa

SEQ ID NO: 2306490 - RNA, 17 nt, Yersinia pestis KIM
uuuaaauacaaaaauac

SEQ ID NO: 2306491 - RNA, 19 nt, Yersinia pestis KIM
uuuaaauacaaaaauacaa

SEQ ID NO: 2306492 - RNA, 20 nt, Yersinia pestis KIM
uuuaaaucuuucuccaguaa

SEQ ID NO: 2306493 - RNA, 21 nt, Yersinia pestis KIM
uuuaacacauuccaguaaaaa

SEQ ID NO: 2306494 - RNA, 22 nt, Yersinia pestis KIM
uuuaacacauuccaguaaaaaa

SEQ ID NO: 2306495 - RNA, 12 nt, Yersinia pestis KIM
uuuaacaacaac

SEQ ID NO: 2306496 - RNA, 18 nt, Yersinia pestis KIM
uuuaaaaacccucuucaa

SEQ ID NO: 2306497 - RNA, 19 nt, Yersinia pestis KIM
uuguuuuucaaucuauucu

SEQ ID NO: 2306498 - RNA, 11 nt, Yersinia pestis KIM
uuuaaaaaaau

SEQ ID NO: 2306499 - RNA, 17 nt, Yersinia pestis KIM
uuuaaaaaaauuaucau

SEQ ID NO: 2306500 - RNA, 22 nt, Yersinia pestis KIM
uuguuuuuucccagaacauaug

SEQ ID NO: 2306501 - RNA, 21 nt, Yersinia pestis KIM
uugcugaguggacgauaaauu

SEQ ID NO: 2306502 - RNA, 18 nt, Yersinia pestis KIM
uugcugaugucauucuau

SEQ ID NO: 2306503 - RNA, 12 nt, Yersinia pestis KIM
uugcugcaaccg

SEQ ID NO: 2306504 - RNA, 15 nt, Yersinia pestis KIM
uugcugccaacggcu

SEQ ID NO: 2306505 - RNA, 22 nt, Yersinia pestis KIM
uuguuaauuaagauuaagccau

SEQ ID NO: 2306506 - RNA, 21 nt, Yersinia pestis KIM
uuguuacccacuaauauuccu

SEQ ID NO: 2306507 - RNA, 23 nt, Yersinia pestis KIM
uuguuaccuaaccaaacauuguc

SEQ ID NO: 2306508 - RNA, 19 nt, Yersinia pestis KIM
uuuaggccaauuuggccaa

SEQ ID NO: 2306509 - RNA, 23 nt, Yersinia pestis KIM
uuuaggucaauaucgauuuuuaa

SEQ ID NO: 2306510 - RNA, 18 nt, Yersinia pestis KIM
uuuagucaaaacaauauc

SEQ ID NO: 2306511 - RNA, 13 nt, Yersinia pestis KIM
uuuagugaaauac

SEQ ID NO: 2306512 - RNA, 13 nt, Yersinia pestis KIM
uuuaguuaaauaa

SEQ ID NO: 2306513 - RNA, 19 nt, Yersinia pestis KIM
uuuaggcgggcaguauaau

SEQ ID NO: 2306514 - RNA, 13 nt, Yersinia pestis KIM
uuuaggcaagagu

SEQ ID NO: 2306515 - RNA, 16 nt, Yersinia pestis KIM
uuuagcgcugcaucug

SEQ ID NO: 2306516 - RNA, 19 nt, Yersinia pestis KIM
uuuacuccccaaagccuac

SEQ ID NO: 2306517 - RNA, 20 nt, Yersinia pestis KIM
uuuacuccccugccuauccu

SEQ ID NO: 2306518 - RNA, 15 nt, Yersinia pestis KIM
uuuacugcuuuucua

SEQ ID NO: 2306519 - RNA, 18 nt, Yersinia pestis KIM
uuuaacgccaccaaugca

SEQ ID NO: 2306520 - RNA, 19 nt, Yersinia pestis KIM
uuuaaccuuucuaauuauu

SEQ ID NO: 2306521 - RNA, 13 nt, Yersinia pestis KIM
uuuaacucaaaua

SEQ ID NO: 2306522 - RNA, 13 nt, Yersinia pestis KIM
uuuaacucauccu

SEQ ID NO: 2306523 - RNA, 18 nt, Yersinia pestis KIM
uuuaauuaguuuaucagu

SEQ ID NO: 2306524 - RNA, 17 nt, Yersinia pestis KIM
uuuaauuaguuuaucag

SEQ ID NO: 2306525 - RNA, 18 nt, Yersinia pestis KIM
uuuaauucaggccaagug

SEQ ID NO: 2306526 - RNA, 11 nt, Yersinia pestis KIM
uuuaccaugcu

SEQ ID NO: 2306527 - RNA, 22 nt, Yersinia pestis KIM
uuuaccaaugcacguaaagagu

SEQ ID NO: 2306528 - RNA, 17 nt, Yersinia pestis KIM
uugacgguuuucugaau

SEQ ID NO: 2306529 - RNA, 20 nt, Yersinia pestis KIM
uugacugaccauaaaaggau

SEQ ID NO: 2306530 - RNA, 13 nt, Yersinia pestis KIM
uugaccugaagaa

SEQ ID NO: 2306531 - RNA, 23 nt, Yersinia pestis KIM
uugaccagauuaaucaccucacc

SEQ ID NO: 2306532 - RNA, 14 nt, Yersinia pestis KIM
uugaccaacugucg

SEQ ID NO: 2306533 - RNA, 14 nt, Yersinia pestis KIM
uugacauuuccuug

SEQ ID NO: 2306534 - RNA, 22 nt, Yersinia pestis KIM
uugaauugagagagcuuacauu

SEQ ID NO: 2306535 - RNA, 13 nt, Yersinia pestis KIM
uugaauuuuuaua

SEQ ID NO: 2306536 - RNA, 18 nt, Yersinia pestis KIM
uugaauuuuuauaauuaa

SEQ ID NO: 2306537 - RNA, 21 nt, Yersinia pestis KIM
uugaacugagccagguuuuuu

SEQ ID NO: 2306538 - RNA, 19 nt, Yersinia pestis KIM
uugaacgauauuuuuauua

SEQ ID NO: 2306539 - RNA, 20 nt, Yersinia pestis KIM
uugaaccguaugcuuucauc

SEQ ID NO: 2306540 - RNA, 13 nt, Yersinia pestis KIM
uugaacgacaugu

SEQ ID NO: 2306541 - RNA, 22 nt, Yersinia pestis KIM
uugaaccgcuaucugcugacca

SEQ ID NO: 2306542 - RNA, 16 nt, Yersinia pestis KIM
uugaacuucgaaagaa

SEQ ID NO: 2306543 - RNA, 23 nt, Yersinia pestis KIM
uugaacuucgaaagaaauaaaag

SEQ ID NO: 2306544 - RNA, 18 nt, Yersinia pestis KIM
uugaagauucaaccaauu

SEQ ID NO: 2306545 - RNA, 14 nt, Yersinia pestis KIM
uugaauaacuucuc

SEQ ID NO: 2306546 - RNA, 21 nt, Yersinia pestis KIM
uugaaguucucaucaaacuca

SEQ ID NO: 2306547 - RNA, 22 nt, Yersinia pestis KIM
uugaagugcgaagcgcacccaa

SEQ ID NO: 2306548 - RNA, 16 nt, Yersinia pestis KIM
uugaauauuuuuaauc

SEQ ID NO: 2306549 - RNA, 17 nt, Yersinia pestis KIM
uugaauauuuuuaaucu

SEQ ID NO: 2306550 - RNA, 17 nt, Yersinia pestis KIM
uugaauuaaauuuuaua

SEQ ID NO: 2306551 - RNA, 14 nt, Yersinia pestis KIM
uucugcgagcguuu

SEQ ID NO: 2306552 - RNA, 14 nt, Yersinia pestis KIM
uucugcgacuuuau

SEQ ID NO: 2306553 - RNA, 15 nt, Yersinia pestis KIM
uucugccuauccuca

SEQ ID NO: 2306554 - RNA, 17 nt, Yersinia pestis KIM
uucugcauaagcaucag

SEQ ID NO: 2306555 - RNA, 21 nt, Yersinia pestis KIM
uucugccacaccgucaucucu

SEQ ID NO: 2306556 - RNA, 13 nt, Yersinia pestis KIM
uucugcccauccu

SEQ ID NO: 2306557 - RNA, 14 nt, Yersinia pestis KIM
uucuugauaccaua

SEQ ID NO: 2306558 - RNA, 18 nt, Yersinia pestis KIM
uucuuuaaucacucucau

SEQ ID NO: 2306559 - RNA, 20 nt, Yersinia pestis KIM
uucuuuauacccaaaauaau

SEQ ID NO: 2306560 - RNA, 13 nt, Yersinia pestis KIM
uucuuucacuaau

SEQ ID NO: 2306561 - RNA, 18 nt, Yersinia pestis KIM
uugaacauucaucuuuug

SEQ ID NO: 2306562 - RNA, 12 nt, Yersinia pestis KIM
uugaacaguggu

SEQ ID NO: 2306563 - RNA, 21 nt, Yersinia pestis KIM
uugaaaccuacaucacaccca

SEQ ID NO: 2306564 - RNA, 14 nt, Yersinia pestis KIM
uugaaaucagauca

SEQ ID NO: 2306565 - RNA, 17 nt, Yersinia pestis KIM
uucuuuugcuguauuuu

SEQ ID NO: 2306566 - RNA, 21 nt, Yersinia pestis KIM
uucuuuucucccuuucacuuu

SEQ ID NO: 2306567 - RNA, 15 nt, Yersinia pestis KIM
uugaaaaguuuuuug

SEQ ID NO: 2306568 - RNA, 22 nt, Yersinia pestis KIM
uugaucaguaaacgguugcugu

SEQ ID NO: 2306569 - RNA, 22 nt, Yersinia pestis KIM
uugauccaaauggcugcguucu

SEQ ID NO: 2306570 - RNA, 22 nt, Yersinia pestis KIM
uugauccgauaaacuucacaau

SEQ ID NO: 2306571 - RNA, 22 nt, Yersinia pestis KIM
uugauccucguuagucacucaa

SEQ ID NO: 2306572 - RNA, 16 nt, Yersinia pestis KIM
uugauauuauuuauau

SEQ ID NO: 2306573 - RNA, 15 nt, Yersinia pestis KIM
uugauauuauuuaua

SEQ ID NO: 2306574 - RNA, 23 nt, Yersinia pestis KIM
uugauaacgccggauaaauuaau

SEQ ID NO: 2306575 - RNA, 19 nt, Yersinia pestis KIM
uugauaucaauauccgcau

SEQ ID NO: 2306576 - RNA, 22 nt, Yersinia pestis KIM
uugagauagucauuuuauuuag

SEQ ID NO: 2306577 - RNA, 23 nt, Yersinia pestis KIM
uugaguuuaacgccgacuuuauu

SEQ ID NO: 2306578 - RNA, 13 nt, Yersinia pestis KIM
uugagaaacugau

SEQ ID NO: 2306579 - RNA, 20 nt, Yersinia pestis KIM
uugagaauuaaggaaacuca

SEQ ID NO: 2306580 - RNA, 15 nt, Yersinia pestis KIM
uugacuuaacaguua

SEQ ID NO: 2306581 - RNA, 20 nt, Yersinia pestis KIM
uugacuucggucaagaugcc

SEQ ID NO: 2306582 - RNA, 14 nt, Yersinia pestis KIM
uugacuuucuaagc

SEQ ID NO: 2306583 - RNA, 18 nt, Yersinia pestis KIM
uugacuuucuaagcugcc

SEQ ID NO: 2306584 - RNA, 18 nt, Yersinia pestis KIM
uugaugcagugaggguaa

SEQ ID NO: 2306585 - RNA, 14 nt, Yersinia pestis KIM
uugauuggcuccua

SEQ ID NO: 2306586 - RNA, 23 nt, Yersinia pestis KIM
uugcaaccuacgccauuaaaagg

SEQ ID NO: 2306587 - RNA, 22 nt, Yersinia pestis KIM
uugcaacauuauccguuugcaa

SEQ ID NO: 2306588 - RNA, 18 nt, Yersinia pestis KIM
uugcaaacggauaauguu

SEQ ID NO: 2306589 - RNA, 18 nt, Yersinia pestis KIM
uugcaauucauguugcca

SEQ ID NO: 2306590 - RNA, 21 nt, Yersinia pestis KIM
uugcaaugcuuauuucacacu

SEQ ID NO: 2306591 - RNA, 20 nt, Yersinia pestis KIM
uugcacaaagcuuacuguuc

SEQ ID NO: 2306592 - RNA, 12 nt, Yersinia pestis KIM
uugcacacccau

SEQ ID NO: 2306593 - RNA, 21 nt, Yersinia pestis KIM
uugcgccgaaauaaaaccauc

SEQ ID NO: 2306594 - RNA, 12 nt, Yersinia pestis KIM
uugccuggccca

SEQ ID NO: 2306595 - RNA, 17 nt, Yersinia pestis KIM
uugccuggcccaucuau

SEQ ID NO: 2306596 - RNA, 13 nt, Yersinia pestis KIM
uugccugcucagc

SEQ ID NO: 2306597 - RNA, 21 nt, Yersinia pestis KIM
uugcgcacaaucagggcacuc

SEQ ID NO: 2306598 - RNA, 14 nt, Yersinia pestis KIM
uugcgccacaaccc

SEQ ID NO: 2306599 - RNA, 18 nt, Yersinia pestis KIM
uugcucuucccugcgcug

SEQ ID NO: 2306600 - RNA, 11 nt, Yersinia pestis KIM
uugcugaauca

SEQ ID NO: 2306601 - RNA, 18 nt, Yersinia pestis KIM
uugcccgauucaccuuca

SEQ ID NO: 2306602 - RNA, 15 nt, Yersinia pestis KIM
uugcccccugcucca

SEQ ID NO: 2306603 - RNA, 14 nt, Yersinia pestis KIM
uugccaaaauuuua

SEQ ID NO: 2306604 - RNA, 19 nt, Yersinia pestis KIM
uugccaaaauccaccagcg

SEQ ID NO: 2306605 - RNA, 14 nt, Yersinia pestis KIM
uugccaaaugcaaa

SEQ ID NO: 2306606 - RNA, 21 nt, Yersinia pestis KIM
uugccaaccggauaaaacaau

SEQ ID NO: 2306607 - RNA, 21 nt, Yersinia pestis KIM
uugcccgcgcuuccaggcuga

SEQ ID NO: 2306608 - RNA, 18 nt, Yersinia pestis KIM
uugcccguuagccaugca

SEQ ID NO: 2306609 - RNA, 20 nt, Yersinia pestis KIM
uugcccuggagcaagauuuu

SEQ ID NO: 2306610 - RNA, 13 nt, Yersinia pestis KIM
uugcccuucagau

SEQ ID NO: 2306611 - RNA, 21 nt, Yersinia pestis KIM
uugccucugcuagcaaauucc

SEQ ID NO: 2306612 - RNA, 20 nt, Yersinia pestis KIM
uugccgccgauaacauuauu

SEQ ID NO: 2306613 - RNA, 19 nt, Yersinia pestis KIM
uuccugauuagcagggcag

SEQ ID NO: 2306614 - RNA, 14 nt, Yersinia pestis KIM
uuccucgugaaaaa

SEQ ID NO: 2306615 - RNA, 15 nt, Yersinia pestis KIM
uuccugccaacaacu

SEQ ID NO: 2306616 - RNA, 16 nt, Yersinia pestis KIM
uuccucccagaauaau

SEQ ID NO: 2306617 - RNA, 21 nt, Yersinia pestis KIM
uuccucccagaauaauaagcc

SEQ ID NO: 2306618 - RNA, 14 nt, Yersinia pestis KIM
uuccucaucgaaau

SEQ ID NO: 2306619 - RNA, 15 nt, Yersinia pestis KIM
uuccgcuggacaacu

SEQ ID NO: 2306620 - RNA, 18 nt, Yersinia pestis KIM
uuccgcgccguguaguuu

SEQ ID NO: 2306621 - RNA, 18 nt, Yersinia pestis KIM
uucccagucauaaauauc

SEQ ID NO: 2306622 - RNA, 24 nt, Yersinia pestis KIM
uucccauagcuggcuucaaaauca

SEQ ID NO: 2306623 - RNA, 19 nt, Yersinia pestis KIM
uucccaccauaaugugccu

SEQ ID NO: 2306624 - RNA, 18 nt, Yersinia pestis KIM
uucccaaucgauaauauu

SEQ ID NO: 2306625 - RNA, 21 nt, Yersinia pestis KIM
uucccaaucgauaauauuauu

SEQ ID NO: 2306626 - RNA, 12 nt, Yersinia pestis KIM
uucccaaaguga

SEQ ID NO: 2306627 - RNA, 17 nt, Yersinia pestis KIM
uuccgagcaaucaaaag

SEQ ID NO: 2306628 - RNA, 17 nt, Yersinia pestis KIM
uuccgauaaccagaccg

SEQ ID NO: 2306629 - RNA, 23 nt, Yersinia pestis KIM
uucccgccaaccaggucaguuuu

SEQ ID NO: 2306630 - RNA, 18 nt, Yersinia pestis KIM
uucccgacagaacugauu

SEQ ID NO: 2306631 - RNA, 10 nt, Yersinia pestis KIM
uucccauuua

SEQ ID NO: 2306632 - RNA, 13 nt, Yersinia pestis KIM
uucccauuuaugg

SEQ ID NO: 2306633 - RNA, 13 nt, Yersinia pestis KIM
uucaggcuuuuuu

SEQ ID NO: 2306634 - RNA, 20 nt, Yersinia pestis KIM
uuccaauuggugcuuuaugu

SEQ ID NO: 2306635 - RNA, 15 nt, Yersinia pestis KIM
uuccaauucauaaua

SEQ ID NO: 2306636 - RNA, 21 nt, Yersinia pestis KIM
uuccacucuuucaaugauggc

SEQ ID NO: 2306637 - RNA, 17 nt, Yersinia pestis KIM
uuccacgcccaacucuu

SEQ ID NO: 2306638 - RNA, 23 nt, Yersinia pestis KIM
uuccagcgcccggcugaccuguu

SEQ ID NO: 2306639 - RNA, 11 nt, Yersinia pestis KIM
uuccagaucuu

SEQ ID NO: 2306640 - RNA, 18 nt, Yersinia pestis KIM
uuccagcaccccuucacc

SEQ ID NO: 2306641 - RNA, 12 nt, Yersinia pestis KIM
uuccagauaucc

SEQ ID NO: 2306642 - RNA, 22 nt, Yersinia pestis KIM
uuccagauaucccaacugaaac

SEQ ID NO: 2306643 - RNA, 19 nt, Yersinia pestis KIM
uuccagugccaauugagua

SEQ ID NO: 2306644 - RNA, 16 nt, Yersinia pestis KIM
uuccagcggcaaauag

SEQ ID NO: 2306645 - RNA, 23 nt, Yersinia pestis KIM
uuccagcggcaaauagagcacca

SEQ ID NO: 2306646 - RNA, 20 nt, Yersinia pestis KIM
uuccauuuaagccaauaaua

SEQ ID NO: 2306647 - RNA, 23 nt, Yersinia pestis KIM
uuccaugcccagcguuggcagaa

SEQ ID NO: 2306648 - RNA, 17 nt, Yersinia pestis KIM
uuccaugcaaaauaugg

SEQ ID NO: 2306649 - RNA, 19 nt, Yersinia pestis KIM
uuccaugacacauauuuca

SEQ ID NO: 2306650 - RNA, 18 nt, Yersinia pestis KIM
uuccauagccaggcagcc

SEQ ID NO: 2306651 - RNA, 23 nt, Yersinia pestis KIM
uucgaaagaaauaaaagaaaacc

SEQ ID NO: 2306652 - RNA, 22 nt, Yersinia pestis KIM
uucgcauaggguucuagagcau

SEQ ID NO: 2306653 - RNA, 12 nt, Yersinia pestis KIM
uucgcaggccag

SEQ ID NO: 2306654 - RNA, 19 nt, Yersinia pestis KIM
uucgcagccaaaauaauca

SEQ ID NO: 2306655 - RNA, 18 nt, Yersinia pestis KIM
uuccuugcucucuucaua

SEQ ID NO: 2306656 - RNA, 14 nt, Yersinia pestis KIM
uuccuuugcccuua

SEQ ID NO: 2306657 - RNA, 16 nt, Yersinia pestis KIM
uucgaaaacucaaaga

SEQ ID NO: 2306658 - RNA, 18 nt, Yersinia pestis KIM
uucgcuauuucucucuac

SEQ ID NO: 2306659 - RNA, 19 nt, Yersinia pestis KIM
uucgcuauuucucucuacu

SEQ ID NO: 2306660 - RNA, 13 nt, Yersinia pestis KIM
uucgcgaacacaa

SEQ ID NO: 2306661 - RNA, 17 nt, Yersinia pestis KIM
uucgcuggucauaauca

SEQ ID NO: 2306662 - RNA, 17 nt, Yersinia pestis KIM
uucgcaucuuccaaagg

SEQ ID NO: 2306663 - RNA, 19 nt, Yersinia pestis KIM
uucgcauucgugccauaaa

SEQ ID NO: 2306664 - RNA, 14 nt, Yersinia pestis KIM
uucgcaucuuccaa

SEQ ID NO: 2306665 - RNA, 14 nt, Yersinia pestis KIM
uucgcuuucaucuu

SEQ ID NO: 2306666 - RNA, 15 nt, Yersinia pestis KIM
uucggacaggaaaac

SEQ ID NO: 2306667 - RNA, 13 nt, Yersinia pestis KIM
uucgguggcccuu

SEQ ID NO: 2306668 - RNA, 13 nt, Yersinia pestis KIM
uucgguggcccug

SEQ ID NO: 2306669 - RNA, 20 nt, Yersinia pestis KIM
uucgguuaagagugcuggca

SEQ ID NO: 2306670 - RNA, 18 nt, Yersinia pestis KIM
uucguaggccgcuuuagu

SEQ ID NO: 2306671 - RNA, 16 nt, Yersinia pestis KIM
uucguguauaucacua

SEQ ID NO: 2306672 - RNA, 20 nt, Yersinia pestis KIM
uucgugcucaucaaccucag

SEQ ID NO: 2306673 - RNA, 22 nt, Yersinia pestis KIM
uucgucaccaucaauauaagag

SEQ ID NO: 2306674 - RNA, 20 nt, Yersinia pestis KIM
uucgucaauuuuugccuuuc

SEQ ID NO: 2306675 - RNA, 16 nt, Yersinia pestis KIM
uucgucagugaugaca

SEQ ID NO: 2306676 - RNA, 16 nt, Yersinia pestis KIM
uucuaacacuucauga

SEQ ID NO: 2306677 - RNA, 15 nt, Yersinia pestis KIM
uucuaagcugccugu

SEQ ID NO: 2306678 - RNA, 14 nt, Yersinia pestis KIM
uucuaacaauaagu

SEQ ID NO: 2306679 - RNA, 19 nt, Yersinia pestis KIM
uucuaaguaaaacaaagua

SEQ ID NO: 2306680 - RNA, 17 nt, Yersinia pestis KIM
uucuaauugauauuauu

SEQ ID NO: 2306681 - RNA, 21 nt, Yersinia pestis KIM
uucuacccuggcggcaaacgc

SEQ ID NO: 2306682 - RNA, 15 nt, Yersinia pestis KIM
uucuaccuggcucaa

SEQ ID NO: 2306683 - RNA, 17 nt, Yersinia pestis KIM
uucucaaugauaaaauc

SEQ ID NO: 2306684 - RNA, 17 nt, Yersinia pestis KIM
uucucaauggcuuuuuu

SEQ ID NO: 2306685 - RNA, 15 nt, Yersinia pestis KIM
uucuauaccaauuga

SEQ ID NO: 2306686 - RNA, 14 nt, Yersinia pestis KIM
uucucugauaaucc

SEQ ID NO: 2306687 - RNA, 17 nt, Yersinia pestis KIM
uucucuggcuaaugucu

SEQ ID NO: 2306688 - RNA, 15 nt, Yersinia pestis KIM
uucugaucauuauua

SEQ ID NO: 2306689 - RNA, 13 nt, Yersinia pestis KIM
uucucuuggcuga

SEQ ID NO: 2306690 - RNA, 22 nt, Yersinia pestis KIM
uucugauagagacgggcguuau

SEQ ID NO: 2306691 - RNA, 23 nt, Yersinia pestis KIM
uucugaucguugccgcuaauucu

SEQ ID NO: 2306692 - RNA, 20 nt, Yersinia pestis KIM
uucugauuuuuuacuuuuuc

SEQ ID NO: 2306693 - RNA, 16 nt, Yersinia pestis KIM
uucucaucgcuuuuuu

SEQ ID NO: 2306694 - RNA, 18 nt, Yersinia pestis KIM
uucucgacauccaauuca

SEQ ID NO: 2306695 - RNA, 20 nt, Yersinia pestis KIM
uuaucacugggcagaugacg

SEQ ID NO: 2306696 - RNA, 19 nt, Yersinia pestis KIM
uuaucacgucgccaauuuu

SEQ ID NO: 2306697 - RNA, 19 nt, Yersinia pestis KIM
uuaucagcgaaaaauuuca

SEQ ID NO: 2306698 - RNA, 14 nt, Yersinia pestis KIM
uuaucaccaaaagc

SEQ ID NO: 2306699 - RNA, 23 nt, Yersinia pestis KIM
uuaucaccuuccgucccaagaaa

SEQ ID NO: 2306700 - RNA, 23 nt, Yersinia pestis KIM
uuaucacaucaacaguugccgac

SEQ ID NO: 2306701 - RNA, 17 nt, Yersinia pestis KIM
uuaucaauacugcaaau

SEQ ID NO: 2306702 - RNA, 15 nt, Yersinia pestis KIM
uuaucaaucaaaaaa

SEQ ID NO: 2306703 - RNA, 15 nt, Yersinia pestis KIM
uuaucaaucagcuga

SEQ ID NO: 2306704 - RNA, 21 nt, Yersinia pestis KIM
uuaucauuuaaauacagauca

SEQ ID NO: 2306705 - RNA, 17 nt, Yersinia pestis KIM
uuaucauugaguucuga

SEQ ID NO: 2306706 - RNA, 21 nt, Yersinia pestis KIM
uuaucaguugguuuauccuuu

SEQ ID NO: 2306707 - RNA, 21 nt, Yersinia pestis KIM
uuaucaucccuugacugacca

SEQ ID NO: 2306708 - RNA, 17 nt, Yersinia pestis KIM
uuaucaucguaguaaua

SEQ ID NO: 2306709 - RNA, 17 nt, Yersinia pestis KIM
uuaucccuccaucaagc

SEQ ID NO: 2306710 - RNA, 22 nt, Yersinia pestis KIM
uuaucccuuacgaucacuuacc

SEQ ID NO: 2306711 - RNA, 18 nt, Yersinia pestis KIM
uuauccauuuucugccaa

SEQ ID NO: 2306712 - RNA, 11 nt, Yersinia pestis KIM
uuauccccuuc

SEQ ID NO: 2306713 - RNA, 13 nt, Yersinia pestis KIM
uuauccccuucga

SEQ ID NO: 2306714 - RNA, 23 nt, Yersinia pestis KIM
uuauccauccccgccucaaugca

SEQ ID NO: 2306715 - RNA, 22 nt, Yersinia pestis KIM
uuauccaauggcucaccuuuca

SEQ ID NO: 2306716 - RNA, 15 nt, Yersinia pestis KIM
uuauccuuuuuauuu

SEQ ID NO: 2306717 - RNA, 13 nt, Yersinia pestis KIM
uuauccuuuuuau

SEQ ID NO: 2306718 - RNA, 15 nt, Yersinia pestis KIM
uuauccguuugcaac

SEQ ID NO: 2306719 - RNA, 22 nt, Yersinia pestis KIM
uuauauccgccauccuucaaga

SEQ ID NO: 2306720 - RNA, 22 nt, Yersinia pestis KIM
uuauaucuauauuggacaguaa

SEQ ID NO: 2306721 - RNA, 21 nt, Yersinia pestis KIM
uuauaugcuugacugcguucu

SEQ ID NO: 2306722 - RNA, 19 nt, Yersinia pestis KIM
uuauaugcgcuggcucuau

SEQ ID NO: 2306723 - RNA, 15 nt, Yersinia pestis KIM
uuaucaaguuaaaua

SEQ ID NO: 2306724 - RNA, 16 nt, Yersinia pestis KIM
uuaucaagaucaaaag

SEQ ID NO: 2306725 - RNA, 17 nt, Yersinia pestis KIM
uuauauauccaaaauaa

SEQ ID NO: 2306726 - RNA, 22 nt, Yersinia pestis KIM
uuauauaauugaagauuuaaau

SEQ ID NO: 2306727 - RNA, 12 nt, Yersinia pestis KIM
uuauauaacuag

SEQ ID NO: 2306728 - RNA, 21 nt, Yersinia pestis KIM
uuauaggucaucccagcacag

SEQ ID NO: 2306729 - RNA, 22 nt, Yersinia pestis KIM
uuauaguccuuccaugacacau

SEQ ID NO: 2306730 - RNA, 13 nt, Yersinia pestis KIM
uuauaguuaaaac

SEQ ID NO: 2306731 - RNA, 14 nt, Yersinia pestis KIM
uuauagccaaaucu

SEQ ID NO: 2306732 - RNA, 16 nt, Yersinia pestis KIM
uuaucggauuacuuca

SEQ ID NO: 2306733 - RNA, 21 nt, Yersinia pestis KIM
uuaucgccuaccaucaaaaua

SEQ ID NO: 2306734 - RNA, 21 nt, Yersinia pestis KIM
uuaucgaggugccgugggggg

SEQ ID NO: 2306735 - RNA, 18 nt, Yersinia pestis KIM
uuaucgauucaaauagcg

SEQ ID NO: 2306736 - RNA, 19 nt, Yersinia pestis KIM
uuaucgugcgucaauaaua

SEQ ID NO: 2306737 - RNA, 19 nt, Yersinia pestis KIM
uuaucggugcugacaaaca

SEQ ID NO: 2306738 - RNA, 21 nt, Yersinia pestis KIM
uuaucucccauuaauuaauca

SEQ ID NO: 2306739 - RNA, 19 nt, Yersinia pestis KIM
uuaucucacgcugaauaac

SEQ ID NO: 2306740 - RNA, 13 nt, Yersinia pestis KIM
uuaucuccuguaa

SEQ ID NO: 2306741 - RNA, 17 nt, Yersinia pestis KIM
uuaucucgcugugcccu

SEQ ID NO: 2306742 - RNA, 21 nt, Yersinia pestis KIM
uuaucuauacuaaauagauaa

SEQ ID NO: 2306743 - RNA, 16 nt, Yersinia pestis KIM
uuaucuguuucaaaua

SEQ ID NO: 2306744 - RNA, 23 nt, Yersinia pestis KIM
uuaucuguuguauacuguuuauu

SEQ ID NO: 2306745 - RNA, 13 nt, Yersinia pestis KIM
uuaucuguuucaa

SEQ ID NO: 2306746 - RNA, 18 nt, Yersinia pestis KIM
uuaucuguuucaaauaag

SEQ ID NO: 2306747 - RNA, 16 nt, Yersinia pestis KIM
uuaucuuuaauuuucu

SEQ ID NO: 2306748 - RNA, 21 nt, Yersinia pestis KIM
uuaucugugccagucuaaaau

SEQ ID NO: 2306749 - RNA, 23 nt, Yersinia pestis KIM
uuaugaauggggggcaaccuggu

SEQ ID NO: 2306750 - RNA, 16 nt, Yersinia pestis KIM
uuaugaucuugaauaa

SEQ ID NO: 2306751 - RNA, 23 nt, Yersinia pestis KIM
uuaugaugcuggguauauauaca

SEQ ID NO: 2306752 - RNA, 18 nt, Yersinia pestis KIM
uuaugaugugauuauuuu

SEQ ID NO: 2306753 - RNA, 15 nt, Yersinia pestis KIM
uuauuacucauuaug

SEQ ID NO: 2306754 - RNA, 12 nt, Yersinia pestis KIM
uuauuacucagc

SEQ ID NO: 2306755 - RNA, 22 nt, Yersinia pestis KIM
uuauuacuacaaacgcguuaau

SEQ ID NO: 2306756 - RNA, 17 nt, Yersinia pestis KIM
uuauuaacuucaauuug

SEQ ID NO: 2306757 - RNA, 21 nt, Yersinia pestis KIM
uuauguucauucucuacugaa

SEQ ID NO: 2306758 - RNA, 21 nt, Yersinia pestis KIM
uuauuaaauaagaaguagaau

SEQ ID NO: 2306759 - RNA, 16 nt, Yersinia pestis KIM
uuauuaaacagucuua

SEQ ID NO: 2306760 - RNA, 23 nt, Yersinia pestis KIM
uuauuaaacagucuuauuacuca

SEQ ID NO: 2306761 - RNA, 19 nt, Yersinia pestis KIM
uuauuaaacagauucaaua

SEQ ID NO: 2306762 - RNA, 15 nt, Yersinia pestis KIM
uuaugucagagauaa

SEQ ID NO: 2306763 - RNA, 19 nt, Yersinia pestis KIM
uuaugucagagauaaaccc

SEQ ID NO: 2306764 - RNA, 17 nt, Yersinia pestis KIM
uuauggcauaaacugaa

SEQ ID NO: 2306765 - RNA, 23 nt, Yersinia pestis KIM
uuauggcaauucgcuuaugacaa

SEQ ID NO: 2306766 - RNA, 16 nt, Yersinia pestis KIM
uuauggcggguaucuu

SEQ ID NO: 2306767 - RNA, 18 nt, Yersinia pestis KIM
uuauggggacucuuuauu

SEQ ID NO: 2306768 - RNA, 14 nt, Yersinia pestis KIM
uuaugcaaauaaua

SEQ ID NO: 2306769 - RNA, 23 nt, Yersinia pestis KIM
uucagcccauggcugaaauaacu

SEQ ID NO: 2306770 - RNA, 18 nt, Yersinia pestis KIM
uucagcccggauagaauu

SEQ ID NO: 2306771 - RNA, 14 nt, Yersinia pestis KIM
uucagccuauccuc

SEQ ID NO: 2306772 - RNA, 19 nt, Yersinia pestis KIM
uucagcauaucccuguuuu

SEQ ID NO: 2306773 - RNA, 13 nt, Yersinia pestis KIM
uucaggccaauag

SEQ ID NO: 2306774 - RNA, 16 nt, Yersinia pestis KIM
uucaggccauccacgc

SEQ ID NO: 2306775 - RNA, 15 nt, Yersinia pestis KIM
uucaggccaagugcu

SEQ ID NO: 2306776 - RNA, 20 nt, Yersinia pestis KIM
uucaggacugucuucaacuu

SEQ ID NO: 2306777 - RNA, 15 nt, Yersinia pestis KIM
uucagcuucagcucu

SEQ ID NO: 2306778 - RNA, 14 nt, Yersinia pestis KIM
uucagcuugcaaca

SEQ ID NO: 2306779 - RNA, 17 nt, Yersinia pestis KIM
uucagcuugcaacaaaa

SEQ ID NO: 2306780 - RNA, 16 nt, Yersinia pestis KIM
uucagcucuucuaaca

SEQ ID NO: 2306781 - RNA, 23 nt, Yersinia pestis KIM
uucagcucuucuaacacuucaug

SEQ ID NO: 2306782 - RNA, 19 nt, Yersinia pestis KIM
uucagcuuccgcuucaacu

SEQ ID NO: 2306783 - RNA, 13 nt, Yersinia pestis KIM
uucagacugcuga

SEQ ID NO: 2306784 - RNA, 19 nt, Yersinia pestis KIM
uucagcaacgguuucaacu

SEQ ID NO: 2306785 - RNA, 16 nt, Yersinia pestis KIM
uucagcaccauaaaaa

SEQ ID NO: 2306786 - RNA, 20 nt, Yersinia pestis KIM
uucagacaguaaauccugau

SEQ ID NO: 2306787 - RNA, 13 nt, Yersinia pestis KIM
uucagacauacaa

SEQ ID NO: 2306788 - RNA, 22 nt, Yersinia pestis KIM
uucagaauugugccccuuuuuu

SEQ ID NO: 2306789 - RNA, 23 nt, Yersinia pestis KIM
uucaccuaucgguaucucccgca

SEQ ID NO: 2306790 - RNA, 20 nt, Yersinia pestis KIM
uucaccuauaauuaacagca

SEQ ID NO: 2306791 - RNA, 16 nt, Yersinia pestis KIM
uucacgauggaaaaaa

SEQ ID NO: 2306792 - RNA, 17 nt, Yersinia pestis KIM
uucacgauggaaaaaau

SEQ ID NO: 2306793 - RNA, 15 nt, Yersinia pestis KIM
uucacguacaacucg

SEQ ID NO: 2306794 - RNA, 16 nt, Yersinia pestis KIM
uucacccauuaauaga

SEQ ID NO: 2306795 - RNA, 13 nt, Yersinia pestis KIM
uucacccucuuuc

SEQ ID NO: 2306796 - RNA, 19 nt, Yersinia pestis KIM
uucacaucggucaauacca

SEQ ID NO: 2306797 - RNA, 17 nt, Yersinia pestis KIM
uucaccgcuuuucuggu

SEQ ID NO: 2306798 - RNA, 14 nt, Yersinia pestis KIM
uucacccuugauuu

SEQ ID NO: 2306799 - RNA, 23 nt, Yersinia pestis KIM
uucaccgccuuucauucugaaga

SEQ ID NO: 2306800 - RNA, 14 nt, Yersinia pestis KIM
uucaccgguaugca

SEQ ID NO: 2306801 - RNA, 23 nt, Yersinia pestis KIM
uucaaucauugagaucaguucag

SEQ ID NO: 2306802 - RNA, 23 nt, Yersinia pestis KIM
uucaauauuuauccauuuaauaa

SEQ ID NO: 2306803 - RNA, 16 nt, Yersinia pestis KIM
uucaauaguuucauau

SEQ ID NO: 2306804 - RNA, 20 nt, Yersinia pestis KIM
uucaauaguuucauaugaaa

SEQ ID NO: 2306805 - RNA, 21 nt, Yersinia pestis KIM
uucaauaguuucauaugaaac

SEQ ID NO: 2306806 - RNA, 18 nt, Yersinia pestis KIM
uucaauacuggccaugug

SEQ ID NO: 2306807 - RNA, 21 nt, Yersinia pestis KIM
uuauuuuuaccaauuguauaa

SEQ ID NO: 2306808 - RNA, 19 nt, Yersinia pestis KIM
uucaaaaacgcacgaaaac

SEQ ID NO: 2306809 - RNA, 21 nt, Yersinia pestis KIM
uuauuuaacacauuccaguaa

SEQ ID NO: 2306810 - RNA, 13 nt, Yersinia pestis KIM
uuauuugaauaaa

SEQ ID NO: 2306811 - RNA, 23 nt, Yersinia pestis KIM
uuauuuggugaguaaaugcccca

SEQ ID NO: 2306812 - RNA, 23 nt, Yersinia pestis KIM
uuauuugucgccaacauuuauuu

SEQ ID NO: 2306813 - RNA, 12 nt, Yersinia pestis KIM
uuauuugcugcc

SEQ ID NO: 2306814 - RNA, 19 nt, Yersinia pestis KIM
uuauuugaguaagacaacu

SEQ ID NO: 2306815 - RNA, 15 nt, Yersinia pestis KIM
uuauuugccuacuga

SEQ ID NO: 2306816 - RNA, 16 nt, Yersinia pestis KIM
uuauuauaugaucagu

SEQ ID NO: 2306817 - RNA, 17 nt, Yersinia pestis KIM
uuauuauaggcguugau

SEQ ID NO: 2306818 - RNA, 18 nt, Yersinia pestis KIM
uuauuagccaaauacccu

SEQ ID NO: 2306819 - RNA, 14 nt, Yersinia pestis KIM
uuauuacugucauu

SEQ ID NO: 2306820 - RNA, 12 nt, Yersinia pestis KIM
uuauuacugaua

SEQ ID NO: 2306821 - RNA, 14 nt, Yersinia pestis KIM
uuauugucucuacu

SEQ ID NO: 2306822 - RNA, 14 nt, Yersinia pestis KIM
uuauugagaagaaa

SEQ ID NO: 2306823 - RNA, 18 nt, Yersinia pestis KIM
uuauuguggcuaccaauu

SEQ ID NO: 2306824 - RNA, 12 nt, Yersinia pestis KIM
uuauugugcccc

SEQ ID NO: 2306825 - RNA, 21 nt, Yersinia pestis KIM
uuauugucuuuaauaaaauca

SEQ ID NO: 2306826 - RNA, 20 nt, Yersinia pestis KIM
uucaaaaggugcaagcagcu

SEQ ID NO: 2306827 - RNA, 19 nt, Yersinia pestis KIM
uucaaaauagaggaaauaa

SEQ ID NO: 2306828 - RNA, 15 nt, Yersinia pestis KIM
uucaaaaucaaaaau

SEQ ID NO: 2306829 - RNA, 14 nt, Yersinia pestis KIM
uucaaacacuuaug

SEQ ID NO: 2306830 - RNA, 22 nt, Yersinia pestis KIM
uucaauacccuaacucuuugga

SEQ ID NO: 2306831 - RNA, 20 nt, Yersinia pestis KIM
uucaauaauuauaccuaccc

SEQ ID NO: 2306832 - RNA, 22 nt, Yersinia pestis KIM
uucaauaaaacucacuugugug

SEQ ID NO: 2306833 - RNA, 16 nt, Yersinia pestis KIM
uucaagagcgauagau

SEQ ID NO: 2306834 - RNA, 16 nt, Yersinia pestis KIM
uucaagaaccgaaaua

SEQ ID NO: 2306835 - RNA, 12 nt, Yersinia pestis KIM
uucaacuuuuuu

SEQ ID NO: 2306836 - RNA, 15 nt, Yersinia pestis KIM
uucaagcaauucaga

SEQ ID NO: 2306837 - RNA, 14 nt, Yersinia pestis KIM
uucaagaugcaggg

SEQ ID NO: 2306838 - RNA, 18 nt, Yersinia pestis KIM
uucaagcccgaaauucag

SEQ ID NO: 2306839 - RNA, 20 nt, Yersinia pestis KIM
uucaagcccgaaauucaguu

SEQ ID NO: 2306840 - RNA, 19 nt, Yersinia pestis KIM
uuagcauugcagauuucuu

SEQ ID NO: 2306841 - RNA, 20 nt, Yersinia pestis KIM
uuagcauugcagauuucuuc

SEQ ID NO: 2306842 - RNA, 23 nt, Yersinia pestis KIM
uuagccaagcaaccuuguuuuau

SEQ ID NO: 2306843 - RNA, 16 nt, Yersinia pestis KIM
uuagccaaauacccua

SEQ ID NO: 2306844 - RNA, 15 nt, Yersinia pestis KIM
uuagcauuuuccaau

SEQ ID NO: 2306845 - RNA, 17 nt, Yersinia pestis KIM
uuagccgaauaucccac

SEQ ID NO: 2306846 - RNA, 16 nt, Yersinia pestis KIM
uuagccauuucaaaac

SEQ ID NO: 2306847 - RNA, 15 nt, Yersinia pestis KIM
uuagccauaagauaa

SEQ ID NO: 2306848 - RNA, 20 nt, Yersinia pestis KIM
uuagcucccccguguucuga

SEQ ID NO: 2306849 - RNA, 19 nt, Yersinia pestis KIM
uuagcuguccucuaccaga

SEQ ID NO: 2306850 - RNA, 12 nt, Yersinia pestis KIM
uuagcuguuuua

SEQ ID NO: 2306851 - RNA, 15 nt, Yersinia pestis KIM
uuagcuuacaccaug

SEQ ID NO: 2306852 - RNA, 23 nt, Yersinia pestis KIM
uuagacgucagauuaguuuuaga

SEQ ID NO: 2306853 - RNA, 11 nt, Yersinia pestis KIM
uuagacgucag

SEQ ID NO: 2306854 - RNA, 20 nt, Yersinia pestis KIM
uuacuuuuuauuaaugcuua

SEQ ID NO: 2306855 - RNA, 15 nt, Yersinia pestis KIM
uuagaagagauagau

SEQ ID NO: 2306856 - RNA, 20 nt, Yersinia pestis KIM
uuagagguuauugacaaaga

SEQ ID NO: 2306857 - RNA, 16 nt, Yersinia pestis KIM
uuagcacauaugcagc

SEQ ID NO: 2306858 - RNA, 21 nt, Yersinia pestis KIM
uuacugccugcagcaacaaua

SEQ ID NO: 2306859 - RNA, 12 nt, Yersinia pestis KIM
uuacugcuuuca

SEQ ID NO: 2306860 - RNA, 16 nt, Yersinia pestis KIM
uuacuggcugaauaca

SEQ ID NO: 2306861 - RNA, 14 nt, Yersinia pestis KIM
uuacuccucugccu

SEQ ID NO: 2306862 - RNA, 12 nt, Yersinia pestis KIM
uuacuccucugc

SEQ ID NO: 2306863 - RNA, 14 nt, Yersinia pestis KIM
uuacugauaucuuu

SEQ ID NO: 2306864 - RNA, 11 nt, Yersinia pestis KIM
uuacuguaaga

SEQ ID NO: 2306865 - RNA, 21 nt, Yersinia pestis KIM
uuacuugugcgcgggcacggg

SEQ ID NO: 2306866 - RNA, 13 nt, Yersinia pestis KIM
uuacuuuuuauua

SEQ ID NO: 2306867 - RNA, 16 nt, Yersinia pestis KIM
uuacgugaucaucuuu

SEQ ID NO: 2306868 - RNA, 17 nt, Yersinia pestis KIM
uuacgugaucaucuuuu

SEQ ID NO: 2306869 - RNA, 22 nt, Yersinia pestis KIM
uuacccgcgaucauuucaacua

SEQ ID NO: 2306870 - RNA, 15 nt, Yersinia pestis KIM
uuacccggaauggag

SEQ ID NO: 2306871 - RNA, 22 nt, Yersinia pestis KIM
uuacccugcgggugcuuuaaug

SEQ ID NO: 2306872 - RNA, 19 nt, Yersinia pestis KIM
uuacccucuaucgcucacu

SEQ ID NO: 2306873 - RNA, 22 nt, Yersinia pestis KIM
uuaccgagcgucaagccaaccc

SEQ ID NO: 2306874 - RNA, 23 nt, Yersinia pestis KIM
uuaccgauaaaggccgcagauaa

SEQ ID NO: 2306875 - RNA, 15 nt, Yersinia pestis KIM
uuaccgaugauuggu

SEQ ID NO: 2306876 - RNA, 14 nt, Yersinia pestis KIM
uuacuaaaauauca

SEQ ID NO: 2306877 - RNA, 14 nt, Yersinia pestis KIM
uuacuaacuggcug

SEQ ID NO: 2306878 - RNA, 18 nt, Yersinia pestis KIM
uuacucaggaacaagacu

SEQ ID NO: 2306879 - RNA, 17 nt, Yersinia pestis KIM
uuacucaguucagcccc

SEQ ID NO: 2306880 - RNA, 13 nt, Yersinia pestis KIM
uuacuauuuuucu

SEQ ID NO: 2306881 - RNA, 18 nt, Yersinia pestis KIM
uuacucagcacauuuuua

SEQ ID NO: 2306882 - RNA, 14 nt, Yersinia pestis KIM
uuacucaggaacaa

SEQ ID NO: 2306883 - RNA, 15 nt, Yersinia pestis KIM
uuauaccccgcgcag

SEQ ID NO: 2306884 - RNA, 15 nt, Yersinia pestis KIM
uuauacuaaagaaau

SEQ ID NO: 2306885 - RNA, 14 nt, Yersinia pestis KIM
uuauacuauuuaug

SEQ ID NO: 2306886 - RNA, 21 nt, Yersinia pestis KIM
uuauacauaucuuuauuauca

SEQ ID NO: 2306887 - RNA, 14 nt, Yersinia pestis KIM
uuauacauauguug

SEQ ID NO: 2306888 - RNA, 13 nt, Yersinia pestis KIM
uuauaaugaaaua

SEQ ID NO: 2306889 - RNA, 14 nt, Yersinia pestis KIM
uuauaaugaaauag

SEQ ID NO: 2306890 - RNA, 12 nt, Yersinia pestis KIM
uuauaauuuaua

SEQ ID NO: 2306891 - RNA, 22 nt, Yersinia pestis KIM
uuauacagcauauaaaaaagca

SEQ ID NO: 2306892 - RNA, 16 nt, Yersinia pestis KIM
uuauaaacaaucugau

SEQ ID NO: 2306893 - RNA, 21 nt, Yersinia pestis KIM
uuauaaacacugauuuauaaa

SEQ ID NO: 2306894 - RNA, 15 nt, Yersinia pestis KIM
uuauaaaccaaaugg

SEQ ID NO: 2306895 - RNA, 16 nt, Yersinia pestis KIM
uuauaaauaauuaaug

SEQ ID NO: 2306896 - RNA, 23 nt, Yersinia pestis KIM
uuauaaggaauauacuuuacaua

SEQ ID NO: 2306897 - RNA, 17 nt, Yersinia pestis KIM
uuauaagcguuauuuuu

SEQ ID NO: 2306898 - RNA, 15 nt, Yersinia pestis KIM
uuauaacuauauucu

SEQ ID NO: 2306899 - RNA, 14 nt, Yersinia pestis KIM
uuauaaauuuucag

SEQ ID NO: 2306900 - RNA, 19 nt, Yersinia pestis KIM
uuaguuacaauaaaucaau

SEQ ID NO: 2306901 - RNA, 18 nt, Yersinia pestis KIM
uuagugccuaucugaaug

SEQ ID NO: 2306902 - RNA, 20 nt, Yersinia pestis KIM
uuagugaaucaucaauaccc

SEQ ID NO: 2306903 - RNA, 15 nt, Yersinia pestis KIM
uuaguuuuaauaacc

SEQ ID NO: 2306904 - RNA, 11 nt, Yersinia pestis KIM
uuauaaaacca

SEQ ID NO: 2306905 - RNA, 16 nt, Yersinia pestis KIM
uuagguaauaccaaug

SEQ ID NO: 2306906 - RNA, 15 nt, Yersinia pestis KIM
uuagguaguuuuauu

SEQ ID NO: 2306907 - RNA, 16 nt, Yersinia pestis KIM
uuagguucuaaaccua

SEQ ID NO: 2306908 - RNA, 19 nt, Yersinia pestis KIM
uuagguucuaaaccuauug

SEQ ID NO: 2306909 - RNA, 19 nt, Yersinia pestis KIM
uuagucucaucgagaauaa

SEQ ID NO: 2306910 - RNA, 21 nt, Yersinia pestis KIM
uuaauggcaccguggauaaac

SEQ ID NO: 2306911 - RNA, 22 nt, Yersinia pestis KIM
uuaauggcaccguggauaaaca

SEQ ID NO: 2306912 - RNA, 14 nt, Yersinia pestis KIM
uuaaugcuguuuug

SEQ ID NO: 2306913 - RNA, 16 nt, Yersinia pestis KIM
uuaaugucuuuacuaa

SEQ ID NO: 2306914 - RNA, 12 nt, Yersinia pestis KIM
uuaaugauaacg

SEQ ID NO: 2306915 - RNA, 19 nt, Yersinia pestis KIM
uuaaugagcguuauuauua

SEQ ID NO: 2306916 - RNA, 13 nt, Yersinia pestis KIM
uuaaucuauuaau

SEQ ID NO: 2306917 - RNA, 17 nt, Yersinia pestis KIM
uuaaugauugauuauca

SEQ ID NO: 2306918 - RNA, 21 nt, Yersinia pestis KIM
uuaauuacuuuauuuaaaauu

SEQ ID NO: 2306919 - RNA, 16 nt, Yersinia pestis KIM
uuaauuaguuuuaaua

SEQ ID NO: 2306920 - RNA, 17 nt, Yersinia pestis KIM
uuaauuaguuuuaauaa

SEQ ID NO: 2306921 - RNA, 18 nt, Yersinia pestis KIM
uuaauuccaugcaaaaua

SEQ ID NO: 2306922 - RNA, 22 nt, Yersinia pestis KIM
uuaauucaucagauuguuuaua

SEQ ID NO: 2306923 - RNA, 22 nt, Yersinia pestis KIM
uuaauugagaauuauaacuauu

SEQ ID NO: 2306924 - RNA, 12 nt, Yersinia pestis KIM
uuaauugccgcg

SEQ ID NO: 2306925 - RNA, 18 nt, Yersinia pestis KIM
uuacagcaaggcagcaag

SEQ ID NO: 2306926 - RNA, 17 nt, Yersinia pestis KIM
uuacagcagguggcuga

SEQ ID NO: 2306927 - RNA, 21 nt, Yersinia pestis KIM
uuacagccgcccccuuucuua

SEQ ID NO: 2306928 - RNA, 19 nt, Yersinia pestis KIM
uuacagacuggccaacagg

SEQ ID NO: 2306929 - RNA, 17 nt, Yersinia pestis KIM
uuacagcaaggcagcaa

SEQ ID NO: 2306930 - RNA, 13 nt, Yersinia pestis KIM
uuacaauaaauca

SEQ ID NO: 2306931 - RNA, 11 nt, Yersinia pestis KIM
uuaccacaccu

SEQ ID NO: 2306932 - RNA, 21 nt, Yersinia pestis KIM
uuaccaccgucaagacaacaa

SEQ ID NO: 2306933 - RNA, 16 nt, Yersinia pestis KIM
uuaccaaacauuuuca

SEQ ID NO: 2306934 - RNA, 20 nt, Yersinia pestis KIM
uuaccaaaagcauccaauac

SEQ ID NO: 2306935 - RNA, 18 nt, Yersinia pestis KIM
uuacaguugauauuauua

SEQ ID NO: 2306936 - RNA, 18 nt, Yersinia pestis KIM
uuacagugaucaugggaa

SEQ ID NO: 2306937 - RNA, 11 nt, Yersinia pestis KIM
uuacauuuuua

SEQ ID NO: 2306938 - RNA, 23 nt, Yersinia pestis KIM
uuacauuuaaacacucaauaagu

SEQ ID NO: 2306939 - RNA, 22 nt, Yersinia pestis KIM
uuaaguguugccaaccggauaa

SEQ ID NO: 2306940 - RNA, 14 nt, Yersinia pestis KIM
uuaagucaauuuca

SEQ ID NO: 2306941 - RNA, 21 nt, Yersinia pestis KIM
uuaauaacuucaguuacucac

SEQ ID NO: 2306942 - RNA, 20 nt, Yersinia pestis KIM
uuaauaagcccaguauugca

SEQ ID NO: 2306943 - RNA, 19 nt, Yersinia pestis KIM
uuaaucggauggucaucca

SEQ ID NO: 2306944 - RNA, 20 nt, Yersinia pestis KIM
uuaaucgccguggugccauc

SEQ ID NO: 2306945 - RNA, 22 nt, Yersinia pestis KIM
uuaauccuaaugaacacuuaau

SEQ ID NO: 2306946 - RNA, 17 nt, Yersinia pestis KIM
uuaauaugcaaaaaaag

SEQ ID NO: 2306947 - RNA, 15 nt, Yersinia pestis KIM
uuaauaugcaaaaaa

SEQ ID NO: 2306948 - RNA, 16 nt, Yersinia pestis KIM
uuaauaugcaaaaaaa

SEQ ID NO: 2306949 - RNA, 18 nt, Yersinia pestis KIM
uuaauauugcauuuuaca

SEQ ID NO: 2306950 - RNA, 12 nt, Yersinia pestis KIM
uuaauagauugu

SEQ ID NO: 2306951 - RNA, 20 nt, Yersinia pestis KIM
uuaacucauuuaucuaaaac

SEQ ID NO: 2306952 - RNA, 13 nt, Yersinia pestis KIM
uuaacucaaauaa

SEQ ID NO: 2306953 - RNA, 14 nt, Yersinia pestis KIM
uuaagaagccucau

SEQ ID NO: 2306954 - RNA, 13 nt, Yersinia pestis KIM
uuaagaagccuca

SEQ ID NO: 2306955 - RNA, 21 nt, Yersinia pestis KIM
uuaagcuauugguuauugauu

SEQ ID NO: 2306956 - RNA, 17 nt, Yersinia pestis KIM
uuaagcuaauucugggu

SEQ ID NO: 2306957 - RNA, 21 nt, Yersinia pestis KIM
uuaagacauugcgcaagcccc

SEQ ID NO: 2306958 - RNA, 16 nt, Yersinia pestis KIM
uuaagauaauuaucca

SEQ ID NO: 2306959 - RNA, 17 nt, Yersinia pestis KIM
ugugcuuuuuggcaaac

SEQ ID NO: 2306960 - RNA, 19 nt, Yersinia pestis KIM
ugugcuuugccauucuggg

SEQ ID NO: 2306961 - RNA, 23 nt, Yersinia pestis KIM
uguggaucagaccuuuacaggac

SEQ ID NO: 2306962 - RNA, 13 nt, Yersinia pestis KIM
uguggaggaaggc

SEQ ID NO: 2306963 - RNA, 13 nt, Yersinia pestis KIM
uuaacccauauua

SEQ ID NO: 2306964 - RNA, 21 nt, Yersinia pestis KIM
uuaacccuucucgugucacag

SEQ ID NO: 2306965 - RNA, 23 nt, Yersinia pestis KIM
uuaaccugagcggcguuguucuc

SEQ ID NO: 2306966 - RNA, 14 nt, Yersinia pestis KIM
uggaguuguugcca

SEQ ID NO: 2306967 - RNA, 22 nt, Yersinia pestis KIM
uggauagggauuguuuucaaau

SEQ ID NO: 2306968 - RNA, 14 nt, Yersinia pestis KIM
uggauaauuucagc

SEQ ID NO: 2306969 - RNA, 13 nt, Yersinia pestis KIM
uggauaaugcuga

SEQ ID NO: 2306970 - RNA, 14 nt, Yersinia pestis KIM
uggaucauggcuuu

SEQ ID NO: 2306971 - RNA, 13 nt, Yersinia pestis KIM
uggaucacaucac

SEQ ID NO: 2306972 - RNA, 12 nt, Yersinia pestis KIM
uggaucagcaga

SEQ ID NO: 2306973 - RNA, 18 nt, Yersinia pestis KIM
uggaucucuccagccugc

SEQ ID NO: 2306974 - RNA, 19 nt, Yersinia pestis KIM
uggaugagccgcagccagc

SEQ ID NO: 2306975 - RNA, 15 nt, Yersinia pestis KIM
uggaugcucauuggu

SEQ ID NO: 2306976 - RNA, 18 nt, Yersinia pestis KIM
uggacgcuggcagccuuu

SEQ ID NO: 2306977 - RNA, 12 nt, Yersinia pestis KIM
uggagagcaggg

SEQ ID NO: 2306978 - RNA, 18 nt, Yersinia pestis KIM
uggagccagccauucuga

SEQ ID NO: 2306979 - RNA, 21 nt, Yersinia pestis KIM
uggagagcagggcccgccauu

SEQ ID NO: 2306980 - RNA, 18 nt, Yersinia pestis KIM
uggagcaaaugaacgcga

SEQ ID NO: 2306981 - RNA, 13 nt, Yersinia pestis KIM
uggagcuauggaa

SEQ ID NO: 2306982 - RNA, 23 nt, Yersinia pestis KIM
uggaggaaggcgguuaucuggaa

SEQ ID NO: 2306983 - RNA, 14 nt, Yersinia pestis KIM
uggaggaaggcggu

SEQ ID NO: 2306984 - RNA, 20 nt, Yersinia pestis KIM
uggaggaaggcgguuaucug

SEQ ID NO: 2306985 - RNA, 19 nt, Yersinia pestis KIM
uggagguguauuuuuaugg

SEQ ID NO: 2306986 - RNA, 23 nt, Yersinia pestis KIM
uggccccuaaugcgcucaccaag

SEQ ID NO: 2306987 - RNA, 13 nt, Yersinia pestis KIM
uggccccugaaua

SEQ ID NO: 2306988 - RNA, 18 nt, Yersinia pestis KIM
uggcccauaacaauuaau

SEQ ID NO: 2306989 - RNA, 14 nt, Yersinia pestis KIM
uggcccaucuaugg

SEQ ID NO: 2306990 - RNA, 14 nt, Yersinia pestis KIM
uggcccaauaaaag

SEQ ID NO: 2306991 - RNA, 16 nt, Yersinia pestis KIM
uggcccacuguuaccc

SEQ ID NO: 2306992 - RNA, 18 nt, Yersinia pestis KIM
uggcccaagccauccuuc

SEQ ID NO: 2306993 - RNA, 19 nt, Yersinia pestis KIM
uggcccaagccauccuuuu

SEQ ID NO: 2306994 - RNA, 13 nt, Yersinia pestis KIM
uggccauguugug

SEQ ID NO: 2306995 - RNA, 22 nt, Yersinia pestis KIM
uggccagaugauaccgcgguca

SEQ ID NO: 2306996 - RNA, 16 nt, Yersinia pestis KIM
uggccacucaccucag

SEQ ID NO: 2306997 - RNA, 17 nt, Yersinia pestis KIM
uggcauccucaggaugg

SEQ ID NO: 2306998 - RNA, 15 nt, Yersinia pestis KIM
uggcaucaaauuuag

SEQ ID NO: 2306999 - RNA, 18 nt, Yersinia pestis KIM
uggcaucaaauuuaguca

SEQ ID NO: 2307000 - RNA, 17 nt, Yersinia pestis KIM
uggcaugacuuagcacg

SEQ ID NO: 2307001 - RNA, 16 nt, Yersinia pestis KIM
uggcauggauaucagc

SEQ ID NO: 2307002 - RNA, 19 nt, Yersinia pestis KIM
uggcacuggaaacaaaacc

SEQ ID NO: 2307003 - RNA, 18 nt, Yersinia pestis KIM
uggcacucucuucaucag

SEQ ID NO: 2307004 - RNA, 19 nt, Yersinia pestis KIM
uggcaacucuagcgccagc

SEQ ID NO: 2307005 - RNA, 14 nt, Yersinia pestis KIM
uggcaacugcaaau

SEQ ID NO: 2307006 - RNA, 16 nt, Yersinia pestis KIM
uggcaacugcaaaugu

SEQ ID NO: 2307007 - RNA, 20 nt, Yersinia pestis KIM
uggcaacugcaaauguucaa

SEQ ID NO: 2307008 - RNA, 13 nt, Yersinia pestis KIM
uggcaagcccuga

SEQ ID NO: 2307009 - RNA, 15 nt, Yersinia pestis KIM
uggcagggccgauaa

SEQ ID NO: 2307010 - RNA, 14 nt, Yersinia pestis KIM
uggcaguauuuuaa

SEQ ID NO: 2307011 - RNA, 19 nt, Yersinia pestis KIM
uggcaguauuuuaagaaaa

SEQ ID NO: 2307012 - RNA, 17 nt, Yersinia pestis KIM
uggcagucacugcugca

SEQ ID NO: 2307013 - RNA, 18 nt, Yersinia pestis KIM
uggcaaaacucaggugag

SEQ ID NO: 2307014 - RNA, 15 nt, Yersinia pestis KIM
uggauuuucaaauca

SEQ ID NO: 2307015 - RNA, 20 nt, Yersinia pestis KIM
uggauuuucaaaucaugcau

SEQ ID NO: 2307016 - RNA, 14 nt, Yersinia pestis KIM
uggcucgugaucag

SEQ ID NO: 2307017 - RNA, 22 nt, Yersinia pestis KIM
uggcugaauaucaucuuuuucu

SEQ ID NO: 2307018 - RNA, 22 nt, Yersinia pestis KIM
uggcucuggccagcgucuucag

SEQ ID NO: 2307019 - RNA, 19 nt, Yersinia pestis KIM
uggcugaggccagcggcau

SEQ ID NO: 2307020 - RNA, 16 nt, Yersinia pestis KIM
uggcugccuaccugca

SEQ ID NO: 2307021 - RNA, 21 nt, Yersinia pestis KIM
uggcugcccagagugacaaca

SEQ ID NO: 2307022 - RNA, 21 nt, Yersinia pestis KIM
uggcugcgggugccgcauuac

SEQ ID NO: 2307023 - RNA, 22 nt, Yersinia pestis KIM
uggcuguuauauaaaugguuau

SEQ ID NO: 2307024 - RNA, 21 nt, Yersinia pestis KIM
ugggaaaaguggcuaucugaa

SEQ ID NO: 2307025 - RNA, 20 nt, Yersinia pestis KIM
uggcuguuuuucauuuacuu

SEQ ID NO: 2307026 - RNA, 18 nt, Yersinia pestis KIM
uggcuuaaucgccagcaa

SEQ ID NO: 2307027 - RNA, 22 nt, Yersinia pestis KIM
ugggaaaaguggcuaucugaaa

SEQ ID NO: 2307028 - RNA, 16 nt, Yersinia pestis KIM
ugggacuuuaucugcc

SEQ ID NO: 2307029 - RNA, 17 nt, Yersinia pestis KIM
ugggccgaugccaggca

SEQ ID NO: 2307030 - RNA, 22 nt, Yersinia pestis KIM
ugggccaggcaaugagugcagc

SEQ ID NO: 2307031 - RNA, 17 nt, Yersinia pestis KIM
ugggccgacucugcaug

SEQ ID NO: 2307032 - RNA, 16 nt, Yersinia pestis KIM
ugggcaucccuuuacg

SEQ ID NO: 2307033 - RNA, 14 nt, Yersinia pestis KIM
ugggcgauaguaau

SEQ ID NO: 2307034 - RNA, 18 nt, Yersinia pestis KIM
ugggcgauaguaauuuuu

SEQ ID NO: 2307035 - RNA, 22 nt, Yersinia pestis KIM
ugggcuucagcgguagcaaagc

SEQ ID NO: 2307036 - RNA, 14 nt, Yersinia pestis KIM
ugggcugccugugc

SEQ ID NO: 2307037 - RNA, 23 nt, Yersinia pestis KIM
ugggcugccugugcggcagugaa

SEQ ID NO: 2307038 - RNA, 21 nt, Yersinia pestis KIM
uggggucaucaacgcacucag

SEQ ID NO: 2307039 - RNA, 13 nt, Yersinia pestis KIM
uggguaauaucac

SEQ ID NO: 2307040 - RNA, 12 nt, Yersinia pestis KIM
uggcgauuucag

SEQ ID NO: 2307041 - RNA, 23 nt, Yersinia pestis KIM
uggcgcauccccacuuguaccug

SEQ ID NO: 2307042 - RNA, 21 nt, Yersinia pestis KIM
uggccuuagcacguuuuucag

SEQ ID NO: 2307043 - RNA, 15 nt, Yersinia pestis KIM
uggccugcacaucaa

SEQ ID NO: 2307044 - RNA, 13 nt, Yersinia pestis KIM
uggccugaugcac

SEQ ID NO: 2307045 - RNA, 21 nt, Yersinia pestis KIM
uggccugcggcgguuacccuc

SEQ ID NO: 2307046 - RNA, 14 nt, Yersinia pestis KIM
uggccgaaauggaa

SEQ ID NO: 2307047 - RNA, 22 nt, Yersinia pestis KIM
uggcgcgguucuaguauucagg

SEQ ID NO: 2307048 - RNA, 15 nt, Yersinia pestis KIM
uggcgcgccacuucu

SEQ ID NO: 2307049 - RNA, 14 nt, Yersinia pestis KIM
uggcgguuccaaag

SEQ ID NO: 2307050 - RNA, 24 nt, Yersinia pestis KIM
uggcguuucugaagaugccaauca

SEQ ID NO: 2307051 - RNA, 14 nt, Yersinia pestis KIM
uggcuaaacccaac

SEQ ID NO: 2307052 - RNA, 22 nt, Yersinia pestis KIM
uggcuaagccgcaauaaauggc

SEQ ID NO: 2307053 - RNA, 16 nt, Yersinia pestis KIM
uggcuaagguaucucg

SEQ ID NO: 2307054 - RNA, 20 nt, Yersinia pestis KIM
uggcuaagauccagucgguc

SEQ ID NO: 2307055 - RNA, 16 nt, Yersinia pestis KIM
uggcuaauuaauuuaa

SEQ ID NO: 2307056 - RNA, 22 nt, Yersinia pestis KIM
uggcuagccugcaccucaucaa

SEQ ID NO: 2307057 - RNA, 21 nt, Yersinia pestis KIM
uggcuaucaauuguuugcuau

SEQ ID NO: 2307058 - RNA, 14 nt, Yersinia pestis KIM
uggcuaucugaaac

SEQ ID NO: 2307059 - RNA, 14 nt, Yersinia pestis KIM
uggcucaucaaagg

SEQ ID NO: 2307060 - RNA, 16 nt, Yersinia pestis KIM
uggcucacugcauacu

SEQ ID NO: 2307061 - RNA, 16 nt, Yersinia pestis KIM
ugucuuuaauaaaauc

SEQ ID NO: 2307062 - RNA, 14 nt, Yersinia pestis KIM
ugucuuuaaguauu

SEQ ID NO: 2307063 - RNA, 18 nt, Yersinia pestis KIM
ugucuuuaauaaaaucaa

SEQ ID NO: 2307064 - RNA, 19 nt, Yersinia pestis KIM
ugucugagucgauagcuuu

SEQ ID NO: 2307065 - RNA, 16 nt, Yersinia pestis KIM
ugucuuuuucuuuuua

SEQ ID NO: 2307066 - RNA, 14 nt, Yersinia pestis KIM
ugucuuuuuuggua

SEQ ID NO: 2307067 - RNA, 19 nt, Yersinia pestis KIM
ugucuuuuuugguaauaag

SEQ ID NO: 2307068 - RNA, 15 nt, Yersinia pestis KIM
ugugcaaucaagggc

SEQ ID NO: 2307069 - RNA, 13 nt, Yersinia pestis KIM
ugugcaaugcaga

SEQ ID NO: 2307070 - RNA, 16 nt, Yersinia pestis KIM
ugugcaccacacagcg

SEQ ID NO: 2307071 - RNA, 15 nt, Yersinia pestis KIM
ugugcccagaaaacc

SEQ ID NO: 2307072 - RNA, 15 nt, Yersinia pestis KIM
ugugcaaaauacaaa

SEQ ID NO: 2307073 - RNA, 22 nt, Yersinia pestis KIM
ugugauuucagccaggcgaucu

SEQ ID NO: 2307074 - RNA, 23 nt, Yersinia pestis KIM
ugugauccacacaguauucugcu

SEQ ID NO: 2307075 - RNA, 19 nt, Yersinia pestis KIM
ugugaugaaacuaaaauaa

SEQ ID NO: 2307076 - RNA, 16 nt, Yersinia pestis KIM
ugucguuuacuggcug

SEQ ID NO: 2307077 - RNA, 14 nt, Yersinia pestis KIM
ugucucuacucucu

SEQ ID NO: 2307078 - RNA, 20 nt, Yersinia pestis KIM
ugucucuacucucuguuuug

SEQ ID NO: 2307079 - RNA, 15 nt, Yersinia pestis KIM
ugucgucaucaggau

SEQ ID NO: 2307080 - RNA, 19 nt, Yersinia pestis KIM
ugucggcagguaaugcauu

SEQ ID NO: 2307081 - RNA, 18 nt, Yersinia pestis KIM
ugucggcgaugaaaaaca

SEQ ID NO: 2307082 - RNA, 18 nt, Yersinia pestis KIM
ugucaccgucaucauuaa

SEQ ID NO: 2307083 - RNA, 13 nt, Yersinia pestis KIM
ugucagcagucug

SEQ ID NO: 2307084 - RNA, 14 nt, Yersinia pestis KIM
ugucagcagucuga

SEQ ID NO: 2307085 - RNA, 16 nt, Yersinia pestis KIM
ugucagcagucugaaa

SEQ ID NO: 2307086 - RNA, 21 nt, Yersinia pestis KIM
ugucagcagucugaagccuac

SEQ ID NO: 2307087 - RNA, 23 nt, Yersinia pestis KIM
ugucagcagucugagggccacuu

SEQ ID NO: 2307088 - RNA, 15 nt, Yersinia pestis KIM
ugucccgaugauugc

SEQ ID NO: 2307089 - RNA, 17 nt, Yersinia pestis KIM
uguccucaagauuaucc

SEQ ID NO: 2307090 - RNA, 15 nt, Yersinia pestis KIM
uguccugcaauccuc

SEQ ID NO: 2307091 - RNA, 18 nt, Yersinia pestis KIM
ugucaauguguugaauau

SEQ ID NO: 2307092 - RNA, 18 nt, Yersinia pestis KIM
ugucaaucgaugagcugg

SEQ ID NO: 2307093 - RNA, 17 nt, Yersinia pestis KIM
ugucaauaaccucagcc

SEQ ID NO: 2307094 - RNA, 19 nt, Yersinia pestis KIM
uguauuuggguuaaauagu

SEQ ID NO: 2307095 - RNA, 14 nt, Yersinia pestis KIM
uguauuugaugguu

SEQ ID NO: 2307096 - RNA, 14 nt, Yersinia pestis KIM
uguauuuauucaaa

SEQ ID NO: 2307097 - RNA, 13 nt, Yersinia pestis KIM
uguauuuaaaaga

SEQ ID NO: 2307098 - RNA, 14 nt, Yersinia pestis KIM
uguauuuaaauagu

SEQ ID NO: 2307099 - RNA, 16 nt, Yersinia pestis KIM
uguauuuaaauaguca

SEQ ID NO: 2307100 - RNA, 12 nt, Yersinia pestis KIM
uguauugcucca

SEQ ID NO: 2307101 - RNA, 16 nt, Yersinia pestis KIM
uguauucuuguauccu

SEQ ID NO: 2307102 - RNA, 23 nt, Yersinia pestis KIM
uguagaucccgugugauuuccau

SEQ ID NO: 2307103 - RNA, 15 nt, Yersinia pestis KIM
uguacugggaugaag

SEQ ID NO: 2307104 - RNA, 17 nt, Yersinia pestis KIM
uguacugcugcaacuca

SEQ ID NO: 2307105 - RNA, 21 nt, Yersinia pestis KIM
uguagccacggcgcaacauua

SEQ ID NO: 2307106 - RNA, 22 nt, Yersinia pestis KIM
uguauccuggccguguuuuucc

SEQ ID NO: 2307107 - RNA, 13 nt, Yersinia pestis KIM
uguaucauauguu

SEQ ID NO: 2307108 - RNA, 17 nt, Yersinia pestis KIM
uggugguaauuugccag

SEQ ID NO: 2307109 - RNA, 19 nt, Yersinia pestis KIM
ugguggcuugggcuucaca

SEQ ID NO: 2307110 - RNA, 21 nt, Yersinia pestis KIM
uggugguaccugcaucaucac

SEQ ID NO: 2307111 - RNA, 19 nt, Yersinia pestis KIM
uggugguugcagugucagu

SEQ ID NO: 2307112 - RNA, 13 nt, Yersinia pestis KIM
ugguuaaucuacc

SEQ ID NO: 2307113 - RNA, 17 nt, Yersinia pestis KIM
ugguuaaucuacccgaa

SEQ ID NO: 2307114 - RNA, 15 nt, Yersinia pestis KIM
ugguuaccaucaacc

SEQ ID NO: 2307115 - RNA, 17 nt, Yersinia pestis KIM
ugguuaccaucaaccac

SEQ ID NO: 2307116 - RNA, 23 nt, Yersinia pestis KIM
ugguuaucaagaucaaaagcaga

SEQ ID NO: 2307117 - RNA, 16 nt, Yersinia pestis KIM
ugguucaccacuuucc

SEQ ID NO: 2307118 - RNA, 19 nt, Yersinia pestis KIM
ugguucaccacuuuccagg

SEQ ID NO: 2307119 - RNA, 17 nt, Yersinia pestis KIM
uggugaguaaaugcccc

SEQ ID NO: 2307120 - RNA, 19 nt, Yersinia pestis KIM
ugggucguugauauuccua

SEQ ID NO: 2307121 - RNA, 16 nt, Yersinia pestis KIM
ugggucaguuuuauua

SEQ ID NO: 2307122 - RNA, 15 nt, Yersinia pestis KIM
ugggucaucacccag

SEQ ID NO: 2307123 - RNA, 15 nt, Yersinia pestis KIM
uggguagacauggca

SEQ ID NO: 2307124 - RNA, 15 nt, Yersinia pestis KIM
uggguauggucagca

SEQ ID NO: 2307125 - RNA, 15 nt, Yersinia pestis KIM
uggguaucuggagcc

SEQ ID NO: 2307126 - RNA, 23 nt, Yersinia pestis KIM
uggguauauaguuuauuuuauuu

SEQ ID NO: 2307127 - RNA, 15 nt, Yersinia pestis KIM
uggguauaugacugu

SEQ ID NO: 2307128 - RNA, 17 nt, Yersinia pestis KIM
uggucgguuuccgccug

SEQ ID NO: 2307129 - RNA, 16 nt, Yersinia pestis KIM
uggucguuuaaauaaa

SEQ ID NO: 2307130 - RNA, 21 nt, Yersinia pestis KIM
uggugacuacggcuacagcgu

SEQ ID NO: 2307131 - RNA, 14 nt, Yersinia pestis KIM
uggucucagaacaa

SEQ ID NO: 2307132 - RNA, 16 nt, Yersinia pestis KIM
uguaagcgugcaaccc

SEQ ID NO: 2307133 - RNA, 13 nt, Yersinia pestis KIM
uguaaauuaauac

SEQ ID NO: 2307134 - RNA, 16 nt, Yersinia pestis KIM
uguaauaacgauuaau

SEQ ID NO: 2307135 - RNA, 17 nt, Yersinia pestis KIM
uguaagucauucuuggu

SEQ ID NO: 2307136 - RNA, 16 nt, Yersinia pestis KIM
uguacguauggcauga

SEQ ID NO: 2307137 - RNA, 14 nt, Yersinia pestis KIM
uguacguauggcau

SEQ ID NO: 2307138 - RNA, 12 nt, Yersinia pestis KIM
uguacauuauuc

SEQ ID NO: 2307139 - RNA, 21 nt, Yersinia pestis KIM
uguacggcgcguuucuuagcu

SEQ ID NO: 2307140 - RNA, 18 nt, Yersinia pestis KIM
uguacagcguuggcagca

SEQ ID NO: 2307141 - RNA, 15 nt, Yersinia pestis KIM
uguaauuguauuaua

SEQ ID NO: 2307142 - RNA, 16 nt, Yersinia pestis KIM
ugguuugguucuggug

SEQ ID NO: 2307143 - RNA, 12 nt, Yersinia pestis KIM
ugguuuggccau

SEQ ID NO: 2307144 - RNA, 11 nt, Yersinia pestis KIM
ugguuuuaaua

SEQ ID NO: 2307145 - RNA, 14 nt, Yersinia pestis KIM
ugguuuuaauaacc

SEQ ID NO: 2307146 - RNA, 17 nt, Yersinia pestis KIM
ugguuuuaucaauaggu

SEQ ID NO: 2307147 - RNA, 14 nt, Yersinia pestis KIM
ugguuuuaccauca

SEQ ID NO: 2307148 - RNA, 19 nt, Yersinia pestis KIM
ugguuuucuauuuccacaa

SEQ ID NO: 2307149 - RNA, 13 nt, Yersinia pestis KIM
uguaaauauaaaa

SEQ ID NO: 2307150 - RNA, 16 nt, Yersinia pestis KIM
uguaaauauaaaauaa

SEQ ID NO: 2307151 - RNA, 22 nt, Yersinia pestis KIM
uguaaauaguuacuauauaaau

SEQ ID NO: 2307152 - RNA, 12 nt, Yersinia pestis KIM
uguaaauaucau

SEQ ID NO: 2307153 - RNA, 23 nt, Yersinia pestis KIM
ugguuguuuuuucccagaacaua

SEQ ID NO: 2307154 - RNA, 16 nt, Yersinia pestis KIM
ugguuugaauucaaga

SEQ ID NO: 2307155 - RNA, 21 nt, Yersinia pestis KIM
ugguuugacauacucuuccaa

SEQ ID NO: 2307156 - RNA, 20 nt, Yersinia pestis KIM
ugguuggcaccacggucaga

SEQ ID NO: 2307157 - RNA, 17 nt, Yersinia pestis KIM
ugguuggcagcucagca

SEQ ID NO: 2307158 - RNA, 13 nt, Yersinia pestis KIM
ugguugcggcacc

SEQ ID NO: 2307159 - RNA, 18 nt, Yersinia pestis KIM
ugguugccagauaauguu

SEQ ID NO: 2307160 - RNA, 13 nt, Yersinia pestis KIM
ugcgccaaucgcc

SEQ ID NO: 2307161 - RNA, 13 nt, Yersinia pestis KIM
ugcgccagcagca

SEQ ID NO: 2307162 - RNA, 14 nt, Yersinia pestis KIM
ugcgaucuauccaa

SEQ ID NO: 2307163 - RNA, 22 nt, Yersinia pestis KIM
ugcgauacaccauuuccaggcu

SEQ ID NO: 2307164 - RNA, 23 nt, Yersinia pestis KIM
ugcgauacaccauuuccaggcua

SEQ ID NO: 2307165 - RNA, 15 nt, Yersinia pestis KIM
ugcgaauggaaaaac

SEQ ID NO: 2307166 - RNA, 16 nt, Yersinia pestis KIM
ugcgaagaucacucau

SEQ ID NO: 2307167 - RNA, 17 nt, Yersinia pestis KIM
ugcgacaccugcuauca

SEQ ID NO: 2307168 - RNA, 17 nt, Yersinia pestis KIM
ugcgacacgcucaucca

SEQ ID NO: 2307169 - RNA, 20 nt, Yersinia pestis KIM
ugcgacaccaagaggcugcg

SEQ ID NO: 2307170 - RNA, 16 nt, Yersinia pestis KIM
ugcgaaauaaaugcga

SEQ ID NO: 2307171 - RNA, 16 nt, Yersinia pestis KIM
ugcgaaaauuuaacua

SEQ ID NO: 2307172 - RNA, 17 nt, Yersinia pestis KIM
ugccuuggucucagaac

SEQ ID NO: 2307173 - RNA, 15 nt, Yersinia pestis KIM
ugccuugccauccau

SEQ ID NO: 2307174 - RNA, 16 nt, Yersinia pestis KIM
ugccuuucuguaacuc

SEQ ID NO: 2307175 - RNA, 15 nt, Yersinia pestis KIM
ugccguaaacaauaa

SEQ ID NO: 2307176 - RNA, 22 nt, Yersinia pestis KIM
ugccgucguauagaaaauuucu

SEQ ID NO: 2307177 - RNA, 15 nt, Yersinia pestis KIM
ugccagaacagcagg

SEQ ID NO: 2307178 - RNA, 14 nt, Yersinia pestis KIM
ugccagauaaaaau

SEQ ID NO: 2307179 - RNA, 19 nt, Yersinia pestis KIM
ugccuucacugguuuucag

SEQ ID NO: 2307180 - RNA, 18 nt, Yersinia pestis KIM
ugccuugaucgcauccuc

SEQ ID NO: 2307181 - RNA, 14 nt, Yersinia pestis KIM
ugccugugcggcag

SEQ ID NO: 2307182 - RNA, 12 nt, Yersinia pestis KIM
ugccugucauca

SEQ ID NO: 2307183 - RNA, 22 nt, Yersinia pestis KIM
ugccuuacuuuuuugccugcuc

SEQ ID NO: 2307184 - RNA, 23 nt, Yersinia pestis KIM
ugcgcuuucagcacgcuuuccag

SEQ ID NO: 2307185 - RNA, 12 nt, Yersinia pestis KIM
ugcggcagugaa

SEQ ID NO: 2307186 - RNA, 21 nt, Yersinia pestis KIM
ugcggcuugagcuuauaucaa

SEQ ID NO: 2307187 - RNA, 15 nt, Yersinia pestis KIM
ugcgguggcacugac

SEQ ID NO: 2307188 - RNA, 12 nt, Yersinia pestis KIM
ugcgguggccag

SEQ ID NO: 2307189 - RNA, 14 nt, Yersinia pestis KIM
ugcggucuggcaac

SEQ ID NO: 2307190 - RNA, 15 nt, Yersinia pestis KIM
ugcgguggccagagc

SEQ ID NO: 2307191 - RNA, 17 nt, Yersinia pestis KIM
ugcgguuacgggugauu

SEQ ID NO: 2307192 - RNA, 16 nt, Yersinia pestis KIM
ugcgguuauuugcuau

SEQ ID NO: 2307193 - RNA, 15 nt, Yersinia pestis KIM
ugcguaaaugaaauu

SEQ ID NO: 2307194 - RNA, 20 nt, Yersinia pestis KIM
ugcgguuuguuugcaucugg

SEQ ID NO: 2307195 - RNA, 22 nt, Yersinia pestis KIM
ugcgguucuguaucauauguuc

SEQ ID NO: 2307196 - RNA, 23 nt, Yersinia pestis KIM
ugcgugcaauaaagcgauaaaua

SEQ ID NO: 2307197 - RNA, 16 nt, Yersinia pestis KIM
ugcguguggucagcac

SEQ ID NO: 2307198 - RNA, 21 nt, Yersinia pestis KIM
ugcguguggucagcacaaaca

SEQ ID NO: 2307199 - RNA, 14 nt, Yersinia pestis KIM
ugcguuuagcuucc

SEQ ID NO: 2307200 - RNA, 19 nt, Yersinia pestis KIM
ugcguuuguaggggagguc

SEQ ID NO: 2307201 - RNA, 22 nt, Yersinia pestis KIM
ugcguccuuugcccauaaaccc

SEQ ID NO: 2307202 - RNA, 19 nt, Yersinia pestis KIM
ugcgucaguucaagcagcu

SEQ ID NO: 2307203 - RNA, 13 nt, Yersinia pestis KIM
ugcuaucaauaaa

SEQ ID NO: 2307204 - RNA, 18 nt, Yersinia pestis KIM
ugcuauauuuuuuauaua

SEQ ID NO: 2307205 - RNA, 13 nt, Yersinia pestis KIM
ugcuaguauuauc

SEQ ID NO: 2307206 - RNA, 13 nt, Yersinia pestis KIM
ugcuauugaacau

SEQ ID NO: 2307207 - RNA, 16 nt, Yersinia pestis KIM
ugcuauugaacauuca

SEQ ID NO: 2307208 - RNA, 20 nt, Yersinia pestis KIM
ugcuauggguaauccccacc

SEQ ID NO: 2307209 - RNA, 15 nt, Yersinia pestis KIM
ugcucaaacucagca

SEQ ID NO: 2307210 - RNA, 11 nt, Yersinia pestis KIM
ugcucaacaua

SEQ ID NO: 2307211 - RNA, 15 nt, Yersinia pestis KIM
ugcuauuucauugau

SEQ ID NO: 2307212 - RNA, 16 nt, Yersinia pestis KIM
ugcuaaccgaauaaaa

SEQ ID NO: 2307213 - RNA, 14 nt, Yersinia pestis KIM
ugcuacagcagcag

SEQ ID NO: 2307214 - RNA, 14 nt, Yersinia pestis KIM
ugcuacuuaauauc

SEQ ID NO: 2307215 - RNA, 13 nt, Yersinia pestis KIM
ugcuacugaaggu

SEQ ID NO: 2307216 - RNA, 17 nt, Yersinia pestis KIM
ugcuccgcaauuugccc

SEQ ID NO: 2307217 - RNA, 12 nt, Yersinia pestis KIM
ugcuccuuacua

SEQ ID NO: 2307218 - RNA, 21 nt, Yersinia pestis KIM
ugcuccuuacuauuuucauug

SEQ ID NO: 2307219 - RNA, 21 nt, Yersinia pestis KIM
ugcuccaguugauacaggaaa

SEQ ID NO: 2307220 - RNA, 14 nt, Yersinia pestis KIM
ugcucauuuaaaau

SEQ ID NO: 2307221 - RNA, 18 nt, Yersinia pestis KIM
ugcucauuuaaaauacuc

SEQ ID NO: 2307222 - RNA, 23 nt, Yersinia pestis KIM
ugcucauguucgcacugcucugc

SEQ ID NO: 2307223 - RNA, 18 nt, Yersinia pestis KIM
ugcuccaaagcuuccaau

SEQ ID NO: 2307224 - RNA, 20 nt, Yersinia pestis KIM
ugcucagggccacuucggug

SEQ ID NO: 2307225 - RNA, 14 nt, Yersinia pestis KIM
ugcucaggccuugc

SEQ ID NO: 2307226 - RNA, 15 nt, Yersinia pestis KIM
ugcucagggccacuu

SEQ ID NO: 2307227 - RNA, 20 nt, Yersinia pestis KIM
ugcucauagcccugcugcuu

SEQ ID NO: 2307228 - RNA, 20 nt, Yersinia pestis KIM
ugcucaucaguuggucuuua

SEQ ID NO: 2307229 - RNA, 21 nt, Yersinia pestis KIM
ugcucacgcagaacgaucugu

SEQ ID NO: 2307230 - RNA, 18 nt, Yersinia pestis KIM
ugcucacgcguaaaugga

SEQ ID NO: 2307231 - RNA, 16 nt, Yersinia pestis KIM
ugcucacuuuuaucca

SEQ ID NO: 2307232 - RNA, 17 nt, Yersinia pestis KIM
ugcucacgguagguuuc

SEQ ID NO: 2307233 - RNA, 21 nt, Yersinia pestis KIM
ugcucacuggaguuaaauccc

SEQ ID NO: 2307234 - RNA, 15 nt, Yersinia pestis KIM
ugcucaacugcucaa

SEQ ID NO: 2307235 - RNA, 12 nt, Yersinia pestis KIM
ugcucaacugcu

SEQ ID NO: 2307236 - RNA, 13 nt, Yersinia pestis KIM
ugcucaacugcuc

SEQ ID NO: 2307237 - RNA, 16 nt, Yersinia pestis KIM
uggaauucgacaauga

SEQ ID NO: 2307238 - RNA, 16 nt, Yersinia pestis KIM
uggaauguucauucaa

SEQ ID NO: 2307239 - RNA, 14 nt, Yersinia pestis KIM
uggaaguuaaaaaa

SEQ ID NO: 2307240 - RNA, 14 nt, Yersinia pestis KIM
uggacgcaucagau

SEQ ID NO: 2307241 - RNA, 23 nt, Yersinia pestis KIM
uggacgaacagccccaaccaucu

SEQ ID NO: 2307242 - RNA, 16 nt, Yersinia pestis KIM
uggaaacaaaaccuaa

SEQ ID NO: 2307243 - RNA, 13 nt, Yersinia pestis KIM
uggaaaaacugaa

SEQ ID NO: 2307244 - RNA, 21 nt, Yersinia pestis KIM
uggaaaaauuagccaagcaac

SEQ ID NO: 2307245 - RNA, 18 nt, Yersinia pestis KIM
uggaaaaaauaauggcca

SEQ ID NO: 2307246 - RNA, 12 nt, Yersinia pestis KIM
ugcuuuuuucac

SEQ ID NO: 2307247 - RNA, 23 nt, Yersinia pestis KIM
ugcuuuuuuauaugcuguauaaa

SEQ ID NO: 2307248 - RNA, 18 nt, Yersinia pestis KIM
uggaaacucuaaggguaa

SEQ ID NO: 2307249 - RNA, 20 nt, Yersinia pestis KIM
uggaagaaucaccgaaagaa

SEQ ID NO: 2307250 - RNA, 16 nt, Yersinia pestis KIM
uggaacuguaaauauc

SEQ ID NO: 2307251 - RNA, 15 nt, Yersinia pestis KIM
uggaagcagaauacu

SEQ ID NO: 2307252 - RNA, 20 nt, Yersinia pestis KIM
uggaagccgacgaucuugcc

SEQ ID NO: 2307253 - RNA, 22 nt, Yersinia pestis KIM
ugcuugcgcguuaaucugcugc

SEQ ID NO: 2307254 - RNA, 18 nt, Yersinia pestis KIM
ugcuuggacucuggaauu

SEQ ID NO: 2307255 - RNA, 22 nt, Yersinia pestis KIM
ugcuuuaaucgccagacuguuc

SEQ ID NO: 2307256 - RNA, 17 nt, Yersinia pestis KIM
ugcuuucagauaaugcc

SEQ ID NO: 2307257 - RNA, 19 nt, Yersinia pestis KIM
ugcuuuccacgcccaacuc

SEQ ID NO: 2307258 - RNA, 18 nt, Yersinia pestis KIM
ugcuuuaucguagccaau

SEQ ID NO: 2307259 - RNA, 22 nt, Yersinia pestis KIM
ugcuuuaaauaacgcaaaaauc

SEQ ID NO: 2307260 - RNA, 13 nt, Yersinia pestis KIM
ugcuuuuugcuuu

SEQ ID NO: 2307261 - RNA, 15 nt, Yersinia pestis KIM
ugcuuuuugcuuuuu

SEQ ID NO: 2307262 - RNA, 20 nt, Yersinia pestis KIM
ugcuuuuugcuguucuaucu

SEQ ID NO: 2307263 - RNA, 21 nt, Yersinia pestis KIM
ugcuuuuuauugucucuacuc

SEQ ID NO: 2307264 - RNA, 21 nt, Yersinia pestis KIM
ugcuucacggacagcaaccac

SEQ ID NO: 2307265 - RNA, 13 nt, Yersinia pestis KIM
ugcuucaagcccg

SEQ ID NO: 2307266 - RNA, 14 nt, Yersinia pestis KIM
ugcuuauuucacac

SEQ ID NO: 2307267 - RNA, 13 nt, Yersinia pestis KIM
ugcuuaccuuguu

SEQ ID NO: 2307268 - RNA, 20 nt, Yersinia pestis KIM
ugcuuaccacuggccuccca

SEQ ID NO: 2307269 - RNA, 20 nt, Yersinia pestis KIM
ugcuugaagugcgaagcgca

SEQ ID NO: 2307270 - RNA, 21 nt, Yersinia pestis KIM
ugcuucuccuguaaugcauuc

SEQ ID NO: 2307271 - RNA, 14 nt, Yersinia pestis KIM
ugcuuccaacucac

SEQ ID NO: 2307272 - RNA, 18 nt, Yersinia pestis KIM
ugcuuccaacucaccuaa

SEQ ID NO: 2307273 - RNA, 21 nt, Yersinia pestis KIM
ugcuguagcgauaagugcagc

SEQ ID NO: 2307274 - RNA, 15 nt, Yersinia pestis KIM
ugcuguauuuaaccg

SEQ ID NO: 2307275 - RNA, 17 nt, Yersinia pestis KIM
ugcuggugggccugcug

SEQ ID NO: 2307276 - RNA, 13 nt, Yersinia pestis KIM
aaaugucguacau

SEQ ID NO: 2307277 - RNA, 13 nt, Yersinia pestis KIM
ugcuguuccaacc

SEQ ID NO: 2307278 - RNA, 14 nt, Yersinia pestis KIM
ugcuguuauuacug

SEQ ID NO: 2307279 - RNA, 12 nt, Yersinia pestis KIM
ugcuuaaaacag

SEQ ID NO: 2307280 - RNA, 23 nt, Yersinia pestis KIM
ugcuuaaaacaggcgaguuuccc

SEQ ID NO: 2307281 - RNA, 21 nt, Yersinia pestis KIM
ugcuguuguagcgccagguaa

SEQ ID NO: 2307282 - RNA, 19 nt, Yersinia pestis KIM
ugcugcugcccgcgaauaa

SEQ ID NO: 2307283 - RNA, 14 nt, Yersinia pestis KIM
ugcugcuuccugcu

SEQ ID NO: 2307284 - RNA, 19 nt, Yersinia pestis KIM
ugcuggaaugcagugccac

SEQ ID NO: 2307285 - RNA, 21 nt, Yersinia pestis KIM
ugcuggauuuuuaucuuucug

SEQ ID NO: 2307286 - RNA, 18 nt, Yersinia pestis KIM
ugcuggcauggaugguca

SEQ ID NO: 2307287 - RNA, 22 nt, Yersinia pestis KIM
ugcuggcguuuuccucgugaaa

SEQ ID NO: 2307288 - RNA, 15 nt, Yersinia pestis KIM
aaauguccacuguac

SEQ ID NO: 2307289 - RNA, 19 nt, Yersinia pestis KIM
aaauguacagucauuuacu

SEQ ID NO: 2307290 - RNA, 20 nt, Yersinia pestis KIM
ugcucuugaguguccacaua

SEQ ID NO: 2307291 - RNA, 16 nt, Yersinia pestis KIM
ugcucuucaccaaagg

SEQ ID NO: 2307292 - RNA, 16 nt, Yersinia pestis KIM
ugcucuucccugcgcu

SEQ ID NO: 2307293 - RNA, 15 nt, Yersinia pestis KIM
ugcucucauuuaaua

SEQ ID NO: 2307294 - RNA, 23 nt, Yersinia pestis KIM
ugcucuacgccccaugcaccuuc

SEQ ID NO: 2307295 - RNA, 19 nt, Yersinia pestis KIM
ugcucgcccaagcggcugg

SEQ ID NO: 2307296 - RNA, 22 nt, Yersinia pestis KIM
ugcucgaucagcgucagcagau

SEQ ID NO: 2307297 - RNA, 16 nt, Yersinia pestis KIM
ugcucggcuaaacggu

SEQ ID NO: 2307298 - RNA, 17 nt, Yersinia pestis KIM
ugcugaagccagcaccg

SEQ ID NO: 2307299 - RNA, 15 nt, Yersinia pestis KIM
ugcugaaaacaauau

SEQ ID NO: 2307300 - RNA, 19 nt, Yersinia pestis KIM
ugcugaaaaucaugaaauu

SEQ ID NO: 2307301 - RNA, 20 nt, Yersinia pestis KIM
ugcugacgauaacuuuuggc

SEQ ID NO: 2307302 - RNA, 21 nt, Yersinia pestis KIM
ugcugacaaaguuaaaugaag

SEQ ID NO: 2307303 - RNA, 13 nt, Yersinia pestis KIM
ugcugacaaaccc

SEQ ID NO: 2307304 - RNA, 14 nt, Yersinia pestis KIM
ugcugagugaagac

SEQ ID NO: 2307305 - RNA, 15 nt, Yersinia pestis KIM
ugcugagugaagaca

SEQ ID NO: 2307306 - RNA, 14 nt, Yersinia pestis KIM
ugcugaugcccauc

SEQ ID NO: 2307307 - RNA, 14 nt, Yersinia pestis KIM
ugcugaugcaauaa

SEQ ID NO: 2307308 - RNA, 20 nt, Yersinia pestis KIM
ugcugcacaaguuggugcag

SEQ ID NO: 2307309 - RNA, 23 nt, Yersinia pestis KIM
ugcugauucugacguuggcucug

SEQ ID NO: 2307310 - RNA, 15 nt, Yersinia pestis KIM
ugcugcccuuugcug

SEQ ID NO: 2307311 - RNA, 14 nt, Yersinia pestis KIM
ugaaaaucaugaaa

SEQ ID NO: 2307312 - RNA, 16 nt, Yersinia pestis KIM
ugaaaaucaugaaauu

SEQ ID NO: 2307313 - RNA, 13 nt, Yersinia pestis KIM
ugaaacacuuauu

SEQ ID NO: 2307314 - RNA, 22 nt, Yersinia pestis KIM
ugaaacacuuauuugaaauacu

SEQ ID NO: 2307315 - RNA, 15 nt, Yersinia pestis KIM
ugaaacaaccguguu

SEQ ID NO: 2307316 - RNA, 19 nt, Yersinia pestis KIM
ugaaacgauaugcuccaga

SEQ ID NO: 2307317 - RNA, 14 nt, Yersinia pestis KIM
ugaaacuaaaauaa

SEQ ID NO: 2307318 - RNA, 15 nt, Yersinia pestis KIM
ugaaacuaaaauaau

SEQ ID NO: 2307319 - RNA, 16 nt, Yersinia pestis KIM
ugaaagccaaucucuu

SEQ ID NO: 2307320 - RNA, 21 nt, Yersinia pestis KIM
ugaaagccaaucucuuguuuu

SEQ ID NO: 2307321 - RNA, 16 nt, Yersinia pestis KIM
ugaaaggcggugaaca

SEQ ID NO: 2307322 - RNA, 15 nt, Yersinia pestis KIM
ugaaauaaauaaguu

SEQ ID NO: 2307323 - RNA, 12 nt, Yersinia pestis KIM
ugaaauaaacuu

SEQ ID NO: 2307324 - RNA, 16 nt, Yersinia pestis KIM
ugaaauaaacuuuuau

SEQ ID NO: 2307325 - RNA, 16 nt, Yersinia pestis KIM
ugaaaguuuauaugcu

SEQ ID NO: 2307326 - RNA, 18 nt, Yersinia pestis KIM
ugaaaagguuaacugcag

SEQ ID NO: 2307327 - RNA, 21 nt, Yersinia pestis KIM
ugaaaaaucugacucuguaaa

SEQ ID NO: 2307328 - RNA, 14 nt, Yersinia pestis KIM
ugaaaaauaauguu

SEQ ID NO: 2307329 - RNA, 18 nt, Yersinia pestis KIM
ugaaaacggcgaggaaga

SEQ ID NO: 2307330 - RNA, 13 nt, Yersinia pestis KIM
ugaaaaacugugc

SEQ ID NO: 2307331 - RNA, 22 nt, Yersinia pestis KIM
ugaaaaaaaacacgguugaaaa

SEQ ID NO: 2307332 - RNA, 17 nt, Yersinia pestis KIM
ugaacggugaggauagg

SEQ ID NO: 2307333 - RNA, 22 nt, Yersinia pestis KIM
ugaacggguuaaucaguggcug

SEQ ID NO: 2307334 - RNA, 12 nt, Yersinia pestis KIM
ugaacguauauu

SEQ ID NO: 2307335 - RNA, 16 nt, Yersinia pestis KIM
ugaacguagcuaacac

SEQ ID NO: 2307336 - RNA, 15 nt, Yersinia pestis KIM
ugaacgcucuuucug

SEQ ID NO: 2307337 - RNA, 22 nt, Yersinia pestis KIM
ugaacucaacuuucucuggcac

SEQ ID NO: 2307338 - RNA, 19 nt, Yersinia pestis KIM
ugaacugaaucacaggcca

SEQ ID NO: 2307339 - RNA, 23 nt, Yersinia pestis KIM
ugaacugaaucacaggccacugc

SEQ ID NO: 2307340 - RNA, 17 nt, Yersinia pestis KIM
ugaaaucgaucauaauc

SEQ ID NO: 2307341 - RNA, 21 nt, Yersinia pestis KIM
ugaaccaucaacaauucgauc

SEQ ID NO: 2307342 - RNA, 17 nt, Yersinia pestis KIM
ugaacccuuucagcgcu

SEQ ID NO: 2307343 - RNA, 23 nt, Yersinia pestis KIM
ugaacccgccacauugagcaaaa

SEQ ID NO: 2307344 - RNA, 19 nt, Yersinia pestis KIM
ugaaccugacgcacagcac

SEQ ID NO: 2307345 - RNA, 18 nt, Yersinia pestis KIM
ugaaccgcuaucugcuga

SEQ ID NO: 2307346 - RNA, 18 nt, Yersinia pestis KIM
ugaaccgcgcucugcugg

SEQ ID NO: 2307347 - RNA, 21 nt, Yersinia pestis KIM
ugaauaaaaaauuauuaaaua

SEQ ID NO: 2307348 - RNA, 18 nt, Yersinia pestis KIM
ugaaggaugaauaaauga

SEQ ID NO: 2307349 - RNA, 16 nt, Yersinia pestis KIM
ugaagcuguuuccuga

SEQ ID NO: 2307350 - RNA, 16 nt, Yersinia pestis KIM
ugaacuucgaaagaaa

SEQ ID NO: 2307351 - RNA, 21 nt, Yersinia pestis KIM
ugaacuucgaaagaaauaaaa

SEQ ID NO: 2307352 - RNA, 15 nt, Yersinia pestis KIM
ugaagacacccguca

SEQ ID NO: 2307353 - RNA, 18 nt, Yersinia pestis KIM
ugaagaauuacgcacuaa

SEQ ID NO: 2307354 - RNA, 12 nt, Yersinia pestis KIM
ucuuuuuaauuu

SEQ ID NO: 2307355 - RNA, 16 nt, Yersinia pestis KIM
ucuuuuuccacacccu

SEQ ID NO: 2307356 - RNA, 16 nt, Yersinia pestis KIM
ucuuuuucugccugag

SEQ ID NO: 2307357 - RNA, 14 nt, Yersinia pestis KIM
ucuuuuaaagaaga

SEQ ID NO: 2307358 - RNA, 13 nt, Yersinia pestis KIM
ucuuuguuacaua

SEQ ID NO: 2307359 - RNA, 21 nt, Yersinia pestis KIM
ucuuuuagcgcuuuuacauca

SEQ ID NO: 2307360 - RNA, 21 nt, Yersinia pestis KIM
ucuuucucgauacaauuuuug

SEQ ID NO: 2307361 - RNA, 17 nt, Yersinia pestis KIM
ucuuucauuucaacaug

SEQ ID NO: 2307362 - RNA, 15 nt, Yersinia pestis KIM
ucuuucacucggaaa

SEQ ID NO: 2307363 - RNA, 17 nt, Yersinia pestis KIM
ucuuucauaucaaaagg

SEQ ID NO: 2307364 - RNA, 15 nt, Yersinia pestis KIM
ucuuucauaucaaaa

SEQ ID NO: 2307365 - RNA, 22 nt, Yersinia pestis KIM
ucuuucuggcuaaacgaucaga

SEQ ID NO: 2307366 - RNA, 22 nt, Yersinia pestis KIM
ucuuucuguucagcauaaauau

SEQ ID NO: 2307367 - RNA, 14 nt, Yersinia pestis KIM
ucuuugaccgaacc

SEQ ID NO: 2307368 - RNA, 18 nt, Yersinia pestis KIM
ucuuugggggcagugacu

SEQ ID NO: 2307369 - RNA, 14 nt, Yersinia pestis KIM
ucuuuaaaaucuug

SEQ ID NO: 2307370 - RNA, 12 nt, Yersinia pestis KIM
ucuuuaaaaacc

SEQ ID NO: 2307371 - RNA, 13 nt, Yersinia pestis KIM
ucuuuaaagacuu

SEQ ID NO: 2307372 - RNA, 14 nt, Yersinia pestis KIM
ucuuuaauaauaga

SEQ ID NO: 2307373 - RNA, 19 nt, Yersinia pestis KIM
ucuuuaaguauugacccuc

SEQ ID NO: 2307374 - RNA, 22 nt, Yersinia pestis KIM
ucuuuaauaaauuuucuaagcu

SEQ ID NO: 2307375 - RNA, 16 nt, Yersinia pestis KIM
ucuuuaacaacaacca

SEQ ID NO: 2307376 - RNA, 18 nt, Yersinia pestis KIM
ucuuuaacaccccuucag

SEQ ID NO: 2307377 - RNA, 15 nt, Yersinia pestis KIM
ucuuguuuaguaauu

SEQ ID NO: 2307378 - RNA, 13 nt, Yersinia pestis KIM
ucuuguucuaaua

SEQ ID NO: 2307379 - RNA, 16 nt, Yersinia pestis KIM
ucuuguucuaauaaua

SEQ ID NO: 2307380 - RNA, 15 nt, Yersinia pestis KIM
ucuuguuaauuuaaa

SEQ ID NO: 2307381 - RNA, 16 nt, Yersinia pestis KIM
ucuuguuaauuuaaac

SEQ ID NO: 2307382 - RNA, 15 nt, Yersinia pestis KIM
ucuuguaaauaguca

SEQ ID NO: 2307383 - RNA, 23 nt, Yersinia pestis KIM
ucuuguaaauagucauauauuuu

SEQ ID NO: 2307384 - RNA, 17 nt, Yersinia pestis KIM
ucuuggggcacaauucu

SEQ ID NO: 2307385 - RNA, 14 nt, Yersinia pestis KIM
ucuuguauauaaaa

SEQ ID NO: 2307386 - RNA, 23 nt, Yersinia pestis KIM
ucuugcucgaucagcgucagcag

SEQ ID NO: 2307387 - RNA, 19 nt, Yersinia pestis KIM
ucuuuacuaaauuagaaaa

SEQ ID NO: 2307388 - RNA, 18 nt, Yersinia pestis KIM
ucuuuaauuuuucccuug

SEQ ID NO: 2307389 - RNA, 14 nt, Yersinia pestis KIM
ucuuuaauuuucug

SEQ ID NO: 2307390 - RNA, 14 nt, Yersinia pestis KIM
ucuuuacaggccac

SEQ ID NO: 2307391 - RNA, 20 nt, Yersinia pestis KIM
ucuuuacgcucugccuguuc

SEQ ID NO: 2307392 - RNA, 16 nt, Yersinia pestis KIM
ucuuuacgaucugccu

SEQ ID NO: 2307393 - RNA, 19 nt, Yersinia pestis KIM
ucuuuacgaucugccuguu

SEQ ID NO: 2307394 - RNA, 20 nt, Yersinia pestis KIM
ucuuucaauggcugcccaga

SEQ ID NO: 2307395 - RNA, 18 nt, Yersinia pestis KIM
ucuuucaccacugccaca

SEQ ID NO: 2307396 - RNA, 23 nt, Yersinia pestis KIM
ucuuuauugcuccuuacuauuuu

SEQ ID NO: 2307397 - RNA, 18 nt, Yersinia pestis KIM
ucuuuauauucaauauca

SEQ ID NO: 2307398 - RNA, 14 nt, Yersinia pestis KIM
ucuuuauauucaau

SEQ ID NO: 2307399 - RNA, 15 nt, Yersinia pestis KIM
ucuuuauaguucauu

SEQ ID NO: 2307400 - RNA, 21 nt, Yersinia pestis KIM
ucuugauuaccaauaauuaau

SEQ ID NO: 2307401 - RNA, 20 nt, Yersinia pestis KIM
ucuugauggucaauaauguc

SEQ ID NO: 2307402 - RNA, 23 nt, Yersinia pestis KIM
ucuugcaacaacgccucaucuuc

SEQ ID NO: 2307403 - RNA, 21 nt, Yersinia pestis KIM
ucuugcaaggggcgagccacg

SEQ ID NO: 2307404 - RNA, 17 nt, Yersinia pestis KIM
ucuugcauacucaggcc

SEQ ID NO: 2307405 - RNA, 22 nt, Yersinia pestis KIM
ucuugaaccaauuuuucuguau

SEQ ID NO: 2307406 - RNA, 13 nt, Yersinia pestis KIM
ucuucuuuuauug

SEQ ID NO: 2307407 - RNA, 12 nt, Yersinia pestis KIM
ucuugaauaaua

SEQ ID NO: 2307408 - RNA, 15 nt, Yersinia pestis KIM
ucuugaauaauauuc

SEQ ID NO: 2307409 - RNA, 18 nt, Yersinia pestis KIM
ucuugaauaauauucaau

SEQ ID NO: 2307410 - RNA, 16 nt, Yersinia pestis KIM
ucuucucguaauuauu

SEQ ID NO: 2307411 - RNA, 10 nt, Yersinia pestis KIM
ucuucuggaa

SEQ ID NO: 2307412 - RNA, 21 nt, Yersinia pestis KIM
ucuucgaucaacgccucacaa

SEQ ID NO: 2307413 - RNA, 12 nt, Yersinia pestis KIM
ucuucgccgcau

SEQ ID NO: 2307414 - RNA, 12 nt, Yersinia pestis KIM
ucuucucacccc

SEQ ID NO: 2307415 - RNA, 15 nt, Yersinia pestis KIM
ucuucuaacacuuca

SEQ ID NO: 2307416 - RNA, 16 nt, Yersinia pestis KIM
ucuucuaacacuucau

SEQ ID NO: 2307417 - RNA, 15 nt, Yersinia pestis KIM
ucuucauugccuucu

SEQ ID NO: 2307418 - RNA, 14 nt, Yersinia pestis KIM
ucuucccuguccag

SEQ ID NO: 2307419 - RNA, 22 nt, Yersinia pestis KIM
ucuuccgcccguucaucaccca

SEQ ID NO: 2307420 - RNA, 12 nt, Yersinia pestis KIM
ucuucaaaagca

SEQ ID NO: 2307421 - RNA, 15 nt, Yersinia pestis KIM
ucuucagucaguguu

SEQ ID NO: 2307422 - RNA, 18 nt, Yersinia pestis KIM
ucuucauauacagaagag

SEQ ID NO: 2307423 - RNA, 14 nt, Yersinia pestis KIM
ucuuauugcuaucu

SEQ ID NO: 2307424 - RNA, 14 nt, Yersinia pestis KIM
ucuuauuacucauu

SEQ ID NO: 2307425 - RNA, 21 nt, Yersinia pestis KIM
ucuuacuguuuucauuauuuu

SEQ ID NO: 2307426 - RNA, 16 nt, Yersinia pestis KIM
ucuuaaugaaugaguu

SEQ ID NO: 2307427 - RNA, 19 nt, Yersinia pestis KIM
ucuuaaucuuuaauucauc

SEQ ID NO: 2307428 - RNA, 15 nt, Yersinia pestis KIM
ucuuaauucccagcc

SEQ ID NO: 2307429 - RNA, 20 nt, Yersinia pestis KIM
ucuuaaggacccguuuauaa

SEQ ID NO: 2307430 - RNA, 22 nt, Yersinia pestis KIM
ucuuaagcguacacuuucuacu

SEQ ID NO: 2307431 - RNA, 22 nt, Yersinia pestis KIM
ucuguuuuguuuccccuaauuc

SEQ ID NO: 2307432 - RNA, 22 nt, Yersinia pestis KIM
ucuguuuuacucguaacuaaga

SEQ ID NO: 2307433 - RNA, 16 nt, Yersinia pestis KIM
ucuguuuuugccaccu

SEQ ID NO: 2307434 - RNA, 20 nt, Yersinia pestis KIM
ucugguagucauauucaggc

SEQ ID NO: 2307435 - RNA, 15 nt, Yersinia pestis KIM
ucugguaguuuugca

SEQ ID NO: 2307436 - RNA, 18 nt, Yersinia pestis KIM
ucugguagccugcacuuc

SEQ ID NO: 2307437 - RNA, 16 nt, Yersinia pestis KIM
ucugcggauaaacacu

SEQ ID NO: 2307438 - RNA, 16 nt, Yersinia pestis KIM
ucugcugaaaaucaug

SEQ ID NO: 2307439 - RNA, 14 nt, Yersinia pestis KIM
ucugcugggauacu

SEQ ID NO: 2307440 - RNA, 14 nt, Yersinia pestis KIM
ucugcugcuuuagg

SEQ ID NO: 2307441 - RNA, 22 nt, Yersinia pestis KIM
ucuggccgaugcgacaauuucc

SEQ ID NO: 2307442 - RNA, 21 nt, Yersinia pestis KIM
ucugggcugaacgugccuguc

SEQ ID NO: 2307443 - RNA, 14 nt, Yersinia pestis KIM
ucuggguaagaaca

SEQ ID NO: 2307444 - RNA, 15 nt, Yersinia pestis KIM
ucuggguaagaacag

SEQ ID NO: 2307445 - RNA, 18 nt, Yersinia pestis KIM
ucuggguaagaacagaga

SEQ ID NO: 2307446 - RNA, 15 nt, Yersinia pestis KIM
ucugggugcugcucc

SEQ ID NO: 2307447 - RNA, 17 nt, Yersinia pestis KIM
ucuggguggcugaaaua

SEQ ID NO: 2307448 - RNA, 17 nt, Yersinia pestis KIM
ucugcaacaacuccuuc

SEQ ID NO: 2307449 - RNA, 16 nt, Yersinia pestis KIM
ucugccaguucuuuca

SEQ ID NO: 2307450 - RNA, 14 nt, Yersinia pestis KIM
ucugccaugguugg

SEQ ID NO: 2307451 - RNA, 17 nt, Yersinia pestis KIM
ucugauguguauauuuu

SEQ ID NO: 2307452 - RNA, 14 nt, Yersinia pestis KIM
ucugauuaccuucu

SEQ ID NO: 2307453 - RNA, 17 nt, Yersinia pestis KIM
ucugauuuuuuacuuuu

SEQ ID NO: 2307454 - RNA, 13 nt, Yersinia pestis KIM
ucugcgcccuuau

SEQ ID NO: 2307455 - RNA, 18 nt, Yersinia pestis KIM
ucugcgccaaaugucacc

SEQ ID NO: 2307456 - RNA, 20 nt, Yersinia pestis KIM
ucugccgucuaucugccaga

SEQ ID NO: 2307457 - RNA, 15 nt, Yersinia pestis KIM
ucugccuuaugaaua

SEQ ID NO: 2307458 - RNA, 19 nt, Yersinia pestis KIM
ucugccuauccucaccguu

SEQ ID NO: 2307459 - RNA, 19 nt, Yersinia pestis KIM
ucugccuauucucaccguu

SEQ ID NO: 2307460 - RNA, 16 nt, Yersinia pestis KIM
ucugcgaccugaucca

SEQ ID NO: 2307461 - RNA, 16 nt, Yersinia pestis KIM
ucucuucgccuuugau

SEQ ID NO: 2307462 - RNA, 19 nt, Yersinia pestis KIM
aaaugcguagagucaguga

SEQ ID NO: 2307463 - RNA, 16 nt, Yersinia pestis KIM
ucucuucagagauuca

SEQ ID NO: 2307464 - RNA, 18 nt, Yersinia pestis KIM
ucucuucagggcggcguu

SEQ ID NO: 2307465 - RNA, 13 nt, Yersinia pestis KIM
ucucuuacauaaa

SEQ ID NO: 2307466 - RNA, 17 nt, Yersinia pestis KIM
ucucuuacauaaagacc

SEQ ID NO: 2307467 - RNA, 23 nt, Yersinia pestis KIM
ucucuguaauggcgcacauuaca

SEQ ID NO: 2307468 - RNA, 15 nt, Yersinia pestis KIM
ucucuagauuaaccu

SEQ ID NO: 2307469 - RNA, 17 nt, Yersinia pestis KIM
ucgcauggcuaaaauua

SEQ ID NO: 2307470 - RNA, 14 nt, Yersinia pestis KIM
ucgcauugucaccc

SEQ ID NO: 2307471 - RNA, 19 nt, Yersinia pestis KIM
ucgcaucgucgcuguuacc

SEQ ID NO: 2307472 - RNA, 22 nt, Yersinia pestis KIM
ucgcaucuuccaaaggaaggga

SEQ ID NO: 2307473 - RNA, 15 nt, Yersinia pestis KIM
ucgcauccgggaacc

SEQ ID NO: 2307474 - RNA, 13 nt, Yersinia pestis KIM
ucugacuaacucu

SEQ ID NO: 2307475 - RNA, 17 nt, Yersinia pestis KIM
ucugacuaacucuucug

SEQ ID NO: 2307476 - RNA, 18 nt, Yersinia pestis KIM
ucugacucuguaaaaauc

SEQ ID NO: 2307477 - RNA, 19 nt, Yersinia pestis KIM
ucugaauagcgcugcauca

SEQ ID NO: 2307478 - RNA, 22 nt, Yersinia pestis KIM
ucugaauagcgcugcaucagca

SEQ ID NO: 2307479 - RNA, 23 nt, Yersinia pestis KIM
ucugaaugaauucuauaaugaug

SEQ ID NO: 2307480 - RNA, 15 nt, Yersinia pestis KIM
ucugauaucucuuua

SEQ ID NO: 2307481 - RNA, 19 nt, Yersinia pestis KIM
ucugauaucucuuuaucau

SEQ ID NO: 2307482 - RNA, 21 nt, Yersinia pestis KIM
ucugauagugauuuuuuucac

SEQ ID NO: 2307483 - RNA, 16 nt, Yersinia pestis KIM
ucugagccucaugaau

SEQ ID NO: 2307484 - RNA, 12 nt, Yersinia pestis KIM
ucugacuguuga

SEQ ID NO: 2307485 - RNA, 16 nt, Yersinia pestis KIM
ucugaaagugcccccu

SEQ ID NO: 2307486 - RNA, 22 nt, Yersinia pestis KIM
ucugaaaucuccuccggagagg

SEQ ID NO: 2307487 - RNA, 12 nt, Yersinia pestis KIM
ucugaauaagag

SEQ ID NO: 2307488 - RNA, 17 nt, Yersinia pestis KIM
ucugaagaugccaauca

SEQ ID NO: 2307489 - RNA, 21 nt, Yersinia pestis KIM
ucugaagcgacacuuauuggu

SEQ ID NO: 2307490 - RNA, 16 nt, Yersinia pestis KIM
ucugaagaugccaauc

SEQ ID NO: 2307491 - RNA, 14 nt, Yersinia pestis KIM
ucucuuucuccaac

SEQ ID NO: 2307492 - RNA, 20 nt, Yersinia pestis KIM
ucucuuucgggcaaaaaaau

SEQ ID NO: 2307493 - RNA, 22 nt, Yersinia pestis KIM
ucucuuugcgcugauaacuucc

SEQ ID NO: 2307494 - RNA, 23 nt, Yersinia pestis KIM
ugacgcuaaccaccgucaccaaa

SEQ ID NO: 2307495 - RNA, 16 nt, Yersinia pestis KIM
ugacgcucgcugcugg

SEQ ID NO: 2307496 - RNA, 13 nt, Yersinia pestis KIM
ugacgcugacauu

SEQ ID NO: 2307497 - RNA, 22 nt, Yersinia pestis KIM
ugacgcuaaccaccgucaccaa

SEQ ID NO: 2307498 - RNA, 12 nt, Yersinia pestis KIM
ugacgcgcugcu

SEQ ID NO: 2307499 - RNA, 16 nt, Yersinia pestis KIM
ugacgcgaucugaaac

SEQ ID NO: 2307500 - RNA, 21 nt, Yersinia pestis KIM
ugaccuauugauaaaaccacu

SEQ ID NO: 2307501 - RNA, 12 nt, Yersinia pestis KIM
ugacgaaugagc

SEQ ID NO: 2307502 - RNA, 14 nt, Yersinia pestis KIM
ugacgacaauauaa

SEQ ID NO: 2307503 - RNA, 21 nt, Yersinia pestis KIM
ugacgagaucauuggcuauca

SEQ ID NO: 2307504 - RNA, 20 nt, Yersinia pestis KIM
ugaauaacuucgcgaacaca

SEQ ID NO: 2307505 - RNA, 12 nt, Yersinia pestis KIM
ugaauaagacag

SEQ ID NO: 2307506 - RNA, 14 nt, Yersinia pestis KIM
ugaauaaauaugac

SEQ ID NO: 2307507 - RNA, 14 nt, Yersinia pestis KIM
ugaauaaaucaaag

SEQ ID NO: 2307508 - RNA, 13 nt, Yersinia pestis KIM
ugacauccgcuug

SEQ ID NO: 2307509 - RNA, 19 nt, Yersinia pestis KIM
ugacauccuuauuuuccgc

SEQ ID NO: 2307510 - RNA, 17 nt, Yersinia pestis KIM
ugacaugcuuaauuauu

SEQ ID NO: 2307511 - RNA, 14 nt, Yersinia pestis KIM
ugacauguuccagu

SEQ ID NO: 2307512 - RNA, 13 nt, Yersinia pestis KIM
ugacauugcccgc

SEQ ID NO: 2307513 - RNA, 18 nt, Yersinia pestis KIM
ugacauuucuuuuuaugu

SEQ ID NO: 2307514 - RNA, 20 nt, Yersinia pestis KIM
ugacauuucuuuuuauguua

SEQ ID NO: 2307515 - RNA, 18 nt, Yersinia pestis KIM
ugaccaaagcaguaaaca

SEQ ID NO: 2307516 - RNA, 15 nt, Yersinia pestis KIM
ugacauuuucuaucu

SEQ ID NO: 2307517 - RNA, 21 nt, Yersinia pestis KIM
ugaccacgcaucaauaauaac

SEQ ID NO: 2307518 - RNA, 20 nt, Yersinia pestis KIM
ugaccacgcaucaauaauaa

SEQ ID NO: 2307519 - RNA, 21 nt, Yersinia pestis KIM
ugaccacuugcugaugcccau

SEQ ID NO: 2307520 - RNA, 15 nt, Yersinia pestis KIM
ugaccagauaggcuu

SEQ ID NO: 2307521 - RNA, 17 nt, Yersinia pestis KIM
ugaccgaaccaccgcag

SEQ ID NO: 2307522 - RNA, 17 nt, Yersinia pestis KIM
ugacccgucagcguccu

SEQ ID NO: 2307523 - RNA, 13 nt, Yersinia pestis KIM
ugaccccaaauuu

SEQ ID NO: 2307524 - RNA, 16 nt, Yersinia pestis KIM
ugacgguuuucugaau

SEQ ID NO: 2307525 - RNA, 20 nt, Yersinia pestis KIM
ugacgguuucaacauccagu

SEQ ID NO: 2307526 - RNA, 17 nt, Yersinia pestis KIM
ugacggugcgauaaaug

SEQ ID NO: 2307527 - RNA, 20 nt, Yersinia pestis KIM
ugacgggucagcugacgcag

SEQ ID NO: 2307528 - RNA, 16 nt, Yersinia pestis KIM
ugacggguauauuuau

SEQ ID NO: 2307529 - RNA, 17 nt, Yersinia pestis KIM
ugacggcggcggaucaa

SEQ ID NO: 2307530 - RNA, 20 nt, Yersinia pestis KIM
ugacggcagcgagcacugcc

SEQ ID NO: 2307531 - RNA, 21 nt, Yersinia pestis KIM
ugacggaaaauuaacuuauug

SEQ ID NO: 2307532 - RNA, 15 nt, Yersinia pestis KIM
ugacgcugcaccgcu

SEQ ID NO: 2307533 - RNA, 15 nt, Yersinia pestis KIM
ugacguuacagaugg

SEQ ID NO: 2307534 - RNA, 17 nt, Yersinia pestis KIM
ugacgugcaggcccagc

SEQ ID NO: 2307535 - RNA, 21 nt, Yersinia pestis KIM
ugacuaaaauucaaacaaaua

SEQ ID NO: 2307536 - RNA, 23 nt, Yersinia pestis KIM
ugacuaaaauucaaacaaauauu

SEQ ID NO: 2307537 - RNA, 16 nt, Yersinia pestis KIM
ugacguugcagggggu

SEQ ID NO: 2307538 - RNA, 21 nt, Yersinia pestis KIM
ugacguucaggccugcaccgg

SEQ ID NO: 2307539 - RNA, 22 nt, Yersinia pestis KIM
ugacuaauuguuugcuuucaga

SEQ ID NO: 2307540 - RNA, 22 nt, Yersinia pestis KIM
ugacucacguauuuucauuuua

SEQ ID NO: 2307541 - RNA, 15 nt, Yersinia pestis KIM
ugacuauuuaaauac

SEQ ID NO: 2307542 - RNA, 19 nt, Yersinia pestis KIM
ugagaccuuccauaacuca

SEQ ID NO: 2307543 - RNA, 18 nt, Yersinia pestis KIM
ugagagugaaugugagug

SEQ ID NO: 2307544 - RNA, 17 nt, Yersinia pestis KIM
ugagacccgauuucacg

SEQ ID NO: 2307545 - RNA, 22 nt, Yersinia pestis KIM
ugagaaaggauuugaagacaac

SEQ ID NO: 2307546 - RNA, 15 nt, Yersinia pestis KIM
ugacucgaacugaaa

SEQ ID NO: 2307547 - RNA, 12 nt, Yersinia pestis KIM
ugacuugauuaa

SEQ ID NO: 2307548 - RNA, 16 nt, Yersinia pestis KIM
ugacuugcagguucaa

SEQ ID NO: 2307549 - RNA, 14 nt, Yersinia pestis KIM
ugacuucuuaucuu

SEQ ID NO: 2307550 - RNA, 19 nt, Yersinia pestis KIM
ugacugaccauaaaaggau

SEQ ID NO: 2307551 - RNA, 22 nt, Yersinia pestis KIM
ugacugaauggcuauuuacucu

SEQ ID NO: 2307552 - RNA, 15 nt, Yersinia pestis KIM
ugacuuacgucuuua

SEQ ID NO: 2307553 - RNA, 21 nt, Yersinia pestis KIM
ugacuuaaauaguucuucgca

SEQ ID NO: 2307554 - RNA, 17 nt, Yersinia pestis KIM
ugacuuacaauaaucug

SEQ ID NO: 2307555 - RNA, 15 nt, Yersinia pestis KIM
ugaucgccguacuug

SEQ ID NO: 2307556 - RNA, 17 nt, Yersinia pestis KIM
ugaucgccguacuuggu

SEQ ID NO: 2307557 - RNA, 19 nt, Yersinia pestis KIM
ugaucgccgcuaauuuucc

SEQ ID NO: 2307558 - RNA, 16 nt, Yersinia pestis KIM
ugaucugaguuucauu

SEQ ID NO: 2307559 - RNA, 17 nt, Yersinia pestis KIM
ugaucugauauuauugc

SEQ ID NO: 2307560 - RNA, 17 nt, Yersinia pestis KIM
ugaucgagcaucaccaa

SEQ ID NO: 2307561 - RNA, 13 nt, Yersinia pestis KIM
ugaugaaguuauu

SEQ ID NO: 2307562 - RNA, 20 nt, Yersinia pestis KIM
ugaugaaguuauuuuuauua

SEQ ID NO: 2307563 - RNA, 17 nt, Yersinia pestis KIM
ugaugacaaugcguuau

SEQ ID NO: 2307564 - RNA, 22 nt, Yersinia pestis KIM
ugaugacacccguuccuucagc

SEQ ID NO: 2307565 - RNA, 13 nt, Yersinia pestis KIM
ugaugacaaugcg

SEQ ID NO: 2307566 - RNA, 14 nt, Yersinia pestis KIM
ugaugacaaugcgu

SEQ ID NO: 2307567 - RNA, 22 nt, Yersinia pestis KIM
ugaucuugaauaauauucaaua

SEQ ID NO: 2307568 - RNA, 17 nt, Yersinia pestis KIM
ugaucuggcuuucucaa

SEQ ID NO: 2307569 - RNA, 12 nt, Yersinia pestis KIM
ugaucuggcuuu

SEQ ID NO: 2307570 - RNA, 15 nt, Yersinia pestis KIM
ugaucugccaguaaa

SEQ ID NO: 2307571 - RNA, 15 nt, Yersinia pestis KIM
ugaucugccagugcc

SEQ ID NO: 2307572 - RNA, 14 nt, Yersinia pestis KIM
ugaucaucuuuuuu

SEQ ID NO: 2307573 - RNA, 16 nt, Yersinia pestis KIM
ugaucaugauuucucg

SEQ ID NO: 2307574 - RNA, 12 nt, Yersinia pestis KIM
ugaucaucuuuu

SEQ ID NO: 2307575 - RNA, 13 nt, Yersinia pestis KIM
ugaucaucaaacu

SEQ ID NO: 2307576 - RNA, 13 nt, Yersinia pestis KIM
ugaucaucagcag

SEQ ID NO: 2307577 - RNA, 14 nt, Yersinia pestis KIM
ugaucaucaucaau

SEQ ID NO: 2307578 - RNA, 20 nt, Yersinia pestis KIM
ugaucauggcuugugcagca

SEQ ID NO: 2307579 - RNA, 19 nt, Yersinia pestis KIM
ugaucaguggcuuaauuga

SEQ ID NO: 2307580 - RNA, 20 nt, Yersinia pestis KIM
ugaucagcauuucggcuauu

SEQ ID NO: 2307581 - RNA, 15 nt, Yersinia pestis KIM
ugauaucucuuuauc

SEQ ID NO: 2307582 - RNA, 16 nt, Yersinia pestis KIM
ugauaucucuuuauca

SEQ ID NO: 2307583 - RNA, 15 nt, Yersinia pestis KIM
ugauacuaaauuuag

SEQ ID NO: 2307584 - RNA, 20 nt, Yersinia pestis KIM
ugauagaaaguugagcagca

SEQ ID NO: 2307585 - RNA, 20 nt, Yersinia pestis KIM
ugauagcaaacaaacaguaa

SEQ ID NO: 2307586 - RNA, 18 nt, Yersinia pestis KIM
ugauaccauugggucagu

SEQ ID NO: 2307587 - RNA, 17 nt, Yersinia pestis KIM
ugauaauaguucauuuu

SEQ ID NO: 2307588 - RNA, 21 nt, Yersinia pestis KIM
ugauaagucgucugauauuaa

SEQ ID NO: 2307589 - RNA, 19 nt, Yersinia pestis KIM
ugauaagugaauaaaucaa

SEQ ID NO: 2307590 - RNA, 13 nt, Yersinia pestis KIM
ugauaaguugaga

SEQ ID NO: 2307591 - RNA, 19 nt, Yersinia pestis KIM
ugauaagccauuuuuuaua

SEQ ID NO: 2307592 - RNA, 19 nt, Yersinia pestis KIM
ugauauaacgaauauucaa

SEQ ID NO: 2307593 - RNA, 15 nt, Yersinia pestis KIM
ugauauauagaaaua

SEQ ID NO: 2307594 - RNA, 17 nt, Yersinia pestis KIM
ugauaucagccagcucc

SEQ ID NO: 2307595 - RNA, 22 nt, Yersinia pestis KIM
ugauaucagccagcuccugcca

SEQ ID NO: 2307596 - RNA, 19 nt, Yersinia pestis KIM
ugauagugauuuuuuucac

SEQ ID NO: 2307597 - RNA, 21 nt, Yersinia pestis KIM
ugauaguuuuuuuuauggcug

SEQ ID NO: 2307598 - RNA, 14 nt, Yersinia pestis KIM
ugauaggucauaua

SEQ ID NO: 2307599 - RNA, 18 nt, Yersinia pestis KIM
ugagcguucaaaaucaaa

SEQ ID NO: 2307600 - RNA, 14 nt, Yersinia pestis KIM
ugagcuauuccagu

SEQ ID NO: 2307601 - RNA, 16 nt, Yersinia pestis KIM
ugagcugaauagccuu

SEQ ID NO: 2307602 - RNA, 17 nt, Yersinia pestis KIM
ugagcucaucuuauuuc

SEQ ID NO: 2307603 - RNA, 15 nt, Yersinia pestis KIM
ugaggauaggcagag

SEQ ID NO: 2307604 - RNA, 15 nt, Yersinia pestis KIM
ugaggauaggcagaa

SEQ ID NO: 2307605 - RNA, 17 nt, Yersinia pestis KIM
ugaggauaggcagaaga

SEQ ID NO: 2307606 - RNA, 18 nt, Yersinia pestis KIM
ugagcgguugaaaaguuu

SEQ ID NO: 2307607 - RNA, 20 nt, Yersinia pestis KIM
ugagcaagggcagcuaaccc

SEQ ID NO: 2307608 - RNA, 16 nt, Yersinia pestis KIM
ugagauuuagaugugc

SEQ ID NO: 2307609 - RNA, 17 nt, Yersinia pestis KIM
ugaguuaucuguuucaa

SEQ ID NO: 2307610 - RNA, 12 nt, Yersinia pestis KIM
ugaguuccagcc

SEQ ID NO: 2307611 - RNA, 14 nt, Yersinia pestis KIM
ugaguuccagcccc

SEQ ID NO: 2307612 - RNA, 18 nt, Yersinia pestis KIM
ugaguguuuuucucagca

SEQ ID NO: 2307613 - RNA, 20 nt, Yersinia pestis KIM
ugaguguuuuucucagcaua

SEQ ID NO: 2307614 - RNA, 16 nt, Yersinia pestis KIM
ugauaaacaauaaaca

SEQ ID NO: 2307615 - RNA, 21 nt, Yersinia pestis KIM
ugauaaacccuacagcaaaca

SEQ ID NO: 2307616 - RNA, 17 nt, Yersinia pestis KIM
ugauaaaaguaauuuau

SEQ ID NO: 2307617 - RNA, 19 nt, Yersinia pestis KIM
ugauaaaacacucuuuuug

SEQ ID NO: 2307618 - RNA, 17 nt, Yersinia pestis KIM
ugaguuuucgauaacca

SEQ ID NO: 2307619 - RNA, 23 nt, Yersinia pestis KIM
ugaggguaagugaauaccgcuaa

SEQ ID NO: 2307620 - RNA, 19 nt, Yersinia pestis KIM
ugagggcguucucaggaac

SEQ ID NO: 2307621 - RNA, 22 nt, Yersinia pestis KIM
ugaggguugucagcagucugaa

SEQ ID NO: 2307622 - RNA, 18 nt, Yersinia pestis KIM
ugagggacagagagauaa

SEQ ID NO: 2307623 - RNA, 16 nt, Yersinia pestis KIM
ugaggcucuucugggc

SEQ ID NO: 2307624 - RNA, 21 nt, Yersinia pestis KIM
ugagugaaaucuccuguggca

SEQ ID NO: 2307625 - RNA, 16 nt, Yersinia pestis KIM
ugaggugaacugaacu

SEQ ID NO: 2307626 - RNA, 11 nt, Yersinia pestis KIM
ugaggucagcg

SEQ ID NO: 2307627 - RNA, 18 nt, Yersinia pestis KIM
ugagucugcggauaaaca

SEQ ID NO: 2307628 - RNA, 20 nt, Yersinia pestis KIM
ugagucugcggauaaacacu

SEQ ID NO: 2307629 - RNA, 12 nt, Yersinia pestis KIM
ugcaguaaaaau

SEQ ID NO: 2307630 - RNA, 17 nt, Yersinia pestis KIM
ugcagguuuugccagau

SEQ ID NO: 2307631 - RNA, 20 nt, Yersinia pestis KIM
ugcaggugugcggauggcug

SEQ ID NO: 2307632 - RNA, 13 nt, Yersinia pestis KIM
ugcaguaaccagu

SEQ ID NO: 2307633 - RNA, 23 nt, Yersinia pestis KIM
ugcaguaaccccuucgagcaccg

SEQ ID NO: 2307634 - RNA, 14 nt, Yersinia pestis KIM
ugcaguaaauaguc

SEQ ID NO: 2307635 - RNA, 17 nt, Yersinia pestis KIM
ugcaguaucccuggcuc

SEQ ID NO: 2307636 - RNA, 22 nt, Yersinia pestis KIM
ugcagucagcacuccguuacca

SEQ ID NO: 2307637 - RNA, 14 nt, Yersinia pestis KIM
ugcaguuaaggcug

SEQ ID NO: 2307638 - RNA, 18 nt, Yersinia pestis KIM
ugcaguuaaggcuggcug

SEQ ID NO: 2307639 - RNA, 15 nt, Yersinia pestis KIM
ugcauaauggacgaa

SEQ ID NO: 2307640 - RNA, 20 nt, Yersinia pestis KIM
ugcauacucacuuaagccac

SEQ ID NO: 2307641 - RNA, 18 nt, Yersinia pestis KIM
ugcauacucaggcccuga

SEQ ID NO: 2307642 - RNA, 19 nt, Yersinia pestis KIM
ugcauagcgugauuuuuau

SEQ ID NO: 2307643 - RNA, 19 nt, Yersinia pestis KIM
ugcaguuucuaccgcuuca

SEQ ID NO: 2307644 - RNA, 22 nt, Yersinia pestis KIM
ugcauuaucuuuaauuuuuccc

SEQ ID NO: 2307645 - RNA, 21 nt, Yersinia pestis KIM
ugcauuaucuuuaauuuuucc

SEQ ID NO: 2307646 - RNA, 13 nt, Yersinia pestis KIM
ugcauucugcugg

SEQ ID NO: 2307647 - RNA, 13 nt, Yersinia pestis KIM
ugcauuggaaaaa

SEQ ID NO: 2307648 - RNA, 19 nt, Yersinia pestis KIM
ugcaucaucacauucaaac

SEQ ID NO: 2307649 - RNA, 17 nt, Yersinia pestis KIM
ugcaucaucacauucaa

SEQ ID NO: 2307650 - RNA, 15 nt, Yersinia pestis KIM
ugcaucucugcauca

SEQ ID NO: 2307651 - RNA, 19 nt, Yersinia pestis KIM
ugcaucguggucaccgcca

SEQ ID NO: 2307652 - RNA, 20 nt, Yersinia pestis KIM
ugccaaugccucuucaauac

SEQ ID NO: 2307653 - RNA, 21 nt, Yersinia pestis KIM
ugccaauugacgccacuuauc

SEQ ID NO: 2307654 - RNA, 22 nt, Yersinia pestis KIM
ugccaauugaguaacugauuaa

SEQ ID NO: 2307655 - RNA, 18 nt, Yersinia pestis KIM
ugccaauuuaacuuucau

SEQ ID NO: 2307656 - RNA, 13 nt, Yersinia pestis KIM
ugccaauauugcc

SEQ ID NO: 2307657 - RNA, 22 nt, Yersinia pestis KIM
ugccaauauguuagcagcacaa

SEQ ID NO: 2307658 - RNA, 19 nt, Yersinia pestis KIM
ugcauuugauacuaaauuu

SEQ ID NO: 2307659 - RNA, 19 nt, Yersinia pestis KIM
ugccaauccccaccaaaag

SEQ ID NO: 2307660 - RNA, 17 nt, Yersinia pestis KIM
ugccaaucccgcagcau

SEQ ID NO: 2307661 - RNA, 17 nt, Yersinia pestis KIM
ugcauuuaugaugcauu

SEQ ID NO: 2307662 - RNA, 20 nt, Yersinia pestis KIM
ugcacagguaguaagcaugc

SEQ ID NO: 2307663 - RNA, 22 nt, Yersinia pestis KIM
ugcacaguaggcugaaggccug

SEQ ID NO: 2307664 - RNA, 15 nt, Yersinia pestis KIM
ugcacaucauuuauu

SEQ ID NO: 2307665 - RNA, 17 nt, Yersinia pestis KIM
ugcaccaauaacugccc

SEQ ID NO: 2307666 - RNA, 22 nt, Yersinia pestis KIM
ugcacacgggcgguaaucugcg

SEQ ID NO: 2307667 - RNA, 19 nt, Yersinia pestis KIM
ugcaccauauucccagcca

SEQ ID NO: 2307668 - RNA, 20 nt, Yersinia pestis KIM
ugcaccucugcugaugucag

SEQ ID NO: 2307669 - RNA, 19 nt, Yersinia pestis KIM
ugcacgucaguuaaauaug

SEQ ID NO: 2307670 - RNA, 17 nt, Yersinia pestis KIM
ugcagauaccacaucaa

SEQ ID NO: 2307671 - RNA, 17 nt, Yersinia pestis KIM
ugcagaucggcauuauu

SEQ ID NO: 2307672 - RNA, 23 nt, Yersinia pestis KIM
ugcagauuuuugcuuuccacgcc

SEQ ID NO: 2307673 - RNA, 20 nt, Yersinia pestis KIM
ugcagcaacaggguauuggc

SEQ ID NO: 2307674 - RNA, 20 nt, Yersinia pestis KIM
ugcagcaacaauaacuuugg

SEQ ID NO: 2307675 - RNA, 19 nt, Yersinia pestis KIM
ugcagaucggcauuauuau

SEQ ID NO: 2307676 - RNA, 14 nt, Yersinia pestis KIM
ugcagcuaaacacg

SEQ ID NO: 2307677 - RNA, 14 nt, Yersinia pestis KIM
ugcaauaacaccag

SEQ ID NO: 2307678 - RNA, 18 nt, Yersinia pestis KIM
ugcaauaacaccagcagg

SEQ ID NO: 2307679 - RNA, 16 nt, Yersinia pestis KIM
ugcaauagcuagcccc

SEQ ID NO: 2307680 - RNA, 13 nt, Yersinia pestis KIM
ugcaauagcucau

SEQ ID NO: 2307681 - RNA, 18 nt, Yersinia pestis KIM
ugcaauagcucauuuuaa

SEQ ID NO: 2307682 - RNA, 22 nt, Yersinia pestis KIM
ugcaauagcucauuuuaaauau

SEQ ID NO: 2307683 - RNA, 17 nt, Yersinia pestis KIM
ugcaaucaagggcgaua

SEQ ID NO: 2307684 - RNA, 16 nt, Yersinia pestis KIM
ugcaaucuaacuaaua

SEQ ID NO: 2307685 - RNA, 17 nt, Yersinia pestis KIM
ugcaaucuguuauaaaa

SEQ ID NO: 2307686 - RNA, 21 nt, Yersinia pestis KIM
ugcaaucuguuauaaaaaagc

SEQ ID NO: 2307687 - RNA, 21 nt, Yersinia pestis KIM
ugcaauggcuggcaaggcacg

SEQ ID NO: 2307688 - RNA, 14 nt, Yersinia pestis KIM
ugcaaugcccagag

SEQ ID NO: 2307689 - RNA, 13 nt, Yersinia pestis KIM
ugcaaugccauga

SEQ ID NO: 2307690 - RNA, 19 nt, Yersinia pestis KIM
ugcaaugaaggcucauagu

SEQ ID NO: 2307691 - RNA, 23 nt, Yersinia pestis KIM
ugcaauuaauuggcccauaacaa

SEQ ID NO: 2307692 - RNA, 15 nt, Yersinia pestis KIM
ugcaauuauaagcac

SEQ ID NO: 2307693 - RNA, 14 nt, Yersinia pestis KIM
ugcaacuucagcca

SEQ ID NO: 2307694 - RNA, 23 nt, Yersinia pestis KIM
ugcaacuuccuugauuuucauuu

SEQ ID NO: 2307695 - RNA, 17 nt, Yersinia pestis KIM
ugcaagccguaauucag

SEQ ID NO: 2307696 - RNA, 14 nt, Yersinia pestis KIM
ugcaagcguuacuc

SEQ ID NO: 2307697 - RNA, 20 nt, Yersinia pestis KIM
ugcaacaacgccucaucuuc

SEQ ID NO: 2307698 - RNA, 13 nt, Yersinia pestis KIM
ugcaacaacuccu

SEQ ID NO: 2307699 - RNA, 23 nt, Yersinia pestis KIM
ugcaaauuuaugcgcuuucucga

SEQ ID NO: 2307700 - RNA, 21 nt, Yersinia pestis KIM
ugcaaauuuaugcgcuuucuc

SEQ ID NO: 2307701 - RNA, 14 nt, Yersinia pestis KIM
ugcaaauuuaucca

SEQ ID NO: 2307702 - RNA, 22 nt, Yersinia pestis KIM
ugcaaaugggugugaacaguga

SEQ ID NO: 2307703 - RNA, 14 nt, Yersinia pestis KIM
ugcaaccaacacca

SEQ ID NO: 2307704 - RNA, 23 nt, Yersinia pestis KIM
ugcaacagauaauuggcaauaau

SEQ ID NO: 2307705 - RNA, 16 nt, Yersinia pestis KIM
ugcaaaaucguuaccg

SEQ ID NO: 2307706 - RNA, 14 nt, Yersinia pestis KIM
ugcaaaaucagcau

SEQ ID NO: 2307707 - RNA, 13 nt, Yersinia pestis KIM
ugcaaaaccccaa

SEQ ID NO: 2307708 - RNA, 23 nt, Yersinia pestis KIM
ugcaaauaauaacgccugcaauu

SEQ ID NO: 2307709 - RNA, 16 nt, Yersinia pestis KIM
ugauuuuuaucaucau

SEQ ID NO: 2307710 - RNA, 22 nt, Yersinia pestis KIM
ugcaaaaaaagacacuaaccag

SEQ ID NO: 2307711 - RNA, 16 nt, Yersinia pestis KIM
ugcaaaaaaagacacu

SEQ ID NO: 2307712 - RNA, 16 nt, Yersinia pestis KIM
ugauuuuuuacuuuuu

SEQ ID NO: 2307713 - RNA, 19 nt, Yersinia pestis KIM
ugauucgggugagugagcg

SEQ ID NO: 2307714 - RNA, 15 nt, Yersinia pestis KIM
ugauucgucugccau

SEQ ID NO: 2307715 - RNA, 14 nt, Yersinia pestis KIM
ugauugcaaaacau

SEQ ID NO: 2307716 - RNA, 16 nt, Yersinia pestis KIM
ugauugcaaaacauag

SEQ ID NO: 2307717 - RNA, 18 nt, Yersinia pestis KIM
ugauugcagaccaaucaa

SEQ ID NO: 2307718 - RNA, 16 nt, Yersinia pestis KIM
ugauuuaauuucugga

SEQ ID NO: 2307719 - RNA, 17 nt, Yersinia pestis KIM
ugauuguugugcauaua

SEQ ID NO: 2307720 - RNA, 18 nt, Yersinia pestis KIM
ugauuccguauuauuuac

SEQ ID NO: 2307721 - RNA, 22 nt, Yersinia pestis KIM
ugaugacgccguacaaauauaa

SEQ ID NO: 2307722 - RNA, 21 nt, Yersinia pestis KIM
ugaugaugagaaguaaaacgu

SEQ ID NO: 2307723 - RNA, 14 nt, Yersinia pestis KIM
ugaugaucaugcuc

SEQ ID NO: 2307724 - RNA, 15 nt, Yersinia pestis KIM
ugaugauaucaccuu

SEQ ID NO: 2307725 - RNA, 14 nt, Yersinia pestis KIM
ugaugauauuuauc

SEQ ID NO: 2307726 - RNA, 15 nt, Yersinia pestis KIM
ugaugaguaacauaa

SEQ ID NO: 2307727 - RNA, 14 nt, Yersinia pestis KIM
ugaugaguaauuuc

SEQ ID NO: 2307728 - RNA, 21 nt, Yersinia pestis KIM
ugaugaguaugcaacagugau

SEQ ID NO: 2307729 - RNA, 18 nt, Yersinia pestis KIM
ucauugagcauaucaauc

SEQ ID NO: 2307730 - RNA, 20 nt, Yersinia pestis KIM
ucauugaggguugucagcag

SEQ ID NO: 2307731 - RNA, 14 nt, Yersinia pestis KIM
ucauuccgccuguu

SEQ ID NO: 2307732 - RNA, 17 nt, Yersinia pestis KIM
ucauuccccaucgccaa

SEQ ID NO: 2307733 - RNA, 11 nt, Yersinia pestis KIM
ucauuaucaug

SEQ ID NO: 2307734 - RNA, 15 nt, Yersinia pestis KIM
ucauucaugaggcuc

SEQ ID NO: 2307735 - RNA, 15 nt, Yersinia pestis KIM
ucauucaugaggcuu

SEQ ID NO: 2307736 - RNA, 17 nt, Yersinia pestis KIM
ucauucauuuuaaaaaa

SEQ ID NO: 2307737 - RNA, 17 nt, Yersinia pestis KIM
ucauucagguuuacgcu

SEQ ID NO: 2307738 - RNA, 20 nt, Yersinia pestis KIM
ucauuagccguuguucaccc

SEQ ID NO: 2307739 - RNA, 21 nt, Yersinia pestis KIM
ucauuagccagccaauggcca

SEQ ID NO: 2307740 - RNA, 19 nt, Yersinia pestis KIM
ucauuauagaauucauuca

SEQ ID NO: 2307741 - RNA, 17 nt, Yersinia pestis KIM
ucauuaaaaaauaauuu

SEQ ID NO: 2307742 - RNA, 21 nt, Yersinia pestis KIM
ucauguggaacggcauugagc

SEQ ID NO: 2307743 - RNA, 17 nt, Yersinia pestis KIM
ucauguucgcacugcuc

SEQ ID NO: 2307744 - RNA, 13 nt, Yersinia pestis KIM
ucauguugaccaa

SEQ ID NO: 2307745 - RNA, 13 nt, Yersinia pestis KIM
ucauguugcaaca

SEQ ID NO: 2307746 - RNA, 15 nt, Yersinia pestis KIM
ucaugugagauaaca

SEQ ID NO: 2307747 - RNA, 15 nt, Yersinia pestis KIM
ucaguuguucaccua

SEQ ID NO: 2307748 - RNA, 15 nt, Yersinia pestis KIM
ucaguuuacaugauu

SEQ ID NO: 2307749 - RNA, 21 nt, Yersinia pestis KIM
ucaguuuagcuaaauuuaaga

SEQ ID NO: 2307750 - RNA, 23 nt, Yersinia pestis KIM
ucaguguuucuauuuucagcaua

SEQ ID NO: 2307751 - RNA, 16 nt, Yersinia pestis KIM
ucaguguuagccccuc

SEQ ID NO: 2307752 - RNA, 20 nt, Yersinia pestis KIM
ucaguucgguugccaaaauu

SEQ ID NO: 2307753 - RNA, 19 nt, Yersinia pestis KIM
ucauuuuccugcauauuau

SEQ ID NO: 2307754 - RNA, 14 nt, Yersinia pestis KIM
ucauuuucuguuga

SEQ ID NO: 2307755 - RNA, 22 nt, Yersinia pestis KIM
uccaaagcaccaacuaagcaga

SEQ ID NO: 2307756 - RNA, 13 nt, Yersinia pestis KIM
uccaacaacugcc

SEQ ID NO: 2307757 - RNA, 20 nt, Yersinia pestis KIM
ucauuugaccuccguaggcc

SEQ ID NO: 2307758 - RNA, 16 nt, Yersinia pestis KIM
ucauuuuccugcauau

SEQ ID NO: 2307759 - RNA, 13 nt, Yersinia pestis KIM
ucauugcccccuu

SEQ ID NO: 2307760 - RNA, 22 nt, Yersinia pestis KIM
ucauugccacgacgcagcucca

SEQ ID NO: 2307761 - RNA, 14 nt, Yersinia pestis KIM
uccacgguauuagu

SEQ ID NO: 2307762 - RNA, 22 nt, Yersinia pestis KIM
uccacuacuuauuuccgcgccg

SEQ ID NO: 2307763 - RNA, 15 nt, Yersinia pestis KIM
uccacgggcucaugc

SEQ ID NO: 2307764 - RNA, 21 nt, Yersinia pestis KIM
uccacgcuuuaagcuaauucu

SEQ ID NO: 2307765 - RNA, 22 nt, Yersinia pestis KIM
uccacgcugaaacuuuucaguu

SEQ ID NO: 2307766 - RNA, 17 nt, Yersinia pestis KIM
uccacgcccaacucuuu

SEQ ID NO: 2307767 - RNA, 21 nt, Yersinia pestis KIM
uccacacccucucuuuccagc

SEQ ID NO: 2307768 - RNA, 15 nt, Yersinia pestis KIM
uccacaccaacagac

SEQ ID NO: 2307769 - RNA, 20 nt, Yersinia pestis KIM
uccacacagcauucugcuuc

SEQ ID NO: 2307770 - RNA, 16 nt, Yersinia pestis KIM
uccacacaguauucug

SEQ ID NO: 2307771 - RNA, 20 nt, Yersinia pestis KIM
uccacacaguauucugcuuc

SEQ ID NO: 2307772 - RNA, 18 nt, Yersinia pestis KIM
uccacaagcguucgagga

SEQ ID NO: 2307773 - RNA, 17 nt, Yersinia pestis KIM
uccaauucauaauagcg

SEQ ID NO: 2307774 - RNA, 15 nt, Yersinia pestis KIM
uccaacucaccuaaa

SEQ ID NO: 2307775 - RNA, 23 nt, Yersinia pestis KIM
uccaacuaaacagggcagaaaau

SEQ ID NO: 2307776 - RNA, 16 nt, Yersinia pestis KIM
uccaacguaaacauug

SEQ ID NO: 2307777 - RNA, 17 nt, Yersinia pestis KIM
uccaacgcacugguugc

SEQ ID NO: 2307778 - RNA, 11 nt, Yersinia pestis KIM
uccaaccaacc

SEQ ID NO: 2307779 - RNA, 19 nt, Yersinia pestis KIM
uccaaccaaccaugcugcc

SEQ ID NO: 2307780 - RNA, 20 nt, Yersinia pestis KIM
uccaaccaaccaugcugccc

SEQ ID NO: 2307781 - RNA, 14 nt, Yersinia pestis KIM
uccaacugacgcca

SEQ ID NO: 2307782 - RNA, 22 nt, Yersinia pestis KIM
uccaacuucgcacgcccaucaa

SEQ ID NO: 2307783 - RNA, 14 nt, Yersinia pestis KIM
uccaacuucuucca

SEQ ID NO: 2307784 - RNA, 18 nt, Yersinia pestis KIM
uccaacuucuuccauuaa

SEQ ID NO: 2307785 - RNA, 23 nt, Yersinia pestis KIM
uccaagcacacugguugaaaccu

SEQ ID NO: 2307786 - RNA, 22 nt, Yersinia pestis KIM
uccaaugacuauucccuuguuu

SEQ ID NO: 2307787 - RNA, 13 nt, Yersinia pestis KIM
uccaauauucccu

SEQ ID NO: 2307788 - RNA, 15 nt, Yersinia pestis KIM
uccagcggcaaauag

SEQ ID NO: 2307789 - RNA, 20 nt, Yersinia pestis KIM
uccagcgcggcgaaacugac

SEQ ID NO: 2307790 - RNA, 13 nt, Yersinia pestis KIM
uccagcguaaaca

SEQ ID NO: 2307791 - RNA, 22 nt, Yersinia pestis KIM
uccaggauauucacguuuuucc

SEQ ID NO: 2307792 - RNA, 13 nt, Yersinia pestis KIM
uccagaacaccaa

SEQ ID NO: 2307793 - RNA, 20 nt, Yersinia pestis KIM
uccagaacaauaccgccaau

SEQ ID NO: 2307794 - RNA, 21 nt, Yersinia pestis KIM
uccacuuuucagauagcccau

SEQ ID NO: 2307795 - RNA, 21 nt, Yersinia pestis KIM
uccacuuuaccgauuucaggu

SEQ ID NO: 2307796 - RNA, 15 nt, Yersinia pestis KIM
uccagcaucgcugag

SEQ ID NO: 2307797 - RNA, 15 nt, Yersinia pestis KIM
uccaggucaaugucu

SEQ ID NO: 2307798 - RNA, 21 nt, Yersinia pestis KIM
uccaggcuaugcuuaauuugg

SEQ ID NO: 2307799 - RNA, 20 nt, Yersinia pestis KIM
uccagguuuuggcuaccuuc

SEQ ID NO: 2307800 - RNA, 21 nt, Yersinia pestis KIM
uccagguuuuggcuaccuucg

SEQ ID NO: 2307801 - RNA, 22 nt, Yersinia pestis KIM
uccagugauaaguuggaggcgu

SEQ ID NO: 2307802 - RNA, 17 nt, Yersinia pestis KIM
uccagugagcaauccaa

SEQ ID NO: 2307803 - RNA, 13 nt, Yersinia pestis KIM
uccaguaaaaaaa

SEQ ID NO: 2307804 - RNA, 17 nt, Yersinia pestis KIM
uccaguaaaagaauaaa

SEQ ID NO: 2307805 - RNA, 18 nt, Yersinia pestis KIM
uccaguaaaagaauaaau

SEQ ID NO: 2307806 - RNA, 15 nt, Yersinia pestis KIM
uccauauagccccaa

SEQ ID NO: 2307807 - RNA, 22 nt, Yersinia pestis KIM
uccauagugauuauuuaaacaa

SEQ ID NO: 2307808 - RNA, 15 nt, Yersinia pestis KIM
uccauagcuaaaaua

SEQ ID NO: 2307809 - RNA, 15 nt, Yersinia pestis KIM
uccauagccaggcag

SEQ ID NO: 2307810 - RNA, 18 nt, Yersinia pestis KIM
uccauagauacacuccau

SEQ ID NO: 2307811 - RNA, 13 nt, Yersinia pestis KIM
uccauggcugaga

SEQ ID NO: 2307812 - RNA, 23 nt, Yersinia pestis KIM
uccaugggccucgcuucugcgag

SEQ ID NO: 2307813 - RNA, 23 nt, Yersinia pestis KIM
uccaugcccagcguuggcagaaa

SEQ ID NO: 2307814 - RNA, 13 nt, Yersinia pestis KIM
uccauguaggcuc

SEQ ID NO: 2307815 - RNA, 20 nt, Yersinia pestis KIM
uccauuagcguauuaaacca

SEQ ID NO: 2307816 - RNA, 22 nt, Yersinia pestis KIM
uccaucagccuaaauucuccuu

SEQ ID NO: 2307817 - RNA, 21 nt, Yersinia pestis KIM
uccaucgccacuucuaacaag

SEQ ID NO: 2307818 - RNA, 16 nt, Yersinia pestis KIM
uccaugacacauauuu

SEQ ID NO: 2307819 - RNA, 22 nt, Yersinia pestis KIM
uccaugacacauauuucaggcu

SEQ ID NO: 2307820 - RNA, 20 nt, Yersinia pestis KIM
uccaucgggaugaccuuccc

SEQ ID NO: 2307821 - RNA, 16 nt, Yersinia pestis KIM
ucccaaaggugcgcca

SEQ ID NO: 2307822 - RNA, 12 nt, Yersinia pestis KIM
ucccaaagugac

SEQ ID NO: 2307823 - RNA, 15 nt, Yersinia pestis KIM
ucccaacggcagaag

SEQ ID NO: 2307824 - RNA, 14 nt, Yersinia pestis KIM
ucccaacugaaacg

SEQ ID NO: 2307825 - RNA, 19 nt, Yersinia pestis KIM
ucccaagaaaagcaccgca

SEQ ID NO: 2307826 - RNA, 21 nt, Yersinia pestis KIM
ucccaagaaaagcaccgcagu

SEQ ID NO: 2307827 - RNA, 17 nt, Yersinia pestis KIM
ucccaagaaaagcaccg

SEQ ID NO: 2307828 - RNA, 14 nt, Yersinia pestis KIM
ucccaaugaauauu

SEQ ID NO: 2307829 - RNA, 23 nt, Yersinia pestis KIM
ucccaaggguauaacucaucagu

SEQ ID NO: 2307830 - RNA, 17 nt, Yersinia pestis KIM
uccauuucaaucacugc

SEQ ID NO: 2307831 - RNA, 13 nt, Yersinia pestis KIM
uccauuucugguu

SEQ ID NO: 2307832 - RNA, 19 nt, Yersinia pestis KIM
uccauuuaagccaauaaua

SEQ ID NO: 2307833 - RNA, 20 nt, Yersinia pestis KIM
uccauuuaagccaauaauau

SEQ ID NO: 2307834 - RNA, 12 nt, Yersinia pestis KIM
ucccaaaauaug

SEQ ID NO: 2307835 - RNA, 20 nt, Yersinia pestis KIM
uccauuccguuauuaaacag

SEQ ID NO: 2307836 - RNA, 23 nt, Yersinia pestis KIM
uccgccugaccgacgagggcuuc

SEQ ID NO: 2307837 - RNA, 17 nt, Yersinia pestis KIM
uccgccugagauuaacc

SEQ ID NO: 2307838 - RNA, 21 nt, Yersinia pestis KIM
uccgccugcguuguuuuucaa

SEQ ID NO: 2307839 - RNA, 17 nt, Yersinia pestis KIM
uccgccuguuuucaggc

SEQ ID NO: 2307840 - RNA, 15 nt, Yersinia pestis KIM
uccgcccucuugcug

SEQ ID NO: 2307841 - RNA, 17 nt, Yersinia pestis KIM
uccgccgccaacaguga

SEQ ID NO: 2307842 - RNA, 14 nt, Yersinia pestis KIM
uccgccccggugac

SEQ ID NO: 2307843 - RNA, 19 nt, Yersinia pestis KIM
uccgcuccugauuuaaccu

SEQ ID NO: 2307844 - RNA, 15 nt, Yersinia pestis KIM
uccgcuauuuuccac

SEQ ID NO: 2307845 - RNA, 21 nt, Yersinia pestis KIM
uccgcgccauaaaagauaacg

SEQ ID NO: 2307846 - RNA, 15 nt, Yersinia pestis KIM
uccgaguuauugaua

SEQ ID NO: 2307847 - RNA, 18 nt, Yersinia pestis KIM
uccgauaaacuucacaau

SEQ ID NO: 2307848 - RNA, 16 nt, Yersinia pestis KIM
uccgcaccgcuagcgg

SEQ ID NO: 2307849 - RNA, 20 nt, Yersinia pestis KIM
uccgccaguugcucacggug

SEQ ID NO: 2307850 - RNA, 13 nt, Yersinia pestis KIM
uccgcaggaagca

SEQ ID NO: 2307851 - RNA, 17 nt, Yersinia pestis KIM
uccgcaccuuugucauu

SEQ ID NO: 2307852 - RNA, 15 nt, Yersinia pestis KIM
ucccuaccaaauguu

SEQ ID NO: 2307853 - RNA, 13 nt, Yersinia pestis KIM
ucccuaaagccau

SEQ ID NO: 2307854 - RNA, 14 nt, Yersinia pestis KIM
ucccuaaaaucauu

SEQ ID NO: 2307855 - RNA, 20 nt, Yersinia pestis KIM
ucccucaauagcuaauaauu

SEQ ID NO: 2307856 - RNA, 19 nt, Yersinia pestis KIM
ucccucaccgccauuuacu

SEQ ID NO: 2307857 - RNA, 12 nt, Yersinia pestis KIM
ucccucagugag

SEQ ID NO: 2307858 - RNA, 13 nt, Yersinia pestis KIM
ucccuauucaaaa

SEQ ID NO: 2307859 - RNA, 21 nt, Yersinia pestis KIM
ucccucuguccccgcuauuau

SEQ ID NO: 2307860 - RNA, 15 nt, Yersinia pestis KIM
ucccugacucccuga

SEQ ID NO: 2307861 - RNA, 16 nt, Yersinia pestis KIM
ucccugacucccugac

SEQ ID NO: 2307862 - RNA, 20 nt, Yersinia pestis KIM
ucccugacucccugacuccc

SEQ ID NO: 2307863 - RNA, 18 nt, Yersinia pestis KIM
ucccuccccacuggguaa

SEQ ID NO: 2307864 - RNA, 20 nt, Yersinia pestis KIM
ucccucauuuauauucuuag

SEQ ID NO: 2307865 - RNA, 18 nt, Yersinia pestis KIM
ucccugauggggcaauca

SEQ ID NO: 2307866 - RNA, 21 nt, Yersinia pestis KIM
ucccugcguugcgaaauaaau

SEQ ID NO: 2307867 - RNA, 13 nt, Yersinia pestis KIM
ucccuucugaaac

SEQ ID NO: 2307868 - RNA, 19 nt, Yersinia pestis KIM
ucccuucgcccuguaaagc

SEQ ID NO: 2307869 - RNA, 15 nt, Yersinia pestis KIM
aaaucugauacugaa

SEQ ID NO: 2307870 - RNA, 19 nt, Yersinia pestis KIM
aaaucuggaauaggggaaa

SEQ ID NO: 2307871 - RNA, 14 nt, Yersinia pestis KIM
aaaucugcuucucc

SEQ ID NO: 2307872 - RNA, 17 nt, Yersinia pestis KIM
aaaucugcucccggcgc

SEQ ID NO: 2307873 - RNA, 18 nt, Yersinia pestis KIM
aaaucuggauaaugucgu

SEQ ID NO: 2307874 - RNA, 18 nt, Yersinia pestis KIM
aaaucucuugauuaccaa

SEQ ID NO: 2307875 - RNA, 23 nt, Yersinia pestis KIM
aaaucucuugauuaccaauaauu

SEQ ID NO: 2307876 - RNA, 15 nt, Yersinia pestis KIM
ucccuuucucaguga

SEQ ID NO: 2307877 - RNA, 15 nt, Yersinia pestis KIM
ucccuuuuaccgaaa

SEQ ID NO: 2307878 - RNA, 14 nt, Yersinia pestis KIM
ucccuuguugccuu

SEQ ID NO: 2307879 - RNA, 16 nt, Yersinia pestis KIM
ucccgcaaagccugcc

SEQ ID NO: 2307880 - RNA, 23 nt, Yersinia pestis KIM
ucccgugugauuuccaucuagcu

SEQ ID NO: 2307881 - RNA, 17 nt, Yersinia pestis KIM
ucccgugugauuuccau

SEQ ID NO: 2307882 - RNA, 20 nt, Yersinia pestis KIM
ucccgugccagauccucuuu

SEQ ID NO: 2307883 - RNA, 18 nt, Yersinia pestis KIM
uccccggcaacacccugu

SEQ ID NO: 2307884 - RNA, 16 nt, Yersinia pestis KIM
uccccuaauucuccuu

SEQ ID NO: 2307885 - RNA, 17 nt, Yersinia pestis KIM
ucccccuuuggccgcuc

SEQ ID NO: 2307886 - RNA, 20 nt, Yersinia pestis KIM
ucccccuugauucacugauu

SEQ ID NO: 2307887 - RNA, 18 nt, Yersinia pestis KIM
ucccccuucagccuucau

SEQ ID NO: 2307888 - RNA, 18 nt, Yersinia pestis KIM
ucccgauauaaauaaaau

SEQ ID NO: 2307889 - RNA, 22 nt, Yersinia pestis KIM
ucccgauaaaaaccauuuuuau

SEQ ID NO: 2307890 - RNA, 19 nt, Yersinia pestis KIM
ucccgaugauugcaucauc

SEQ ID NO: 2307891 - RNA, 18 nt, Yersinia pestis KIM
uccccugaaccauggcuu

SEQ ID NO: 2307892 - RNA, 22 nt, Yersinia pestis KIM
uccccuucgauauuacaguuua

SEQ ID NO: 2307893 - RNA, 22 nt, Yersinia pestis KIM
uccccuucaauugacuuugcca

SEQ ID NO: 2307894 - RNA, 12 nt, Yersinia pestis KIM
ucccccaccuga

SEQ ID NO: 2307895 - RNA, 20 nt, Yersinia pestis KIM
ucccccaccaguaaacgcca

SEQ ID NO: 2307896 - RNA, 18 nt, Yersinia pestis KIM
uccccauggcuuucagga

SEQ ID NO: 2307897 - RNA, 13 nt, Yersinia pestis KIM
uccccaacucuuu

SEQ ID NO: 2307898 - RNA, 21 nt, Yersinia pestis KIM
uccccaacucuuucaacuucc

SEQ ID NO: 2307899 - RNA, 17 nt, Yersinia pestis KIM
uccccaauucacgcaag

SEQ ID NO: 2307900 - RNA, 16 nt, Yersinia pestis KIM
uccccagaugaauggu

SEQ ID NO: 2307901 - RNA, 18 nt, Yersinia pestis KIM
uccccacggcgacguuca

SEQ ID NO: 2307902 - RNA, 12 nt, Yersinia pestis KIM
uccccacuucau

SEQ ID NO: 2307903 - RNA, 18 nt, Yersinia pestis KIM
uccccacuucaucaucaa

SEQ ID NO: 2307904 - RNA, 14 nt, Yersinia pestis KIM
ucccauuuauggca

SEQ ID NO: 2307905 - RNA, 13 nt, Yersinia pestis KIM
ucccauuuauuac

SEQ ID NO: 2307906 - RNA, 15 nt, Yersinia pestis KIM
ucccauuauuauaag

SEQ ID NO: 2307907 - RNA, 15 nt, Yersinia pestis KIM
ucccauuaauuaauc

SEQ ID NO: 2307908 - RNA, 14 nt, Yersinia pestis KIM
ucccaguuuuuaau

SEQ ID NO: 2307909 - RNA, 15 nt, Yersinia pestis KIM
ucccaguuuuuaauu

SEQ ID NO: 2307910 - RNA, 16 nt, Yersinia pestis KIM
ucccaguuuuuaauuu

SEQ ID NO: 2307911 - RNA, 17 nt, Yersinia pestis KIM
ucccagucauaaauauc

SEQ ID NO: 2307912 - RNA, 14 nt, Yersinia pestis KIM
ucccagucgucuuc

SEQ ID NO: 2307913 - RNA, 22 nt, Yersinia pestis KIM
ucccauagcuggcuucaaaauc

SEQ ID NO: 2307914 - RNA, 13 nt, Yersinia pestis KIM
ucccauacccacu

SEQ ID NO: 2307915 - RNA, 16 nt, Yersinia pestis KIM
ucccauacccacuaau

SEQ ID NO: 2307916 - RNA, 18 nt, Yersinia pestis KIM
ucccauacccacuaauac

SEQ ID NO: 2307917 - RNA, 16 nt, Yersinia pestis KIM
ucccaucccuuugauc

SEQ ID NO: 2307918 - RNA, 19 nt, Yersinia pestis KIM
ucccagaauaauaagccgu

SEQ ID NO: 2307919 - RNA, 14 nt, Yersinia pestis KIM
ucccagacugcuga

SEQ ID NO: 2307920 - RNA, 11 nt, Yersinia pestis KIM
ucccagccacu

SEQ ID NO: 2307921 - RNA, 12 nt, Yersinia pestis KIM
uccucagccuuu

SEQ ID NO: 2307922 - RNA, 14 nt, Yersinia pestis KIM
uccuccccugcguu

SEQ ID NO: 2307923 - RNA, 18 nt, Yersinia pestis KIM
uccuccugaucuucauug

SEQ ID NO: 2307924 - RNA, 18 nt, Yersinia pestis KIM
uccucgcgggucaugaaa

SEQ ID NO: 2307925 - RNA, 23 nt, Yersinia pestis KIM
uccucggguuuuauaccggggcc

SEQ ID NO: 2307926 - RNA, 20 nt, Yersinia pestis KIM
uccugacgaugauaaaucag

SEQ ID NO: 2307927 - RNA, 14 nt, Yersinia pestis KIM
uccugcaacgccuu

SEQ ID NO: 2307928 - RNA, 14 nt, Yersinia pestis KIM
uccugauuuaaccu

SEQ ID NO: 2307929 - RNA, 15 nt, Yersinia pestis KIM
uccugauuuaguuua

SEQ ID NO: 2307930 - RNA, 18 nt, Yersinia pestis KIM
uccugaucuucauugccu

SEQ ID NO: 2307931 - RNA, 13 nt, Yersinia pestis KIM
uccugaaauaaag

SEQ ID NO: 2307932 - RNA, 14 nt, Yersinia pestis KIM
uccugaaauaaaga

SEQ ID NO: 2307933 - RNA, 14 nt, Yersinia pestis KIM
uccucuuucuuaau

SEQ ID NO: 2307934 - RNA, 11 nt, Yersinia pestis KIM
uccugaauaau

SEQ ID NO: 2307935 - RNA, 23 nt, Yersinia pestis KIM
uccucugccuauucucaccguuu

SEQ ID NO: 2307936 - RNA, 22 nt, Yersinia pestis KIM
uccucugugacucuauugucuu

SEQ ID NO: 2307937 - RNA, 14 nt, Yersinia pestis KIM
uccucugccuauuc

SEQ ID NO: 2307938 - RNA, 13 nt, Yersinia pestis KIM
uccucugccuauc

SEQ ID NO: 2307939 - RNA, 22 nt, Yersinia pestis KIM
uccucugaauaaaaaauuauua

SEQ ID NO: 2307940 - RNA, 23 nt, Yersinia pestis KIM
uccuucacuuacucucuccgcaa

SEQ ID NO: 2307941 - RNA, 20 nt, Yersinia pestis KIM
uccugcgguggccagagcau

SEQ ID NO: 2307942 - RNA, 15 nt, Yersinia pestis KIM
uccugcgguggccag

SEQ ID NO: 2307943 - RNA, 23 nt, Yersinia pestis KIM
uccugccgccucugcuccgguaa

SEQ ID NO: 2307944 - RNA, 14 nt, Yersinia pestis KIM
uccugcccaugcuc

SEQ ID NO: 2307945 - RNA, 16 nt, Yersinia pestis KIM
uccugcaauccuccca

SEQ ID NO: 2307946 - RNA, 15 nt, Yersinia pestis KIM
uccugcacaguagaa

SEQ ID NO: 2307947 - RNA, 16 nt, Yersinia pestis KIM
uccuggaaccagugaa

SEQ ID NO: 2307948 - RNA, 22 nt, Yersinia pestis KIM
uccugcuuaaugcgaacagccc

SEQ ID NO: 2307949 - RNA, 21 nt, Yersinia pestis KIM
uccuggcgguaauaaaucaug

SEQ ID NO: 2307950 - RNA, 19 nt, Yersinia pestis KIM
uccuggccguguuuuuccc

SEQ ID NO: 2307951 - RNA, 14 nt, Yersinia pestis KIM
uccuacauucagua

SEQ ID NO: 2307952 - RNA, 19 nt, Yersinia pestis KIM
uccuacccuuugagaaagg

SEQ ID NO: 2307953 - RNA, 20 nt, Yersinia pestis KIM
uccuacgccggagucuaucu

SEQ ID NO: 2307954 - RNA, 14 nt, Yersinia pestis KIM
uccuauucagcagc

SEQ ID NO: 2307955 - RNA, 16 nt, Yersinia pestis KIM
uccuauucagcagcau

SEQ ID NO: 2307956 - RNA, 11 nt, Yersinia pestis KIM
uccuauuuaau

SEQ ID NO: 2307957 - RNA, 19 nt, Yersinia pestis KIM
uccucaacaguacugccaa

SEQ ID NO: 2307958 - RNA, 15 nt, Yersinia pestis KIM
uccggucugaagaga

SEQ ID NO: 2307959 - RNA, 14 nt, Yersinia pestis KIM
uccggugaagaauu

SEQ ID NO: 2307960 - RNA, 15 nt, Yersinia pestis KIM
uccgguguuuuugac

SEQ ID NO: 2307961 - RNA, 13 nt, Yersinia pestis KIM
uccgguguauuug

SEQ ID NO: 2307962 - RNA, 21 nt, Yersinia pestis KIM
uccguacccgcucuaaguuaa

SEQ ID NO: 2307963 - RNA, 15 nt, Yersinia pestis KIM
uccguuaucaucccu

SEQ ID NO: 2307964 - RNA, 15 nt, Yersinia pestis KIM
uccguuuucacccaa

SEQ ID NO: 2307965 - RNA, 12 nt, Yersinia pestis KIM
uccguuaaaaaa

SEQ ID NO: 2307966 - RNA, 19 nt, Yersinia pestis KIM
uccguuaacccaaagccau

SEQ ID NO: 2307967 - RNA, 17 nt, Yersinia pestis KIM
uccguguaguuauugau

SEQ ID NO: 2307968 - RNA, 12 nt, Yersinia pestis KIM
uccgucgccaac

SEQ ID NO: 2307969 - RNA, 15 nt, Yersinia pestis KIM
uccgguacugugcug

SEQ ID NO: 2307970 - RNA, 19 nt, Yersinia pestis KIM
uccggauuaaauucuaccu

SEQ ID NO: 2307971 - RNA, 13 nt, Yersinia pestis KIM
uccggacaggcuu

SEQ ID NO: 2307972 - RNA, 16 nt, Yersinia pestis KIM
uccggaaucagcguuu

SEQ ID NO: 2307973 - RNA, 15 nt, Yersinia pestis KIM
uccggacuucauaaa

SEQ ID NO: 2307974 - RNA, 19 nt, Yersinia pestis KIM
uccgcuuagcaggcccuuu

SEQ ID NO: 2307975 - RNA, 23 nt, Yersinia pestis KIM
uccggcaaaaacgccaucaauaa

SEQ ID NO: 2307976 - RNA, 13 nt, Yersinia pestis KIM
ucgcaaaaugcca

SEQ ID NO: 2307977 - RNA, 19 nt, Yersinia pestis KIM
ucgcaaaauuuauauucau

SEQ ID NO: 2307978 - RNA, 16 nt, Yersinia pestis KIM
ucgcaaagcgggccag

SEQ ID NO: 2307979 - RNA, 22 nt, Yersinia pestis KIM
ucgcaaagcgggccagcaacca

SEQ ID NO: 2307980 - RNA, 12 nt, Yersinia pestis KIM
ucgcaagcaaua

SEQ ID NO: 2307981 - RNA, 16 nt, Yersinia pestis KIM
ucgcauaggccaauag

SEQ ID NO: 2307982 - RNA, 22 nt, Yersinia pestis KIM
ucgcauaggccaauagaaaaac

SEQ ID NO: 2307983 - RNA, 23 nt, Yersinia pestis KIM
ucgcaguggguaacauaugagua

SEQ ID NO: 2307984 - RNA, 15 nt, Yersinia pestis KIM
ucgcaggcuucaacu

SEQ ID NO: 2307985 - RNA, 20 nt, Yersinia pestis KIM
ucgcagaccaaauuccccag

SEQ ID NO: 2307986 - RNA, 21 nt, Yersinia pestis KIM
ucgcagacagauuuggccacg

SEQ ID NO: 2307987 - RNA, 16 nt, Yersinia pestis KIM
ucgcacugaguucugc

SEQ ID NO: 2307988 - RNA, 21 nt, Yersinia pestis KIM
ucgcacgggcuuuaaugagua

SEQ ID NO: 2307989 - RNA, 17 nt, Yersinia pestis KIM
ucgcagccaaaauaauc

SEQ ID NO: 2307990 - RNA, 19 nt, Yersinia pestis KIM
ucgcagccaaaauaaucac

SEQ ID NO: 2307991 - RNA, 14 nt, Yersinia pestis KIM
ucgcaaaacuucac

SEQ ID NO: 2307992 - RNA, 16 nt, Yersinia pestis KIM
ucgauuugcugcugcu

SEQ ID NO: 2307993 - RNA, 15 nt, Yersinia pestis KIM
ucgauuucacuugcc

SEQ ID NO: 2307994 - RNA, 18 nt, Yersinia pestis KIM
ucgauugauauauagaaa

SEQ ID NO: 2307995 - RNA, 20 nt, Yersinia pestis KIM
ucgaugccggguuggcuccc

SEQ ID NO: 2307996 - RNA, 13 nt, Yersinia pestis KIM
ucgauacaauuuu

SEQ ID NO: 2307997 - RNA, 12 nt, Yersinia pestis KIM
ucgaguuuauau

SEQ ID NO: 2307998 - RNA, 17 nt, Yersinia pestis KIM
ucgaguccguuaaaaaa

SEQ ID NO: 2307999 - RNA, 16 nt, Yersinia pestis KIM
ucgauagucagcuuca

SEQ ID NO: 2308000 - RNA, 13 nt, Yersinia pestis KIM
ucgauacaguggc

SEQ ID NO: 2308001 - RNA, 16 nt, Yersinia pestis KIM
ucgauagcuuucuccu

SEQ ID NO: 2308002 - RNA, 20 nt, Yersinia pestis KIM
ucgauaguaaacaguuucag

SEQ ID NO: 2308003 - RNA, 21 nt, Yersinia pestis KIM
ucgauaguaacaccagcaucc

SEQ ID NO: 2308004 - RNA, 20 nt, Yersinia pestis KIM
ucgaucaaaacaauaaaaag

SEQ ID NO: 2308005 - RNA, 23 nt, Yersinia pestis KIM
ucgaucaaaacaauaaaaagauc

SEQ ID NO: 2308006 - RNA, 17 nt, Yersinia pestis KIM
ucgagccgcgcccuccc

SEQ ID NO: 2308007 - RNA, 21 nt, Yersinia pestis KIM
ucgagcaggcuuugugccaaa

SEQ ID NO: 2308008 - RNA, 15 nt, Yersinia pestis KIM
ucgagcuaccggcau

SEQ ID NO: 2308009 - RNA, 17 nt, Yersinia pestis KIM
ucgagaguugcucaccc

SEQ ID NO: 2308010 - RNA, 15 nt, Yersinia pestis KIM
ucgagauuacgguca

SEQ ID NO: 2308011 - RNA, 14 nt, Yersinia pestis KIM
ucgacuacuggcug

SEQ ID NO: 2308012 - RNA, 15 nt, Yersinia pestis KIM
ucgacucugggccgu

SEQ ID NO: 2308013 - RNA, 14 nt, Yersinia pestis KIM
uccuuuuauuuaga

SEQ ID NO: 2308014 - RNA, 15 nt, Yersinia pestis KIM
uccuuuugacugguc

SEQ ID NO: 2308015 - RNA, 18 nt, Yersinia pestis KIM
uccuuucuguuccaugau

SEQ ID NO: 2308016 - RNA, 19 nt, Yersinia pestis KIM
uccuuuggauuuaaugcug

SEQ ID NO: 2308017 - RNA, 19 nt, Yersinia pestis KIM
uccuuugcccuuacuauuu

SEQ ID NO: 2308018 - RNA, 22 nt, Yersinia pestis KIM
ucgaaaacucaaagauuucauc

SEQ ID NO: 2308019 - RNA, 18 nt, Yersinia pestis KIM
ucgaaaagcgccuuuuau

SEQ ID NO: 2308020 - RNA, 17 nt, Yersinia pestis KIM
ucgaacccauucaucaa

SEQ ID NO: 2308021 - RNA, 18 nt, Yersinia pestis KIM
ucgaacauuuucuaagcu

SEQ ID NO: 2308022 - RNA, 17 nt, Yersinia pestis KIM
ucgaaauuaaggaaaag

SEQ ID NO: 2308023 - RNA, 13 nt, Yersinia pestis KIM
ucgaaagaaauaa

SEQ ID NO: 2308024 - RNA, 21 nt, Yersinia pestis KIM
ucgaaacacccuccuauuaau

SEQ ID NO: 2308025 - RNA, 18 nt, Yersinia pestis KIM
uccuucucgaugccuucu

SEQ ID NO: 2308026 - RNA, 18 nt, Yersinia pestis KIM
uccuucggacgcuccuca

SEQ ID NO: 2308027 - RNA, 21 nt, Yersinia pestis KIM
uccuucggacgcuccucacuu

SEQ ID NO: 2308028 - RNA, 22 nt, Yersinia pestis KIM
uccuuguggauccagcaccaca

SEQ ID NO: 2308029 - RNA, 17 nt, Yersinia pestis KIM
uccuugggucaguuuua

SEQ ID NO: 2308030 - RNA, 13 nt, Yersinia pestis KIM
uccuugcucucuu

SEQ ID NO: 2308031 - RNA, 16 nt, Yersinia pestis KIM
uccuuggaacuuacuc

SEQ ID NO: 2308032 - RNA, 17 nt, Yersinia pestis KIM
ucgacggccaauuucag

SEQ ID NO: 2308033 - RNA, 18 nt, Yersinia pestis KIM
ucgacggccaauuucagu

SEQ ID NO: 2308034 - RNA, 18 nt, Yersinia pestis KIM
ucgaccuuaaccgcacaa

SEQ ID NO: 2308035 - RNA, 17 nt, Yersinia pestis KIM
ucgaccucaguuuugcu

SEQ ID NO: 2308036 - RNA, 16 nt, Yersinia pestis KIM
ucgacaggcaauuauc

SEQ ID NO: 2308037 - RNA, 17 nt, Yersinia pestis KIM
ucgaacuaucuuuucga

SEQ ID NO: 2308038 - RNA, 18 nt, Yersinia pestis KIM
ucgaaccugaacgcagga

SEQ ID NO: 2308039 - RNA, 11 nt, Yersinia pestis KIM
ucgaaccgaua

SEQ ID NO: 2308040 - RNA, 23 nt, Yersinia pestis KIM
ucgaauuauuuagagucuauaau

SEQ ID NO: 2308041 - RNA, 18 nt, Yersinia pestis KIM
ucgaaucacuuauuggaa

SEQ ID NO: 2308042 - RNA, 21 nt, Yersinia pestis KIM
ucgacaccuucaaucauugag

SEQ ID NO: 2308043 - RNA, 18 nt, Yersinia pestis KIM
uagucucacuaaaucaaa

SEQ ID NO: 2308044 - RNA, 16 nt, Yersinia pestis KIM
uagucucuugggcagc

SEQ ID NO: 2308045 - RNA, 19 nt, Yersinia pestis KIM
uagugaaguaauaaaaauc

SEQ ID NO: 2308046 - RNA, 15 nt, Yersinia pestis KIM
uagugacguaaaaag

SEQ ID NO: 2308047 - RNA, 21 nt, Yersinia pestis KIM
uagugacuaauuguuugcuuu

SEQ ID NO: 2308048 - RNA, 14 nt, Yersinia pestis KIM
uagugacucaucaa

SEQ ID NO: 2308049 - RNA, 18 nt, Yersinia pestis KIM
uagucuuuuuaauaugug

SEQ ID NO: 2308050 - RNA, 14 nt, Yersinia pestis KIM
uaguuauauaaggu

SEQ ID NO: 2308051 - RNA, 16 nt, Yersinia pestis KIM
uaguuaggugaaauau

SEQ ID NO: 2308052 - RNA, 16 nt, Yersinia pestis KIM
uaguuacaauaaauca

SEQ ID NO: 2308053 - RNA, 23 nt, Yersinia pestis KIM
uaguuaucucccauuaauuaauc

SEQ ID NO: 2308054 - RNA, 15 nt, Yersinia pestis KIM
uagugacucaucaaa

SEQ ID NO: 2308055 - RNA, 22 nt, Yersinia pestis KIM
uagugcuuccaacucaccuaaa

SEQ ID NO: 2308056 - RNA, 21 nt, Yersinia pestis KIM
uaguguaaaaaccaucugaug

SEQ ID NO: 2308057 - RNA, 15 nt, Yersinia pestis KIM
uaguggcacaaauaa

SEQ ID NO: 2308058 - RNA, 15 nt, Yersinia pestis KIM
uacuuuauuuaaaau

SEQ ID NO: 2308059 - RNA, 16 nt, Yersinia pestis KIM
uaggugcgcaaaccug

SEQ ID NO: 2308060 - RNA, 21 nt, Yersinia pestis KIM
uaggugcucugccuuaugaau

SEQ ID NO: 2308061 - RNA, 18 nt, Yersinia pestis KIM
uagguuacgucauauccc

SEQ ID NO: 2308062 - RNA, 20 nt, Yersinia pestis KIM
uaggugguaccugcacugag

SEQ ID NO: 2308063 - RNA, 14 nt, Yersinia pestis KIM
uaguaacaccagca

SEQ ID NO: 2308064 - RNA, 15 nt, Yersinia pestis KIM
uaguaagcaugccau

SEQ ID NO: 2308065 - RNA, 20 nt, Yersinia pestis KIM
uaguaagcaugccauccugc

SEQ ID NO: 2308066 - RNA, 22 nt, Yersinia pestis KIM
uaguaacuguaaggccaaaccc

SEQ ID NO: 2308067 - RNA, 23 nt, Yersinia pestis KIM
uaguacguagcgauaacagauau

SEQ ID NO: 2308068 - RNA, 18 nt, Yersinia pestis KIM
uagucauauauuuuucuu

SEQ ID NO: 2308069 - RNA, 20 nt, Yersinia pestis KIM
uagucacgggguguguggca

SEQ ID NO: 2308070 - RNA, 22 nt, Yersinia pestis KIM
uagucacgcggcggcgucaaau

SEQ ID NO: 2308071 - RNA, 14 nt, Yersinia pestis KIM
uagucagcuucacu

SEQ ID NO: 2308072 - RNA, 17 nt, Yersinia pestis KIM
uauaaccaugaugacaa

SEQ ID NO: 2308073 - RNA, 18 nt, Yersinia pestis KIM
uauaaccgucaccaaaau

SEQ ID NO: 2308074 - RNA, 16 nt, Yersinia pestis KIM
uauaagcgcucaaaua

SEQ ID NO: 2308075 - RNA, 15 nt, Yersinia pestis KIM
uauaagcaauaccga

SEQ ID NO: 2308076 - RNA, 21 nt, Yersinia pestis KIM
uauaacauaauaaauuaauag

SEQ ID NO: 2308077 - RNA, 14 nt, Yersinia pestis KIM
uauaaauaauuaau

SEQ ID NO: 2308078 - RNA, 23 nt, Yersinia pestis KIM
uauaaagccauuggucaaucuag

SEQ ID NO: 2308079 - RNA, 20 nt, Yersinia pestis KIM
uauaaagauuuuaagcacug

SEQ ID NO: 2308080 - RNA, 23 nt, Yersinia pestis KIM
uauaaacacugauuuauaaauaa

SEQ ID NO: 2308081 - RNA, 24 nt, Yersinia pestis KIM
uauaaacacugauuuauaaauaau

SEQ ID NO: 2308082 - RNA, 23 nt, Yersinia pestis KIM
uauaaacacuuaccuauaaacau

SEQ ID NO: 2308083 - RNA, 14 nt, Yersinia pestis KIM
uauaaacauaaaaa

SEQ ID NO: 2308084 - RNA, 13 nt, Yersinia pestis KIM
uauaaauaaaaua

SEQ ID NO: 2308085 - RNA, 14 nt, Yersinia pestis KIM
uauaaauaaaauag

SEQ ID NO: 2308086 - RNA, 16 nt, Yersinia pestis KIM
uauaaaagcaucucga

SEQ ID NO: 2308087 - RNA, 23 nt, Yersinia pestis KIM
uauaauugaagauuuaaauaaca

SEQ ID NO: 2308088 - RNA, 23 nt, Yersinia pestis KIM
uauaauuucaagaauugugcccc

SEQ ID NO: 2308089 - RNA, 15 nt, Yersinia pestis KIM
uauaauuauuucucu

SEQ ID NO: 2308090 - RNA, 13 nt, Yersinia pestis KIM
uauaauuauugaa

SEQ ID NO: 2308091 - RNA, 13 nt, Yersinia pestis KIM
uauaauucaauau

SEQ ID NO: 2308092 - RNA, 15 nt, Yersinia pestis KIM
uauaauuaacagcau

SEQ ID NO: 2308093 - RNA, 12 nt, Yersinia pestis KIM
uauaaugaugua

SEQ ID NO: 2308094 - RNA, 16 nt, Yersinia pestis KIM
uauaaugaaauaguaa

SEQ ID NO: 2308095 - RNA, 23 nt, Yersinia pestis KIM
uauaauagcuggcggauaaaaau

SEQ ID NO: 2308096 - RNA, 16 nt, Yersinia pestis KIM
uauaauaugccagcgc

SEQ ID NO: 2308097 - RNA, 21 nt, Yersinia pestis KIM
uauauaaauggcuguuauaua

SEQ ID NO: 2308098 - RNA, 17 nt, Yersinia pestis KIM
uauauauccaaaauaau

SEQ ID NO: 2308099 - RNA, 17 nt, Yersinia pestis KIM
uauaucguguuuaguug

SEQ ID NO: 2308100 - RNA, 13 nt, Yersinia pestis KIM
uauaucuauauug

SEQ ID NO: 2308101 - RNA, 17 nt, Yersinia pestis KIM
uauaggguuguguggua

SEQ ID NO: 2308102 - RNA, 15 nt, Yersinia pestis KIM
uauagguuauaagcc

SEQ ID NO: 2308103 - RNA, 21 nt, Yersinia pestis KIM
uauaguuuauuuuauuuaauc

SEQ ID NO: 2308104 - RNA, 19 nt, Yersinia pestis KIM
uauacaauccaaccuauau

SEQ ID NO: 2308105 - RNA, 13 nt, Yersinia pestis KIM
uauacagaagagu

SEQ ID NO: 2308106 - RNA, 14 nt, Yersinia pestis KIM
uauaugauaauagu

SEQ ID NO: 2308107 - RNA, 20 nt, Yersinia pestis KIM
uauaugcgcuggcucuauuu

SEQ ID NO: 2308108 - RNA, 15 nt, Yersinia pestis KIM
uauaugcuguauaaa

SEQ ID NO: 2308109 - RNA, 23 nt, Yersinia pestis KIM
uauauggauuggcauuuaaaagg

SEQ ID NO: 2308110 - RNA, 14 nt, Yersinia pestis KIM
uauauuuauggaua

SEQ ID NO: 2308111 - RNA, 19 nt, Yersinia pestis KIM
uauauuuacgcauaaugag

SEQ ID NO: 2308112 - RNA, 11 nt, Yersinia pestis KIM
uauauuuacug

SEQ ID NO: 2308113 - RNA, 15 nt, Yersinia pestis KIM
uauauuaucauucaa

SEQ ID NO: 2308114 - RNA, 17 nt, Yersinia pestis KIM
uauauuaguuaacccua

SEQ ID NO: 2308115 - RNA, 15 nt, Yersinia pestis KIM
uauauucaauaucac

SEQ ID NO: 2308116 - RNA, 18 nt, Yersinia pestis KIM
uauauucaauugaaauaa

SEQ ID NO: 2308117 - RNA, 22 nt, Yersinia pestis KIM
uaucacccgccaucgccccaaa

SEQ ID NO: 2308118 - RNA, 18 nt, Yersinia pestis KIM
uaucaccguaaacauuga

SEQ ID NO: 2308119 - RNA, 14 nt, Yersinia pestis KIM
uaucacaucgcccu

SEQ ID NO: 2308120 - RNA, 13 nt, Yersinia pestis KIM
uauauuuugagau

SEQ ID NO: 2308121 - RNA, 21 nt, Yersinia pestis KIM
uauauuuugaauauuuuuaau

SEQ ID NO: 2308122 - RNA, 21 nt, Yersinia pestis KIM
uaucaacgcccagcuuuagca

SEQ ID NO: 2308123 - RNA, 22 nt, Yersinia pestis KIM
uaucaacguagcugaauugcuu

SEQ ID NO: 2308124 - RNA, 17 nt, Yersinia pestis KIM
uaucgcuguaugguaua

SEQ ID NO: 2308125 - RNA, 15 nt, Yersinia pestis KIM
uaucgcuuuuagaua

SEQ ID NO: 2308126 - RNA, 15 nt, Yersinia pestis KIM
uaucgcucaucaugg

SEQ ID NO: 2308127 - RNA, 19 nt, Yersinia pestis KIM
uaucgcgguuuuaaauaca

SEQ ID NO: 2308128 - RNA, 20 nt, Yersinia pestis KIM
uaucgcgguuuuaaauacac

SEQ ID NO: 2308129 - RNA, 15 nt, Yersinia pestis KIM
uaucgccaagccagu

SEQ ID NO: 2308130 - RNA, 23 nt, Yersinia pestis KIM
uaucgccaacacuauuguggaua

SEQ ID NO: 2308131 - RNA, 21 nt, Yersinia pestis KIM
uaucgcgaaacucuuccuugc

SEQ ID NO: 2308132 - RNA, 21 nt, Yersinia pestis KIM
uaucggccauauuaccgcuga

SEQ ID NO: 2308133 - RNA, 17 nt, Yersinia pestis KIM
uaucggcaaacaucaca

SEQ ID NO: 2308134 - RNA, 15 nt, Yersinia pestis KIM
uaucggcaaauuaaa

SEQ ID NO: 2308135 - RNA, 23 nt, Yersinia pestis KIM
uaucgugaacaggccccaaaaua

SEQ ID NO: 2308136 - RNA, 22 nt, Yersinia pestis KIM
uaucggugcugacaaacagaua

SEQ ID NO: 2308137 - RNA, 19 nt, Yersinia pestis KIM
uaucggugcugacaaacag

SEQ ID NO: 2308138 - RNA, 19 nt, Yersinia pestis KIM
uaucgauuuuuaagucaau

SEQ ID NO: 2308139 - RNA, 20 nt, Yersinia pestis KIM
uauccuggccguguuuuucc

SEQ ID NO: 2308140 - RNA, 22 nt, Yersinia pestis KIM
uauccccuaucgaacuauugau

SEQ ID NO: 2308141 - RNA, 14 nt, Yersinia pestis KIM
uaucccccucacug

SEQ ID NO: 2308142 - RNA, 16 nt, Yersinia pestis KIM
uaucccuauuuuuucc

SEQ ID NO: 2308143 - RNA, 16 nt, Yersinia pestis KIM
uaucccuccccacugg

SEQ ID NO: 2308144 - RNA, 15 nt, Yersinia pestis KIM
uauccguuaacccaa

SEQ ID NO: 2308145 - RNA, 16 nt, Yersinia pestis KIM
uauccguuaacccaaa

SEQ ID NO: 2308146 - RNA, 18 nt, Yersinia pestis KIM
uauccggguggcuuggca

SEQ ID NO: 2308147 - RNA, 14 nt, Yersinia pestis KIM
uaucaucaccaccc

SEQ ID NO: 2308148 - RNA, 12 nt, Yersinia pestis KIM
uaucaucaccau

SEQ ID NO: 2308149 - RNA, 15 nt, Yersinia pestis KIM
uaucaucauaaaugg

SEQ ID NO: 2308150 - RNA, 15 nt, Yersinia pestis KIM
uaucaucaccaaaca

SEQ ID NO: 2308151 - RNA, 23 nt, Yersinia pestis KIM
uaucaucaccaagcuuaauauua

SEQ ID NO: 2308152 - RNA, 17 nt, Yersinia pestis KIM
uauccaggcacugccau

SEQ ID NO: 2308153 - RNA, 13 nt, Yersinia pestis KIM
uauccagccgcuc

SEQ ID NO: 2308154 - RNA, 15 nt, Yersinia pestis KIM
uaucauaauccaacu

SEQ ID NO: 2308155 - RNA, 14 nt, Yersinia pestis KIM
uaucauauuaacau

SEQ ID NO: 2308156 - RNA, 15 nt, Yersinia pestis KIM
uaucagcgaaaaauu

SEQ ID NO: 2308157 - RNA, 18 nt, Yersinia pestis KIM
uaucagccccuaaauccu

SEQ ID NO: 2308158 - RNA, 16 nt, Yersinia pestis KIM
uaucagcgauuuuaaa

SEQ ID NO: 2308159 - RNA, 17 nt, Yersinia pestis KIM
uaucagcgauuuuaaaa

SEQ ID NO: 2308160 - RNA, 20 nt, Yersinia pestis KIM
uaucagcgcacccacuuccu

SEQ ID NO: 2308161 - RNA, 16 nt, Yersinia pestis KIM
uauggaugaugcacag

SEQ ID NO: 2308162 - RNA, 17 nt, Yersinia pestis KIM
uauggauaauuuaauua

SEQ ID NO: 2308163 - RNA, 15 nt, Yersinia pestis KIM
uauggauacacggcu

SEQ ID NO: 2308164 - RNA, 13 nt, Yersinia pestis KIM
uauggaugugauc

SEQ ID NO: 2308165 - RNA, 14 nt, Yersinia pestis KIM
uauggauaaauccu

SEQ ID NO: 2308166 - RNA, 15 nt, Yersinia pestis KIM
uauggauaauuuaau

SEQ ID NO: 2308167 - RNA, 22 nt, Yersinia pestis KIM
uauggcauaaacugaaguuaaa

SEQ ID NO: 2308168 - RNA, 13 nt, Yersinia pestis KIM
uauggcgaagaga

SEQ ID NO: 2308169 - RNA, 19 nt, Yersinia pestis KIM
uauggggaugauuguuuua

SEQ ID NO: 2308170 - RNA, 21 nt, Yersinia pestis KIM
uaugguauagacuguuuuauu

SEQ ID NO: 2308171 - RNA, 13 nt, Yersinia pestis KIM
uauggucagcaau

SEQ ID NO: 2308172 - RNA, 19 nt, Yersinia pestis KIM
uaugccgcccucuuuucuu

SEQ ID NO: 2308173 - RNA, 20 nt, Yersinia pestis KIM
uaugccauauuacucucuau

SEQ ID NO: 2308174 - RNA, 22 nt, Yersinia pestis KIM
uaugcccccagguuucagucaa

SEQ ID NO: 2308175 - RNA, 20 nt, Yersinia pestis KIM
uaugccuuggcaaagagacu

SEQ ID NO: 2308176 - RNA, 13 nt, Yersinia pestis KIM
uaugccuuuucuu

SEQ ID NO: 2308177 - RNA, 16 nt, Yersinia pestis KIM
uaugccuuuucuuccg

SEQ ID NO: 2308178 - RNA, 19 nt, Yersinia pestis KIM
uaugcguggguucuucaaa

SEQ ID NO: 2308179 - RNA, 20 nt, Yersinia pestis KIM
uaugcugaauaaacggcaag

SEQ ID NO: 2308180 - RNA, 14 nt, Yersinia pestis KIM
uaugcuguauaaaa

SEQ ID NO: 2308181 - RNA, 23 nt, Yersinia pestis KIM
uaugcucaccgcccccaauaagg

SEQ ID NO: 2308182 - RNA, 19 nt, Yersinia pestis KIM
uaugcaguuaagguuagcu

SEQ ID NO: 2308183 - RNA, 14 nt, Yersinia pestis KIM
uaugcauuauugau

SEQ ID NO: 2308184 - RNA, 14 nt, Yersinia pestis KIM
uaugcaaauaauaa

SEQ ID NO: 2308185 - RNA, 18 nt, Yersinia pestis KIM
uaugaucuugauaaacau

SEQ ID NO: 2308186 - RNA, 18 nt, Yersinia pestis KIM
uaugauggcaucuuauua

SEQ ID NO: 2308187 - RNA, 19 nt, Yersinia pestis KIM
uaugaauggaaguuaaaaa

SEQ ID NO: 2308188 - RNA, 22 nt, Yersinia pestis KIM
uaugaauggaaguuaaaaaaau

SEQ ID NO: 2308189 - RNA, 20 nt, Yersinia pestis KIM
uaugaaugagguuuacauuu

SEQ ID NO: 2308190 - RNA, 21 nt, Yersinia pestis KIM
uaugaaugaguuucaagucaa

SEQ ID NO: 2308191 - RNA, 22 nt, Yersinia pestis KIM
uaugaaugaguuucaagucaau

SEQ ID NO: 2308192 - RNA, 22 nt, Yersinia pestis KIM
uaugacggggauauauggccgc

SEQ ID NO: 2308193 - RNA, 21 nt, Yersinia pestis KIM
uaugacaaguugucuguaaua

SEQ ID NO: 2308194 - RNA, 16 nt, Yersinia pestis KIM
uaugacagcauacauc

SEQ ID NO: 2308195 - RNA, 19 nt, Yersinia pestis KIM
uaucuauuuuuauuucucc

SEQ ID NO: 2308196 - RNA, 23 nt, Yersinia pestis KIM
uaucuauauagggaaauaacauc

SEQ ID NO: 2308197 - RNA, 17 nt, Yersinia pestis KIM
uaucuagcguccaugua

SEQ ID NO: 2308198 - RNA, 15 nt, Yersinia pestis KIM
uaucuaaaacugccu

SEQ ID NO: 2308199 - RNA, 21 nt, Yersinia pestis KIM
uaucuaaaaggauagggagcc

SEQ ID NO: 2308200 - RNA, 18 nt, Yersinia pestis KIM
uaucguuaucaacgccca

SEQ ID NO: 2308201 - RNA, 17 nt, Yersinia pestis KIM
uaucguuucuguuuugu

SEQ ID NO: 2308202 - RNA, 15 nt, Yersinia pestis KIM
uaucucauccagcaa

SEQ ID NO: 2308203 - RNA, 22 nt, Yersinia pestis KIM
uaucucgauugccuuuuuugaa

SEQ ID NO: 2308204 - RNA, 14 nt, Yersinia pestis KIM
uaucucgccuuuaa

SEQ ID NO: 2308205 - RNA, 20 nt, Yersinia pestis KIM
uaucucccauuaauuaauca

SEQ ID NO: 2308206 - RNA, 14 nt, Yersinia pestis KIM
uaucucauccagca

SEQ ID NO: 2308207 - RNA, 15 nt, Yersinia pestis KIM
uaucuggcuuuccug

SEQ ID NO: 2308208 - RNA, 16 nt, Yersinia pestis KIM
uaucuguaaucaccag

SEQ ID NO: 2308209 - RNA, 14 nt, Yersinia pestis KIM
uaucugcguuuucu

SEQ ID NO: 2308210 - RNA, 20 nt, Yersinia pestis KIM
uaucuucccuguccagccca

SEQ ID NO: 2308211 - RNA, 19 nt, Yersinia pestis KIM
uaucuuccacaugcuuuuu

SEQ ID NO: 2308212 - RNA, 18 nt, Yersinia pestis KIM
uaucuuguaaauagucau

SEQ ID NO: 2308213 - RNA, 15 nt, Yersinia pestis KIM
uaucuuuaaaaaccc

SEQ ID NO: 2308214 - RNA, 13 nt, Yersinia pestis KIM
uaucuuuaauuuu

SEQ ID NO: 2308215 - RNA, 16 nt, Yersinia pestis KIM
uaucuuuaauuuuucc

SEQ ID NO: 2308216 - RNA, 19 nt, Yersinia pestis KIM
uaucuucauauacagaaga

SEQ ID NO: 2308217 - RNA, 20 nt, Yersinia pestis KIM
uaucuguuucaaauaaguau

SEQ ID NO: 2308218 - RNA, 14 nt, Yersinia pestis KIM
uaugaaggccauaa

SEQ ID NO: 2308219 - RNA, 10 nt, Yersinia pestis KIM
uaugaauaaa

SEQ ID NO: 2308220 - RNA, 15 nt, Yersinia pestis KIM
uaucuuuauuaucaa

SEQ ID NO: 2308221 - RNA, 16 nt, Yersinia pestis KIM
uaucuuuauugcuccu

SEQ ID NO: 2308222 - RNA, 13 nt, Yersinia pestis KIM
uaucuuucacccu

SEQ ID NO: 2308223 - RNA, 12 nt, Yersinia pestis KIM
uaucuuuccagc

SEQ ID NO: 2308224 - RNA, 18 nt, Yersinia pestis KIM
uaucuuuuauuuaugaua

SEQ ID NO: 2308225 - RNA, 23 nt, Yersinia pestis KIM
uauugaaccuacccuuauucuua

SEQ ID NO: 2308226 - RNA, 18 nt, Yersinia pestis KIM
uauugaagcuguuuccug

SEQ ID NO: 2308227 - RNA, 19 nt, Yersinia pestis KIM
aaauccugaauaauacugu

SEQ ID NO: 2308228 - RNA, 20 nt, Yersinia pestis KIM
aaauccgugcugguccuuuu

SEQ ID NO: 2308229 - RNA, 17 nt, Yersinia pestis KIM
uauugcaaggucaacga

SEQ ID NO: 2308230 - RNA, 14 nt, Yersinia pestis KIM
uauugcaacgcuug

SEQ ID NO: 2308231 - RNA, 16 nt, Yersinia pestis KIM
uauugcaacgcuugca

SEQ ID NO: 2308232 - RNA, 20 nt, Yersinia pestis KIM
aaauccugaauaauacuguc

SEQ ID NO: 2308233 - RNA, 19 nt, Yersinia pestis KIM
uauuuaaccgcccucuuga

SEQ ID NO: 2308234 - RNA, 20 nt, Yersinia pestis KIM
uauuguugccaauguugcug

SEQ ID NO: 2308235 - RNA, 19 nt, Yersinia pestis KIM
uauuguuuugacuaaaauu

SEQ ID NO: 2308236 - RNA, 17 nt, Yersinia pestis KIM
uauuggucaauaaaauu

SEQ ID NO: 2308237 - RNA, 16 nt, Yersinia pestis KIM
uauugggcugccugug

SEQ ID NO: 2308238 - RNA, 22 nt, Yersinia pestis KIM
uauuguuauuuuggcuuucagu

SEQ ID NO: 2308239 - RNA, 19 nt, Yersinia pestis KIM
uauuggagcugaaaauagu

SEQ ID NO: 2308240 - RNA, 15 nt, Yersinia pestis KIM
uauuggguuauuaac

SEQ ID NO: 2308241 - RNA, 22 nt, Yersinia pestis KIM
uauuggcuaaaguguacuguua

SEQ ID NO: 2308242 - RNA, 18 nt, Yersinia pestis KIM
uauucuuaucaaucaaaa

SEQ ID NO: 2308243 - RNA, 18 nt, Yersinia pestis KIM
uauucgggcaacuaauuc

SEQ ID NO: 2308244 - RNA, 12 nt, Yersinia pestis KIM
uauuccuaauua

SEQ ID NO: 2308245 - RNA, 15 nt, Yersinia pestis KIM
uauucgucauucguu

SEQ ID NO: 2308246 - RNA, 23 nt, Yersinia pestis KIM
uauucuaauugauauuauuuaua

SEQ ID NO: 2308247 - RNA, 14 nt, Yersinia pestis KIM
uauucuaggcauga

SEQ ID NO: 2308248 - RNA, 19 nt, Yersinia pestis KIM
uauuccgagcaaucaaaag

SEQ ID NO: 2308249 - RNA, 16 nt, Yersinia pestis KIM
uauuccucucugucug

SEQ ID NO: 2308250 - RNA, 14 nt, Yersinia pestis KIM
uauuccucugccua

SEQ ID NO: 2308251 - RNA, 18 nt, Yersinia pestis KIM
uauuccccaccauugcaa

SEQ ID NO: 2308252 - RNA, 18 nt, Yersinia pestis KIM
uauucaaccgccagugcc

SEQ ID NO: 2308253 - RNA, 16 nt, Yersinia pestis KIM
uauucaacgccaauac

SEQ ID NO: 2308254 - RNA, 21 nt, Yersinia pestis KIM
uauucccagccaacuccuuga

SEQ ID NO: 2308255 - RNA, 22 nt, Yersinia pestis KIM
uauucaaacggugugcaaugca

SEQ ID NO: 2308256 - RNA, 23 nt, Yersinia pestis KIM
uauuauguaaauaguuacuauau

SEQ ID NO: 2308257 - RNA, 14 nt, Yersinia pestis KIM
uauguugcacugac

SEQ ID NO: 2308258 - RNA, 13 nt, Yersinia pestis KIM
uauguuaaaucag

SEQ ID NO: 2308259 - RNA, 23 nt, Yersinia pestis KIM
uaugucaccuccacuucaagccg

SEQ ID NO: 2308260 - RNA, 20 nt, Yersinia pestis KIM
uaugucagauagaccaauga

SEQ ID NO: 2308261 - RNA, 15 nt, Yersinia pestis KIM
uauguccucaccauu

SEQ ID NO: 2308262 - RNA, 15 nt, Yersinia pestis KIM
uaugugccaaaaaaa

SEQ ID NO: 2308263 - RNA, 16 nt, Yersinia pestis KIM
uaugugccaaaaaaag

SEQ ID NO: 2308264 - RNA, 16 nt, Yersinia pestis KIM
uauguacacauuauuu

SEQ ID NO: 2308265 - RNA, 13 nt, Yersinia pestis KIM
uauguaaugccac

SEQ ID NO: 2308266 - RNA, 14 nt, Yersinia pestis KIM
uauguaaugccaca

SEQ ID NO: 2308267 - RNA, 15 nt, Yersinia pestis KIM
uauguaguuaaucua

SEQ ID NO: 2308268 - RNA, 23 nt, Yersinia pestis KIM
uauguagggguacagcagggauu

SEQ ID NO: 2308269 - RNA, 16 nt, Yersinia pestis KIM
uaugguuaaucuaccc

SEQ ID NO: 2308270 - RNA, 16 nt, Yersinia pestis KIM
uauguaacacauauuu

SEQ ID NO: 2308271 - RNA, 20 nt, Yersinia pestis KIM
uauuaggugcuuguucuguu

SEQ ID NO: 2308272 - RNA, 17 nt, Yersinia pestis KIM
uauuaucugguuggcau

SEQ ID NO: 2308273 - RNA, 22 nt, Yersinia pestis KIM
uauuaauaggaggguguuuuuu

SEQ ID NO: 2308274 - RNA, 22 nt, Yersinia pestis KIM
uauuaauaucgagguucgacua

SEQ ID NO: 2308275 - RNA, 11 nt, Yersinia pestis KIM
uauuaaauaag

SEQ ID NO: 2308276 - RNA, 18 nt, Yersinia pestis KIM
uauuaaacuugcucuuuc

SEQ ID NO: 2308277 - RNA, 14 nt, Yersinia pestis KIM
uauuaacauaucaa

SEQ ID NO: 2308278 - RNA, 16 nt, Yersinia pestis KIM
ucacaggccacugcau

SEQ ID NO: 2308279 - RNA, 16 nt, Yersinia pestis KIM
ucacaggggcaauaau

SEQ ID NO: 2308280 - RNA, 13 nt, Yersinia pestis KIM
ucacagauaaaca

SEQ ID NO: 2308281 - RNA, 18 nt, Yersinia pestis KIM
ucacagauaaacaaggca

SEQ ID NO: 2308282 - RNA, 12 nt, Yersinia pestis KIM
ucacagauaaac

SEQ ID NO: 2308283 - RNA, 12 nt, Yersinia pestis KIM
ucacaguaaauu

SEQ ID NO: 2308284 - RNA, 15 nt, Yersinia pestis KIM
ucacauaaauaaguu

SEQ ID NO: 2308285 - RNA, 16 nt, Yersinia pestis KIM
ucacauagcuguaaau

SEQ ID NO: 2308286 - RNA, 20 nt, Yersinia pestis KIM
ucacauagugcaaaauucca

SEQ ID NO: 2308287 - RNA, 19 nt, Yersinia pestis KIM
ucaccaguagcccagccgg

SEQ ID NO: 2308288 - RNA, 18 nt, Yersinia pestis KIM
ucaccaguagcccagccg

SEQ ID NO: 2308289 - RNA, 17 nt, Yersinia pestis KIM
ucaccauaacugcugcu

SEQ ID NO: 2308290 - RNA, 16 nt, Yersinia pestis KIM
ucaccauaacugcugc

SEQ ID NO: 2308291 - RNA, 22 nt, Yersinia pestis KIM
ucaccaucagacaggauaauca

SEQ ID NO: 2308292 - RNA, 20 nt, Yersinia pestis KIM
ucaccaucugguucgguaua

SEQ ID NO: 2308293 - RNA, 14 nt, Yersinia pestis KIM
ucaccaucugccug

SEQ ID NO: 2308294 - RNA, 18 nt, Yersinia pestis KIM
ucaccacgauuagccaua

SEQ ID NO: 2308295 - RNA, 18 nt, Yersinia pestis KIM
ucaccagguuucgguacu

SEQ ID NO: 2308296 - RNA, 15 nt, Yersinia pestis KIM
ucaccagguccgccc

SEQ ID NO: 2308297 - RNA, 19 nt, Yersinia pestis KIM
ucacaugcucaguuguauu

SEQ ID NO: 2308298 - RNA, 16 nt, Yersinia pestis KIM
ucacaucauaaucggu

SEQ ID NO: 2308299 - RNA, 17 nt, Yersinia pestis KIM
ucacaucggucaauacc

SEQ ID NO: 2308300 - RNA, 22 nt, Yersinia pestis KIM
ucacaucucggcguaaacaauc

SEQ ID NO: 2308301 - RNA, 19 nt, Yersinia pestis KIM
ucacaucgcccugcucuuc

SEQ ID NO: 2308302 - RNA, 20 nt, Yersinia pestis KIM
ucacauccaauggcaaugga

SEQ ID NO: 2308303 - RNA, 18 nt, Yersinia pestis KIM
ucaauaucgauuuuuaag

SEQ ID NO: 2308304 - RNA, 19 nt, Yersinia pestis KIM
ucaauaucgauuuuuaagu

SEQ ID NO: 2308305 - RNA, 22 nt, Yersinia pestis KIM
ucaauaugcaguuuuccucccu

SEQ ID NO: 2308306 - RNA, 22 nt, Yersinia pestis KIM
ucaauagcauaaauaucaguga

SEQ ID NO: 2308307 - RNA, 16 nt, Yersinia pestis KIM
ucaauaggucaguggu

SEQ ID NO: 2308308 - RNA, 16 nt, Yersinia pestis KIM
ucaauauaagagaaau

SEQ ID NO: 2308309 - RNA, 19 nt, Yersinia pestis KIM
ucaauaccgcuuuuaccaa

SEQ ID NO: 2308310 - RNA, 19 nt, Yersinia pestis KIM
ucaauagcauaaauaucag

SEQ ID NO: 2308311 - RNA, 19 nt, Yersinia pestis KIM
ucaauaccuuacugcauca

SEQ ID NO: 2308312 - RNA, 16 nt, Yersinia pestis KIM
ucaauacguuagucau

SEQ ID NO: 2308313 - RNA, 19 nt, Yersinia pestis KIM
ucaauacuguuaucacuga

SEQ ID NO: 2308314 - RNA, 12 nt, Yersinia pestis KIM
ucaauaauauuu

SEQ ID NO: 2308315 - RNA, 22 nt, Yersinia pestis KIM
ucaauaagugcaaacuuaaaaa

SEQ ID NO: 2308316 - RNA, 13 nt, Yersinia pestis KIM
ucaauaauaaaau

SEQ ID NO: 2308317 - RNA, 19 nt, Yersinia pestis KIM
ucaauaagugcaaacuuaa

SEQ ID NO: 2308318 - RNA, 23 nt, Yersinia pestis KIM
ucaauaaguagccacuuaauaau

SEQ ID NO: 2308319 - RNA, 20 nt, Yersinia pestis KIM
ucaauaaccucaggggccaa

SEQ ID NO: 2308320 - RNA, 15 nt, Yersinia pestis KIM
ucaauaagaaugacu

SEQ ID NO: 2308321 - RNA, 18 nt, Yersinia pestis KIM
ucaauaagaaugacuuuc

SEQ ID NO: 2308322 - RNA, 19 nt, Yersinia pestis KIM
ucaauaaccucaaaaggau

SEQ ID NO: 2308323 - RNA, 13 nt, Yersinia pestis KIM
ucaauaaccucag

SEQ ID NO: 2308324 - RNA, 16 nt, Yersinia pestis KIM
ucaauaaccucagccu

SEQ ID NO: 2308325 - RNA, 18 nt, Yersinia pestis KIM
ucaauaaccucagccuca

SEQ ID NO: 2308326 - RNA, 23 nt, Yersinia pestis KIM
ucaauaaccucagccucauucau

SEQ ID NO: 2308327 - RNA, 12 nt, Yersinia pestis KIM
ucaauaaccuca

SEQ ID NO: 2308328 - RNA, 17 nt, Yersinia pestis KIM
ucaauaacauuaccacc

SEQ ID NO: 2308329 - RNA, 23 nt, Yersinia pestis KIM
ucaauggcugcccagagugacaa

SEQ ID NO: 2308330 - RNA, 17 nt, Yersinia pestis KIM
ucaaugaugucaucuuc

SEQ ID NO: 2308331 - RNA, 14 nt, Yersinia pestis KIM
ucaaugagcauacc

SEQ ID NO: 2308332 - RNA, 15 nt, Yersinia pestis KIM
ucaaugagucucaau

SEQ ID NO: 2308333 - RNA, 18 nt, Yersinia pestis KIM
ucaaugacuccugaaaua

SEQ ID NO: 2308334 - RNA, 23 nt, Yersinia pestis KIM
ucaaugacuccugaaauaaagaa

SEQ ID NO: 2308335 - RNA, 15 nt, Yersinia pestis KIM
ucaaucacuggcaau

SEQ ID NO: 2308336 - RNA, 23 nt, Yersinia pestis KIM
ucaaucacuggcaauaauucaga

SEQ ID NO: 2308337 - RNA, 22 nt, Yersinia pestis KIM
ucaaucagcugauaugaaaaau

SEQ ID NO: 2308338 - RNA, 17 nt, Yersinia pestis KIM
ucaauccaaaugacacu

SEQ ID NO: 2308339 - RNA, 20 nt, Yersinia pestis KIM
ucaaugugguaacccgcaag

SEQ ID NO: 2308340 - RNA, 14 nt, Yersinia pestis KIM
ucaauucucccauu

SEQ ID NO: 2308341 - RNA, 22 nt, Yersinia pestis KIM
ucaauuggcucuggaaaucacg

SEQ ID NO: 2308342 - RNA, 15 nt, Yersinia pestis KIM
ucaauugagaauaac

SEQ ID NO: 2308343 - RNA, 16 nt, Yersinia pestis KIM
ucaauugagucucugg

SEQ ID NO: 2308344 - RNA, 23 nt, Yersinia pestis KIM
ucaauugugcaaaaucagcauaa

SEQ ID NO: 2308345 - RNA, 16 nt, Yersinia pestis KIM
ucaacaaucaaucacc

SEQ ID NO: 2308346 - RNA, 15 nt, Yersinia pestis KIM
ucaacaaucaaucac

SEQ ID NO: 2308347 - RNA, 14 nt, Yersinia pestis KIM
ucaacaaguugccc

SEQ ID NO: 2308348 - RNA, 18 nt, Yersinia pestis KIM
ucaacaaauucaccagca

SEQ ID NO: 2308349 - RNA, 14 nt, Yersinia pestis KIM
ucaacacauaaaau

SEQ ID NO: 2308350 - RNA, 18 nt, Yersinia pestis KIM
ucaacacggugaauaaac

SEQ ID NO: 2308351 - RNA, 16 nt, Yersinia pestis KIM
ucaacagcaucaucaa

SEQ ID NO: 2308352 - RNA, 23 nt, Yersinia pestis KIM
ucaacagauaugcauuauugaug

SEQ ID NO: 2308353 - RNA, 22 nt, Yersinia pestis KIM
ucaacagauaugcauuauugau

SEQ ID NO: 2308354 - RNA, 22 nt, Yersinia pestis KIM
ucaacauuuaagugcuaaucau

SEQ ID NO: 2308355 - RNA, 15 nt, Yersinia pestis KIM
ucaaccaagacauaa

SEQ ID NO: 2308356 - RNA, 17 nt, Yersinia pestis KIM
ucaaccacgguaauagc

SEQ ID NO: 2308357 - RNA, 14 nt, Yersinia pestis KIM
ucaacaucgcaccg

SEQ ID NO: 2308358 - RNA, 17 nt, Yersinia pestis KIM
ucaacaucgcaccgaug

SEQ ID NO: 2308359 - RNA, 20 nt, Yersinia pestis KIM
ucaacgccauagcaaaucac

SEQ ID NO: 2308360 - RNA, 17 nt, Yersinia pestis KIM
ucaacgccaaaauaacc

SEQ ID NO: 2308361 - RNA, 19 nt, Yersinia pestis KIM
ucaacgcccagcuuuagca

SEQ ID NO: 2308362 - RNA, 22 nt, Yersinia pestis KIM
ucaacgcccagcuuuuuacgca

SEQ ID NO: 2308363 - RNA, 21 nt, Yersinia pestis KIM
ucaacgcccgcggccaauagc

SEQ ID NO: 2308364 - RNA, 13 nt, Yersinia pestis KIM
ucaaccuuuuccg

SEQ ID NO: 2308365 - RNA, 23 nt, Yersinia pestis KIM
ucaaccuggcaccggacaaacca

SEQ ID NO: 2308366 - RNA, 15 nt, Yersinia pestis KIM
ucaacgaccaguaag

SEQ ID NO: 2308367 - RNA, 19 nt, Yersinia pestis KIM
ucaacgcaccauccagcaa

SEQ ID NO: 2308368 - RNA, 14 nt, Yersinia pestis KIM
ucaaccucagccuc

SEQ ID NO: 2308369 - RNA, 15 nt, Yersinia pestis KIM
ucaaccucagccuca

SEQ ID NO: 2308370 - RNA, 20 nt, Yersinia pestis KIM
ucaaccucagccucauucau

SEQ ID NO: 2308371 - RNA, 16 nt, Yersinia pestis KIM
ucaaccugaucaucaa

SEQ ID NO: 2308372 - RNA, 11 nt, Yersinia pestis KIM
ucaaccugaau

SEQ ID NO: 2308373 - RNA, 17 nt, Yersinia pestis KIM
ucaaccccuucuucacc

SEQ ID NO: 2308374 - RNA, 16 nt, Yersinia pestis KIM
ucaacuuucucuggca

SEQ ID NO: 2308375 - RNA, 21 nt, Yersinia pestis KIM
ucaacuuuaauaugcaaaaaa

SEQ ID NO: 2308376 - RNA, 12 nt, Yersinia pestis KIM
ucaacuucaacg

SEQ ID NO: 2308377 - RNA, 17 nt, Yersinia pestis KIM
ucaacuucacuuugacu

SEQ ID NO: 2308378 - RNA, 22 nt, Yersinia pestis KIM
ucaacuaccccacauucaguac

SEQ ID NO: 2308379 - RNA, 14 nt, Yersinia pestis KIM
ucaacggcaccaca

SEQ ID NO: 2308380 - RNA, 15 nt, Yersinia pestis KIM
ucaacgcucaaucac

SEQ ID NO: 2308381 - RNA, 21 nt, Yersinia pestis KIM
ucaacgcgaauaucaggcacu

SEQ ID NO: 2308382 - RNA, 17 nt, Yersinia pestis KIM
ucaaacugauaaagcaa

SEQ ID NO: 2308383 - RNA, 22 nt, Yersinia pestis KIM
ucaaaucagaggcuucauucgu

SEQ ID NO: 2308384 - RNA, 21 nt, Yersinia pestis KIM
ucaaauagauagcaaucaaua

SEQ ID NO: 2308385 - RNA, 12 nt, Yersinia pestis KIM
ucaaaugucccc

SEQ ID NO: 2308386 - RNA, 14 nt, Yersinia pestis KIM
ucaaaugauucagu

SEQ ID NO: 2308387 - RNA, 21 nt, Yersinia pestis KIM
ucaaaugauucagugauaaca

SEQ ID NO: 2308388 - RNA, 15 nt, Yersinia pestis KIM
ucaacaaacaguuca

SEQ ID NO: 2308389 - RNA, 22 nt, Yersinia pestis KIM
ucaaauugcacaugcagcauuu

SEQ ID NO: 2308390 - RNA, 23 nt, Yersinia pestis KIM
ucaaaaggauggcccaagccauc

SEQ ID NO: 2308391 - RNA, 19 nt, Yersinia pestis KIM
ucaaaaggauggcccaagc

SEQ ID NO: 2308392 - RNA, 20 nt, Yersinia pestis KIM
ucaaaaggauggcccaagcc

SEQ ID NO: 2308393 - RNA, 21 nt, Yersinia pestis KIM
ucaaaaggauggcccaagcca

SEQ ID NO: 2308394 - RNA, 12 nt, Yersinia pestis KIM
ucaaaauuccau

SEQ ID NO: 2308395 - RNA, 17 nt, Yersinia pestis KIM
uauuuacaaauaaccgc

SEQ ID NO: 2308396 - RNA, 24 nt, Yersinia pestis KIM
ucaaaacggcaauuaagcaaaaag

SEQ ID NO: 2308397 - RNA, 16 nt, Yersinia pestis KIM
ucaaaacugauuaaua

SEQ ID NO: 2308398 - RNA, 22 nt, Yersinia pestis KIM
ucaaaagaaacugucagucaaa

SEQ ID NO: 2308399 - RNA, 14 nt, Yersinia pestis KIM
ucaaaagcggcucu

SEQ ID NO: 2308400 - RNA, 11 nt, Yersinia pestis KIM
ucaaacaaaua

SEQ ID NO: 2308401 - RNA, 13 nt, Yersinia pestis KIM
ucaaacaaaucuu

SEQ ID NO: 2308402 - RNA, 13 nt, Yersinia pestis KIM
ucaaacauagaca

SEQ ID NO: 2308403 - RNA, 20 nt, Yersinia pestis KIM
ucaaaccaagcccuuuggca

SEQ ID NO: 2308404 - RNA, 17 nt, Yersinia pestis KIM
ucagaaacggugaaaau

SEQ ID NO: 2308405 - RNA, 20 nt, Yersinia pestis KIM
ucagaaauaaauucaucuca

SEQ ID NO: 2308406 - RNA, 20 nt, Yersinia pestis KIM
ucagaaccgacagguuaggg

SEQ ID NO: 2308407 - RNA, 20 nt, Yersinia pestis KIM
ucagaaccuguuacaucaga

SEQ ID NO: 2308408 - RNA, 14 nt, Yersinia pestis KIM
ucagaaacaucuuc

SEQ ID NO: 2308409 - RNA, 15 nt, Yersinia pestis KIM
ucagaaaauucauac

SEQ ID NO: 2308410 - RNA, 11 nt, Yersinia pestis KIM
ucagaaaacag

SEQ ID NO: 2308411 - RNA, 15 nt, Yersinia pestis KIM
ucacuuuuugucaau

SEQ ID NO: 2308412 - RNA, 18 nt, Yersinia pestis KIM
ucacuuuuaagauccugu

SEQ ID NO: 2308413 - RNA, 14 nt, Yersinia pestis KIM
ucacuuuuacggac

SEQ ID NO: 2308414 - RNA, 19 nt, Yersinia pestis KIM
ucacuuuuaugacggcauc

SEQ ID NO: 2308415 - RNA, 23 nt, Yersinia pestis KIM
ucacuuugcauuuucuggugagc

SEQ ID NO: 2308416 - RNA, 13 nt, Yersinia pestis KIM
ucacuuugucaau

SEQ ID NO: 2308417 - RNA, 15 nt, Yersinia pestis KIM
ucacuggcaccgcuu

SEQ ID NO: 2308418 - RNA, 21 nt, Yersinia pestis KIM
ucacuggaguuaaaucccugu

SEQ ID NO: 2308419 - RNA, 22 nt, Yersinia pestis KIM
ucacuggaguuaaaucccugug

SEQ ID NO: 2308420 - RNA, 16 nt, Yersinia pestis KIM
ucacuggccgcaggcg

SEQ ID NO: 2308421 - RNA, 19 nt, Yersinia pestis KIM
ucacugcuuuaucaccagu

SEQ ID NO: 2308422 - RNA, 13 nt, Yersinia pestis KIM
ucacuggaaaaag

SEQ ID NO: 2308423 - RNA, 14 nt, Yersinia pestis KIM
ucacugcuccagcc

SEQ ID NO: 2308424 - RNA, 17 nt, Yersinia pestis KIM
ucacugcauacucacuu

SEQ ID NO: 2308425 - RNA, 15 nt, Yersinia pestis KIM
ucacccguaaacaca

SEQ ID NO: 2308426 - RNA, 12 nt, Yersinia pestis KIM
ucacccucugcg

SEQ ID NO: 2308427 - RNA, 12 nt, Yersinia pestis KIM
ucacccucuuuc

SEQ ID NO: 2308428 - RNA, 14 nt, Yersinia pestis KIM
ucacccuggcucug

SEQ ID NO: 2308429 - RNA, 21 nt, Yersinia pestis KIM
ucacccuuuaaaucuagcccu

SEQ ID NO: 2308430 - RNA, 19 nt, Yersinia pestis KIM
ucacggacagcaaccacuu

SEQ ID NO: 2308431 - RNA, 12 nt, Yersinia pestis KIM
ucacgccuaucu

SEQ ID NO: 2308432 - RNA, 22 nt, Yersinia pestis KIM
ucacgcugguuaucacagcaaa

SEQ ID NO: 2308433 - RNA, 17 nt, Yersinia pestis KIM
ucacgcccuacugagaa

SEQ ID NO: 2308434 - RNA, 13 nt, Yersinia pestis KIM
ucacuauaauuau

SEQ ID NO: 2308435 - RNA, 22 nt, Yersinia pestis KIM
ucacuauaauuauuucucugau

SEQ ID NO: 2308436 - RNA, 12 nt, Yersinia pestis KIM
ucacuauaauuu

SEQ ID NO: 2308437 - RNA, 15 nt, Yersinia pestis KIM
ucacuauccuuugau

SEQ ID NO: 2308438 - RNA, 15 nt, Yersinia pestis KIM
ucacguuuuuccauu

SEQ ID NO: 2308439 - RNA, 15 nt, Yersinia pestis KIM
ucagacugcugacaa

SEQ ID NO: 2308440 - RNA, 21 nt, Yersinia pestis KIM
ucagacugcugacaacccuca

SEQ ID NO: 2308441 - RNA, 13 nt, Yersinia pestis KIM
ucagacugcucuu

SEQ ID NO: 2308442 - RNA, 22 nt, Yersinia pestis KIM
ucagacgagucuauugaaaaaa

SEQ ID NO: 2308443 - RNA, 20 nt, Yersinia pestis KIM
ucagacgacgugcagcgcgc

SEQ ID NO: 2308444 - RNA, 17 nt, Yersinia pestis KIM
ucagacggcagcaacga

SEQ ID NO: 2308445 - RNA, 23 nt, Yersinia pestis KIM
ucagagucugucauggcacgcuu

SEQ ID NO: 2308446 - RNA, 12 nt, Yersinia pestis KIM
ucagaguccaau

SEQ ID NO: 2308447 - RNA, 18 nt, Yersinia pestis KIM
ucagaggcucauccugcg

SEQ ID NO: 2308448 - RNA, 22 nt, Yersinia pestis KIM
ucagauaaaaaaggguaaucag

SEQ ID NO: 2308449 - RNA, 16 nt, Yersinia pestis KIM
ucagauaaaaagccag

SEQ ID NO: 2308450 - RNA, 20 nt, Yersinia pestis KIM
ucagagauucagaggaaaga

SEQ ID NO: 2308451 - RNA, 13 nt, Yersinia pestis KIM
ucagacauuuuuc

SEQ ID NO: 2308452 - RNA, 23 nt, Yersinia pestis KIM
ucagacauuuuucuauuucuggu

SEQ ID NO: 2308453 - RNA, 14 nt, Yersinia pestis KIM
ucagacagccauca

SEQ ID NO: 2308454 - RNA, 17 nt, Yersinia pestis KIM
ucagacacguaaaacag

SEQ ID NO: 2308455 - RNA, 21 nt, Yersinia pestis KIM
ucagauuagucuuagacguca

SEQ ID NO: 2308456 - RNA, 19 nt, Yersinia pestis KIM
ucagauuagucuuagacgu

SEQ ID NO: 2308457 - RNA, 14 nt, Yersinia pestis KIM
ucagaucaacagau

SEQ ID NO: 2308458 - RNA, 13 nt, Yersinia pestis KIM
ucagauaucugcu

SEQ ID NO: 2308459 - RNA, 12 nt, Yersinia pestis KIM
ucagauaucagc

SEQ ID NO: 2308460 - RNA, 21 nt, Yersinia pestis KIM
ucagauaaaaauaaucaauga

SEQ ID NO: 2308461 - RNA, 13 nt, Yersinia pestis KIM
ucagauaagaucu

SEQ ID NO: 2308462 - RNA, 13 nt, Yersinia pestis KIM
ucagauaaggcau

SEQ ID NO: 2308463 - RNA, 18 nt, Yersinia pestis KIM
ucagauacggcuccagaa

SEQ ID NO: 2308464 - RNA, 15 nt, Yersinia pestis KIM
ucagauacggcucca

SEQ ID NO: 2308465 - RNA, 14 nt, Yersinia pestis KIM
ucagcaaaucaaac

SEQ ID NO: 2308466 - RNA, 20 nt, Yersinia pestis KIM
ucagauuuagcgauauaacu

SEQ ID NO: 2308467 - RNA, 22 nt, Yersinia pestis KIM
ucagauuuagcgauauaacuca

SEQ ID NO: 2308468 - RNA, 22 nt, Yersinia pestis KIM
ucagauuguuuauaaauuaaaa

SEQ ID NO: 2308469 - RNA, 16 nt, Yersinia pestis KIM
ucagcaaaguauuuau

SEQ ID NO: 2308470 - RNA, 17 nt, Yersinia pestis KIM
ucagcaaaguauuuaua

SEQ ID NO: 2308471 - RNA, 16 nt, Yersinia pestis KIM
aaaucguauaacauaa

SEQ ID NO: 2308472 - RNA, 19 nt, Yersinia pestis KIM
aaaucguaaucaccauuaa

SEQ ID NO: 2308473 - RNA, 17 nt, Yersinia pestis KIM
ucagcgguagcaaagcg

SEQ ID NO: 2308474 - RNA, 20 nt, Yersinia pestis KIM
ucagcucauuaaacuguucu

SEQ ID NO: 2308475 - RNA, 14 nt, Yersinia pestis KIM
ucagcgucuucaau

SEQ ID NO: 2308476 - RNA, 21 nt, Yersinia pestis KIM
ucagcguagccguuaaauauc

SEQ ID NO: 2308477 - RNA, 15 nt, Yersinia pestis KIM
ucagcguauagccuu

SEQ ID NO: 2308478 - RNA, 20 nt, Yersinia pestis KIM
ucagccccgccaggaaaacg

SEQ ID NO: 2308479 - RNA, 23 nt, Yersinia pestis KIM
ucagccaacaagcggacuucacu

SEQ ID NO: 2308480 - RNA, 23 nt, Yersinia pestis KIM
ucagccaagucagggaucaccuc

SEQ ID NO: 2308481 - RNA, 16 nt, Yersinia pestis KIM
ucagcgauuuuaaaaa

SEQ ID NO: 2308482 - RNA, 14 nt, Yersinia pestis KIM
ucagcgcacugcau

SEQ ID NO: 2308483 - RNA, 12 nt, Yersinia pestis KIM
ucagcaccuauc

SEQ ID NO: 2308484 - RNA, 13 nt, Yersinia pestis KIM
ucagcauuaauac

SEQ ID NO: 2308485 - RNA, 15 nt, Yersinia pestis KIM
ucagcauauuaccca

SEQ ID NO: 2308486 - RNA, 13 nt, Yersinia pestis KIM
ucagcauaucccu

SEQ ID NO: 2308487 - RNA, 20 nt, Yersinia pestis KIM
ucagcauaucccuguuuucu

SEQ ID NO: 2308488 - RNA, 20 nt, Yersinia pestis KIM
ucagcaucuuuaauaaauuu

SEQ ID NO: 2308489 - RNA, 19 nt, Yersinia pestis KIM
ucagcagucugaggcccgc

SEQ ID NO: 2308490 - RNA, 22 nt, Yersinia pestis KIM
ucagcagucugaggcccgcuag

SEQ ID NO: 2308491 - RNA, 22 nt, Yersinia pestis KIM
ucagcagucugagccucaugaa

SEQ ID NO: 2308492 - RNA, 17 nt, Yersinia pestis KIM
ucagcagucugaggccc

SEQ ID NO: 2308493 - RNA, 11 nt, Yersinia pestis KIM
ucagcagucug

SEQ ID NO: 2308494 - RNA, 21 nt, Yersinia pestis KIM
ucagcagucugaaaucuccuc

SEQ ID NO: 2308495 - RNA, 16 nt, Yersinia pestis KIM
ucagcaggggcaaccu

SEQ ID NO: 2308496 - RNA, 13 nt, Yersinia pestis KIM
ucaggcucaucac

SEQ ID NO: 2308497 - RNA, 15 nt, Yersinia pestis KIM
ucaggcucaucaccu

SEQ ID NO: 2308498 - RNA, 19 nt, Yersinia pestis KIM
ucaggcucaucaccuucca

SEQ ID NO: 2308499 - RNA, 16 nt, Yersinia pestis KIM
ucaggucgauuacaua

SEQ ID NO: 2308500 - RNA, 19 nt, Yersinia pestis KIM
ucagugguuuuauaaauaa

SEQ ID NO: 2308501 - RNA, 16 nt, Yersinia pestis KIM
ucagugguuuuaucaa

SEQ ID NO: 2308502 - RNA, 16 nt, Yersinia pestis KIM
ucaguguauuuaucaa

SEQ ID NO: 2308503 - RNA, 14 nt, Yersinia pestis KIM
ucagugucagcaaa

SEQ ID NO: 2308504 - RNA, 16 nt, Yersinia pestis KIM
ucagugggcuauuuau

SEQ ID NO: 2308505 - RNA, 18 nt, Yersinia pestis KIM
ucaguaguggcuccacua

SEQ ID NO: 2308506 - RNA, 20 nt, Yersinia pestis KIM
ucaguaucagcgauuuuaaa

SEQ ID NO: 2308507 - RNA, 15 nt, Yersinia pestis KIM
ucaguauuggucuua

SEQ ID NO: 2308508 - RNA, 17 nt, Yersinia pestis KIM
ucagucucuuuacggaa

SEQ ID NO: 2308509 - RNA, 20 nt, Yersinia pestis KIM
ucagugaaggaugaauaaau

SEQ ID NO: 2308510 - RNA, 15 nt, Yersinia pestis KIM
ucagugaagagauaa

SEQ ID NO: 2308511 - RNA, 21 nt, Yersinia pestis KIM
ucagugaaagggaaguuucuu

SEQ ID NO: 2308512 - RNA, 13 nt, Yersinia pestis KIM
ucaggcccugaga

SEQ ID NO: 2308513 - RNA, 20 nt, Yersinia pestis KIM
ucaggccgguauucagccaa

SEQ ID NO: 2308514 - RNA, 20 nt, Yersinia pestis KIM
aaaucuagcccuucagcaaa

SEQ ID NO: 2308515 - RNA, 21 nt, Yersinia pestis KIM
aaaucuacuuuauucaauacu

SEQ ID NO: 2308516 - RNA, 22 nt, Yersinia pestis KIM
aaaucuccuguggcacaucaau

SEQ ID NO: 2308517 - RNA, 18 nt, Yersinia pestis KIM
aaaucuccuccggagagg

SEQ ID NO: 2308518 - RNA, 16 nt, Yersinia pestis KIM
ucagcucuucuaacac

SEQ ID NO: 2308519 - RNA, 21 nt, Yersinia pestis KIM
guggccaguaacgcuucauca

SEQ ID NO: 2308520 - RNA, 23 nt, Yersinia pestis KIM
guggcagauuggcuugcuugaug

SEQ ID NO: 2308521 - RNA, 18 nt, Yersinia pestis KIM
guggcguucccgcaggcg

SEQ ID NO: 2308522 - RNA, 22 nt, Yersinia pestis KIM
guggcgguucgagcggcauauc

SEQ ID NO: 2308523 - RNA, 23 nt, Yersinia pestis KIM
guggcuaucugaaacugagauuu

SEQ ID NO: 2308524 - RNA, 15 nt, Yersinia pestis KIM
gugggcagggcagcu

SEQ ID NO: 2308525 - RNA, 22 nt, Yersinia pestis KIM
guggcaacucuagcgccagcaa

SEQ ID NO: 2308526 - RNA, 13 nt, Yersinia pestis KIM
guggauccagcac

SEQ ID NO: 2308527 - RNA, 20 nt, Yersinia pestis KIM
guggauagggauuguuuuca

SEQ ID NO: 2308528 - RNA, 15 nt, Yersinia pestis KIM
guggauaaacaaaua

SEQ ID NO: 2308529 - RNA, 17 nt, Yersinia pestis KIM
guggaguaguucuuggg

SEQ ID NO: 2308530 - RNA, 22 nt, Yersinia pestis KIM
guggagagaaaggcuuugccug

SEQ ID NO: 2308531 - RNA, 18 nt, Yersinia pestis KIM
gugcuguuccaaccaacc

SEQ ID NO: 2308532 - RNA, 20 nt, Yersinia pestis KIM
gugcuguuggugauauaaau

SEQ ID NO: 2308533 - RNA, 13 nt, Yersinia pestis KIM
aaauauaaaauaa

SEQ ID NO: 2308534 - RNA, 22 nt, Yersinia pestis KIM
aaauauaagauuccuuaccuga

SEQ ID NO: 2308535 - RNA, 17 nt, Yersinia pestis KIM
gugguguuggcuguggu

SEQ ID NO: 2308536 - RNA, 12 nt, Yersinia pestis KIM
gugguuaccauc

SEQ ID NO: 2308537 - RNA, 15 nt, Yersinia pestis KIM
gugguucaaccaccg

SEQ ID NO: 2308538 - RNA, 20 nt, Yersinia pestis KIM
gugguuagcagauaauaaau

SEQ ID NO: 2308539 - RNA, 12 nt, Yersinia pestis KIM
gugguguuaucc

SEQ ID NO: 2308540 - RNA, 15 nt, Yersinia pestis KIM
gugucagaccaaaua

SEQ ID NO: 2308541 - RNA, 19 nt, Yersinia pestis KIM
gugucagggcaauaacaaa

SEQ ID NO: 2308542 - RNA, 17 nt, Yersinia pestis KIM
gugucaguacgcuggcc

SEQ ID NO: 2308543 - RNA, 17 nt, Yersinia pestis KIM
gugucaguaugaaauuu

SEQ ID NO: 2308544 - RNA, 13 nt, Yersinia pestis KIM
gugucagcaaacu

SEQ ID NO: 2308545 - RNA, 23 nt, Yersinia pestis KIM
gugucaccgagagauucaugggc

SEQ ID NO: 2308546 - RNA, 18 nt, Yersinia pestis KIM
gugucaugcgcagaaaac

SEQ ID NO: 2308547 - RNA, 22 nt, Yersinia pestis KIM
gugugaacagugaugagaaucu

SEQ ID NO: 2308548 - RNA, 21 nt, Yersinia pestis KIM
gugugucuucagaaugaaagg

SEQ ID NO: 2308549 - RNA, 19 nt, Yersinia pestis KIM
guguguggcaauaaaggca

SEQ ID NO: 2308550 - RNA, 18 nt, Yersinia pestis KIM
guguuaaccgccccaaca

SEQ ID NO: 2308551 - RNA, 16 nt, Yersinia pestis KIM
gugugggcuggugcgg

SEQ ID NO: 2308552 - RNA, 21 nt, Yersinia pestis KIM
guguucauaaauuaaaacuga

SEQ ID NO: 2308553 - RNA, 23 nt, Yersinia pestis KIM
gugugcugcgaagaucacucaug

SEQ ID NO: 2308554 - RNA, 17 nt, Yersinia pestis KIM
gugugcagcaagaacaa

SEQ ID NO: 2308555 - RNA, 14 nt, Yersinia pestis KIM
gugugauuuccauc

SEQ ID NO: 2308556 - RNA, 10 nt, Yersinia pestis KIM
aaauauccug

SEQ ID NO: 2308557 - RNA, 16 nt, Yersinia pestis KIM
aaauauccugcucagc

SEQ ID NO: 2308558 - RNA, 20 nt, Yersinia pestis KIM
aaauauccugcucagcuaaa

SEQ ID NO: 2308559 - RNA, 18 nt, Yersinia pestis KIM
aaauaucauuaacaaacu

SEQ ID NO: 2308560 - RNA, 18 nt, Yersinia pestis KIM
aaauaucauuauuuugaa

SEQ ID NO: 2308561 - RNA, 15 nt, Yersinia pestis KIM
aaauaucauuaacaa

SEQ ID NO: 2308562 - RNA, 13 nt, Yersinia pestis KIM
aaauaucacuuuu

SEQ ID NO: 2308563 - RNA, 22 nt, Yersinia pestis KIM
aaauaucacuauaauuauuucu

SEQ ID NO: 2308564 - RNA, 22 nt, Yersinia pestis KIM
guuccacaauguugauacucca

SEQ ID NO: 2308565 - RNA, 21 nt, Yersinia pestis KIM
guuccaacgcacacccccauu

SEQ ID NO: 2308566 - RNA, 21 nt, Yersinia pestis KIM
guuccagugagcaauccaacc

SEQ ID NO: 2308567 - RNA, 18 nt, Yersinia pestis KIM
guuccaguucgacauaaa

SEQ ID NO: 2308568 - RNA, 18 nt, Yersinia pestis KIM
guucaucagcccagcggu

SEQ ID NO: 2308569 - RNA, 16 nt, Yersinia pestis KIM
guucaggcagauaaau

SEQ ID NO: 2308570 - RNA, 15 nt, Yersinia pestis KIM
guucaggauccgccu

SEQ ID NO: 2308571 - RNA, 18 nt, Yersinia pestis KIM
guucaucauuuuuuaucu

SEQ ID NO: 2308572 - RNA, 23 nt, Yersinia pestis KIM
guucagcgacgauaauuugcagc

SEQ ID NO: 2308573 - RNA, 13 nt, Yersinia pestis KIM
guuauuuucuaua

SEQ ID NO: 2308574 - RNA, 19 nt, Yersinia pestis KIM
guuauuuuggcuuucagug

SEQ ID NO: 2308575 - RNA, 14 nt, Yersinia pestis KIM
guuauuugaauaaa

SEQ ID NO: 2308576 - RNA, 17 nt, Yersinia pestis KIM
guuauuugaauaaaaga

SEQ ID NO: 2308577 - RNA, 15 nt, Yersinia pestis KIM
guuauuugaauaaga

SEQ ID NO: 2308578 - RNA, 17 nt, Yersinia pestis KIM
guuauuucugguagccu

SEQ ID NO: 2308579 - RNA, 15 nt, Yersinia pestis KIM
guuauuucuguucca

SEQ ID NO: 2308580 - RNA, 14 nt, Yersinia pestis KIM
guuauuggcuaaag

SEQ ID NO: 2308581 - RNA, 13 nt, Yersinia pestis KIM
guucgguaaauaa

SEQ ID NO: 2308582 - RNA, 15 nt, Yersinia pestis KIM
guuccuguuuuugaa

SEQ ID NO: 2308583 - RNA, 19 nt, Yersinia pestis KIM
guuccuucagccaccagau

SEQ ID NO: 2308584 - RNA, 16 nt, Yersinia pestis KIM
guuccuucagccacca

SEQ ID NO: 2308585 - RNA, 19 nt, Yersinia pestis KIM
guuccuggaaccagugaau

SEQ ID NO: 2308586 - RNA, 18 nt, Yersinia pestis KIM
guuacuuccauaaacgga

SEQ ID NO: 2308587 - RNA, 15 nt, Yersinia pestis KIM
guuacuguaagauaa

SEQ ID NO: 2308588 - RNA, 19 nt, Yersinia pestis KIM
guuacuguaagauaauucg

SEQ ID NO: 2308589 - RNA, 12 nt, Yersinia pestis KIM
guuagugaguua

SEQ ID NO: 2308590 - RNA, 17 nt, Yersinia pestis KIM
guuagucacucaagcca

SEQ ID NO: 2308591 - RNA, 20 nt, Yersinia pestis KIM
guuauagaucuccugcaacg

SEQ ID NO: 2308592 - RNA, 23 nt, Yersinia pestis KIM
guuaucaagaucaaaagcagaga

SEQ ID NO: 2308593 - RNA, 22 nt, Yersinia pestis KIM
guuaucaaauacgaccgucacc

SEQ ID NO: 2308594 - RNA, 15 nt, Yersinia pestis KIM
guuaugccaaccgga

SEQ ID NO: 2308595 - RNA, 17 nt, Yersinia pestis KIM
guuaucuuuuauuuaug

SEQ ID NO: 2308596 - RNA, 18 nt, Yersinia pestis KIM
guuaugaggggaggcugu

SEQ ID NO: 2308597 - RNA, 20 nt, Yersinia pestis KIM
guuaugaugaguaacauaau

SEQ ID NO: 2308598 - RNA, 18 nt, Yersinia pestis KIM
guuaucaauuaacuacac

SEQ ID NO: 2308599 - RNA, 15 nt, Yersinia pestis KIM
guuaucuggaauuua

SEQ ID NO: 2308600 - RNA, 15 nt, Yersinia pestis KIM
guuaaaaagaaaaag

SEQ ID NO: 2308601 - RNA, 15 nt, Yersinia pestis KIM
guuaaaaaauucauc

SEQ ID NO: 2308602 - RNA, 11 nt, Yersinia pestis KIM
guuaaaaaaau

SEQ ID NO: 2308603 - RNA, 22 nt, Yersinia pestis KIM
guuaaaaaauucaucuuuaaca

SEQ ID NO: 2308604 - RNA, 20 nt, Yersinia pestis KIM
guuaacaccaucaacauggg

SEQ ID NO: 2308605 - RNA, 21 nt, Yersinia pestis KIM
guuaauugguuaauugccgcg

SEQ ID NO: 2308606 - RNA, 23 nt, Yersinia pestis KIM
guuaauugccgcgucuguuaucu

SEQ ID NO: 2308607 - RNA, 14 nt, Yersinia pestis KIM
guuaacccaaagcc

SEQ ID NO: 2308608 - RNA, 12 nt, Yersinia pestis KIM
guuaacccaaag

SEQ ID NO: 2308609 - RNA, 20 nt, Yersinia pestis KIM
guuaacucagccacaagaua

SEQ ID NO: 2308610 - RNA, 16 nt, Yersinia pestis KIM
guuaacucauuuaucu

SEQ ID NO: 2308611 - RNA, 21 nt, Yersinia pestis KIM
guuaacuggcuccgcacggcu

SEQ ID NO: 2308612 - RNA, 20 nt, Yersinia pestis KIM
guuaacugcaguaaaaauau

SEQ ID NO: 2308613 - RNA, 13 nt, Yersinia pestis KIM
guuaacuuuuucu

SEQ ID NO: 2308614 - RNA, 19 nt, Yersinia pestis KIM
guuaagagaucccgugcca

SEQ ID NO: 2308615 - RNA, 16 nt, Yersinia pestis KIM
guuaagagugcuggca

SEQ ID NO: 2308616 - RNA, 18 nt, Yersinia pestis KIM
guuaagcagguagcuguu

SEQ ID NO: 2308617 - RNA, 13 nt, Yersinia pestis KIM
guuguaugucaau

SEQ ID NO: 2308618 - RNA, 17 nt, Yersinia pestis KIM
guugguagcguuuuuuc

SEQ ID NO: 2308619 - RNA, 15 nt, Yersinia pestis KIM
guugcuguucucucc

SEQ ID NO: 2308620 - RNA, 18 nt, Yersinia pestis KIM
guugcuauuuccccgccg

SEQ ID NO: 2308621 - RNA, 16 nt, Yersinia pestis KIM
guugcucacccauuuu

SEQ ID NO: 2308622 - RNA, 23 nt, Yersinia pestis KIM
guucucacuuggguagcagccca

SEQ ID NO: 2308623 - RNA, 18 nt, Yersinia pestis KIM
guucuacugcguccuuug

SEQ ID NO: 2308624 - RNA, 20 nt, Yersinia pestis KIM
guucuacagggaaaaacgca

SEQ ID NO: 2308625 - RNA, 14 nt, Yersinia pestis KIM
guugaguauacuaa

SEQ ID NO: 2308626 - RNA, 21 nt, Yersinia pestis KIM
guucuccaguugccagcaggc

SEQ ID NO: 2308627 - RNA, 21 nt, Yersinia pestis KIM
guugcaggaauccaaguucaa

SEQ ID NO: 2308628 - RNA, 15 nt, Yersinia pestis KIM
guugcacccugcuug

SEQ ID NO: 2308629 - RNA, 20 nt, Yersinia pestis KIM
guugauaaaacacucuuuuu

SEQ ID NO: 2308630 - RNA, 20 nt, Yersinia pestis KIM
guugauaaacaauaaacaga

SEQ ID NO: 2308631 - RNA, 21 nt, Yersinia pestis KIM
guugauaaguugagaucaacu

SEQ ID NO: 2308632 - RNA, 22 nt, Yersinia pestis KIM
guuuaucaaacagcacaucgcc

SEQ ID NO: 2308633 - RNA, 17 nt, Yersinia pestis KIM
guuuaucacccgccauc

SEQ ID NO: 2308634 - RNA, 18 nt, Yersinia pestis KIM
guuuaucucgcugugccc

SEQ ID NO: 2308635 - RNA, 20 nt, Yersinia pestis KIM
guuuaugcagggaaccuggg

SEQ ID NO: 2308636 - RNA, 16 nt, Yersinia pestis KIM
guuuaacucaaauaaa

SEQ ID NO: 2308637 - RNA, 20 nt, Yersinia pestis KIM
guugucagcagucugaaauc

SEQ ID NO: 2308638 - RNA, 13 nt, Yersinia pestis KIM
guuuacuuuaaau

SEQ ID NO: 2308639 - RNA, 14 nt, Yersinia pestis KIM
guuuacucgcuccg

SEQ ID NO: 2308640 - RNA, 13 nt, Yersinia pestis KIM
guuuacguaaaua

SEQ ID NO: 2308641 - RNA, 14 nt, Yersinia pestis KIM
aaauauuaauccau

SEQ ID NO: 2308642 - RNA, 18 nt, Yersinia pestis KIM
aaauauucauuaaaaaau

SEQ ID NO: 2308643 - RNA, 15 nt, Yersinia pestis KIM
aaauauucauuaaaa

SEQ ID NO: 2308644 - RNA, 22 nt, Yersinia pestis KIM
aaauauucauuaaaaaauaauu

SEQ ID NO: 2308645 - RNA, 16 nt, Yersinia pestis KIM
aaauauggguuaaaaa

SEQ ID NO: 2308646 - RNA, 20 nt, Yersinia pestis KIM
aaauauggguuaaaaacuuu

SEQ ID NO: 2308647 - RNA, 16 nt, Yersinia pestis KIM
aaauauggcggcauca

SEQ ID NO: 2308648 - RNA, 21 nt, Yersinia pestis KIM
guuuccaaaacucauguccag

SEQ ID NO: 2308649 - RNA, 17 nt, Yersinia pestis KIM
guuuccacgaaggcacc

SEQ ID NO: 2308650 - RNA, 22 nt, Yersinia pestis KIM
aaauauucucaauauuaauaau

SEQ ID NO: 2308651 - RNA, 21 nt, Yersinia pestis KIM
aaauauucucaauauuaauaa

SEQ ID NO: 2308652 - RNA, 18 nt, Yersinia pestis KIM
guuucaguggcuucucuu

SEQ ID NO: 2308653 - RNA, 19 nt, Yersinia pestis KIM
guuucauccccaccaggua

SEQ ID NO: 2308654 - RNA, 18 nt, Yersinia pestis KIM
guuucaucgacucuuuuu

SEQ ID NO: 2308655 - RNA, 13 nt, Yersinia pestis KIM
guuucacccucug

SEQ ID NO: 2308656 - RNA, 12 nt, Yersinia pestis KIM
guuucagggugg

SEQ ID NO: 2308657 - RNA, 20 nt, Yersinia pestis KIM
guuucaguaaaaccagcagc

SEQ ID NO: 2308658 - RNA, 19 nt, Yersinia pestis KIM
guuucagcuccgauuaagu

SEQ ID NO: 2308659 - RNA, 15 nt, Yersinia pestis KIM
guuucagacuccugc

SEQ ID NO: 2308660 - RNA, 17 nt, Yersinia pestis KIM
aaauaugaucuugauaa

SEQ ID NO: 2308661 - RNA, 20 nt, Yersinia pestis KIM
aaauaucuuucagcaccaua

SEQ ID NO: 2308662 - RNA, 16 nt, Yersinia pestis KIM
guuugcgccguaaacu

SEQ ID NO: 2308663 - RNA, 23 nt, Yersinia pestis KIM
guuugcggucuggcaacugcaaa

SEQ ID NO: 2308664 - RNA, 20 nt, Yersinia pestis KIM
guuugccguuuccagugcgg

SEQ ID NO: 2308665 - RNA, 22 nt, Yersinia pestis KIM
guuugcucuucccugcgcugag

SEQ ID NO: 2308666 - RNA, 23 nt, Yersinia pestis KIM
guuuuaggcaauccaaacauaca

SEQ ID NO: 2308667 - RNA, 15 nt, Yersinia pestis KIM
guuuguuuggauaaa

SEQ ID NO: 2308668 - RNA, 19 nt, Yersinia pestis KIM
guuuguuucucugccgcca

SEQ ID NO: 2308669 - RNA, 12 nt, Yersinia pestis KIM
guuugacgcugu

SEQ ID NO: 2308670 - RNA, 14 nt, Yersinia pestis KIM
guuugacggcggcg

SEQ ID NO: 2308671 - RNA, 14 nt, Yersinia pestis KIM
guuugagaccccca

SEQ ID NO: 2308672 - RNA, 18 nt, Yersinia pestis KIM
guuugaucccacugcccg

SEQ ID NO: 2308673 - RNA, 15 nt, Yersinia pestis KIM
guuucuuacuaaaau

SEQ ID NO: 2308674 - RNA, 16 nt, Yersinia pestis KIM
guuucuuacuaaaaua

SEQ ID NO: 2308675 - RNA, 23 nt, Yersinia pestis KIM
aaauccaccagcgggcggcagau

SEQ ID NO: 2308676 - RNA, 18 nt, Yersinia pestis KIM
aaauccaagccaccacca

SEQ ID NO: 2308677 - RNA, 15 nt, Yersinia pestis KIM
aaaucauagccagcg

SEQ ID NO: 2308678 - RNA, 17 nt, Yersinia pestis KIM
aaaucagaggcuucauu

SEQ ID NO: 2308679 - RNA, 21 nt, Yersinia pestis KIM
aaaucaguuccugauucgguu

SEQ ID NO: 2308680 - RNA, 17 nt, Yersinia pestis KIM
aaaucagacgagucuau

SEQ ID NO: 2308681 - RNA, 23 nt, Yersinia pestis KIM
aaaucagacgagucuauugaaaa

SEQ ID NO: 2308682 - RNA, 18 nt, Yersinia pestis KIM
guuuugcagaucaaucgc

SEQ ID NO: 2308683 - RNA, 21 nt, Yersinia pestis KIM
guuuugcaaugcuuauuucac

SEQ ID NO: 2308684 - RNA, 18 nt, Yersinia pestis KIM
guuuugcuaacugugcca

SEQ ID NO: 2308685 - RNA, 14 nt, Yersinia pestis KIM
guuuugacuaaaau

SEQ ID NO: 2308686 - RNA, 15 nt, Yersinia pestis KIM
guuuugacuaaaauu

SEQ ID NO: 2308687 - RNA, 14 nt, Yersinia pestis KIM
aaauauuguugcca

SEQ ID NO: 2308688 - RNA, 13 nt, Yersinia pestis KIM
aaaucaaaaauga

SEQ ID NO: 2308689 - RNA, 18 nt, Yersinia pestis KIM
aaaucaagggcgauggca

SEQ ID NO: 2308690 - RNA, 17 nt, Yersinia pestis KIM
aaaucaauaucgcuaaa

SEQ ID NO: 2308691 - RNA, 14 nt, Yersinia pestis KIM
aaaucaccccccug

SEQ ID NO: 2308692 - RNA, 18 nt, Yersinia pestis KIM
aaaucacccgcaagaaua

SEQ ID NO: 2308693 - RNA, 19 nt, Yersinia pestis KIM
aaaucacccgcaagaauaa

SEQ ID NO: 2308694 - RNA, 19 nt, Yersinia pestis KIM
aaaucacguuuccaaaacu

SEQ ID NO: 2308695 - RNA, 22 nt, Yersinia pestis KIM
aaaucacguuuccaaaacucau

SEQ ID NO: 2308696 - RNA, 12 nt, Yersinia pestis KIM
aaaucacacugg

SEQ ID NO: 2308697 - RNA, 16 nt, Yersinia pestis KIM
aaaucaccaaauccaa

SEQ ID NO: 2308698 - RNA, 22 nt, Yersinia pestis KIM
guuucuauccgaaaaauauucu

SEQ ID NO: 2308699 - RNA, 13 nt, Yersinia pestis KIM
gugaauuagguaa

SEQ ID NO: 2308700 - RNA, 14 nt, Yersinia pestis KIM
gugaaucagccaga

SEQ ID NO: 2308701 - RNA, 14 nt, Yersinia pestis KIM
gugaauaaaucaaa

SEQ ID NO: 2308702 - RNA, 14 nt, Yersinia pestis KIM
gugaagaacagcag

SEQ ID NO: 2308703 - RNA, 19 nt, Yersinia pestis KIM
gugaacggccaucaauaaa

SEQ ID NO: 2308704 - RNA, 21 nt, Yersinia pestis KIM
gugaagcaauuugaucaccaa

SEQ ID NO: 2308705 - RNA, 18 nt, Yersinia pestis KIM
gugaagaacagcaguggg

SEQ ID NO: 2308706 - RNA, 21 nt, Yersinia pestis KIM
aaauagcggccaacauaauca

SEQ ID NO: 2308707 - RNA, 23 nt, Yersinia pestis KIM
aaauagcggccaacauaaucaau

SEQ ID NO: 2308708 - RNA, 16 nt, Yersinia pestis KIM
aaauagcggccaacau

SEQ ID NO: 2308709 - RNA, 18 nt, Yersinia pestis KIM
aaauagcggccaacauaa

SEQ ID NO: 2308710 - RNA, 14 nt, Yersinia pestis KIM
aaauagccuuccuu

SEQ ID NO: 2308711 - RNA, 15 nt, Yersinia pestis KIM
aaauagccuuccuug

SEQ ID NO: 2308712 - RNA, 18 nt, Yersinia pestis KIM
aaauagcuuccauuaaaa

SEQ ID NO: 2308713 - RNA, 14 nt, Yersinia pestis KIM
aaauagcuucccug

SEQ ID NO: 2308714 - RNA, 16 nt, Yersinia pestis KIM
gugaaccguacagaua

SEQ ID NO: 2308715 - RNA, 20 nt, Yersinia pestis KIM
gugaccgcagauauccuuuu

SEQ ID NO: 2308716 - RNA, 23 nt, Yersinia pestis KIM
gugacgcuugaauauagcguuca

SEQ ID NO: 2308717 - RNA, 18 nt, Yersinia pestis KIM
gugacgucguagaggcga

SEQ ID NO: 2308718 - RNA, 18 nt, Yersinia pestis KIM
gugacgcuggcacuggau

SEQ ID NO: 2308719 - RNA, 21 nt, Yersinia pestis KIM
aaauaguuacuauauaaauga

SEQ ID NO: 2308720 - RNA, 21 nt, Yersinia pestis KIM
gugaccaaagcaguaaacauu

SEQ ID NO: 2308721 - RNA, 18 nt, Yersinia pestis KIM
gugaccaaagcaguaaac

SEQ ID NO: 2308722 - RNA, 13 nt, Yersinia pestis KIM
gugacauuuucac

SEQ ID NO: 2308723 - RNA, 14 nt, Yersinia pestis KIM
aaauagucaguaaa

SEQ ID NO: 2308724 - RNA, 22 nt, Yersinia pestis KIM
aaauagucagugggcuauuuau

SEQ ID NO: 2308725 - RNA, 21 nt, Yersinia pestis KIM
aaauagucguuauauaaaugg

SEQ ID NO: 2308726 - RNA, 23 nt, Yersinia pestis KIM
aaauagugcuaucugcugcggua

SEQ ID NO: 2308727 - RNA, 22 nt, Yersinia pestis KIM
aaauagugauuagcaucugcaa

SEQ ID NO: 2308728 - RNA, 13 nt, Yersinia pestis KIM
aaauaggcgucag

SEQ ID NO: 2308729 - RNA, 21 nt, Yersinia pestis KIM
aaauaggcguuaucggcgcag

SEQ ID NO: 2308730 - RNA, 18 nt, Yersinia pestis KIM
aaauagguaguggaaaga

SEQ ID NO: 2308731 - RNA, 23 nt, Yersinia pestis KIM
aaauaggcaggcccgcuucccua

SEQ ID NO: 2308732 - RNA, 15 nt, Yersinia pestis KIM
aaauaggccauucaa

SEQ ID NO: 2308733 - RNA, 21 nt, Yersinia pestis KIM
aaauagggaagguguuuaaaa

SEQ ID NO: 2308734 - RNA, 13 nt, Yersinia pestis KIM
gugcaaugcagau

SEQ ID NO: 2308735 - RNA, 14 nt, Yersinia pestis KIM
gugcaaucuaaagg

SEQ ID NO: 2308736 - RNA, 20 nt, Yersinia pestis KIM
gugcaaucuguuauaaaaaa

SEQ ID NO: 2308737 - RNA, 18 nt, Yersinia pestis KIM
gugcaggcuaccagaaau

SEQ ID NO: 2308738 - RNA, 16 nt, Yersinia pestis KIM
gugauaaguuuuaaua

SEQ ID NO: 2308739 - RNA, 15 nt, Yersinia pestis KIM
gugaucgcucaggcg

SEQ ID NO: 2308740 - RNA, 22 nt, Yersinia pestis KIM
gugauuagcaucugcaacaccg

SEQ ID NO: 2308741 - RNA, 16 nt, Yersinia pestis KIM
gugauuauuuaaacaa

SEQ ID NO: 2308742 - RNA, 15 nt, Yersinia pestis KIM
gugauuucagccagg

SEQ ID NO: 2308743 - RNA, 16 nt, Yersinia pestis KIM
gugauuuccaucuagc

SEQ ID NO: 2308744 - RNA, 18 nt, Yersinia pestis KIM
gugcaauaaauucaaaau

SEQ ID NO: 2308745 - RNA, 22 nt, Yersinia pestis KIM
gugagcaauccaaccgaugguu

SEQ ID NO: 2308746 - RNA, 12 nt, Yersinia pestis KIM
gugagcauuuug

SEQ ID NO: 2308747 - RNA, 15 nt, Yersinia pestis KIM
gugacuaaaacaagc

SEQ ID NO: 2308748 - RNA, 23 nt, Yersinia pestis KIM
gugacuauucugccuauccucac

SEQ ID NO: 2308749 - RNA, 18 nt, Yersinia pestis KIM
gugacucaucaaaacaau

SEQ ID NO: 2308750 - RNA, 17 nt, Yersinia pestis KIM
gugacugguaugcggga

SEQ ID NO: 2308751 - RNA, 13 nt, Yersinia pestis KIM
gugaguaucgaua

SEQ ID NO: 2308752 - RNA, 23 nt, Yersinia pestis KIM
gugaguaaauaccuucagacuga

SEQ ID NO: 2308753 - RNA, 18 nt, Yersinia pestis KIM
gugagguuuuugauggug

SEQ ID NO: 2308754 - RNA, 13 nt, Yersinia pestis KIM
gugagugagcgcg

SEQ ID NO: 2308755 - RNA, 18 nt, Yersinia pestis KIM
gugagucagguggcuauu

SEQ ID NO: 2308756 - RNA, 21 nt, Yersinia pestis KIM
gugagugaacauagcuaacac

SEQ ID NO: 2308757 - RNA, 19 nt, Yersinia pestis KIM
gugaucaguccuuagcaug

SEQ ID NO: 2308758 - RNA, 22 nt, Yersinia pestis KIM
gugauaaacucaguauauuggu

SEQ ID NO: 2308759 - RNA, 15 nt, Yersinia pestis KIM
gugaggauaggcaga

SEQ ID NO: 2308760 - RNA, 19 nt, Yersinia pestis KIM
gugagcugaacugagguga

SEQ ID NO: 2308761 - RNA, 17 nt, Yersinia pestis KIM
gugaggcaaugaacggg

SEQ ID NO: 2308762 - RNA, 22 nt, Yersinia pestis KIM
aaauagccaaccagauuaaaua

SEQ ID NO: 2308763 - RNA, 15 nt, Yersinia pestis KIM
aaauagcaagccaaa

SEQ ID NO: 2308764 - RNA, 21 nt, Yersinia pestis KIM
gugaaaccauugguaauaaug

SEQ ID NO: 2308765 - RNA, 14 nt, Yersinia pestis KIM
gugaaacaaauaca

SEQ ID NO: 2308766 - RNA, 18 nt, Yersinia pestis KIM
gucuuguuggucaccacu

SEQ ID NO: 2308767 - RNA, 17 nt, Yersinia pestis KIM
gucuuuaaaaucuugug

SEQ ID NO: 2308768 - RNA, 23 nt, Yersinia pestis KIM
gucuuuuugggugacaacgucac

SEQ ID NO: 2308769 - RNA, 16 nt, Yersinia pestis KIM
gucuugaucaacucac

SEQ ID NO: 2308770 - RNA, 17 nt, Yersinia pestis KIM
gucuugcaccugaucgu

SEQ ID NO: 2308771 - RNA, 19 nt, Yersinia pestis KIM
gucuucuuuugggauaaaa

SEQ ID NO: 2308772 - RNA, 21 nt, Yersinia pestis KIM
gucuuggucauaccggcggca

SEQ ID NO: 2308773 - RNA, 13 nt, Yersinia pestis KIM
gucuucaucaucc

SEQ ID NO: 2308774 - RNA, 15 nt, Yersinia pestis KIM
gucuucagcuuccgc

SEQ ID NO: 2308775 - RNA, 14 nt, Yersinia pestis KIM
gucuucaacuuuac

SEQ ID NO: 2308776 - RNA, 14 nt, Yersinia pestis KIM
gucuuacggagaag

SEQ ID NO: 2308777 - RNA, 19 nt, Yersinia pestis KIM
gucuuaucauaauccaacu

SEQ ID NO: 2308778 - RNA, 22 nt, Yersinia pestis KIM
gucuguuuccacucggccagag

SEQ ID NO: 2308779 - RNA, 15 nt, Yersinia pestis KIM
gucugccauugcuca

SEQ ID NO: 2308780 - RNA, 16 nt, Yersinia pestis KIM
gucugcaauagcucau

SEQ ID NO: 2308781 - RNA, 16 nt, Yersinia pestis KIM
gucugagccucaugaa

SEQ ID NO: 2308782 - RNA, 15 nt, Yersinia pestis KIM
gucugagccucauga

SEQ ID NO: 2308783 - RNA, 21 nt, Yersinia pestis KIM
gucugauaaccguuuuuucaa

SEQ ID NO: 2308784 - RNA, 14 nt, Yersinia pestis KIM
gucugauauuaaaa

SEQ ID NO: 2308785 - RNA, 20 nt, Yersinia pestis KIM
gucugauauuaaaaaaggga

SEQ ID NO: 2308786 - RNA, 15 nt, Yersinia pestis KIM
gucuggucuuucauu

SEQ ID NO: 2308787 - RNA, 16 nt, Yersinia pestis KIM
gucugggccaucaagc

SEQ ID NO: 2308788 - RNA, 13 nt, Yersinia pestis KIM
gucguuauauaaa

SEQ ID NO: 2308789 - RNA, 15 nt, Yersinia pestis KIM
gucguugagcgggug

SEQ ID NO: 2308790 - RNA, 20 nt, Yersinia pestis KIM
gucguggaguagagcuucca

SEQ ID NO: 2308791 - RNA, 17 nt, Yersinia pestis KIM
gucguuuaaauaaaaaa

SEQ ID NO: 2308792 - RNA, 14 nt, Yersinia pestis KIM
gucucuauucacua

SEQ ID NO: 2308793 - RNA, 22 nt, Yersinia pestis KIM
gucucuagaauuugaucagcca

SEQ ID NO: 2308794 - RNA, 17 nt, Yersinia pestis KIM
gucucuguggauugcca

SEQ ID NO: 2308795 - RNA, 15 nt, Yersinia pestis KIM
gucucuugcaaugaa

SEQ ID NO: 2308796 - RNA, 16 nt, Yersinia pestis KIM
gucucuuuuucaucuu

SEQ ID NO: 2308797 - RNA, 18 nt, Yersinia pestis KIM
gucucuuucgggcaaaaa

SEQ ID NO: 2308798 - RNA, 18 nt, Yersinia pestis KIM
gucgaucccaauauuaaa

SEQ ID NO: 2308799 - RNA, 20 nt, Yersinia pestis KIM
gucgauaagcacuccacugg

SEQ ID NO: 2308800 - RNA, 18 nt, Yersinia pestis KIM
guccuucggacgcuccuc

SEQ ID NO: 2308801 - RNA, 18 nt, Yersinia pestis KIM
guccucaggcaacccuuu

SEQ ID NO: 2308802 - RNA, 18 nt, Yersinia pestis KIM
gucccgacgguuucuguc

SEQ ID NO: 2308803 - RNA, 14 nt, Yersinia pestis KIM
gucccaggccuccg

SEQ ID NO: 2308804 - RNA, 22 nt, Yersinia pestis KIM
gucgggcgcugagcgggcggca

SEQ ID NO: 2308805 - RNA, 21 nt, Yersinia pestis KIM
gucgguuuuuguauuccacuu

SEQ ID NO: 2308806 - RNA, 22 nt, Yersinia pestis KIM
gucgcccugaauuucaauaaca

SEQ ID NO: 2308807 - RNA, 19 nt, Yersinia pestis KIM
gucgcgggcacuuugucaa

SEQ ID NO: 2308808 - RNA, 14 nt, Yersinia pestis KIM
gucgccgguggcug

SEQ ID NO: 2308809 - RNA, 17 nt, Yersinia pestis KIM
gucgcgaauagccaagc

SEQ ID NO: 2308810 - RNA, 20 nt, Yersinia pestis KIM
gucaucgccuucuggcaaac

SEQ ID NO: 2308811 - RNA, 23 nt, Yersinia pestis KIM
gucaucgaacccgcuaacaugcc

SEQ ID NO: 2308812 - RNA, 15 nt, Yersinia pestis KIM
gucaucauauucaau

SEQ ID NO: 2308813 - RNA, 13 nt, Yersinia pestis KIM
gucaucaaccucg

SEQ ID NO: 2308814 - RNA, 18 nt, Yersinia pestis KIM
gucagguuaauaccugca

SEQ ID NO: 2308815 - RNA, 18 nt, Yersinia pestis KIM
gucaucgggguuugucag

SEQ ID NO: 2308816 - RNA, 23 nt, Yersinia pestis KIM
gucaucggggguugucugcagaa

SEQ ID NO: 2308817 - RNA, 17 nt, Yersinia pestis KIM
gucaucggguuuugucg

SEQ ID NO: 2308818 - RNA, 23 nt, Yersinia pestis KIM
gucaucucuaaaaaaugauuuua

SEQ ID NO: 2308819 - RNA, 13 nt, Yersinia pestis KIM
gucaugaaaaucu

SEQ ID NO: 2308820 - RNA, 17 nt, Yersinia pestis KIM
gucaugaaguugauaaa

SEQ ID NO: 2308821 - RNA, 18 nt, Yersinia pestis KIM
gucauguugaccaaacag

SEQ ID NO: 2308822 - RNA, 12 nt, Yersinia pestis KIM
gucauuaacaca

SEQ ID NO: 2308823 - RNA, 20 nt, Yersinia pestis KIM
gucauuaacuguuaaaacag

SEQ ID NO: 2308824 - RNA, 16 nt, Yersinia pestis KIM
gucaugguacaacugc

SEQ ID NO: 2308825 - RNA, 17 nt, Yersinia pestis KIM
guccaacucccaaauau

SEQ ID NO: 2308826 - RNA, 20 nt, Yersinia pestis KIM
gucauuuuauuuaggcuaca

SEQ ID NO: 2308827 - RNA, 12 nt, Yersinia pestis KIM
guccauaauucu

SEQ ID NO: 2308828 - RNA, 17 nt, Yersinia pestis KIM
guccauagcuaaaauaa

SEQ ID NO: 2308829 - RNA, 15 nt, Yersinia pestis KIM
gucagggugaaagcc

SEQ ID NO: 2308830 - RNA, 16 nt, Yersinia pestis KIM
gucagguaaguagaau

SEQ ID NO: 2308831 - RNA, 18 nt, Yersinia pestis KIM
gucagcagacgaaccgcu

SEQ ID NO: 2308832 - RNA, 13 nt, Yersinia pestis KIM
gucagcacuucca

SEQ ID NO: 2308833 - RNA, 16 nt, Yersinia pestis KIM
gucacugccaucucau

SEQ ID NO: 2308834 - RNA, 16 nt, Yersinia pestis KIM
gucagcagucugagcc

SEQ ID NO: 2308835 - RNA, 15 nt, Yersinia pestis KIM
gucagcagucugaua

SEQ ID NO: 2308836 - RNA, 20 nt, Yersinia pestis KIM
gucacuaaauccaaaugccc

SEQ ID NO: 2308837 - RNA, 13 nt, Yersinia pestis KIM
gucacgucuucac

SEQ ID NO: 2308838 - RNA, 15 nt, Yersinia pestis KIM
gucacucagaaaaca

SEQ ID NO: 2308839 - RNA, 17 nt, Yersinia pestis KIM
gucacucagaaaacagc

SEQ ID NO: 2308840 - RNA, 21 nt, Yersinia pestis KIM
gucacucaagccaguaacuac

SEQ ID NO: 2308841 - RNA, 19 nt, Yersinia pestis KIM
gucacugaugcuuggcccg

SEQ ID NO: 2308842 - RNA, 10 nt, Yersinia pestis KIM
ggugaacaga

SEQ ID NO: 2308843 - RNA, 19 nt, Yersinia pestis KIM
ggugaaccaucaacaauuc

SEQ ID NO: 2308844 - RNA, 22 nt, Yersinia pestis KIM
gucaaucacuggcaauaauuca

SEQ ID NO: 2308845 - RNA, 17 nt, Yersinia pestis KIM
gucaaucgaugagcugg

SEQ ID NO: 2308846 - RNA, 15 nt, Yersinia pestis KIM
gucaagaugcauauu

SEQ ID NO: 2308847 - RNA, 17 nt, Yersinia pestis KIM
gucaagacaacaaacag

SEQ ID NO: 2308848 - RNA, 14 nt, Yersinia pestis KIM
gucaagacaacaaa

SEQ ID NO: 2308849 - RNA, 22 nt, Yersinia pestis KIM
gucacccuuuugaauucaccaa

SEQ ID NO: 2308850 - RNA, 19 nt, Yersinia pestis KIM
gucaccgaacucgauaaua

SEQ ID NO: 2308851 - RNA, 18 nt, Yersinia pestis KIM
gucaaucuuauugaaaac

SEQ ID NO: 2308852 - RNA, 20 nt, Yersinia pestis KIM
gucaaucuagaacuauuggu

SEQ ID NO: 2308853 - RNA, 18 nt, Yersinia pestis KIM
gucaaucguuaguuguua

SEQ ID NO: 2308854 - RNA, 21 nt, Yersinia pestis KIM
gucaauguguugaauauccaa

SEQ ID NO: 2308855 - RNA, 18 nt, Yersinia pestis KIM
gucaauugagaauaacgc

SEQ ID NO: 2308856 - RNA, 14 nt, Yersinia pestis KIM
uacuaaaauaucac

SEQ ID NO: 2308857 - RNA, 22 nt, Yersinia pestis KIM
uacgugacggcggcgagcacug

SEQ ID NO: 2308858 - RNA, 21 nt, Yersinia pestis KIM
uacuaaacccggugguugaac

SEQ ID NO: 2308859 - RNA, 18 nt, Yersinia pestis KIM
uacuaaauuagaaaacaa

SEQ ID NO: 2308860 - RNA, 16 nt, Yersinia pestis KIM
uacuaccuuuugcaua

SEQ ID NO: 2308861 - RNA, 13 nt, Yersinia pestis KIM
uacuaauuucuaa

SEQ ID NO: 2308862 - RNA, 15 nt, Yersinia pestis KIM
uacuaauuucuaauu

SEQ ID NO: 2308863 - RNA, 23 nt, Yersinia pestis KIM
uacgcgauauucgcgcccaaaug

SEQ ID NO: 2308864 - RNA, 20 nt, Yersinia pestis KIM
uacggcgaaauauaaaacag

SEQ ID NO: 2308865 - RNA, 20 nt, Yersinia pestis KIM
uacggcgacuugccguggcu

SEQ ID NO: 2308866 - RNA, 16 nt, Yersinia pestis KIM
uacggcgauauuuauu

SEQ ID NO: 2308867 - RNA, 19 nt, Yersinia pestis KIM
uacgcuaugaauaagcauu

SEQ ID NO: 2308868 - RNA, 20 nt, Yersinia pestis KIM
uacggcugcgcgacaaaacc

SEQ ID NO: 2308869 - RNA, 12 nt, Yersinia pestis KIM
uacguaauuuac

SEQ ID NO: 2308870 - RNA, 16 nt, Yersinia pestis KIM
uacgccuggcuaacgu

SEQ ID NO: 2308871 - RNA, 15 nt, Yersinia pestis KIM
uacgccaugcagcua

SEQ ID NO: 2308872 - RNA, 23 nt, Yersinia pestis KIM
uacgcaugaucccugguuugcca

SEQ ID NO: 2308873 - RNA, 16 nt, Yersinia pestis KIM
uacgcaugaugcugcc

SEQ ID NO: 2308874 - RNA, 14 nt, Yersinia pestis KIM
uaccguugggcuuu

SEQ ID NO: 2308875 - RNA, 18 nt, Yersinia pestis KIM
uaccgguuugggcaucaa

SEQ ID NO: 2308876 - RNA, 15 nt, Yersinia pestis KIM
uaccgucauccagca

SEQ ID NO: 2308877 - RNA, 13 nt, Yersinia pestis KIM
uacgcaacaagcc

SEQ ID NO: 2308878 - RNA, 23 nt, Yersinia pestis KIM
uacgcaacguaauaucugccacc

SEQ ID NO: 2308879 - RNA, 13 nt, Yersinia pestis KIM
uacgcaaguaaaa

SEQ ID NO: 2308880 - RNA, 20 nt, Yersinia pestis KIM
uacgagagaucguaggcuuu

SEQ ID NO: 2308881 - RNA, 16 nt, Yersinia pestis KIM
uacgaccgucaccaaa

SEQ ID NO: 2308882 - RNA, 21 nt, Yersinia pestis KIM
uacugaauaagguucuuucau

SEQ ID NO: 2308883 - RNA, 15 nt, Yersinia pestis KIM
uacugagaaucacuu

SEQ ID NO: 2308884 - RNA, 22 nt, Yersinia pestis KIM
uacugcauugagacccguuacu

SEQ ID NO: 2308885 - RNA, 14 nt, Yersinia pestis KIM
uacugccaaccacc

SEQ ID NO: 2308886 - RNA, 16 nt, Yersinia pestis KIM
uacugccaaccaccaa

SEQ ID NO: 2308887 - RNA, 22 nt, Yersinia pestis KIM
uacugccaaccaccaaagauac

SEQ ID NO: 2308888 - RNA, 14 nt, Yersinia pestis KIM
uacugcccgucguu

SEQ ID NO: 2308889 - RNA, 16 nt, Yersinia pestis KIM
uacugagucuugauau

SEQ ID NO: 2308890 - RNA, 14 nt, Yersinia pestis KIM
uacucguuuuacau

SEQ ID NO: 2308891 - RNA, 16 nt, Yersinia pestis KIM
uacucguauaaaaaau

SEQ ID NO: 2308892 - RNA, 20 nt, Yersinia pestis KIM
uacucgguccaucugaaauu

SEQ ID NO: 2308893 - RNA, 17 nt, Yersinia pestis KIM
uacucuguguagugggg

SEQ ID NO: 2308894 - RNA, 17 nt, Yersinia pestis KIM
uacucuuccuguacguu

SEQ ID NO: 2308895 - RNA, 23 nt, Yersinia pestis KIM
uacuggcauacagcucaucacca

SEQ ID NO: 2308896 - RNA, 15 nt, Yersinia pestis KIM
uacugucuuuuuugg

SEQ ID NO: 2308897 - RNA, 20 nt, Yersinia pestis KIM
uacuguuaguucagacguac

SEQ ID NO: 2308898 - RNA, 16 nt, Yersinia pestis KIM
uacuguuccggcgcga

SEQ ID NO: 2308899 - RNA, 13 nt, Yersinia pestis KIM
uacuguuuucauu

SEQ ID NO: 2308900 - RNA, 18 nt, Yersinia pestis KIM
uacugcgguccuacccuu

SEQ ID NO: 2308901 - RNA, 17 nt, Yersinia pestis KIM
uacuucaggccaauagc

SEQ ID NO: 2308902 - RNA, 13 nt, Yersinia pestis KIM
uacuguuuugguu

SEQ ID NO: 2308903 - RNA, 24 nt, Yersinia pestis KIM
uacuuauugggcgcgauaaaagau

SEQ ID NO: 2308904 - RNA, 21 nt, Yersinia pestis KIM
uacuugauggcuguuuuucau

SEQ ID NO: 2308905 - RNA, 18 nt, Yersinia pestis KIM
uaccgccaaucucuccua

SEQ ID NO: 2308906 - RNA, 22 nt, Yersinia pestis KIM
uaccgcauaagacaccacauca

SEQ ID NO: 2308907 - RNA, 14 nt, Yersinia pestis KIM
uaccgccagaauaa

SEQ ID NO: 2308908 - RNA, 15 nt, Yersinia pestis KIM
uaccgcuaugcuaaa

SEQ ID NO: 2308909 - RNA, 22 nt, Yersinia pestis KIM
uaccgcugcccggcucaucaag

SEQ ID NO: 2308910 - RNA, 15 nt, Yersinia pestis KIM
uaccgcugccggguu

SEQ ID NO: 2308911 - RNA, 20 nt, Yersinia pestis KIM
uaccggauacaccguaucug

SEQ ID NO: 2308912 - RNA, 17 nt, Yersinia pestis KIM
uaccgaguucucaccaa

SEQ ID NO: 2308913 - RNA, 18 nt, Yersinia pestis KIM
uaccgaguucucaccaag

SEQ ID NO: 2308914 - RNA, 19 nt, Yersinia pestis KIM
uaccgauaauaaauauccu

SEQ ID NO: 2308915 - RNA, 13 nt, Yersinia pestis KIM
uaccgauuucagg

SEQ ID NO: 2308916 - RNA, 17 nt, Yersinia pestis KIM
uaccgauuucaggucgc

SEQ ID NO: 2308917 - RNA, 20 nt, Yersinia pestis KIM
uaccgacaucaacagaggca

SEQ ID NO: 2308918 - RNA, 17 nt, Yersinia pestis KIM
uacccugcaccauaucc

SEQ ID NO: 2308919 - RNA, 13 nt, Yersinia pestis KIM
uacccugcaccau

SEQ ID NO: 2308920 - RNA, 20 nt, Yersinia pestis KIM
uacccuuaacggucagaucc

SEQ ID NO: 2308921 - RNA, 13 nt, Yersinia pestis KIM
uacccuuugagaa

SEQ ID NO: 2308922 - RNA, 23 nt, Yersinia pestis KIM
uaccgaaauauucgucucaucaa

SEQ ID NO: 2308923 - RNA, 21 nt, Yersinia pestis KIM
uacccuaacucuuuggauggg

SEQ ID NO: 2308924 - RNA, 22 nt, Yersinia pestis KIM
uacccuacccauuauaaauaau

SEQ ID NO: 2308925 - RNA, 15 nt, Yersinia pestis KIM
uacccucgacaccaa

SEQ ID NO: 2308926 - RNA, 22 nt, Yersinia pestis KIM
uacccgacaccggcugauuacc

SEQ ID NO: 2308927 - RNA, 20 nt, Yersinia pestis KIM
uaccagggcaccuaauucac

SEQ ID NO: 2308928 - RNA, 24 nt, Yersinia pestis KIM
uaccauauccacgguauuaguauu

SEQ ID NO: 2308929 - RNA, 16 nt, Yersinia pestis KIM
uaccauaaggccaggc

SEQ ID NO: 2308930 - RNA, 22 nt, Yersinia pestis KIM
uaccaugagugaaaauauguag

SEQ ID NO: 2308931 - RNA, 22 nt, Yersinia pestis KIM
uaccauauggaugaugcacagc

SEQ ID NO: 2308932 - RNA, 15 nt, Yersinia pestis KIM
uaccaucaaaauaug

SEQ ID NO: 2308933 - RNA, 22 nt, Yersinia pestis KIM
uaccaucaacgcgcauugcgcc

SEQ ID NO: 2308934 - RNA, 14 nt, Yersinia pestis KIM
uacccacuaauauu

SEQ ID NO: 2308935 - RNA, 14 nt, Yersinia pestis KIM
uacccaaaccaaca

SEQ ID NO: 2308936 - RNA, 15 nt, Yersinia pestis KIM
uaccccccaagcuuu

SEQ ID NO: 2308937 - RNA, 13 nt, Yersinia pestis KIM
uacccauuuuaau

SEQ ID NO: 2308938 - RNA, 21 nt, Yersinia pestis KIM
uacccauaacuugagcacaua

SEQ ID NO: 2308939 - RNA, 21 nt, Yersinia pestis KIM
uacaucuccgcuauuuuccac

SEQ ID NO: 2308940 - RNA, 14 nt, Yersinia pestis KIM
uaccaaauaaacca

SEQ ID NO: 2308941 - RNA, 20 nt, Yersinia pestis KIM
uaccaaauaaaccagaugug

SEQ ID NO: 2308942 - RNA, 16 nt, Yersinia pestis KIM
uacauccuaaauaauu

SEQ ID NO: 2308943 - RNA, 19 nt, Yersinia pestis KIM
uacaucgccaguguugcca

SEQ ID NO: 2308944 - RNA, 22 nt, Yersinia pestis KIM
uacauccaauuuuuucaucaua

SEQ ID NO: 2308945 - RNA, 13 nt, Yersinia pestis KIM
uacauccuaaaua

SEQ ID NO: 2308946 - RNA, 13 nt, Yersinia pestis KIM
uacaucagacacg

SEQ ID NO: 2308947 - RNA, 22 nt, Yersinia pestis KIM
uacaucagggugaccgcacugc

SEQ ID NO: 2308948 - RNA, 15 nt, Yersinia pestis KIM
uacaucaucuucuau

SEQ ID NO: 2308949 - RNA, 12 nt, Yersinia pestis KIM
uacauagaugua

SEQ ID NO: 2308950 - RNA, 15 nt, Yersinia pestis KIM
uacauagauguauuu

SEQ ID NO: 2308951 - RNA, 16 nt, Yersinia pestis KIM
uacauagaaaauaaua

SEQ ID NO: 2308952 - RNA, 22 nt, Yersinia pestis KIM
uacauagaaaauaauaucggca

SEQ ID NO: 2308953 - RNA, 23 nt, Yersinia pestis KIM
uacaauuuuuggucguauucaua

SEQ ID NO: 2308954 - RNA, 21 nt, Yersinia pestis KIM
uacagucccugugcgcccacg

SEQ ID NO: 2308955 - RNA, 18 nt, Yersinia pestis KIM
uacagucauuuacugaug

SEQ ID NO: 2308956 - RNA, 13 nt, Yersinia pestis KIM
uacaguaagguau

SEQ ID NO: 2308957 - RNA, 18 nt, Yersinia pestis KIM
uacaguaaggcagcaagu

SEQ ID NO: 2308958 - RNA, 9 nt, Yersinia pestis KIM
uaauuugua

SEQ ID NO: 2308959 - RNA, 12 nt, Yersinia pestis KIM
uaauuuguaaau

SEQ ID NO: 2308960 - RNA, 13 nt, Yersinia pestis KIM
uaauuuuucccuu

SEQ ID NO: 2308961 - RNA, 16 nt, Yersinia pestis KIM
uacaaaaaacaaaccg

SEQ ID NO: 2308962 - RNA, 22 nt, Yersinia pestis KIM
uaauuugcuccuggcaugcauu

SEQ ID NO: 2308963 - RNA, 16 nt, Yersinia pestis KIM
uaauuugcuuuaaaua

SEQ ID NO: 2308964 - RNA, 18 nt, Yersinia pestis KIM
uaauuugcuuuaaauaac

SEQ ID NO: 2308965 - RNA, 22 nt, Yersinia pestis KIM
uaauuucaccacaucuugcauc

SEQ ID NO: 2308966 - RNA, 18 nt, Yersinia pestis KIM
uaauuucagauaaaaaua

SEQ ID NO: 2308967 - RNA, 14 nt, Yersinia pestis KIM
uaauuuaucugcua

SEQ ID NO: 2308968 - RNA, 21 nt, Yersinia pestis KIM
uaauugcggucaguuggcuua

SEQ ID NO: 2308969 - RNA, 14 nt, Yersinia pestis KIM
uaauugcaccccac

SEQ ID NO: 2308970 - RNA, 21 nt, Yersinia pestis KIM
uacaaacagggcagccaauua

SEQ ID NO: 2308971 - RNA, 22 nt, Yersinia pestis KIM
uacaaacagggcagccaauuac

SEQ ID NO: 2308972 - RNA, 19 nt, Yersinia pestis KIM
uacaaauuugacauuuccu

SEQ ID NO: 2308973 - RNA, 23 nt, Yersinia pestis KIM
uacaacacaucgaagcugucuuu

SEQ ID NO: 2308974 - RNA, 13 nt, Yersinia pestis KIM
uacaacaauaaua

SEQ ID NO: 2308975 - RNA, 20 nt, Yersinia pestis KIM
uacaagccgugaccaaagug

SEQ ID NO: 2308976 - RNA, 18 nt, Yersinia pestis KIM
uacaagcacucaauguca

SEQ ID NO: 2308977 - RNA, 18 nt, Yersinia pestis KIM
uaauuaauuuaaacaacc

SEQ ID NO: 2308978 - RNA, 17 nt, Yersinia pestis KIM
uaauuaaacgcucauca

SEQ ID NO: 2308979 - RNA, 20 nt, Yersinia pestis KIM
uaauuaaacgcucaucaacc

SEQ ID NO: 2308980 - RNA, 21 nt, Yersinia pestis KIM
uaauuacaguugauauuauua

SEQ ID NO: 2308981 - RNA, 23 nt, Yersinia pestis KIM
uaauuacaguugauauuauuauu

SEQ ID NO: 2308982 - RNA, 15 nt, Yersinia pestis KIM
uaauuacgcguucac

SEQ ID NO: 2308983 - RNA, 12 nt, Yersinia pestis KIM
uaauguuaauau

SEQ ID NO: 2308984 - RNA, 15 nt, Yersinia pestis KIM
uaauguuuauauuga

SEQ ID NO: 2308985 - RNA, 12 nt, Yersinia pestis KIM
uaauguugaucu

SEQ ID NO: 2308986 - RNA, 22 nt, Yersinia pestis KIM
uaauuauuguggcuaccaauua

SEQ ID NO: 2308987 - RNA, 14 nt, Yersinia pestis KIM
uaauuauuuauaau

SEQ ID NO: 2308988 - RNA, 18 nt, Yersinia pestis KIM
uaauuauuuauaaugggu

SEQ ID NO: 2308989 - RNA, 23 nt, Yersinia pestis KIM
uaauuacuuuauuuaaaauuaau

SEQ ID NO: 2308990 - RNA, 19 nt, Yersinia pestis KIM
uaauucgaguuucaggaag

SEQ ID NO: 2308991 - RNA, 17 nt, Yersinia pestis KIM
uaauugagaauuauaac

SEQ ID NO: 2308992 - RNA, 14 nt, Yersinia pestis KIM
uaauucaaaaugua

SEQ ID NO: 2308993 - RNA, 20 nt, Yersinia pestis KIM
uaaugcggugguuaacagcg

SEQ ID NO: 2308994 - RNA, 13 nt, Yersinia pestis KIM
uaaugcgaaaaaa

SEQ ID NO: 2308995 - RNA, 14 nt, Yersinia pestis KIM
uaaugcgaaaaaag

SEQ ID NO: 2308996 - RNA, 20 nt, Yersinia pestis KIM
uaaugcacgucaguuaaaua

SEQ ID NO: 2308997 - RNA, 18 nt, Yersinia pestis KIM
uaaugccuggugcaaccg

SEQ ID NO: 2308998 - RNA, 17 nt, Yersinia pestis KIM
uaaugucgccauaacgc

SEQ ID NO: 2308999 - RNA, 15 nt, Yersinia pestis KIM
uaaugucaugaaucc

SEQ ID NO: 2309000 - RNA, 17 nt, Yersinia pestis KIM
uaaugucuuuacuaaau

SEQ ID NO: 2309001 - RNA, 22 nt, Yersinia pestis KIM
uaauguauuuauucaaaaaauu

SEQ ID NO: 2309002 - RNA, 14 nt, Yersinia pestis KIM
uaaugauuauugac

SEQ ID NO: 2309003 - RNA, 14 nt, Yersinia pestis KIM
uaaugauugauuau

SEQ ID NO: 2309004 - RNA, 15 nt, Yersinia pestis KIM
uaaugaguuggcauu

SEQ ID NO: 2309005 - RNA, 20 nt, Yersinia pestis KIM
uaaugaugagguaauacuca

SEQ ID NO: 2309006 - RNA, 17 nt, Yersinia pestis KIM
uaaugagcguuauuauu

SEQ ID NO: 2309007 - RNA, 19 nt, Yersinia pestis KIM
uaaugaggguaagugaaua

SEQ ID NO: 2309008 - RNA, 14 nt, Yersinia pestis KIM
uaaucgauaaugga

SEQ ID NO: 2309009 - RNA, 20 nt, Yersinia pestis KIM
uaauauccaaccaaccaugc

SEQ ID NO: 2309010 - RNA, 15 nt, Yersinia pestis KIM
uaauaucaaaacuga

SEQ ID NO: 2309011 - RNA, 14 nt, Yersinia pestis KIM
uaauaucaaugagu

SEQ ID NO: 2309012 - RNA, 11 nt, Yersinia pestis KIM
uaauauaucuc

SEQ ID NO: 2309013 - RNA, 22 nt, Yersinia pestis KIM
uaauaucggcaaauuaaauuau

SEQ ID NO: 2309014 - RNA, 22 nt, Yersinia pestis KIM
uaauaugcaaaaaaagacacua

SEQ ID NO: 2309015 - RNA, 15 nt, Yersinia pestis KIM
uaauaugccaaaucu

SEQ ID NO: 2309016 - RNA, 22 nt, Yersinia pestis KIM
uaauauucaauaggguaauacc

SEQ ID NO: 2309017 - RNA, 14 nt, Yersinia pestis KIM
uaauauugccgcag

SEQ ID NO: 2309018 - RNA, 20 nt, Yersinia pestis KIM
uaauauuuuacugccacuga

SEQ ID NO: 2309019 - RNA, 17 nt, Yersinia pestis KIM
uaauauuuucagcccua

SEQ ID NO: 2309020 - RNA, 17 nt, Yersinia pestis KIM
uaaucaucuacaacauc

SEQ ID NO: 2309021 - RNA, 18 nt, Yersinia pestis KIM
uaaucaucuacaacauca

SEQ ID NO: 2309022 - RNA, 11 nt, Yersinia pestis KIM
uaaucaugggg

SEQ ID NO: 2309023 - RNA, 22 nt, Yersinia pestis KIM
uaauccaagccaugguaaccac

SEQ ID NO: 2309024 - RNA, 18 nt, Yersinia pestis KIM
uaauccaaaauaauauaa

SEQ ID NO: 2309025 - RNA, 19 nt, Yersinia pestis KIM
uaaucauuuauuuuuccag

SEQ ID NO: 2309026 - RNA, 12 nt, Yersinia pestis KIM
uaauccauacag

SEQ ID NO: 2309027 - RNA, 19 nt, Yersinia pestis KIM
uaauccgaccaccacugca

SEQ ID NO: 2309028 - RNA, 19 nt, Yersinia pestis KIM
uaauccauucacgcccuac

SEQ ID NO: 2309029 - RNA, 20 nt, Yersinia pestis KIM
uaaucaccagacaaccaaua

SEQ ID NO: 2309030 - RNA, 20 nt, Yersinia pestis KIM
uaaucaauccuacauucagu

SEQ ID NO: 2309031 - RNA, 21 nt, Yersinia pestis KIM
uaaucaauccuacauucagua

SEQ ID NO: 2309032 - RNA, 18 nt, Yersinia pestis KIM
uaaucagacugcugacaa

SEQ ID NO: 2309033 - RNA, 22 nt, Yersinia pestis KIM
uaaucagaggugaaaaaauauc

SEQ ID NO: 2309034 - RNA, 22 nt, Yersinia pestis KIM
uaaucaccucaccagcaucuug

SEQ ID NO: 2309035 - RNA, 15 nt, Yersinia pestis KIM
uaaucaccauuaaua

SEQ ID NO: 2309036 - RNA, 16 nt, Yersinia pestis KIM
uaaucaccauuaauaa

SEQ ID NO: 2309037 - RNA, 19 nt, Yersinia pestis KIM
uaaucaccauuaauaauau

SEQ ID NO: 2309038 - RNA, 12 nt, Yersinia pestis KIM
uaaucacuuauu

SEQ ID NO: 2309039 - RNA, 23 nt, Yersinia pestis KIM
uaaucacucucaugaauacgcua

SEQ ID NO: 2309040 - RNA, 16 nt, Yersinia pestis KIM
uaaucagccuucaggg

SEQ ID NO: 2309041 - RNA, 20 nt, Yersinia pestis KIM
uaaucaggcauuacagacug

SEQ ID NO: 2309042 - RNA, 15 nt, Yersinia pestis KIM
uaaucauaggccacu

SEQ ID NO: 2309043 - RNA, 16 nt, Yersinia pestis KIM
uaaucaucaguuuauu

SEQ ID NO: 2309044 - RNA, 15 nt, Yersinia pestis KIM
uaauacaauagagaa

SEQ ID NO: 2309045 - RNA, 18 nt, Yersinia pestis KIM
uaauacacccgaaggcca

SEQ ID NO: 2309046 - RNA, 18 nt, Yersinia pestis KIM
uaauacauaaaaucaaua

SEQ ID NO: 2309047 - RNA, 20 nt, Yersinia pestis KIM
uaauacaggcugacauuucu

SEQ ID NO: 2309048 - RNA, 15 nt, Yersinia pestis KIM
uaauaacgaauuuca

SEQ ID NO: 2309049 - RNA, 22 nt, Yersinia pestis KIM
uaauaagacguuauuauugauu

SEQ ID NO: 2309050 - RNA, 18 nt, Yersinia pestis KIM
uaauaacuuaaauaauuu

SEQ ID NO: 2309051 - RNA, 21 nt, Yersinia pestis KIM
uaauaagccgcaggcaaacaa

SEQ ID NO: 2309052 - RNA, 16 nt, Yersinia pestis KIM
uaauaaugauuauuga

SEQ ID NO: 2309053 - RNA, 22 nt, Yersinia pestis KIM
uaauaaugccguuaauugugau

SEQ ID NO: 2309054 - RNA, 13 nt, Yersinia pestis KIM
uaauaaugaugaa

SEQ ID NO: 2309055 - RNA, 17 nt, Yersinia pestis KIM
uaauaaugaacaaauau

SEQ ID NO: 2309056 - RNA, 14 nt, Yersinia pestis KIM
uaauaauaaauugc

SEQ ID NO: 2309057 - RNA, 14 nt, Yersinia pestis KIM
uaauaaguuaauaa

SEQ ID NO: 2309058 - RNA, 19 nt, Yersinia pestis KIM
uaauagauuguaaguaacu

SEQ ID NO: 2309059 - RNA, 20 nt, Yersinia pestis KIM
uaauagauuguaaguaacua

SEQ ID NO: 2309060 - RNA, 13 nt, Yersinia pestis KIM
uaauacucuguua

SEQ ID NO: 2309061 - RNA, 22 nt, Yersinia pestis KIM
uaauacggcuugcaauuggggu

SEQ ID NO: 2309062 - RNA, 18 nt, Yersinia pestis KIM
uaauaccguuuucuuuca

SEQ ID NO: 2309063 - RNA, 16 nt, Yersinia pestis KIM
uaauacgccauccgca

SEQ ID NO: 2309064 - RNA, 17 nt, Yersinia pestis KIM
uaauagcuuaaucauca

SEQ ID NO: 2309065 - RNA, 12 nt, Yersinia pestis KIM
uaauaguucauu

SEQ ID NO: 2309066 - RNA, 19 nt, Yersinia pestis KIM
uaauaguguuguaagauuu

SEQ ID NO: 2309067 - RNA, 15 nt, Yersinia pestis KIM
uaauauaauucaaua

SEQ ID NO: 2309068 - RNA, 18 nt, Yersinia pestis KIM
uaauauaauucaauauau

SEQ ID NO: 2309069 - RNA, 19 nt, Yersinia pestis KIM
uaauauaauucaauauaua

SEQ ID NO: 2309070 - RNA, 12 nt, Yersinia pestis KIM
uaauauaauuca

SEQ ID NO: 2309071 - RNA, 20 nt, Yersinia pestis KIM
uaauaguucauuuuguauuu

SEQ ID NO: 2309072 - RNA, 24 nt, Yersinia pestis KIM
uaacugacgaauagcaucaggggu

SEQ ID NO: 2309073 - RNA, 17 nt, Yersinia pestis KIM
aaaucccccaccaguaa

SEQ ID NO: 2309074 - RNA, 14 nt, Yersinia pestis KIM
aaaucccgaugaac

SEQ ID NO: 2309075 - RNA, 16 nt, Yersinia pestis KIM
uaacugcugcuuuaau

SEQ ID NO: 2309076 - RNA, 21 nt, Yersinia pestis KIM
aaaucccggcauauuauuugu

SEQ ID NO: 2309077 - RNA, 21 nt, Yersinia pestis KIM
uaacuuacugcucuaucucuu

SEQ ID NO: 2309078 - RNA, 15 nt, Yersinia pestis KIM
uaacuuaauggcacc

SEQ ID NO: 2309079 - RNA, 22 nt, Yersinia pestis KIM
uaacuuaucgaccaacuggcaa

SEQ ID NO: 2309080 - RNA, 18 nt, Yersinia pestis KIM
uaacuucagguucaccuu

SEQ ID NO: 2309081 - RNA, 16 nt, Yersinia pestis KIM
uaacugugcagcccau

SEQ ID NO: 2309082 - RNA, 18 nt, Yersinia pestis KIM
uaacuggcuggcuuugga

SEQ ID NO: 2309083 - RNA, 14 nt, Yersinia pestis KIM
uaacuguuuuauau

SEQ ID NO: 2309084 - RNA, 17 nt, Yersinia pestis KIM
uaacuuaaaauauggca

SEQ ID NO: 2309085 - RNA, 15 nt, Yersinia pestis KIM
uaacuggccaauuaa

SEQ ID NO: 2309086 - RNA, 14 nt, Yersinia pestis KIM
uaacguagagagac

SEQ ID NO: 2309087 - RNA, 15 nt, Yersinia pestis KIM
uaacgucaacagaac

SEQ ID NO: 2309088 - RNA, 16 nt, Yersinia pestis KIM
uaacgucaacagaacu

SEQ ID NO: 2309089 - RNA, 19 nt, Yersinia pestis KIM
uaacgucaacagaacuaau

SEQ ID NO: 2309090 - RNA, 19 nt, Yersinia pestis KIM
uaacgucgcugaaaugcua

SEQ ID NO: 2309091 - RNA, 21 nt, Yersinia pestis KIM
uaacgucgcugaaaugcuaug

SEQ ID NO: 2309092 - RNA, 19 nt, Yersinia pestis KIM
uaacuacacuucguaaucu

SEQ ID NO: 2309093 - RNA, 15 nt, Yersinia pestis KIM
uaacuaacaucagcg

SEQ ID NO: 2309094 - RNA, 23 nt, Yersinia pestis KIM
uaacuaacaucagcgauucauug

SEQ ID NO: 2309095 - RNA, 15 nt, Yersinia pestis KIM
uaacuaacagauugu

SEQ ID NO: 2309096 - RNA, 16 nt, Yersinia pestis KIM
uaacuaacguuuugua

SEQ ID NO: 2309097 - RNA, 15 nt, Yersinia pestis KIM
uaacguuucagggug

SEQ ID NO: 2309098 - RNA, 20 nt, Yersinia pestis KIM
uaacucauuuaucuaaaacu

SEQ ID NO: 2309099 - RNA, 13 nt, Yersinia pestis KIM
uaacucaucagua

SEQ ID NO: 2309100 - RNA, 12 nt, Yersinia pestis KIM
uaacucaauaau

SEQ ID NO: 2309101 - RNA, 15 nt, Yersinia pestis KIM
uaacucaauaauauu

SEQ ID NO: 2309102 - RNA, 14 nt, Yersinia pestis KIM
uaacucaaauuauu

SEQ ID NO: 2309103 - RNA, 16 nt, Yersinia pestis KIM
uaacucgcgcuuuauu

SEQ ID NO: 2309104 - RNA, 19 nt, Yersinia pestis KIM
uaacuccacuucuuccauu

SEQ ID NO: 2309105 - RNA, 13 nt, Yersinia pestis KIM
uaagacuguuuua

SEQ ID NO: 2309106 - RNA, 18 nt, Yersinia pestis KIM
uaagacguuauuauugau

SEQ ID NO: 2309107 - RNA, 23 nt, Yersinia pestis KIM
uaagacauugcgcaagccccuau

SEQ ID NO: 2309108 - RNA, 13 nt, Yersinia pestis KIM
uaagauuaagcca

SEQ ID NO: 2309109 - RNA, 18 nt, Yersinia pestis KIM
uaagauaauuauccauuu

SEQ ID NO: 2309110 - RNA, 23 nt, Yersinia pestis KIM
uaagauaacccaaugccauagcu

SEQ ID NO: 2309111 - RNA, 19 nt, Yersinia pestis KIM
uaagaaagagaugacccaa

SEQ ID NO: 2309112 - RNA, 17 nt, Yersinia pestis KIM
uaagaagccucaugaau

SEQ ID NO: 2309113 - RNA, 15 nt, Yersinia pestis KIM
uaagaagccucauga

SEQ ID NO: 2309114 - RNA, 15 nt, Yersinia pestis KIM
uaagaauaaauaaua

SEQ ID NO: 2309115 - RNA, 14 nt, Yersinia pestis KIM
uaagaauaaauaau

SEQ ID NO: 2309116 - RNA, 17 nt, Yersinia pestis KIM
uaagaaguagaaugaga

SEQ ID NO: 2309117 - RNA, 13 nt, Yersinia pestis KIM
uaacuuuauugac

SEQ ID NO: 2309118 - RNA, 16 nt, Yersinia pestis KIM
uaacuuuaucagucug

SEQ ID NO: 2309119 - RNA, 17 nt, Yersinia pestis KIM
uaacuuuuuauuucuuu

SEQ ID NO: 2309120 - RNA, 19 nt, Yersinia pestis KIM
uaacuuuuggcagcaccag

SEQ ID NO: 2309121 - RNA, 16 nt, Yersinia pestis KIM
uaacuuuuuauuucuu

SEQ ID NO: 2309122 - RNA, 16 nt, Yersinia pestis KIM
uaacuuuucuucauug

SEQ ID NO: 2309123 - RNA, 21 nt, Yersinia pestis KIM
uaacuuuucuucauugcugcu

SEQ ID NO: 2309124 - RNA, 13 nt, Yersinia pestis KIM
uaacuuuucuuca

SEQ ID NO: 2309125 - RNA, 21 nt, Yersinia pestis KIM
uaacuuuggguauaugacugu

SEQ ID NO: 2309126 - RNA, 21 nt, Yersinia pestis KIM
uaacuuuggguuaucccuacc

SEQ ID NO: 2309127 - RNA, 14 nt, Yersinia pestis KIM
uaagcgguuucaug

SEQ ID NO: 2309128 - RNA, 20 nt, Yersinia pestis KIM
uaagcgguuuguuaaaaagc

SEQ ID NO: 2309129 - RNA, 14 nt, Yersinia pestis KIM
uaagcguauuuugu

SEQ ID NO: 2309130 - RNA, 19 nt, Yersinia pestis KIM
uaagcuauugguuauugau

SEQ ID NO: 2309131 - RNA, 16 nt, Yersinia pestis KIM
uaagcuaucauuaaau

SEQ ID NO: 2309132 - RNA, 17 nt, Yersinia pestis KIM
uaagcugucuaaauugc

SEQ ID NO: 2309133 - RNA, 15 nt, Yersinia pestis KIM
uaagcucuuccaaua

SEQ ID NO: 2309134 - RNA, 15 nt, Yersinia pestis KIM
uaagcugccucagac

SEQ ID NO: 2309135 - RNA, 14 nt, Yersinia pestis KIM
uaagcugccugugc

SEQ ID NO: 2309136 - RNA, 14 nt, Yersinia pestis KIM
uaagcugcagaggu

SEQ ID NO: 2309137 - RNA, 22 nt, Yersinia pestis KIM
uaaggcccauuugucgcgccug

SEQ ID NO: 2309138 - RNA, 23 nt, Yersinia pestis KIM
uaaggccgcgauaaaaaauaaag

SEQ ID NO: 2309139 - RNA, 22 nt, Yersinia pestis KIM
uaaggcccgcaguaauauguaa

SEQ ID NO: 2309140 - RNA, 13 nt, Yersinia pestis KIM
uaaggcccauuug

SEQ ID NO: 2309141 - RNA, 18 nt, Yersinia pestis KIM
uaaggcauauacaaccuc

SEQ ID NO: 2309142 - RNA, 13 nt, Yersinia pestis KIM
uaaggcaucaacc

SEQ ID NO: 2309143 - RNA, 18 nt, Yersinia pestis KIM
uaaggcaucaaccaguuc

SEQ ID NO: 2309144 - RNA, 21 nt, Yersinia pestis KIM
uaaggccucggcgauugaaca

SEQ ID NO: 2309145 - RNA, 17 nt, Yersinia pestis KIM
uaaggaucguucagugc

SEQ ID NO: 2309146 - RNA, 13 nt, Yersinia pestis KIM
uaaggaucugaag

SEQ ID NO: 2309147 - RNA, 16 nt, Yersinia pestis KIM
uaagcacgaauuuuau

SEQ ID NO: 2309148 - RNA, 19 nt, Yersinia pestis KIM
uaagcagggcgaucaggaa

SEQ ID NO: 2309149 - RNA, 16 nt, Yersinia pestis KIM
uaagcaggcaguaaaa

SEQ ID NO: 2309150 - RNA, 13 nt, Yersinia pestis KIM
uaagcagagaauu

SEQ ID NO: 2309151 - RNA, 22 nt, Yersinia pestis KIM
uaagcagagaauuucaagcugu

SEQ ID NO: 2309152 - RNA, 17 nt, Yersinia pestis KIM
uaagcaugccgccagau

SEQ ID NO: 2309153 - RNA, 23 nt, Yersinia pestis KIM
uaagccuaauggugcuauuucug

SEQ ID NO: 2309154 - RNA, 17 nt, Yersinia pestis KIM
uaagccugaugccuuga

SEQ ID NO: 2309155 - RNA, 19 nt, Yersinia pestis KIM
uaagccucgcguaucauga

SEQ ID NO: 2309156 - RNA, 20 nt, Yersinia pestis KIM
uaagccucgcguaucaugag

SEQ ID NO: 2309157 - RNA, 18 nt, Yersinia pestis KIM
uaagccgcagaugccaga

SEQ ID NO: 2309158 - RNA, 15 nt, Yersinia pestis KIM
uaagccgucagcuua

SEQ ID NO: 2309159 - RNA, 12 nt, Yersinia pestis KIM
uaagccagugug

SEQ ID NO: 2309160 - RNA, 22 nt, Yersinia pestis KIM
uaagccauuaaacguuugggau

SEQ ID NO: 2309161 - RNA, 14 nt, Yersinia pestis KIM
uaagccaauaauau

SEQ ID NO: 2309162 - RNA, 14 nt, Yersinia pestis KIM
uaagggaaauaccc

SEQ ID NO: 2309163 - RNA, 21 nt, Yersinia pestis KIM
uaaggugaugaaugacuggcu

SEQ ID NO: 2309164 - RNA, 19 nt, Yersinia pestis KIM
uaaggugaugaaugacugg

SEQ ID NO: 2309165 - RNA, 15 nt, Yersinia pestis KIM
uaaggucacuguuuc

SEQ ID NO: 2309166 - RNA, 20 nt, Yersinia pestis KIM
uaagguguuacaacaugaaa

SEQ ID NO: 2309167 - RNA, 17 nt, Yersinia pestis KIM
uaagguucuuucauuca

SEQ ID NO: 2309168 - RNA, 13 nt, Yersinia pestis KIM
uaaguaacuaaca

SEQ ID NO: 2309169 - RNA, 15 nt, Yersinia pestis KIM
uaaguaauaacucag

SEQ ID NO: 2309170 - RNA, 16 nt, Yersinia pestis KIM
uaaguauuucaaauaa

SEQ ID NO: 2309171 - RNA, 21 nt, Yersinia pestis KIM
uaauaaacagacaaaaaauag

SEQ ID NO: 2309172 - RNA, 14 nt, Yersinia pestis KIM
uaauaaaaaacuga

SEQ ID NO: 2309173 - RNA, 16 nt, Yersinia pestis KIM
uaauaaaaaacugacu

SEQ ID NO: 2309174 - RNA, 14 nt, Yersinia pestis KIM
uaauaaauuauaau

SEQ ID NO: 2309175 - RNA, 21 nt, Yersinia pestis KIM
uaauaaagcgaugcucaauac

SEQ ID NO: 2309176 - RNA, 16 nt, Yersinia pestis KIM
uaaguuacgucagaaa

SEQ ID NO: 2309177 - RNA, 22 nt, Yersinia pestis KIM
uaaguuaucgucacuggcacca

SEQ ID NO: 2309178 - RNA, 20 nt, Yersinia pestis KIM
uaaguucagcgcuuaauauu

SEQ ID NO: 2309179 - RNA, 17 nt, Yersinia pestis KIM
uaaguugaugcagugag

SEQ ID NO: 2309180 - RNA, 18 nt, Yersinia pestis KIM
uaaguugaugcagugagg

SEQ ID NO: 2309181 - RNA, 22 nt, Yersinia pestis KIM
uaaguucgucagugaugacauc

SEQ ID NO: 2309182 - RNA, 17 nt, Yersinia pestis KIM
uaaguguguguauuuaa

SEQ ID NO: 2309183 - RNA, 16 nt, Yersinia pestis KIM
uaagugccgggaauau

SEQ ID NO: 2309184 - RNA, 16 nt, Yersinia pestis KIM
uaagugcgggaaagua

SEQ ID NO: 2309185 - RNA, 13 nt, Yersinia pestis KIM
uaaguuaaaaaga

SEQ ID NO: 2309186 - RNA, 14 nt, Yersinia pestis KIM
uaaguuaaaaagaa

SEQ ID NO: 2309187 - RNA, 17 nt, Yersinia pestis KIM
uaagugcaaacuuaaaa

SEQ ID NO: 2309188 - RNA, 16 nt, Yersinia pestis KIM
uaagugccaguuaaua

SEQ ID NO: 2309189 - RNA, 14 nt, Yersinia pestis KIM
uaagugcuaaucau

SEQ ID NO: 2309190 - RNA, 22 nt, Yersinia pestis KIM
uaagugauucgggugagugagc

SEQ ID NO: 2309191 - RNA, 15 nt, Yersinia pestis KIM
uaaauggcauuuuuu

SEQ ID NO: 2309192 - RNA, 18 nt, Yersinia pestis KIM
uaaauggcgaaaggaaca

SEQ ID NO: 2309193 - RNA, 21 nt, Yersinia pestis KIM
uaaauggcgaaaggaacaaaa

SEQ ID NO: 2309194 - RNA, 14 nt, Yersinia pestis KIM
uaaauguuagcuca

SEQ ID NO: 2309195 - RNA, 16 nt, Yersinia pestis KIM
uaaaugcuguaagaau

SEQ ID NO: 2309196 - RNA, 13 nt, Yersinia pestis KIM
uaaauccagccca

SEQ ID NO: 2309197 - RNA, 13 nt, Yersinia pestis KIM
uaaauccuucugg

SEQ ID NO: 2309198 - RNA, 19 nt, Yersinia pestis KIM
uaaauccugggauuuugcc

SEQ ID NO: 2309199 - RNA, 21 nt, Yersinia pestis KIM
uaaauucuaccuggcucaaau

SEQ ID NO: 2309200 - RNA, 19 nt, Yersinia pestis KIM
uaaauucuccuugagcggc

SEQ ID NO: 2309201 - RNA, 18 nt, Yersinia pestis KIM
uaaauucuaccuggcuca

SEQ ID NO: 2309202 - RNA, 15 nt, Yersinia pestis KIM
uaaauucuuuauacc

SEQ ID NO: 2309203 - RNA, 20 nt, Yersinia pestis KIM
uaaauucaacuucuccugua

SEQ ID NO: 2309204 - RNA, 16 nt, Yersinia pestis KIM
uaaauuccguggcuua

SEQ ID NO: 2309205 - RNA, 17 nt, Yersinia pestis KIM
uaaauuaaaacugaaaa

SEQ ID NO: 2309206 - RNA, 14 nt, Yersinia pestis KIM
uaaauuaaaacuga

SEQ ID NO: 2309207 - RNA, 13 nt, Yersinia pestis KIM
uaaauuaaaaaga

SEQ ID NO: 2309208 - RNA, 14 nt, Yersinia pestis KIM
uaaauucaaaauag

SEQ ID NO: 2309209 - RNA, 15 nt, Yersinia pestis KIM
uaaauucaaauauca

SEQ ID NO: 2309210 - RNA, 19 nt, Yersinia pestis KIM
uaacaccagcauccugcaa

SEQ ID NO: 2309211 - RNA, 13 nt, Yersinia pestis KIM
uaacaccccuuca

SEQ ID NO: 2309212 - RNA, 16 nt, Yersinia pestis KIM
uaacacccaauaauaa

SEQ ID NO: 2309213 - RNA, 21 nt, Yersinia pestis KIM
uaacacccaauaauaaaaaaa

SEQ ID NO: 2309214 - RNA, 18 nt, Yersinia pestis KIM
uaacaccagcauccugca

SEQ ID NO: 2309215 - RNA, 21 nt, Yersinia pestis KIM
uaacaccagcaggugauacau

SEQ ID NO: 2309216 - RNA, 13 nt, Yersinia pestis KIM
uaacacauuaauu

SEQ ID NO: 2309217 - RNA, 22 nt, Yersinia pestis KIM
uaacacauuaauuuaucugcua

SEQ ID NO: 2309218 - RNA, 19 nt, Yersinia pestis KIM
uaacacauuauucuguacg

SEQ ID NO: 2309219 - RNA, 21 nt, Yersinia pestis KIM
uaacacauuccaguaaaaaaa

SEQ ID NO: 2309220 - RNA, 22 nt, Yersinia pestis KIM
uaacacauuccaguaaaaaaau

SEQ ID NO: 2309221 - RNA, 23 nt, Yersinia pestis KIM
uaacacauuccaguaaaaaaaua

SEQ ID NO: 2309222 - RNA, 20 nt, Yersinia pestis KIM
uaacacagucggcauagcua

SEQ ID NO: 2309223 - RNA, 22 nt, Yersinia pestis KIM
uaacaauaaguugaacaguggu

SEQ ID NO: 2309224 - RNA, 21 nt, Yersinia pestis KIM
uaacaagcgaccaucaugaau

SEQ ID NO: 2309225 - RNA, 12 nt, Yersinia pestis KIM
uaacaauucucu

SEQ ID NO: 2309226 - RNA, 14 nt, Yersinia pestis KIM
uaacaauuuaucag

SEQ ID NO: 2309227 - RNA, 17 nt, Yersinia pestis KIM
uaacaauuuuauuguuu

SEQ ID NO: 2309228 - RNA, 22 nt, Yersinia pestis KIM
uaacaauuuuauuguuuucguu

SEQ ID NO: 2309229 - RNA, 13 nt, Yersinia pestis KIM
uaaauuuucuaag

SEQ ID NO: 2309230 - RNA, 19 nt, Yersinia pestis KIM
uaaauuuucuaagcugccu

SEQ ID NO: 2309231 - RNA, 17 nt, Yersinia pestis KIM
uaacaacuuccacacaa

SEQ ID NO: 2309232 - RNA, 16 nt, Yersinia pestis KIM
uaacaacuuccacaca

SEQ ID NO: 2309233 - RNA, 15 nt, Yersinia pestis KIM
uaacaaacacaucca

SEQ ID NO: 2309234 - RNA, 14 nt, Yersinia pestis KIM
uaacauguagcaca

SEQ ID NO: 2309235 - RNA, 13 nt, Yersinia pestis KIM
uaacaugcugaua

SEQ ID NO: 2309236 - RNA, 17 nt, Yersinia pestis KIM
uaaccacacuuggugcu

SEQ ID NO: 2309237 - RNA, 18 nt, Yersinia pestis KIM
uaacaucagcgauucauu

SEQ ID NO: 2309238 - RNA, 20 nt, Yersinia pestis KIM
uaacaucagcgauucauuga

SEQ ID NO: 2309239 - RNA, 17 nt, Yersinia pestis KIM
uaacacuugaccaaccu

SEQ ID NO: 2309240 - RNA, 21 nt, Yersinia pestis KIM
uaacacuucagacugaaagua

SEQ ID NO: 2309241 - RNA, 13 nt, Yersinia pestis KIM
uaacagagcagaa

SEQ ID NO: 2309242 - RNA, 16 nt, Yersinia pestis KIM
uaaccagcaucaguag

SEQ ID NO: 2309243 - RNA, 20 nt, Yersinia pestis KIM
uaaccagacgcaaccaaaac

SEQ ID NO: 2309244 - RNA, 20 nt, Yersinia pestis KIM
uaaccagaagaacagcccuc

SEQ ID NO: 2309245 - RNA, 23 nt, Yersinia pestis KIM
uaaccagagcggagccucaguuc

SEQ ID NO: 2309246 - RNA, 19 nt, Yersinia pestis KIM
uaaccccguagcacacaca

SEQ ID NO: 2309247 - RNA, 20 nt, Yersinia pestis KIM
uaaccauccauauuuggcau

SEQ ID NO: 2309248 - RNA, 17 nt, Yersinia pestis KIM
uaaccauaaaauaaaua

SEQ ID NO: 2309249 - RNA, 13 nt, Yersinia pestis KIM
uaaccauaaaaua

SEQ ID NO: 2309250 - RNA, 14 nt, Yersinia pestis KIM
uaaccaucaaauac

SEQ ID NO: 2309251 - RNA, 16 nt, Yersinia pestis KIM
uaacccgauaaugccc

SEQ ID NO: 2309252 - RNA, 14 nt, Yersinia pestis KIM
uaacgcaaaaauca

SEQ ID NO: 2309253 - RNA, 17 nt, Yersinia pestis KIM
uaaccgguauauuggcc

SEQ ID NO: 2309254 - RNA, 21 nt, Yersinia pestis KIM
uaaccgacuugcccaauggca

SEQ ID NO: 2309255 - RNA, 17 nt, Yersinia pestis KIM
uaaccgaagauaaccgg

SEQ ID NO: 2309256 - RNA, 17 nt, Yersinia pestis KIM
uaaccucacgccaccuu

SEQ ID NO: 2309257 - RNA, 22 nt, Yersinia pestis KIM
uaaccucacgggcuuccaucag

SEQ ID NO: 2309258 - RNA, 22 nt, Yersinia pestis KIM
uaaccguuuuuucaacuggcug

SEQ ID NO: 2309259 - RNA, 21 nt, Yersinia pestis KIM
uaacgccgcuaaaucaucaaa

SEQ ID NO: 2309260 - RNA, 19 nt, Yersinia pestis KIM
uaacgcccggcaauaauag

SEQ ID NO: 2309261 - RNA, 21 nt, Yersinia pestis KIM
uaacgccggauaaauuaauaa

SEQ ID NO: 2309262 - RNA, 15 nt, Yersinia pestis KIM
uaacgcuucaucaug

SEQ ID NO: 2309263 - RNA, 14 nt, Yersinia pestis KIM
uaacgcugaauaag

SEQ ID NO: 2309264 - RNA, 14 nt, Yersinia pestis KIM
uaacgcucuuguag

SEQ ID NO: 2309265 - RNA, 20 nt, Yersinia pestis KIM
uaacgguuaagaagcgauua

SEQ ID NO: 2309266 - RNA, 17 nt, Yersinia pestis KIM
uaacggcagcuuccugu

SEQ ID NO: 2309267 - RNA, 14 nt, Yersinia pestis KIM
uaacggaaaaucau

SEQ ID NO: 2309268 - RNA, 17 nt, Yersinia pestis KIM
uaacggaaggggaauau

SEQ ID NO: 2309269 - RNA, 12 nt, Yersinia pestis KIM
uaaaucaucauu

SEQ ID NO: 2309270 - RNA, 14 nt, Yersinia pestis KIM
uaaaucaucaaauu

SEQ ID NO: 2309271 - RNA, 12 nt, Yersinia pestis KIM
uaaaucagugua

SEQ ID NO: 2309272 - RNA, 15 nt, Yersinia pestis KIM
uaaauauuaacauuc

SEQ ID NO: 2309273 - RNA, 21 nt, Yersinia pestis KIM
uaaauauccugcucagcuaaa

SEQ ID NO: 2309274 - RNA, 20 nt, Yersinia pestis KIM
uaaauauccugcucagcuaa

SEQ ID NO: 2309275 - RNA, 20 nt, Yersinia pestis KIM
uaaauaaaaagcguuucaga

SEQ ID NO: 2309276 - RNA, 12 nt, Yersinia pestis KIM
uaaaguuuuucc

SEQ ID NO: 2309277 - RNA, 15 nt, Yersinia pestis KIM
uaaauaacagcuaaa

SEQ ID NO: 2309278 - RNA, 23 nt, Yersinia pestis KIM
uaaauaaauuuaucuaauguauu

SEQ ID NO: 2309279 - RNA, 22 nt, Yersinia pestis KIM
uaaauaaccgagcgugaagagc

SEQ ID NO: 2309280 - RNA, 14 nt, Yersinia pestis KIM
uaaauaaguaggca

SEQ ID NO: 2309281 - RNA, 20 nt, Yersinia pestis KIM
uaaauaguuagugaguuauu

SEQ ID NO: 2309282 - RNA, 18 nt, Yersinia pestis KIM
uaaauagugggcuaaaac

SEQ ID NO: 2309283 - RNA, 13 nt, Yersinia pestis KIM
uaaauagugggcu

SEQ ID NO: 2309284 - RNA, 16 nt, Yersinia pestis KIM
uaaauagucauauauu

SEQ ID NO: 2309285 - RNA, 17 nt, Yersinia pestis KIM
uaaauaguucuucgcaa

SEQ ID NO: 2309286 - RNA, 14 nt, Yersinia pestis KIM
uaaauaauaaauua

SEQ ID NO: 2309287 - RNA, 16 nt, Yersinia pestis KIM
uaaauauaaaauaaua

SEQ ID NO: 2309288 - RNA, 21 nt, Yersinia pestis KIM
uaaaguguacuguuaacucau

SEQ ID NO: 2309289 - RNA, 15 nt, Yersinia pestis KIM
uaaaguuaucaccaa

SEQ ID NO: 2309290 - RNA, 15 nt, Yersinia pestis KIM
uaaaguugaaccaau

SEQ ID NO: 2309291 - RNA, 17 nt, Yersinia pestis KIM
uaaaguuagcuacgcug

SEQ ID NO: 2309292 - RNA, 15 nt, Yersinia pestis KIM
uaaagucaucccgca

SEQ ID NO: 2309293 - RNA, 14 nt, Yersinia pestis KIM
uaaagcccgcuuca

SEQ ID NO: 2309294 - RNA, 14 nt, Yersinia pestis KIM
uaaagcugucaguc

SEQ ID NO: 2309295 - RNA, 21 nt, Yersinia pestis KIM
uaaagcugucaguccaaaaua

SEQ ID NO: 2309296 - RNA, 11 nt, Yersinia pestis KIM
uaaagcccagg

SEQ ID NO: 2309297 - RNA, 20 nt, Yersinia pestis KIM
uaaagcauuuaucauauuaa

SEQ ID NO: 2309298 - RNA, 16 nt, Yersinia pestis KIM
uaaagcauuuaucaua

SEQ ID NO: 2309299 - RNA, 14 nt, Yersinia pestis KIM
uaaagcaucagacu

SEQ ID NO: 2309300 - RNA, 21 nt, Yersinia pestis KIM
uaaagauccccacaaaaucaa

SEQ ID NO: 2309301 - RNA, 20 nt, Yersinia pestis KIM
guuuuucaucugugccugca

SEQ ID NO: 2309302 - RNA, 19 nt, Yersinia pestis KIM
uaaacaaccaaaaaucuug

SEQ ID NO: 2309303 - RNA, 20 nt, Yersinia pestis KIM
uaaacaaccaaaaaucuugu

SEQ ID NO: 2309304 - RNA, 13 nt, Yersinia pestis KIM
uaaacaacgcuga

SEQ ID NO: 2309305 - RNA, 14 nt, Yersinia pestis KIM
guuuuuaucccccu

SEQ ID NO: 2309306 - RNA, 15 nt, Yersinia pestis KIM
uaaaccagccaguga

SEQ ID NO: 2309307 - RNA, 16 nt, Yersinia pestis KIM
uaaaccagccagugau

SEQ ID NO: 2309308 - RNA, 15 nt, Yersinia pestis KIM
uaaaccgcaccacaa

SEQ ID NO: 2309309 - RNA, 16 nt, Yersinia pestis KIM
uaaaccgcaccacaaa

SEQ ID NO: 2309310 - RNA, 17 nt, Yersinia pestis KIM
uaaaccgcaccacaaag

SEQ ID NO: 2309311 - RNA, 21 nt, Yersinia pestis KIM
uaaaccgggccuaauuuaacu

SEQ ID NO: 2309312 - RNA, 16 nt, Yersinia pestis KIM
uaaaccaaucaagcau

SEQ ID NO: 2309313 - RNA, 13 nt, Yersinia pestis KIM
uaaaccaaauggu

SEQ ID NO: 2309314 - RNA, 15 nt, Yersinia pestis KIM
uaaaccaaagauaau

SEQ ID NO: 2309315 - RNA, 15 nt, Yersinia pestis KIM
uaaacagacuaaaaa

SEQ ID NO: 2309316 - RNA, 14 nt, Yersinia pestis KIM
uaaacagccagcau

SEQ ID NO: 2309317 - RNA, 19 nt, Yersinia pestis KIM
uaaacagccguauaucuua

SEQ ID NO: 2309318 - RNA, 19 nt, Yersinia pestis KIM
uaaacauuuacuuauaaac

SEQ ID NO: 2309319 - RNA, 15 nt, Yersinia pestis KIM
uaaacacucaauaag

SEQ ID NO: 2309320 - RNA, 14 nt, Yersinia pestis KIM
uaaacagacacagc

SEQ ID NO: 2309321 - RNA, 14 nt, Yersinia pestis KIM
uaaacagacaaaaa

SEQ ID NO: 2309322 - RNA, 16 nt, Yersinia pestis KIM
uaaacagacaaaaaau

SEQ ID NO: 2309323 - RNA, 13 nt, Yersinia pestis KIM
uaaacaagcuuau

SEQ ID NO: 2309324 - RNA, 17 nt, Yersinia pestis KIM
uaaacaagcuuauauua

SEQ ID NO: 2309325 - RNA, 21 nt, Yersinia pestis KIM
uaaacgccgcgucaauaacau

SEQ ID NO: 2309326 - RNA, 20 nt, Yersinia pestis KIM
uaaacgcgaguuaggaaaaa

SEQ ID NO: 2309327 - RNA, 16 nt, Yersinia pestis KIM
uaaaccgugauugguu

SEQ ID NO: 2309328 - RNA, 16 nt, Yersinia pestis KIM
uaaaccguacauuaaa

SEQ ID NO: 2309329 - RNA, 13 nt, Yersinia pestis KIM
uaaagacccaaua

SEQ ID NO: 2309330 - RNA, 23 nt, Yersinia pestis KIM
uaaacugaauaucccccuccgga

SEQ ID NO: 2309331 - RNA, 16 nt, Yersinia pestis KIM
uaaacuguuggcguga

SEQ ID NO: 2309332 - RNA, 14 nt, Yersinia pestis KIM
gcucucgacaaccu

SEQ ID NO: 2309333 - RNA, 15 nt, Yersinia pestis KIM
gcugaaaucaggcug

SEQ ID NO: 2309334 - RNA, 23 nt, Yersinia pestis KIM
gcugaaguggcugaauaucaucu

SEQ ID NO: 2309335 - RNA, 16 nt, Yersinia pestis KIM
gcugaacccugacggc

SEQ ID NO: 2309336 - RNA, 22 nt, Yersinia pestis KIM
gcugaccuguuguaacacuuga

SEQ ID NO: 2309337 - RNA, 15 nt, Yersinia pestis KIM
gcugaauugcuuauc

SEQ ID NO: 2309338 - RNA, 17 nt, Yersinia pestis KIM
gcugaauuggaagagcc

SEQ ID NO: 2309339 - RNA, 18 nt, Yersinia pestis KIM
gcugaauaucaucuuuuu

SEQ ID NO: 2309340 - RNA, 21 nt, Yersinia pestis KIM
gcugaauaucaucuuuuucug

SEQ ID NO: 2309341 - RNA, 19 nt, Yersinia pestis KIM
gcugcagccgggaugauca

SEQ ID NO: 2309342 - RNA, 23 nt, Yersinia pestis KIM
gcugcaacuccuuaccacugcuc

SEQ ID NO: 2309343 - RNA, 21 nt, Yersinia pestis KIM
gcugcaacucauuaacaauua

SEQ ID NO: 2309344 - RNA, 13 nt, Yersinia pestis KIM
gcugcaacucauu

SEQ ID NO: 2309345 - RNA, 20 nt, Yersinia pestis KIM
gcugcaaacaggcccacugc

SEQ ID NO: 2309346 - RNA, 21 nt, Yersinia pestis KIM
gcugauuaccugcaucaagcc

SEQ ID NO: 2309347 - RNA, 20 nt, Yersinia pestis KIM
gcugauuaauaucaaaacug

SEQ ID NO: 2309348 - RNA, 15 nt, Yersinia pestis KIM
gcugauuaauaucaa

SEQ ID NO: 2309349 - RNA, 22 nt, Yersinia pestis KIM
gcugauagaaaguugagcagca

SEQ ID NO: 2309350 - RNA, 23 nt, Yersinia pestis KIM
gcugauagaaaguugagcagcaa

SEQ ID NO: 2309351 - RNA, 22 nt, Yersinia pestis KIM
gcugagauuauugggcugccug

SEQ ID NO: 2309352 - RNA, 13 nt, Yersinia pestis KIM
gcugccuaccugc

SEQ ID NO: 2309353 - RNA, 17 nt, Yersinia pestis KIM
gcugcgccaauacccgu

SEQ ID NO: 2309354 - RNA, 19 nt, Yersinia pestis KIM
gcugccgcaagaaagaaaa

SEQ ID NO: 2309355 - RNA, 15 nt, Yersinia pestis KIM
gcuggaucagcagac

SEQ ID NO: 2309356 - RNA, 16 nt, Yersinia pestis KIM
gcuggacaacuucacu

SEQ ID NO: 2309357 - RNA, 13 nt, Yersinia pestis KIM
gcuggaaguuggc

SEQ ID NO: 2309358 - RNA, 11 nt, Yersinia pestis KIM
gcugcugcucg

SEQ ID NO: 2309359 - RNA, 20 nt, Yersinia pestis KIM
gcugcuaaacaggguugagc

SEQ ID NO: 2309360 - RNA, 9 nt, Yersinia pestis KIM
gcugcucac

SEQ ID NO: 2309361 - RNA, 14 nt, Yersinia pestis KIM
gcuccucaaccccu

SEQ ID NO: 2309362 - RNA, 14 nt, Yersinia pestis KIM
gcuccucagccuuu

SEQ ID NO: 2309363 - RNA, 18 nt, Yersinia pestis KIM
gcuccuccuuggggccuc

SEQ ID NO: 2309364 - RNA, 21 nt, Yersinia pestis KIM
gcuccuauagcucagaaaaua

SEQ ID NO: 2309365 - RNA, 23 nt, Yersinia pestis KIM
gcuccuauagcucagaaaauaaa

SEQ ID NO: 2309366 - RNA, 20 nt, Yersinia pestis KIM
gcuccgguuuucacccccac

SEQ ID NO: 2309367 - RNA, 14 nt, Yersinia pestis KIM
gcuccgcggugcuu

SEQ ID NO: 2309368 - RNA, 18 nt, Yersinia pestis KIM
gcuccgcccuaaagcugu

SEQ ID NO: 2309369 - RNA, 21 nt, Yersinia pestis KIM
gcuccaucuuuuacaaauuug

SEQ ID NO: 2309370 - RNA, 21 nt, Yersinia pestis KIM
gcuccauuucugguugugcuu

SEQ ID NO: 2309371 - RNA, 17 nt, Yersinia pestis KIM
gcuccagcgucacuuca

SEQ ID NO: 2309372 - RNA, 20 nt, Yersinia pestis KIM
gcgguauuccgagcaaucaa

SEQ ID NO: 2309373 - RNA, 22 nt, Yersinia pestis KIM
gcucaucaaaggagugcccggc

SEQ ID NO: 2309374 - RNA, 23 nt, Yersinia pestis KIM
gcucaucauccaucacaaaaccu

SEQ ID NO: 2309375 - RNA, 20 nt, Yersinia pestis KIM
gcucauccaucauugcuaaa

SEQ ID NO: 2309376 - RNA, 13 nt, Yersinia pestis KIM
gcucauagcccug

SEQ ID NO: 2309377 - RNA, 19 nt, Yersinia pestis KIM
gcucauaaagcaucagacu

SEQ ID NO: 2309378 - RNA, 19 nt, Yersinia pestis KIM
gcuccaaagcuuccaauau

SEQ ID NO: 2309379 - RNA, 15 nt, Yersinia pestis KIM
gcucaucgguaccag

SEQ ID NO: 2309380 - RNA, 23 nt, Yersinia pestis KIM
gcucaucuaacucauucauaauu

SEQ ID NO: 2309381 - RNA, 14 nt, Yersinia pestis KIM
gcucgacggccaau

SEQ ID NO: 2309382 - RNA, 13 nt, Yersinia pestis KIM
gcucgaagcgcgc

SEQ ID NO: 2309383 - RNA, 14 nt, Yersinia pestis KIM
gcuccugaugacuc

SEQ ID NO: 2309384 - RNA, 15 nt, Yersinia pestis KIM
gcuccugaugacuca

SEQ ID NO: 2309385 - RNA, 15 nt, Yersinia pestis KIM
gcuccugagcugagu

SEQ ID NO: 2309386 - RNA, 21 nt, Yersinia pestis KIM
gcuccugccacagacuuucuu

SEQ ID NO: 2309387 - RNA, 19 nt, Yersinia pestis KIM
gcucuacgccccaugcacc

SEQ ID NO: 2309388 - RNA, 14 nt, Yersinia pestis KIM
gcucuaucgauaaa

SEQ ID NO: 2309389 - RNA, 21 nt, Yersinia pestis KIM
gcucuaguacguaaauuuauu

SEQ ID NO: 2309390 - RNA, 18 nt, Yersinia pestis KIM
gcucgucuucgacagcag

SEQ ID NO: 2309391 - RNA, 15 nt, Yersinia pestis KIM
gcucgugaucagcag

SEQ ID NO: 2309392 - RNA, 18 nt, Yersinia pestis KIM
gcucgugaucagcagacu

SEQ ID NO: 2309393 - RNA, 14 nt, Yersinia pestis KIM
gcuuuauuauauga

SEQ ID NO: 2309394 - RNA, 16 nt, Yersinia pestis KIM
gcuuucaauaaaacuc

SEQ ID NO: 2309395 - RNA, 20 nt, Yersinia pestis KIM
gcuuucagauaaugccuaag

SEQ ID NO: 2309396 - RNA, 15 nt, Yersinia pestis KIM
gcuuucaucuucuuc

SEQ ID NO: 2309397 - RNA, 21 nt, Yersinia pestis KIM
gcuuucaggagugaauuucuu

SEQ ID NO: 2309398 - RNA, 19 nt, Yersinia pestis KIM
gcuuuccagcucuggccag

SEQ ID NO: 2309399 - RNA, 23 nt, Yersinia pestis KIM
gcuuuaccuguuucgauccagcu

SEQ ID NO: 2309400 - RNA, 16 nt, Yersinia pestis KIM
gcuuuacuccucugcc

SEQ ID NO: 2309401 - RNA, 20 nt, Yersinia pestis KIM
gcuuuacuccucugccuauc

SEQ ID NO: 2309402 - RNA, 13 nt, Yersinia pestis KIM
gcuuuacuccucu

SEQ ID NO: 2309403 - RNA, 16 nt, Yersinia pestis KIM
gcuuuagccagucacc

SEQ ID NO: 2309404 - RNA, 14 nt, Yersinia pestis KIM
gcuuuagcauugca

SEQ ID NO: 2309405 - RNA, 17 nt, Yersinia pestis KIM
gcuuuacucuucagccu

SEQ ID NO: 2309406 - RNA, 15 nt, Yersinia pestis KIM
gcuuuacucuucugc

SEQ ID NO: 2309407 - RNA, 19 nt, Yersinia pestis KIM
gcuuuagugggugagcaga

SEQ ID NO: 2309408 - RNA, 18 nt, Yersinia pestis KIM
gcuuuauaguccuuccau

SEQ ID NO: 2309409 - RNA, 13 nt, Yersinia pestis KIM
gcuuuaaugaguu

SEQ ID NO: 2309410 - RNA, 13 nt, Yersinia pestis KIM
gcuuuaauccauu

SEQ ID NO: 2309411 - RNA, 19 nt, Yersinia pestis KIM
gcuuuaagauccauguaua

SEQ ID NO: 2309412 - RNA, 20 nt, Yersinia pestis KIM
gcuuuaagauccaguucagu

SEQ ID NO: 2309413 - RNA, 19 nt, Yersinia pestis KIM
gcuuguucuguuagcgacu

SEQ ID NO: 2309414 - RNA, 17 nt, Yersinia pestis KIM
gcuuguuguugauaguu

SEQ ID NO: 2309415 - RNA, 17 nt, Yersinia pestis KIM
gcuuuaaauaacgcaaa

SEQ ID NO: 2309416 - RNA, 21 nt, Yersinia pestis KIM
aaaggccggauguaaaacacg

SEQ ID NO: 2309417 - RNA, 20 nt, Yersinia pestis KIM
gcuugugcucacgucaccac

SEQ ID NO: 2309418 - RNA, 14 nt, Yersinia pestis KIM
gcuuguuagcugcc

SEQ ID NO: 2309419 - RNA, 15 nt, Yersinia pestis KIM
gcuugcuggcggcgg

SEQ ID NO: 2309420 - RNA, 19 nt, Yersinia pestis KIM
gcuugcuuugcuucaucca

SEQ ID NO: 2309421 - RNA, 13 nt, Yersinia pestis KIM
aaaggcaaagaag

SEQ ID NO: 2309422 - RNA, 20 nt, Yersinia pestis KIM
aaaggccaccaaauugcggc

SEQ ID NO: 2309423 - RNA, 23 nt, Yersinia pestis KIM
aaaggcaaaaugaucaucagcag

SEQ ID NO: 2309424 - RNA, 12 nt, Yersinia pestis KIM
aaaggcaaagaa

SEQ ID NO: 2309425 - RNA, 17 nt, Yersinia pestis KIM
gcuugggcuucacaucc

SEQ ID NO: 2309426 - RNA, 14 nt, Yersinia pestis KIM
gcuucgccacggca

SEQ ID NO: 2309427 - RNA, 15 nt, Yersinia pestis KIM
gcuucgagcccccag

SEQ ID NO: 2309428 - RNA, 23 nt, Yersinia pestis KIM
gcuucgcucggcucgaaccugaa

SEQ ID NO: 2309429 - RNA, 17 nt, Yersinia pestis KIM
gcuucguagccauuggg

SEQ ID NO: 2309430 - RNA, 22 nt, Yersinia pestis KIM
gcuucugcgaggccgcugcaag

SEQ ID NO: 2309431 - RNA, 17 nt, Yersinia pestis KIM
gcuucuguggcggcaag

SEQ ID NO: 2309432 - RNA, 17 nt, Yersinia pestis KIM
gcuucuggcacaaagca

SEQ ID NO: 2309433 - RNA, 18 nt, Yersinia pestis KIM
gcuucuggcgugucaucu

SEQ ID NO: 2309434 - RNA, 17 nt, Yersinia pestis KIM
gcuucugggccaaagcg

SEQ ID NO: 2309435 - RNA, 16 nt, Yersinia pestis KIM
gcuucuaacaauaagu

SEQ ID NO: 2309436 - RNA, 13 nt, Yersinia pestis KIM
gcuucuuuuaaag

SEQ ID NO: 2309437 - RNA, 19 nt, Yersinia pestis KIM
gcuugaaguacggugccag

SEQ ID NO: 2309438 - RNA, 14 nt, Yersinia pestis KIM
gcuugaucacaauc

SEQ ID NO: 2309439 - RNA, 22 nt, Yersinia pestis KIM
gcuugcauacgcuuaaccagca

SEQ ID NO: 2309440 - RNA, 19 nt, Yersinia pestis KIM
gcuugcaucaacuuugguu

SEQ ID NO: 2309441 - RNA, 19 nt, Yersinia pestis KIM
gcuugcgcguuaaucugcu

SEQ ID NO: 2309442 - RNA, 19 nt, Yersinia pestis KIM
aaaggaauaucugugauaa

SEQ ID NO: 2309443 - RNA, 21 nt, Yersinia pestis KIM
gcuggucauaaucaucugcuc

SEQ ID NO: 2309444 - RNA, 15 nt, Yersinia pestis KIM
gcuggucaucacgcu

SEQ ID NO: 2309445 - RNA, 21 nt, Yersinia pestis KIM
gcuggcaaccgguaacauaua

SEQ ID NO: 2309446 - RNA, 19 nt, Yersinia pestis KIM
gcuggcaaaguuauugacc

SEQ ID NO: 2309447 - RNA, 14 nt, Yersinia pestis KIM
gcugucauaaaaaa

SEQ ID NO: 2309448 - RNA, 16 nt, Yersinia pestis KIM
gcugucauaaaaaaag

SEQ ID NO: 2309449 - RNA, 15 nt, Yersinia pestis KIM
aaaggaguucugcag

SEQ ID NO: 2309450 - RNA, 21 nt, Yersinia pestis KIM
aaaggauggcccaagccaucc

SEQ ID NO: 2309451 - RNA, 15 nt, Yersinia pestis KIM
gcugugguugccaaa

SEQ ID NO: 2309452 - RNA, 13 nt, Yersinia pestis KIM
gcugugugggcgg

SEQ ID NO: 2309453 - RNA, 19 nt, Yersinia pestis KIM
gcuguuccaaccaaccuug

SEQ ID NO: 2309454 - RNA, 18 nt, Yersinia pestis KIM
gcuguuacccauggcaac

SEQ ID NO: 2309455 - RNA, 21 nt, Yersinia pestis KIM
gcuguuauuacugucauugcu

SEQ ID NO: 2309456 - RNA, 12 nt, Yersinia pestis KIM
gcuguucaaaau

SEQ ID NO: 2309457 - RNA, 14 nt, Yersinia pestis KIM
gcuguuauauaaau

SEQ ID NO: 2309458 - RNA, 20 nt, Yersinia pestis KIM
gcuuaaucgccagcaaauca

SEQ ID NO: 2309459 - RNA, 22 nt, Yersinia pestis KIM
gcuuaaucaucaucacaaauaa

SEQ ID NO: 2309460 - RNA, 13 nt, Yersinia pestis KIM
gcuuaaucuuuuu

SEQ ID NO: 2309461 - RNA, 16 nt, Yersinia pestis KIM
gcuuaaauaaaacacc

SEQ ID NO: 2309462 - RNA, 16 nt, Yersinia pestis KIM
gcuguuguuguugauu

SEQ ID NO: 2309463 - RNA, 15 nt, Yersinia pestis KIM
gcuguugcguaccau

SEQ ID NO: 2309464 - RNA, 15 nt, Yersinia pestis KIM
gcuuccaucacaaau

SEQ ID NO: 2309465 - RNA, 23 nt, Yersinia pestis KIM
gcuucauucguuagcucuucacg

SEQ ID NO: 2309466 - RNA, 16 nt, Yersinia pestis KIM
gcuucauccaacuuac

SEQ ID NO: 2309467 - RNA, 16 nt, Yersinia pestis KIM
gcuucaucagcgccca

SEQ ID NO: 2309468 - RNA, 18 nt, Yersinia pestis KIM
gcuucaucaguaaaauac

SEQ ID NO: 2309469 - RNA, 19 nt, Yersinia pestis KIM
gcuucaguuuugcggguga

SEQ ID NO: 2309470 - RNA, 17 nt, Yersinia pestis KIM
gcuucagcucuucuaac

SEQ ID NO: 2309471 - RNA, 12 nt, Yersinia pestis KIM
gcuuauggccuu

SEQ ID NO: 2309472 - RNA, 12 nt, Yersinia pestis KIM
gcuuauucgagu

SEQ ID NO: 2309473 - RNA, 20 nt, Yersinia pestis KIM
gcuucaaaaucaccuggcca

SEQ ID NO: 2309474 - RNA, 20 nt, Yersinia pestis KIM
gcuucacggacagcaaccac

SEQ ID NO: 2309475 - RNA, 15 nt, Yersinia pestis KIM
gcuucacaucauaau

SEQ ID NO: 2309476 - RNA, 23 nt, Yersinia pestis KIM
gcuuaucucggggccacgguugg

SEQ ID NO: 2309477 - RNA, 17 nt, Yersinia pestis KIM
gcuuaucaaagugcuua

SEQ ID NO: 2309478 - RNA, 23 nt, Yersinia pestis KIM
gcuuagcaggcccuuucaccgcu

SEQ ID NO: 2309479 - RNA, 22 nt, Yersinia pestis KIM
gcuuacuuuuauaccgcagcau

SEQ ID NO: 2309480 - RNA, 14 nt, Yersinia pestis KIM
gcuuacauaaguaa

SEQ ID NO: 2309481 - RNA, 22 nt, Yersinia pestis KIM
gcuuaccgucugggcuggugga

SEQ ID NO: 2309482 - RNA, 23 nt, Yersinia pestis KIM
ggcccugagguugcucagcgggc

SEQ ID NO: 2309483 - RNA, 13 nt, Yersinia pestis KIM
ggcccggccaggc

SEQ ID NO: 2309484 - RNA, 23 nt, Yersinia pestis KIM
ggcccgcuaucacuagcgggccu

SEQ ID NO: 2309485 - RNA, 20 nt, Yersinia pestis KIM
ggcccgcuagugauagcggg

SEQ ID NO: 2309486 - RNA, 23 nt, Yersinia pestis KIM
ggcccgcuagugauagcgggccu

SEQ ID NO: 2309487 - RNA, 14 nt, Yersinia pestis KIM
ggcccgcuucccua

SEQ ID NO: 2309488 - RNA, 14 nt, Yersinia pestis KIM
aaagucuuaaucuu

SEQ ID NO: 2309489 - RNA, 13 nt, Yersinia pestis KIM
aaagucuuaaucu

SEQ ID NO: 2309490 - RNA, 20 nt, Yersinia pestis KIM
aaagucguucuuuggcauca

SEQ ID NO: 2309491 - RNA, 21 nt, Yersinia pestis KIM
aaagucgguguaguguuuggu

SEQ ID NO: 2309492 - RNA, 23 nt, Yersinia pestis KIM
aaagugagaaggguauugaagau

SEQ ID NO: 2309493 - RNA, 18 nt, Yersinia pestis KIM
ggccaugaaucaaauuau

SEQ ID NO: 2309494 - RNA, 15 nt, Yersinia pestis KIM
ggccagcagaacuaa

SEQ ID NO: 2309495 - RNA, 20 nt, Yersinia pestis KIM
ggccagcuuuuuaucauuua

SEQ ID NO: 2309496 - RNA, 18 nt, Yersinia pestis KIM
ggccccuuaaauaugaug

SEQ ID NO: 2309497 - RNA, 15 nt, Yersinia pestis KIM
ggccccagcccagca

SEQ ID NO: 2309498 - RNA, 14 nt, Yersinia pestis KIM
ggccccagcccagc

SEQ ID NO: 2309499 - RNA, 20 nt, Yersinia pestis KIM
ggcccaucuuucggccuccc

SEQ ID NO: 2309500 - RNA, 18 nt, Yersinia pestis KIM
ggccacuucgguggcccu

SEQ ID NO: 2309501 - RNA, 19 nt, Yersinia pestis KIM
ggccagagacaccgccagc

SEQ ID NO: 2309502 - RNA, 14 nt, Yersinia pestis KIM
ggccagagcauaga

SEQ ID NO: 2309503 - RNA, 20 nt, Yersinia pestis KIM
ggcauggauggucauaaaau

SEQ ID NO: 2309504 - RNA, 16 nt, Yersinia pestis KIM
ggcauggacgagcaca

SEQ ID NO: 2309505 - RNA, 17 nt, Yersinia pestis KIM
ggcauuagagguuuaca

SEQ ID NO: 2309506 - RNA, 21 nt, Yersinia pestis KIM
ggcauucuaguuugugcugcu

SEQ ID NO: 2309507 - RNA, 19 nt, Yersinia pestis KIM
ggcauucgcugauuaaugu

SEQ ID NO: 2309508 - RNA, 14 nt, Yersinia pestis KIM
ggccaauaggcccc

SEQ ID NO: 2309509 - RNA, 18 nt, Yersinia pestis KIM
ggcaggguauuuucuccu

SEQ ID NO: 2309510 - RNA, 21 nt, Yersinia pestis KIM
ggcagggcgcuuucuggguga

SEQ ID NO: 2309511 - RNA, 17 nt, Yersinia pestis KIM
ggcagguagggcggccc

SEQ ID NO: 2309512 - RNA, 21 nt, Yersinia pestis KIM
ggcagguagggcggcccacuu

SEQ ID NO: 2309513 - RNA, 15 nt, Yersinia pestis KIM
ggcagguaaauccuu

SEQ ID NO: 2309514 - RNA, 16 nt, Yersinia pestis KIM
ggcaguaacgccauaa

SEQ ID NO: 2309515 - RNA, 21 nt, Yersinia pestis KIM
ggcaguaaaaugccgcgcuug

SEQ ID NO: 2309516 - RNA, 12 nt, Yersinia pestis KIM
ggcaucaccaaa

SEQ ID NO: 2309517 - RNA, 16 nt, Yersinia pestis KIM
ggcaucaaucagcggg

SEQ ID NO: 2309518 - RNA, 14 nt, Yersinia pestis KIM
ggcauauacaaccu

SEQ ID NO: 2309519 - RNA, 13 nt, Yersinia pestis KIM
ggcaucauccuca

SEQ ID NO: 2309520 - RNA, 22 nt, Yersinia pestis KIM
aaaguauucuuaucaaucaaaa

SEQ ID NO: 2309521 - RNA, 13 nt, Yersinia pestis KIM
aaagucacacugu

SEQ ID NO: 2309522 - RNA, 15 nt, Yersinia pestis KIM
ggcaaggcacgagcg

SEQ ID NO: 2309523 - RNA, 16 nt, Yersinia pestis KIM
ggcaaggauggcgcgg

SEQ ID NO: 2309524 - RNA, 12 nt, Yersinia pestis KIM
ggcaaggcacga

SEQ ID NO: 2309525 - RNA, 14 nt, Yersinia pestis KIM
ggcaaguuaaucau

SEQ ID NO: 2309526 - RNA, 19 nt, Yersinia pestis KIM
ggcagauaugccaggcauc

SEQ ID NO: 2309527 - RNA, 17 nt, Yersinia pestis KIM
ggcagauuucaccccuu

SEQ ID NO: 2309528 - RNA, 15 nt, Yersinia pestis KIM
ggcagccuuuaucca

SEQ ID NO: 2309529 - RNA, 13 nt, Yersinia pestis KIM
ggcaggagucuga

SEQ ID NO: 2309530 - RNA, 22 nt, Yersinia pestis KIM
ggcaggaagcccguuauggcaa

SEQ ID NO: 2309531 - RNA, 12 nt, Yersinia pestis KIM
aaaguagccaau

SEQ ID NO: 2309532 - RNA, 23 nt, Yersinia pestis KIM
ggauuaacuuuucuucauugcug

SEQ ID NO: 2309533 - RNA, 19 nt, Yersinia pestis KIM
ggauuacauaugauggcau

SEQ ID NO: 2309534 - RNA, 18 nt, Yersinia pestis KIM
ggauuacuucaauaagaa

SEQ ID NO: 2309535 - RNA, 19 nt, Yersinia pestis KIM
ggauuaaauaaagauaaug

SEQ ID NO: 2309536 - RNA, 19 nt, Yersinia pestis KIM
ggauuaaauucuaccuggc

SEQ ID NO: 2309537 - RNA, 15 nt, Yersinia pestis KIM
ggauucaaacaaggc

SEQ ID NO: 2309538 - RNA, 15 nt, Yersinia pestis KIM
ggauuuuccgcagcu

SEQ ID NO: 2309539 - RNA, 12 nt, Yersinia pestis KIM
ggauuucuucau

SEQ ID NO: 2309540 - RNA, 22 nt, Yersinia pestis KIM
ggauucgugucaauauucuguu

SEQ ID NO: 2309541 - RNA, 18 nt, Yersinia pestis KIM
ggcaacuuuuuucauccu

SEQ ID NO: 2309542 - RNA, 21 nt, Yersinia pestis KIM
ggcaagaaacuucauuucagg

SEQ ID NO: 2309543 - RNA, 13 nt, Yersinia pestis KIM
ggcaagaaacuuc

SEQ ID NO: 2309544 - RNA, 18 nt, Yersinia pestis KIM
ggcaagacgguaucuagg

SEQ ID NO: 2309545 - RNA, 23 nt, Yersinia pestis KIM
ggcaagcagacgcacccggcugg

SEQ ID NO: 2309546 - RNA, 21 nt, Yersinia pestis KIM
ggcaacagcauggaaacggug

SEQ ID NO: 2309547 - RNA, 16 nt, Yersinia pestis KIM
ggcaaaagcaucacca

SEQ ID NO: 2309548 - RNA, 11 nt, Yersinia pestis KIM
ggcaaaaaaau

SEQ ID NO: 2309549 - RNA, 19 nt, Yersinia pestis KIM
ggauggcccaagccauccu

SEQ ID NO: 2309550 - RNA, 16 nt, Yersinia pestis KIM
ggauggccgggcuguc

SEQ ID NO: 2309551 - RNA, 17 nt, Yersinia pestis KIM
aaaguacgcaaaauaag

SEQ ID NO: 2309552 - RNA, 18 nt, Yersinia pestis KIM
ggaugucaggaucauugc

SEQ ID NO: 2309553 - RNA, 13 nt, Yersinia pestis KIM
ggauccauaggau

SEQ ID NO: 2309554 - RNA, 17 nt, Yersinia pestis KIM
ggaucaggaucaccagc

SEQ ID NO: 2309555 - RNA, 20 nt, Yersinia pestis KIM
ggaucgggcuaucaucaaag

SEQ ID NO: 2309556 - RNA, 21 nt, Yersinia pestis KIM
ggaucucacccacacgacaug

SEQ ID NO: 2309557 - RNA, 20 nt, Yersinia pestis KIM
ggaugaguauuaccucauca

SEQ ID NO: 2309558 - RNA, 21 nt, Yersinia pestis KIM
ggaugacaguauuugcagugg

SEQ ID NO: 2309559 - RNA, 13 nt, Yersinia pestis KIM
ggauaaaaaugca

SEQ ID NO: 2309560 - RNA, 17 nt, Yersinia pestis KIM
ggauaaauuaauaacgc

SEQ ID NO: 2309561 - RNA, 17 nt, Yersinia pestis KIM
ggauaaaucgcccaacc

SEQ ID NO: 2309562 - RNA, 13 nt, Yersinia pestis KIM
ggaguuuuuauuu

SEQ ID NO: 2309563 - RNA, 18 nt, Yersinia pestis KIM
ggaguuuuacugauaugg

SEQ ID NO: 2309564 - RNA, 23 nt, Yersinia pestis KIM
ggaguuacucagcauccuccuga

SEQ ID NO: 2309565 - RNA, 17 nt, Yersinia pestis KIM
ggagccaauagaggcuc

SEQ ID NO: 2309566 - RNA, 19 nt, Yersinia pestis KIM
ggauaaccgcauucccugc

SEQ ID NO: 2309567 - RNA, 18 nt, Yersinia pestis KIM
ggauaaguuccggcagau

SEQ ID NO: 2309568 - RNA, 13 nt, Yersinia pestis KIM
ggauaaucaucag

SEQ ID NO: 2309569 - RNA, 18 nt, Yersinia pestis KIM
ggauaauguccuauuuaa

SEQ ID NO: 2309570 - RNA, 22 nt, Yersinia pestis KIM
ggauacaaaugagagcgcagca

SEQ ID NO: 2309571 - RNA, 23 nt, Yersinia pestis KIM
ggauaccaaucccuacggcaauc

SEQ ID NO: 2309572 - RNA, 14 nt, Yersinia pestis KIM
ggauagcaacugcc

SEQ ID NO: 2309573 - RNA, 15 nt, Yersinia pestis KIM
ggauacuggugucuu

SEQ ID NO: 2309574 - RNA, 18 nt, Yersinia pestis KIM
ggaucaacgcccgcggcc

SEQ ID NO: 2309575 - RNA, 14 nt, Yersinia pestis KIM
ggaucaaauguccc

SEQ ID NO: 2309576 - RNA, 11 nt, Yersinia pestis KIM
ggauauuucgg

SEQ ID NO: 2309577 - RNA, 17 nt, Yersinia pestis KIM
ggauauucucaacuuca

SEQ ID NO: 2309578 - RNA, 17 nt, Yersinia pestis KIM
aaagguuaacugcagug

SEQ ID NO: 2309579 - RNA, 14 nt, Yersinia pestis KIM
aaagguuaacugca

SEQ ID NO: 2309580 - RNA, 18 nt, Yersinia pestis KIM
aaagguaugugccaaaaa

SEQ ID NO: 2309581 - RNA, 20 nt, Yersinia pestis KIM
aaagguaugugccaaaaaaa

SEQ ID NO: 2309582 - RNA, 12 nt, Yersinia pestis KIM
ggagaggcuuac

SEQ ID NO: 2309583 - RNA, 11 nt, Yersinia pestis KIM
ggagaggcgcu

SEQ ID NO: 2309584 - RNA, 12 nt, Yersinia pestis KIM
ggagagauuaga

SEQ ID NO: 2309585 - RNA, 18 nt, Yersinia pestis KIM
ggagauuucagacugcug

SEQ ID NO: 2309586 - RNA, 19 nt, Yersinia pestis KIM
ggagauuucagacugcuga

SEQ ID NO: 2309587 - RNA, 23 nt, Yersinia pestis KIM
ggagcaagacguccgucguuugc

SEQ ID NO: 2309588 - RNA, 15 nt, Yersinia pestis KIM
ggagagaacaggcag

SEQ ID NO: 2309589 - RNA, 21 nt, Yersinia pestis KIM
ggagacuucgccaaucucaaa

SEQ ID NO: 2309590 - RNA, 23 nt, Yersinia pestis KIM
ggagacgccuucacggguucgcg

SEQ ID NO: 2309591 - RNA, 17 nt, Yersinia pestis KIM
ggagaccgcaugcugca

SEQ ID NO: 2309592 - RNA, 12 nt, Yersinia pestis KIM
ggagaaacauua

SEQ ID NO: 2309593 - RNA, 16 nt, Yersinia pestis KIM
aaaggcuauuuaaauu

SEQ ID NO: 2309594 - RNA, 18 nt, Yersinia pestis KIM
ggacaggcuccuccuugg

SEQ ID NO: 2309595 - RNA, 14 nt, Yersinia pestis KIM
ggacgcuccucacu

SEQ ID NO: 2309596 - RNA, 21 nt, Yersinia pestis KIM
ggacgcuuuacuccccugccu

SEQ ID NO: 2309597 - RNA, 15 nt, Yersinia pestis KIM
aaaggguaaucagaa

SEQ ID NO: 2309598 - RNA, 17 nt, Yersinia pestis KIM
ggacgaauacacagcga

SEQ ID NO: 2309599 - RNA, 21 nt, Yersinia pestis KIM
ggacgaccuguagcuuuuuaa

SEQ ID NO: 2309600 - RNA, 21 nt, Yersinia pestis KIM
ggaacguggguggucauuuaa

SEQ ID NO: 2309601 - RNA, 22 nt, Yersinia pestis KIM
ggaagccgccaaguuggggaua

SEQ ID NO: 2309602 - RNA, 17 nt, Yersinia pestis KIM
ggaagguaccugaucag

SEQ ID NO: 2309603 - RNA, 13 nt, Yersinia pestis KIM
ggaagguguuuaa

SEQ ID NO: 2309604 - RNA, 19 nt, Yersinia pestis KIM
ggaagcgccgacacccagc

SEQ ID NO: 2309605 - RNA, 20 nt, Yersinia pestis KIM
ggaagccggcgucuuuacga

SEQ ID NO: 2309606 - RNA, 15 nt, Yersinia pestis KIM
ggaacagcucggcca

SEQ ID NO: 2309607 - RNA, 21 nt, Yersinia pestis KIM
ggaacagcucggccagcauuc

SEQ ID NO: 2309608 - RNA, 12 nt, Yersinia pestis KIM
ggaacaggccaa

SEQ ID NO: 2309609 - RNA, 20 nt, Yersinia pestis KIM
ggaaauuucccccucacauu

SEQ ID NO: 2309610 - RNA, 15 nt, Yersinia pestis KIM
ggacaaaccagcccu

SEQ ID NO: 2309611 - RNA, 19 nt, Yersinia pestis KIM
ggaauaaccuacaaaaaua

SEQ ID NO: 2309612 - RNA, 18 nt, Yersinia pestis KIM
ggaaugaguugcccuaaa

SEQ ID NO: 2309613 - RNA, 18 nt, Yersinia pestis KIM
ggaauggcgcaauagcau

SEQ ID NO: 2309614 - RNA, 21 nt, Yersinia pestis KIM
ggucgaacccauucaucaaac

SEQ ID NO: 2309615 - RNA, 18 nt, Yersinia pestis KIM
ggucgggcgcugagcggg

SEQ ID NO: 2309616 - RNA, 12 nt, Yersinia pestis KIM
ggucguauucag

SEQ ID NO: 2309617 - RNA, 16 nt, Yersinia pestis KIM
ggucgugaaagcagaa

SEQ ID NO: 2309618 - RNA, 14 nt, Yersinia pestis KIM
ggugaaaaaauauc

SEQ ID NO: 2309619 - RNA, 14 nt, Yersinia pestis KIM
ggucaacugugcca

SEQ ID NO: 2309620 - RNA, 13 nt, Yersinia pestis KIM
ggucaauaccaua

SEQ ID NO: 2309621 - RNA, 15 nt, Yersinia pestis KIM
ggucaauaaaauuaa

SEQ ID NO: 2309622 - RNA, 22 nt, Yersinia pestis KIM
ggucagagauauaaacgacuuc

SEQ ID NO: 2309623 - RNA, 17 nt, Yersinia pestis KIM
ggucagaaccuguuaca

SEQ ID NO: 2309624 - RNA, 19 nt, Yersinia pestis KIM
gguccccagagcgcaaaag

SEQ ID NO: 2309625 - RNA, 17 nt, Yersinia pestis KIM
ggucccuaacgcaauac

SEQ ID NO: 2309626 - RNA, 12 nt, Yersinia pestis KIM
ggucauguggaa

SEQ ID NO: 2309627 - RNA, 16 nt, Yersinia pestis KIM
ggucaguugaauauuc

SEQ ID NO: 2309628 - RNA, 23 nt, Yersinia pestis KIM
ggucaguugaauauuccauuugu

SEQ ID NO: 2309629 - RNA, 17 nt, Yersinia pestis KIM
ggucaucacccagcaaa

SEQ ID NO: 2309630 - RNA, 14 nt, Yersinia pestis KIM
ggucaucaaggugc

SEQ ID NO: 2309631 - RNA, 17 nt, Yersinia pestis KIM
ggucaugaaaucagaga

SEQ ID NO: 2309632 - RNA, 14 nt, Yersinia pestis KIM
ggucaugcacaguu

SEQ ID NO: 2309633 - RNA, 16 nt, Yersinia pestis KIM
gguaccguugagaaca

SEQ ID NO: 2309634 - RNA, 15 nt, Yersinia pestis KIM
gguacggccagcaau

SEQ ID NO: 2309635 - RNA, 18 nt, Yersinia pestis KIM
gguacccauuauucuuua

SEQ ID NO: 2309636 - RNA, 20 nt, Yersinia pestis KIM
gguacaauucgcaagaagcg

SEQ ID NO: 2309637 - RNA, 18 nt, Yersinia pestis KIM
gguacuuaacuggccaau

SEQ ID NO: 2309638 - RNA, 16 nt, Yersinia pestis KIM
gguagaccaccaacuc

SEQ ID NO: 2309639 - RNA, 19 nt, Yersinia pestis KIM
gguagaucaaacauaaccu

SEQ ID NO: 2309640 - RNA, 11 nt, Yersinia pestis KIM
gguaucaguca

SEQ ID NO: 2309641 - RNA, 17 nt, Yersinia pestis KIM
gguauagagugcaucca

SEQ ID NO: 2309642 - RNA, 21 nt, Yersinia pestis KIM
gguauagcuaucacgacuacc

SEQ ID NO: 2309643 - RNA, 13 nt, Yersinia pestis KIM
gguauaugacugu

SEQ ID NO: 2309644 - RNA, 19 nt, Yersinia pestis KIM
gguagguuucugggcuggc

SEQ ID NO: 2309645 - RNA, 21 nt, Yersinia pestis KIM
gguagucauauucaggcuggg

SEQ ID NO: 2309646 - RNA, 18 nt, Yersinia pestis KIM
gguaucuaggugcaguaa

SEQ ID NO: 2309647 - RNA, 20 nt, Yersinia pestis KIM
gguauuugaacuucaaaucg

SEQ ID NO: 2309648 - RNA, 16 nt, Yersinia pestis KIM
gguauuuaggcgcuga

SEQ ID NO: 2309649 - RNA, 22 nt, Yersinia pestis KIM
gguauuccauagccaggcagcc

SEQ ID NO: 2309650 - RNA, 17 nt, Yersinia pestis KIM
gguauuccgagcaauca

SEQ ID NO: 2309651 - RNA, 19 nt, Yersinia pestis KIM
gguauucagccgccagcca

SEQ ID NO: 2309652 - RNA, 16 nt, Yersinia pestis KIM
gguauuuuacugauga

SEQ ID NO: 2309653 - RNA, 22 nt, Yersinia pestis KIM
ggucaaaaacacagguucucca

SEQ ID NO: 2309654 - RNA, 16 nt, Yersinia pestis KIM
gguaaucccgaaucaa

SEQ ID NO: 2309655 - RNA, 21 nt, Yersinia pestis KIM
gguaaucccgauauaaauaaa

SEQ ID NO: 2309656 - RNA, 17 nt, Yersinia pestis KIM
gguaaucagacugcuga

SEQ ID NO: 2309657 - RNA, 17 nt, Yersinia pestis KIM
gguaaucaauuuuugcg

SEQ ID NO: 2309658 - RNA, 15 nt, Yersinia pestis KIM
gguaaucacauaacu

SEQ ID NO: 2309659 - RNA, 12 nt, Yersinia pestis KIM
gguaauaaauca

SEQ ID NO: 2309660 - RNA, 20 nt, Yersinia pestis KIM
gguaauaaugaacaaauauc

SEQ ID NO: 2309661 - RNA, 16 nt, Yersinia pestis KIM
gguaauaaugcucggc

SEQ ID NO: 2309662 - RNA, 22 nt, Yersinia pestis KIM
gguaaguccaucagccuaaauu

SEQ ID NO: 2309663 - RNA, 18 nt, Yersinia pestis KIM
gguaaguaauugaagugg

SEQ ID NO: 2309664 - RNA, 22 nt, Yersinia pestis KIM
gguaaggccgcgauaaaaaaua

SEQ ID NO: 2309665 - RNA, 15 nt, Yersinia pestis KIM
gguaagaauaaauaa

SEQ ID NO: 2309666 - RNA, 12 nt, Yersinia pestis KIM
gguaagaaagag

SEQ ID NO: 2309667 - RNA, 16 nt, Yersinia pestis KIM
gguaagaauaggcagg

SEQ ID NO: 2309668 - RNA, 17 nt, Yersinia pestis KIM
gguaagaauaggcaggg

SEQ ID NO: 2309669 - RNA, 14 nt, Yersinia pestis KIM
gguaaaauccccau

SEQ ID NO: 2309670 - RNA, 20 nt, Yersinia pestis KIM
gguaaaaggcccgcuaguga

SEQ ID NO: 2309671 - RNA, 13 nt, Yersinia pestis KIM
gguaacauauaaa

SEQ ID NO: 2309672 - RNA, 17 nt, Yersinia pestis KIM
gguaaccaaucacauca

SEQ ID NO: 2309673 - RNA, 21 nt, Yersinia pestis KIM
gguaaccugaaagucaggauu

SEQ ID NO: 2309674 - RNA, 22 nt, Yersinia pestis KIM
gguaacgccgcuguagcgccaa

SEQ ID NO: 2309675 - RNA, 20 nt, Yersinia pestis KIM
gguaaauuuacgcuucgcug

SEQ ID NO: 2309676 - RNA, 24 nt, Yersinia pestis KIM
ggguggccgccgcggugaagaaca

SEQ ID NO: 2309677 - RNA, 16 nt, Yersinia pestis KIM
gggugagugagcgcgg

SEQ ID NO: 2309678 - RNA, 17 nt, Yersinia pestis KIM
gggugagugagcgcagg

SEQ ID NO: 2309679 - RNA, 13 nt, Yersinia pestis KIM
gggugagugaacg

SEQ ID NO: 2309680 - RNA, 22 nt, Yersinia pestis KIM
gggugagugaacguagcuaaca

SEQ ID NO: 2309681 - RNA, 17 nt, Yersinia pestis KIM
gggugccauagcaaucc

SEQ ID NO: 2309682 - RNA, 17 nt, Yersinia pestis KIM
ggguucaucaacugaca

SEQ ID NO: 2309683 - RNA, 11 nt, Yersinia pestis KIM
ggguucaucau

SEQ ID NO: 2309684 - RNA, 19 nt, Yersinia pestis KIM
ggguucuaaauccugcaaa

SEQ ID NO: 2309685 - RNA, 19 nt, Yersinia pestis KIM
ggguugcccaucagcauca

SEQ ID NO: 2309686 - RNA, 12 nt, Yersinia pestis KIM
ggguuaaauagu

SEQ ID NO: 2309687 - RNA, 20 nt, Yersinia pestis KIM
gggugguuagcagauaauaa

SEQ ID NO: 2309688 - RNA, 17 nt, Yersinia pestis KIM
ggggguugucagcaguc

SEQ ID NO: 2309689 - RNA, 14 nt, Yersinia pestis KIM
gggguaagauccac

SEQ ID NO: 2309690 - RNA, 12 nt, Yersinia pestis KIM
ggguauccagug

SEQ ID NO: 2309691 - RNA, 21 nt, Yersinia pestis KIM
ggguaucaguguauuuaucaa

SEQ ID NO: 2309692 - RNA, 23 nt, Yersinia pestis KIM
ggguaacgccgcuaaaucaucaa

SEQ ID NO: 2309693 - RNA, 17 nt, Yersinia pestis KIM
ggguaauccccaccaac

SEQ ID NO: 2309694 - RNA, 23 nt, Yersinia pestis KIM
gggguuuaggccuauaaccccca

SEQ ID NO: 2309695 - RNA, 13 nt, Yersinia pestis KIM
ggguaaaaucccc

SEQ ID NO: 2309696 - RNA, 13 nt, Yersinia pestis KIM
gggucgugcggga

SEQ ID NO: 2309697 - RNA, 11 nt, Yersinia pestis KIM
ggguaucugug

SEQ ID NO: 2309698 - RNA, 20 nt, Yersinia pestis KIM
ggguauguaaugccacacuc

SEQ ID NO: 2309699 - RNA, 22 nt, Yersinia pestis KIM
ggguauuugucgucccaggccu

SEQ ID NO: 2309700 - RNA, 22 nt, Yersinia pestis KIM
ggggcaggagucugaaaccccu

SEQ ID NO: 2309701 - RNA, 17 nt, Yersinia pestis KIM
ggggccaucaucuucaa

SEQ ID NO: 2309702 - RNA, 12 nt, Yersinia pestis KIM
gggggcgacgau

SEQ ID NO: 2309703 - RNA, 12 nt, Yersinia pestis KIM
ggggcgguuggg

SEQ ID NO: 2309704 - RNA, 21 nt, Yersinia pestis KIM
gggcuugcauaucagcaauga

SEQ ID NO: 2309705 - RNA, 21 nt, Yersinia pestis KIM
gggcuuuaauacaauagagaa

SEQ ID NO: 2309706 - RNA, 16 nt, Yersinia pestis KIM
gggcuucggucaggug

SEQ ID NO: 2309707 - RNA, 15 nt, Yersinia pestis KIM
gggcuuccaauauug

SEQ ID NO: 2309708 - RNA, 13 nt, Yersinia pestis KIM
gggcuuuugcugu

SEQ ID NO: 2309709 - RNA, 20 nt, Yersinia pestis KIM
gggcugcgcccuucgccggu

SEQ ID NO: 2309710 - RNA, 12 nt, Yersinia pestis KIM
ggggaccagcac

SEQ ID NO: 2309711 - RNA, 19 nt, Yersinia pestis KIM
ggggcacaauucugaaagu

SEQ ID NO: 2309712 - RNA, 14 nt, Yersinia pestis KIM
ggggauggccgggc

SEQ ID NO: 2309713 - RNA, 22 nt, Yersinia pestis KIM
gggccuuaaaaaacgauuagcu

SEQ ID NO: 2309714 - RNA, 13 nt, Yersinia pestis KIM
gggccgugcggga

SEQ ID NO: 2309715 - RNA, 19 nt, Yersinia pestis KIM
gggccaauccaauaggaua

SEQ ID NO: 2309716 - RNA, 16 nt, Yersinia pestis KIM
gggcauuuaauucagu

SEQ ID NO: 2309717 - RNA, 23 nt, Yersinia pestis KIM
gggcauucauuucuuuggcugag

SEQ ID NO: 2309718 - RNA, 18 nt, Yersinia pestis KIM
gggcaucgaaaagcgccu

SEQ ID NO: 2309719 - RNA, 13 nt, Yersinia pestis KIM
gggcgcagccccc

SEQ ID NO: 2309720 - RNA, 20 nt, Yersinia pestis KIM
gggcgcugagguucuccaac

SEQ ID NO: 2309721 - RNA, 20 nt, Yersinia pestis KIM
gggcgauggggaguauucgu

SEQ ID NO: 2309722 - RNA, 16 nt, Yersinia pestis KIM
gggcgaugugcuccgc

SEQ ID NO: 2309723 - RNA, 18 nt, Yersinia pestis KIM
gggcgauagcccuacugg

SEQ ID NO: 2309724 - RNA, 17 nt, Yersinia pestis KIM
gggcugacagagcgggu

SEQ ID NO: 2309725 - RNA, 20 nt, Yersinia pestis KIM
gggcugaguaaagcccagca

SEQ ID NO: 2309726 - RNA, 21 nt, Yersinia pestis KIM
gggcugaguaaagcccagcag

SEQ ID NO: 2309727 - RNA, 11 nt, Yersinia pestis KIM
gggcugaucau

SEQ ID NO: 2309728 - RNA, 19 nt, Yersinia pestis KIM
gggcguuuaccauccagug

SEQ ID NO: 2309729 - RNA, 22 nt, Yersinia pestis KIM
gggcuaucaucaaaggcaauac

SEQ ID NO: 2309730 - RNA, 23 nt, Yersinia pestis KIM
gggcuauuuauuuagagcguccu

SEQ ID NO: 2309731 - RNA, 16 nt, Yersinia pestis KIM
gggcgguaguauuugu

SEQ ID NO: 2309732 - RNA, 20 nt, Yersinia pestis KIM
gggcgguaguauuuguagug

SEQ ID NO: 2309733 - RNA, 14 nt, Yersinia pestis KIM
gggcaggagucuga

SEQ ID NO: 2309734 - RNA, 12 nt, Yersinia pestis KIM
gggcacuuucau

SEQ ID NO: 2309735 - RNA, 12 nt, Yersinia pestis KIM
gggcagaaaaua

SEQ ID NO: 2309736 - RNA, 19 nt, Yersinia pestis KIM
gggaucuccagaagcauau

SEQ ID NO: 2309737 - RNA, 20 nt, Yersinia pestis KIM
gggaucuccggacaggcuug

SEQ ID NO: 2309738 - RNA, 10 nt, Yersinia pestis KIM
gggauggaaa

SEQ ID NO: 2309739 - RNA, 14 nt, Yersinia pestis KIM
gggauucgaaccug

SEQ ID NO: 2309740 - RNA, 17 nt, Yersinia pestis KIM
gggaucaccucuucagg

SEQ ID NO: 2309741 - RNA, 13 nt, Yersinia pestis KIM
gggaucaacaugg

SEQ ID NO: 2309742 - RNA, 12 nt, Yersinia pestis KIM
gggauaucucac

SEQ ID NO: 2309743 - RNA, 15 nt, Yersinia pestis KIM
gggaucaccucuuca

SEQ ID NO: 2309744 - RNA, 21 nt, Yersinia pestis KIM
gggaguauacggucaaaagcu

SEQ ID NO: 2309745 - RNA, 15 nt, Yersinia pestis KIM
gggauaaaccagugu

SEQ ID NO: 2309746 - RNA, 15 nt, Yersinia pestis KIM
gggaaacaguaaauu

SEQ ID NO: 2309747 - RNA, 21 nt, Yersinia pestis KIM
gggaaaucaaagacuaaccuc

SEQ ID NO: 2309748 - RNA, 21 nt, Yersinia pestis KIM
gggaaccccucugcagcguca

SEQ ID NO: 2309749 - RNA, 19 nt, Yersinia pestis KIM
gggaaccccuucaggccau

SEQ ID NO: 2309750 - RNA, 14 nt, Yersinia pestis KIM
ggcuuuuggggcgc

SEQ ID NO: 2309751 - RNA, 20 nt, Yersinia pestis KIM
ggcuuuuguuaauucaccua

SEQ ID NO: 2309752 - RNA, 16 nt, Yersinia pestis KIM
ggcuuuuuuaauaaaa

SEQ ID NO: 2309753 - RNA, 19 nt, Yersinia pestis KIM
ggcuuuaagauccaguuca

SEQ ID NO: 2309754 - RNA, 17 nt, Yersinia pestis KIM
ggcuuuaagauccaguu

SEQ ID NO: 2309755 - RNA, 19 nt, Yersinia pestis KIM
ggcuuuaccuuacguaaac

SEQ ID NO: 2309756 - RNA, 20 nt, Yersinia pestis KIM
ggcuuuacggcucaccuggc

SEQ ID NO: 2309757 - RNA, 16 nt, Yersinia pestis KIM
ggcuuucaauaaaacu

SEQ ID NO: 2309758 - RNA, 17 nt, Yersinia pestis KIM
ggcuuucaggugacuga

SEQ ID NO: 2309759 - RNA, 12 nt, Yersinia pestis KIM
gggaaugcaccc

SEQ ID NO: 2309760 - RNA, 11 nt, Yersinia pestis KIM
gggaauucuuu

SEQ ID NO: 2309761 - RNA, 18 nt, Yersinia pestis KIM
gggaauucuuuggcaaau

SEQ ID NO: 2309762 - RNA, 15 nt, Yersinia pestis KIM
gggagccgcccugca

SEQ ID NO: 2309763 - RNA, 13 nt, Yersinia pestis KIM
ggcugauagaaag

SEQ ID NO: 2309764 - RNA, 16 nt, Yersinia pestis KIM
ggcugaggccagcggc

SEQ ID NO: 2309765 - RNA, 17 nt, Yersinia pestis KIM
ggcugauguucugccaa

SEQ ID NO: 2309766 - RNA, 19 nt, Yersinia pestis KIM
ggcugauucacuggcaaaa

SEQ ID NO: 2309767 - RNA, 21 nt, Yersinia pestis KIM
ggcugacggugccagauagac

SEQ ID NO: 2309768 - RNA, 13 nt, Yersinia pestis KIM
ggcugccugccug

SEQ ID NO: 2309769 - RNA, 22 nt, Yersinia pestis KIM
ggcugcgccauaugccaugaug

SEQ ID NO: 2309770 - RNA, 15 nt, Yersinia pestis KIM
ggcgucaagguaccc

SEQ ID NO: 2309771 - RNA, 15 nt, Yersinia pestis KIM
ggcucaucaaaggag

SEQ ID NO: 2309772 - RNA, 13 nt, Yersinia pestis KIM
ggcucgagccgcg

SEQ ID NO: 2309773 - RNA, 12 nt, Yersinia pestis KIM
ggcucgaaccug

SEQ ID NO: 2309774 - RNA, 14 nt, Yersinia pestis KIM
ggcucgaagcgcgc

SEQ ID NO: 2309775 - RNA, 14 nt, Yersinia pestis KIM
ggcucuggagcucu

SEQ ID NO: 2309776 - RNA, 17 nt, Yersinia pestis KIM
ggcucucuucagcgcuu

SEQ ID NO: 2309777 - RNA, 23 nt, Yersinia pestis KIM
ggcucugcgaccaaggcucuggc

SEQ ID NO: 2309778 - RNA, 12 nt, Yersinia pestis KIM
ggcucugauucu

SEQ ID NO: 2309779 - RNA, 18 nt, Yersinia pestis KIM
ggcuggaaaaaauaaugg

SEQ ID NO: 2309780 - RNA, 22 nt, Yersinia pestis KIM
ggcuggaaaaaauaauggccaa

SEQ ID NO: 2309781 - RNA, 14 nt, Yersinia pestis KIM
ggcuguaaauaaau

SEQ ID NO: 2309782 - RNA, 16 nt, Yersinia pestis KIM
ggcuguaaauaaauaa

SEQ ID NO: 2309783 - RNA, 20 nt, Yersinia pestis KIM
ggcugucggcgaugaaaaac

SEQ ID NO: 2309784 - RNA, 21 nt, Yersinia pestis KIM
ggcugucggcgaugaaaaaca

SEQ ID NO: 2309785 - RNA, 20 nt, Yersinia pestis KIM
ggcuggggguucaguaaagc

SEQ ID NO: 2309786 - RNA, 17 nt, Yersinia pestis KIM
ggcuugcaaucagaggc

SEQ ID NO: 2309787 - RNA, 15 nt, Yersinia pestis KIM
ggcuucuuaauuccc

SEQ ID NO: 2309788 - RNA, 19 nt, Yersinia pestis KIM
ggcuugaaguucucaucaa

SEQ ID NO: 2309789 - RNA, 18 nt, Yersinia pestis KIM
ggcuucuccugcgguggc

SEQ ID NO: 2309790 - RNA, 22 nt, Yersinia pestis KIM
ggcuugcaaucagaggccauca

SEQ ID NO: 2309791 - RNA, 15 nt, Yersinia pestis KIM
ggcuugguuguuucu

SEQ ID NO: 2309792 - RNA, 15 nt, Yersinia pestis KIM
ggcuuagucauuaag

SEQ ID NO: 2309793 - RNA, 17 nt, Yersinia pestis KIM
ggcuuagucauuaagaa

SEQ ID NO: 2309794 - RNA, 12 nt, Yersinia pestis KIM
ggcuuagccacu

SEQ ID NO: 2309795 - RNA, 14 nt, Yersinia pestis KIM
ggcuguugacauaa

SEQ ID NO: 2309796 - RNA, 22 nt, Yersinia pestis KIM
ggcuguucuuggaacaggccaa

SEQ ID NO: 2309797 - RNA, 20 nt, Yersinia pestis KIM
ggcuucacccuggcucuggc

SEQ ID NO: 2309798 - RNA, 19 nt, Yersinia pestis KIM
ggcuucccuguauaaaaau

SEQ ID NO: 2309799 - RNA, 21 nt, Yersinia pestis KIM
ggcuucccuguauaaaaauag

SEQ ID NO: 2309800 - RNA, 15 nt, Yersinia pestis KIM
ggcuucgcuguagga

SEQ ID NO: 2309801 - RNA, 14 nt, Yersinia pestis KIM
ggcggcagcacaga

SEQ ID NO: 2309802 - RNA, 19 nt, Yersinia pestis KIM
ggcggccagcaagagcagc

SEQ ID NO: 2309803 - RNA, 13 nt, Yersinia pestis KIM
ggcggccucugcu

SEQ ID NO: 2309804 - RNA, 19 nt, Yersinia pestis KIM
ggcgguaguauuuguagug

SEQ ID NO: 2309805 - RNA, 20 nt, Yersinia pestis KIM
ggcgguaguauuuguaguga

SEQ ID NO: 2309806 - RNA, 24 nt, Yersinia pestis KIM
aaauacggcgaaauauaaaacagu

SEQ ID NO: 2309807 - RNA, 23 nt, Yersinia pestis KIM
aaauacggccagucaaaagaaac

SEQ ID NO: 2309808 - RNA, 13 nt, Yersinia pestis KIM
aaauaccgcugcu

SEQ ID NO: 2309809 - RNA, 14 nt, Yersinia pestis KIM
aaauaccgcuugcc

SEQ ID NO: 2309810 - RNA, 22 nt, Yersinia pestis KIM
aaauacgaucaacucaacuuua

SEQ ID NO: 2309811 - RNA, 17 nt, Yersinia pestis KIM
aaauaccuucagacuga

SEQ ID NO: 2309812 - RNA, 15 nt, Yersinia pestis KIM
ggcggaagacuucca

SEQ ID NO: 2309813 - RNA, 19 nt, Yersinia pestis KIM
aaauagaaaacagcaauau

SEQ ID NO: 2309814 - RNA, 21 nt, Yersinia pestis KIM
aaauacauaauaaugaugaac

SEQ ID NO: 2309815 - RNA, 22 nt, Yersinia pestis KIM
aaauacccagcuucuuuuaaag

SEQ ID NO: 2309816 - RNA, 18 nt, Yersinia pestis KIM
aaauacccagcuucuuuu

SEQ ID NO: 2309817 - RNA, 16 nt, Yersinia pestis KIM
aaauaccaauuaauaa

SEQ ID NO: 2309818 - RNA, 21 nt, Yersinia pestis KIM
ggcgcacauuacaagugccaa

SEQ ID NO: 2309819 - RNA, 17 nt, Yersinia pestis KIM
ggcgauugaacaugaug

SEQ ID NO: 2309820 - RNA, 12 nt, Yersinia pestis KIM
ggcgauuucagc

SEQ ID NO: 2309821 - RNA, 22 nt, Yersinia pestis KIM
aaauaaugucgucaauuaaaau

SEQ ID NO: 2309822 - RNA, 16 nt, Yersinia pestis KIM
aaauaauuacuuauaa

SEQ ID NO: 2309823 - RNA, 12 nt, Yersinia pestis KIM
aaauacaaaaau

SEQ ID NO: 2309824 - RNA, 15 nt, Yersinia pestis KIM
aaauacaaaaauaca

SEQ ID NO: 2309825 - RNA, 20 nt, Yersinia pestis KIM
aaauacaaauaaaauaaauc

SEQ ID NO: 2309826 - RNA, 12 nt, Yersinia pestis KIM
ggcgauauauuu

SEQ ID NO: 2309827 - RNA, 12 nt, Yersinia pestis KIM
aaauaagccagu

SEQ ID NO: 2309828 - RNA, 14 nt, Yersinia pestis KIM
aaauaagccagugc

SEQ ID NO: 2309829 - RNA, 16 nt, Yersinia pestis KIM
aaauaagaauaagggu

SEQ ID NO: 2309830 - RNA, 13 nt, Yersinia pestis KIM
aaauaauaucaau

SEQ ID NO: 2309831 - RNA, 22 nt, Yersinia pestis KIM
aaauaauaucaagucuugaaga

SEQ ID NO: 2309832 - RNA, 22 nt, Yersinia pestis KIM
aaauaauauaauucaauauaua

SEQ ID NO: 2309833 - RNA, 16 nt, Yersinia pestis KIM
aaauaauggccaagcg

SEQ ID NO: 2309834 - RNA, 14 nt, Yersinia pestis KIM
aaauaauggccaag

SEQ ID NO: 2309835 - RNA, 22 nt, Yersinia pestis KIM
aaauaauuaaaccucagaaaaa

SEQ ID NO: 2309836 - RNA, 23 nt, Yersinia pestis KIM
aaauaaucauaucaaaauaaaaa

SEQ ID NO: 2309837 - RNA, 23 nt, Yersinia pestis KIM
aaauaauccauagauuauuuuua

SEQ ID NO: 2309838 - RNA, 20 nt, Yersinia pestis KIM
aaauaaucauaucaaaauaa

SEQ ID NO: 2309839 - RNA, 18 nt, Yersinia pestis KIM
aaauaaucagcucauuaa

SEQ ID NO: 2309840 - RNA, 20 nt, Yersinia pestis KIM
aaauaaucagcucauuaaac

SEQ ID NO: 2309841 - RNA, 21 nt, Yersinia pestis KIM
ggcgacaaucaauggccagcg

SEQ ID NO: 2309842 - RNA, 16 nt, Yersinia pestis KIM
ggcgaacagaaaucaa

SEQ ID NO: 2309843 - RNA, 23 nt, Yersinia pestis KIM
ggcgaaauugacuuuaaaaaaau

SEQ ID NO: 2309844 - RNA, 13 nt, Yersinia pestis KIM
ggcgaaaggcgca

SEQ ID NO: 2309845 - RNA, 18 nt, Yersinia pestis KIM
ggccuuucggcaaauuaa

SEQ ID NO: 2309846 - RNA, 15 nt, Yersinia pestis KIM
ggccgacucugcaug

SEQ ID NO: 2309847 - RNA, 11 nt, Yersinia pestis KIM
ggcgagcacug

SEQ ID NO: 2309848 - RNA, 12 nt, Yersinia pestis KIM
aaauaaauuuaa

SEQ ID NO: 2309849 - RNA, 17 nt, Yersinia pestis KIM
aaauaaccgccaaaaua

SEQ ID NO: 2309850 - RNA, 22 nt, Yersinia pestis KIM
aaauaacccgccuagcaucaua

SEQ ID NO: 2309851 - RNA, 13 nt, Yersinia pestis KIM
aaauaaccaacac

SEQ ID NO: 2309852 - RNA, 14 nt, Yersinia pestis KIM
aaauaaccgagcgu

SEQ ID NO: 2309853 - RNA, 18 nt, Yersinia pestis KIM
gcgcaccgaaauagucgc

SEQ ID NO: 2309854 - RNA, 16 nt, Yersinia pestis KIM
gcgcaaccuggccaau

SEQ ID NO: 2309855 - RNA, 20 nt, Yersinia pestis KIM
gcgaugaggcucuucugggc

SEQ ID NO: 2309856 - RNA, 16 nt, Yersinia pestis KIM
gcgauuaaaauaaagc

SEQ ID NO: 2309857 - RNA, 13 nt, Yersinia pestis KIM
gcgauuaaaauaa

SEQ ID NO: 2309858 - RNA, 19 nt, Yersinia pestis KIM
gcgauuaaggguuaaccag

SEQ ID NO: 2309859 - RNA, 17 nt, Yersinia pestis KIM
gcgauugugcagagugu

SEQ ID NO: 2309860 - RNA, 16 nt, Yersinia pestis KIM
gcgcaaaauuaagaca

SEQ ID NO: 2309861 - RNA, 17 nt, Yersinia pestis KIM
gcgaagcguaaauuuac

SEQ ID NO: 2309862 - RNA, 17 nt, Yersinia pestis KIM
gcgacggagagaacagg

SEQ ID NO: 2309863 - RNA, 12 nt, Yersinia pestis KIM
gcgacucauccg

SEQ ID NO: 2309864 - RNA, 13 nt, Yersinia pestis KIM
gcgacuccuggca

SEQ ID NO: 2309865 - RNA, 22 nt, Yersinia pestis KIM
gcgagcagugauuucuuacagu

SEQ ID NO: 2309866 - RNA, 13 nt, Yersinia pestis KIM
gcgagcaugacac

SEQ ID NO: 2309867 - RNA, 23 nt, Yersinia pestis KIM
gcgauaaaagauuuccuuucgca

SEQ ID NO: 2309868 - RNA, 18 nt, Yersinia pestis KIM
gcgauaaacacccaagaa

SEQ ID NO: 2309869 - RNA, 15 nt, Yersinia pestis KIM
gcgaugaaaaacaga

SEQ ID NO: 2309870 - RNA, 20 nt, Yersinia pestis KIM
gcgaugaaaaacagauauac

SEQ ID NO: 2309871 - RNA, 12 nt, Yersinia pestis KIM
gcgaugacugag

SEQ ID NO: 2309872 - RNA, 20 nt, Yersinia pestis KIM
gcgaucuauucucuguaaug

SEQ ID NO: 2309873 - RNA, 14 nt, Yersinia pestis KIM
gcgaucacaauaca

SEQ ID NO: 2309874 - RNA, 18 nt, Yersinia pestis KIM
gcgauauucugauggugu

SEQ ID NO: 2309875 - RNA, 23 nt, Yersinia pestis KIM
gcgcagugcucgggugccucacg

SEQ ID NO: 2309876 - RNA, 15 nt, Yersinia pestis KIM
gcgcagguucaucag

SEQ ID NO: 2309877 - RNA, 19 nt, Yersinia pestis KIM
gcgcaguaacuguguuuga

SEQ ID NO: 2309878 - RNA, 20 nt, Yersinia pestis KIM
gcgcagguaaugucacugcc

SEQ ID NO: 2309879 - RNA, 16 nt, Yersinia pestis KIM
gcgcacucauccucug

SEQ ID NO: 2309880 - RNA, 20 nt, Yersinia pestis KIM
gcgcacguaccacggcggga

SEQ ID NO: 2309881 - RNA, 15 nt, Yersinia pestis KIM
gcgcacugucugagc

SEQ ID NO: 2309882 - RNA, 13 nt, Yersinia pestis KIM
gcgcagccacaug

SEQ ID NO: 2309883 - RNA, 21 nt, Yersinia pestis KIM
gcgcagaguccucucaccaag

SEQ ID NO: 2309884 - RNA, 18 nt, Yersinia pestis KIM
gcgcagauuauggguggu

SEQ ID NO: 2309885 - RNA, 11 nt, Yersinia pestis KIM
gcgccagcagc

SEQ ID NO: 2309886 - RNA, 21 nt, Yersinia pestis KIM
gcgccagcaauuggccuucca

SEQ ID NO: 2309887 - RNA, 23 nt, Yersinia pestis KIM
gcgccagcggaauaugacgauga

SEQ ID NO: 2309888 - RNA, 15 nt, Yersinia pestis KIM
gcgccagacuggccg

SEQ ID NO: 2309889 - RNA, 16 nt, Yersinia pestis KIM
gcgccacgcuccacac

SEQ ID NO: 2309890 - RNA, 22 nt, Yersinia pestis KIM
gcgcauauaggcgaaaggcgca

SEQ ID NO: 2309891 - RNA, 20 nt, Yersinia pestis KIM
gcgcaucugcugcacuuaac

SEQ ID NO: 2309892 - RNA, 15 nt, Yersinia pestis KIM
gcgccaaucgccacc

SEQ ID NO: 2309893 - RNA, 22 nt, Yersinia pestis KIM
gccgugagcaaucuggcggccg

SEQ ID NO: 2309894 - RNA, 14 nt, Yersinia pestis KIM
gccgugacuacggu

SEQ ID NO: 2309895 - RNA, 20 nt, Yersinia pestis KIM
gccguuacccccgacgacuu

SEQ ID NO: 2309896 - RNA, 16 nt, Yersinia pestis KIM
gccuaauguacuacca

SEQ ID NO: 2309897 - RNA, 23 nt, Yersinia pestis KIM
gccuaauuucgguagcucggccc

SEQ ID NO: 2309898 - RNA, 23 nt, Yersinia pestis KIM
gccuaauuugguacgacgccaga

SEQ ID NO: 2309899 - RNA, 15 nt, Yersinia pestis KIM
gccuagcaucauaaa

SEQ ID NO: 2309900 - RNA, 21 nt, Yersinia pestis KIM
gccgcuuucaucgauugcugg

SEQ ID NO: 2309901 - RNA, 18 nt, Yersinia pestis KIM
gccguaucuuguaguaac

SEQ ID NO: 2309902 - RNA, 14 nt, Yersinia pestis KIM
gccuccaguugagu

SEQ ID NO: 2309903 - RNA, 14 nt, Yersinia pestis KIM
gccuauccucauga

SEQ ID NO: 2309904 - RNA, 15 nt, Yersinia pestis KIM
gccuauccucaugau

SEQ ID NO: 2309905 - RNA, 17 nt, Yersinia pestis KIM
gccuaucugaaugaauu

SEQ ID NO: 2309906 - RNA, 22 nt, Yersinia pestis KIM
gccuaguuaaacucaccgagca

SEQ ID NO: 2309907 - RNA, 19 nt, Yersinia pestis KIM
gccucaugaaugaggcuga

SEQ ID NO: 2309908 - RNA, 20 nt, Yersinia pestis KIM
gccucaguaucuuuccagcc

SEQ ID NO: 2309909 - RNA, 21 nt, Yersinia pestis KIM
gccucaucagaggcucauccu

SEQ ID NO: 2309910 - RNA, 13 nt, Yersinia pestis KIM
gccucgcuucugc

SEQ ID NO: 2309911 - RNA, 21 nt, Yersinia pestis KIM
gccucgcuucugcgaggccgc

SEQ ID NO: 2309912 - RNA, 15 nt, Yersinia pestis KIM
gccucuagcuaacag

SEQ ID NO: 2309913 - RNA, 17 nt, Yersinia pestis KIM
gccucgaugcucaggcc

SEQ ID NO: 2309914 - RNA, 14 nt, Yersinia pestis KIM
gccuuuauucauuc

SEQ ID NO: 2309915 - RNA, 12 nt, Yersinia pestis KIM
gccuuucugggc

SEQ ID NO: 2309916 - RNA, 15 nt, Yersinia pestis KIM
gccuucacugguuuu

SEQ ID NO: 2309917 - RNA, 14 nt, Yersinia pestis KIM
gcgaaaggaacaaa

SEQ ID NO: 2309918 - RNA, 13 nt, Yersinia pestis KIM
gcgaaauugacuu

SEQ ID NO: 2309919 - RNA, 11 nt, Yersinia pestis KIM
gcgaacagcag

SEQ ID NO: 2309920 - RNA, 22 nt, Yersinia pestis KIM
gccuggcgcauaguuucaauau

SEQ ID NO: 2309921 - RNA, 21 nt, Yersinia pestis KIM
gccuggcgcauaguuucaaua

SEQ ID NO: 2309922 - RNA, 16 nt, Yersinia pestis KIM
gccuggcuugaccuug

SEQ ID NO: 2309923 - RNA, 22 nt, Yersinia pestis KIM
gccuuaacccgcgggagucagu

SEQ ID NO: 2309924 - RNA, 23 nt, Yersinia pestis KIM
gccuuaacugcauagcuaaccuu

SEQ ID NO: 2309925 - RNA, 20 nt, Yersinia pestis KIM
gccuguuuacguaaauagau

SEQ ID NO: 2309926 - RNA, 16 nt, Yersinia pestis KIM
gccuuauugaccgugu

SEQ ID NO: 2309927 - RNA, 22 nt, Yersinia pestis KIM
gccuguucucuccgccgcaggc

SEQ ID NO: 2309928 - RNA, 13 nt, Yersinia pestis KIM
gccugcuggcaaa

SEQ ID NO: 2309929 - RNA, 13 nt, Yersinia pestis KIM
gccugcggcggcu

SEQ ID NO: 2309930 - RNA, 17 nt, Yersinia pestis KIM
gccugcuguucuggcag

SEQ ID NO: 2309931 - RNA, 18 nt, Yersinia pestis KIM
gccucuggccucgcccuu

SEQ ID NO: 2309932 - RNA, 13 nt, Yersinia pestis KIM
gccucucagacug

SEQ ID NO: 2309933 - RNA, 17 nt, Yersinia pestis KIM
gccucucagacugcuga

SEQ ID NO: 2309934 - RNA, 16 nt, Yersinia pestis KIM
gccucuggugccaacg

SEQ ID NO: 2309935 - RNA, 16 nt, Yersinia pestis KIM
gccucuguagccgcag

SEQ ID NO: 2309936 - RNA, 13 nt, Yersinia pestis KIM
gcggcaucaccaa

SEQ ID NO: 2309937 - RNA, 14 nt, Yersinia pestis KIM
gcggcaucaccaaa

SEQ ID NO: 2309938 - RNA, 18 nt, Yersinia pestis KIM
gcggccagcaagagcagc

SEQ ID NO: 2309939 - RNA, 23 nt, Yersinia pestis KIM
gcggcaagaacaccgucaguaug

SEQ ID NO: 2309940 - RNA, 20 nt, Yersinia pestis KIM
gcggcaccgccgucaaacca

SEQ ID NO: 2309941 - RNA, 15 nt, Yersinia pestis KIM
gcggauuuauaagga

SEQ ID NO: 2309942 - RNA, 14 nt, Yersinia pestis KIM
gcggcacucgcuca

SEQ ID NO: 2309943 - RNA, 23 nt, Yersinia pestis KIM
gcggcaggcaugguaagaauaaa

SEQ ID NO: 2309944 - RNA, 20 nt, Yersinia pestis KIM
gcggacgcuuuacucuucug

SEQ ID NO: 2309945 - RNA, 22 nt, Yersinia pestis KIM
gcggaauauuuaaccagagauu

SEQ ID NO: 2309946 - RNA, 17 nt, Yersinia pestis KIM
gcgcuggcguaaaauau

SEQ ID NO: 2309947 - RNA, 15 nt, Yersinia pestis KIM
gcgcuggcuuuuuca

SEQ ID NO: 2309948 - RNA, 13 nt, Yersinia pestis KIM
gcgcuuaaauaaa

SEQ ID NO: 2309949 - RNA, 19 nt, Yersinia pestis KIM
gcggaaaugccgauaaaaa

SEQ ID NO: 2309950 - RNA, 13 nt, Yersinia pestis KIM
gcgcugcagcgau

SEQ ID NO: 2309951 - RNA, 15 nt, Yersinia pestis KIM
gcgcugcaucagcag

SEQ ID NO: 2309952 - RNA, 15 nt, Yersinia pestis KIM
gcgcugauugugccu

SEQ ID NO: 2309953 - RNA, 17 nt, Yersinia pestis KIM
gcgcugaucaucaucaa

SEQ ID NO: 2309954 - RNA, 19 nt, Yersinia pestis KIM
gcggccgaucccccgccgu

SEQ ID NO: 2309955 - RNA, 16 nt, Yersinia pestis KIM
gcggcuaaagcugcuu

SEQ ID NO: 2309956 - RNA, 17 nt, Yersinia pestis KIM
gcggcggcuaugugccg

SEQ ID NO: 2309957 - RNA, 12 nt, Yersinia pestis KIM
gcgggagucagu

SEQ ID NO: 2309958 - RNA, 22 nt, Yersinia pestis KIM
gcgggaaucuugauuagcuggc

SEQ ID NO: 2309959 - RNA, 15 nt, Yersinia pestis KIM
gcggcuuucauccca

SEQ ID NO: 2309960 - RNA, 18 nt, Yersinia pestis KIM
gcggcucucuuucuccaa

SEQ ID NO: 2309961 - RNA, 14 nt, Yersinia pestis KIM
gcgcccauccgcag

SEQ ID NO: 2309962 - RNA, 14 nt, Yersinia pestis KIM
gcgcccaguggagc

SEQ ID NO: 2309963 - RNA, 20 nt, Yersinia pestis KIM
gcgcccaagcuuggccccuu

SEQ ID NO: 2309964 - RNA, 23 nt, Yersinia pestis KIM
gcgcccaaaugccgaaggcugac

SEQ ID NO: 2309965 - RNA, 16 nt, Yersinia pestis KIM
gcgccauuaccacugu

SEQ ID NO: 2309966 - RNA, 13 nt, Yersinia pestis KIM
gcgccauaaaaga

SEQ ID NO: 2309967 - RNA, 14 nt, Yersinia pestis KIM
gcgccgacugcuga

SEQ ID NO: 2309968 - RNA, 13 nt, Yersinia pestis KIM
gcgccgacugcug

SEQ ID NO: 2309969 - RNA, 16 nt, Yersinia pestis KIM
gcgcccuucccauuua

SEQ ID NO: 2309970 - RNA, 19 nt, Yersinia pestis KIM
gcgccguaaaaagcagcaa

SEQ ID NO: 2309971 - RNA, 14 nt, Yersinia pestis KIM
gcgcgcugcugcuc

SEQ ID NO: 2309972 - RNA, 17 nt, Yersinia pestis KIM
gcgccuuccuuuuauuu

SEQ ID NO: 2309973 - RNA, 21 nt, Yersinia pestis KIM
gcgcgaaauauugcccuacgg

SEQ ID NO: 2309974 - RNA, 23 nt, Yersinia pestis KIM
gcgccuuuuauucuuuggugagc

SEQ ID NO: 2309975 - RNA, 23 nt, Yersinia pestis KIM
gcagugcaucuuccaauucauaa

SEQ ID NO: 2309976 - RNA, 16 nt, Yersinia pestis KIM
gcagugaggcaaugaa

SEQ ID NO: 2309977 - RNA, 12 nt, Yersinia pestis KIM
gcagugacugaa

SEQ ID NO: 2309978 - RNA, 12 nt, Yersinia pestis KIM
gcagucugaggc

SEQ ID NO: 2309979 - RNA, 20 nt, Yersinia pestis KIM
gcagucugagccucaugaau

SEQ ID NO: 2309980 - RNA, 15 nt, Yersinia pestis KIM
gcagucugagggcca

SEQ ID NO: 2309981 - RNA, 20 nt, Yersinia pestis KIM
gcagucugagggccacuucg

SEQ ID NO: 2309982 - RNA, 15 nt, Yersinia pestis KIM
gcagucgauaaacau

SEQ ID NO: 2309983 - RNA, 22 nt, Yersinia pestis KIM
gcagucgauaaacaucaugaca

SEQ ID NO: 2309984 - RNA, 21 nt, Yersinia pestis KIM
gcagucagcaugguagccugc

SEQ ID NO: 2309985 - RNA, 18 nt, Yersinia pestis KIM
gcaguaaguuaaaaagaa

SEQ ID NO: 2309986 - RNA, 22 nt, Yersinia pestis KIM
gcaguaaguuaaaaagaaaaag

SEQ ID NO: 2309987 - RNA, 21 nt, Yersinia pestis KIM
gcaggggaggcgguccuccug

SEQ ID NO: 2309988 - RNA, 18 nt, Yersinia pestis KIM
gcauaaacugaaguuaaa

SEQ ID NO: 2309989 - RNA, 20 nt, Yersinia pestis KIM
gcauaaacugaaguuaaaaa

SEQ ID NO: 2309990 - RNA, 13 nt, Yersinia pestis KIM
gcauaaaaauaca

SEQ ID NO: 2309991 - RNA, 20 nt, Yersinia pestis KIM
gcaguuugaguguggugagc

SEQ ID NO: 2309992 - RNA, 15 nt, Yersinia pestis KIM
gcaguggaugauaaa

SEQ ID NO: 2309993 - RNA, 20 nt, Yersinia pestis KIM
gcagugcguaaucagccgcg

SEQ ID NO: 2309994 - RNA, 12 nt, Yersinia pestis KIM
gcagugccuuau

SEQ ID NO: 2309995 - RNA, 21 nt, Yersinia pestis KIM
gcagugucagggcaauaacaa

SEQ ID NO: 2309996 - RNA, 20 nt, Yersinia pestis KIM
gcaguuaacgacgccccacu

SEQ ID NO: 2309997 - RNA, 21 nt, Yersinia pestis KIM
gcaguuagugccuaucugaau

SEQ ID NO: 2309998 - RNA, 13 nt, Yersinia pestis KIM
gcagcuuggggau

SEQ ID NO: 2309999 - RNA, 14 nt, Yersinia pestis KIM
gcaggaaacaugcu

SEQ ID NO: 2310000 - RNA, 11 nt, Yersinia pestis KIM
gcaggaagcaa

SEQ ID NO: 2310001 - RNA, 14 nt, Yersinia pestis KIM
gcaggaagcaauga

SEQ ID NO: 2310002 - RNA, 22 nt, Yersinia pestis KIM
gcaggaaguuauggaugaccaa

SEQ ID NO: 2310003 - RNA, 22 nt, Yersinia pestis KIM
gcaggaacgaaguuagacccaa

SEQ ID NO: 2310004 - RNA, 20 nt, Yersinia pestis KIM
gcaaccgagaagucggcuuu

SEQ ID NO: 2310005 - RNA, 18 nt, Yersinia pestis KIM
gcagcguaggcaacuaag

SEQ ID NO: 2310006 - RNA, 21 nt, Yersinia pestis KIM
gcagcguaggcaacuaagcug

SEQ ID NO: 2310007 - RNA, 21 nt, Yersinia pestis KIM
gcagcguagguaacuaagcug

SEQ ID NO: 2310008 - RNA, 14 nt, Yersinia pestis KIM
gcagcgucaagguc

SEQ ID NO: 2310009 - RNA, 17 nt, Yersinia pestis KIM
gcagcguauucaguaaa

SEQ ID NO: 2310010 - RNA, 17 nt, Yersinia pestis KIM
gcagcgucauggucuca

SEQ ID NO: 2310011 - RNA, 16 nt, Yersinia pestis KIM
gcagcucaaaaucuuc

SEQ ID NO: 2310012 - RNA, 16 nt, Yersinia pestis KIM
gcaggauaaagcugaa

SEQ ID NO: 2310013 - RNA, 15 nt, Yersinia pestis KIM
gcaggccuucuucaa

SEQ ID NO: 2310014 - RNA, 18 nt, Yersinia pestis KIM
gcagggccgauaaaaaac

SEQ ID NO: 2310015 - RNA, 21 nt, Yersinia pestis KIM
gcagggccgcccagauaaaga

SEQ ID NO: 2310016 - RNA, 16 nt, Yersinia pestis KIM
gcaggcugucaggaac

SEQ ID NO: 2310017 - RNA, 15 nt, Yersinia pestis KIM
gcagggcauucgccu

SEQ ID NO: 2310018 - RNA, 19 nt, Yersinia pestis KIM
gcauccaagccaucauuag

SEQ ID NO: 2310019 - RNA, 14 nt, Yersinia pestis KIM
gcauccaaccugca

SEQ ID NO: 2310020 - RNA, 18 nt, Yersinia pestis KIM
gcaucaucgcuuugcggg

SEQ ID NO: 2310021 - RNA, 22 nt, Yersinia pestis KIM
gcauccuugaucgccaaauaaa

SEQ ID NO: 2310022 - RNA, 17 nt, Yersinia pestis KIM
gcauccuugaucgccaa

SEQ ID NO: 2310023 - RNA, 20 nt, Yersinia pestis KIM
gcaucgaguccguuaaaaaa

SEQ ID NO: 2310024 - RNA, 15 nt, Yersinia pestis KIM
gcaucgacgagcggc

SEQ ID NO: 2310025 - RNA, 21 nt, Yersinia pestis KIM
gcaucugcaauggcuggcaag

SEQ ID NO: 2310026 - RNA, 16 nt, Yersinia pestis KIM
gcaucugaaagcuuca

SEQ ID NO: 2310027 - RNA, 11 nt, Yersinia pestis KIM
gcaucucugca

SEQ ID NO: 2310028 - RNA, 22 nt, Yersinia pestis KIM
gcaucauccagcucaacgaccc

SEQ ID NO: 2310029 - RNA, 13 nt, Yersinia pestis KIM
gcaucauccagcu

SEQ ID NO: 2310030 - RNA, 13 nt, Yersinia pestis KIM
gcaucaacaugga

SEQ ID NO: 2310031 - RNA, 12 nt, Yersinia pestis KIM
gcaucaacuuug

SEQ ID NO: 2310032 - RNA, 13 nt, Yersinia pestis KIM
gcauauuucucuu

SEQ ID NO: 2310033 - RNA, 17 nt, Yersinia pestis KIM
gcauauuacccaguacu

SEQ ID NO: 2310034 - RNA, 19 nt, Yersinia pestis KIM
gcauauuacccaguacugu

SEQ ID NO: 2310035 - RNA, 17 nt, Yersinia pestis KIM
gcauauuauaaugaaau

SEQ ID NO: 2310036 - RNA, 18 nt, Yersinia pestis KIM
gcauauugagcauacugu

SEQ ID NO: 2310037 - RNA, 22 nt, Yersinia pestis KIM
gcauagcuaaccuuaacuacac

SEQ ID NO: 2310038 - RNA, 15 nt, Yersinia pestis KIM
gcauaggccaauaga

SEQ ID NO: 2310039 - RNA, 18 nt, Yersinia pestis KIM
gcauaugaguuucaaaua

SEQ ID NO: 2310040 - RNA, 18 nt, Yersinia pestis KIM
gcauaucccuguuuucua

SEQ ID NO: 2310041 - RNA, 19 nt, Yersinia pestis KIM
gcauagccggagguuuuuc

SEQ ID NO: 2310042 - RNA, 16 nt, Yersinia pestis KIM
gcauggucccuacggu

SEQ ID NO: 2310043 - RNA, 23 nt, Yersinia pestis KIM
gcauuaauaccguuuucuuucaa

SEQ ID NO: 2310044 - RNA, 22 nt, Yersinia pestis KIM
gcauuaaggcgcgacugauuga

SEQ ID NO: 2310045 - RNA, 15 nt, Yersinia pestis KIM
gcaucuuccaaagga

SEQ ID NO: 2310046 - RNA, 15 nt, Yersinia pestis KIM
gcaucuuauuauuac

SEQ ID NO: 2310047 - RNA, 19 nt, Yersinia pestis KIM
gcaucuugaaggauggcgg

SEQ ID NO: 2310048 - RNA, 19 nt, Yersinia pestis KIM
gcaucuggucaucauguag

SEQ ID NO: 2310049 - RNA, 22 nt, Yersinia pestis KIM
gcaucuggccagaugauaccgc

SEQ ID NO: 2310050 - RNA, 14 nt, Yersinia pestis KIM
gcaugcccagccuc

SEQ ID NO: 2310051 - RNA, 16 nt, Yersinia pestis KIM
gcauuuaugaugcauu

SEQ ID NO: 2310052 - RNA, 15 nt, Yersinia pestis KIM
gcauuucauuaaaug

SEQ ID NO: 2310053 - RNA, 18 nt, Yersinia pestis KIM
gcauuucuuuuucaacuc

SEQ ID NO: 2310054 - RNA, 23 nt, Yersinia pestis KIM
gccaaacgugcuacuuaauaucu

SEQ ID NO: 2310055 - RNA, 12 nt, Yersinia pestis KIM
gcauuuucagua

SEQ ID NO: 2310056 - RNA, 14 nt, Yersinia pestis KIM
gcauuggauaauuu

SEQ ID NO: 2310057 - RNA, 14 nt, Yersinia pestis KIM
gcauuggcaaauca

SEQ ID NO: 2310058 - RNA, 23 nt, Yersinia pestis KIM
gcauucauaucguccaaagggag

SEQ ID NO: 2310059 - RNA, 22 nt, Yersinia pestis KIM
gcauucccugcgguuauuugcu

SEQ ID NO: 2310060 - RNA, 15 nt, Yersinia pestis KIM
gcauucauuucuuug

SEQ ID NO: 2310061 - RNA, 20 nt, Yersinia pestis KIM
gccagcgggaaucaaacucu

SEQ ID NO: 2310062 - RNA, 21 nt, Yersinia pestis KIM
gccagcguucaacuucggcag

SEQ ID NO: 2310063 - RNA, 17 nt, Yersinia pestis KIM
gccaggcaaugagugca

SEQ ID NO: 2310064 - RNA, 20 nt, Yersinia pestis KIM
gccaggcaaugagugcagcc

SEQ ID NO: 2310065 - RNA, 14 nt, Yersinia pestis KIM
gccagcugcaauug

SEQ ID NO: 2310066 - RNA, 21 nt, Yersinia pestis KIM
gccagcuuuuuaucauuuaaa

SEQ ID NO: 2310067 - RNA, 16 nt, Yersinia pestis KIM
gccaggaaauuugcac

SEQ ID NO: 2310068 - RNA, 17 nt, Yersinia pestis KIM
gccaggaaauuugcacu

SEQ ID NO: 2310069 - RNA, 18 nt, Yersinia pestis KIM
gccagcagcauaaccagu

SEQ ID NO: 2310070 - RNA, 23 nt, Yersinia pestis KIM
gccagcauucaggcuuuuuucua

SEQ ID NO: 2310071 - RNA, 21 nt, Yersinia pestis KIM
gccagccccaaucaccggcug

SEQ ID NO: 2310072 - RNA, 22 nt, Yersinia pestis KIM
gccagccccaaucaccggcugg

SEQ ID NO: 2310073 - RNA, 13 nt, Yersinia pestis KIM
gccagccauuaaa

SEQ ID NO: 2310074 - RNA, 18 nt, Yersinia pestis KIM
gccagccccaauccgccu

SEQ ID NO: 2310075 - RNA, 19 nt, Yersinia pestis KIM
gccagcgccccaucaauuu

SEQ ID NO: 2310076 - RNA, 13 nt, Yersinia pestis KIM
gccaccucacuca

SEQ ID NO: 2310077 - RNA, 15 nt, Yersinia pestis KIM
gccaccucacucagc

SEQ ID NO: 2310078 - RNA, 17 nt, Yersinia pestis KIM
gccaccucacucagcga

SEQ ID NO: 2310079 - RNA, 19 nt, Yersinia pestis KIM
gccacgccaguaaacagcc

SEQ ID NO: 2310080 - RNA, 17 nt, Yersinia pestis KIM
gccacgccaguaaacag

SEQ ID NO: 2310081 - RNA, 15 nt, Yersinia pestis KIM
gccacgaugugaagc

SEQ ID NO: 2310082 - RNA, 17 nt, Yersinia pestis KIM
gccaccagaaucaucag

SEQ ID NO: 2310083 - RNA, 14 nt, Yersinia pestis KIM
gccaccaaaaaacg

SEQ ID NO: 2310084 - RNA, 16 nt, Yersinia pestis KIM
gccacagucgccguca

SEQ ID NO: 2310085 - RNA, 13 nt, Yersinia pestis KIM
gccaaaugucacc

SEQ ID NO: 2310086 - RNA, 15 nt, Yersinia pestis KIM
gccaaaugaaaauau

SEQ ID NO: 2310087 - RNA, 20 nt, Yersinia pestis KIM
gccacacagaaucaccaaca

SEQ ID NO: 2310088 - RNA, 21 nt, Yersinia pestis KIM
gccagcaauguguugaaugac

SEQ ID NO: 2310089 - RNA, 21 nt, Yersinia pestis KIM
gccagcaauaagccacgcugu

SEQ ID NO: 2310090 - RNA, 19 nt, Yersinia pestis KIM
gccagauccucuuuauugg

SEQ ID NO: 2310091 - RNA, 11 nt, Yersinia pestis KIM
gccagauaaaa

SEQ ID NO: 2310092 - RNA, 21 nt, Yersinia pestis KIM
gccagauaacgauaacuccag

SEQ ID NO: 2310093 - RNA, 15 nt, Yersinia pestis KIM
gccagauuuaaauca

SEQ ID NO: 2310094 - RNA, 18 nt, Yersinia pestis KIM
gccagauugugcuccagc

SEQ ID NO: 2310095 - RNA, 22 nt, Yersinia pestis KIM
gccagauugugcuccagcacuu

SEQ ID NO: 2310096 - RNA, 20 nt, Yersinia pestis KIM
gccagauugccaaucagaac

SEQ ID NO: 2310097 - RNA, 13 nt, Yersinia pestis KIM
gccagcaaagaca

SEQ ID NO: 2310098 - RNA, 14 nt, Yersinia pestis KIM
gccagcaaaucaca

SEQ ID NO: 2310099 - RNA, 20 nt, Yersinia pestis KIM
gccagcaaccacgguaucaa

SEQ ID NO: 2310100 - RNA, 21 nt, Yersinia pestis KIM
gccagauucgcaaagcgggcc

SEQ ID NO: 2310101 - RNA, 16 nt, Yersinia pestis KIM
gccagauuauccagcc

SEQ ID NO: 2310102 - RNA, 14 nt, Yersinia pestis KIM
gccacgcuguguca

SEQ ID NO: 2310103 - RNA, 20 nt, Yersinia pestis KIM
gccagacccggcaaauaaau

SEQ ID NO: 2310104 - RNA, 16 nt, Yersinia pestis KIM
gccagaaucagcccca

SEQ ID NO: 2310105 - RNA, 15 nt, Yersinia pestis KIM
gccagaaucaaccac

SEQ ID NO: 2310106 - RNA, 23 nt, Yersinia pestis KIM
gccagaaucacugucaaaaagca

SEQ ID NO: 2310107 - RNA, 18 nt, Yersinia pestis KIM
gccagaauaucguggaga

SEQ ID NO: 2310108 - RNA, 15 nt, Yersinia pestis KIM
gccagagagcugaga

SEQ ID NO: 2310109 - RNA, 22 nt, Yersinia pestis KIM
gccagacgaguauuccccacug

SEQ ID NO: 2310110 - RNA, 14 nt, Yersinia pestis KIM
gccgcggcggccag

SEQ ID NO: 2310111 - RNA, 13 nt, Yersinia pestis KIM
gccgcggcuggga

SEQ ID NO: 2310112 - RNA, 17 nt, Yersinia pestis KIM
gccgcuaguuugacgcu

SEQ ID NO: 2310113 - RNA, 15 nt, Yersinia pestis KIM
gccgcuauauuuuua

SEQ ID NO: 2310114 - RNA, 14 nt, Yersinia pestis KIM
gccgcuccagcacu

SEQ ID NO: 2310115 - RNA, 15 nt, Yersinia pestis KIM
gccgcucaucaucca

SEQ ID NO: 2310116 - RNA, 17 nt, Yersinia pestis KIM
gccgcucgguagcaaaa

SEQ ID NO: 2310117 - RNA, 19 nt, Yersinia pestis KIM
gccgcuggcgauccccuuc

SEQ ID NO: 2310118 - RNA, 17 nt, Yersinia pestis KIM
gccgcgaaaaaccauga

SEQ ID NO: 2310119 - RNA, 15 nt, Yersinia pestis KIM
gccgccuuccugcua

SEQ ID NO: 2310120 - RNA, 16 nt, Yersinia pestis KIM
gccgcgauaaaaaaua

SEQ ID NO: 2310121 - RNA, 17 nt, Yersinia pestis KIM
gccgccgccagccccgc

SEQ ID NO: 2310122 - RNA, 20 nt, Yersinia pestis KIM
aaagcucugacaaaaugcca

SEQ ID NO: 2310123 - RNA, 13 nt, Yersinia pestis KIM
aaagcuauuuuuu

SEQ ID NO: 2310124 - RNA, 20 nt, Yersinia pestis KIM
aaagcugaucgcuaaaaagc

SEQ ID NO: 2310125 - RNA, 19 nt, Yersinia pestis KIM
gccgauacgcgccgcagca

SEQ ID NO: 2310126 - RNA, 18 nt, Yersinia pestis KIM
gccgagcaagugaauaac

SEQ ID NO: 2310127 - RNA, 15 nt, Yersinia pestis KIM
gccgcauucaccacc

SEQ ID NO: 2310128 - RNA, 17 nt, Yersinia pestis KIM
gccgcaugcaacagaua

SEQ ID NO: 2310129 - RNA, 14 nt, Yersinia pestis KIM
gccgcagccagcgu

SEQ ID NO: 2310130 - RNA, 18 nt, Yersinia pestis KIM
gccgcagcagugccuggu

SEQ ID NO: 2310131 - RNA, 13 nt, Yersinia pestis KIM
gccgagaacagaa

SEQ ID NO: 2310132 - RNA, 22 nt, Yersinia pestis KIM
gccgacaauaccgccacacaau

SEQ ID NO: 2310133 - RNA, 19 nt, Yersinia pestis KIM
gccgacaaaaucccccacc

SEQ ID NO: 2310134 - RNA, 13 nt, Yersinia pestis KIM
gccgacaaaaucc

SEQ ID NO: 2310135 - RNA, 14 nt, Yersinia pestis KIM
gccgaaccugcaug

SEQ ID NO: 2310136 - RNA, 19 nt, Yersinia pestis KIM
gccgaaccccuagccagcc

SEQ ID NO: 2310137 - RNA, 20 nt, Yersinia pestis KIM
gcccuugagggucgcccgga

SEQ ID NO: 2310138 - RNA, 21 nt, Yersinia pestis KIM
gcccuguaacuuuauugacug

SEQ ID NO: 2310139 - RNA, 14 nt, Yersinia pestis KIM
gcccuguaaagcca

SEQ ID NO: 2310140 - RNA, 15 nt, Yersinia pestis KIM
gcccugugaaucuuu

SEQ ID NO: 2310141 - RNA, 14 nt, Yersinia pestis KIM
gcccugccuggcag

SEQ ID NO: 2310142 - RNA, 20 nt, Yersinia pestis KIM
gcccugccugguauuuucua

SEQ ID NO: 2310143 - RNA, 23 nt, Yersinia pestis KIM
gcccugcuaauuugacgccgccg

SEQ ID NO: 2310144 - RNA, 15 nt, Yersinia pestis KIM
gcccugcucuucugg

SEQ ID NO: 2310145 - RNA, 21 nt, Yersinia pestis KIM
gcccgcuaucacuagcgggcc

SEQ ID NO: 2310146 - RNA, 22 nt, Yersinia pestis KIM
gcccgcuaucacuagcgggccu

SEQ ID NO: 2310147 - RNA, 14 nt, Yersinia pestis KIM
gcccggaagguuuc

SEQ ID NO: 2310148 - RNA, 22 nt, Yersinia pestis KIM
gcccggcugauauaacaaguua

SEQ ID NO: 2310149 - RNA, 19 nt, Yersinia pestis KIM
gcccggcauggacgagcac

SEQ ID NO: 2310150 - RNA, 13 nt, Yersinia pestis KIM
gccccuucuggug

SEQ ID NO: 2310151 - RNA, 12 nt, Yersinia pestis KIM
gccccaucagca

SEQ ID NO: 2310152 - RNA, 21 nt, Yersinia pestis KIM
gcccccaauaagggccacccu

SEQ ID NO: 2310153 - RNA, 19 nt, Yersinia pestis KIM
gcccccaauaagggccacc

SEQ ID NO: 2310154 - RNA, 22 nt, Yersinia pestis KIM
gccccaugguuacgccagcagc

SEQ ID NO: 2310155 - RNA, 18 nt, Yersinia pestis KIM
gcccccuagugauggggg

SEQ ID NO: 2310156 - RNA, 22 nt, Yersinia pestis KIM
gcccagcagugcugcgcccagu

SEQ ID NO: 2310157 - RNA, 18 nt, Yersinia pestis KIM
gcccauccgcaggaagca

SEQ ID NO: 2310158 - RNA, 11 nt, Yersinia pestis KIM
gcccaucagca

SEQ ID NO: 2310159 - RNA, 20 nt, Yersinia pestis KIM
gcccacauaaagauagccac

SEQ ID NO: 2310160 - RNA, 16 nt, Yersinia pestis KIM
gccauccuuuugacug

SEQ ID NO: 2310161 - RNA, 21 nt, Yersinia pestis KIM
gccaucgcaccaaacggaaug

SEQ ID NO: 2310162 - RNA, 14 nt, Yersinia pestis KIM
gccaucgccaacag

SEQ ID NO: 2310163 - RNA, 17 nt, Yersinia pestis KIM
gccaucgccaacaggcc

SEQ ID NO: 2310164 - RNA, 15 nt, Yersinia pestis KIM
gccaucaggcaaaag

SEQ ID NO: 2310165 - RNA, 18 nt, Yersinia pestis KIM
gccaucaggcgcuuuucu

SEQ ID NO: 2310166 - RNA, 16 nt, Yersinia pestis KIM
gccaggcucccaaggg

SEQ ID NO: 2310167 - RNA, 13 nt, Yersinia pestis KIM
gccauauccaacu

SEQ ID NO: 2310168 - RNA, 19 nt, Yersinia pestis KIM
gccauauacgcauaaugcg

SEQ ID NO: 2310169 - RNA, 12 nt, Yersinia pestis KIM
gccauuacccuc

SEQ ID NO: 2310170 - RNA, 18 nt, Yersinia pestis KIM
gccauucaauguccaugu

SEQ ID NO: 2310171 - RNA, 21 nt, Yersinia pestis KIM
gccauuaaccuaaaaacguca

SEQ ID NO: 2310172 - RNA, 16 nt, Yersinia pestis KIM
gccauuaccacuguua

SEQ ID NO: 2310173 - RNA, 20 nt, Yersinia pestis KIM
gccaucuuguucuaauaaua

SEQ ID NO: 2310174 - RNA, 18 nt, Yersinia pestis KIM
gcccaaucuaacuggccc

SEQ ID NO: 2310175 - RNA, 21 nt, Yersinia pestis KIM
gcccaacaacuucaccacugu

SEQ ID NO: 2310176 - RNA, 21 nt, Yersinia pestis KIM
gccauugccgaaccugcaugu

SEQ ID NO: 2310177 - RNA, 18 nt, Yersinia pestis KIM
gccauuggcaaaggccag

SEQ ID NO: 2310178 - RNA, 15 nt, Yersinia pestis KIM
gcccaaaucugccug

SEQ ID NO: 2310179 - RNA, 19 nt, Yersinia pestis KIM
gccauuggguauggucagc

SEQ ID NO: 2310180 - RNA, 15 nt, Yersinia pestis KIM
gccauuucaccaaua

SEQ ID NO: 2310181 - RNA, 14 nt, Yersinia pestis KIM
gcaaacggauaaug

SEQ ID NO: 2310182 - RNA, 16 nt, Yersinia pestis KIM
gcaaacggauaauguu

SEQ ID NO: 2310183 - RNA, 19 nt, Yersinia pestis KIM
gcaaacggauaauguugca

SEQ ID NO: 2310184 - RNA, 15 nt, Yersinia pestis KIM
gcaaacgaacgaaua

SEQ ID NO: 2310185 - RNA, 13 nt, Yersinia pestis KIM
gcaaacagguaaa

SEQ ID NO: 2310186 - RNA, 15 nt, Yersinia pestis KIM
gcaaacaucacaccu

SEQ ID NO: 2310187 - RNA, 17 nt, Yersinia pestis KIM
gcaaagcgggccagcaa

SEQ ID NO: 2310188 - RNA, 16 nt, Yersinia pestis KIM
gcaaagcgggccagca

SEQ ID NO: 2310189 - RNA, 15 nt, Yersinia pestis KIM
gcaaagaagaauaag

SEQ ID NO: 2310190 - RNA, 13 nt, Yersinia pestis KIM
gcaaagagucgca

SEQ ID NO: 2310191 - RNA, 23 nt, Yersinia pestis KIM
gcaaagagaacgggcaaccugua

SEQ ID NO: 2310192 - RNA, 19 nt, Yersinia pestis KIM
gcaaacuuaaaaaucaaaa

SEQ ID NO: 2310193 - RNA, 13 nt, Yersinia pestis KIM
gcaaagaagaaua

SEQ ID NO: 2310194 - RNA, 15 nt, Yersinia pestis KIM
gcaaaaagccagcga

SEQ ID NO: 2310195 - RNA, 20 nt, Yersinia pestis KIM
gcaaaaacagucauuaacac

SEQ ID NO: 2310196 - RNA, 18 nt, Yersinia pestis KIM
gcaaaaacgccaucaaua

SEQ ID NO: 2310197 - RNA, 12 nt, Yersinia pestis KIM
gauuuuuuguuc

SEQ ID NO: 2310198 - RNA, 13 nt, Yersinia pestis KIM
gauuuuuuguucu

SEQ ID NO: 2310199 - RNA, 23 nt, Yersinia pestis KIM
gauuuuuuaugucagagauaaac

SEQ ID NO: 2310200 - RNA, 17 nt, Yersinia pestis KIM
gcaaaaaaagacacuaa

SEQ ID NO: 2310201 - RNA, 18 nt, Yersinia pestis KIM
gauuuuuuaccugagaaa

SEQ ID NO: 2310202 - RNA, 20 nt, Yersinia pestis KIM
gauuuuuuacuuuuuccuua

SEQ ID NO: 2310203 - RNA, 13 nt, Yersinia pestis KIM
gcaaaaugccaac

SEQ ID NO: 2310204 - RNA, 21 nt, Yersinia pestis KIM
gcaaaaugaucaucagcagca

SEQ ID NO: 2310205 - RNA, 21 nt, Yersinia pestis KIM
gcaaaauguguuuucugugcu

SEQ ID NO: 2310206 - RNA, 18 nt, Yersinia pestis KIM
gcaaaauaccgguggcau

SEQ ID NO: 2310207 - RNA, 15 nt, Yersinia pestis KIM
gcaaaauagcacaga

SEQ ID NO: 2310208 - RNA, 14 nt, Yersinia pestis KIM
gcaaaaauuacagu

SEQ ID NO: 2310209 - RNA, 23 nt, Yersinia pestis KIM
gcaaaacggccaguaaucaaaca

SEQ ID NO: 2310210 - RNA, 17 nt, Yersinia pestis KIM
gcaaaacguauaaaagc

SEQ ID NO: 2310211 - RNA, 22 nt, Yersinia pestis KIM
gcaaccaccuuuaccaugcuca

SEQ ID NO: 2310212 - RNA, 15 nt, Yersinia pestis KIM
gcaaccauauuaaac

SEQ ID NO: 2310213 - RNA, 18 nt, Yersinia pestis KIM
gcaaccccuaauccagca

SEQ ID NO: 2310214 - RNA, 23 nt, Yersinia pestis KIM
gcaacauuacccacuugcaacau

SEQ ID NO: 2310215 - RNA, 20 nt, Yersinia pestis KIM
gcaacauuauccguuugcaa

SEQ ID NO: 2310216 - RNA, 22 nt, Yersinia pestis KIM
gcaacauuauccguuugcaaca

SEQ ID NO: 2310217 - RNA, 22 nt, Yersinia pestis KIM
gcaacaucaggccuucuuuucu

SEQ ID NO: 2310218 - RNA, 17 nt, Yersinia pestis KIM
gcaacacaucuuccagu

SEQ ID NO: 2310219 - RNA, 15 nt, Yersinia pestis KIM
gcaacacccaacuca

SEQ ID NO: 2310220 - RNA, 13 nt, Yersinia pestis KIM
gcaacaacacccg

SEQ ID NO: 2310221 - RNA, 15 nt, Yersinia pestis KIM
gcaacaauaaagcgg

SEQ ID NO: 2310222 - RNA, 12 nt, Yersinia pestis KIM
gcaacagauaau

SEQ ID NO: 2310223 - RNA, 18 nt, Yersinia pestis KIM
gcaaauggcuuauuucac

SEQ ID NO: 2310224 - RNA, 13 nt, Yersinia pestis KIM
gcaaaucaucgcu

SEQ ID NO: 2310225 - RNA, 16 nt, Yersinia pestis KIM
gcaaauucccaccaua

SEQ ID NO: 2310226 - RNA, 18 nt, Yersinia pestis KIM
gcaacaaaaucgcgacca

SEQ ID NO: 2310227 - RNA, 23 nt, Yersinia pestis KIM
gcaacaaaaucgcgaccagcaga

SEQ ID NO: 2310228 - RNA, 14 nt, Yersinia pestis KIM
gcaaauuuauccaa

SEQ ID NO: 2310229 - RNA, 12 nt, Yersinia pestis KIM
gcaaauuuagcc

SEQ ID NO: 2310230 - RNA, 19 nt, Yersinia pestis KIM
gcaaauuuagccgcaacua

SEQ ID NO: 2310231 - RNA, 12 nt, Yersinia pestis KIM
gcaaauuuaucc

SEQ ID NO: 2310232 - RNA, 21 nt, Yersinia pestis KIM
gcaaauaaagggccugcaaac

SEQ ID NO: 2310233 - RNA, 21 nt, Yersinia pestis KIM
gcaaauaaauaccggcaggaa

SEQ ID NO: 2310234 - RNA, 22 nt, Yersinia pestis KIM
gcaaauaauaacgccugcaauu

SEQ ID NO: 2310235 - RNA, 15 nt, Yersinia pestis KIM
gcaaauaaacaaaau

SEQ ID NO: 2310236 - RNA, 23 nt, Yersinia pestis KIM
gcaaaguuuguguagcccacugg

SEQ ID NO: 2310237 - RNA, 15 nt, Yersinia pestis KIM
gcaaaguuauugacc

SEQ ID NO: 2310238 - RNA, 22 nt, Yersinia pestis KIM
gcaaauagccguuucagauaaa

SEQ ID NO: 2310239 - RNA, 17 nt, Yersinia pestis KIM
gcaaauagagcaccaaa

SEQ ID NO: 2310240 - RNA, 14 nt, Yersinia pestis KIM
gauugguuauccua

SEQ ID NO: 2310241 - RNA, 16 nt, Yersinia pestis KIM
gauugugcuccagcac

SEQ ID NO: 2310242 - RNA, 18 nt, Yersinia pestis KIM
gauuguuacgccuucagc

SEQ ID NO: 2310243 - RNA, 13 nt, Yersinia pestis KIM
gauuuaaacccuc

SEQ ID NO: 2310244 - RNA, 19 nt, Yersinia pestis KIM
gauuuacguguucuuaauu

SEQ ID NO: 2310245 - RNA, 24 nt, Yersinia pestis KIM
gauuucaccuauaauuaacagcau

SEQ ID NO: 2310246 - RNA, 15 nt, Yersinia pestis KIM
gauuuauuagagaua

SEQ ID NO: 2310247 - RNA, 15 nt, Yersinia pestis KIM
gauuucaucauucaa

SEQ ID NO: 2310248 - RNA, 23 nt, Yersinia pestis KIM
gauuucaucagcguuacccagau

SEQ ID NO: 2310249 - RNA, 22 nt, Yersinia pestis KIM
gauuucaggucgcaagcaauau

SEQ ID NO: 2310250 - RNA, 12 nt, Yersinia pestis KIM
gauuugcucaga

SEQ ID NO: 2310251 - RNA, 14 nt, Yersinia pestis KIM
gauuuguaauaacg

SEQ ID NO: 2310252 - RNA, 13 nt, Yersinia pestis KIM
gauuugaaccgcu

SEQ ID NO: 2310253 - RNA, 14 nt, Yersinia pestis KIM
gauuuuccgcagcu

SEQ ID NO: 2310254 - RNA, 19 nt, Yersinia pestis KIM
gauuuucaugauccacaau

SEQ ID NO: 2310255 - RNA, 22 nt, Yersinia pestis KIM
gauuuguugaugaaugauggua

SEQ ID NO: 2310256 - RNA, 16 nt, Yersinia pestis KIM
gauuugugcaaauaag

SEQ ID NO: 2310257 - RNA, 15 nt, Yersinia pestis KIM
gauuuguugaugaau

SEQ ID NO: 2310258 - RNA, 17 nt, Yersinia pestis KIM
gauugacugaaugugaa

SEQ ID NO: 2310259 - RNA, 19 nt, Yersinia pestis KIM
gauugacugaaugugaaga

SEQ ID NO: 2310260 - RNA, 16 nt, Yersinia pestis KIM
gauucucggcggggag

SEQ ID NO: 2310261 - RNA, 14 nt, Yersinia pestis KIM
gauucucggcaugc

SEQ ID NO: 2310262 - RNA, 15 nt, Yersinia pestis KIM
gauucucggcgggga

SEQ ID NO: 2310263 - RNA, 16 nt, Yersinia pestis KIM
gauugcagauaaacau

SEQ ID NO: 2310264 - RNA, 22 nt, Yersinia pestis KIM
gauugcaucaucaguauugacg

SEQ ID NO: 2310265 - RNA, 22 nt, Yersinia pestis KIM
gauugcuggcgcugaucaucau

SEQ ID NO: 2310266 - RNA, 19 nt, Yersinia pestis KIM
gauuggacccgucaccaca

SEQ ID NO: 2310267 - RNA, 22 nt, Yersinia pestis KIM
gauuggagucaugaggcaguga

SEQ ID NO: 2310268 - RNA, 22 nt, Yersinia pestis KIM
gauuccuguugaccaauccggu

SEQ ID NO: 2310269 - RNA, 21 nt, Yersinia pestis KIM
gauucgcggcagagaucaugu

SEQ ID NO: 2310270 - RNA, 16 nt, Yersinia pestis KIM
gauucgcgaccagcag

SEQ ID NO: 2310271 - RNA, 23 nt, Yersinia pestis KIM
gauucggcuucgguuugagcuug

SEQ ID NO: 2310272 - RNA, 19 nt, Yersinia pestis KIM
gauuccaucagcgcacugc

SEQ ID NO: 2310273 - RNA, 19 nt, Yersinia pestis KIM
gauucaccaguagcccagc

SEQ ID NO: 2310274 - RNA, 14 nt, Yersinia pestis KIM
gauucagaaaggua

SEQ ID NO: 2310275 - RNA, 16 nt, Yersinia pestis KIM
gauucaauauuuaucc

SEQ ID NO: 2310276 - RNA, 15 nt, Yersinia pestis KIM
gauucaagaaccgca

SEQ ID NO: 2310277 - RNA, 18 nt, Yersinia pestis KIM
gauuaauuauugggggga

SEQ ID NO: 2310278 - RNA, 16 nt, Yersinia pestis KIM
gauuaauacaucauca

SEQ ID NO: 2310279 - RNA, 13 nt, Yersinia pestis KIM
gauuaccaauaau

SEQ ID NO: 2310280 - RNA, 13 nt, Yersinia pestis KIM
gauuacaaaauau

SEQ ID NO: 2310281 - RNA, 19 nt, Yersinia pestis KIM
gauuagcagggcaguaaaa

SEQ ID NO: 2310282 - RNA, 14 nt, Yersinia pestis KIM
gauuagcuucugcu

SEQ ID NO: 2310283 - RNA, 16 nt, Yersinia pestis KIM
gauuagcgagguuuug

SEQ ID NO: 2310284 - RNA, 19 nt, Yersinia pestis KIM
gauuacgggucagcucacc

SEQ ID NO: 2310285 - RNA, 12 nt, Yersinia pestis KIM
gauuaccggcac

SEQ ID NO: 2310286 - RNA, 12 nt, Yersinia pestis KIM
gauuauuauuca

SEQ ID NO: 2310287 - RNA, 13 nt, Yersinia pestis KIM
gauuaugcugacc

SEQ ID NO: 2310288 - RNA, 20 nt, Yersinia pestis KIM
gauuagucuuagacgucaga

SEQ ID NO: 2310289 - RNA, 20 nt, Yersinia pestis KIM
gauuaguuuuagacgucaga

SEQ ID NO: 2310290 - RNA, 17 nt, Yersinia pestis KIM
gaugugauccacacagu

SEQ ID NO: 2310291 - RNA, 23 nt, Yersinia pestis KIM
gauguggauaauuucagcagcac

SEQ ID NO: 2310292 - RNA, 13 nt, Yersinia pestis KIM
gaugugcuccgca

SEQ ID NO: 2310293 - RNA, 22 nt, Yersinia pestis KIM
gauguguuuaaaucuuucucca

SEQ ID NO: 2310294 - RNA, 16 nt, Yersinia pestis KIM
gauguuaacucagcca

SEQ ID NO: 2310295 - RNA, 21 nt, Yersinia pestis KIM
gauguuaaaccaaagauaaua

SEQ ID NO: 2310296 - RNA, 11 nt, Yersinia pestis KIM
gauguguaccu

SEQ ID NO: 2310297 - RNA, 20 nt, Yersinia pestis KIM
gauguuauuugaauaaaaga

SEQ ID NO: 2310298 - RNA, 18 nt, Yersinia pestis KIM
gauguuauuugaauaaga

SEQ ID NO: 2310299 - RNA, 20 nt, Yersinia pestis KIM
gauguuacgcuaucgcuaaa

SEQ ID NO: 2310300 - RNA, 12 nt, Yersinia pestis KIM
gauuaaccuuau

SEQ ID NO: 2310301 - RNA, 18 nt, Yersinia pestis KIM
gauuaacuucuauuuuuc

SEQ ID NO: 2310302 - RNA, 17 nt, Yersinia pestis KIM
gauuaagaaaacauuaa

SEQ ID NO: 2310303 - RNA, 15 nt, Yersinia pestis KIM
gauguucgcuccccc

SEQ ID NO: 2310304 - RNA, 15 nt, Yersinia pestis KIM
gauguuuaacccaau

SEQ ID NO: 2310305 - RNA, 12 nt, Yersinia pestis KIM
gauguaaaacac

SEQ ID NO: 2310306 - RNA, 12 nt, Yersinia pestis KIM
gauguaacagcg

SEQ ID NO: 2310307 - RNA, 23 nt, Yersinia pestis KIM
gaugguggcucugccaauaaagu

SEQ ID NO: 2310308 - RNA, 21 nt, Yersinia pestis KIM
gaugguggcucugccaauaaa

SEQ ID NO: 2310309 - RNA, 17 nt, Yersinia pestis KIM
gaugguuaauccaccug

SEQ ID NO: 2310310 - RNA, 22 nt, Yersinia pestis KIM
gauguagucccccuccggcgcc

SEQ ID NO: 2310311 - RNA, 21 nt, Yersinia pestis KIM
gauggcuaauuaauuuaaaca

SEQ ID NO: 2310312 - RNA, 10 nt, Yersinia pestis KIM
gauggcuguu

SEQ ID NO: 2310313 - RNA, 14 nt, Yersinia pestis KIM
gauggcuguuuuuc

SEQ ID NO: 2310314 - RNA, 13 nt, Yersinia pestis KIM
gauggucacccuc

SEQ ID NO: 2310315 - RNA, 14 nt, Yersinia pestis KIM
gauggucaacuaaa

SEQ ID NO: 2310316 - RNA, 18 nt, Yersinia pestis KIM
gauggcgaucaagguuuc

SEQ ID NO: 2310317 - RNA, 16 nt, Yersinia pestis KIM
gauggcauucguggug

SEQ ID NO: 2310318 - RNA, 14 nt, Yersinia pestis KIM
gauggcccaagcca

SEQ ID NO: 2310319 - RNA, 14 nt, Yersinia pestis KIM
gauggaguaaucau

SEQ ID NO: 2310320 - RNA, 15 nt, Yersinia pestis KIM
gauggaguaaucauu

SEQ ID NO: 2310321 - RNA, 13 nt, Yersinia pestis KIM
gauggagugguca

SEQ ID NO: 2310322 - RNA, 20 nt, Yersinia pestis KIM
gauggauccccguucuagua

SEQ ID NO: 2310323 - RNA, 20 nt, Yersinia pestis KIM
gauggaaccucgcgugcggg

SEQ ID NO: 2310324 - RNA, 14 nt, Yersinia pestis KIM
gaugcuuggcccga

SEQ ID NO: 2310325 - RNA, 18 nt, Yersinia pestis KIM
gaugcgcgcgucacuaaa

SEQ ID NO: 2310326 - RNA, 14 nt, Yersinia pestis KIM
gaugccuuguuucu

SEQ ID NO: 2310327 - RNA, 13 nt, Yersinia pestis KIM
gaugccuauuugc

SEQ ID NO: 2310328 - RNA, 18 nt, Yersinia pestis KIM
gaugccuauuugcagaaa

SEQ ID NO: 2310329 - RNA, 13 nt, Yersinia pestis KIM
gaugccgcuuuag

SEQ ID NO: 2310330 - RNA, 23 nt, Yersinia pestis KIM
gaugcggguuuuuuuacauauaa

SEQ ID NO: 2310331 - RNA, 17 nt, Yersinia pestis KIM
gaugcuaacaacuucca

SEQ ID NO: 2310332 - RNA, 17 nt, Yersinia pestis KIM
gaugcuaaccgaauaaa

SEQ ID NO: 2310333 - RNA, 21 nt, Yersinia pestis KIM
gaugcuaaccgaauaaaaccu

SEQ ID NO: 2310334 - RNA, 17 nt, Yersinia pestis KIM
gaugcguugugaucguu

SEQ ID NO: 2310335 - RNA, 17 nt, Yersinia pestis KIM
gaugcucuucuucacug

SEQ ID NO: 2310336 - RNA, 21 nt, Yersinia pestis KIM
gaugcugacagaacgcaauca

SEQ ID NO: 2310337 - RNA, 18 nt, Yersinia pestis KIM
gaugcauccuugaucgcc

SEQ ID NO: 2310338 - RNA, 20 nt, Yersinia pestis KIM
gaugcauauuugcagaaagu

SEQ ID NO: 2310339 - RNA, 15 nt, Yersinia pestis KIM
gaugcauauuauaau

SEQ ID NO: 2310340 - RNA, 17 nt, Yersinia pestis KIM
gaugcauauuauaauga

SEQ ID NO: 2310341 - RNA, 18 nt, Yersinia pestis KIM
gaugcauauuauaaugaa

SEQ ID NO: 2310342 - RNA, 21 nt, Yersinia pestis KIM
gaugcauguuauuggcuaaag

SEQ ID NO: 2310343 - RNA, 18 nt, Yersinia pestis KIM
gaugcacaguaggcugaa

SEQ ID NO: 2310344 - RNA, 21 nt, Yersinia pestis KIM
gaugcacaguaggcugaaggc

SEQ ID NO: 2310345 - RNA, 13 nt, Yersinia pestis KIM
gaugauaucaccu

SEQ ID NO: 2310346 - RNA, 15 nt, Yersinia pestis KIM
gaugaguauuaccuc

SEQ ID NO: 2310347 - RNA, 14 nt, Yersinia pestis KIM
gaugaucucuggcc

SEQ ID NO: 2310348 - RNA, 21 nt, Yersinia pestis KIM
gaugaugaagcauuaaacaga

SEQ ID NO: 2310349 - RNA, 14 nt, Yersinia pestis KIM
gaugauauuuaucg

SEQ ID NO: 2310350 - RNA, 17 nt, Yersinia pestis KIM
aaagccugaauucugua

SEQ ID NO: 2310351 - RNA, 19 nt, Yersinia pestis KIM
aaagccugaauucuguaga

SEQ ID NO: 2310352 - RNA, 14 nt, Yersinia pestis KIM
aaagccgugggcag

SEQ ID NO: 2310353 - RNA, 14 nt, Yersinia pestis KIM
aaagccucuaccaa

SEQ ID NO: 2310354 - RNA, 20 nt, Yersinia pestis KIM
gaugacgccguacaaauaua

SEQ ID NO: 2310355 - RNA, 16 nt, Yersinia pestis KIM
gaugacguaauuuuaa

SEQ ID NO: 2310356 - RNA, 19 nt, Yersinia pestis KIM
gaugaccauuuauuuccac

SEQ ID NO: 2310357 - RNA, 18 nt, Yersinia pestis KIM
gaugaccgauuauaugaa

SEQ ID NO: 2310358 - RNA, 22 nt, Yersinia pestis KIM
gaugacaucgacggcagugacg

SEQ ID NO: 2310359 - RNA, 18 nt, Yersinia pestis KIM
gaugacaggggauagcaa

SEQ ID NO: 2310360 - RNA, 21 nt, Yersinia pestis KIM
gaugagcuggugagaaaggcg

SEQ ID NO: 2310361 - RNA, 14 nt, Yersinia pestis KIM
gaucuuuuucauuc

SEQ ID NO: 2310362 - RNA, 13 nt, Yersinia pestis KIM
gaugaaaaacugu

SEQ ID NO: 2310363 - RNA, 20 nt, Yersinia pestis KIM
gaugaaaaauacaaauauaa

SEQ ID NO: 2310364 - RNA, 11 nt, Yersinia pestis KIM
gaugaaaaaua

SEQ ID NO: 2310365 - RNA, 13 nt, Yersinia pestis KIM
gaugaaacacaac

SEQ ID NO: 2310366 - RNA, 16 nt, Yersinia pestis KIM
gaugaaacacaacaac

SEQ ID NO: 2310367 - RNA, 19 nt, Yersinia pestis KIM
gaugaaacccagaauggaa

SEQ ID NO: 2310368 - RNA, 22 nt, Yersinia pestis KIM
gaucuuuggccccgcgcuaacc

SEQ ID NO: 2310369 - RNA, 15 nt, Yersinia pestis KIM
gaucuugauaaacau

SEQ ID NO: 2310370 - RNA, 17 nt, Yersinia pestis KIM
gaucuucauugccuucu

SEQ ID NO: 2310371 - RNA, 22 nt, Yersinia pestis KIM
gaucuuauuaauugguauuuua

SEQ ID NO: 2310372 - RNA, 20 nt, Yersinia pestis KIM
gaugaagguaaugcgaaaaa

SEQ ID NO: 2310373 - RNA, 18 nt, Yersinia pestis KIM
gaugaagcauuaaacaga

SEQ ID NO: 2310374 - RNA, 16 nt, Yersinia pestis KIM
gaugaacuacaggggg

SEQ ID NO: 2310375 - RNA, 20 nt, Yersinia pestis KIM
gaugaaauccagaucagcgc

SEQ ID NO: 2310376 - RNA, 12 nt, Yersinia pestis KIM
gaugaaauuuua

SEQ ID NO: 2310377 - RNA, 14 nt, Yersinia pestis KIM
gaugaacacagaaa

SEQ ID NO: 2310378 - RNA, 15 nt, Yersinia pestis KIM
gaugaaacuaaaaua

SEQ ID NO: 2310379 - RNA, 22 nt, Yersinia pestis KIM
gaugaaacuaaaauaaucuugu

SEQ ID NO: 2310380 - RNA, 12 nt, Yersinia pestis KIM
gaugaaauaaac

SEQ ID NO: 2310381 - RNA, 13 nt, Yersinia pestis KIM
gagcgcagacguu

SEQ ID NO: 2310382 - RNA, 22 nt, Yersinia pestis KIM
gagccagagacauaaagcccgc

SEQ ID NO: 2310383 - RNA, 18 nt, Yersinia pestis KIM
gagccaauuaagaaaucu

SEQ ID NO: 2310384 - RNA, 22 nt, Yersinia pestis KIM
gagccaauuaagaaaucugcag

SEQ ID NO: 2310385 - RNA, 19 nt, Yersinia pestis KIM
gagccgcccuuuagccagc

SEQ ID NO: 2310386 - RNA, 17 nt, Yersinia pestis KIM
gagccuguaucggguga

SEQ ID NO: 2310387 - RNA, 16 nt, Yersinia pestis KIM
gagccucaugaaugag

SEQ ID NO: 2310388 - RNA, 21 nt, Yersinia pestis KIM
gagccucaugaaugaggcuga

SEQ ID NO: 2310389 - RNA, 18 nt, Yersinia pestis KIM
gagccuacuacauggaug

SEQ ID NO: 2310390 - RNA, 15 nt, Yersinia pestis KIM
gagcgugaagagcga

SEQ ID NO: 2310391 - RNA, 14 nt, Yersinia pestis KIM
gagcgucaagccaa

SEQ ID NO: 2310392 - RNA, 20 nt, Yersinia pestis KIM
gagcgucaagccaaccccca

SEQ ID NO: 2310393 - RNA, 12 nt, Yersinia pestis KIM
gagcguaaucug

SEQ ID NO: 2310394 - RNA, 21 nt, Yersinia pestis KIM
gagcguauagguuauaagcca

SEQ ID NO: 2310395 - RNA, 17 nt, Yersinia pestis KIM
gagcuauggaagaacug

SEQ ID NO: 2310396 - RNA, 16 nt, Yersinia pestis KIM
gagcucagccaggcag

SEQ ID NO: 2310397 - RNA, 22 nt, Yersinia pestis KIM
gagcucagccaggcagcuauca

SEQ ID NO: 2310398 - RNA, 18 nt, Yersinia pestis KIM
gagcggaucgacgugaag

SEQ ID NO: 2310399 - RNA, 18 nt, Yersinia pestis KIM
gagcgcuuuaaccaaaga

SEQ ID NO: 2310400 - RNA, 13 nt, Yersinia pestis KIM
gagcggcaacugu

SEQ ID NO: 2310401 - RNA, 13 nt, Yersinia pestis KIM
gagcgguaagcug

SEQ ID NO: 2310402 - RNA, 15 nt, Yersinia pestis KIM
gagcggggcaaaaau

SEQ ID NO: 2310403 - RNA, 13 nt, Yersinia pestis KIM
gagagguugcaaa

SEQ ID NO: 2310404 - RNA, 16 nt, Yersinia pestis KIM
gacucacgucaguaau

SEQ ID NO: 2310405 - RNA, 15 nt, Yersinia pestis KIM
gacucaucaaaacaa

SEQ ID NO: 2310406 - RNA, 18 nt, Yersinia pestis KIM
gacucaucuaauuuucuc

SEQ ID NO: 2310407 - RNA, 14 nt, Yersinia pestis KIM
gagauugaugggau

SEQ ID NO: 2310408 - RNA, 18 nt, Yersinia pestis KIM
gagauugcguuauaucua

SEQ ID NO: 2310409 - RNA, 22 nt, Yersinia pestis KIM
gagauucaccgauagcccaucu

SEQ ID NO: 2310410 - RNA, 22 nt, Yersinia pestis KIM
gagauuauugggcugccugugc

SEQ ID NO: 2310411 - RNA, 22 nt, Yersinia pestis KIM
gagaucguaggcuugagguuau

SEQ ID NO: 2310412 - RNA, 17 nt, Yersinia pestis KIM
aaagcacagacaaacaa

SEQ ID NO: 2310413 - RNA, 21 nt, Yersinia pestis KIM
aaagcagaaagggcgcaugua

SEQ ID NO: 2310414 - RNA, 18 nt, Yersinia pestis KIM
gagccaauagaggcuccc

SEQ ID NO: 2310415 - RNA, 21 nt, Yersinia pestis KIM
gagccaaacgugcuacuuaau

SEQ ID NO: 2310416 - RNA, 20 nt, Yersinia pestis KIM
aaagcagacuugaacuucga

SEQ ID NO: 2310417 - RNA, 18 nt, Yersinia pestis KIM
gagcaaucuggcggccgc

SEQ ID NO: 2310418 - RNA, 20 nt, Yersinia pestis KIM
gagcagccaacacaccugca

SEQ ID NO: 2310419 - RNA, 21 nt, Yersinia pestis KIM
gagcaauaccaaaaaucucuu

SEQ ID NO: 2310420 - RNA, 17 nt, Yersinia pestis KIM
gagcaagggcagcuaac

SEQ ID NO: 2310421 - RNA, 19 nt, Yersinia pestis KIM
gagcaaacggguggccaca

SEQ ID NO: 2310422 - RNA, 13 nt, Yersinia pestis KIM
gaguucucaccaa

SEQ ID NO: 2310423 - RNA, 14 nt, Yersinia pestis KIM
gaguuuccaguuca

SEQ ID NO: 2310424 - RNA, 20 nt, Yersinia pestis KIM
gauaaaaggcuauuuaaauu

SEQ ID NO: 2310425 - RNA, 18 nt, Yersinia pestis KIM
gauaaaagaaagggcaac

SEQ ID NO: 2310426 - RNA, 13 nt, Yersinia pestis KIM
gauaaaauacuuc

SEQ ID NO: 2310427 - RNA, 15 nt, Yersinia pestis KIM
gauaaacaaauauga

SEQ ID NO: 2310428 - RNA, 21 nt, Yersinia pestis KIM
gauaacgggcagguuuuucaa

SEQ ID NO: 2310429 - RNA, 17 nt, Yersinia pestis KIM
gauaacgggcagguuuu

SEQ ID NO: 2310430 - RNA, 23 nt, Yersinia pestis KIM
gauaacggcuggucgcuggguuc

SEQ ID NO: 2310431 - RNA, 16 nt, Yersinia pestis KIM
gauaacgcgaucugaa

SEQ ID NO: 2310432 - RNA, 22 nt, Yersinia pestis KIM
gauaaacaauaaacagacuaaa

SEQ ID NO: 2310433 - RNA, 16 nt, Yersinia pestis KIM
gauaaacaucaugaga

SEQ ID NO: 2310434 - RNA, 15 nt, Yersinia pestis KIM
gauaaagagugaaau

SEQ ID NO: 2310435 - RNA, 16 nt, Yersinia pestis KIM
gauaacccacagcaag

SEQ ID NO: 2310436 - RNA, 14 nt, Yersinia pestis KIM
gauaacccacguuc

SEQ ID NO: 2310437 - RNA, 22 nt, Yersinia pestis KIM
gauaaacuguuuaagcuuuuua

SEQ ID NO: 2310438 - RNA, 20 nt, Yersinia pestis KIM
gagucgauagcuuucuccuu

SEQ ID NO: 2310439 - RNA, 22 nt, Yersinia pestis KIM
gagucgauagcuuucuccuuug

SEQ ID NO: 2310440 - RNA, 14 nt, Yersinia pestis KIM
gagucgaugaaaca

SEQ ID NO: 2310441 - RNA, 22 nt, Yersinia pestis KIM
gaguauguauccaucugaugag

SEQ ID NO: 2310442 - RNA, 21 nt, Yersinia pestis KIM
gaguacuaacgucaacagaac

SEQ ID NO: 2310443 - RNA, 20 nt, Yersinia pestis KIM
gaguacgaacaguagccccu

SEQ ID NO: 2310444 - RNA, 23 nt, Yersinia pestis KIM
gaguacugcgcuagaccaguuaa

SEQ ID NO: 2310445 - RNA, 17 nt, Yersinia pestis KIM
gagugaaucgccguuac

SEQ ID NO: 2310446 - RNA, 17 nt, Yersinia pestis KIM
gagugaagacaucgcca

SEQ ID NO: 2310447 - RNA, 15 nt, Yersinia pestis KIM
gaguguaaaaagcag

SEQ ID NO: 2310448 - RNA, 23 nt, Yersinia pestis KIM
gaguguucggggguugucagcag

SEQ ID NO: 2310449 - RNA, 19 nt, Yersinia pestis KIM
gaggagauuucagacugcu

SEQ ID NO: 2310450 - RNA, 16 nt, Yersinia pestis KIM
gaggagauuucagacu

SEQ ID NO: 2310451 - RNA, 19 nt, Yersinia pestis KIM
gaggacuuccugcccagcg

SEQ ID NO: 2310452 - RNA, 14 nt, Yersinia pestis KIM
gaggacggcggccu

SEQ ID NO: 2310453 - RNA, 17 nt, Yersinia pestis KIM
gagcugaauagccuuga

SEQ ID NO: 2310454 - RNA, 15 nt, Yersinia pestis KIM
gagcugacgucagau

SEQ ID NO: 2310455 - RNA, 17 nt, Yersinia pestis KIM
gagcugaucugccagua

SEQ ID NO: 2310456 - RNA, 16 nt, Yersinia pestis KIM
gagcugcgauaaucug

SEQ ID NO: 2310457 - RNA, 18 nt, Yersinia pestis KIM
gaggccuuauucgccagg

SEQ ID NO: 2310458 - RNA, 17 nt, Yersinia pestis KIM
gagggcuucuggcgugu

SEQ ID NO: 2310459 - RNA, 13 nt, Yersinia pestis KIM
gagggcuucuggc

SEQ ID NO: 2310460 - RNA, 21 nt, Yersinia pestis KIM
gagggcuauuuuuaugcaggg

SEQ ID NO: 2310461 - RNA, 15 nt, Yersinia pestis KIM
gagggugaugacaau

SEQ ID NO: 2310462 - RNA, 16 nt, Yersinia pestis KIM
gagggugaugacaaug

SEQ ID NO: 2310463 - RNA, 17 nt, Yersinia pestis KIM
gaggguugucagcaguc

SEQ ID NO: 2310464 - RNA, 15 nt, Yersinia pestis KIM
gaggguugucagcag

SEQ ID NO: 2310465 - RNA, 18 nt, Yersinia pestis KIM
gaguaaagcccagcaggc

SEQ ID NO: 2310466 - RNA, 16 nt, Yersinia pestis KIM
gagguacggccagcaa

SEQ ID NO: 2310467 - RNA, 14 nt, Yersinia pestis KIM
gaguaaugaaaucu

SEQ ID NO: 2310468 - RNA, 22 nt, Yersinia pestis KIM
gaguaaguucgucagugaugac

SEQ ID NO: 2310469 - RNA, 22 nt, Yersinia pestis KIM
gaguaauuucagauaaaaauaa

SEQ ID NO: 2310470 - RNA, 20 nt, Yersinia pestis KIM
gaguaacacuucagacugaa

SEQ ID NO: 2310471 - RNA, 21 nt, Yersinia pestis KIM
gaguaacaaauggucaggaac

SEQ ID NO: 2310472 - RNA, 11 nt, Yersinia pestis KIM
gaguaaauaca

SEQ ID NO: 2310473 - RNA, 20 nt, Yersinia pestis KIM
gaguaaauagcaaaacugag

SEQ ID NO: 2310474 - RNA, 18 nt, Yersinia pestis KIM
gaucgcucucacccugcg

SEQ ID NO: 2310475 - RNA, 18 nt, Yersinia pestis KIM
gaucgcggcgguaacccc

SEQ ID NO: 2310476 - RNA, 20 nt, Yersinia pestis KIM
gaucgcgcccauccgcagga

SEQ ID NO: 2310477 - RNA, 20 nt, Yersinia pestis KIM
gaucgcccugaauagccuga

SEQ ID NO: 2310478 - RNA, 12 nt, Yersinia pestis KIM
gaucguaggcuu

SEQ ID NO: 2310479 - RNA, 16 nt, Yersinia pestis KIM
gaucguaaagacgccg

SEQ ID NO: 2310480 - RNA, 17 nt, Yersinia pestis KIM
gaucguccggcagggug

SEQ ID NO: 2310481 - RNA, 18 nt, Yersinia pestis KIM
gaucggguggaccuccau

SEQ ID NO: 2310482 - RNA, 16 nt, Yersinia pestis KIM
gaucggccaauaugau

SEQ ID NO: 2310483 - RNA, 19 nt, Yersinia pestis KIM
gaucuaacguccccugagc

SEQ ID NO: 2310484 - RNA, 21 nt, Yersinia pestis KIM
gaucuggcuuucucaacagca

SEQ ID NO: 2310485 - RNA, 18 nt, Yersinia pestis KIM
gaucucuaucgcgguuuu

SEQ ID NO: 2310486 - RNA, 21 nt, Yersinia pestis KIM
gaucucuaucgcgguuuuaaa

SEQ ID NO: 2310487 - RNA, 17 nt, Yersinia pestis KIM
gaucucuuuauauucaa

SEQ ID NO: 2310488 - RNA, 19 nt, Yersinia pestis KIM
gaucugaaacggugaggau

SEQ ID NO: 2310489 - RNA, 20 nt, Yersinia pestis KIM
gaucugacauuugcaucuau

SEQ ID NO: 2310490 - RNA, 15 nt, Yersinia pestis KIM
gauccgggaaaaaau

SEQ ID NO: 2310491 - RNA, 14 nt, Yersinia pestis KIM
gaucccgugccaga

SEQ ID NO: 2310492 - RNA, 16 nt, Yersinia pestis KIM
gauccacuccagugcc

SEQ ID NO: 2310493 - RNA, 18 nt, Yersinia pestis KIM
gauccacuuauaucucca

SEQ ID NO: 2310494 - RNA, 16 nt, Yersinia pestis KIM
gauccacuacuuauuu

SEQ ID NO: 2310495 - RNA, 18 nt, Yersinia pestis KIM
gauccagaauuucauugu

SEQ ID NO: 2310496 - RNA, 14 nt, Yersinia pestis KIM
gauccaccacauca

SEQ ID NO: 2310497 - RNA, 16 nt, Yersinia pestis KIM
gauccacauucugugu

SEQ ID NO: 2310498 - RNA, 21 nt, Yersinia pestis KIM
gauccacacaguauucugcuu

SEQ ID NO: 2310499 - RNA, 20 nt, Yersinia pestis KIM
gaucauuucccccaccugau

SEQ ID NO: 2310500 - RNA, 14 nt, Yersinia pestis KIM
gauccauaggaucu

SEQ ID NO: 2310501 - RNA, 16 nt, Yersinia pestis KIM
gaucccaagcaggaaa

SEQ ID NO: 2310502 - RNA, 16 nt, Yersinia pestis KIM
gaucccacugcccgaa

SEQ ID NO: 2310503 - RNA, 18 nt, Yersinia pestis KIM
gauccaucugauaaguuu

SEQ ID NO: 2310504 - RNA, 16 nt, Yersinia pestis KIM
gaucccaaaagaaaau

SEQ ID NO: 2310505 - RNA, 14 nt, Yersinia pestis KIM
gaucgcacuucaac

SEQ ID NO: 2310506 - RNA, 17 nt, Yersinia pestis KIM
gaucgaucucuuuauau

SEQ ID NO: 2310507 - RNA, 20 nt, Yersinia pestis KIM
gauccuuuagcgcugcaucu

SEQ ID NO: 2310508 - RNA, 18 nt, Yersinia pestis KIM
gauccuggcccgccagca

SEQ ID NO: 2310509 - RNA, 21 nt, Yersinia pestis KIM
gaucgacgugaagugagcuga

SEQ ID NO: 2310510 - RNA, 18 nt, Yersinia pestis KIM
gauccuaggcggugaggg

SEQ ID NO: 2310511 - RNA, 17 nt, Yersinia pestis KIM
gauccucguuagucacu

SEQ ID NO: 2310512 - RNA, 20 nt, Yersinia pestis KIM
gauccugccgccucugcucc

SEQ ID NO: 2310513 - RNA, 13 nt, Yersinia pestis KIM
aaagcccagguua

SEQ ID NO: 2310514 - RNA, 16 nt, Yersinia pestis KIM
aaagccauuagcguug

SEQ ID NO: 2310515 - RNA, 15 nt, Yersinia pestis KIM
gaucaaggagauucc

SEQ ID NO: 2310516 - RNA, 19 nt, Yersinia pestis KIM
gaucaccaggcucucauau

SEQ ID NO: 2310517 - RNA, 18 nt, Yersinia pestis KIM
gaucaccgccugcguauu

SEQ ID NO: 2310518 - RNA, 19 nt, Yersinia pestis KIM
gaucacggauaucaauaac

SEQ ID NO: 2310519 - RNA, 13 nt, Yersinia pestis KIM
gaucagcauuucg

SEQ ID NO: 2310520 - RNA, 17 nt, Yersinia pestis KIM
gaucagcgccugcuguu

SEQ ID NO: 2310521 - RNA, 13 nt, Yersinia pestis KIM
gaucaguggggua

SEQ ID NO: 2310522 - RNA, 16 nt, Yersinia pestis KIM
gaucagugaacugcuc

SEQ ID NO: 2310523 - RNA, 16 nt, Yersinia pestis KIM
gaucauaagccgcaga

SEQ ID NO: 2310524 - RNA, 22 nt, Yersinia pestis KIM
gaucaucugguuuuuuuauaaa

SEQ ID NO: 2310525 - RNA, 13 nt, Yersinia pestis KIM
gaucaucugguga

SEQ ID NO: 2310526 - RNA, 17 nt, Yersinia pestis KIM
gaucaucaacgcgccuu

SEQ ID NO: 2310527 - RNA, 16 nt, Yersinia pestis KIM
gaucaucagcagcagg

SEQ ID NO: 2310528 - RNA, 16 nt, Yersinia pestis KIM
gaucaucaggcaggua

SEQ ID NO: 2310529 - RNA, 22 nt, Yersinia pestis KIM
gaucauggcuugugcagcaaua

SEQ ID NO: 2310530 - RNA, 12 nt, Yersinia pestis KIM
gaucaugggaaa

SEQ ID NO: 2310531 - RNA, 19 nt, Yersinia pestis KIM
gaucaugaaaaaugagcaa

SEQ ID NO: 2310532 - RNA, 17 nt, Yersinia pestis KIM
gauacuuuuuauuuuuu

SEQ ID NO: 2310533 - RNA, 19 nt, Yersinia pestis KIM
gauagagauaaaaaaaccg

SEQ ID NO: 2310534 - RNA, 14 nt, Yersinia pestis KIM
gauacuggaagaaa

SEQ ID NO: 2310535 - RNA, 13 nt, Yersinia pestis KIM
gauacgacuucuu

SEQ ID NO: 2310536 - RNA, 19 nt, Yersinia pestis KIM
gauacgcauugaggucagc

SEQ ID NO: 2310537 - RNA, 22 nt, Yersinia pestis KIM
gauaacuuuuuauuucuuuuaa

SEQ ID NO: 2310538 - RNA, 21 nt, Yersinia pestis KIM
gauaacuuccuuugcccuuac

SEQ ID NO: 2310539 - RNA, 16 nt, Yersinia pestis KIM
gauaacuccaggguaa

SEQ ID NO: 2310540 - RNA, 16 nt, Yersinia pestis KIM
gauaugacuaaacuga

SEQ ID NO: 2310541 - RNA, 20 nt, Yersinia pestis KIM
gauaugacagaaaaaucaca

SEQ ID NO: 2310542 - RNA, 14 nt, Yersinia pestis KIM
gauaugaauauccg

SEQ ID NO: 2310543 - RNA, 20 nt, Yersinia pestis KIM
gauaugcauuauugauguua

SEQ ID NO: 2310544 - RNA, 20 nt, Yersinia pestis KIM
gauaugccggggauauuuug

SEQ ID NO: 2310545 - RNA, 20 nt, Yersinia pestis KIM
gauaugaugcggaagaaggc

SEQ ID NO: 2310546 - RNA, 18 nt, Yersinia pestis KIM
gauauauagaaauaagga

SEQ ID NO: 2310547 - RNA, 14 nt, Yersinia pestis KIM
gauauagccuucuu

SEQ ID NO: 2310548 - RNA, 14 nt, Yersinia pestis KIM
gauauagagcucag

SEQ ID NO: 2310549 - RNA, 18 nt, Yersinia pestis KIM
gauagugucacucugguu

SEQ ID NO: 2310550 - RNA, 16 nt, Yersinia pestis KIM
gauagcaaucaauaag

SEQ ID NO: 2310551 - RNA, 16 nt, Yersinia pestis KIM
gauagauuuuucaccu

SEQ ID NO: 2310552 - RNA, 23 nt, Yersinia pestis KIM
gauagggggcaaccauauuaaac

SEQ ID NO: 2310553 - RNA, 20 nt, Yersinia pestis KIM
gauaggccggggagccaagu

SEQ ID NO: 2310554 - RNA, 15 nt, Yersinia pestis KIM
gauaggcgaaauuga

SEQ ID NO: 2310555 - RNA, 22 nt, Yersinia pestis KIM
gauagggagccaauagaggcuc

SEQ ID NO: 2310556 - RNA, 23 nt, Yersinia pestis KIM
gauaguacguagcgauaacagau

SEQ ID NO: 2310557 - RNA, 23 nt, Yersinia pestis KIM
gauaguaacaccagcauccugca

SEQ ID NO: 2310558 - RNA, 16 nt, Yersinia pestis KIM
cuuucuaagcugccug

SEQ ID NO: 2310559 - RNA, 17 nt, Yersinia pestis KIM
cuuucuaagcugccugu

SEQ ID NO: 2310560 - RNA, 14 nt, Yersinia pestis KIM
cuuucuaauuauua

SEQ ID NO: 2310561 - RNA, 16 nt, Yersinia pestis KIM
cuuucuaauuauuaaa

SEQ ID NO: 2310562 - RNA, 22 nt, Yersinia pestis KIM
cuuucauuuguuggcaaauuaa

SEQ ID NO: 2310563 - RNA, 17 nt, Yersinia pestis KIM
cuuucaucgauugcugg

SEQ ID NO: 2310564 - RNA, 12 nt, Yersinia pestis KIM
cuuuccccagau

SEQ ID NO: 2310565 - RNA, 22 nt, Yersinia pestis KIM
cuuuccccauuuuuuuauaauc

SEQ ID NO: 2310566 - RNA, 20 nt, Yersinia pestis KIM
cuuucucgacauccaauuca

SEQ ID NO: 2310567 - RNA, 22 nt, Yersinia pestis KIM
cuuucucauuagcgucuuuuuu

SEQ ID NO: 2310568 - RNA, 22 nt, Yersinia pestis KIM
cuuucucuggcacgcuuucugc

SEQ ID NO: 2310569 - RNA, 18 nt, Yersinia pestis KIM
cuuucucuccuuauacua

SEQ ID NO: 2310570 - RNA, 15 nt, Yersinia pestis KIM
cuuucucggugugcu

SEQ ID NO: 2310571 - RNA, 19 nt, Yersinia pestis KIM
cuuucucgauacaauuuuu

SEQ ID NO: 2310572 - RNA, 16 nt, Yersinia pestis KIM
cuuucucgauacaauu

SEQ ID NO: 2310573 - RNA, 22 nt, Yersinia pestis KIM
cuuucuuuucgcuauuucucuc

SEQ ID NO: 2310574 - RNA, 20 nt, Yersinia pestis KIM
cuuucuuuaaucacucucau

SEQ ID NO: 2310575 - RNA, 23 nt, Yersinia pestis KIM
cuuugucaauaaccucagccuca

SEQ ID NO: 2310576 - RNA, 17 nt, Yersinia pestis KIM
cuuuguauuuugcacaa

SEQ ID NO: 2310577 - RNA, 17 nt, Yersinia pestis KIM
cuuugaugccuaauaau

SEQ ID NO: 2310578 - RNA, 14 nt, Yersinia pestis KIM
cuuugaugccuaau

SEQ ID NO: 2310579 - RNA, 22 nt, Yersinia pestis KIM
cuuugacuaauacugcgguccu

SEQ ID NO: 2310580 - RNA, 17 nt, Yersinia pestis KIM
cuuugaccauuuguuuu

SEQ ID NO: 2310581 - RNA, 12 nt, Yersinia pestis KIM
cuuugcgugaca

SEQ ID NO: 2310582 - RNA, 14 nt, Yersinia pestis KIM
cuuuauauucaaua

SEQ ID NO: 2310583 - RNA, 21 nt, Yersinia pestis KIM
cuuuaggauuuauuucucuga

SEQ ID NO: 2310584 - RNA, 15 nt, Yersinia pestis KIM
cuuuagcuauuacua

SEQ ID NO: 2310585 - RNA, 14 nt, Yersinia pestis KIM
cuuuagcauugcag

SEQ ID NO: 2310586 - RNA, 21 nt, Yersinia pestis KIM
cuuuaucauugaguucugauc

SEQ ID NO: 2310587 - RNA, 13 nt, Yersinia pestis KIM
cuuuauucaauac

SEQ ID NO: 2310588 - RNA, 18 nt, Yersinia pestis KIM
cuuuauucauucagagua

SEQ ID NO: 2310589 - RNA, 12 nt, Yersinia pestis KIM
cuuuauuauaug

SEQ ID NO: 2310590 - RNA, 21 nt, Yersinia pestis KIM
cuuucaggagugaauuucuuc

SEQ ID NO: 2310591 - RNA, 12 nt, Yersinia pestis KIM
cuuucaguaauc

SEQ ID NO: 2310592 - RNA, 16 nt, Yersinia pestis KIM
cuuucagugagcauuu

SEQ ID NO: 2310593 - RNA, 23 nt, Yersinia pestis KIM
cuuucagggaguaacuugacgac

SEQ ID NO: 2310594 - RNA, 15 nt, Yersinia pestis KIM
cuuucauacaucauu

SEQ ID NO: 2310595 - RNA, 14 nt, Yersinia pestis KIM
cuuuauugcuccuu

SEQ ID NO: 2310596 - RNA, 19 nt, Yersinia pestis KIM
cuuuauugcuccuuacuau

SEQ ID NO: 2310597 - RNA, 22 nt, Yersinia pestis KIM
cuuuaccaugcucauguucaug

SEQ ID NO: 2310598 - RNA, 18 nt, Yersinia pestis KIM
cuuuacgaucugccuguu

SEQ ID NO: 2310599 - RNA, 22 nt, Yersinia pestis KIM
cuuuacgaucugccuguucucu

SEQ ID NO: 2310600 - RNA, 20 nt, Yersinia pestis KIM
cuuuaauccauucacgcccu

SEQ ID NO: 2310601 - RNA, 15 nt, Yersinia pestis KIM
cuuuaacaauuuauc

SEQ ID NO: 2310602 - RNA, 13 nt, Yersinia pestis KIM
cuuuaauaaaauc

SEQ ID NO: 2310603 - RNA, 18 nt, Yersinia pestis KIM
cuucgcggugauuccaau

SEQ ID NO: 2310604 - RNA, 15 nt, Yersinia pestis KIM
cuucgcuggccgcaa

SEQ ID NO: 2310605 - RNA, 18 nt, Yersinia pestis KIM
cuucgcuccggucaacgu

SEQ ID NO: 2310606 - RNA, 14 nt, Yersinia pestis KIM
cuucgcugacauuu

SEQ ID NO: 2310607 - RNA, 15 nt, Yersinia pestis KIM
cuucgcuuucaucuu

SEQ ID NO: 2310608 - RNA, 18 nt, Yersinia pestis KIM
aaagacccaauacaccac

SEQ ID NO: 2310609 - RNA, 13 nt, Yersinia pestis KIM
gaaaagcagacuu

SEQ ID NO: 2310610 - RNA, 20 nt, Yersinia pestis KIM
gaaaagcagucgacagugua

SEQ ID NO: 2310611 - RNA, 13 nt, Yersinia pestis KIM
gaaaagcagcagu

SEQ ID NO: 2310612 - RNA, 20 nt, Yersinia pestis KIM
gaaaagaggggcaguuguug

SEQ ID NO: 2310613 - RNA, 20 nt, Yersinia pestis KIM
gaaaacugugcgaauggaaa

SEQ ID NO: 2310614 - RNA, 20 nt, Yersinia pestis KIM
gaaaacccuguugcaccagg

SEQ ID NO: 2310615 - RNA, 21 nt, Yersinia pestis KIM
gaaaacccccagcuaggcugg

SEQ ID NO: 2310616 - RNA, 14 nt, Yersinia pestis KIM
gaaaaccuaauacu

SEQ ID NO: 2310617 - RNA, 18 nt, Yersinia pestis KIM
gaaaaccuucagcaaaga

SEQ ID NO: 2310618 - RNA, 19 nt, Yersinia pestis KIM
gaaaaccuucagcaaagag

SEQ ID NO: 2310619 - RNA, 24 nt, Yersinia pestis KIM
gaaaacguuaacugcaguaaaaau

SEQ ID NO: 2310620 - RNA, 16 nt, Yersinia pestis KIM
cuuuuuuaauaaaaaa

SEQ ID NO: 2310621 - RNA, 17 nt, Yersinia pestis KIM
cuuuuuuaauaaaaaac

SEQ ID NO: 2310622 - RNA, 20 nt, Yersinia pestis KIM
cuuuuuuaacguccauuggc

SEQ ID NO: 2310623 - RNA, 21 nt, Yersinia pestis KIM
cuuuuuuaacguccauuggcg

SEQ ID NO: 2310624 - RNA, 17 nt, Yersinia pestis KIM
cuuuuucgugucguaac

SEQ ID NO: 2310625 - RNA, 14 nt, Yersinia pestis KIM
cuuuuguuaauuca

SEQ ID NO: 2310626 - RNA, 14 nt, Yersinia pestis KIM
gaaaacaagccagc

SEQ ID NO: 2310627 - RNA, 15 nt, Yersinia pestis KIM
gaaaaaaacagacua

SEQ ID NO: 2310628 - RNA, 20 nt, Yersinia pestis KIM
cuuuuccgccaugagaacca

SEQ ID NO: 2310629 - RNA, 19 nt, Yersinia pestis KIM
cuuuucaguuuuaauuuau

SEQ ID NO: 2310630 - RNA, 17 nt, Yersinia pestis KIM
cuuuucauuuccucugg

SEQ ID NO: 2310631 - RNA, 20 nt, Yersinia pestis KIM
cuuuucaucgcauaggccaa

SEQ ID NO: 2310632 - RNA, 17 nt, Yersinia pestis KIM
cuuuuaugcaucuuuua

SEQ ID NO: 2310633 - RNA, 19 nt, Yersinia pestis KIM
cuuuuacgggccuuuuaau

SEQ ID NO: 2310634 - RNA, 14 nt, Yersinia pestis KIM
cuuuuacggacugc

SEQ ID NO: 2310635 - RNA, 16 nt, Yersinia pestis KIM
cuuuugccacauuucc

SEQ ID NO: 2310636 - RNA, 18 nt, Yersinia pestis KIM
cuuuugcauauuucucuu

SEQ ID NO: 2310637 - RNA, 22 nt, Yersinia pestis KIM
cuuuugcuguucacgaucucua

SEQ ID NO: 2310638 - RNA, 21 nt, Yersinia pestis KIM
cuuuucuuuaugucuuuuucu

SEQ ID NO: 2310639 - RNA, 16 nt, Yersinia pestis KIM
cuuuucuuuuuuugug

SEQ ID NO: 2310640 - RNA, 20 nt, Yersinia pestis KIM
cuuuucuuuuuuuguguauc

SEQ ID NO: 2310641 - RNA, 21 nt, Yersinia pestis KIM
aaagacuuuauucacagcaga

SEQ ID NO: 2310642 - RNA, 20 nt, Yersinia pestis KIM
aaagacuuuauucacagcag

SEQ ID NO: 2310643 - RNA, 15 nt, Yersinia pestis KIM
cuuuucugauuuuuu

SEQ ID NO: 2310644 - RNA, 23 nt, Yersinia pestis KIM
aaagacgccguaaauacauccau

SEQ ID NO: 2310645 - RNA, 16 nt, Yersinia pestis KIM
aaagacgccguaaaua

SEQ ID NO: 2310646 - RNA, 19 nt, Yersinia pestis KIM
aaagacgccggcuucccug

SEQ ID NO: 2310647 - RNA, 17 nt, Yersinia pestis KIM
gaaccugacgcacagca

SEQ ID NO: 2310648 - RNA, 23 nt, Yersinia pestis KIM
gaaccugcauccccggcauccca

SEQ ID NO: 2310649 - RNA, 18 nt, Yersinia pestis KIM
gaaccugaaauacaaaua

SEQ ID NO: 2310650 - RNA, 18 nt, Yersinia pestis KIM
gaaccucgacuaaacgcc

SEQ ID NO: 2310651 - RNA, 17 nt, Yersinia pestis KIM
gaacgaggacuuccugc

SEQ ID NO: 2310652 - RNA, 18 nt, Yersinia pestis KIM
gaacgaggacuuccugcc

SEQ ID NO: 2310653 - RNA, 14 nt, Yersinia pestis KIM
gaaccuucucugca

SEQ ID NO: 2310654 - RNA, 20 nt, Yersinia pestis KIM
gaaccuguuacaucagagcu

SEQ ID NO: 2310655 - RNA, 19 nt, Yersinia pestis KIM
gaaccgcagacauaucuga

SEQ ID NO: 2310656 - RNA, 13 nt, Yersinia pestis KIM
gaacccuucagca

SEQ ID NO: 2310657 - RNA, 17 nt, Yersinia pestis KIM
gaaccccuagccagcca

SEQ ID NO: 2310658 - RNA, 19 nt, Yersinia pestis KIM
gaacccgcagauaaacccg

SEQ ID NO: 2310659 - RNA, 20 nt, Yersinia pestis KIM
gaaccgcuaucugcugacca

SEQ ID NO: 2310660 - RNA, 13 nt, Yersinia pestis KIM
gaaccaucaacaa

SEQ ID NO: 2310661 - RNA, 22 nt, Yersinia pestis KIM
gaaccauuuuuuguagugaaag

SEQ ID NO: 2310662 - RNA, 16 nt, Yersinia pestis KIM
gaaccagugaaugcug

SEQ ID NO: 2310663 - RNA, 24 nt, Yersinia pestis KIM
gaaccauaaacaaguugaaccaua

SEQ ID NO: 2310664 - RNA, 18 nt, Yersinia pestis KIM
gaacauugcaguauuuug

SEQ ID NO: 2310665 - RNA, 14 nt, Yersinia pestis KIM
gaacauuauuuuuc

SEQ ID NO: 2310666 - RNA, 20 nt, Yersinia pestis KIM
gaacauuuaucuaucuguuc

SEQ ID NO: 2310667 - RNA, 20 nt, Yersinia pestis KIM
gaacauuuucuaagcugccu

SEQ ID NO: 2310668 - RNA, 18 nt, Yersinia pestis KIM
gaaccaauuuuucuguau

SEQ ID NO: 2310669 - RNA, 23 nt, Yersinia pestis KIM
gaaccaccaagaacgccaaauga

SEQ ID NO: 2310670 - RNA, 21 nt, Yersinia pestis KIM
gaaccaaaauucacaacuugu

SEQ ID NO: 2310671 - RNA, 14 nt, Yersinia pestis KIM
gaacgcuggcggca

SEQ ID NO: 2310672 - RNA, 13 nt, Yersinia pestis KIM
gaacgcacaaugg

SEQ ID NO: 2310673 - RNA, 19 nt, Yersinia pestis KIM
gaacgccaaguaugcaggc

SEQ ID NO: 2310674 - RNA, 14 nt, Yersinia pestis KIM
gaacgauauuuuua

SEQ ID NO: 2310675 - RNA, 23 nt, Yersinia pestis KIM
gaacggccugccagaacagcagg

SEQ ID NO: 2310676 - RNA, 18 nt, Yersinia pestis KIM
gaacgcuugcgccaaauc

SEQ ID NO: 2310677 - RNA, 20 nt, Yersinia pestis KIM
gaacgcuuguggaaauagaa

SEQ ID NO: 2310678 - RNA, 19 nt, Yersinia pestis KIM
gaacggacauuuagcacug

SEQ ID NO: 2310679 - RNA, 21 nt, Yersinia pestis KIM
gaacggacauuuuacucccug

SEQ ID NO: 2310680 - RNA, 13 nt, Yersinia pestis KIM
gaacggagaugau

SEQ ID NO: 2310681 - RNA, 23 nt, Yersinia pestis KIM
gaacggauacccagcacaaugac

SEQ ID NO: 2310682 - RNA, 16 nt, Yersinia pestis KIM
gaacggugaggauagg

SEQ ID NO: 2310683 - RNA, 17 nt, Yersinia pestis KIM
gaacuaauaucaacaga

SEQ ID NO: 2310684 - RNA, 20 nt, Yersinia pestis KIM
gaacuaauaucaacagaacu

SEQ ID NO: 2310685 - RNA, 22 nt, Yersinia pestis KIM
gaacuaauaucaacagaacuaa

SEQ ID NO: 2310686 - RNA, 21 nt, Yersinia pestis KIM
gaacuacuccauccccaacuc

SEQ ID NO: 2310687 - RNA, 12 nt, Yersinia pestis KIM
gaacuauugaug

SEQ ID NO: 2310688 - RNA, 15 nt, Yersinia pestis KIM
gaacucgauaauaaa

SEQ ID NO: 2310689 - RNA, 15 nt, Yersinia pestis KIM
gaacucauuuuuugc

SEQ ID NO: 2310690 - RNA, 13 nt, Yersinia pestis KIM
gaacucgguguau

SEQ ID NO: 2310691 - RNA, 22 nt, Yersinia pestis KIM
gaacugaaucacaggccacugc

SEQ ID NO: 2310692 - RNA, 14 nt, Yersinia pestis KIM
gaacaaaacaagcc

SEQ ID NO: 2310693 - RNA, 17 nt, Yersinia pestis KIM
gaacaaaacaagcccca

SEQ ID NO: 2310694 - RNA, 19 nt, Yersinia pestis KIM
gaacacgacgccauaaaag

SEQ ID NO: 2310695 - RNA, 20 nt, Yersinia pestis KIM
gaacacgacgccauaaaaga

SEQ ID NO: 2310696 - RNA, 21 nt, Yersinia pestis KIM
gaacacgauaagcgggguuaa

SEQ ID NO: 2310697 - RNA, 18 nt, Yersinia pestis KIM
gaacacgcucgcguguca

SEQ ID NO: 2310698 - RNA, 21 nt, Yersinia pestis KIM
gaacagcaggccgcgaauaug

SEQ ID NO: 2310699 - RNA, 15 nt, Yersinia pestis KIM
gaacagcagaauaau

SEQ ID NO: 2310700 - RNA, 16 nt, Yersinia pestis KIM
gaacagcagaauaauu

SEQ ID NO: 2310701 - RNA, 18 nt, Yersinia pestis KIM
gaacauagcuaacaccgc

SEQ ID NO: 2310702 - RNA, 18 nt, Yersinia pestis KIM
gaacaggccaaagcuguu

SEQ ID NO: 2310703 - RNA, 19 nt, Yersinia pestis KIM
gaaauucauuaucaggcac

SEQ ID NO: 2310704 - RNA, 20 nt, Yersinia pestis KIM
gaaauucaaccucuuguaaa

SEQ ID NO: 2310705 - RNA, 21 nt, Yersinia pestis KIM
aaagagauguuauuugaauaa

SEQ ID NO: 2310706 - RNA, 21 nt, Yersinia pestis KIM
gaaauucuguagaguaaaacu

SEQ ID NO: 2310707 - RNA, 23 nt, Yersinia pestis KIM
gaaauucuguagaguaaaacuga

SEQ ID NO: 2310708 - RNA, 17 nt, Yersinia pestis KIM
gaaauuuguucaagcgu

SEQ ID NO: 2310709 - RNA, 15 nt, Yersinia pestis KIM
gaaauuugcacugca

SEQ ID NO: 2310710 - RNA, 18 nt, Yersinia pestis KIM
gaaaucgauggccgcccu

SEQ ID NO: 2310711 - RNA, 14 nt, Yersinia pestis KIM
gaaaugacaaauca

SEQ ID NO: 2310712 - RNA, 14 nt, Yersinia pestis KIM
gaaauuaaggaaaa

SEQ ID NO: 2310713 - RNA, 16 nt, Yersinia pestis KIM
gaaaugauaucugaau

SEQ ID NO: 2310714 - RNA, 12 nt, Yersinia pestis KIM
aaagagauaggc

SEQ ID NO: 2310715 - RNA, 14 nt, Yersinia pestis KIM
gaaagcgccugugg

SEQ ID NO: 2310716 - RNA, 21 nt, Yersinia pestis KIM
gaaagcgccugugggcggcuu

SEQ ID NO: 2310717 - RNA, 14 nt, Yersinia pestis KIM
gaaagcaggucgcc

SEQ ID NO: 2310718 - RNA, 15 nt, Yersinia pestis KIM
gaaacugucagucaa

SEQ ID NO: 2310719 - RNA, 23 nt, Yersinia pestis KIM
gaaacuggagaucugcuguaggu

SEQ ID NO: 2310720 - RNA, 14 nt, Yersinia pestis KIM
gaaacuucaaaauc

SEQ ID NO: 2310721 - RNA, 19 nt, Yersinia pestis KIM
gaaaaugaucaucaagcca

SEQ ID NO: 2310722 - RNA, 14 nt, Yersinia pestis KIM
gaaaaugauuuaau

SEQ ID NO: 2310723 - RNA, 14 nt, Yersinia pestis KIM
gaaaaucaugaaau

SEQ ID NO: 2310724 - RNA, 19 nt, Yersinia pestis KIM
gaaauaaaugacuaucccu

SEQ ID NO: 2310725 - RNA, 20 nt, Yersinia pestis KIM
gaaauaaucauaucaaaaua

SEQ ID NO: 2310726 - RNA, 13 nt, Yersinia pestis KIM
gaaauaaauaagu

SEQ ID NO: 2310727 - RNA, 17 nt, Yersinia pestis KIM
gaaagcguauuaucugc

SEQ ID NO: 2310728 - RNA, 17 nt, Yersinia pestis KIM
gaaauagcgccugcccu

SEQ ID NO: 2310729 - RNA, 15 nt, Yersinia pestis KIM
gaaauagcaacuaaa

SEQ ID NO: 2310730 - RNA, 20 nt, Yersinia pestis KIM
gaaauacuuauuugaaacag

SEQ ID NO: 2310731 - RNA, 13 nt, Yersinia pestis KIM
gaaauacuuauuu

SEQ ID NO: 2310732 - RNA, 14 nt, Yersinia pestis KIM
gaaauaccccucac

SEQ ID NO: 2310733 - RNA, 17 nt, Yersinia pestis KIM
gaaauacagaaaaauag

SEQ ID NO: 2310734 - RNA, 22 nt, Yersinia pestis KIM
gacaggcuaacaacuaacgauu

SEQ ID NO: 2310735 - RNA, 18 nt, Yersinia pestis KIM
gacaggcucagcacaaac

SEQ ID NO: 2310736 - RNA, 21 nt, Yersinia pestis KIM
gacaguaaccgggcuugauua

SEQ ID NO: 2310737 - RNA, 17 nt, Yersinia pestis KIM
gacagauccugccgccu

SEQ ID NO: 2310738 - RNA, 21 nt, Yersinia pestis KIM
gacagcauacauccuaaauaa

SEQ ID NO: 2310739 - RNA, 17 nt, Yersinia pestis KIM
gacacccguacgaauuu

SEQ ID NO: 2310740 - RNA, 18 nt, Yersinia pestis KIM
gacaccgccagcaacagc

SEQ ID NO: 2310741 - RNA, 16 nt, Yersinia pestis KIM
gacaccggggauccau

SEQ ID NO: 2310742 - RNA, 22 nt, Yersinia pestis KIM
gacauccgcuugcagcaacagg

SEQ ID NO: 2310743 - RNA, 14 nt, Yersinia pestis KIM
gacaugcucuucug

SEQ ID NO: 2310744 - RNA, 17 nt, Yersinia pestis KIM
gacaguauuugcagugg

SEQ ID NO: 2310745 - RNA, 17 nt, Yersinia pestis KIM
gaccaauauaaaagcca

SEQ ID NO: 2310746 - RNA, 19 nt, Yersinia pestis KIM
gaccaauauaaaagccagc

SEQ ID NO: 2310747 - RNA, 16 nt, Yersinia pestis KIM
gaccaauucaucagcg

SEQ ID NO: 2310748 - RNA, 19 nt, Yersinia pestis KIM
gaccaauugguaagaaugg

SEQ ID NO: 2310749 - RNA, 18 nt, Yersinia pestis KIM
gacauuuuucuauuucug

SEQ ID NO: 2310750 - RNA, 12 nt, Yersinia pestis KIM
gacauuuucuau

SEQ ID NO: 2310751 - RNA, 22 nt, Yersinia pestis KIM
gacauuugcaacuuccuugauu

SEQ ID NO: 2310752 - RNA, 17 nt, Yersinia pestis KIM
gaccgcguaagccgugc

SEQ ID NO: 2310753 - RNA, 23 nt, Yersinia pestis KIM
gaccgcuguuugauuaaaacccc

SEQ ID NO: 2310754 - RNA, 22 nt, Yersinia pestis KIM
gaccgccagugccgcggcggcc

SEQ ID NO: 2310755 - RNA, 14 nt, Yersinia pestis KIM
gaccgccagugccg

SEQ ID NO: 2310756 - RNA, 21 nt, Yersinia pestis KIM
gaccgcgacacaagccauuuc

SEQ ID NO: 2310757 - RNA, 20 nt, Yersinia pestis KIM
gaccccuucuuccagcauca

SEQ ID NO: 2310758 - RNA, 23 nt, Yersinia pestis KIM
gaccaucccccauggggccaccu

SEQ ID NO: 2310759 - RNA, 20 nt, Yersinia pestis KIM
gaccaccgauacgcgcaccg

SEQ ID NO: 2310760 - RNA, 13 nt, Yersinia pestis KIM
gaccaccgcagca

SEQ ID NO: 2310761 - RNA, 16 nt, Yersinia pestis KIM
gacgccacaccacguu

SEQ ID NO: 2310762 - RNA, 23 nt, Yersinia pestis KIM
gacgccccgaaccauuuaccauc

SEQ ID NO: 2310763 - RNA, 13 nt, Yersinia pestis KIM
gacgcaguaagau

SEQ ID NO: 2310764 - RNA, 14 nt, Yersinia pestis KIM
gacgauaaauucaa

SEQ ID NO: 2310765 - RNA, 23 nt, Yersinia pestis KIM
gacgauaacuuuuggcagcacca

SEQ ID NO: 2310766 - RNA, 16 nt, Yersinia pestis KIM
gaccuggaagaacagc

SEQ ID NO: 2310767 - RNA, 19 nt, Yersinia pestis KIM
gacgaaauagcgccugccc

SEQ ID NO: 2310768 - RNA, 17 nt, Yersinia pestis KIM
gacgaacagugccaaca

SEQ ID NO: 2310769 - RNA, 13 nt, Yersinia pestis KIM
gacgaacagcccc

SEQ ID NO: 2310770 - RNA, 19 nt, Yersinia pestis KIM
gaccuguagcuuuuuaaau

SEQ ID NO: 2310771 - RNA, 15 nt, Yersinia pestis KIM
gaccuugauucucaa

SEQ ID NO: 2310772 - RNA, 16 nt, Yersinia pestis KIM
gaccugugcaccacac

SEQ ID NO: 2310773 - RNA, 13 nt, Yersinia pestis KIM
gaccuugguaucu

SEQ ID NO: 2310774 - RNA, 17 nt, Yersinia pestis KIM
gacggaauccaacaucc

SEQ ID NO: 2310775 - RNA, 22 nt, Yersinia pestis KIM
gacggagaaucgcuggacaaug

SEQ ID NO: 2310776 - RNA, 20 nt, Yersinia pestis KIM
gacgccguaaauacauccau

SEQ ID NO: 2310777 - RNA, 13 nt, Yersinia pestis KIM
gacgcuuauccug

SEQ ID NO: 2310778 - RNA, 12 nt, Yersinia pestis KIM
gacggcggcgga

SEQ ID NO: 2310779 - RNA, 16 nt, Yersinia pestis KIM
gacgguacugaaaucc

SEQ ID NO: 2310780 - RNA, 14 nt, Yersinia pestis KIM
gacgucauaaaaag

SEQ ID NO: 2310781 - RNA, 16 nt, Yersinia pestis KIM
gacguuauuauugauu

SEQ ID NO: 2310782 - RNA, 18 nt, Yersinia pestis KIM
gacgugugcuguaagaaa

SEQ ID NO: 2310783 - RNA, 17 nt, Yersinia pestis KIM
gacuaaggcaaccugag

SEQ ID NO: 2310784 - RNA, 20 nt, Yersinia pestis KIM
gacuaacagaauauugacac

SEQ ID NO: 2310785 - RNA, 15 nt, Yersinia pestis KIM
gacuaaccaagccau

SEQ ID NO: 2310786 - RNA, 16 nt, Yersinia pestis KIM
gacuaaccaagccauc

SEQ ID NO: 2310787 - RNA, 17 nt, Yersinia pestis KIM
gacuaaccaagccaucg

SEQ ID NO: 2310788 - RNA, 14 nt, Yersinia pestis KIM
gacuaaccucugca

SEQ ID NO: 2310789 - RNA, 17 nt, Yersinia pestis KIM
gacguucaggccugcac

SEQ ID NO: 2310790 - RNA, 16 nt, Yersinia pestis KIM
gacuaaaauucaaaca

SEQ ID NO: 2310791 - RNA, 19 nt, Yersinia pestis KIM
gacuauucccuuguuugcg

SEQ ID NO: 2310792 - RNA, 15 nt, Yersinia pestis KIM
gacuauuuaaauaca

SEQ ID NO: 2310793 - RNA, 17 nt, Yersinia pestis KIM
gacuaccaaccgcuuua

SEQ ID NO: 2310794 - RNA, 20 nt, Yersinia pestis KIM
gacuacggcuacagcgucag

SEQ ID NO: 2310795 - RNA, 15 nt, Yersinia pestis KIM
gacuacuggcugggg

SEQ ID NO: 2310796 - RNA, 17 nt, Yersinia pestis KIM
gacuacugucuuuuuug

SEQ ID NO: 2310797 - RNA, 18 nt, Yersinia pestis KIM
gaaugaaguucaccagcu

SEQ ID NO: 2310798 - RNA, 12 nt, Yersinia pestis KIM
gaaugagaugaa

SEQ ID NO: 2310799 - RNA, 20 nt, Yersinia pestis KIM
gaaugacgcggguuuugccg

SEQ ID NO: 2310800 - RNA, 14 nt, Yersinia pestis KIM
gaaugguuuuucag

SEQ ID NO: 2310801 - RNA, 12 nt, Yersinia pestis KIM
gaaugugagugu

SEQ ID NO: 2310802 - RNA, 15 nt, Yersinia pestis KIM
gaaugugaagagcgg

SEQ ID NO: 2310803 - RNA, 14 nt, Yersinia pestis KIM
gaaugaggcugagg

SEQ ID NO: 2310804 - RNA, 14 nt, Yersinia pestis KIM
gaauagagccucua

SEQ ID NO: 2310805 - RNA, 19 nt, Yersinia pestis KIM
gaauagccaagccuuguaa

SEQ ID NO: 2310806 - RNA, 20 nt, Yersinia pestis KIM
gaauagccaagccuuguaac

SEQ ID NO: 2310807 - RNA, 19 nt, Yersinia pestis KIM
gaauagaucccauacccac

SEQ ID NO: 2310808 - RNA, 17 nt, Yersinia pestis KIM
aaagauuucaucauuca

SEQ ID NO: 2310809 - RNA, 22 nt, Yersinia pestis KIM
aaagauuucaucauucaauacc

SEQ ID NO: 2310810 - RNA, 18 nt, Yersinia pestis KIM
aaagauuauguagauccc

SEQ ID NO: 2310811 - RNA, 12 nt, Yersinia pestis KIM
aaagauuaagac

SEQ ID NO: 2310812 - RNA, 16 nt, Yersinia pestis KIM
aaagauucauaaaaaa

SEQ ID NO: 2310813 - RNA, 20 nt, Yersinia pestis KIM
aaagauucauaaaaaaagaa

SEQ ID NO: 2310814 - RNA, 22 nt, Yersinia pestis KIM
gaaucagcggcggcgcugauuc

SEQ ID NO: 2310815 - RNA, 19 nt, Yersinia pestis KIM
gaaucagccccaagcuuag

SEQ ID NO: 2310816 - RNA, 14 nt, Yersinia pestis KIM
gaauccagccaugc

SEQ ID NO: 2310817 - RNA, 20 nt, Yersinia pestis KIM
gaaucauaaugguaccggca

SEQ ID NO: 2310818 - RNA, 23 nt, Yersinia pestis KIM
gaaucccaucaaacgugaaauug

SEQ ID NO: 2310819 - RNA, 19 nt, Yersinia pestis KIM
gaauuaagaagccucauga

SEQ ID NO: 2310820 - RNA, 13 nt, Yersinia pestis KIM
gaauuaaauuuua

SEQ ID NO: 2310821 - RNA, 20 nt, Yersinia pestis KIM
gaauuaagaagccucaugaa

SEQ ID NO: 2310822 - RNA, 14 nt, Yersinia pestis KIM
gaauuaacauacaa

SEQ ID NO: 2310823 - RNA, 16 nt, Yersinia pestis KIM
gaauuaauaacaguau

SEQ ID NO: 2310824 - RNA, 18 nt, Yersinia pestis KIM
gaauuauaacuauuaucu

SEQ ID NO: 2310825 - RNA, 19 nt, Yersinia pestis KIM
gaauuuaagauaccagcga

SEQ ID NO: 2310826 - RNA, 19 nt, Yersinia pestis KIM
gaauuuaugcaccaaauuc

SEQ ID NO: 2310827 - RNA, 23 nt, Yersinia pestis KIM
gacaaaaaauaguuguuagccac

SEQ ID NO: 2310828 - RNA, 19 nt, Yersinia pestis KIM
gacaaaagugucauuugga

SEQ ID NO: 2310829 - RNA, 22 nt, Yersinia pestis KIM
gacaaaaucccccaccaguaaa

SEQ ID NO: 2310830 - RNA, 18 nt, Yersinia pestis KIM
gacaaaccccgaugacgc

SEQ ID NO: 2310831 - RNA, 15 nt, Yersinia pestis KIM
gacaaaccccgauaa

SEQ ID NO: 2310832 - RNA, 14 nt, Yersinia pestis KIM
gacacaacacauua

SEQ ID NO: 2310833 - RNA, 17 nt, Yersinia pestis KIM
gacaccaagaggcugcg

SEQ ID NO: 2310834 - RNA, 21 nt, Yersinia pestis KIM
gacaaucuguuccugauucca

SEQ ID NO: 2310835 - RNA, 21 nt, Yersinia pestis KIM
gacaauaccgccacacaauac

SEQ ID NO: 2310836 - RNA, 14 nt, Yersinia pestis KIM
gacaaugacugugc

SEQ ID NO: 2310837 - RNA, 16 nt, Yersinia pestis KIM
gaagggguucuuccaa

SEQ ID NO: 2310838 - RNA, 14 nt, Yersinia pestis KIM
gaagggggcuuauu

SEQ ID NO: 2310839 - RNA, 19 nt, Yersinia pestis KIM
gaaggguauugaagauacc

SEQ ID NO: 2310840 - RNA, 18 nt, Yersinia pestis KIM
gaaguacaguaccugcua

SEQ ID NO: 2310841 - RNA, 13 nt, Yersinia pestis KIM
gaaguacuuauuu

SEQ ID NO: 2310842 - RNA, 17 nt, Yersinia pestis KIM
gaagguaaucagacugc

SEQ ID NO: 2310843 - RNA, 11 nt, Yersinia pestis KIM
gaaggcacggc

SEQ ID NO: 2310844 - RNA, 18 nt, Yersinia pestis KIM
gaaggcacccaugcuccc

SEQ ID NO: 2310845 - RNA, 21 nt, Yersinia pestis KIM
gaaggcacccaugcucccucc

SEQ ID NO: 2310846 - RNA, 14 nt, Yersinia pestis KIM
gaaggauugaccaa

SEQ ID NO: 2310847 - RNA, 18 nt, Yersinia pestis KIM
gaauaccauaacgcugcu

SEQ ID NO: 2310848 - RNA, 17 nt, Yersinia pestis KIM
gaauacagguacuucaa

SEQ ID NO: 2310849 - RNA, 18 nt, Yersinia pestis KIM
gaauaauccaagccaugg

SEQ ID NO: 2310850 - RNA, 21 nt, Yersinia pestis KIM
gaauaacuucgcgaacacaau

SEQ ID NO: 2310851 - RNA, 11 nt, Yersinia pestis KIM
gaauaauacug

SEQ ID NO: 2310852 - RNA, 13 nt, Yersinia pestis KIM
gaauaaacagcag

SEQ ID NO: 2310853 - RNA, 12 nt, Yersinia pestis KIM
gaauaaaagaga

SEQ ID NO: 2310854 - RNA, 23 nt, Yersinia pestis KIM
gaauaaaaccuugcgccaagucc

SEQ ID NO: 2310855 - RNA, 16 nt, Yersinia pestis KIM
aaagauccccacaaaa

SEQ ID NO: 2310856 - RNA, 15 nt, Yersinia pestis KIM
gaagcguaaagcacc

SEQ ID NO: 2310857 - RNA, 15 nt, Yersinia pestis KIM
gaagcggccagguuc

SEQ ID NO: 2310858 - RNA, 12 nt, Yersinia pestis KIM
gaagcaagaaac

SEQ ID NO: 2310859 - RNA, 13 nt, Yersinia pestis KIM
gaagcaagaaacu

SEQ ID NO: 2310860 - RNA, 16 nt, Yersinia pestis KIM
gaagcaaucaggaaau

SEQ ID NO: 2310861 - RNA, 21 nt, Yersinia pestis KIM
gaagaguugauccgauaaacu

SEQ ID NO: 2310862 - RNA, 12 nt, Yersinia pestis KIM
gaacuuacuccc

SEQ ID NO: 2310863 - RNA, 19 nt, Yersinia pestis KIM
gaacuucgaaagaaauaaa

SEQ ID NO: 2310864 - RNA, 13 nt, Yersinia pestis KIM
gaacuucgaaaga

SEQ ID NO: 2310865 - RNA, 22 nt, Yersinia pestis KIM
gaagaaaagagucgcuuuggga

SEQ ID NO: 2310866 - RNA, 13 nt, Yersinia pestis KIM
gaagacuuccagc

SEQ ID NO: 2310867 - RNA, 15 nt, Yersinia pestis KIM
gaagaacaaauucau

SEQ ID NO: 2310868 - RNA, 17 nt, Yersinia pestis KIM
aaagagggucacaagaa

SEQ ID NO: 2310869 - RNA, 17 nt, Yersinia pestis KIM
cuguccaagaagccaag

SEQ ID NO: 2310870 - RNA, 17 nt, Yersinia pestis KIM
cuguccaguugcuggaa

SEQ ID NO: 2310871 - RNA, 20 nt, Yersinia pestis KIM
cugucacuguugcgggcauc

SEQ ID NO: 2310872 - RNA, 14 nt, Yersinia pestis KIM
aaacugccuauuua

SEQ ID NO: 2310873 - RNA, 16 nt, Yersinia pestis KIM
aaacugcgcuuccagc

SEQ ID NO: 2310874 - RNA, 20 nt, Yersinia pestis KIM
cugucaaucgaugagcuggu

SEQ ID NO: 2310875 - RNA, 15 nt, Yersinia pestis KIM
aaacugaaaaguuuc

SEQ ID NO: 2310876 - RNA, 15 nt, Yersinia pestis KIM
aaacugaaguuaaaa

SEQ ID NO: 2310877 - RNA, 15 nt, Yersinia pestis KIM
aaacugaaaaaggca

SEQ ID NO: 2310878 - RNA, 22 nt, Yersinia pestis KIM
aaacugaaguuaaaaagccuga

SEQ ID NO: 2310879 - RNA, 16 nt, Yersinia pestis KIM
aaacugauaaagcaaa

SEQ ID NO: 2310880 - RNA, 14 nt, Yersinia pestis KIM
cuguagaacaccug

SEQ ID NO: 2310881 - RNA, 18 nt, Yersinia pestis KIM
cuguagaacaccugccuu

SEQ ID NO: 2310882 - RNA, 23 nt, Yersinia pestis KIM
cuguagaagugcaggcuaccaga

SEQ ID NO: 2310883 - RNA, 16 nt, Yersinia pestis KIM
cuguacugggaugaag

SEQ ID NO: 2310884 - RNA, 14 nt, Yersinia pestis KIM
cuguauaaaaauag

SEQ ID NO: 2310885 - RNA, 14 nt, Yersinia pestis KIM
cuguauaaaagaau

SEQ ID NO: 2310886 - RNA, 17 nt, Yersinia pestis KIM
cuguauaaaagaaugaa

SEQ ID NO: 2310887 - RNA, 23 nt, Yersinia pestis KIM
cuguaguucaauggucaugcaca

SEQ ID NO: 2310888 - RNA, 17 nt, Yersinia pestis KIM
cuguagcuuuuuaaaua

SEQ ID NO: 2310889 - RNA, 14 nt, Yersinia pestis KIM
cuguauguguuugu

SEQ ID NO: 2310890 - RNA, 10 nt, Yersinia pestis KIM
cuguaugccu

SEQ ID NO: 2310891 - RNA, 15 nt, Yersinia pestis KIM
cugucaaaaagcacc

SEQ ID NO: 2310892 - RNA, 13 nt, Yersinia pestis KIM
aaacucuaagggu

SEQ ID NO: 2310893 - RNA, 19 nt, Yersinia pestis KIM
cugugccaaugccucuuca

SEQ ID NO: 2310894 - RNA, 21 nt, Yersinia pestis KIM
cugugccaacaucgcgcugcu

SEQ ID NO: 2310895 - RNA, 17 nt, Yersinia pestis KIM
cugugaaucuuuuugcu

SEQ ID NO: 2310896 - RNA, 16 nt, Yersinia pestis KIM
cugugacacgagaagg

SEQ ID NO: 2310897 - RNA, 14 nt, Yersinia pestis KIM
cugugagcgcagac

SEQ ID NO: 2310898 - RNA, 17 nt, Yersinia pestis KIM
cugugaucgcugccgca

SEQ ID NO: 2310899 - RNA, 20 nt, Yersinia pestis KIM
cugugauuucagccaggcga

SEQ ID NO: 2310900 - RNA, 14 nt, Yersinia pestis KIM
cugugcggcaguga

SEQ ID NO: 2310901 - RNA, 19 nt, Yersinia pestis KIM
cugugcggcagugaacguu

SEQ ID NO: 2310902 - RNA, 18 nt, Yersinia pestis KIM
cugugcuuugccauucug

SEQ ID NO: 2310903 - RNA, 19 nt, Yersinia pestis KIM
cuguggagguggugguaau

SEQ ID NO: 2310904 - RNA, 15 nt, Yersinia pestis KIM
cuguggcaugacuga

SEQ ID NO: 2310905 - RNA, 14 nt, Yersinia pestis KIM
cugucggagccuga

SEQ ID NO: 2310906 - RNA, 20 nt, Yersinia pestis KIM
cugucggaagagauagagca

SEQ ID NO: 2310907 - RNA, 18 nt, Yersinia pestis KIM
cugucggcgaugaaaaac

SEQ ID NO: 2310908 - RNA, 15 nt, Yersinia pestis KIM
cugucggcgcagcaa

SEQ ID NO: 2310909 - RNA, 16 nt, Yersinia pestis KIM
cugucgcauaagacaa

SEQ ID NO: 2310910 - RNA, 20 nt, Yersinia pestis KIM
cugucgauuuguggauaacu

SEQ ID NO: 2310911 - RNA, 13 nt, Yersinia pestis KIM
cugucuauugauu

SEQ ID NO: 2310912 - RNA, 16 nt, Yersinia pestis KIM
cugucugcuguugcca

SEQ ID NO: 2310913 - RNA, 17 nt, Yersinia pestis KIM
cugucugcuguugccac

SEQ ID NO: 2310914 - RNA, 21 nt, Yersinia pestis KIM
cugucuuaggugacaggcaaa

SEQ ID NO: 2310915 - RNA, 13 nt, Yersinia pestis KIM
cugucuuauuuuu

SEQ ID NO: 2310916 - RNA, 17 nt, Yersinia pestis KIM
cugucuuuuaaugaugc

SEQ ID NO: 2310917 - RNA, 22 nt, Yersinia pestis KIM
cuggguuuuauugcaacugggc

SEQ ID NO: 2310918 - RNA, 15 nt, Yersinia pestis KIM
cugggugugcguaca

SEQ ID NO: 2310919 - RNA, 21 nt, Yersinia pestis KIM
cugggucgugagucagguggc

SEQ ID NO: 2310920 - RNA, 14 nt, Yersinia pestis KIM
cugggucaucaccc

SEQ ID NO: 2310921 - RNA, 22 nt, Yersinia pestis KIM
cugggguauguaaugccacacu

SEQ ID NO: 2310922 - RNA, 21 nt, Yersinia pestis KIM
cuggguaauucauuauuacuc

SEQ ID NO: 2310923 - RNA, 16 nt, Yersinia pestis KIM
cugggcugauggucau

SEQ ID NO: 2310924 - RNA, 23 nt, Yersinia pestis KIM
cugggggugagcaagggcagcua

SEQ ID NO: 2310925 - RNA, 20 nt, Yersinia pestis KIM
cuggucgggugcaggccauu

SEQ ID NO: 2310926 - RNA, 21 nt, Yersinia pestis KIM
cuggucuuaaucauuuguuuc

SEQ ID NO: 2310927 - RNA, 21 nt, Yersinia pestis KIM
cuggucacuaaaacugaagca

SEQ ID NO: 2310928 - RNA, 21 nt, Yersinia pestis KIM
cuggucauaaucaucugcucc

SEQ ID NO: 2310929 - RNA, 19 nt, Yersinia pestis KIM
cugguagucauauucaggc

SEQ ID NO: 2310930 - RNA, 14 nt, Yersinia pestis KIM
cugguaccaaucuc

SEQ ID NO: 2310931 - RNA, 17 nt, Yersinia pestis KIM
cugguagcugcucacga

SEQ ID NO: 2310932 - RNA, 15 nt, Yersinia pestis KIM
cugguagccugcacu

SEQ ID NO: 2310933 - RNA, 12 nt, Yersinia pestis KIM
cuguaccaccac

SEQ ID NO: 2310934 - RNA, 17 nt, Yersinia pestis KIM
cuguaauugcgucaggg

SEQ ID NO: 2310935 - RNA, 13 nt, Yersinia pestis KIM
cuguaauuaauua

SEQ ID NO: 2310936 - RNA, 18 nt, Yersinia pestis KIM
cuguaauuaauuauaagc

SEQ ID NO: 2310937 - RNA, 13 nt, Yersinia pestis KIM
cuguaauccggca

SEQ ID NO: 2310938 - RNA, 19 nt, Yersinia pestis KIM
cuguaaugccccacuucac

SEQ ID NO: 2310939 - RNA, 13 nt, Yersinia pestis KIM
cuguaaccgccug

SEQ ID NO: 2310940 - RNA, 19 nt, Yersinia pestis KIM
cuguaaccucacgccaccu

SEQ ID NO: 2310941 - RNA, 13 nt, Yersinia pestis KIM
cuguaaucaccag

SEQ ID NO: 2310942 - RNA, 17 nt, Yersinia pestis KIM
cuguaaaggcaaagaag

SEQ ID NO: 2310943 - RNA, 14 nt, Yersinia pestis KIM
cuguaaauaaauaa

SEQ ID NO: 2310944 - RNA, 23 nt, Yersinia pestis KIM
cuguaaaauaccaauuaauaaga

SEQ ID NO: 2310945 - RNA, 13 nt, Yersinia pestis KIM
cugguggcugaga

SEQ ID NO: 2310946 - RNA, 19 nt, Yersinia pestis KIM
cugguggcuugggcuucac

SEQ ID NO: 2310947 - RNA, 23 nt, Yersinia pestis KIM
cuggugucacaaucucuggcaac

SEQ ID NO: 2310948 - RNA, 14 nt, Yersinia pestis KIM
cugguugcuguucu

SEQ ID NO: 2310949 - RNA, 13 nt, Yersinia pestis KIM
cuuccgccgccaa

SEQ ID NO: 2310950 - RNA, 23 nt, Yersinia pestis KIM
cuuccgccucuuuuuccacaccc

SEQ ID NO: 2310951 - RNA, 14 nt, Yersinia pestis KIM
cuuccgccagcaga

SEQ ID NO: 2310952 - RNA, 18 nt, Yersinia pestis KIM
cuuccuugcucucuucau

SEQ ID NO: 2310953 - RNA, 17 nt, Yersinia pestis KIM
cuuccuugauuuucauu

SEQ ID NO: 2310954 - RNA, 19 nt, Yersinia pestis KIM
cuuccuugauuuucauuuc

SEQ ID NO: 2310955 - RNA, 19 nt, Yersinia pestis KIM
cuucgcccuguaaagccag

SEQ ID NO: 2310956 - RNA, 22 nt, Yersinia pestis KIM
cuucgcaaugauuacaucacuu

SEQ ID NO: 2310957 - RNA, 16 nt, Yersinia pestis KIM
cuucgaaagaaauaaa

SEQ ID NO: 2310958 - RNA, 16 nt, Yersinia pestis KIM
cuucgcaaaauuuaua

SEQ ID NO: 2310959 - RNA, 18 nt, Yersinia pestis KIM
cuucccauagacggcgaa

SEQ ID NO: 2310960 - RNA, 14 nt, Yersinia pestis KIM
cuuccaucaggaag

SEQ ID NO: 2310961 - RNA, 14 nt, Yersinia pestis KIM
cuuccauuucugcc

SEQ ID NO: 2310962 - RNA, 13 nt, Yersinia pestis KIM
cuuccauuaccug

SEQ ID NO: 2310963 - RNA, 23 nt, Yersinia pestis KIM
cuuccaugacacauauuucaggc

SEQ ID NO: 2310964 - RNA, 16 nt, Yersinia pestis KIM
cuuccaugacacauau

SEQ ID NO: 2310965 - RNA, 23 nt, Yersinia pestis KIM
cuuccacacaaacgcauucauau

SEQ ID NO: 2310966 - RNA, 22 nt, Yersinia pestis KIM
cuuccaauuggugcuuuaugua

SEQ ID NO: 2310967 - RNA, 15 nt, Yersinia pestis KIM
cuuccaacuugccgc

SEQ ID NO: 2310968 - RNA, 21 nt, Yersinia pestis KIM
cuuccaacucaccuaaaucau

SEQ ID NO: 2310969 - RNA, 13 nt, Yersinia pestis KIM
aaacuuaauuuca

SEQ ID NO: 2310970 - RNA, 19 nt, Yersinia pestis KIM
cuucaccgcuuuucuggua

SEQ ID NO: 2310971 - RNA, 16 nt, Yersinia pestis KIM
cuucaccgcuuuucug

SEQ ID NO: 2310972 - RNA, 12 nt, Yersinia pestis KIM
cuucacaucaua

SEQ ID NO: 2310973 - RNA, 12 nt, Yersinia pestis KIM
cuucacacuggu

SEQ ID NO: 2310974 - RNA, 14 nt, Yersinia pestis KIM
cuucaauuuugugg

SEQ ID NO: 2310975 - RNA, 21 nt, Yersinia pestis KIM
cuuauucccacuuauuauaaa

SEQ ID NO: 2310976 - RNA, 17 nt, Yersinia pestis KIM
cuuauucuaauugauau

SEQ ID NO: 2310977 - RNA, 23 nt, Yersinia pestis KIM
cuuauucuaauugauauuauuua

SEQ ID NO: 2310978 - RNA, 23 nt, Yersinia pestis KIM
cuucaauaagaaugacuuuccuu

SEQ ID NO: 2310979 - RNA, 17 nt, Yersinia pestis KIM
cuucaauaccaaauuua

SEQ ID NO: 2310980 - RNA, 14 nt, Yersinia pestis KIM
cuucaagguacuga

SEQ ID NO: 2310981 - RNA, 19 nt, Yersinia pestis KIM
cuucagcgguagagaucuc

SEQ ID NO: 2310982 - RNA, 18 nt, Yersinia pestis KIM
cuucagccuauccucacc

SEQ ID NO: 2310983 - RNA, 19 nt, Yersinia pestis KIM
cuucagccgcucaucaucc

SEQ ID NO: 2310984 - RNA, 20 nt, Yersinia pestis KIM
cuucagcccauggcugaaau

SEQ ID NO: 2310985 - RNA, 22 nt, Yersinia pestis KIM
cuucagacaguaaauccugaug

SEQ ID NO: 2310986 - RNA, 13 nt, Yersinia pestis KIM
cuucagacugaaa

SEQ ID NO: 2310987 - RNA, 23 nt, Yersinia pestis KIM
cuucagacugaaaguagaaauaa

SEQ ID NO: 2310988 - RNA, 15 nt, Yersinia pestis KIM
cuuccaaaggaaggg

SEQ ID NO: 2310989 - RNA, 13 nt, Yersinia pestis KIM
cuuccaaaggaag

SEQ ID NO: 2310990 - RNA, 14 nt, Yersinia pestis KIM
cuucauguuuauca

SEQ ID NO: 2310991 - RNA, 15 nt, Yersinia pestis KIM
cuucaucuaaauauu

SEQ ID NO: 2310992 - RNA, 16 nt, Yersinia pestis KIM
cuucaucugcacuggu

SEQ ID NO: 2310993 - RNA, 10 nt, Yersinia pestis KIM
cuuaauaaua

SEQ ID NO: 2310994 - RNA, 14 nt, Yersinia pestis KIM
cuuaauaauaucaa

SEQ ID NO: 2310995 - RNA, 15 nt, Yersinia pestis KIM
cuuaauaauaucaaa

SEQ ID NO: 2310996 - RNA, 19 nt, Yersinia pestis KIM
cuuaauaauaucaaauguc

SEQ ID NO: 2310997 - RNA, 12 nt, Yersinia pestis KIM
cuuaauaaugac

SEQ ID NO: 2310998 - RNA, 11 nt, Yersinia pestis KIM
cuuaauuuuau

SEQ ID NO: 2310999 - RNA, 13 nt, Yersinia pestis KIM
cuuaauuuuauca

SEQ ID NO: 2311000 - RNA, 23 nt, Yersinia pestis KIM
cuuaauuggcggaagacuuccag

SEQ ID NO: 2311001 - RNA, 16 nt, Yersinia pestis KIM
cuuaauuuaaauaaga

SEQ ID NO: 2311002 - RNA, 21 nt, Yersinia pestis KIM
cuuaagcauuggcaaaucauc

SEQ ID NO: 2311003 - RNA, 23 nt, Yersinia pestis KIM
cuuacguuuugagguuuuaccaa

SEQ ID NO: 2311004 - RNA, 23 nt, Yersinia pestis KIM
cuuacgcuguaugccgcucaagg

SEQ ID NO: 2311005 - RNA, 16 nt, Yersinia pestis KIM
cuuacuaaaauaucac

SEQ ID NO: 2311006 - RNA, 15 nt, Yersinia pestis KIM
cuuagucauuaagaa

SEQ ID NO: 2311007 - RNA, 15 nt, Yersinia pestis KIM
cuuacuuuuuacggc

SEQ ID NO: 2311008 - RNA, 15 nt, Yersinia pestis KIM
cuuacuuuuuugccu

SEQ ID NO: 2311009 - RNA, 18 nt, Yersinia pestis KIM
cuuacuuuuuugccugcu

SEQ ID NO: 2311010 - RNA, 23 nt, Yersinia pestis KIM
cuuacuuuuuugccugcucagcu

SEQ ID NO: 2311011 - RNA, 14 nt, Yersinia pestis KIM
cuuauccacagcau

SEQ ID NO: 2311012 - RNA, 19 nt, Yersinia pestis KIM
cuuaucccuccaucaagcc

SEQ ID NO: 2311013 - RNA, 18 nt, Yersinia pestis KIM
cuuaucauaauccaacuc

SEQ ID NO: 2311014 - RNA, 18 nt, Yersinia pestis KIM
cuuauuaauuaaugaaau

SEQ ID NO: 2311015 - RNA, 23 nt, Yersinia pestis KIM
cuuaucuuuucugauuuuuuacu

SEQ ID NO: 2311016 - RNA, 16 nt, Yersinia pestis KIM
cuguuugcuguaaaca

SEQ ID NO: 2311017 - RNA, 22 nt, Yersinia pestis KIM
cuguuuuaaaaaaaaagaaaau

SEQ ID NO: 2311018 - RNA, 20 nt, Yersinia pestis KIM
cuguuggugauauaaaucca

SEQ ID NO: 2311019 - RNA, 15 nt, Yersinia pestis KIM
cuguuggcuccugag

SEQ ID NO: 2311020 - RNA, 21 nt, Yersinia pestis KIM
cuguuguaguuagaugacauc

SEQ ID NO: 2311021 - RNA, 19 nt, Yersinia pestis KIM
cuguuguaacacuugacca

SEQ ID NO: 2311022 - RNA, 15 nt, Yersinia pestis KIM
cuguugccacagacg

SEQ ID NO: 2311023 - RNA, 12 nt, Yersinia pestis KIM
cuguugccaugc

SEQ ID NO: 2311024 - RNA, 11 nt, Yersinia pestis KIM
cuguugccccc

SEQ ID NO: 2311025 - RNA, 18 nt, Yersinia pestis KIM
cuguugcaugaaaucagu

SEQ ID NO: 2311026 - RNA, 12 nt, Yersinia pestis KIM
cuguugcuucac

SEQ ID NO: 2311027 - RNA, 15 nt, Yersinia pestis KIM
cuguuggcaauuuca

SEQ ID NO: 2311028 - RNA, 17 nt, Yersinia pestis KIM
cuuaaaaucuguaauua

SEQ ID NO: 2311029 - RNA, 18 nt, Yersinia pestis KIM
cuuaaaaucuguaauuaa

SEQ ID NO: 2311030 - RNA, 20 nt, Yersinia pestis KIM
cuuaaaaucuguaauuaauu

SEQ ID NO: 2311031 - RNA, 17 nt, Yersinia pestis KIM
cuuaaaauacugccaau

SEQ ID NO: 2311032 - RNA, 18 nt, Yersinia pestis KIM
cuuaacucgccacucaca

SEQ ID NO: 2311033 - RNA, 18 nt, Yersinia pestis KIM
cuuaacguugcaaaugcu

SEQ ID NO: 2311034 - RNA, 19 nt, Yersinia pestis KIM
cuguguuuugagcaucacu

SEQ ID NO: 2311035 - RNA, 13 nt, Yersinia pestis KIM
cuguguuuauacc

SEQ ID NO: 2311036 - RNA, 21 nt, Yersinia pestis KIM
cuguguuugauuaaugccucu

SEQ ID NO: 2311037 - RNA, 16 nt, Yersinia pestis KIM
cuguguuuugagcauc

SEQ ID NO: 2311038 - RNA, 21 nt, Yersinia pestis KIM
cuguuaacuaacgucccauuc

SEQ ID NO: 2311039 - RNA, 23 nt, Yersinia pestis KIM
cugugugggcacucgcaagacga

SEQ ID NO: 2311040 - RNA, 14 nt, Yersinia pestis KIM
cuguguauuuaacc

SEQ ID NO: 2311041 - RNA, 15 nt, Yersinia pestis KIM
cuguguaacugccac

SEQ ID NO: 2311042 - RNA, 14 nt, Yersinia pestis KIM
cugugguggcgguc

SEQ ID NO: 2311043 - RNA, 15 nt, Yersinia pestis KIM
cuguggucaacagug

SEQ ID NO: 2311044 - RNA, 14 nt, Yersinia pestis KIM
cugugguuggcagc

SEQ ID NO: 2311045 - RNA, 16 nt, Yersinia pestis KIM
cuguugaugaguaaac

SEQ ID NO: 2311046 - RNA, 16 nt, Yersinia pestis KIM
cuguucucucccguug

SEQ ID NO: 2311047 - RNA, 12 nt, Yersinia pestis KIM
cuguucucuccg

SEQ ID NO: 2311048 - RNA, 16 nt, Yersinia pestis KIM
cuguucucuguuucca

SEQ ID NO: 2311049 - RNA, 15 nt, Yersinia pestis KIM
cuguuaccaaacauu

SEQ ID NO: 2311050 - RNA, 14 nt, Yersinia pestis KIM
cuguucagaugauc

SEQ ID NO: 2311051 - RNA, 18 nt, Yersinia pestis KIM
cuguuacaucagagcuca

SEQ ID NO: 2311052 - RNA, 20 nt, Yersinia pestis KIM
cuguuaauccuaaugaacac

SEQ ID NO: 2311053 - RNA, 12 nt, Yersinia pestis KIM
cuguuccaggca

SEQ ID NO: 2311054 - RNA, 15 nt, Yersinia pestis KIM
cuggcgcagaguauc

SEQ ID NO: 2311055 - RNA, 17 nt, Yersinia pestis KIM
cuggcgcaacagcgccu

SEQ ID NO: 2311056 - RNA, 14 nt, Yersinia pestis KIM
cuggcgcgcuuugg

SEQ ID NO: 2311057 - RNA, 19 nt, Yersinia pestis KIM
cuggcgcauccccacuugu

SEQ ID NO: 2311058 - RNA, 15 nt, Yersinia pestis KIM
cuggcggauaaaaau

SEQ ID NO: 2311059 - RNA, 20 nt, Yersinia pestis KIM
cuggcggauaacggcggcaa

SEQ ID NO: 2311060 - RNA, 21 nt, Yersinia pestis KIM
cuggccguguuuuucccuacc

SEQ ID NO: 2311061 - RNA, 16 nt, Yersinia pestis KIM
cuggccugagaaccca

SEQ ID NO: 2311062 - RNA, 17 nt, Yersinia pestis KIM
cuggccugagaacccau

SEQ ID NO: 2311063 - RNA, 23 nt, Yersinia pestis KIM
cuggccucuuuacgcucugccug

SEQ ID NO: 2311064 - RNA, 14 nt, Yersinia pestis KIM
cuggcacuggaugu

SEQ ID NO: 2311065 - RNA, 19 nt, Yersinia pestis KIM
cuggcaguaaaacccgccc

SEQ ID NO: 2311066 - RNA, 12 nt, Yersinia pestis KIM
cuggcaggaaau

SEQ ID NO: 2311067 - RNA, 19 nt, Yersinia pestis KIM
aaacucaugacaucccagc

SEQ ID NO: 2311068 - RNA, 21 nt, Yersinia pestis KIM
cuggcuaacuggcggggcaaa

SEQ ID NO: 2311069 - RNA, 22 nt, Yersinia pestis KIM
cuggcguuuuccucgugaaaaa

SEQ ID NO: 2311070 - RNA, 15 nt, Yersinia pestis KIM
cuggcucugcgacca

SEQ ID NO: 2311071 - RNA, 15 nt, Yersinia pestis KIM
cuggcucggcgcgcu

SEQ ID NO: 2311072 - RNA, 20 nt, Yersinia pestis KIM
cugggccacgaugugaagca

SEQ ID NO: 2311073 - RNA, 16 nt, Yersinia pestis KIM
cugggccaucaagcca

SEQ ID NO: 2311074 - RNA, 13 nt, Yersinia pestis KIM
cugggccgaugcc

SEQ ID NO: 2311075 - RNA, 13 nt, Yersinia pestis KIM
cuggcuuucgcuu

SEQ ID NO: 2311076 - RNA, 23 nt, Yersinia pestis KIM
cuggcuuuuucacacgcccaggc

SEQ ID NO: 2311077 - RNA, 13 nt, Yersinia pestis KIM
cugggaaugcacc

SEQ ID NO: 2311078 - RNA, 22 nt, Yersinia pestis KIM
cuggcuuagaucuuuggccccg

SEQ ID NO: 2311079 - RNA, 18 nt, Yersinia pestis KIM
cuggaauggcgcaauagc

SEQ ID NO: 2311080 - RNA, 22 nt, Yersinia pestis KIM
cuggaauggcgcaauagcaucu

SEQ ID NO: 2311081 - RNA, 13 nt, Yersinia pestis KIM
cuggagccauauc

SEQ ID NO: 2311082 - RNA, 22 nt, Yersinia pestis KIM
cuggcaauuucuguuaccagaa

SEQ ID NO: 2311083 - RNA, 14 nt, Yersinia pestis KIM
cuggauauuuuuaa

SEQ ID NO: 2311084 - RNA, 19 nt, Yersinia pestis KIM
cuggaugcucauugguuca

SEQ ID NO: 2311085 - RNA, 15 nt, Yersinia pestis KIM
cuggauggccaucuc

SEQ ID NO: 2311086 - RNA, 21 nt, Yersinia pestis KIM
cuggauaagugaauaacgcug

SEQ ID NO: 2311087 - RNA, 17 nt, Yersinia pestis KIM
cuggauauauuuacaaa

SEQ ID NO: 2311088 - RNA, 16 nt, Yersinia pestis KIM
cugcugguuuuacuga

SEQ ID NO: 2311089 - RNA, 21 nt, Yersinia pestis KIM
cugcugugucgcuauuuccga

SEQ ID NO: 2311090 - RNA, 13 nt, Yersinia pestis KIM
cugcuugcgcguu

SEQ ID NO: 2311091 - RNA, 20 nt, Yersinia pestis KIM
cugcgagcguuuaaauaccc

SEQ ID NO: 2311092 - RNA, 15 nt, Yersinia pestis KIM
cugcgaggccgcugc

SEQ ID NO: 2311093 - RNA, 14 nt, Yersinia pestis KIM
cugcggauaaacac

SEQ ID NO: 2311094 - RNA, 15 nt, Yersinia pestis KIM
cugcgaccaaggcuc

SEQ ID NO: 2311095 - RNA, 23 nt, Yersinia pestis KIM
cugcgaauuagucucuuauucuc

SEQ ID NO: 2311096 - RNA, 22 nt, Yersinia pestis KIM
cugcgugaaacgauaugcucca

SEQ ID NO: 2311097 - RNA, 15 nt, Yersinia pestis KIM
cugcucgcccaagcg

SEQ ID NO: 2311098 - RNA, 20 nt, Yersinia pestis KIM
cugcuccccccgugauaugc

SEQ ID NO: 2311099 - RNA, 22 nt, Yersinia pestis KIM
cugcucccguaaacguucugcc

SEQ ID NO: 2311100 - RNA, 13 nt, Yersinia pestis KIM
cugcuccagccaa

SEQ ID NO: 2311101 - RNA, 19 nt, Yersinia pestis KIM
cugcuccaaagcuuccaau

SEQ ID NO: 2311102 - RNA, 17 nt, Yersinia pestis KIM
cugcuccaaagcuucca

SEQ ID NO: 2311103 - RNA, 15 nt, Yersinia pestis KIM
cugcucauaaagcau

SEQ ID NO: 2311104 - RNA, 14 nt, Yersinia pestis KIM
cugcucauaaagca

SEQ ID NO: 2311105 - RNA, 12 nt, Yersinia pestis KIM
cugcuaauuaaa

SEQ ID NO: 2311106 - RNA, 15 nt, Yersinia pestis KIM
cugcugacaaacccc

SEQ ID NO: 2311107 - RNA, 12 nt, Yersinia pestis KIM
cugcugacaaac

SEQ ID NO: 2311108 - RNA, 13 nt, Yersinia pestis KIM
aaacuauucugcu

SEQ ID NO: 2311109 - RNA, 14 nt, Yersinia pestis KIM
aaacuauucugcuu

SEQ ID NO: 2311110 - RNA, 22 nt, Yersinia pestis KIM
aaacuauucaucccuaaaauca

SEQ ID NO: 2311111 - RNA, 17 nt, Yersinia pestis KIM
cugccaugggaaaucaa

SEQ ID NO: 2311112 - RNA, 18 nt, Yersinia pestis KIM
cugccaugggaaaucaaa

SEQ ID NO: 2311113 - RNA, 19 nt, Yersinia pestis KIM
cugccagcguugcagaguu

SEQ ID NO: 2311114 - RNA, 23 nt, Yersinia pestis KIM
cugccaccggggaggaugguaaa

SEQ ID NO: 2311115 - RNA, 12 nt, Yersinia pestis KIM
cugccacugacu

SEQ ID NO: 2311116 - RNA, 20 nt, Yersinia pestis KIM
cugcaucagcagugacguca

SEQ ID NO: 2311117 - RNA, 21 nt, Yersinia pestis KIM
cugccccgaagcucaagcugg

SEQ ID NO: 2311118 - RNA, 18 nt, Yersinia pestis KIM
cugccccgaagcucaagc

SEQ ID NO: 2311119 - RNA, 22 nt, Yersinia pestis KIM
cugcccccccggguggcgcuga

SEQ ID NO: 2311120 - RNA, 21 nt, Yersinia pestis KIM
cugcccccccgaugacacgau

SEQ ID NO: 2311121 - RNA, 12 nt, Yersinia pestis KIM
cugcccccgacg

SEQ ID NO: 2311122 - RNA, 23 nt, Yersinia pestis KIM
cugccauuuugccugcaauugug

SEQ ID NO: 2311123 - RNA, 18 nt, Yersinia pestis KIM
cugcccaaaauaauguuu

SEQ ID NO: 2311124 - RNA, 14 nt, Yersinia pestis KIM
cugccgccucugcu

SEQ ID NO: 2311125 - RNA, 22 nt, Yersinia pestis KIM
cugccggcguuaaugccacccc

SEQ ID NO: 2311126 - RNA, 17 nt, Yersinia pestis KIM
cugccggcgaagcucuu

SEQ ID NO: 2311127 - RNA, 14 nt, Yersinia pestis KIM
cugccguaaacaau

SEQ ID NO: 2311128 - RNA, 19 nt, Yersinia pestis KIM
cugcaaauuuauccaaucu

SEQ ID NO: 2311129 - RNA, 19 nt, Yersinia pestis KIM
cugauuuuuuguucuuaau

SEQ ID NO: 2311130 - RNA, 23 nt, Yersinia pestis KIM
cugcaaaugggugugaacaguga

SEQ ID NO: 2311131 - RNA, 19 nt, Yersinia pestis KIM
cugcacauacucaccuccc

SEQ ID NO: 2311132 - RNA, 15 nt, Yersinia pestis KIM
cugcaacccacgccc

SEQ ID NO: 2311133 - RNA, 18 nt, Yersinia pestis KIM
cugcaccaaugacuaauu

SEQ ID NO: 2311134 - RNA, 23 nt, Yersinia pestis KIM
cugcaccaaucauuacaucaucu

SEQ ID NO: 2311135 - RNA, 20 nt, Yersinia pestis KIM
cugcaccucugcugauguca

SEQ ID NO: 2311136 - RNA, 17 nt, Yersinia pestis KIM
cugcacgccuacggcuu

SEQ ID NO: 2311137 - RNA, 16 nt, Yersinia pestis KIM
cugcacguuuaauuuc

SEQ ID NO: 2311138 - RNA, 22 nt, Yersinia pestis KIM
cugcacggaucacgcuguucac

SEQ ID NO: 2311139 - RNA, 20 nt, Yersinia pestis KIM
cugcagcgauauacaucacg

SEQ ID NO: 2311140 - RNA, 21 nt, Yersinia pestis KIM
cugcagaaaaugcggcggcug

SEQ ID NO: 2311141 - RNA, 18 nt, Yersinia pestis KIM
cugcauagcuaaccuuaa

SEQ ID NO: 2311142 - RNA, 17 nt, Yersinia pestis KIM
cugcauauccucccgcu

SEQ ID NO: 2311143 - RNA, 13 nt, Yersinia pestis KIM
cugauagagacgg

SEQ ID NO: 2311144 - RNA, 18 nt, Yersinia pestis KIM
cugauagccaacacgacc

SEQ ID NO: 2311145 - RNA, 15 nt, Yersinia pestis KIM
cugauagucaauaaa

SEQ ID NO: 2311146 - RNA, 16 nt, Yersinia pestis KIM
cugaguaauauuauuc

SEQ ID NO: 2311147 - RNA, 14 nt, Yersinia pestis KIM
cugaguaauauuau

SEQ ID NO: 2311148 - RNA, 13 nt, Yersinia pestis KIM
cugagucagucag

SEQ ID NO: 2311149 - RNA, 20 nt, Yersinia pestis KIM
cugaguauuacgguaauaaa

SEQ ID NO: 2311150 - RNA, 13 nt, Yersinia pestis KIM
cugauaaaacagu

SEQ ID NO: 2311151 - RNA, 18 nt, Yersinia pestis KIM
cugaguuugcuacuggcc

SEQ ID NO: 2311152 - RNA, 15 nt, Yersinia pestis KIM
cugagguugaugagc

SEQ ID NO: 2311153 - RNA, 16 nt, Yersinia pestis KIM
cugagguugcucagcg

SEQ ID NO: 2311154 - RNA, 18 nt, Yersinia pestis KIM
cugaguaacgaacgucgc

SEQ ID NO: 2311155 - RNA, 22 nt, Yersinia pestis KIM
cugaguaaagcccagcaggcug

SEQ ID NO: 2311156 - RNA, 12 nt, Yersinia pestis KIM
cugagggugaug

SEQ ID NO: 2311157 - RNA, 13 nt, Yersinia pestis KIM
cugagggccacuu

SEQ ID NO: 2311158 - RNA, 15 nt, Yersinia pestis KIM
cugaggauaaaaacu

SEQ ID NO: 2311159 - RNA, 21 nt, Yersinia pestis KIM
cugagcgacauuucggccacc

SEQ ID NO: 2311160 - RNA, 19 nt, Yersinia pestis KIM
cugagcgaacugaaugcgu

SEQ ID NO: 2311161 - RNA, 19 nt, Yersinia pestis KIM
cugagccucaugaaugagg

SEQ ID NO: 2311162 - RNA, 22 nt, Yersinia pestis KIM
cugagccucaugaaugaggcug

SEQ ID NO: 2311163 - RNA, 21 nt, Yersinia pestis KIM
cugagcgaucaauacaccaga

SEQ ID NO: 2311164 - RNA, 14 nt, Yersinia pestis KIM
cugagcgaucaaua

SEQ ID NO: 2311165 - RNA, 22 nt, Yersinia pestis KIM
cugagcgaucaauacaccagac

SEQ ID NO: 2311166 - RNA, 18 nt, Yersinia pestis KIM
cugagcgcuuuaaccaaa

SEQ ID NO: 2311167 - RNA, 15 nt, Yersinia pestis KIM
cugagcgggcggcaa

SEQ ID NO: 2311168 - RNA, 22 nt, Yersinia pestis KIM
cugauauaacaaguuacauuuu

SEQ ID NO: 2311169 - RNA, 15 nt, Yersinia pestis KIM
cugauauaaagcauu

SEQ ID NO: 2311170 - RNA, 16 nt, Yersinia pestis KIM
cugaugacucaucugg

SEQ ID NO: 2311171 - RNA, 21 nt, Yersinia pestis KIM
cugaugacgccguacaaauau

SEQ ID NO: 2311172 - RNA, 18 nt, Yersinia pestis KIM
cugaugaauagaggacua

SEQ ID NO: 2311173 - RNA, 15 nt, Yersinia pestis KIM
cugaugcuuuucuuu

SEQ ID NO: 2311174 - RNA, 16 nt, Yersinia pestis KIM
cugaugagcuggcaaa

SEQ ID NO: 2311175 - RNA, 14 nt, Yersinia pestis KIM
cugauggucaugga

SEQ ID NO: 2311176 - RNA, 19 nt, Yersinia pestis KIM
cugauggugucaacucagu

SEQ ID NO: 2311177 - RNA, 17 nt, Yersinia pestis KIM
cugauguugucaccugg

SEQ ID NO: 2311178 - RNA, 17 nt, Yersinia pestis KIM
cugauguucugccaacc

SEQ ID NO: 2311179 - RNA, 18 nt, Yersinia pestis KIM
cugaugucagugcuccau

SEQ ID NO: 2311180 - RNA, 11 nt, Yersinia pestis KIM
cugauuaauag

SEQ ID NO: 2311181 - RNA, 15 nt, Yersinia pestis KIM
cugauuaauuuuaau

SEQ ID NO: 2311182 - RNA, 22 nt, Yersinia pestis KIM
cugauucaacacggugaauaaa

SEQ ID NO: 2311183 - RNA, 17 nt, Yersinia pestis KIM
cugauucagauuuacuc

SEQ ID NO: 2311184 - RNA, 19 nt, Yersinia pestis KIM
cugauucgcgaccagcaga

SEQ ID NO: 2311185 - RNA, 17 nt, Yersinia pestis KIM
cugauuugccagcaccg

SEQ ID NO: 2311186 - RNA, 14 nt, Yersinia pestis KIM
cugaauaaacacca

SEQ ID NO: 2311187 - RNA, 19 nt, Yersinia pestis KIM
cugaauaaaaaauuauuaa

SEQ ID NO: 2311188 - RNA, 20 nt, Yersinia pestis KIM
cugaauacaacgguuuaugc

SEQ ID NO: 2311189 - RNA, 22 nt, Yersinia pestis KIM
cugaauacaacgguuuaugccc

SEQ ID NO: 2311190 - RNA, 18 nt, Yersinia pestis KIM
cugaauaccggccugauu

SEQ ID NO: 2311191 - RNA, 15 nt, Yersinia pestis KIM
cugaaugugaagagc

SEQ ID NO: 2311192 - RNA, 16 nt, Yersinia pestis KIM
cugaauugauuuauuc

SEQ ID NO: 2311193 - RNA, 21 nt, Yersinia pestis KIM
cugaauugcuuauccagccgc

SEQ ID NO: 2311194 - RNA, 16 nt, Yersinia pestis KIM
cugaauuggaagagcc

SEQ ID NO: 2311195 - RNA, 16 nt, Yersinia pestis KIM
cugaauggaucacauc

SEQ ID NO: 2311196 - RNA, 22 nt, Yersinia pestis KIM
cugaauggaucacaucacagug

SEQ ID NO: 2311197 - RNA, 20 nt, Yersinia pestis KIM
cugaauggcaacgcgcagug

SEQ ID NO: 2311198 - RNA, 17 nt, Yersinia pestis KIM
cugaauggcuauuuacu

SEQ ID NO: 2311199 - RNA, 18 nt, Yersinia pestis KIM
cugaaugguuuuagucau

SEQ ID NO: 2311200 - RNA, 23 nt, Yersinia pestis KIM
cugaaugguuuuagucauuugcu

SEQ ID NO: 2311201 - RNA, 18 nt, Yersinia pestis KIM
cugaaucuguaagucauu

SEQ ID NO: 2311202 - RNA, 15 nt, Yersinia pestis KIM
cugaaucgauaaacc

SEQ ID NO: 2311203 - RNA, 21 nt, Yersinia pestis KIM
cugaaucgcugccauaugcau

SEQ ID NO: 2311204 - RNA, 20 nt, Yersinia pestis KIM
cugaaucacaggccacugca

SEQ ID NO: 2311205 - RNA, 18 nt, Yersinia pestis KIM
cugaccggaagcaaucag

SEQ ID NO: 2311206 - RNA, 22 nt, Yersinia pestis KIM
cugaccgauaaacgccagucag

SEQ ID NO: 2311207 - RNA, 14 nt, Yersinia pestis KIM
cugacaucaucacc

SEQ ID NO: 2311208 - RNA, 16 nt, Yersinia pestis KIM
cugacagccugugccc

SEQ ID NO: 2311209 - RNA, 17 nt, Yersinia pestis KIM
cugacagccugugccca

SEQ ID NO: 2311210 - RNA, 15 nt, Yersinia pestis KIM
cugacauaagguuuc

SEQ ID NO: 2311211 - RNA, 19 nt, Yersinia pestis KIM
cugacauaagguuucauuu

SEQ ID NO: 2311212 - RNA, 17 nt, Yersinia pestis KIM
cugaauuuuuuaccuag

SEQ ID NO: 2311213 - RNA, 12 nt, Yersinia pestis KIM
cugaauuucaau

SEQ ID NO: 2311214 - RNA, 16 nt, Yersinia pestis KIM
cugacgguuucaacau

SEQ ID NO: 2311215 - RNA, 14 nt, Yersinia pestis KIM
cugacuguuuugcu

SEQ ID NO: 2311216 - RNA, 14 nt, Yersinia pestis KIM
cugacugcuggcag

SEQ ID NO: 2311217 - RNA, 16 nt, Yersinia pestis KIM
cugacggguauaucac

SEQ ID NO: 2311218 - RNA, 14 nt, Yersinia pestis KIM
cugacgcagaagua

SEQ ID NO: 2311219 - RNA, 18 nt, Yersinia pestis KIM
cugacgccaugcucagaa

SEQ ID NO: 2311220 - RNA, 18 nt, Yersinia pestis KIM
cugacgaugauaaaucag

SEQ ID NO: 2311221 - RNA, 16 nt, Yersinia pestis KIM
cugacgaugauaaauc

SEQ ID NO: 2311222 - RNA, 19 nt, Yersinia pestis KIM
cugacgcacagcacgguaa

SEQ ID NO: 2311223 - RNA, 16 nt, Yersinia pestis KIM
cguucaacaccacaac

SEQ ID NO: 2311224 - RNA, 23 nt, Yersinia pestis KIM
cguucaacaguaucaaccaccgc

SEQ ID NO: 2311225 - RNA, 20 nt, Yersinia pestis KIM
cguuauuuuuguaacucaau

SEQ ID NO: 2311226 - RNA, 17 nt, Yersinia pestis KIM
cguuauugcgacauaaa

SEQ ID NO: 2311227 - RNA, 16 nt, Yersinia pestis KIM
cguuauucucaauuga

SEQ ID NO: 2311228 - RNA, 19 nt, Yersinia pestis KIM
cguucacacgauuccucug

SEQ ID NO: 2311229 - RNA, 20 nt, Yersinia pestis KIM
cguucacacgauuccucugu

SEQ ID NO: 2311230 - RNA, 18 nt, Yersinia pestis KIM
cguucaccccccacccug

SEQ ID NO: 2311231 - RNA, 22 nt, Yersinia pestis KIM
cguucagauuaacggucacugg

SEQ ID NO: 2311232 - RNA, 21 nt, Yersinia pestis KIM
cguucagugcgauguuuucca

SEQ ID NO: 2311233 - RNA, 13 nt, Yersinia pestis KIM
cguucaucaccca

SEQ ID NO: 2311234 - RNA, 23 nt, Yersinia pestis KIM
cguucccgcaggcggccaaugac

SEQ ID NO: 2311235 - RNA, 17 nt, Yersinia pestis KIM
cguucuaucaaugccuu

SEQ ID NO: 2311236 - RNA, 15 nt, Yersinia pestis KIM
cguucuccaguugcc

SEQ ID NO: 2311237 - RNA, 16 nt, Yersinia pestis KIM
cguuacccacauuaaa

SEQ ID NO: 2311238 - RNA, 22 nt, Yersinia pestis KIM
cguuacccccuucaccaauaca

SEQ ID NO: 2311239 - RNA, 18 nt, Yersinia pestis KIM
cguuacaacgagggcuca

SEQ ID NO: 2311240 - RNA, 22 nt, Yersinia pestis KIM
cguuacaacgagggcucaaucu

SEQ ID NO: 2311241 - RNA, 18 nt, Yersinia pestis KIM
cguuacacaaucaguaaa

SEQ ID NO: 2311242 - RNA, 13 nt, Yersinia pestis KIM
cguuacagcaagg

SEQ ID NO: 2311243 - RNA, 18 nt, Yersinia pestis KIM
cguuacagcaaggcagaa

SEQ ID NO: 2311244 - RNA, 19 nt, Yersinia pestis KIM
cguuaauuauagugaaaac

SEQ ID NO: 2311245 - RNA, 16 nt, Yersinia pestis KIM
cguuagccuacuggcg

SEQ ID NO: 2311246 - RNA, 15 nt, Yersinia pestis KIM
cguuagcucuucacg

SEQ ID NO: 2311247 - RNA, 13 nt, Yersinia pestis KIM
cguuauauaaaug

SEQ ID NO: 2311248 - RNA, 22 nt, Yersinia pestis KIM
cguuaucaaauacgaccgucac

SEQ ID NO: 2311249 - RNA, 20 nt, Yersinia pestis KIM
cguuaucaauacugcaaaug

SEQ ID NO: 2311250 - RNA, 15 nt, Yersinia pestis KIM
cguuaugccaaccgg

SEQ ID NO: 2311251 - RNA, 18 nt, Yersinia pestis KIM
cguuaucggcgcaggcag

SEQ ID NO: 2311252 - RNA, 21 nt, Yersinia pestis KIM
cguuucccccuguaaaacaag

SEQ ID NO: 2311253 - RNA, 13 nt, Yersinia pestis KIM
cguuuccccuuca

SEQ ID NO: 2311254 - RNA, 20 nt, Yersinia pestis KIM
cguuuccagcggcguaucaa

SEQ ID NO: 2311255 - RNA, 17 nt, Yersinia pestis KIM
cguuguuggcacaacug

SEQ ID NO: 2311256 - RNA, 15 nt, Yersinia pestis KIM
cguuuaaaguaaauc

SEQ ID NO: 2311257 - RNA, 11 nt, Yersinia pestis KIM
cguuuaaauaa

SEQ ID NO: 2311258 - RNA, 15 nt, Yersinia pestis KIM
cguuuaaaaaauauc

SEQ ID NO: 2311259 - RNA, 18 nt, Yersinia pestis KIM
cguuguuaucaucaccac

SEQ ID NO: 2311260 - RNA, 19 nt, Yersinia pestis KIM
cguuguuaucaucaccacc

SEQ ID NO: 2311261 - RNA, 20 nt, Yersinia pestis KIM
cguuguuaucaucaccaccc

SEQ ID NO: 2311262 - RNA, 16 nt, Yersinia pestis KIM
cguuucuacaauggcc

SEQ ID NO: 2311263 - RNA, 15 nt, Yersinia pestis KIM
cguugucagccaugc

SEQ ID NO: 2311264 - RNA, 13 nt, Yersinia pestis KIM
cguugucuguaac

SEQ ID NO: 2311265 - RNA, 20 nt, Yersinia pestis KIM
cguugccccaucagcacucc

SEQ ID NO: 2311266 - RNA, 15 nt, Yersinia pestis KIM
cguugaugcucuucu

SEQ ID NO: 2311267 - RNA, 20 nt, Yersinia pestis KIM
cuaaaagggaguucaucaaa

SEQ ID NO: 2311268 - RNA, 21 nt, Yersinia pestis KIM
cuaaaaggauagggagccaau

SEQ ID NO: 2311269 - RNA, 13 nt, Yersinia pestis KIM
cuaaaauuuuaag

SEQ ID NO: 2311270 - RNA, 21 nt, Yersinia pestis KIM
cuaaacagggcagaaaauacc

SEQ ID NO: 2311271 - RNA, 12 nt, Yersinia pestis KIM
cuaaaacugaag

SEQ ID NO: 2311272 - RNA, 15 nt, Yersinia pestis KIM
cuaaaagcuaaaaau

SEQ ID NO: 2311273 - RNA, 14 nt, Yersinia pestis KIM
cuaaaaaaugauuu

SEQ ID NO: 2311274 - RNA, 14 nt, Yersinia pestis KIM
cguuuugcaucaac

SEQ ID NO: 2311275 - RNA, 16 nt, Yersinia pestis KIM
cguuuuuuugccagug

SEQ ID NO: 2311276 - RNA, 15 nt, Yersinia pestis KIM
cguuuuugaaauacc

SEQ ID NO: 2311277 - RNA, 14 nt, Yersinia pestis KIM
cuaaugauuacucu

SEQ ID NO: 2311278 - RNA, 17 nt, Yersinia pestis KIM
cuaaugccgagaacaga

SEQ ID NO: 2311279 - RNA, 20 nt, Yersinia pestis KIM
cuaauggccagacacugaca

SEQ ID NO: 2311280 - RNA, 14 nt, Yersinia pestis KIM
cuaaucuccucucc

SEQ ID NO: 2311281 - RNA, 21 nt, Yersinia pestis KIM
cuaaucauuuauuuuuccagg

SEQ ID NO: 2311282 - RNA, 11 nt, Yersinia pestis KIM
cuaauccaagg

SEQ ID NO: 2311283 - RNA, 17 nt, Yersinia pestis KIM
cuaauauuuauaaaaaa

SEQ ID NO: 2311284 - RNA, 16 nt, Yersinia pestis KIM
cuaauauuuucagccc

SEQ ID NO: 2311285 - RNA, 19 nt, Yersinia pestis KIM
cuaauauuuucagcccuac

SEQ ID NO: 2311286 - RNA, 13 nt, Yersinia pestis KIM
cuaaucauaucca

SEQ ID NO: 2311287 - RNA, 14 nt, Yersinia pestis KIM
cuaauagcauuuuu

SEQ ID NO: 2311288 - RNA, 16 nt, Yersinia pestis KIM
cuaauacgcuaucaac

SEQ ID NO: 2311289 - RNA, 16 nt, Yersinia pestis KIM
cuacaagcaugugaug

SEQ ID NO: 2311290 - RNA, 14 nt, Yersinia pestis KIM
cuacaaaaauaguu

SEQ ID NO: 2311291 - RNA, 15 nt, Yersinia pestis KIM
cuaauuugacgccgc

SEQ ID NO: 2311292 - RNA, 14 nt, Yersinia pestis KIM
cuaauuuucccugu

SEQ ID NO: 2311293 - RNA, 18 nt, Yersinia pestis KIM
cuaauucaggcaaauucu

SEQ ID NO: 2311294 - RNA, 20 nt, Yersinia pestis KIM
cuaauucaggcaaauucuca

SEQ ID NO: 2311295 - RNA, 23 nt, Yersinia pestis KIM
cuaauuauuuuauuuaaaauuaa

SEQ ID NO: 2311296 - RNA, 20 nt, Yersinia pestis KIM
cuaauuaauuuaaacaacca

SEQ ID NO: 2311297 - RNA, 16 nt, Yersinia pestis KIM
cuaauguuuguuucuc

SEQ ID NO: 2311298 - RNA, 18 nt, Yersinia pestis KIM
cuaaugugaugaaacuaa

SEQ ID NO: 2311299 - RNA, 18 nt, Yersinia pestis KIM
cuaauuaaagacgcauga

SEQ ID NO: 2311300 - RNA, 17 nt, Yersinia pestis KIM
cuaauggugcuauuucu

SEQ ID NO: 2311301 - RNA, 13 nt, Yersinia pestis KIM
cuaauugauauua

SEQ ID NO: 2311302 - RNA, 17 nt, Yersinia pestis KIM
cuaauuguuauuauuaa

SEQ ID NO: 2311303 - RNA, 18 nt, Yersinia pestis KIM
cuaacguccccugagcga

SEQ ID NO: 2311304 - RNA, 17 nt, Yersinia pestis KIM
cuaacgucgcuguuacu

SEQ ID NO: 2311305 - RNA, 20 nt, Yersinia pestis KIM
cuaacgucgcuguuacucag

SEQ ID NO: 2311306 - RNA, 16 nt, Yersinia pestis KIM
cuaacgucaacagaac

SEQ ID NO: 2311307 - RNA, 22 nt, Yersinia pestis KIM
cuaacggcagcuuccugugaaa

SEQ ID NO: 2311308 - RNA, 14 nt, Yersinia pestis KIM
cuaacgagaaaguc

SEQ ID NO: 2311309 - RNA, 17 nt, Yersinia pestis KIM
cuaaccuuaacugcaua

SEQ ID NO: 2311310 - RNA, 20 nt, Yersinia pestis KIM
cuaacuggcccucuuuuuug

SEQ ID NO: 2311311 - RNA, 20 nt, Yersinia pestis KIM
cuaacugugccaaugccucu

SEQ ID NO: 2311312 - RNA, 17 nt, Yersinia pestis KIM
cuaacucuucuggcaaa

SEQ ID NO: 2311313 - RNA, 23 nt, Yersinia pestis KIM
cuaacuaauaauaaucuuaagua

SEQ ID NO: 2311314 - RNA, 17 nt, Yersinia pestis KIM
cuaaccccugcaucuug

SEQ ID NO: 2311315 - RNA, 15 nt, Yersinia pestis KIM
cuaacccauugguuu

SEQ ID NO: 2311316 - RNA, 13 nt, Yersinia pestis KIM
cuaacaccgcugu

SEQ ID NO: 2311317 - RNA, 22 nt, Yersinia pestis KIM
cuaacacgaccuucaucucuga

SEQ ID NO: 2311318 - RNA, 14 nt, Yersinia pestis KIM
cuaaaccaucagag

SEQ ID NO: 2311319 - RNA, 16 nt, Yersinia pestis KIM
cuaacaacuuccacac

SEQ ID NO: 2311320 - RNA, 16 nt, Yersinia pestis KIM
cuaacaacaauuuacg

SEQ ID NO: 2311321 - RNA, 22 nt, Yersinia pestis KIM
cuaaacgaccaauuucaauaau

SEQ ID NO: 2311322 - RNA, 23 nt, Yersinia pestis KIM
cuaagcugccugugcggcaguga

SEQ ID NO: 2311323 - RNA, 21 nt, Yersinia pestis KIM
cuaaguucagcgcuuaauauu

SEQ ID NO: 2311324 - RNA, 17 nt, Yersinia pestis KIM
cuaaguccaagacagaa

SEQ ID NO: 2311325 - RNA, 18 nt, Yersinia pestis KIM
cuaagcgaagauacaaua

SEQ ID NO: 2311326 - RNA, 19 nt, Yersinia pestis KIM
cuaagcucuuccaauagca

SEQ ID NO: 2311327 - RNA, 15 nt, Yersinia pestis KIM
cuaagccggucuuuu

SEQ ID NO: 2311328 - RNA, 22 nt, Yersinia pestis KIM
cuaagaauugguuauccuaaga

SEQ ID NO: 2311329 - RNA, 18 nt, Yersinia pestis KIM
cgucuacgcucuccucuc

SEQ ID NO: 2311330 - RNA, 20 nt, Yersinia pestis KIM
cgucgugugucuuaagccug

SEQ ID NO: 2311331 - RNA, 14 nt, Yersinia pestis KIM
cgucguuugcucca

SEQ ID NO: 2311332 - RNA, 17 nt, Yersinia pestis KIM
cgucgguuuuuguauuc

SEQ ID NO: 2311333 - RNA, 14 nt, Yersinia pestis KIM
cgugcagcgcgcag

SEQ ID NO: 2311334 - RNA, 15 nt, Yersinia pestis KIM
cgugcagcgcgcagc

SEQ ID NO: 2311335 - RNA, 19 nt, Yersinia pestis KIM
cgugcagcgcgcagccaac

SEQ ID NO: 2311336 - RNA, 14 nt, Yersinia pestis KIM
cgugccccaaugau

SEQ ID NO: 2311337 - RNA, 16 nt, Yersinia pestis KIM
cgugauugguuuaucc

SEQ ID NO: 2311338 - RNA, 14 nt, Yersinia pestis KIM
cgucuucgacagca

SEQ ID NO: 2311339 - RNA, 19 nt, Yersinia pestis KIM
cgugacguuaucucaacca

SEQ ID NO: 2311340 - RNA, 20 nt, Yersinia pestis KIM
cgucuuuacgaucugccugu

SEQ ID NO: 2311341 - RNA, 23 nt, Yersinia pestis KIM
cgucuuguuggucaccacuugca

SEQ ID NO: 2311342 - RNA, 21 nt, Yersinia pestis KIM
cgucuuuaucgccagcugcaa

SEQ ID NO: 2311343 - RNA, 23 nt, Yersinia pestis KIM
cgucuuuacgaucugccuguucu

SEQ ID NO: 2311344 - RNA, 12 nt, Yersinia pestis KIM
cguacuuuccuu

SEQ ID NO: 2311345 - RNA, 12 nt, Yersinia pestis KIM
cguacucuucug

SEQ ID NO: 2311346 - RNA, 18 nt, Yersinia pestis KIM
cguacucuucuguauaug

SEQ ID NO: 2311347 - RNA, 19 nt, Yersinia pestis KIM
cguaauucagauaagaucu

SEQ ID NO: 2311348 - RNA, 15 nt, Yersinia pestis KIM
cguaauucagcacgg

SEQ ID NO: 2311349 - RNA, 14 nt, Yersinia pestis KIM
cguacaucagggug

SEQ ID NO: 2311350 - RNA, 16 nt, Yersinia pestis KIM
cguacauauaucacua

SEQ ID NO: 2311351 - RNA, 11 nt, Yersinia pestis KIM
cguacauuaaa

SEQ ID NO: 2311352 - RNA, 13 nt, Yersinia pestis KIM
cguaccacaagcc

SEQ ID NO: 2311353 - RNA, 17 nt, Yersinia pestis KIM
cguagcacacgacugag

SEQ ID NO: 2311354 - RNA, 15 nt, Yersinia pestis KIM
cguauauuggccugc

SEQ ID NO: 2311355 - RNA, 13 nt, Yersinia pestis KIM
cguaucagccccu

SEQ ID NO: 2311356 - RNA, 12 nt, Yersinia pestis KIM
cguaggcugacc

SEQ ID NO: 2311357 - RNA, 14 nt, Yersinia pestis KIM
cguaggcugaccac

SEQ ID NO: 2311358 - RNA, 18 nt, Yersinia pestis KIM
cguagguuucagccucug

SEQ ID NO: 2311359 - RNA, 12 nt, Yersinia pestis KIM
cguagguaauua

SEQ ID NO: 2311360 - RNA, 14 nt, Yersinia pestis KIM
cguagggauaaauc

SEQ ID NO: 2311361 - RNA, 17 nt, Yersinia pestis KIM
cguaggcuuggcgggcu

SEQ ID NO: 2311362 - RNA, 21 nt, Yersinia pestis KIM
cgucauugaggguugucagca

SEQ ID NO: 2311363 - RNA, 18 nt, Yersinia pestis KIM
cgucaugcugaaucugua

SEQ ID NO: 2311364 - RNA, 19 nt, Yersinia pestis KIM
cgucaugaaguugauaaaa

SEQ ID NO: 2311365 - RNA, 21 nt, Yersinia pestis KIM
cgucauugguguuacagcaag

SEQ ID NO: 2311366 - RNA, 22 nt, Yersinia pestis KIM
cgucauuuccguuaacccaaag

SEQ ID NO: 2311367 - RNA, 14 nt, Yersinia pestis KIM
cgucccuaaagcca

SEQ ID NO: 2311368 - RNA, 21 nt, Yersinia pestis KIM
cguccagaacaauaccgccaa

SEQ ID NO: 2311369 - RNA, 20 nt, Yersinia pestis KIM
cgucagguaaguagaaugca

SEQ ID NO: 2311370 - RNA, 12 nt, Yersinia pestis KIM
cgucacuuccau

SEQ ID NO: 2311371 - RNA, 12 nt, Yersinia pestis KIM
cgucagauuagu

SEQ ID NO: 2311372 - RNA, 18 nt, Yersinia pestis KIM
cgucaccgccaaaauaaa

SEQ ID NO: 2311373 - RNA, 16 nt, Yersinia pestis KIM
cgucaccguguucaug

SEQ ID NO: 2311374 - RNA, 22 nt, Yersinia pestis KIM
cuagaaauaaguugaaccauaa

SEQ ID NO: 2311375 - RNA, 18 nt, Yersinia pestis KIM
cuagacaguaaccgggcu

SEQ ID NO: 2311376 - RNA, 17 nt, Yersinia pestis KIM
cuagccaccucacucag

SEQ ID NO: 2311377 - RNA, 16 nt, Yersinia pestis KIM
cuagcgccagcaauug

SEQ ID NO: 2311378 - RNA, 15 nt, Yersinia pestis KIM
cuagcgagcucugag

SEQ ID NO: 2311379 - RNA, 21 nt, Yersinia pestis KIM
cuacguuguuaucaucaccac

SEQ ID NO: 2311380 - RNA, 18 nt, Yersinia pestis KIM
cuacggcugaucugcccc

SEQ ID NO: 2311381 - RNA, 22 nt, Yersinia pestis KIM
cuacgcuuucaggagugaauuu

SEQ ID NO: 2311382 - RNA, 14 nt, Yersinia pestis KIM
cuacggcuucccau

SEQ ID NO: 2311383 - RNA, 16 nt, Yersinia pestis KIM
cuacgggcaaacuccu

SEQ ID NO: 2311384 - RNA, 16 nt, Yersinia pestis KIM
cuacgguaauaaacag

SEQ ID NO: 2311385 - RNA, 13 nt, Yersinia pestis KIM
cuauaaauuuuaa

SEQ ID NO: 2311386 - RNA, 17 nt, Yersinia pestis KIM
cuauaaauaaauuuauc

SEQ ID NO: 2311387 - RNA, 23 nt, Yersinia pestis KIM
cuauaaggcucuguuaccagccg

SEQ ID NO: 2311388 - RNA, 14 nt, Yersinia pestis KIM
cuauaaggcucugu

SEQ ID NO: 2311389 - RNA, 15 nt, Yersinia pestis KIM
cuauaaacauuuacu

SEQ ID NO: 2311390 - RNA, 20 nt, Yersinia pestis KIM
cuauaaacauuuacuuauaa

SEQ ID NO: 2311391 - RNA, 20 nt, Yersinia pestis KIM
cuaguacguaaauuuauuua

SEQ ID NO: 2311392 - RNA, 12 nt, Yersinia pestis KIM
cuagugaugggg

SEQ ID NO: 2311393 - RNA, 20 nt, Yersinia pestis KIM
cuaguuaacccuaccuaggc

SEQ ID NO: 2311394 - RNA, 14 nt, Yersinia pestis KIM
cuagugccacaaca

SEQ ID NO: 2311395 - RNA, 18 nt, Yersinia pestis KIM
cuacacgcuuuacuguca

SEQ ID NO: 2311396 - RNA, 15 nt, Yersinia pestis KIM
cuacaauaucuuccc

SEQ ID NO: 2311397 - RNA, 13 nt, Yersinia pestis KIM
cuacacacagcaa

SEQ ID NO: 2311398 - RNA, 18 nt, Yersinia pestis KIM
cuacaggcgcaacugcca

SEQ ID NO: 2311399 - RNA, 21 nt, Yersinia pestis KIM
cuacaggcgcaacugccaugg

SEQ ID NO: 2311400 - RNA, 14 nt, Yersinia pestis KIM
cuacagggaaaaac

SEQ ID NO: 2311401 - RNA, 23 nt, Yersinia pestis KIM
cuacauagcgcauccaaccugca

SEQ ID NO: 2311402 - RNA, 18 nt, Yersinia pestis KIM
cuaccagcagugcagcca

SEQ ID NO: 2311403 - RNA, 19 nt, Yersinia pestis KIM
cuaccaaccgcuuuaucgc

SEQ ID NO: 2311404 - RNA, 21 nt, Yersinia pestis KIM
cuaccaugagugaaaauaugu

SEQ ID NO: 2311405 - RNA, 22 nt, Yersinia pestis KIM
cuacccauuauaaauaauuaau

SEQ ID NO: 2311406 - RNA, 17 nt, Yersinia pestis KIM
cuaccguaucagccccu

SEQ ID NO: 2311407 - RNA, 14 nt, Yersinia pestis KIM
cuaccguaucagcc

SEQ ID NO: 2311408 - RNA, 21 nt, Yersinia pestis KIM
cuaccugcaccaaucauuaca

SEQ ID NO: 2311409 - RNA, 17 nt, Yersinia pestis KIM
cuacgccgucaucaucu

SEQ ID NO: 2311410 - RNA, 22 nt, Yersinia pestis KIM
cuaccggccauugauaccuuca

SEQ ID NO: 2311411 - RNA, 14 nt, Yersinia pestis KIM
cuaccgccagcuga

SEQ ID NO: 2311412 - RNA, 17 nt, Yersinia pestis KIM
cuaccgagucuauuuuc

SEQ ID NO: 2311413 - RNA, 14 nt, Yersinia pestis KIM
cucagccucauuca

SEQ ID NO: 2311414 - RNA, 15 nt, Yersinia pestis KIM
cucagcgucacggaa

SEQ ID NO: 2311415 - RNA, 23 nt, Yersinia pestis KIM
cucagcgcuggcgagguaccgcu

SEQ ID NO: 2311416 - RNA, 20 nt, Yersinia pestis KIM
cucagcugguuagagcacag

SEQ ID NO: 2311417 - RNA, 16 nt, Yersinia pestis KIM
cucagcuucaggccaa

SEQ ID NO: 2311418 - RNA, 14 nt, Yersinia pestis KIM
cucaggaaucuuca

SEQ ID NO: 2311419 - RNA, 21 nt, Yersinia pestis KIM
cucacuuuuugucaauaaaau

SEQ ID NO: 2311420 - RNA, 22 nt, Yersinia pestis KIM
cucagcauauuguaaacuucca

SEQ ID NO: 2311421 - RNA, 22 nt, Yersinia pestis KIM
cucagcagagucgcaaaaaaua

SEQ ID NO: 2311422 - RNA, 15 nt, Yersinia pestis KIM
cucagcaucaccgcc

SEQ ID NO: 2311423 - RNA, 14 nt, Yersinia pestis KIM
cucagcauccuccu

SEQ ID NO: 2311424 - RNA, 21 nt, Yersinia pestis KIM
cucacgucaccacgcagucag

SEQ ID NO: 2311425 - RNA, 14 nt, Yersinia pestis KIM
cucacuuuuaucca

SEQ ID NO: 2311426 - RNA, 17 nt, Yersinia pestis KIM
cucacuuuuauccagcc

SEQ ID NO: 2311427 - RNA, 13 nt, Yersinia pestis KIM
cucacuuuuauug

SEQ ID NO: 2311428 - RNA, 20 nt, Yersinia pestis KIM
cucacuuguguaaacuccuu

SEQ ID NO: 2311429 - RNA, 23 nt, Yersinia pestis KIM
cucacuuguguaaacuccuugga

SEQ ID NO: 2311430 - RNA, 18 nt, Yersinia pestis KIM
cucacguauuuucauuuu

SEQ ID NO: 2311431 - RNA, 16 nt, Yersinia pestis KIM
cucacguauuuucauu

SEQ ID NO: 2311432 - RNA, 18 nt, Yersinia pestis KIM
cucacgggcuuccaucag

SEQ ID NO: 2311433 - RNA, 20 nt, Yersinia pestis KIM
cucacgguagugacucauca

SEQ ID NO: 2311434 - RNA, 13 nt, Yersinia pestis KIM
cucaaugauaaaa

SEQ ID NO: 2311435 - RNA, 18 nt, Yersinia pestis KIM
cucaaugcaguaaagauu

SEQ ID NO: 2311436 - RNA, 22 nt, Yersinia pestis KIM
cucaaucggcugguaacugagu

SEQ ID NO: 2311437 - RNA, 15 nt, Yersinia pestis KIM
cucaaucucugccug

SEQ ID NO: 2311438 - RNA, 22 nt, Yersinia pestis KIM
cucaaauagauagcaaucaaua

SEQ ID NO: 2311439 - RNA, 20 nt, Yersinia pestis KIM
cucaaacaugagcgcaugcc

SEQ ID NO: 2311440 - RNA, 17 nt, Yersinia pestis KIM
cucaaacugauaaagca

SEQ ID NO: 2311441 - RNA, 17 nt, Yersinia pestis KIM
cucaaagaccacaucaa

SEQ ID NO: 2311442 - RNA, 23 nt, Yersinia pestis KIM
cucaaagaccacaucaaccugau

SEQ ID NO: 2311443 - RNA, 19 nt, Yersinia pestis KIM
cucaaaaggauggcccaag

SEQ ID NO: 2311444 - RNA, 15 nt, Yersinia pestis KIM
cucaccauguacaug

SEQ ID NO: 2311445 - RNA, 19 nt, Yersinia pestis KIM
cucaccccuauuagggaac

SEQ ID NO: 2311446 - RNA, 18 nt, Yersinia pestis KIM
cucaauucaauacgcagg

SEQ ID NO: 2311447 - RNA, 21 nt, Yersinia pestis KIM
cucaauucaauacgcaggcgg

SEQ ID NO: 2311448 - RNA, 18 nt, Yersinia pestis KIM
cucaauuugguauuggcu

SEQ ID NO: 2311449 - RNA, 18 nt, Yersinia pestis KIM
cuauucacuauuuauuaa

SEQ ID NO: 2311450 - RNA, 12 nt, Yersinia pestis KIM
cuauuccaguuu

SEQ ID NO: 2311451 - RNA, 19 nt, Yersinia pestis KIM
cuauucaaugacuccugaa

SEQ ID NO: 2311452 - RNA, 23 nt, Yersinia pestis KIM
cuauggcgguuccaaagcaccaa

SEQ ID NO: 2311453 - RNA, 22 nt, Yersinia pestis KIM
cuauuagccagaaauagcacca

SEQ ID NO: 2311454 - RNA, 19 nt, Yersinia pestis KIM
cuaucuauuuuuauuucuc

SEQ ID NO: 2311455 - RNA, 21 nt, Yersinia pestis KIM
cuaucucgacaaauccuuuua

SEQ ID NO: 2311456 - RNA, 14 nt, Yersinia pestis KIM
cuauagacaauacu

SEQ ID NO: 2311457 - RNA, 21 nt, Yersinia pestis KIM
cuauagauacccacuuuauuu

SEQ ID NO: 2311458 - RNA, 12 nt, Yersinia pestis KIM
cuaucuucuucu

SEQ ID NO: 2311459 - RNA, 15 nt, Yersinia pestis KIM
cuaucugcugcggua

SEQ ID NO: 2311460 - RNA, 18 nt, Yersinia pestis KIM
cuaucuuuucgauagcca

SEQ ID NO: 2311461 - RNA, 15 nt, Yersinia pestis KIM
cuaucuuuauugcuc

SEQ ID NO: 2311462 - RNA, 19 nt, Yersinia pestis KIM
cuauuuacugcauucugag

SEQ ID NO: 2311463 - RNA, 16 nt, Yersinia pestis KIM
cuauuuacucucuuug

SEQ ID NO: 2311464 - RNA, 16 nt, Yersinia pestis KIM
cuauuuauugccauuu

SEQ ID NO: 2311465 - RNA, 17 nt, Yersinia pestis KIM
cuauuguuacuuuuaau

SEQ ID NO: 2311466 - RNA, 18 nt, Yersinia pestis KIM
cuauugugucaauaccuu

SEQ ID NO: 2311467 - RNA, 13 nt, Yersinia pestis KIM
cuauugcgacggu

SEQ ID NO: 2311468 - RNA, 15 nt, Yersinia pestis KIM
cuauugauaaaaccg

SEQ ID NO: 2311469 - RNA, 13 nt, Yersinia pestis KIM
cuauugaccacca

SEQ ID NO: 2311470 - RNA, 23 nt, Yersinia pestis KIM
cuauugauguuaacucagccaca

SEQ ID NO: 2311471 - RNA, 19 nt, Yersinia pestis KIM
cuauugauuacaaaauaua

SEQ ID NO: 2311472 - RNA, 20 nt, Yersinia pestis KIM
cuauucugccuauccucacc

SEQ ID NO: 2311473 - RNA, 15 nt, Yersinia pestis KIM
cuauuuuuauacagg

SEQ ID NO: 2311474 - RNA, 19 nt, Yersinia pestis KIM
cuauuuuuauuucuccuua

SEQ ID NO: 2311475 - RNA, 19 nt, Yersinia pestis KIM
cuauuuuugccaaugcugc

SEQ ID NO: 2311476 - RNA, 22 nt, Yersinia pestis KIM
cucaaaacggcaauuaagcaaa

SEQ ID NO: 2311477 - RNA, 12 nt, Yersinia pestis KIM
cuauuuuuuccg

SEQ ID NO: 2311478 - RNA, 17 nt, Yersinia pestis KIM
cuauuuccgaaagcgcc

SEQ ID NO: 2311479 - RNA, 15 nt, Yersinia pestis KIM
cuauuucucucuacu

SEQ ID NO: 2311480 - RNA, 20 nt, Yersinia pestis KIM
cucgguauguacacauuauu

SEQ ID NO: 2311481 - RNA, 15 nt, Yersinia pestis KIM
cucgcugugcccuuu

SEQ ID NO: 2311482 - RNA, 20 nt, Yersinia pestis KIM
cucgcuuaacugugcagccc

SEQ ID NO: 2311483 - RNA, 20 nt, Yersinia pestis KIM
cucgcgggucaugaaaucag

SEQ ID NO: 2311484 - RNA, 20 nt, Yersinia pestis KIM
cucguggacauagagaugaa

SEQ ID NO: 2311485 - RNA, 13 nt, Yersinia pestis KIM
cucguuaucuuca

SEQ ID NO: 2311486 - RNA, 19 nt, Yersinia pestis KIM
cucguuaucuucauauaca

SEQ ID NO: 2311487 - RNA, 13 nt, Yersinia pestis KIM
cucgcgcccugcc

SEQ ID NO: 2311488 - RNA, 19 nt, Yersinia pestis KIM
cucgcggaaaucagcuuca

SEQ ID NO: 2311489 - RNA, 18 nt, Yersinia pestis KIM
cucgccccgugcuacucc

SEQ ID NO: 2311490 - RNA, 21 nt, Yersinia pestis KIM
cucgauugccuuuuuugaacg

SEQ ID NO: 2311491 - RNA, 16 nt, Yersinia pestis KIM
cucgaacgauuuucuu

SEQ ID NO: 2311492 - RNA, 14 nt, Yersinia pestis KIM
cucgaacaaccggu

SEQ ID NO: 2311493 - RNA, 17 nt, Yersinia pestis KIM
cuccucagccuuuuuug

SEQ ID NO: 2311494 - RNA, 23 nt, Yersinia pestis KIM
cuccacaccuccgcccucuugcu

SEQ ID NO: 2311495 - RNA, 20 nt, Yersinia pestis KIM
cuccacacguguacucauau

SEQ ID NO: 2311496 - RNA, 17 nt, Yersinia pestis KIM
cuccaauaauucgugaa

SEQ ID NO: 2311497 - RNA, 15 nt, Yersinia pestis KIM
cuccacgccccaacg

SEQ ID NO: 2311498 - RNA, 16 nt, Yersinia pestis KIM
cuccacuaugcccagu

SEQ ID NO: 2311499 - RNA, 16 nt, Yersinia pestis KIM
cuccacugauuaucga

SEQ ID NO: 2311500 - RNA, 16 nt, Yersinia pestis KIM
cuccagaggguaugac

SEQ ID NO: 2311501 - RNA, 12 nt, Yersinia pestis KIM
cucaggccuugc

SEQ ID NO: 2311502 - RNA, 21 nt, Yersinia pestis KIM
cucaggauuagcuucugcuau

SEQ ID NO: 2311503 - RNA, 19 nt, Yersinia pestis KIM
cucaggcacauagcuggcu

SEQ ID NO: 2311504 - RNA, 13 nt, Yersinia pestis KIM
cucaggcccgcua

SEQ ID NO: 2311505 - RNA, 16 nt, Yersinia pestis KIM
cucauuauggauaauu

SEQ ID NO: 2311506 - RNA, 18 nt, Yersinia pestis KIM
cucauucaugaggcuucu

SEQ ID NO: 2311507 - RNA, 17 nt, Yersinia pestis KIM
cucauucaugaggcuca

SEQ ID NO: 2311508 - RNA, 16 nt, Yersinia pestis KIM
cucauucaugaggcuu

SEQ ID NO: 2311509 - RNA, 16 nt, Yersinia pestis KIM
cucauucaugaggcuc

SEQ ID NO: 2311510 - RNA, 16 nt, Yersinia pestis KIM
cucauugguucacuga

SEQ ID NO: 2311511 - RNA, 14 nt, Yersinia pestis KIM
cucauuuaaaauac

SEQ ID NO: 2311512 - RNA, 13 nt, Yersinia pestis KIM
cucauuuaaaaua

SEQ ID NO: 2311513 - RNA, 11 nt, Yersinia pestis KIM
cucauuuuuug

SEQ ID NO: 2311514 - RNA, 13 nt, Yersinia pestis KIM
cucauuuuuugcg

SEQ ID NO: 2311515 - RNA, 22 nt, Yersinia pestis KIM
cuccaagcacacugguugaaac

SEQ ID NO: 2311516 - RNA, 22 nt, Yersinia pestis KIM
cucccuauaaugcgccuccacu

SEQ ID NO: 2311517 - RNA, 20 nt, Yersinia pestis KIM
cuccagccgguuuuuuccac

SEQ ID NO: 2311518 - RNA, 17 nt, Yersinia pestis KIM
cuccauuuuuuugaugc

SEQ ID NO: 2311519 - RNA, 17 nt, Yersinia pestis KIM
cucccauucgcgcccca

SEQ ID NO: 2311520 - RNA, 20 nt, Yersinia pestis KIM
cucccauucgcgccccaaau

SEQ ID NO: 2311521 - RNA, 13 nt, Yersinia pestis KIM
cucccauuaauua

SEQ ID NO: 2311522 - RNA, 15 nt, Yersinia pestis KIM
cucccauuaauuaau

SEQ ID NO: 2311523 - RNA, 20 nt, Yersinia pestis KIM
cuccggcgugaguuccagcc

SEQ ID NO: 2311524 - RNA, 15 nt, Yersinia pestis KIM
cuccgcggugcuuuu

SEQ ID NO: 2311525 - RNA, 16 nt, Yersinia pestis KIM
cuccguugcaggcacu

SEQ ID NO: 2311526 - RNA, 22 nt, Yersinia pestis KIM
cuccgguucuugcgcgcuggga

SEQ ID NO: 2311527 - RNA, 22 nt, Yersinia pestis KIM
cuccggugguuucgccgccaau

SEQ ID NO: 2311528 - RNA, 14 nt, Yersinia pestis KIM
aaaaaaaagaaaau

SEQ ID NO: 2311529 - RNA, 15 nt, Yersinia pestis KIM
aaaaaaagacacuaa

SEQ ID NO: 2311530 - RNA, 20 nt, Yersinia pestis KIM
aaaaaaccuuauuuuugcau

SEQ ID NO: 2311531 - RNA, 16 nt, Yersinia pestis KIM
aaaaaagaaaauggcu

SEQ ID NO: 2311532 - RNA, 23 nt, Yersinia pestis KIM
aaaaaacgggucgucucuugcaa

SEQ ID NO: 2311533 - RNA, 16 nt, Yersinia pestis KIM
aaaaaauuaaaauaau

SEQ ID NO: 2311534 - RNA, 16 nt, Yersinia pestis KIM
aaaaaagcuauaaaua

SEQ ID NO: 2311535 - RNA, 19 nt, Yersinia pestis KIM
aaaaaagcuauaaauaaau

SEQ ID NO: 2311536 - RNA, 18 nt, Yersinia pestis KIM
aaaaaauuaaaauaauga

SEQ ID NO: 2311537 - RNA, 21 nt, Yersinia pestis KIM
aaaaaaugccagccccaauca

SEQ ID NO: 2311538 - RNA, 16 nt, Yersinia pestis KIM
aaaaaacuaagggcga

SEQ ID NO: 2311539 - RNA, 18 nt, Yersinia pestis KIM
aaaaaacggugaacauuu

SEQ ID NO: 2311540 - RNA, 19 nt, Yersinia pestis KIM
aaaaaagaguaaauaaaua

SEQ ID NO: 2311541 - RNA, 23 nt, Yersinia pestis KIM
aaaaacaaaugauuauuuauuua

SEQ ID NO: 2311542 - RNA, 13 nt, Yersinia pestis KIM
aaaaaauuaucau

SEQ ID NO: 2311543 - RNA, 14 nt, Yersinia pestis KIM
aaaaaauuauuaaa

SEQ ID NO: 2311544 - RNA, 12 nt, Yersinia pestis KIM
aaaaagauggcu

SEQ ID NO: 2311545 - RNA, 15 nt, Yersinia pestis KIM
aaaaagacauaaaga

SEQ ID NO: 2311546 - RNA, 15 nt, Yersinia pestis KIM
aaaaacuucaucgau

SEQ ID NO: 2311547 - RNA, 22 nt, Yersinia pestis KIM
aaaaaggauuuuauuaaaucac

SEQ ID NO: 2311548 - RNA, 21 nt, Yersinia pestis KIM
aaaaaggcaccagcgcacuga

SEQ ID NO: 2311549 - RNA, 15 nt, Yersinia pestis KIM
aaaaagcgacacuua

SEQ ID NO: 2311550 - RNA, 15 nt, Yersinia pestis KIM
aaaaagcgaucgacc

SEQ ID NO: 2311551 - RNA, 22 nt, Yersinia pestis KIM
aaaaagccggguggcccaauaa

SEQ ID NO: 2311552 - RNA, 16 nt, Yersinia pestis KIM
aaaaagcguuucagag

SEQ ID NO: 2311553 - RNA, 17 nt, Yersinia pestis KIM
aaaaacugaaaaaggca

SEQ ID NO: 2311554 - RNA, 16 nt, Yersinia pestis KIM
aaaaacgugaauaucc

SEQ ID NO: 2311555 - RNA, 19 nt, Yersinia pestis KIM
aaaaacccauuaaaaacaa

SEQ ID NO: 2311556 - RNA, 21 nt, Yersinia pestis KIM
aaaaaccaucugaugcagguu

SEQ ID NO: 2311557 - RNA, 21 nt, Yersinia pestis KIM
aaaaaccaugagaauacuuca

SEQ ID NO: 2311558 - RNA, 23 nt, Yersinia pestis KIM
aaaaacggacgaccuguagcuuu

SEQ ID NO: 2311559 - RNA, 17 nt, Yersinia pestis KIM
aaaaacgccuccaguga

SEQ ID NO: 2311560 - RNA, 18 nt, Yersinia pestis KIM
aaaaacgcagauuuguac

SEQ ID NO: 2311561 - RNA, 18 nt, Yersinia pestis KIM
aaaaacacagguucucca

SEQ ID NO: 2311562 - RNA, 17 nt, Yersinia pestis KIM
aaaaacacgguugaaaa

SEQ ID NO: 2311563 - RNA, 19 nt, Yersinia pestis KIM
aaaaaccggcguaaauaaa

SEQ ID NO: 2311564 - RNA, 12 nt, Yersinia pestis KIM
aaaaaccgcagc

SEQ ID NO: 2311565 - RNA, 14 nt, Yersinia pestis KIM
aaaaacccucuuca

SEQ ID NO: 2311566 - RNA, 19 nt, Yersinia pestis KIM
aaaaacgccaucaauaauu

SEQ ID NO: 2311567 - RNA, 17 nt, Yersinia pestis KIM
aaaaacgccaucaauaa

SEQ ID NO: 2311568 - RNA, 15 nt, Yersinia pestis KIM
aaaaacgcuggccag

SEQ ID NO: 2311569 - RNA, 11 nt, Yersinia pestis KIM
aaaaacgcugg

SEQ ID NO: 2311570 - RNA, 17 nt, Yersinia pestis KIM
aaaaacgcacgaaaaca

SEQ ID NO: 2311571 - RNA, 17 nt, Yersinia pestis KIM
aaaaacuuaucuaaaaa

SEQ ID NO: 2311572 - RNA, 20 nt, Yersinia pestis KIM
aaaaacugcggcaauaagca

SEQ ID NO: 2311573 - RNA, 23 nt, Yersinia pestis KIM
aaaaacucgcgccugaaaucauu

SEQ ID NO: 2311574 - RNA, 21 nt, Yersinia pestis KIM
aaaaacguuacugcucgccca

SEQ ID NO: 2311575 - RNA, 23 nt, Yersinia pestis KIM
aaaaagugcuauccucuuaaugu

SEQ ID NO: 2311576 - RNA, 14 nt, Yersinia pestis KIM
aaaaaguguugacg

SEQ ID NO: 2311577 - RNA, 18 nt, Yersinia pestis KIM
aaaaagucauuaacuguu

SEQ ID NO: 2311578 - RNA, 19 nt, Yersinia pestis KIM
aaaaauaucuuuaaacccc

SEQ ID NO: 2311579 - RNA, 23 nt, Yersinia pestis KIM
aaaaauauuaacugcagugaaaa

SEQ ID NO: 2311580 - RNA, 17 nt, Yersinia pestis KIM
aaaaauggaguuuuacu

SEQ ID NO: 2311581 - RNA, 22 nt, Yersinia pestis KIM
aaaaaucuuguuaauuuaaaca

SEQ ID NO: 2311582 - RNA, 19 nt, Yersinia pestis KIM
aaaaaucugcaauaucauc

SEQ ID NO: 2311583 - RNA, 21 nt, Yersinia pestis KIM
aaaaauucauucuuuuauaca

SEQ ID NO: 2311584 - RNA, 22 nt, Yersinia pestis KIM
aaaaccuuuauguaguucaguc

SEQ ID NO: 2311585 - RNA, 22 nt, Yersinia pestis KIM
aaaaccuuauuuuugcauauaa

SEQ ID NO: 2311586 - RNA, 12 nt, Yersinia pestis KIM
aaaaccuuuaau

SEQ ID NO: 2311587 - RNA, 24 nt, Yersinia pestis KIM
aaaaccuuuaaucagauauuccug

SEQ ID NO: 2311588 - RNA, 21 nt, Yersinia pestis KIM
aaaaccggcguaaauaaaagc

SEQ ID NO: 2311589 - RNA, 21 nt, Yersinia pestis KIM
aaaaccgccccccauccccaa

SEQ ID NO: 2311590 - RNA, 16 nt, Yersinia pestis KIM
aaaacccauuaaaaac

SEQ ID NO: 2311591 - RNA, 15 nt, Yersinia pestis KIM
aaaaccacugaccua

SEQ ID NO: 2311592 - RNA, 14 nt, Yersinia pestis KIM
aaaaccacugaccu

SEQ ID NO: 2311593 - RNA, 15 nt, Yersinia pestis KIM
aaaaccaccaaaaua

SEQ ID NO: 2311594 - RNA, 11 nt, Yersinia pestis KIM
aaaaccagcag

SEQ ID NO: 2311595 - RNA, 23 nt, Yersinia pestis KIM
aaaaccagcagcgcauaaaaaua

SEQ ID NO: 2311596 - RNA, 20 nt, Yersinia pestis KIM
aaaacaggcgaguuucccuu

SEQ ID NO: 2311597 - RNA, 22 nt, Yersinia pestis KIM
aaaacaguucggucuauaaaac

SEQ ID NO: 2311598 - RNA, 10 nt, Yersinia pestis KIM
aaaacaguuu

SEQ ID NO: 2311599 - RNA, 17 nt, Yersinia pestis KIM
aaaauugacgaaaguua

SEQ ID NO: 2311600 - RNA, 22 nt, Yersinia pestis KIM
aaacaaugugccgcgcaaccau

SEQ ID NO: 2311601 - RNA, 19 nt, Yersinia pestis KIM
aaacaaucugaugaauuaa

SEQ ID NO: 2311602 - RNA, 14 nt, Yersinia pestis KIM
aaacacgcaacacu

SEQ ID NO: 2311603 - RNA, 16 nt, Yersinia pestis KIM
aaacacccaagaauau

SEQ ID NO: 2311604 - RNA, 17 nt, Yersinia pestis KIM
aaacaccggcaauauga

SEQ ID NO: 2311605 - RNA, 17 nt, Yersinia pestis KIM
aaacacuuaugaucuug

SEQ ID NO: 2311606 - RNA, 16 nt, Yersinia pestis KIM
aaacacucaauaagua

SEQ ID NO: 2311607 - RNA, 22 nt, Yersinia pestis KIM
aaacacugauuuauaaauaauu

SEQ ID NO: 2311608 - RNA, 13 nt, Yersinia pestis KIM
aaacaauuucgaa

SEQ ID NO: 2311609 - RNA, 19 nt, Yersinia pestis KIM
aaacacaaaauagaaaaca

SEQ ID NO: 2311610 - RNA, 23 nt, Yersinia pestis KIM
aaacacaaaauagaaaacagcaa

SEQ ID NO: 2311611 - RNA, 23 nt, Yersinia pestis KIM
aaacauacuuuucauuuccucug

SEQ ID NO: 2311612 - RNA, 18 nt, Yersinia pestis KIM
aaacaguuaaagguaaaa

SEQ ID NO: 2311613 - RNA, 13 nt, Yersinia pestis KIM
aaacaguagcagg

SEQ ID NO: 2311614 - RNA, 12 nt, Yersinia pestis KIM
aaacagucuuau

SEQ ID NO: 2311615 - RNA, 16 nt, Yersinia pestis KIM
aaacagucuuauuacu

SEQ ID NO: 2311616 - RNA, 16 nt, Yersinia pestis KIM
aaacagggcagaaaau

SEQ ID NO: 2311617 - RNA, 19 nt, Yersinia pestis KIM
aaacagguaaugcgcgcag

SEQ ID NO: 2311618 - RNA, 22 nt, Yersinia pestis KIM
aaacagccaccagccaacuuuc

SEQ ID NO: 2311619 - RNA, 17 nt, Yersinia pestis KIM
aaacagcacuaucccca

SEQ ID NO: 2311620 - RNA, 15 nt, Yersinia pestis KIM
aaacagcaacaccau

SEQ ID NO: 2311621 - RNA, 23 nt, Yersinia pestis KIM
aaacagauacaucgccaguguug

SEQ ID NO: 2311622 - RNA, 23 nt, Yersinia pestis KIM
aaacagaucacccgcaaaacuga

SEQ ID NO: 2311623 - RNA, 14 nt, Yersinia pestis KIM
aaaccacugaccua

SEQ ID NO: 2311624 - RNA, 10 nt, Yersinia pestis KIM
aaaccacuga

SEQ ID NO: 2311625 - RNA, 12 nt, Yersinia pestis KIM
aaaccacgcggu

SEQ ID NO: 2311626 - RNA, 15 nt, Yersinia pestis KIM
aaaccacgcgguugg

SEQ ID NO: 2311627 - RNA, 18 nt, Yersinia pestis KIM
aaaccaccaaaauagcgg

SEQ ID NO: 2311628 - RNA, 22 nt, Yersinia pestis KIM
aaacauuuucaucugaccaaac

SEQ ID NO: 2311629 - RNA, 23 nt, Yersinia pestis KIM
aaacauuuucaucugaccaaaca

SEQ ID NO: 2311630 - RNA, 24 nt, Yersinia pestis KIM
aaaccaaaaagggcacagcgagau

SEQ ID NO: 2311631 - RNA, 21 nt, Yersinia pestis KIM
aaaccaacaauauucgcagcc

SEQ ID NO: 2311632 - RNA, 13 nt, Yersinia pestis KIM
aaaccaacaauau

SEQ ID NO: 2311633 - RNA, 14 nt, Yersinia pestis KIM
aaaccaaagauaau

SEQ ID NO: 2311634 - RNA, 21 nt, Yersinia pestis KIM
aaaccaaagauaauacauaaa

SEQ ID NO: 2311635 - RNA, 16 nt, Yersinia pestis KIM
aaaccaagaagacuaa

SEQ ID NO: 2311636 - RNA, 13 nt, Yersinia pestis KIM
aaacauuggcuuu

SEQ ID NO: 2311637 - RNA, 15 nt, Yersinia pestis KIM
aaacauuuaaauaug

SEQ ID NO: 2311638 - RNA, 17 nt, Yersinia pestis KIM
aaacauuuaaauaugaa

SEQ ID NO: 2311639 - RNA, 20 nt, Yersinia pestis KIM
aaacauuuacuuauaaacac

SEQ ID NO: 2311640 - RNA, 22 nt, Yersinia pestis KIM
aaacauuguuaccuaaccaaac

SEQ ID NO: 2311641 - RNA, 19 nt, Yersinia pestis KIM
aaacauugacgauggaauc

SEQ ID NO: 2311642 - RNA, 22 nt, Yersinia pestis KIM
aaacauggcucucuuuuuucuc

SEQ ID NO: 2311643 - RNA, 19 nt, Yersinia pestis KIM
aaacauggcggcagcacag

SEQ ID NO: 2311644 - RNA, 20 nt, Yersinia pestis KIM
aaacauggcggcagcacaga

SEQ ID NO: 2311645 - RNA, 17 nt, Yersinia pestis KIM
aaacaucgacaccaaga

SEQ ID NO: 2311646 - RNA, 23 nt, Yersinia pestis KIM
aaacaucaucccuauagacaaua

SEQ ID NO: 2311647 - RNA, 22 nt, Yersinia pestis KIM
aaacccucuguagagaaauuca

SEQ ID NO: 2311648 - RNA, 13 nt, Yersinia pestis KIM
aaaccgcaccaca

SEQ ID NO: 2311649 - RNA, 19 nt, Yersinia pestis KIM
aaaccgcuguuuuaaucgg

SEQ ID NO: 2311650 - RNA, 16 nt, Yersinia pestis KIM
aaaccggaugauuuca

SEQ ID NO: 2311651 - RNA, 19 nt, Yersinia pestis KIM
aaaccgcuggugacggcuu

SEQ ID NO: 2311652 - RNA, 23 nt, Yersinia pestis KIM
aaaccgcuauaucaucagcagag

SEQ ID NO: 2311653 - RNA, 23 nt, Yersinia pestis KIM
aaaccgcagcagacaacugacaa

SEQ ID NO: 2311654 - RNA, 22 nt, Yersinia pestis KIM
aaaccgggccuaauuuaacuuu

SEQ ID NO: 2311655 - RNA, 22 nt, Yersinia pestis KIM
aaaccguacauuaaaugaauac

SEQ ID NO: 2311656 - RNA, 17 nt, Yersinia pestis KIM
aaaccgguuaaaacaga

SEQ ID NO: 2311657 - RNA, 18 nt, Yersinia pestis KIM
aaaccaucugaugcaggu

SEQ ID NO: 2311658 - RNA, 22 nt, Yersinia pestis KIM
aaaccagaugaucugaugauca

SEQ ID NO: 2311659 - RNA, 22 nt, Yersinia pestis KIM
aaaccauugguaauaaugccca

SEQ ID NO: 2311660 - RNA, 17 nt, Yersinia pestis KIM
aaacccaccugaaucuc

SEQ ID NO: 2311661 - RNA, 17 nt, Yersinia pestis KIM
aaacccauuaaaaacaa

SEQ ID NO: 2311662 - RNA, 19 nt, Yersinia pestis KIM
aaaccccuuuugauuuguu

SEQ ID NO: 2311663 - RNA, 23 nt, Yersinia pestis KIM
aaaacgauuagcuugugugcuua

SEQ ID NO: 2311664 - RNA, 15 nt, Yersinia pestis KIM
aaaacgccagcagac

SEQ ID NO: 2311665 - RNA, 18 nt, Yersinia pestis KIM
aaaagcgccuuuuauucu

SEQ ID NO: 2311666 - RNA, 16 nt, Yersinia pestis KIM
aaaacgccuccaguga

SEQ ID NO: 2311667 - RNA, 19 nt, Yersinia pestis KIM
aaaaacugugcaaauggcu

SEQ ID NO: 2311668 - RNA, 20 nt, Yersinia pestis KIM
aaaaacugugcaaauggcuu

SEQ ID NO: 2311669 - RNA, 21 nt, Yersinia pestis KIM
aaaaacuucaucgauaguaaa

SEQ ID NO: 2311670 - RNA, 14 nt, Yersinia pestis KIM
aaaaacuuuuauug

SEQ ID NO: 2311671 - RNA, 17 nt, Yersinia pestis KIM
aaaaagaaaaaaacaga

SEQ ID NO: 2311672 - RNA, 14 nt, Yersinia pestis KIM
aaaaagaaaaaaac

SEQ ID NO: 2311673 - RNA, 11 nt, Yersinia pestis KIM
aaaaagaaaau

SEQ ID NO: 2311674 - RNA, 14 nt, Yersinia pestis KIM
aaaaagacacuaac

SEQ ID NO: 2311675 - RNA, 19 nt, Yersinia pestis KIM
aaaaguuuuuugaaauuag

SEQ ID NO: 2311676 - RNA, 13 nt, Yersinia pestis KIM
aaaauaacguagu

SEQ ID NO: 2311677 - RNA, 13 nt, Yersinia pestis KIM
aaaauaaccaaca

SEQ ID NO: 2311678 - RNA, 18 nt, Yersinia pestis KIM
aaaauaaagggggcaccg

SEQ ID NO: 2311679 - RNA, 14 nt, Yersinia pestis KIM
aaaaggauggccca

SEQ ID NO: 2311680 - RNA, 18 nt, Yersinia pestis KIM
aaaaggauagggagccaa

SEQ ID NO: 2311681 - RNA, 18 nt, Yersinia pestis KIM
aaaagggaguucaucaaa

SEQ ID NO: 2311682 - RNA, 22 nt, Yersinia pestis KIM
aaaagucagcaaaucaaacaaa

SEQ ID NO: 2311683 - RNA, 17 nt, Yersinia pestis KIM
aaaagguuaacugcagu

SEQ ID NO: 2311684 - RNA, 15 nt, Yersinia pestis KIM
aaaagucagcaaauc

SEQ ID NO: 2311685 - RNA, 12 nt, Yersinia pestis KIM
aaaauuaacuua

SEQ ID NO: 2311686 - RNA, 13 nt, Yersinia pestis KIM
aaaauuaauaaau

SEQ ID NO: 2311687 - RNA, 13 nt, Yersinia pestis KIM
aaaauuaaaauaa

SEQ ID NO: 2311688 - RNA, 18 nt, Yersinia pestis KIM
aaaauguguuuucugugc

SEQ ID NO: 2311689 - RNA, 14 nt, Yersinia pestis KIM
aaaaugagccugaa

SEQ ID NO: 2311690 - RNA, 18 nt, Yersinia pestis KIM
aaaauggcuuuuuuaaua

SEQ ID NO: 2311691 - RNA, 22 nt, Yersinia pestis KIM
aaaauggguauauuuaccaaaa

SEQ ID NO: 2311692 - RNA, 16 nt, Yersinia pestis KIM
aaaaucuuguuaauuu

SEQ ID NO: 2311693 - RNA, 19 nt, Yersinia pestis KIM
aaaaucuuccuuuccauuu

SEQ ID NO: 2311694 - RNA, 13 nt, Yersinia pestis KIM
aaaaucaaaacag

SEQ ID NO: 2311695 - RNA, 15 nt, Yersinia pestis KIM
aaaaucaaaaaugau

SEQ ID NO: 2311696 - RNA, 13 nt, Yersinia pestis KIM
aaaauauuuugcu

SEQ ID NO: 2311697 - RNA, 22 nt, Yersinia pestis KIM
aaaaucaguaccgacaccaaua

SEQ ID NO: 2311698 - RNA, 15 nt, Yersinia pestis KIM
aaaaucauggcauaa

SEQ ID NO: 2311699 - RNA, 22 nt, Yersinia pestis KIM
aaaauauuaacugcagugaaaa

SEQ ID NO: 2311700 - RNA, 18 nt, Yersinia pestis KIM
aaaauauucuaaguaaaa

SEQ ID NO: 2311701 - RNA, 13 nt, Yersinia pestis KIM
aaaauauccagca

SEQ ID NO: 2311702 - RNA, 17 nt, Yersinia pestis KIM
aaaauaucgcgcuucag

SEQ ID NO: 2311703 - RNA, 20 nt, Yersinia pestis KIM
aaaauaugauaguguaaaaa

SEQ ID NO: 2311704 - RNA, 15 nt, Yersinia pestis KIM
aaaauacaaccaaca

SEQ ID NO: 2311705 - RNA, 16 nt, Yersinia pestis KIM
aaaauacccaacaggu

SEQ ID NO: 2311706 - RNA, 18 nt, Yersinia pestis KIM
aaaauacccaaagucauu

SEQ ID NO: 2311707 - RNA, 13 nt, Yersinia pestis KIM
aaaauaucacuau

SEQ ID NO: 2311708 - RNA, 23 nt, Yersinia pestis KIM
aaagcguccgcgccaaggcaagg

SEQ ID NO: 2311709 - RNA, 17 nt, Yersinia pestis KIM
aaagcuauaaauaaauu

SEQ ID NO: 2311710 - RNA, 22 nt, Yersinia pestis KIM
aaagcguccgcgccaaggaagg

SEQ ID NO: 2311711 - RNA, 11 nt, Yersinia pestis KIM
aaagcgucagc

SEQ ID NO: 2311712 - RNA, 19 nt, Yersinia pestis KIM
aaagcgggccagcaaccac

SEQ ID NO: 2311713 - RNA, 16 nt, Yersinia pestis KIM
aaagcucugacaaaau

SEQ ID NO: 2311714 - RNA, 22 nt, Yersinia pestis KIM
aaagcucugacaaaaugccaga

SEQ ID NO: 2311715 - RNA, 18 nt, Yersinia pestis KIM
aaagcgccuuccuuuuau

SEQ ID NO: 2311716 - RNA, 16 nt, Yersinia pestis KIM
aaagcgccugauggcg

SEQ ID NO: 2311717 - RNA, 18 nt, Yersinia pestis KIM
aaagccuuucagcgcugc

SEQ ID NO: 2311718 - RNA, 17 nt, Yersinia pestis KIM
aaagcgacacuuauugg

SEQ ID NO: 2311719 - RNA, 22 nt, Yersinia pestis KIM
aaagcgacacuuauuggucgcu

SEQ ID NO: 2311720 - RNA, 12 nt, Yersinia pestis KIM
aaagccugccau

SEQ ID NO: 2311721 - RNA, 16 nt, Yersinia pestis KIM
aaagccuguaaaauau

SEQ ID NO: 2311722 - RNA, 19 nt, Yersinia pestis KIM
aaagcaucaaucaucugcu

SEQ ID NO: 2311723 - RNA, 24 nt, Yersinia pestis KIM
aaagcaucaaucaucugcuguaca

SEQ ID NO: 2311724 - RNA, 14 nt, Yersinia pestis KIM
aaagcaucaccaaa

SEQ ID NO: 2311725 - RNA, 20 nt, Yersinia pestis KIM
aaagcaucucgauacauacc

SEQ ID NO: 2311726 - RNA, 14 nt, Yersinia pestis KIM
aaaggcugcaccuu

SEQ ID NO: 2311727 - RNA, 17 nt, Yersinia pestis KIM
aaaggcugcaccuuaca

SEQ ID NO: 2311728 - RNA, 15 nt, Yersinia pestis KIM
aaaggcuauuuaaau

SEQ ID NO: 2311729 - RNA, 12 nt, Yersinia pestis KIM
aaaggcgcugga

SEQ ID NO: 2311730 - RNA, 11 nt, Yersinia pestis KIM
aaagguaaaca

SEQ ID NO: 2311731 - RNA, 21 nt, Yersinia pestis KIM
aaagguaugugccaaaaaaag

SEQ ID NO: 2311732 - RNA, 19 nt, Yersinia pestis KIM
aaaggucguugccuguagc

SEQ ID NO: 2311733 - RNA, 23 nt, Yersinia pestis KIM
aaaggauggcccaagccauccuu

SEQ ID NO: 2311734 - RNA, 23 nt, Yersinia pestis KIM
aaaggauuugaagacaacucuuc

SEQ ID NO: 2311735 - RNA, 18 nt, Yersinia pestis KIM
aaaggauuugaagacaac

SEQ ID NO: 2311736 - RNA, 16 nt, Yersinia pestis KIM
aaagauuaagacuuuc

SEQ ID NO: 2311737 - RNA, 20 nt, Yersinia pestis KIM
aaagauggcauuaaaaaucu

SEQ ID NO: 2311738 - RNA, 16 nt, Yersinia pestis KIM
aaagcacagacaaaca

SEQ ID NO: 2311739 - RNA, 18 nt, Yersinia pestis KIM
aaagcacagacaaacaac

SEQ ID NO: 2311740 - RNA, 16 nt, Yersinia pestis KIM
aaagacauaaagaaaa

SEQ ID NO: 2311741 - RNA, 13 nt, Yersinia pestis KIM
aaagagugaaaua

SEQ ID NO: 2311742 - RNA, 23 nt, Yersinia pestis KIM
aaagaucugcauugauuaaauca

SEQ ID NO: 2311743 - RNA, 16 nt, Yersinia pestis KIM
aaagaguaaauaaaua

SEQ ID NO: 2311744 - RNA, 15 nt, Yersinia pestis KIM
aaagagucgcuuugg

SEQ ID NO: 2311745 - RNA, 19 nt, Yersinia pestis KIM
aaaccgugauugguuuauc

SEQ ID NO: 2311746 - RNA, 21 nt, Yersinia pestis KIM
aaaccgugauugguuuauccc

SEQ ID NO: 2311747 - RNA, 17 nt, Yersinia pestis KIM
aaaccuaacgccaaaau

SEQ ID NO: 2311748 - RNA, 14 nt, Yersinia pestis KIM
aaaccuaaugccag

SEQ ID NO: 2311749 - RNA, 13 nt, Yersinia pestis KIM
aaaccuaaaccuu

SEQ ID NO: 2311750 - RNA, 15 nt, Yersinia pestis KIM
aaagaaaauggcuuu

SEQ ID NO: 2311751 - RNA, 12 nt, Yersinia pestis KIM
aaagaaaaauag

SEQ ID NO: 2311752 - RNA, 15 nt, Yersinia pestis KIM
aaagaaaaaucgcca

SEQ ID NO: 2311753 - RNA, 21 nt, Yersinia pestis KIM
aaagaaaaucaggauaucuau

SEQ ID NO: 2311754 - RNA, 17 nt, Yersinia pestis KIM
aaagaaauaaaagaaaa

SEQ ID NO: 2311755 - RNA, 21 nt, Yersinia pestis KIM
aaagaagacgaguaaugaaau

SEQ ID NO: 2311756 - RNA, 23 nt, Yersinia pestis KIM
aaauagauaaaaacauuuaaaua

SEQ ID NO: 2311757 - RNA, 11 nt, Yersinia pestis KIM
aaauagagcac

SEQ ID NO: 2311758 - RNA, 20 nt, Yersinia pestis KIM
aaauagauagcaaucaauaa

SEQ ID NO: 2311759 - RNA, 16 nt, Yersinia pestis KIM
aaauagacucaacaaa

SEQ ID NO: 2311760 - RNA, 17 nt, Yersinia pestis KIM
aaauagacucaacaaac

SEQ ID NO: 2311761 - RNA, 13 nt, Yersinia pestis KIM
aaauagauuuaac

SEQ ID NO: 2311762 - RNA, 19 nt, Yersinia pestis KIM
aaauaguugcuaucaauaa

SEQ ID NO: 2311763 - RNA, 18 nt, Yersinia pestis KIM
aaauaguuguuagccacu

SEQ ID NO: 2311764 - RNA, 19 nt, Yersinia pestis KIM
aaauaucauccccuuucug

SEQ ID NO: 2311765 - RNA, 21 nt, Yersinia pestis KIM
aaauauccuccggcauagccg

SEQ ID NO: 2311766 - RNA, 15 nt, Yersinia pestis KIM
aaauaucuuuaaacc

SEQ ID NO: 2311767 - RNA, 20 nt, Yersinia pestis KIM
aaauaccgcgaucaacaaga

SEQ ID NO: 2311768 - RNA, 18 nt, Yersinia pestis KIM
aaauaccgcgaucaacaa

SEQ ID NO: 2311769 - RNA, 20 nt, Yersinia pestis KIM
aaauaccgccaaauacaaac

SEQ ID NO: 2311770 - RNA, 20 nt, Yersinia pestis KIM
aaauacccagcuucuuuuaa

SEQ ID NO: 2311771 - RNA, 20 nt, Yersinia pestis KIM
aaauacauccauguaggcuc

SEQ ID NO: 2311772 - RNA, 16 nt, Yersinia pestis KIM
aaauacauccauguag

SEQ ID NO: 2311773 - RNA, 17 nt, Yersinia pestis KIM
aaauaccaacccgauac

SEQ ID NO: 2311774 - RNA, 19 nt, Yersinia pestis KIM
aaauaccggauuguucagc

SEQ ID NO: 2311775 - RNA, 22 nt, Yersinia pestis KIM
aaauaccugaguagcauaaaaa

SEQ ID NO: 2311776 - RNA, 14 nt, Yersinia pestis KIM
aaauagaaaacagc

SEQ ID NO: 2311777 - RNA, 22 nt, Yersinia pestis KIM
aaauagaagguaaucagacugc

SEQ ID NO: 2311778 - RNA, 22 nt, Yersinia pestis KIM
aaauaauguccccuugaguauc

SEQ ID NO: 2311779 - RNA, 12 nt, Yersinia pestis KIM
aaauaauuaaac

SEQ ID NO: 2311780 - RNA, 23 nt, Yersinia pestis KIM
aaauaauuaaaccucagaaaaau

SEQ ID NO: 2311781 - RNA, 15 nt, Yersinia pestis KIM
aaauacaaccaacaa

SEQ ID NO: 2311782 - RNA, 17 nt, Yersinia pestis KIM
aaauacaaccaacaaac

SEQ ID NO: 2311783 - RNA, 13 nt, Yersinia pestis KIM
aaauacaaccaac

SEQ ID NO: 2311784 - RNA, 16 nt, Yersinia pestis KIM
aaauacaaaaauacaa

SEQ ID NO: 2311785 - RNA, 23 nt, Yersinia pestis KIM
aaauacaggggcguuauugagaa

SEQ ID NO: 2311786 - RNA, 16 nt, Yersinia pestis KIM
aaauacauaucaacac

SEQ ID NO: 2311787 - RNA, 12 nt, Yersinia pestis KIM
aaauacauauca

SEQ ID NO: 2311788 - RNA, 16 nt, Yersinia pestis KIM
aaauacauaauaauga

SEQ ID NO: 2311789 - RNA, 18 nt, Yersinia pestis KIM
aaaguuauugaccaauau

SEQ ID NO: 2311790 - RNA, 20 nt, Yersinia pestis KIM
aaaguuuagcaaagcaucga

SEQ ID NO: 2311791 - RNA, 15 nt, Yersinia pestis KIM
aaaguugagcagcaa

SEQ ID NO: 2311792 - RNA, 21 nt, Yersinia pestis KIM
aaauaaacgggcuuccaucag

SEQ ID NO: 2311793 - RNA, 11 nt, Yersinia pestis KIM
aaauaaaacaa

SEQ ID NO: 2311794 - RNA, 19 nt, Yersinia pestis KIM
aaauaaauaaguucagauu

SEQ ID NO: 2311795 - RNA, 19 nt, Yersinia pestis KIM
aaauaaaguccagaggccg

SEQ ID NO: 2311796 - RNA, 16 nt, Yersinia pestis KIM
aaauaaagauaaugug

SEQ ID NO: 2311797 - RNA, 22 nt, Yersinia pestis KIM
aaaguggugagcugaucugcca

SEQ ID NO: 2311798 - RNA, 20 nt, Yersinia pestis KIM
aaagugcugcaaggcauuaa

SEQ ID NO: 2311799 - RNA, 14 nt, Yersinia pestis KIM
aaagugcuucucug

SEQ ID NO: 2311800 - RNA, 18 nt, Yersinia pestis KIM
aaaguggccacucaccuc

SEQ ID NO: 2311801 - RNA, 15 nt, Yersinia pestis KIM
aaagugacgaaugag

SEQ ID NO: 2311802 - RNA, 18 nt, Yersinia pestis KIM
aaagugcuauccucuuaa

SEQ ID NO: 2311803 - RNA, 13 nt, Yersinia pestis KIM
aaaguagaaauaa

SEQ ID NO: 2311804 - RNA, 15 nt, Yersinia pestis KIM
aaauuaaaaauuaau

SEQ ID NO: 2311805 - RNA, 13 nt, Yersinia pestis KIM
aaaaagagucagu

SEQ ID NO: 2311806 - RNA, 12 nt, Yersinia pestis KIM
aaauuaaaauaa

SEQ ID NO: 2311807 - RNA, 16 nt, Yersinia pestis KIM
aaauuaaucuuguaaa

SEQ ID NO: 2311808 - RNA, 17 nt, Yersinia pestis KIM
aaaaagcagcaaacgaa

SEQ ID NO: 2311809 - RNA, 19 nt, Yersinia pestis KIM
aaauuacucguauaaaaaa

SEQ ID NO: 2311810 - RNA, 20 nt, Yersinia pestis KIM
aaauuacucguauaaaaaau

SEQ ID NO: 2311811 - RNA, 23 nt, Yersinia pestis KIM
aaauuacucguauaaaaaauaag

SEQ ID NO: 2311812 - RNA, 14 nt, Yersinia pestis KIM
aaauuagaaaacaa

SEQ ID NO: 2311813 - RNA, 16 nt, Yersinia pestis KIM
aaauuagaaaacaagu

SEQ ID NO: 2311814 - RNA, 21 nt, Yersinia pestis KIM
aaauucaaaauagaggaaaua

SEQ ID NO: 2311815 - RNA, 16 nt, Yersinia pestis KIM
aaauggucaguuuaau

SEQ ID NO: 2311816 - RNA, 15 nt, Yersinia pestis KIM
aaauggguuguucuu

SEQ ID NO: 2311817 - RNA, 19 nt, Yersinia pestis KIM
aaaugguuugcuguucuug

SEQ ID NO: 2311818 - RNA, 16 nt, Yersinia pestis KIM
aaauguaagcuacuaa

SEQ ID NO: 2311819 - RNA, 17 nt, Yersinia pestis KIM
aaauguacagucauuua

SEQ ID NO: 2311820 - RNA, 21 nt, Yersinia pestis KIM
aaaugucgaaagauagcaaaa

SEQ ID NO: 2311821 - RNA, 14 nt, Yersinia pestis KIM
aaaugucagcguuu

SEQ ID NO: 2311822 - RNA, 15 nt, Yersinia pestis KIM
aaaugcaauauugcu

SEQ ID NO: 2311823 - RNA, 21 nt, Yersinia pestis KIM
aaaugaucaucaagccaaugg

SEQ ID NO: 2311824 - RNA, 19 nt, Yersinia pestis KIM
aaaugggccugaguggggg

SEQ ID NO: 2311825 - RNA, 23 nt, Yersinia pestis KIM
aaauggcuuuuuuaauaaaaaac

SEQ ID NO: 2311826 - RNA, 19 nt, Yersinia pestis KIM
aaauggcuuuuuuaauaaa

SEQ ID NO: 2311827 - RNA, 18 nt, Yersinia pestis KIM
aaauggcguuguagggag

SEQ ID NO: 2311828 - RNA, 22 nt, Yersinia pestis KIM
aaauggcguuuaaaguaaauca

SEQ ID NO: 2311829 - RNA, 16 nt, Yersinia pestis KIM
aaauggccuugcccau

SEQ ID NO: 2311830 - RNA, 17 nt, Yersinia pestis KIM
aaaugcauuauaaggaa

SEQ ID NO: 2311831 - RNA, 21 nt, Yersinia pestis KIM
aaauggcacuggaaacaaaac

SEQ ID NO: 2311832 - RNA, 21 nt, Yersinia pestis KIM
aaauggcagggccgauaaaaa

SEQ ID NO: 2311833 - RNA, 22 nt, Yersinia pestis KIM
aaaucguaaucaccauuaauaa

SEQ ID NO: 2311834 - RNA, 20 nt, Yersinia pestis KIM
aaaucgucgaacauuuucua

SEQ ID NO: 2311835 - RNA, 19 nt, Yersinia pestis KIM
aaaucguauaacauaauaa

SEQ ID NO: 2311836 - RNA, 21 nt, Yersinia pestis KIM
aaaucugacucuguaaaaauc

SEQ ID NO: 2311837 - RNA, 20 nt, Yersinia pestis KIM
aaaucuccuguggcacauca

SEQ ID NO: 2311838 - RNA, 16 nt, Yersinia pestis KIM
aaaugacuaucccuuc

SEQ ID NO: 2311839 - RNA, 18 nt, Yersinia pestis KIM
aaaugagaauaucuauau

SEQ ID NO: 2311840 - RNA, 12 nt, Yersinia pestis KIM
aaaugagccugu

SEQ ID NO: 2311841 - RNA, 21 nt, Yersinia pestis KIM
aaaugaagggggcuuauucua

SEQ ID NO: 2311842 - RNA, 12 nt, Yersinia pestis KIM
aaaugacacuuu

SEQ ID NO: 2311843 - RNA, 13 nt, Yersinia pestis KIM
aaaugacaaauca

SEQ ID NO: 2311844 - RNA, 21 nt, Yersinia pestis KIM
aaaugaccaacuguaaaaucu

SEQ ID NO: 2311845 - RNA, 15 nt, Yersinia pestis KIM
aaaugacauauugug

SEQ ID NO: 2311846 - RNA, 20 nt, Yersinia pestis KIM
aaaucccgcuugucgcccug

SEQ ID NO: 2311847 - RNA, 15 nt, Yersinia pestis KIM
aaauccccauuccaa

SEQ ID NO: 2311848 - RNA, 14 nt, Yersinia pestis KIM
aaauccacuacucg

SEQ ID NO: 2311849 - RNA, 18 nt, Yersinia pestis KIM
aaauauggguuaaaaacu

SEQ ID NO: 2311850 - RNA, 22 nt, Yersinia pestis KIM
aaauauggguuaaaaacuuuua

SEQ ID NO: 2311851 - RNA, 22 nt, Yersinia pestis KIM
aaauccgacugauagcaaacaa

SEQ ID NO: 2311852 - RNA, 13 nt, Yersinia pestis KIM
aaaucgaaauuaa

SEQ ID NO: 2311853 - RNA, 16 nt, Yersinia pestis KIM
aaauugcugaaaaaaa

SEQ ID NO: 2311854 - RNA, 17 nt, Yersinia pestis KIM
aaauugcugaaaaaaaa

SEQ ID NO: 2311855 - RNA, 20 nt, Yersinia pestis KIM
aaauugcgcccggcccacuu

SEQ ID NO: 2311856 - RNA, 18 nt, Yersinia pestis KIM
aaauugccccacauuacu

SEQ ID NO: 2311857 - RNA, 18 nt, Yersinia pestis KIM
aaauugggggucagggcg

SEQ ID NO: 2311858 - RNA, 14 nt, Yersinia pestis KIM
aaauucaucucacg

SEQ ID NO: 2311859 - RNA, 20 nt, Yersinia pestis KIM
aaauucaucuuuaacaacaa

SEQ ID NO: 2311860 - RNA, 13 nt, Yersinia pestis KIM
aaauucaaauauc

SEQ ID NO: 2311861 - RNA, 18 nt, Yersinia pestis KIM
aaauucaaauaucauuau

SEQ ID NO: 2311862 - RNA, 22 nt, Yersinia pestis KIM
aaauucaaccucuuguaaacca

SEQ ID NO: 2311863 - RNA, 23 nt, Yersinia pestis KIM
aaauucauucuuuuauacagcau

SEQ ID NO: 2311864 - RNA, 23 nt, Yersinia pestis KIM
aaauugacuuuaaaaaaauuauc

SEQ ID NO: 2311865 - RNA, 16 nt, Yersinia pestis KIM
aaauugacuuuaaaaa

SEQ ID NO: 2311866 - RNA, 12 nt, Yersinia pestis KIM
aaauugaagagu

SEQ ID NO: 2311867 - RNA, 16 nt, Yersinia pestis KIM
aaauuucaguuuuuag

SEQ ID NO: 2311868 - RNA, 17 nt, Yersinia pestis KIM
aaauuugcacugcaggg

SEQ ID NO: 2311869 - RNA, 11 nt, Yersinia pestis KIM
aaauuuuauga

SEQ ID NO: 2311870 - RNA, 15 nt, Yersinia pestis KIM
aaauuuuauauuauc

SEQ ID NO: 2311871 - RNA, 14 nt, Yersinia pestis KIM
aaauuuauccugua

SEQ ID NO: 2311872 - RNA, 17 nt, Yersinia pestis KIM
aaauuuaagaaaucuau

SEQ ID NO: 2311873 - RNA, 19 nt, Yersinia pestis KIM
aacaaccuaaaaaaaacaa

SEQ ID NO: 2311874 - RNA, 14 nt, Yersinia pestis KIM
aacaacgaaacaca

SEQ ID NO: 2311875 - RNA, 18 nt, Yersinia pestis KIM
aacaaccuaaaaaaaaca

SEQ ID NO: 2311876 - RNA, 22 nt, Yersinia pestis KIM
aacaaccguggcgucgcccguu

SEQ ID NO: 2311877 - RNA, 23 nt, Yersinia pestis KIM
aacaaggaaaucgaaauuaagga

SEQ ID NO: 2311878 - RNA, 16 nt, Yersinia pestis KIM
aacaagcgaccaucau

SEQ ID NO: 2311879 - RNA, 23 nt, Yersinia pestis KIM
aacaacccauuuccccuuucugg

SEQ ID NO: 2311880 - RNA, 23 nt, Yersinia pestis KIM
aacaaccauuguggcuaaaccca

SEQ ID NO: 2311881 - RNA, 13 nt, Yersinia pestis KIM
aacaacacaauua

SEQ ID NO: 2311882 - RNA, 16 nt, Yersinia pestis KIM
aacaaaugaacccuuu

SEQ ID NO: 2311883 - RNA, 22 nt, Yersinia pestis KIM
aacaaaucuuaaauugaagagu

SEQ ID NO: 2311884 - RNA, 23 nt, Yersinia pestis KIM
aacaaaucuuaaauugaagaguu

SEQ ID NO: 2311885 - RNA, 14 nt, Yersinia pestis KIM
aacaaacacaucca

SEQ ID NO: 2311886 - RNA, 16 nt, Yersinia pestis KIM
aacaaaauagggcgcc

SEQ ID NO: 2311887 - RNA, 21 nt, Yersinia pestis KIM
aacaaaaucgcgaccagcaga

SEQ ID NO: 2311888 - RNA, 22 nt, Yersinia pestis KIM
aacaaaccuaaaccuuucagac

SEQ ID NO: 2311889 - RNA, 22 nt, Yersinia pestis KIM
aacaaacuacuugguuuaaauu

SEQ ID NO: 2311890 - RNA, 20 nt, Yersinia pestis KIM
aaauuuuguacaacuucuuc

SEQ ID NO: 2311891 - RNA, 13 nt, Yersinia pestis KIM
aaauuuuuauaua

SEQ ID NO: 2311892 - RNA, 20 nt, Yersinia pestis KIM
aaauuuucuaagcugccugu

SEQ ID NO: 2311893 - RNA, 22 nt, Yersinia pestis KIM
aaauuuucuaagcugccugugc

SEQ ID NO: 2311894 - RNA, 22 nt, Yersinia pestis KIM
aacaaaaauuuucccaaaguga

SEQ ID NO: 2311895 - RNA, 17 nt, Yersinia pestis KIM
caacugccaauauguua

SEQ ID NO: 2311896 - RNA, 13 nt, Yersinia pestis KIM
caacugacugaag

SEQ ID NO: 2311897 - RNA, 19 nt, Yersinia pestis KIM
caacugauaauucaguguc

SEQ ID NO: 2311898 - RNA, 15 nt, Yersinia pestis KIM
caacugacagcgguc

SEQ ID NO: 2311899 - RNA, 14 nt, Yersinia pestis KIM
caacugaaacugga

SEQ ID NO: 2311900 - RNA, 17 nt, Yersinia pestis KIM
caacuguuuuauuggca

SEQ ID NO: 2311901 - RNA, 19 nt, Yersinia pestis KIM
caacugguuaucacugucc

SEQ ID NO: 2311902 - RNA, 14 nt, Yersinia pestis KIM
caacuguaaugccc

SEQ ID NO: 2311903 - RNA, 16 nt, Yersinia pestis KIM
caacuaaacagaucac

SEQ ID NO: 2311904 - RNA, 22 nt, Yersinia pestis KIM
caacuaaacagggcagaaaaua

SEQ ID NO: 2311905 - RNA, 22 nt, Yersinia pestis KIM
caacgcccgcggccaauagcaa

SEQ ID NO: 2311906 - RNA, 15 nt, Yersinia pestis KIM
caacgcccugcaucu

SEQ ID NO: 2311907 - RNA, 17 nt, Yersinia pestis KIM
caacgcccugcaucuug

SEQ ID NO: 2311908 - RNA, 21 nt, Yersinia pestis KIM
caacucccaaauauauucuau

SEQ ID NO: 2311909 - RNA, 20 nt, Yersinia pestis KIM
caacuccaucgccacuucua

SEQ ID NO: 2311910 - RNA, 13 nt, Yersinia pestis KIM
caacuaagcugcc

SEQ ID NO: 2311911 - RNA, 14 nt, Yersinia pestis KIM
caacuaagcugccu

SEQ ID NO: 2311912 - RNA, 17 nt, Yersinia pestis KIM
caacuccuuaccacugc

SEQ ID NO: 2311913 - RNA, 23 nt, Yersinia pestis KIM
caagaaacuucauuucagguaaa

SEQ ID NO: 2311914 - RNA, 17 nt, Yersinia pestis KIM
caagaaaucaaaagggg

SEQ ID NO: 2311915 - RNA, 19 nt, Yersinia pestis KIM
caagaaagaaaaauagacu

SEQ ID NO: 2311916 - RNA, 18 nt, Yersinia pestis KIM
caagaaccgaaauaucau

SEQ ID NO: 2311917 - RNA, 23 nt, Yersinia pestis KIM
caagaaacgccccgauaaaccaa

SEQ ID NO: 2311918 - RNA, 18 nt, Yersinia pestis KIM
caacuuuuuucauccuaa

SEQ ID NO: 2311919 - RNA, 21 nt, Yersinia pestis KIM
caacuuucccagucauaaaua

SEQ ID NO: 2311920 - RNA, 13 nt, Yersinia pestis KIM
caacuuuuacugu

SEQ ID NO: 2311921 - RNA, 11 nt, Yersinia pestis KIM
caacuucuuca

SEQ ID NO: 2311922 - RNA, 12 nt, Yersinia pestis KIM
caacuucuucau

SEQ ID NO: 2311923 - RNA, 23 nt, Yersinia pestis KIM
caaggagaucgcucucacccugc

SEQ ID NO: 2311924 - RNA, 22 nt, Yersinia pestis KIM
caagcuuuugccacauuucccu

SEQ ID NO: 2311925 - RNA, 16 nt, Yersinia pestis KIM
caaggcggcagagcca

SEQ ID NO: 2311926 - RNA, 17 nt, Yersinia pestis KIM
caaggcggaauagagga

SEQ ID NO: 2311927 - RNA, 12 nt, Yersinia pestis KIM
caaggcggaugu

SEQ ID NO: 2311928 - RNA, 13 nt, Yersinia pestis KIM
caaggcuuucugg

SEQ ID NO: 2311929 - RNA, 16 nt, Yersinia pestis KIM
caaggucgccucuggg

SEQ ID NO: 2311930 - RNA, 14 nt, Yersinia pestis KIM
caagguauguuugc

SEQ ID NO: 2311931 - RNA, 20 nt, Yersinia pestis KIM
caaggugccauaaauaccaa

SEQ ID NO: 2311932 - RNA, 24 nt, Yersinia pestis KIM
caagguucgaaaaaacaucacacu

SEQ ID NO: 2311933 - RNA, 18 nt, Yersinia pestis KIM
caagggcaauguguuugc

SEQ ID NO: 2311934 - RNA, 15 nt, Yersinia pestis KIM
caagguacugauaau

SEQ ID NO: 2311935 - RNA, 16 nt, Yersinia pestis KIM
caagguaaugguaaaa

SEQ ID NO: 2311936 - RNA, 15 nt, Yersinia pestis KIM
caagccagugcggga

SEQ ID NO: 2311937 - RNA, 14 nt, Yersinia pestis KIM
caagccaguaacua

SEQ ID NO: 2311938 - RNA, 21 nt, Yersinia pestis KIM
caagccccuauaauuuguuua

SEQ ID NO: 2311939 - RNA, 20 nt, Yersinia pestis KIM
caagcguuaugacgccaacu

SEQ ID NO: 2311940 - RNA, 17 nt, Yersinia pestis KIM
caagcgggugagauauu

SEQ ID NO: 2311941 - RNA, 18 nt, Yersinia pestis KIM
caagcguacaagaauaac

SEQ ID NO: 2311942 - RNA, 19 nt, Yersinia pestis KIM
caagcgcgguuacuguuac

SEQ ID NO: 2311943 - RNA, 14 nt, Yersinia pestis KIM
caagcgcuguuaac

SEQ ID NO: 2311944 - RNA, 19 nt, Yersinia pestis KIM
caagcaagcggcagcgcug

SEQ ID NO: 2311945 - RNA, 13 nt, Yersinia pestis KIM
caagcacacuggu

SEQ ID NO: 2311946 - RNA, 23 nt, Yersinia pestis KIM
caagauugggaucaacgcccgcg

SEQ ID NO: 2311947 - RNA, 13 nt, Yersinia pestis KIM
caagcaaacugau

SEQ ID NO: 2311948 - RNA, 19 nt, Yersinia pestis KIM
caagauugggaucaacgcc

SEQ ID NO: 2311949 - RNA, 23 nt, Yersinia pestis KIM
caagauugaugacucgauaguga

SEQ ID NO: 2311950 - RNA, 23 nt, Yersinia pestis KIM
caagagugagucaucgggguuug

SEQ ID NO: 2311951 - RNA, 16 nt, Yersinia pestis KIM
caauagaaaagcgccu

SEQ ID NO: 2311952 - RNA, 14 nt, Yersinia pestis KIM
caauagaaaggcua

SEQ ID NO: 2311953 - RNA, 14 nt, Yersinia pestis KIM
caauagcccaaaua

SEQ ID NO: 2311954 - RNA, 15 nt, Yersinia pestis KIM
caauaccgccaauau

SEQ ID NO: 2311955 - RNA, 16 nt, Yersinia pestis KIM
caauaccgccaauauc

SEQ ID NO: 2311956 - RNA, 12 nt, Yersinia pestis KIM
caauacccaugg

SEQ ID NO: 2311957 - RNA, 19 nt, Yersinia pestis KIM
caauaccgaugagcugaau

SEQ ID NO: 2311958 - RNA, 16 nt, Yersinia pestis KIM
caauaccauauaccca

SEQ ID NO: 2311959 - RNA, 15 nt, Yersinia pestis KIM
caauaccaaaaaucu

SEQ ID NO: 2311960 - RNA, 15 nt, Yersinia pestis KIM
caauaccgccacaca

SEQ ID NO: 2311961 - RNA, 21 nt, Yersinia pestis KIM
caauaccgccacacaauacau

SEQ ID NO: 2311962 - RNA, 14 nt, Yersinia pestis KIM
caauacuacuuucu

SEQ ID NO: 2311963 - RNA, 14 nt, Yersinia pestis KIM
caauacugccuaac

SEQ ID NO: 2311964 - RNA, 18 nt, Yersinia pestis KIM
caauacuguuaucacuga

SEQ ID NO: 2311965 - RNA, 23 nt, Yersinia pestis KIM
caauagguguugccggcggcgcu

SEQ ID NO: 2311966 - RNA, 17 nt, Yersinia pestis KIM
caauaggucagugguuu

SEQ ID NO: 2311967 - RNA, 14 nt, Yersinia pestis KIM
caauaguguugcua

SEQ ID NO: 2311968 - RNA, 23 nt, Yersinia pestis KIM
caauagcuagccccaaucaagca

SEQ ID NO: 2311969 - RNA, 22 nt, Yersinia pestis KIM
caauagcggaauauuuaaccag

SEQ ID NO: 2311970 - RNA, 21 nt, Yersinia pestis KIM
caauagcguuaacgauauaau

SEQ ID NO: 2311971 - RNA, 20 nt, Yersinia pestis KIM
caauagcgccaagugucaaa

SEQ ID NO: 2311972 - RNA, 14 nt, Yersinia pestis KIM
caauaggucagugg

SEQ ID NO: 2311973 - RNA, 15 nt, Yersinia pestis KIM
caauaggucaguggu

SEQ ID NO: 2311974 - RNA, 14 nt, Yersinia pestis KIM
caauaucuuugucu

SEQ ID NO: 2311975 - RNA, 15 nt, Yersinia pestis KIM
caauaucuuugucug

SEQ ID NO: 2311976 - RNA, 16 nt, Yersinia pestis KIM
caauauaauaaucuau

SEQ ID NO: 2311977 - RNA, 21 nt, Yersinia pestis KIM
caauaugcaguuuuccucccu

SEQ ID NO: 2311978 - RNA, 16 nt, Yersinia pestis KIM
caauauguugcacuga

SEQ ID NO: 2311979 - RNA, 15 nt, Yersinia pestis KIM
caauauguuuguuga

SEQ ID NO: 2311980 - RNA, 14 nt, Yersinia pestis KIM
caauauuaaaauag

SEQ ID NO: 2311981 - RNA, 12 nt, Yersinia pestis KIM
caaguaaaaaaa

SEQ ID NO: 2311982 - RNA, 17 nt, Yersinia pestis KIM
caaguaaaaaaaaccug

SEQ ID NO: 2311983 - RNA, 20 nt, Yersinia pestis KIM
caaguaaaaaaaaccuggcu

SEQ ID NO: 2311984 - RNA, 17 nt, Yersinia pestis KIM
caaguaaaagucagcaa

SEQ ID NO: 2311985 - RNA, 14 nt, Yersinia pestis KIM
caauaaaucgccac

SEQ ID NO: 2311986 - RNA, 18 nt, Yersinia pestis KIM
caauaaccgcagcaggca

SEQ ID NO: 2311987 - RNA, 15 nt, Yersinia pestis KIM
caauaaccucagagg

SEQ ID NO: 2311988 - RNA, 21 nt, Yersinia pestis KIM
caauaaccucaggggccaaca

SEQ ID NO: 2311989 - RNA, 21 nt, Yersinia pestis KIM
caauaaccucagccucauuca

SEQ ID NO: 2311990 - RNA, 22 nt, Yersinia pestis KIM
caauaacaccgucuuugaccga

SEQ ID NO: 2311991 - RNA, 18 nt, Yersinia pestis KIM
caauaacuccacuucuuc

SEQ ID NO: 2311992 - RNA, 15 nt, Yersinia pestis KIM
caauaaucucagcau

SEQ ID NO: 2311993 - RNA, 13 nt, Yersinia pestis KIM
caauacauagaag

SEQ ID NO: 2311994 - RNA, 22 nt, Yersinia pestis KIM
caauaauuaggaauaucaacga

SEQ ID NO: 2311995 - RNA, 17 nt, Yersinia pestis KIM
caaucggcagauuggau

SEQ ID NO: 2311996 - RNA, 23 nt, Yersinia pestis KIM
caaucgcucugcguuuuucccug

SEQ ID NO: 2311997 - RNA, 14 nt, Yersinia pestis KIM
caauccgcugacau

SEQ ID NO: 2311998 - RNA, 15 nt, Yersinia pestis KIM
caauccuaucguuua

SEQ ID NO: 2311999 - RNA, 21 nt, Yersinia pestis KIM
caaucucugcaguacagauaa

SEQ ID NO: 2312000 - RNA, 21 nt, Yersinia pestis KIM
caaucuccccguuuaggauug

SEQ ID NO: 2312001 - RNA, 13 nt, Yersinia pestis KIM
caaucuccaauga

SEQ ID NO: 2312002 - RNA, 19 nt, Yersinia pestis KIM
caaucuccaaugaccccgc

SEQ ID NO: 2312003 - RNA, 16 nt, Yersinia pestis KIM
caaucuccaguaaauc

SEQ ID NO: 2312004 - RNA, 17 nt, Yersinia pestis KIM
caaucgggaaaacaggc

SEQ ID NO: 2312005 - RNA, 15 nt, Yersinia pestis KIM
caauauucgcagcca

SEQ ID NO: 2312006 - RNA, 14 nt, Yersinia pestis KIM
caauauuggauaau

SEQ ID NO: 2312007 - RNA, 19 nt, Yersinia pestis KIM
caauauuuauccauuuaau

SEQ ID NO: 2312008 - RNA, 15 nt, Yersinia pestis KIM
caaucaucaucccag

SEQ ID NO: 2312009 - RNA, 23 nt, Yersinia pestis KIM
caaucaucaucccagucgucuuc

SEQ ID NO: 2312010 - RNA, 12 nt, Yersinia pestis KIM
caaucaucaucc

SEQ ID NO: 2312011 - RNA, 18 nt, Yersinia pestis KIM
caaucauuacaucaucuu

SEQ ID NO: 2312012 - RNA, 19 nt, Yersinia pestis KIM
caaucauuacaucaucuuc

SEQ ID NO: 2312013 - RNA, 21 nt, Yersinia pestis KIM
caaucauguugcaucgcacug

SEQ ID NO: 2312014 - RNA, 15 nt, Yersinia pestis KIM
caaucauuacaucau

SEQ ID NO: 2312015 - RNA, 12 nt, Yersinia pestis KIM
caaucauucugu

SEQ ID NO: 2312016 - RNA, 16 nt, Yersinia pestis KIM
caaucaucguggcuuu

SEQ ID NO: 2312017 - RNA, 15 nt, Yersinia pestis KIM
caauccgaacaaaau

SEQ ID NO: 2312018 - RNA, 14 nt, Yersinia pestis KIM
caauccgaacaaaa

SEQ ID NO: 2312019 - RNA, 17 nt, Yersinia pestis KIM
caaugagaucgaacuga

SEQ ID NO: 2312020 - RNA, 22 nt, Yersinia pestis KIM
caaucuugguuaauagcauuug

SEQ ID NO: 2312021 - RNA, 13 nt, Yersinia pestis KIM
caaugaaaauauc

SEQ ID NO: 2312022 - RNA, 16 nt, Yersinia pestis KIM
caaugauuuuuuucau

SEQ ID NO: 2312023 - RNA, 19 nt, Yersinia pestis KIM
caaugaugacuugauuaac

SEQ ID NO: 2312024 - RNA, 16 nt, Yersinia pestis KIM
caaugaugucaucuuc

SEQ ID NO: 2312025 - RNA, 16 nt, Yersinia pestis KIM
caaugauaaaauccug

SEQ ID NO: 2312026 - RNA, 18 nt, Yersinia pestis KIM
caaugagggaugaaaaga

SEQ ID NO: 2312027 - RNA, 20 nt, Yersinia pestis KIM
caaugagggaugaaaagagc

SEQ ID NO: 2312028 - RNA, 17 nt, Yersinia pestis KIM
caaugccucuucaauac

SEQ ID NO: 2312029 - RNA, 15 nt, Yersinia pestis KIM
caaugccucuucaau

SEQ ID NO: 2312030 - RNA, 15 nt, Yersinia pestis KIM
caaugccuaaagcca

SEQ ID NO: 2312031 - RNA, 21 nt, Yersinia pestis KIM
caaugcgcggguaacaacuca

SEQ ID NO: 2312032 - RNA, 14 nt, Yersinia pestis KIM
caaugcaguaaaga

SEQ ID NO: 2312033 - RNA, 21 nt, Yersinia pestis KIM
caaugccaagaauaauuacug

SEQ ID NO: 2312034 - RNA, 23 nt, Yersinia pestis KIM
caacacuccucuuucuuaauaau

SEQ ID NO: 2312035 - RNA, 23 nt, Yersinia pestis KIM
caacacagguucccaucccuuug

SEQ ID NO: 2312036 - RNA, 20 nt, Yersinia pestis KIM
caacacuucuggccgcucuu

SEQ ID NO: 2312037 - RNA, 20 nt, Yersinia pestis KIM
caacacuuuuaaggaacggg

SEQ ID NO: 2312038 - RNA, 20 nt, Yersinia pestis KIM
caacagaacuaauaucaaca

SEQ ID NO: 2312039 - RNA, 22 nt, Yersinia pestis KIM
caacagauaauuggcaauaaug

SEQ ID NO: 2312040 - RNA, 12 nt, Yersinia pestis KIM
caacagagaaau

SEQ ID NO: 2312041 - RNA, 13 nt, Yersinia pestis KIM
caacacaccugca

SEQ ID NO: 2312042 - RNA, 15 nt, Yersinia pestis KIM
caacaauuuccauau

SEQ ID NO: 2312043 - RNA, 18 nt, Yersinia pestis KIM
caacaacgccucaucuuc

SEQ ID NO: 2312044 - RNA, 18 nt, Yersinia pestis KIM
caaauuuggccuuucucg

SEQ ID NO: 2312045 - RNA, 15 nt, Yersinia pestis KIM
caaauuuuuccuuua

SEQ ID NO: 2312046 - RNA, 15 nt, Yersinia pestis KIM
caaauugcuaacaaa

SEQ ID NO: 2312047 - RNA, 15 nt, Yersinia pestis KIM
caaauuugacauuuc

SEQ ID NO: 2312048 - RNA, 18 nt, Yersinia pestis KIM
caaauucuuucaacgcau

SEQ ID NO: 2312049 - RNA, 13 nt, Yersinia pestis KIM
caaauuaauaggu

SEQ ID NO: 2312050 - RNA, 22 nt, Yersinia pestis KIM
caaauggaauaaaaagucagcu

SEQ ID NO: 2312051 - RNA, 21 nt, Yersinia pestis KIM
caaauuacgugcccaaaaacg

SEQ ID NO: 2312052 - RNA, 15 nt, Yersinia pestis KIM
caaauagauuuaacu

SEQ ID NO: 2312053 - RNA, 21 nt, Yersinia pestis KIM
caaauagagcaccaaaucuuc

SEQ ID NO: 2312054 - RNA, 22 nt, Yersinia pestis KIM
caaauagcgcugcagcaucaag

SEQ ID NO: 2312055 - RNA, 20 nt, Yersinia pestis KIM
caaauagcuggcauccucag

SEQ ID NO: 2312056 - RNA, 21 nt, Yersinia pestis KIM
caaauagcaagccaaaacagc

SEQ ID NO: 2312057 - RNA, 12 nt, Yersinia pestis KIM
caaccccagccg

SEQ ID NO: 2312058 - RNA, 17 nt, Yersinia pestis KIM
caaccccaucagcauau

SEQ ID NO: 2312059 - RNA, 23 nt, Yersinia pestis KIM
caaccccuaauccagcagccucu

SEQ ID NO: 2312060 - RNA, 21 nt, Yersinia pestis KIM
caacccgcccaagcccucuuc

SEQ ID NO: 2312061 - RNA, 17 nt, Yersinia pestis KIM
caaccgaggcgcugaca

SEQ ID NO: 2312062 - RNA, 14 nt, Yersinia pestis KIM
caaccgagaagucg

SEQ ID NO: 2312063 - RNA, 20 nt, Yersinia pestis KIM
caaccaccuuuaccaugcuc

SEQ ID NO: 2312064 - RNA, 15 nt, Yersinia pestis KIM
caaccacgacgugcu

SEQ ID NO: 2312065 - RNA, 15 nt, Yersinia pestis KIM
caaccaccaaaaacu

SEQ ID NO: 2312066 - RNA, 16 nt, Yersinia pestis KIM
caaccaccaaagauac

SEQ ID NO: 2312067 - RNA, 16 nt, Yersinia pestis KIM
caacauaguugaauaa

SEQ ID NO: 2312068 - RNA, 16 nt, Yersinia pestis KIM
caacauuuuuagcuuc

SEQ ID NO: 2312069 - RNA, 13 nt, Yersinia pestis KIM
caaccaacaccaa

SEQ ID NO: 2312070 - RNA, 23 nt, Yersinia pestis KIM
caacauacuggcuaauauaucuc

SEQ ID NO: 2312071 - RNA, 15 nt, Yersinia pestis KIM
caacauaaguaauaa

SEQ ID NO: 2312072 - RNA, 17 nt, Yersinia pestis KIM
caacauaaguaauaagu

SEQ ID NO: 2312073 - RNA, 13 nt, Yersinia pestis KIM
caacaggccaccu

SEQ ID NO: 2312074 - RNA, 18 nt, Yersinia pestis KIM
caaccuguagcucauacu

SEQ ID NO: 2312075 - RNA, 23 nt, Yersinia pestis KIM
caaccuggaauggcgcaauagca

SEQ ID NO: 2312076 - RNA, 22 nt, Yersinia pestis KIM
caaccuugggggaccagcacau

SEQ ID NO: 2312077 - RNA, 12 nt, Yersinia pestis KIM
caacgaaaucac

SEQ ID NO: 2312078 - RNA, 19 nt, Yersinia pestis KIM
caacgaaacgcauaagaau

SEQ ID NO: 2312079 - RNA, 17 nt, Yersinia pestis KIM
caacgaaggcaacaaca

SEQ ID NO: 2312080 - RNA, 17 nt, Yersinia pestis KIM
caaccugacugcuggca

SEQ ID NO: 2312081 - RNA, 17 nt, Yersinia pestis KIM
caaccugcaaugccuaa

SEQ ID NO: 2312082 - RNA, 18 nt, Yersinia pestis KIM
caaccgcuggcaguugcc

SEQ ID NO: 2312083 - RNA, 17 nt, Yersinia pestis KIM
caaccugcgccacccau

SEQ ID NO: 2312084 - RNA, 14 nt, Yersinia pestis KIM
caacgacagcaaca

SEQ ID NO: 2312085 - RNA, 17 nt, Yersinia pestis KIM
caacgacagcaacaaca

SEQ ID NO: 2312086 - RNA, 15 nt, Yersinia pestis KIM
caacgaccaguaagu

SEQ ID NO: 2312087 - RNA, 18 nt, Yersinia pestis KIM
caacgauauagagcucag

SEQ ID NO: 2312088 - RNA, 17 nt, Yersinia pestis KIM
caacgcaccauccagca

SEQ ID NO: 2312089 - RNA, 12 nt, Yersinia pestis KIM
caacgcacugaa

SEQ ID NO: 2312090 - RNA, 13 nt, Yersinia pestis KIM
caacgcacacccc

SEQ ID NO: 2312091 - RNA, 14 nt, Yersinia pestis KIM
caacgcacaccccc

SEQ ID NO: 2312092 - RNA, 15 nt, Yersinia pestis KIM
caacgccagauaacg

SEQ ID NO: 2312093 - RNA, 14 nt, Yersinia pestis KIM
caacgccaauaccg

SEQ ID NO: 2312094 - RNA, 20 nt, Yersinia pestis KIM
caaaguuuguguagcccacu

SEQ ID NO: 2312095 - RNA, 13 nt, Yersinia pestis KIM
caaauaaacaaaa

SEQ ID NO: 2312096 - RNA, 15 nt, Yersinia pestis KIM
caaauaaaacagaac

SEQ ID NO: 2312097 - RNA, 16 nt, Yersinia pestis KIM
caaauaaaaccaagaa

SEQ ID NO: 2312098 - RNA, 15 nt, Yersinia pestis KIM
caaaguuaaaugaag

SEQ ID NO: 2312099 - RNA, 23 nt, Yersinia pestis KIM
caaagugcugaucccgguuuuug

SEQ ID NO: 2312100 - RNA, 20 nt, Yersinia pestis KIM
caaagugcugcaaggcauua

SEQ ID NO: 2312101 - RNA, 22 nt, Yersinia pestis KIM
caaagugcuuaacccaccaaua

SEQ ID NO: 2312102 - RNA, 14 nt, Yersinia pestis KIM
caaaguaaucaggc

SEQ ID NO: 2312103 - RNA, 18 nt, Yersinia pestis KIM
caaauaaguauuucaaau

SEQ ID NO: 2312104 - RNA, 23 nt, Yersinia pestis KIM
caaauaaguauuucaaauaagug

SEQ ID NO: 2312105 - RNA, 18 nt, Yersinia pestis KIM
caaauaaguacuuccaau

SEQ ID NO: 2312106 - RNA, 23 nt, Yersinia pestis KIM
caaauaaguacuuccaauaagug

SEQ ID NO: 2312107 - RNA, 22 nt, Yersinia pestis KIM
caaauaagcaucggcaacguca

SEQ ID NO: 2312108 - RNA, 15 nt, Yersinia pestis KIM
caaauaauucagacg

SEQ ID NO: 2312109 - RNA, 17 nt, Yersinia pestis KIM
caaauaauucagacggc

SEQ ID NO: 2312110 - RNA, 20 nt, Yersinia pestis KIM
caaauaauucagacggcaga

SEQ ID NO: 2312111 - RNA, 19 nt, Yersinia pestis KIM
caaauaccgggacuaccaa

SEQ ID NO: 2312112 - RNA, 23 nt, Yersinia pestis KIM
caaauacgaccgucaccaaauag

SEQ ID NO: 2312113 - RNA, 16 nt, Yersinia pestis KIM
caaauacggcgaaaua

SEQ ID NO: 2312114 - RNA, 22 nt, Yersinia pestis KIM
caaauacggcgaaauauaaaac

SEQ ID NO: 2312115 - RNA, 17 nt, Yersinia pestis KIM
caaagcuauuuuuagcc

SEQ ID NO: 2312116 - RNA, 17 nt, Yersinia pestis KIM
caaagcuuacuguucac

SEQ ID NO: 2312117 - RNA, 21 nt, Yersinia pestis KIM
caaagcaccaacuaagcagau

SEQ ID NO: 2312118 - RNA, 22 nt, Yersinia pestis KIM
caaagauagacauauuguccaa

SEQ ID NO: 2312119 - RNA, 21 nt, Yersinia pestis KIM
caaagcaaugaauacccaaaa

SEQ ID NO: 2312120 - RNA, 19 nt, Yersinia pestis KIM
caaagcguacucuucugua

SEQ ID NO: 2312121 - RNA, 19 nt, Yersinia pestis KIM
caaagagucgcaaaacuuc

SEQ ID NO: 2312122 - RNA, 15 nt, Yersinia pestis KIM
caaagauacagugga

SEQ ID NO: 2312123 - RNA, 18 nt, Yersinia pestis KIM
caaacuggccauguugug

SEQ ID NO: 2312124 - RNA, 23 nt, Yersinia pestis KIM
caaacucagcgaauaaauaauug

SEQ ID NO: 2312125 - RNA, 17 nt, Yersinia pestis KIM
caaacucauacacuaau

SEQ ID NO: 2312126 - RNA, 23 nt, Yersinia pestis KIM
caaaaugcucuucaccaaaggaa

SEQ ID NO: 2312127 - RNA, 16 nt, Yersinia pestis KIM
caaaaugcguaaaaac

SEQ ID NO: 2312128 - RNA, 16 nt, Yersinia pestis KIM
caaaaugccaacaacu

SEQ ID NO: 2312129 - RNA, 16 nt, Yersinia pestis KIM
caaaaugaucaucagc

SEQ ID NO: 2312130 - RNA, 17 nt, Yersinia pestis KIM
caaaaugaucaucagca

SEQ ID NO: 2312131 - RNA, 12 nt, Yersinia pestis KIM
caaaaugacaau

SEQ ID NO: 2312132 - RNA, 16 nt, Yersinia pestis KIM
caaaaugaccuuaucu

SEQ ID NO: 2312133 - RNA, 12 nt, Yersinia pestis KIM
caaaauuuauau

SEQ ID NO: 2312134 - RNA, 20 nt, Yersinia pestis KIM
caaaauaaaaauucacaaca

SEQ ID NO: 2312135 - RNA, 23 nt, Yersinia pestis KIM
caaaauaaccaacaccaucgcag

SEQ ID NO: 2312136 - RNA, 13 nt, Yersinia pestis KIM
caaaauaaaaauu

SEQ ID NO: 2312137 - RNA, 13 nt, Yersinia pestis KIM
caaaaucaccggu

SEQ ID NO: 2312138 - RNA, 23 nt, Yersinia pestis KIM
caaaaguuaggguucaguaaaac

SEQ ID NO: 2312139 - RNA, 19 nt, Yersinia pestis KIM
caaaaguucacaugaugaa

SEQ ID NO: 2312140 - RNA, 21 nt, Yersinia pestis KIM
caaacccuaauaccaacagca

SEQ ID NO: 2312141 - RNA, 16 nt, Yersinia pestis KIM
caaacccuaauaccaa

SEQ ID NO: 2312142 - RNA, 17 nt, Yersinia pestis KIM
caaaccccgaugacuca

SEQ ID NO: 2312143 - RNA, 13 nt, Yersinia pestis KIM
caaacgcugcaca

SEQ ID NO: 2312144 - RNA, 23 nt, Yersinia pestis KIM
caaacacuuaugaucuugaauaa

SEQ ID NO: 2312145 - RNA, 16 nt, Yersinia pestis KIM
caaacagaccccagaa

SEQ ID NO: 2312146 - RNA, 17 nt, Yersinia pestis KIM
caaacagaccccagaag

SEQ ID NO: 2312147 - RNA, 16 nt, Yersinia pestis KIM
caaacaguaacccagc

SEQ ID NO: 2312148 - RNA, 18 nt, Yersinia pestis KIM
caaacagcuucgccacca

SEQ ID NO: 2312149 - RNA, 21 nt, Yersinia pestis KIM
caaacaucggauaauguuaau

SEQ ID NO: 2312150 - RNA, 15 nt, Yersinia pestis KIM
caaacauaaccugca

SEQ ID NO: 2312151 - RNA, 22 nt, Yersinia pestis KIM
caaacaugagcgcaugcccggu

SEQ ID NO: 2312152 - RNA, 16 nt, Yersinia pestis KIM
cacgcuguucaccgau

SEQ ID NO: 2312153 - RNA, 21 nt, Yersinia pestis KIM
cacgcucgcccaugaccacuu

SEQ ID NO: 2312154 - RNA, 12 nt, Yersinia pestis KIM
cacggcaggcgg

SEQ ID NO: 2312155 - RNA, 14 nt, Yersinia pestis KIM
cacggacagcaacc

SEQ ID NO: 2312156 - RNA, 17 nt, Yersinia pestis KIM
cacggaaaguagccauu

SEQ ID NO: 2312157 - RNA, 19 nt, Yersinia pestis KIM
cacgcuuuaagcuaauucu

SEQ ID NO: 2312158 - RNA, 22 nt, Yersinia pestis KIM
cacggugcgucaguucaagcag

SEQ ID NO: 2312159 - RNA, 19 nt, Yersinia pestis KIM
cacgguagugacucaucaa

SEQ ID NO: 2312160 - RNA, 17 nt, Yersinia pestis KIM
cacgguauugcucucga

SEQ ID NO: 2312161 - RNA, 22 nt, Yersinia pestis KIM
cacgguuaauucaugugagaua

SEQ ID NO: 2312162 - RNA, 13 nt, Yersinia pestis KIM
cacgguucacccc

SEQ ID NO: 2312163 - RNA, 14 nt, Yersinia pestis KIM
cacgguugaaaagu

SEQ ID NO: 2312164 - RNA, 19 nt, Yersinia pestis KIM
cacguacaacucguuaucu

SEQ ID NO: 2312165 - RNA, 15 nt, Yersinia pestis KIM
cacgucaguuaaaua

SEQ ID NO: 2312166 - RNA, 22 nt, Yersinia pestis KIM
caccugcgggauagcauaaaua

SEQ ID NO: 2312167 - RNA, 20 nt, Yersinia pestis KIM
caccugcccagacucaaaau

SEQ ID NO: 2312168 - RNA, 15 nt, Yersinia pestis KIM
caccugcccgccccg

SEQ ID NO: 2312169 - RNA, 19 nt, Yersinia pestis KIM
caccuucuugguuaguucu

SEQ ID NO: 2312170 - RNA, 19 nt, Yersinia pestis KIM
caccuuccgucccaagaaa

SEQ ID NO: 2312171 - RNA, 19 nt, Yersinia pestis KIM
caccuuggaaaacagcaac

SEQ ID NO: 2312172 - RNA, 13 nt, Yersinia pestis KIM
cacgaccugugca

SEQ ID NO: 2312173 - RNA, 14 nt, Yersinia pestis KIM
cacgaccugugcac

SEQ ID NO: 2312174 - RNA, 18 nt, Yersinia pestis KIM
aaaauacucauuuuuaag

SEQ ID NO: 2312175 - RNA, 12 nt, Yersinia pestis KIM
cacgcccaacuc

SEQ ID NO: 2312176 - RNA, 19 nt, Yersinia pestis KIM
cacgcauuccaucagccaa

SEQ ID NO: 2312177 - RNA, 21 nt, Yersinia pestis KIM
cacgaucagugaagagauaac

SEQ ID NO: 2312178 - RNA, 14 nt, Yersinia pestis KIM
cacgauagccagug

SEQ ID NO: 2312179 - RNA, 21 nt, Yersinia pestis KIM
caccucuugcauacucaggcc

SEQ ID NO: 2312180 - RNA, 13 nt, Yersinia pestis KIM
caccugaaccuga

SEQ ID NO: 2312181 - RNA, 21 nt, Yersinia pestis KIM
caccugauaagccgucagcuu

SEQ ID NO: 2312182 - RNA, 16 nt, Yersinia pestis KIM
caccugaguaauauua

SEQ ID NO: 2312183 - RNA, 16 nt, Yersinia pestis KIM
caccugaucaugccac

SEQ ID NO: 2312184 - RNA, 15 nt, Yersinia pestis KIM
caccgugugauaaac

SEQ ID NO: 2312185 - RNA, 15 nt, Yersinia pestis KIM
caccguggcgcgcca

SEQ ID NO: 2312186 - RNA, 18 nt, Yersinia pestis KIM
caccguggcgcgccacuu

SEQ ID NO: 2312187 - RNA, 12 nt, Yersinia pestis KIM
caccuccugugg

SEQ ID NO: 2312188 - RNA, 16 nt, Yersinia pestis KIM
caccguaacuucuucg

SEQ ID NO: 2312189 - RNA, 18 nt, Yersinia pestis KIM
caccguaacuucuucgcg

SEQ ID NO: 2312190 - RNA, 16 nt, Yersinia pestis KIM
caccggggauccauag

SEQ ID NO: 2312191 - RNA, 23 nt, Yersinia pestis KIM
caccggcgagaaggauugaccaa

SEQ ID NO: 2312192 - RNA, 22 nt, Yersinia pestis KIM
caccgccgucaaaccaagcccu

SEQ ID NO: 2312193 - RNA, 16 nt, Yersinia pestis KIM
caccgauggcaccgac

SEQ ID NO: 2312194 - RNA, 16 nt, Yersinia pestis KIM
caccgccagcaacagc

SEQ ID NO: 2312195 - RNA, 14 nt, Yersinia pestis KIM
caccgccagcaaua

SEQ ID NO: 2312196 - RNA, 16 nt, Yersinia pestis KIM
caccgcacacugacag

SEQ ID NO: 2312197 - RNA, 13 nt, Yersinia pestis KIM
caccccuucagcg

SEQ ID NO: 2312198 - RNA, 23 nt, Yersinia pestis KIM
caccccuauuagggaacgccagc

SEQ ID NO: 2312199 - RNA, 15 nt, Yersinia pestis KIM
caccauuuccaggcu

SEQ ID NO: 2312200 - RNA, 11 nt, Yersinia pestis KIM
cacccaaaaua

SEQ ID NO: 2312201 - RNA, 14 nt, Yersinia pestis KIM
caccauuugcccug

SEQ ID NO: 2312202 - RNA, 13 nt, Yersinia pestis KIM
cacccaacaauga

SEQ ID NO: 2312203 - RNA, 22 nt, Yersinia pestis KIM
cacccgcuucauucgcauaggg

SEQ ID NO: 2312204 - RNA, 21 nt, Yersinia pestis KIM
cacccgcuggcgcacgccggc

SEQ ID NO: 2312205 - RNA, 13 nt, Yersinia pestis KIM
cacccggccaucu

SEQ ID NO: 2312206 - RNA, 20 nt, Yersinia pestis KIM
cacccuuuugaauucaccaa

SEQ ID NO: 2312207 - RNA, 22 nt, Yersinia pestis KIM
cacccuuuaaaucuagcccuuc

SEQ ID NO: 2312208 - RNA, 12 nt, Yersinia pestis KIM
cacccguugcaa

SEQ ID NO: 2312209 - RNA, 23 nt, Yersinia pestis KIM
cacccguugcauuuuucuguuca

SEQ ID NO: 2312210 - RNA, 16 nt, Yersinia pestis KIM
cacccucaacucaaaa

SEQ ID NO: 2312211 - RNA, 12 nt, Yersinia pestis KIM
cacaugcucagu

SEQ ID NO: 2312212 - RNA, 19 nt, Yersinia pestis KIM
cacaugcuuuuuuuaagca

SEQ ID NO: 2312213 - RNA, 22 nt, Yersinia pestis KIM
cacauugccgccgauaacauua

SEQ ID NO: 2312214 - RNA, 16 nt, Yersinia pestis KIM
cacauucuguguaccc

SEQ ID NO: 2312215 - RNA, 15 nt, Yersinia pestis KIM
cacaucugggucaug

SEQ ID NO: 2312216 - RNA, 20 nt, Yersinia pestis KIM
cacaucugggucauguggaa

SEQ ID NO: 2312217 - RNA, 21 nt, Yersinia pestis KIM
cacaucuugcgccgaaauaaa

SEQ ID NO: 2312218 - RNA, 15 nt, Yersinia pestis KIM
cacaugcagcauuuc

SEQ ID NO: 2312219 - RNA, 19 nt, Yersinia pestis KIM
cacaguuuucuuaaaauac

SEQ ID NO: 2312220 - RNA, 22 nt, Yersinia pestis KIM
cacaguuuaucucgcugugccc

SEQ ID NO: 2312221 - RNA, 18 nt, Yersinia pestis KIM
cacauaaauaaguucagg

SEQ ID NO: 2312222 - RNA, 12 nt, Yersinia pestis KIM
cacauaaauaag

SEQ ID NO: 2312223 - RNA, 19 nt, Yersinia pestis KIM
cacauaaaaagaaaaaaac

SEQ ID NO: 2312224 - RNA, 15 nt, Yersinia pestis KIM
cacauaaccaucaaa

SEQ ID NO: 2312225 - RNA, 13 nt, Yersinia pestis KIM
caccacuuuccag

SEQ ID NO: 2312226 - RNA, 23 nt, Yersinia pestis KIM
caccaccaucacuuccagcgccc

SEQ ID NO: 2312227 - RNA, 16 nt, Yersinia pestis KIM
caccaauuucaucgcu

SEQ ID NO: 2312228 - RNA, 13 nt, Yersinia pestis KIM
caccaauggcuaa

SEQ ID NO: 2312229 - RNA, 19 nt, Yersinia pestis KIM
caccaauggcuaaaucauc

SEQ ID NO: 2312230 - RNA, 21 nt, Yersinia pestis KIM
aaaaguuaggguucaguaaaa

SEQ ID NO: 2312231 - RNA, 17 nt, Yersinia pestis KIM
aaaaguuucagcgugga

SEQ ID NO: 2312232 - RNA, 15 nt, Yersinia pestis KIM
caccagcgcacugaa

SEQ ID NO: 2312233 - RNA, 14 nt, Yersinia pestis KIM
aaaaguuuuuugaa

SEQ ID NO: 2312234 - RNA, 21 nt, Yersinia pestis KIM
aaaaguuucagcguggaauua

SEQ ID NO: 2312235 - RNA, 19 nt, Yersinia pestis KIM
caccauaaccaauccaugc

SEQ ID NO: 2312236 - RNA, 15 nt, Yersinia pestis KIM
caccaguuuauuuuc

SEQ ID NO: 2312237 - RNA, 18 nt, Yersinia pestis KIM
caccaguuuauuuucccu

SEQ ID NO: 2312238 - RNA, 14 nt, Yersinia pestis KIM
caccaucaacaugg

SEQ ID NO: 2312239 - RNA, 15 nt, Yersinia pestis KIM
caccaucaacauggg

SEQ ID NO: 2312240 - RNA, 23 nt, Yersinia pestis KIM
caccauagccacgcuauucacuc

SEQ ID NO: 2312241 - RNA, 23 nt, Yersinia pestis KIM
caccaucggaucacggauaucaa

SEQ ID NO: 2312242 - RNA, 15 nt, Yersinia pestis KIM
caccaucacuuccag

SEQ ID NO: 2312243 - RNA, 16 nt, Yersinia pestis KIM
caccaugaugaaucug

SEQ ID NO: 2312244 - RNA, 15 nt, Yersinia pestis KIM
caccauuaacaagcg

SEQ ID NO: 2312245 - RNA, 18 nt, Yersinia pestis KIM
caauguugcugaauaaau

SEQ ID NO: 2312246 - RNA, 19 nt, Yersinia pestis KIM
caauguugcugaauaaaua

SEQ ID NO: 2312247 - RNA, 13 nt, Yersinia pestis KIM
caauuagucacua

SEQ ID NO: 2312248 - RNA, 14 nt, Yersinia pestis KIM
caauuaucuuaucc

SEQ ID NO: 2312249 - RNA, 18 nt, Yersinia pestis KIM
caauugacuuugccagca

SEQ ID NO: 2312250 - RNA, 18 nt, Yersinia pestis KIM
caauucacgcaaggccag

SEQ ID NO: 2312251 - RNA, 17 nt, Yersinia pestis KIM
caauucaucagcgcugg

SEQ ID NO: 2312252 - RNA, 22 nt, Yersinia pestis KIM
caauuuuugccuuucugggcug

SEQ ID NO: 2312253 - RNA, 14 nt, Yersinia pestis KIM
caauuuuugauacu

SEQ ID NO: 2312254 - RNA, 16 nt, Yersinia pestis KIM
caauuuuugcagugca

SEQ ID NO: 2312255 - RNA, 16 nt, Yersinia pestis KIM
cacaaaggcaaaauga

SEQ ID NO: 2312256 - RNA, 22 nt, Yersinia pestis KIM
caauuugucauguugaccaaac

SEQ ID NO: 2312257 - RNA, 20 nt, Yersinia pestis KIM
caauuugucauguugaccaa

SEQ ID NO: 2312258 - RNA, 22 nt, Yersinia pestis KIM
caauuuagacaugggcagugca

SEQ ID NO: 2312259 - RNA, 15 nt, Yersinia pestis KIM
caauuuagacagcuu

SEQ ID NO: 2312260 - RNA, 18 nt, Yersinia pestis KIM
caauuuacgguccauaaa

SEQ ID NO: 2312261 - RNA, 20 nt, Yersinia pestis KIM
caauuugucguuuacuggcu

SEQ ID NO: 2312262 - RNA, 14 nt, Yersinia pestis KIM
caauuuuauggaua

SEQ ID NO: 2312263 - RNA, 16 nt, Yersinia pestis KIM
cacagccuacgggguc

SEQ ID NO: 2312264 - RNA, 19 nt, Yersinia pestis KIM
cacagcgaagcguaaauuu

SEQ ID NO: 2312265 - RNA, 13 nt, Yersinia pestis KIM
cacagauaaacaa

SEQ ID NO: 2312266 - RNA, 12 nt, Yersinia pestis KIM
cacagacaaaca

SEQ ID NO: 2312267 - RNA, 13 nt, Yersinia pestis KIM
cacagacaaacaa

SEQ ID NO: 2312268 - RNA, 12 nt, Yersinia pestis KIM
cacagacauuug

SEQ ID NO: 2312269 - RNA, 21 nt, Yersinia pestis KIM
cacaggcgauagcuucagcau

SEQ ID NO: 2312270 - RNA, 20 nt, Yersinia pestis KIM
cacaggcuucgacaggcaau

SEQ ID NO: 2312271 - RNA, 18 nt, Yersinia pestis KIM
cacaggggcgaugucacc

SEQ ID NO: 2312272 - RNA, 20 nt, Yersinia pestis KIM
cacaguagaagcuaccagca

SEQ ID NO: 2312273 - RNA, 16 nt, Yersinia pestis KIM
cacagucuuuuuccca

SEQ ID NO: 2312274 - RNA, 18 nt, Yersinia pestis KIM
cacaccggucgccgugcu

SEQ ID NO: 2312275 - RNA, 17 nt, Yersinia pestis KIM
cacacccucaacucaaa

SEQ ID NO: 2312276 - RNA, 19 nt, Yersinia pestis KIM
cacaccauuuggacugaau

SEQ ID NO: 2312277 - RNA, 14 nt, Yersinia pestis KIM
cacacugguugaaa

SEQ ID NO: 2312278 - RNA, 12 nt, Yersinia pestis KIM
cacacuggaugc

SEQ ID NO: 2312279 - RNA, 14 nt, Yersinia pestis KIM
cacacugagcaccg

SEQ ID NO: 2312280 - RNA, 17 nt, Yersinia pestis KIM
cacacugagcaccgcag

SEQ ID NO: 2312281 - RNA, 22 nt, Yersinia pestis KIM
cacacugacagcaacgacgccc

SEQ ID NO: 2312282 - RNA, 15 nt, Yersinia pestis KIM
cacacucagacaauc

SEQ ID NO: 2312283 - RNA, 12 nt, Yersinia pestis KIM
cacaccacacug

SEQ ID NO: 2312284 - RNA, 16 nt, Yersinia pestis KIM
cacaauuucaccccga

SEQ ID NO: 2312285 - RNA, 22 nt, Yersinia pestis KIM
cacaaaguaaauuggcacgggc

SEQ ID NO: 2312286 - RNA, 20 nt, Yersinia pestis KIM
cacaaaguagguuaagaccc

SEQ ID NO: 2312287 - RNA, 19 nt, Yersinia pestis KIM
auuucaucggcaaaaacag

SEQ ID NO: 2312288 - RNA, 20 nt, Yersinia pestis KIM
auuucaucggcaaaaacagu

SEQ ID NO: 2312289 - RNA, 18 nt, Yersinia pestis KIM
auuucacuggaaaaagug

SEQ ID NO: 2312290 - RNA, 15 nt, Yersinia pestis KIM
auuucacuguuauau

SEQ ID NO: 2312291 - RNA, 19 nt, Yersinia pestis KIM
auuucagacugcugacaac

SEQ ID NO: 2312292 - RNA, 13 nt, Yersinia pestis KIM
auuucagcagcac

SEQ ID NO: 2312293 - RNA, 22 nt, Yersinia pestis KIM
auuucaacgcaccauccagcaa

SEQ ID NO: 2312294 - RNA, 22 nt, Yersinia pestis KIM
auuuauaaaaccacugaccuau

SEQ ID NO: 2312295 - RNA, 14 nt, Yersinia pestis KIM
auuuauaaacaauc

SEQ ID NO: 2312296 - RNA, 13 nt, Yersinia pestis KIM
auuucacuggaaa

SEQ ID NO: 2312297 - RNA, 17 nt, Yersinia pestis KIM
auuucaagcaauucaga

SEQ ID NO: 2312298 - RNA, 22 nt, Yersinia pestis KIM
auuuaggauuagccgcuuucau

SEQ ID NO: 2312299 - RNA, 14 nt, Yersinia pestis KIM
auuuaggcguucuu

SEQ ID NO: 2312300 - RNA, 23 nt, Yersinia pestis KIM
auuuagguaguuuuauucagagc

SEQ ID NO: 2312301 - RNA, 15 nt, Yersinia pestis KIM
auuuauaaaaccacu

SEQ ID NO: 2312302 - RNA, 19 nt, Yersinia pestis KIM
auuuaguaucauugugaua

SEQ ID NO: 2312303 - RNA, 19 nt, Yersinia pestis KIM
auuucgcccugcauaucau

SEQ ID NO: 2312304 - RNA, 23 nt, Yersinia pestis KIM
auuucuaauucgugggcauuuuu

SEQ ID NO: 2312305 - RNA, 20 nt, Yersinia pestis KIM
auuucuacgccgucaucauc

SEQ ID NO: 2312306 - RNA, 17 nt, Yersinia pestis KIM
auuuccguuaacccaaa

SEQ ID NO: 2312307 - RNA, 21 nt, Yersinia pestis KIM
auuuccuuguggauccagcac

SEQ ID NO: 2312308 - RNA, 19 nt, Yersinia pestis KIM
auuuguggugguugcagug

SEQ ID NO: 2312309 - RNA, 18 nt, Yersinia pestis KIM
auuugugucgggauuuuu

SEQ ID NO: 2312310 - RNA, 14 nt, Yersinia pestis KIM
auuuguuaaaacag

SEQ ID NO: 2312311 - RNA, 15 nt, Yersinia pestis KIM
auuuguuaaaacagu

SEQ ID NO: 2312312 - RNA, 18 nt, Yersinia pestis KIM
auuuguagugaaugacag

SEQ ID NO: 2312313 - RNA, 22 nt, Yersinia pestis KIM
auuuggagguguauuuuuaugg

SEQ ID NO: 2312314 - RNA, 21 nt, Yersinia pestis KIM
auuugcuuuaaauaacgcaaa

SEQ ID NO: 2312315 - RNA, 21 nt, Yersinia pestis KIM
auuuggugguugaaauaacug

SEQ ID NO: 2312316 - RNA, 17 nt, Yersinia pestis KIM
auuugguuggcuuuaac

SEQ ID NO: 2312317 - RNA, 15 nt, Yersinia pestis KIM
auuuguaaauuuuuu

SEQ ID NO: 2312318 - RNA, 14 nt, Yersinia pestis KIM
auuuguaauaacga

SEQ ID NO: 2312319 - RNA, 14 nt, Yersinia pestis KIM
auuugacauuuccu

SEQ ID NO: 2312320 - RNA, 22 nt, Yersinia pestis KIM
auuucuuuugcuguauuuuucg

SEQ ID NO: 2312321 - RNA, 18 nt, Yersinia pestis KIM
auuucuuuuaaaucagaa

SEQ ID NO: 2312322 - RNA, 13 nt, Yersinia pestis KIM
auuucuccccacu

SEQ ID NO: 2312323 - RNA, 23 nt, Yersinia pestis KIM
auuucuccccacuucaucaucaa

SEQ ID NO: 2312324 - RNA, 19 nt, Yersinia pestis KIM
auuugcccgauucaccuuc

SEQ ID NO: 2312325 - RNA, 20 nt, Yersinia pestis KIM
auuugcaguggaugauaaau

SEQ ID NO: 2312326 - RNA, 14 nt, Yersinia pestis KIM
auuugcagaaagua

SEQ ID NO: 2312327 - RNA, 19 nt, Yersinia pestis KIM
auuugcacguagagauuaa

SEQ ID NO: 2312328 - RNA, 13 nt, Yersinia pestis KIM
auuugccagagug

SEQ ID NO: 2312329 - RNA, 19 nt, Yersinia pestis KIM
auuugccagagugugggau

SEQ ID NO: 2312330 - RNA, 23 nt, Yersinia pestis KIM
auuuuuuguucuuaauuuuauca

SEQ ID NO: 2312331 - RNA, 23 nt, Yersinia pestis KIM
auuuuuugugcccagaaaacccc

SEQ ID NO: 2312332 - RNA, 17 nt, Yersinia pestis KIM
auuuuuuucacccaugu

SEQ ID NO: 2312333 - RNA, 15 nt, Yersinia pestis KIM
auuuuuuugaugcau

SEQ ID NO: 2312334 - RNA, 13 nt, Yersinia pestis KIM
caaaaaacaaacc

SEQ ID NO: 2312335 - RNA, 22 nt, Yersinia pestis KIM
auuuuuggucguuuaaauaaaa

SEQ ID NO: 2312336 - RNA, 14 nt, Yersinia pestis KIM
auuuuuguauuuaa

SEQ ID NO: 2312337 - RNA, 17 nt, Yersinia pestis KIM
auuuuuugcguauuauc

SEQ ID NO: 2312338 - RNA, 13 nt, Yersinia pestis KIM
auuuuuauaauca

SEQ ID NO: 2312339 - RNA, 19 nt, Yersinia pestis KIM
auuuuugcauauaaaacac

SEQ ID NO: 2312340 - RNA, 20 nt, Yersinia pestis KIM
caaaaacccauuaaaaacaa

SEQ ID NO: 2312341 - RNA, 21 nt, Yersinia pestis KIM
caaaaacccauuaaaaacaaa

SEQ ID NO: 2312342 - RNA, 17 nt, Yersinia pestis KIM
caaaaauaguugcuauc

SEQ ID NO: 2312343 - RNA, 17 nt, Yersinia pestis KIM
caaaaauacaaaaagcg

SEQ ID NO: 2312344 - RNA, 21 nt, Yersinia pestis KIM
caaaacaauaucuauuugagu

SEQ ID NO: 2312345 - RNA, 19 nt, Yersinia pestis KIM
caaaaaugauauugugaua

SEQ ID NO: 2312346 - RNA, 15 nt, Yersinia pestis KIM
auuuugcggaucaca

SEQ ID NO: 2312347 - RNA, 18 nt, Yersinia pestis KIM
auuuuguacaacuucuuc

SEQ ID NO: 2312348 - RNA, 18 nt, Yersinia pestis KIM
auuuugucaugaaaaucu

SEQ ID NO: 2312349 - RNA, 19 nt, Yersinia pestis KIM
auuuuuacgauaucaccag

SEQ ID NO: 2312350 - RNA, 21 nt, Yersinia pestis KIM
auuuuuacgauaucaccaggu

SEQ ID NO: 2312351 - RNA, 16 nt, Yersinia pestis KIM
auuuuuaguaguaaua

SEQ ID NO: 2312352 - RNA, 22 nt, Yersinia pestis KIM
auuuuuaguauuggaaaaauca

SEQ ID NO: 2312353 - RNA, 19 nt, Yersinia pestis KIM
auuuugaggauauuagggc

SEQ ID NO: 2312354 - RNA, 19 nt, Yersinia pestis KIM
auuuucugauguguauauu

SEQ ID NO: 2312355 - RNA, 18 nt, Yersinia pestis KIM
auuuucugccaacgagaa

SEQ ID NO: 2312356 - RNA, 20 nt, Yersinia pestis KIM
auuuucuggugagcaucaac

SEQ ID NO: 2312357 - RNA, 21 nt, Yersinia pestis KIM
auuuucccugugcaaucaagg

SEQ ID NO: 2312358 - RNA, 13 nt, Yersinia pestis KIM
auuuuccugcaua

SEQ ID NO: 2312359 - RNA, 22 nt, Yersinia pestis KIM
auuuuccugcauauuauuuugc

SEQ ID NO: 2312360 - RNA, 17 nt, Yersinia pestis KIM
auuuucccugugcaauc

SEQ ID NO: 2312361 - RNA, 21 nt, Yersinia pestis KIM
auuuuccagaugaauauguuc

SEQ ID NO: 2312362 - RNA, 22 nt, Yersinia pestis KIM
auuuucagacugaaaugacauu

SEQ ID NO: 2312363 - RNA, 22 nt, Yersinia pestis KIM
auuuuauuguuuucguuuaaaa

SEQ ID NO: 2312364 - RNA, 21 nt, Yersinia pestis KIM
auuuuaaacaagcuuauauua

SEQ ID NO: 2312365 - RNA, 16 nt, Yersinia pestis KIM
auugaccagauagcug

SEQ ID NO: 2312366 - RNA, 17 nt, Yersinia pestis KIM
auugaccagauagcugu

SEQ ID NO: 2312367 - RNA, 15 nt, Yersinia pestis KIM
auugaccaauauaaa

SEQ ID NO: 2312368 - RNA, 14 nt, Yersinia pestis KIM
auugaccaccagag

SEQ ID NO: 2312369 - RNA, 19 nt, Yersinia pestis KIM
auugacccucuuaaugaau

SEQ ID NO: 2312370 - RNA, 14 nt, Yersinia pestis KIM
auugaagauacccu

SEQ ID NO: 2312371 - RNA, 16 nt, Yersinia pestis KIM
auugagcauaucaauc

SEQ ID NO: 2312372 - RNA, 13 nt, Yersinia pestis KIM
auugagcaaaauu

SEQ ID NO: 2312373 - RNA, 24 nt, Yersinia pestis KIM
auugagcauaucaaucagcaucuu

SEQ ID NO: 2312374 - RNA, 23 nt, Yersinia pestis KIM
auugagacccguuacugcaucua

SEQ ID NO: 2312375 - RNA, 22 nt, Yersinia pestis KIM
auugagaauuauaacuauuauc

SEQ ID NO: 2312376 - RNA, 16 nt, Yersinia pestis KIM
auugacugaaugugaa

SEQ ID NO: 2312377 - RNA, 13 nt, Yersinia pestis KIM
auugacuuuaaaa

SEQ ID NO: 2312378 - RNA, 18 nt, Yersinia pestis KIM
auugaguuucaaugccaa

SEQ ID NO: 2312379 - RNA, 18 nt, Yersinia pestis KIM
auugagugcggccacacg

SEQ ID NO: 2312380 - RNA, 21 nt, Yersinia pestis KIM
auucucauugcccccuucaau

SEQ ID NO: 2312381 - RNA, 21 nt, Yersinia pestis KIM
auucuaggcaugaauaauauc

SEQ ID NO: 2312382 - RNA, 19 nt, Yersinia pestis KIM
auucucccgauacccauuu

SEQ ID NO: 2312383 - RNA, 13 nt, Yersinia pestis KIM
auucugucagagc

SEQ ID NO: 2312384 - RNA, 18 nt, Yersinia pestis KIM
auucuuaucaaucaaaaa

SEQ ID NO: 2312385 - RNA, 20 nt, Yersinia pestis KIM
auucuuaucaaucaaaaaau

SEQ ID NO: 2312386 - RNA, 14 nt, Yersinia pestis KIM
auucuuuuauacag

SEQ ID NO: 2312387 - RNA, 13 nt, Yersinia pestis KIM
auucgaguuaacu

SEQ ID NO: 2312388 - RNA, 20 nt, Yersinia pestis KIM
auucgaguuaacuucagguu

SEQ ID NO: 2312389 - RNA, 23 nt, Yersinia pestis KIM
auuccugguuuuaccaucaccau

SEQ ID NO: 2312390 - RNA, 22 nt, Yersinia pestis KIM
auucgcaucuuccaaaggaagg

SEQ ID NO: 2312391 - RNA, 22 nt, Yersinia pestis KIM
auucgcacaguuuucuuaaaau

SEQ ID NO: 2312392 - RNA, 18 nt, Yersinia pestis KIM
auucgccggggacuacac

SEQ ID NO: 2312393 - RNA, 16 nt, Yersinia pestis KIM
auucgcccucaaccaa

SEQ ID NO: 2312394 - RNA, 16 nt, Yersinia pestis KIM
auucgauaaaaggcua

SEQ ID NO: 2312395 - RNA, 14 nt, Yersinia pestis KIM
auucgauagaaaca

SEQ ID NO: 2312396 - RNA, 21 nt, Yersinia pestis KIM
auucgggcaacuaauucuuag

SEQ ID NO: 2312397 - RNA, 15 nt, Yersinia pestis KIM
auucgggugagugaa

SEQ ID NO: 2312398 - RNA, 18 nt, Yersinia pestis KIM
auucgccugauaaaauua

SEQ ID NO: 2312399 - RNA, 20 nt, Yersinia pestis KIM
auucuaccuggcucaaauuu

SEQ ID NO: 2312400 - RNA, 21 nt, Yersinia pestis KIM
auucuaccuggcucaaauuug

SEQ ID NO: 2312401 - RNA, 16 nt, Yersinia pestis KIM
auucauaccgcagaua

SEQ ID NO: 2312402 - RNA, 20 nt, Yersinia pestis KIM
auucauacggcgauauuuau

SEQ ID NO: 2312403 - RNA, 13 nt, Yersinia pestis KIM
auucccagccacu

SEQ ID NO: 2312404 - RNA, 16 nt, Yersinia pestis KIM
auuccccaccauugca

SEQ ID NO: 2312405 - RNA, 21 nt, Yersinia pestis KIM
auuccccaccauugcaaacau

SEQ ID NO: 2312406 - RNA, 18 nt, Yersinia pestis KIM
auuccccccagucacuac

SEQ ID NO: 2312407 - RNA, 19 nt, Yersinia pestis KIM
auucccccugagucaaauc

SEQ ID NO: 2312408 - RNA, 16 nt, Yersinia pestis KIM
auucccccaaaaccuc

SEQ ID NO: 2312409 - RNA, 19 nt, Yersinia pestis KIM
auuccgccuguuuucaggc

SEQ ID NO: 2312410 - RNA, 23 nt, Yersinia pestis KIM
auuccgcgagcaauaccaaaaau

SEQ ID NO: 2312411 - RNA, 14 nt, Yersinia pestis KIM
auuccgcccugaau

SEQ ID NO: 2312412 - RNA, 12 nt, Yersinia pestis KIM
auuccucuguga

SEQ ID NO: 2312413 - RNA, 15 nt, Yersinia pestis KIM
auugauugcuuacca

SEQ ID NO: 2312414 - RNA, 15 nt, Yersinia pestis KIM
auugauucaucaacu

SEQ ID NO: 2312415 - RNA, 22 nt, Yersinia pestis KIM
auugcgagucucaucaaggaaa

SEQ ID NO: 2312416 - RNA, 21 nt, Yersinia pestis KIM
auugauaaaaguaauuuauca

SEQ ID NO: 2312417 - RNA, 17 nt, Yersinia pestis KIM
auugauaaaaguaauuu

SEQ ID NO: 2312418 - RNA, 13 nt, Yersinia pestis KIM
auugauaaaacca

SEQ ID NO: 2312419 - RNA, 19 nt, Yersinia pestis KIM
auugauaauggcauuuuca

SEQ ID NO: 2312420 - RNA, 23 nt, Yersinia pestis KIM
auugauaagccauuuuuuauaaa

SEQ ID NO: 2312421 - RNA, 16 nt, Yersinia pestis KIM
auugauauauagaaau

SEQ ID NO: 2312422 - RNA, 23 nt, Yersinia pestis KIM
auugauuaauuuuucauaauaau

SEQ ID NO: 2312423 - RNA, 18 nt, Yersinia pestis KIM
auugauuacaaaauauac

SEQ ID NO: 2312424 - RNA, 20 nt, Yersinia pestis KIM
auugcucacgcguaaaugga

SEQ ID NO: 2312425 - RNA, 18 nt, Yersinia pestis KIM
auugcuacguaaugauga

SEQ ID NO: 2312426 - RNA, 23 nt, Yersinia pestis KIM
auugcuacugaagguuauuacuu

SEQ ID NO: 2312427 - RNA, 22 nt, Yersinia pestis KIM
auugcuugccagcgcuuuaggc

SEQ ID NO: 2312428 - RNA, 19 nt, Yersinia pestis KIM
auugguacagaaaauacug

SEQ ID NO: 2312429 - RNA, 22 nt, Yersinia pestis KIM
auugucacccacuaauggguua

SEQ ID NO: 2312430 - RNA, 22 nt, Yersinia pestis KIM
auuggcaacaacagauaaagcu

SEQ ID NO: 2312431 - RNA, 21 nt, Yersinia pestis KIM
auuggcaguauuuuaagaaaa

SEQ ID NO: 2312432 - RNA, 16 nt, Yersinia pestis KIM
auuggacccgucacca

SEQ ID NO: 2312433 - RNA, 18 nt, Yersinia pestis KIM
auuggguaauaucaccau

SEQ ID NO: 2312434 - RNA, 19 nt, Yersinia pestis KIM
auuggcgaugcgcuccgcc

SEQ ID NO: 2312435 - RNA, 17 nt, Yersinia pestis KIM
auuggcgagcaugacac

SEQ ID NO: 2312436 - RNA, 19 nt, Yersinia pestis KIM
auuggccugcacaucaaua

SEQ ID NO: 2312437 - RNA, 17 nt, Yersinia pestis KIM
auuggccgcgcacagca

SEQ ID NO: 2312438 - RNA, 16 nt, Yersinia pestis KIM
auuggcauuuaaaagg

SEQ ID NO: 2312439 - RNA, 18 nt, Yersinia pestis KIM
auugucuggucuuucauu

SEQ ID NO: 2312440 - RNA, 18 nt, Yersinia pestis KIM
auugucuucuuuugggau

SEQ ID NO: 2312441 - RNA, 17 nt, Yersinia pestis KIM
auugucuuuaauaaaau

SEQ ID NO: 2312442 - RNA, 12 nt, Yersinia pestis KIM
auuguuugcuuu

SEQ ID NO: 2312443 - RNA, 19 nt, Yersinia pestis KIM
auuguuugcuuucagauaa

SEQ ID NO: 2312444 - RNA, 14 nt, Yersinia pestis KIM
auuuaaacacucaa

SEQ ID NO: 2312445 - RNA, 20 nt, Yersinia pestis KIM
auuuaaacagccguauaucu

SEQ ID NO: 2312446 - RNA, 13 nt, Yersinia pestis KIM
auuuaaacacuca

SEQ ID NO: 2312447 - RNA, 18 nt, Yersinia pestis KIM
auuuaagcugaaauuuuu

SEQ ID NO: 2312448 - RNA, 19 nt, Yersinia pestis KIM
auuuaagccaauaauauaa

SEQ ID NO: 2312449 - RNA, 22 nt, Yersinia pestis KIM
auuuaauugagaauuauaacua

SEQ ID NO: 2312450 - RNA, 22 nt, Yersinia pestis KIM
auuuagcaaagcgauaucguua

SEQ ID NO: 2312451 - RNA, 23 nt, Yersinia pestis KIM
auuuagcauuauucuucaccacg

SEQ ID NO: 2312452 - RNA, 20 nt, Yersinia pestis KIM
auuuagcgugacacugucac

SEQ ID NO: 2312453 - RNA, 17 nt, Yersinia pestis KIM
auuuagcuggcugaacg

SEQ ID NO: 2312454 - RNA, 13 nt, Yersinia pestis KIM
auuuagacucugc

SEQ ID NO: 2312455 - RNA, 15 nt, Yersinia pestis KIM
auuuagacagcuuaa

SEQ ID NO: 2312456 - RNA, 20 nt, Yersinia pestis KIM
auuuacugguaccaaauaac

SEQ ID NO: 2312457 - RNA, 21 nt, Yersinia pestis KIM
auuuacugguaccaaauaaca

SEQ ID NO: 2312458 - RNA, 13 nt, Yersinia pestis KIM
auuuacuuauaaa

SEQ ID NO: 2312459 - RNA, 15 nt, Yersinia pestis KIM
auuuacuuauaaaca

SEQ ID NO: 2312460 - RNA, 21 nt, Yersinia pestis KIM
auuuacuccccaaagccuacg

SEQ ID NO: 2312461 - RNA, 15 nt, Yersinia pestis KIM
auuuacucaucuauu

SEQ ID NO: 2312462 - RNA, 19 nt, Yersinia pestis KIM
auuuaccugcucaacugcu

SEQ ID NO: 2312463 - RNA, 18 nt, Yersinia pestis KIM
auuuaccuguuugcaaca

SEQ ID NO: 2312464 - RNA, 17 nt, Yersinia pestis KIM
auuuaccgucuuuuugg

SEQ ID NO: 2312465 - RNA, 21 nt, Yersinia pestis KIM
auuuacaccgugcaauagcua

SEQ ID NO: 2312466 - RNA, 22 nt, Yersinia pestis KIM
auuuaccgacagcaucuagcag

SEQ ID NO: 2312467 - RNA, 14 nt, Yersinia pestis KIM
augcaguaaauagu

SEQ ID NO: 2312468 - RNA, 23 nt, Yersinia pestis KIM
augcaguaacucgacaaccuucu

SEQ ID NO: 2312469 - RNA, 12 nt, Yersinia pestis KIM
augcaguaaaua

SEQ ID NO: 2312470 - RNA, 22 nt, Yersinia pestis KIM
augcaguuaagguuagcuaugc

SEQ ID NO: 2312471 - RNA, 23 nt, Yersinia pestis KIM
augcaguuuuccucccugccaag

SEQ ID NO: 2312472 - RNA, 20 nt, Yersinia pestis KIM
augcauacccgucguacuuu

SEQ ID NO: 2312473 - RNA, 15 nt, Yersinia pestis KIM
augcaucgcaucaga

SEQ ID NO: 2312474 - RNA, 17 nt, Yersinia pestis KIM
augcaugaaaacccugu

SEQ ID NO: 2312475 - RNA, 21 nt, Yersinia pestis KIM
augcauauuugcagaaaguaa

SEQ ID NO: 2312476 - RNA, 19 nt, Yersinia pestis KIM
augcauccaagccaucauu

SEQ ID NO: 2312477 - RNA, 20 nt, Yersinia pestis KIM
augcaccgcccagauucauu

SEQ ID NO: 2312478 - RNA, 14 nt, Yersinia pestis KIM
augcaccuuccggg

SEQ ID NO: 2312479 - RNA, 18 nt, Yersinia pestis KIM
augcagggagguuauauu

SEQ ID NO: 2312480 - RNA, 17 nt, Yersinia pestis KIM
augcagcuaaaagaugc

SEQ ID NO: 2312481 - RNA, 21 nt, Yersinia pestis KIM
augccccucacccguaaacac

SEQ ID NO: 2312482 - RNA, 22 nt, Yersinia pestis KIM
augccccucacccguaaacaca

SEQ ID NO: 2312483 - RNA, 14 nt, Yersinia pestis KIM
augccggugagcac

SEQ ID NO: 2312484 - RNA, 23 nt, Yersinia pestis KIM
augccggucaauugagucucugg

SEQ ID NO: 2312485 - RNA, 21 nt, Yersinia pestis KIM
augccagcgcaaaaggcaucc

SEQ ID NO: 2312486 - RNA, 19 nt, Yersinia pestis KIM
augcauguuauuggcuaaa

SEQ ID NO: 2312487 - RNA, 23 nt, Yersinia pestis KIM
augcauuccccuguauuaaccag

SEQ ID NO: 2312488 - RNA, 19 nt, Yersinia pestis KIM
augcguugaugcucuucuu

SEQ ID NO: 2312489 - RNA, 15 nt, Yersinia pestis KIM
augcuaaaaaacagc

SEQ ID NO: 2312490 - RNA, 18 nt, Yersinia pestis KIM
augcuaacaacuuccaca

SEQ ID NO: 2312491 - RNA, 11 nt, Yersinia pestis KIM
augcuaacucg

SEQ ID NO: 2312492 - RNA, 17 nt, Yersinia pestis KIM
augcuaacucgcgauaa

SEQ ID NO: 2312493 - RNA, 20 nt, Yersinia pestis KIM
aaaagagauccguuuaauca

SEQ ID NO: 2312494 - RNA, 21 nt, Yersinia pestis KIM
aaaagacgccuuccggcaucu

SEQ ID NO: 2312495 - RNA, 13 nt, Yersinia pestis KIM
aaaagaccgcuuu

SEQ ID NO: 2312496 - RNA, 21 nt, Yersinia pestis KIM
augcucaauacuaaacccggu

SEQ ID NO: 2312497 - RNA, 13 nt, Yersinia pestis KIM
augcucacaauca

SEQ ID NO: 2312498 - RNA, 17 nt, Yersinia pestis KIM
aaaagagucgaugaaac

SEQ ID NO: 2312499 - RNA, 15 nt, Yersinia pestis KIM
augcucuuuuuaugc

SEQ ID NO: 2312500 - RNA, 23 nt, Yersinia pestis KIM
augcugaaugaauuguuguaauu

SEQ ID NO: 2312501 - RNA, 18 nt, Yersinia pestis KIM
augcugaccccaaauuug

SEQ ID NO: 2312502 - RNA, 21 nt, Yersinia pestis KIM
augcucuucaccaaaggaagc

SEQ ID NO: 2312503 - RNA, 16 nt, Yersinia pestis KIM
augcucauuuaaaaua

SEQ ID NO: 2312504 - RNA, 20 nt, Yersinia pestis KIM
augccguuaauugugaucag

SEQ ID NO: 2312505 - RNA, 21 nt, Yersinia pestis KIM
augcggcauaacugaauacuu

SEQ ID NO: 2312506 - RNA, 17 nt, Yersinia pestis KIM
augcgcucacuuuuauu

SEQ ID NO: 2312507 - RNA, 22 nt, Yersinia pestis KIM
augcggguuuuuuuacauauaa

SEQ ID NO: 2312508 - RNA, 19 nt, Yersinia pestis KIM
augcggguuucauccccac

SEQ ID NO: 2312509 - RNA, 17 nt, Yersinia pestis KIM
augcgguucuguaucau

SEQ ID NO: 2312510 - RNA, 16 nt, Yersinia pestis KIM
augcgucuuuagauuu

SEQ ID NO: 2312511 - RNA, 19 nt, Yersinia pestis KIM
auguaguacuuaccuuccc

SEQ ID NO: 2312512 - RNA, 20 nt, Yersinia pestis KIM
auguagggguacagcaggga

SEQ ID NO: 2312513 - RNA, 20 nt, Yersinia pestis KIM
auguagcacacuaccgucuu

SEQ ID NO: 2312514 - RNA, 17 nt, Yersinia pestis KIM
auguaacggucauaauc

SEQ ID NO: 2312515 - RNA, 12 nt, Yersinia pestis KIM
augguuuugugu

SEQ ID NO: 2312516 - RNA, 16 nt, Yersinia pestis KIM
augguuguuaauuaag

SEQ ID NO: 2312517 - RNA, 22 nt, Yersinia pestis KIM
auggucaggaacccauuugcac

SEQ ID NO: 2312518 - RNA, 15 nt, Yersinia pestis KIM
auggugaaccagaua

SEQ ID NO: 2312519 - RNA, 13 nt, Yersinia pestis KIM
auguauaaagaau

SEQ ID NO: 2312520 - RNA, 14 nt, Yersinia pestis KIM
auguaguucagucg

SEQ ID NO: 2312521 - RNA, 21 nt, Yersinia pestis KIM
auguaguuaaucuacccgagu

SEQ ID NO: 2312522 - RNA, 20 nt, Yersinia pestis KIM
auguauccaaggcagauauu

SEQ ID NO: 2312523 - RNA, 22 nt, Yersinia pestis KIM
aaaagaucugcauugauuaaau

SEQ ID NO: 2312524 - RNA, 13 nt, Yersinia pestis KIM
augucagauuagu

SEQ ID NO: 2312525 - RNA, 15 nt, Yersinia pestis KIM
augucagagauaaac

SEQ ID NO: 2312526 - RNA, 13 nt, Yersinia pestis KIM
augucacuugccc

SEQ ID NO: 2312527 - RNA, 20 nt, Yersinia pestis KIM
auguauucccucaauagcua

SEQ ID NO: 2312528 - RNA, 15 nt, Yersinia pestis KIM
auguauuuauucaaa

SEQ ID NO: 2312529 - RNA, 19 nt, Yersinia pestis KIM
auguauuuauucaaaaaau

SEQ ID NO: 2312530 - RNA, 20 nt, Yersinia pestis KIM
augucaucuuccgucaguug

SEQ ID NO: 2312531 - RNA, 21 nt, Yersinia pestis KIM
augucaugauaaaacuauucu

SEQ ID NO: 2312532 - RNA, 14 nt, Yersinia pestis KIM
auguccaguuauca

SEQ ID NO: 2312533 - RNA, 17 nt, Yersinia pestis KIM
augucagccguuuacga

SEQ ID NO: 2312534 - RNA, 14 nt, Yersinia pestis KIM
auggcuuuaugacc

SEQ ID NO: 2312535 - RNA, 22 nt, Yersinia pestis KIM
auggcuuuagguugagaauuaa

SEQ ID NO: 2312536 - RNA, 13 nt, Yersinia pestis KIM
auggcuuucagga

SEQ ID NO: 2312537 - RNA, 13 nt, Yersinia pestis KIM
augggaaacaagg

SEQ ID NO: 2312538 - RNA, 14 nt, Yersinia pestis KIM
auggcuuuuuuaau

SEQ ID NO: 2312539 - RNA, 22 nt, Yersinia pestis KIM
auggcuuuuuuacgcgccugcu

SEQ ID NO: 2312540 - RNA, 20 nt, Yersinia pestis KIM
auggcuuuacggcucaccug

SEQ ID NO: 2312541 - RNA, 16 nt, Yersinia pestis KIM
auggcuugugcagcaa

SEQ ID NO: 2312542 - RNA, 18 nt, Yersinia pestis KIM
auggcuugugcagcaaua

SEQ ID NO: 2312543 - RNA, 18 nt, Yersinia pestis KIM
augggauauuaucgaaac

SEQ ID NO: 2312544 - RNA, 17 nt, Yersinia pestis KIM
augggcaucucaauaug

SEQ ID NO: 2312545 - RNA, 21 nt, Yersinia pestis KIM
augggguuuauugguuauuuu

SEQ ID NO: 2312546 - RNA, 20 nt, Yersinia pestis KIM
auggguaauccccaccaaca

SEQ ID NO: 2312547 - RNA, 23 nt, Yersinia pestis KIM
auggguauauuaucauucaagaa

SEQ ID NO: 2312548 - RNA, 19 nt, Yersinia pestis KIM
auggguauauuuaccaaaa

SEQ ID NO: 2312549 - RNA, 14 nt, Yersinia pestis KIM
augggugacucuuu

SEQ ID NO: 2312550 - RNA, 16 nt, Yersinia pestis KIM
auggucacccuuuuga

SEQ ID NO: 2312551 - RNA, 17 nt, Yersinia pestis KIM
auggccuugaaucaaaa

SEQ ID NO: 2312552 - RNA, 16 nt, Yersinia pestis KIM
auggcgcacauuacaa

SEQ ID NO: 2312553 - RNA, 14 nt, Yersinia pestis KIM
auggccagacacug

SEQ ID NO: 2312554 - RNA, 13 nt, Yersinia pestis KIM
auggcauuuucag

SEQ ID NO: 2312555 - RNA, 13 nt, Yersinia pestis KIM
auggcauuuuucg

SEQ ID NO: 2312556 - RNA, 18 nt, Yersinia pestis KIM
auggcauuaaaaaucugc

SEQ ID NO: 2312557 - RNA, 15 nt, Yersinia pestis KIM
auggccaugaaucaa

SEQ ID NO: 2312558 - RNA, 19 nt, Yersinia pestis KIM
auggccaugaaucaaauua

SEQ ID NO: 2312559 - RNA, 15 nt, Yersinia pestis KIM
auggcccaagccauc

SEQ ID NO: 2312560 - RNA, 22 nt, Yersinia pestis KIM
auggccugcggcgguuacccuc

SEQ ID NO: 2312561 - RNA, 22 nt, Yersinia pestis KIM
augcuggcuuuuuuguuuuuau

SEQ ID NO: 2312562 - RNA, 15 nt, Yersinia pestis KIM
augcuguagcagccu

SEQ ID NO: 2312563 - RNA, 15 nt, Yersinia pestis KIM
augcugauuaaugag

SEQ ID NO: 2312564 - RNA, 21 nt, Yersinia pestis KIM
augcugaugcaauaacuccac

SEQ ID NO: 2312565 - RNA, 15 nt, Yersinia pestis KIM
auggcaacagcaugg

SEQ ID NO: 2312566 - RNA, 13 nt, Yersinia pestis KIM
auggcaacagcau

SEQ ID NO: 2312567 - RNA, 15 nt, Yersinia pestis KIM
augcuguauaaaaga

SEQ ID NO: 2312568 - RNA, 15 nt, Yersinia pestis KIM
auggauuugcacaua

SEQ ID NO: 2312569 - RNA, 16 nt, Yersinia pestis KIM
auuaucaucaauagcg

SEQ ID NO: 2312570 - RNA, 13 nt, Yersinia pestis KIM
auuaucaucacca

SEQ ID NO: 2312571 - RNA, 12 nt, Yersinia pestis KIM
auuaucaucuuu

SEQ ID NO: 2312572 - RNA, 12 nt, Yersinia pestis KIM
auuaucauguaa

SEQ ID NO: 2312573 - RNA, 15 nt, Yersinia pestis KIM
auuauccguuugcaa

SEQ ID NO: 2312574 - RNA, 19 nt, Yersinia pestis KIM
auuaucccguucaauaaua

SEQ ID NO: 2312575 - RNA, 15 nt, Yersinia pestis KIM
auuaucaaguuaaau

SEQ ID NO: 2312576 - RNA, 18 nt, Yersinia pestis KIM
auuauucauauugaauua

SEQ ID NO: 2312577 - RNA, 15 nt, Yersinia pestis KIM
auuauucaacgugac

SEQ ID NO: 2312578 - RNA, 13 nt, Yersinia pestis KIM
auuauuauuacua

SEQ ID NO: 2312579 - RNA, 14 nt, Yersinia pestis KIM
auuauuacuagaca

SEQ ID NO: 2312580 - RNA, 20 nt, Yersinia pestis KIM
auuauuaguagcacuauuuu

SEQ ID NO: 2312581 - RNA, 14 nt, Yersinia pestis KIM
auuaugaaaguaag

SEQ ID NO: 2312582 - RNA, 19 nt, Yersinia pestis KIM
auuaugaaaguaagagucu

SEQ ID NO: 2312583 - RNA, 14 nt, Yersinia pestis KIM
auuaucuuuuaaaa

SEQ ID NO: 2312584 - RNA, 19 nt, Yersinia pestis KIM
auuaucuucuauuacccuu

SEQ ID NO: 2312585 - RNA, 18 nt, Yersinia pestis KIM
auuaucuuuaauuuucug

SEQ ID NO: 2312586 - RNA, 20 nt, Yersinia pestis KIM
auuacccauaacuugagcac

SEQ ID NO: 2312587 - RNA, 21 nt, Yersinia pestis KIM
auuacccacgccgaaaacaau

SEQ ID NO: 2312588 - RNA, 13 nt, Yersinia pestis KIM
auuacccauaacu

SEQ ID NO: 2312589 - RNA, 17 nt, Yersinia pestis KIM
auuacgccauccacuca

SEQ ID NO: 2312590 - RNA, 17 nt, Yersinia pestis KIM
auuaggcuuuguuggca

SEQ ID NO: 2312591 - RNA, 16 nt, Yersinia pestis KIM
auuaggccacauuauu

SEQ ID NO: 2312592 - RNA, 15 nt, Yersinia pestis KIM
auucagcucugccag

SEQ ID NO: 2312593 - RNA, 22 nt, Yersinia pestis KIM
auucagcguuuuauuuggcuca

SEQ ID NO: 2312594 - RNA, 13 nt, Yersinia pestis KIM
auucagccacuca

SEQ ID NO: 2312595 - RNA, 17 nt, Yersinia pestis KIM
auucagcagcauuucuc

SEQ ID NO: 2312596 - RNA, 22 nt, Yersinia pestis KIM
auucagcccggauagaauugaa

SEQ ID NO: 2312597 - RNA, 22 nt, Yersinia pestis KIM
auucagcaucaaauuauuuuuc

SEQ ID NO: 2312598 - RNA, 23 nt, Yersinia pestis KIM
auucagcaucaaauuauuuuucc

SEQ ID NO: 2312599 - RNA, 18 nt, Yersinia pestis KIM
auucagcaacucgguuuu

SEQ ID NO: 2312600 - RNA, 19 nt, Yersinia pestis KIM
auucaggccuugauggcua

SEQ ID NO: 2312601 - RNA, 14 nt, Yersinia pestis KIM
auucaguaaaaacu

SEQ ID NO: 2312602 - RNA, 16 nt, Yersinia pestis KIM
auucagaggaaagaga

SEQ ID NO: 2312603 - RNA, 19 nt, Yersinia pestis KIM
auucagacccgauuucaac

SEQ ID NO: 2312604 - RNA, 16 nt, Yersinia pestis KIM
auucagacgacgugca

SEQ ID NO: 2312605 - RNA, 23 nt, Yersinia pestis KIM
auucagacgguugcuagagcaug

SEQ ID NO: 2312606 - RNA, 17 nt, Yersinia pestis KIM
auucagaggaaagagag

SEQ ID NO: 2312607 - RNA, 21 nt, Yersinia pestis KIM
auucagaugagaaucucucca

SEQ ID NO: 2312608 - RNA, 18 nt, Yersinia pestis KIM
auucacgcaaggccaggu

SEQ ID NO: 2312609 - RNA, 16 nt, Yersinia pestis KIM
auucacgcaaggccag

SEQ ID NO: 2312610 - RNA, 17 nt, Yersinia pestis KIM
auucacgcccuacugag

SEQ ID NO: 2312611 - RNA, 16 nt, Yersinia pestis KIM
auucacugaguugaga

SEQ ID NO: 2312612 - RNA, 14 nt, Yersinia pestis KIM
auucacguuuuucc

SEQ ID NO: 2312613 - RNA, 15 nt, Yersinia pestis KIM
auucacguuuuucca

SEQ ID NO: 2312614 - RNA, 16 nt, Yersinia pestis KIM
auucacuauagacuca

SEQ ID NO: 2312615 - RNA, 15 nt, Yersinia pestis KIM
auucaccaccauauu

SEQ ID NO: 2312616 - RNA, 23 nt, Yersinia pestis KIM
auucaccagauggcgaucaaggu

SEQ ID NO: 2312617 - RNA, 12 nt, Yersinia pestis KIM
auucacagcaga

SEQ ID NO: 2312618 - RNA, 14 nt, Yersinia pestis KIM
auucacagcagaac

SEQ ID NO: 2312619 - RNA, 22 nt, Yersinia pestis KIM
auucacaacagugcaacauuaa

SEQ ID NO: 2312620 - RNA, 22 nt, Yersinia pestis KIM
auucacaacauagguuuuuuca

SEQ ID NO: 2312621 - RNA, 12 nt, Yersinia pestis KIM
auucacaacagu

SEQ ID NO: 2312622 - RNA, 19 nt, Yersinia pestis KIM
auucaauugugcaaaauca

SEQ ID NO: 2312623 - RNA, 15 nt, Yersinia pestis KIM
auucaauugugcaaa

SEQ ID NO: 2312624 - RNA, 15 nt, Yersinia pestis KIM
auucaauugaucuaa

SEQ ID NO: 2312625 - RNA, 22 nt, Yersinia pestis KIM
auucaaugcggcuuuacuggcu

SEQ ID NO: 2312626 - RNA, 17 nt, Yersinia pestis KIM
aaaagcugucauaaaaa

SEQ ID NO: 2312627 - RNA, 20 nt, Yersinia pestis KIM
aaaagcugucauaaaaaaag

SEQ ID NO: 2312628 - RNA, 20 nt, Yersinia pestis KIM
aaaaggcaccagcgcacuga

SEQ ID NO: 2312629 - RNA, 13 nt, Yersinia pestis KIM
auuauucuuuuac

SEQ ID NO: 2312630 - RNA, 21 nt, Yersinia pestis KIM
auucaauccauugaucucauu

SEQ ID NO: 2312631 - RNA, 13 nt, Yersinia pestis KIM
auucaauaucacu

SEQ ID NO: 2312632 - RNA, 16 nt, Yersinia pestis KIM
auucaauaucacugau

SEQ ID NO: 2312633 - RNA, 19 nt, Yersinia pestis KIM
auucaauaggguaauacca

SEQ ID NO: 2312634 - RNA, 14 nt, Yersinia pestis KIM
aaaagcacagacaa

SEQ ID NO: 2312635 - RNA, 17 nt, Yersinia pestis KIM
aaaagcacagacaaaca

SEQ ID NO: 2312636 - RNA, 18 nt, Yersinia pestis KIM
aaaagcacagacaaacaa

SEQ ID NO: 2312637 - RNA, 15 nt, Yersinia pestis KIM
auuaaggugguuuug

SEQ ID NO: 2312638 - RNA, 22 nt, Yersinia pestis KIM
auuaaggugguuuuggccggga

SEQ ID NO: 2312639 - RNA, 23 nt, Yersinia pestis KIM
auuaacaagcgaccaucaugaau

SEQ ID NO: 2312640 - RNA, 22 nt, Yersinia pestis KIM
auuaacaauuacuuuggcauuu

SEQ ID NO: 2312641 - RNA, 19 nt, Yersinia pestis KIM
auuaacacaguaaaaaaac

SEQ ID NO: 2312642 - RNA, 12 nt, Yersinia pestis KIM
auuaacauccau

SEQ ID NO: 2312643 - RNA, 20 nt, Yersinia pestis KIM
auuaacacauuaauuuaucu

SEQ ID NO: 2312644 - RNA, 16 nt, Yersinia pestis KIM
auuaaugagucaauga

SEQ ID NO: 2312645 - RNA, 15 nt, Yersinia pestis KIM
auuaaucagcauuaa

SEQ ID NO: 2312646 - RNA, 20 nt, Yersinia pestis KIM
auuaaucaccucaccagcau

SEQ ID NO: 2312647 - RNA, 20 nt, Yersinia pestis KIM
auuaaucaacagauaugcau

SEQ ID NO: 2312648 - RNA, 16 nt, Yersinia pestis KIM
aaaagcagcaaacgaa

SEQ ID NO: 2312649 - RNA, 19 nt, Yersinia pestis KIM
aaaagcaugcccagccucu

SEQ ID NO: 2312650 - RNA, 13 nt, Yersinia pestis KIM
aaaagcaugccca

SEQ ID NO: 2312651 - RNA, 21 nt, Yersinia pestis KIM
aaaagcauguggaagauauuc

SEQ ID NO: 2312652 - RNA, 16 nt, Yersinia pestis KIM
auuaccaauaauuaau

SEQ ID NO: 2312653 - RNA, 22 nt, Yersinia pestis KIM
auuacacuuucuuugaugcaua

SEQ ID NO: 2312654 - RNA, 16 nt, Yersinia pestis KIM
auuacagacuggccaa

SEQ ID NO: 2312655 - RNA, 13 nt, Yersinia pestis KIM
auuaccacuguua

SEQ ID NO: 2312656 - RNA, 13 nt, Yersinia pestis KIM
auuacaacuugaa

SEQ ID NO: 2312657 - RNA, 13 nt, Yersinia pestis KIM
auuacacagcauc

SEQ ID NO: 2312658 - RNA, 18 nt, Yersinia pestis KIM
auuacaccuuaaaacagc

SEQ ID NO: 2312659 - RNA, 14 nt, Yersinia pestis KIM
auuacacugaauug

SEQ ID NO: 2312660 - RNA, 13 nt, Yersinia pestis KIM
auuaauuuaaaca

SEQ ID NO: 2312661 - RNA, 15 nt, Yersinia pestis KIM
auuaauuggccggga

SEQ ID NO: 2312662 - RNA, 13 nt, Yersinia pestis KIM
auuaauuauaagc

SEQ ID NO: 2312663 - RNA, 12 nt, Yersinia pestis KIM
auuaauuauuuu

SEQ ID NO: 2312664 - RNA, 20 nt, Yersinia pestis KIM
auuaauuccacgcugaaacu

SEQ ID NO: 2312665 - RNA, 16 nt, Yersinia pestis KIM
auuaauuauuuauaau

SEQ ID NO: 2312666 - RNA, 21 nt, Yersinia pestis KIM
auuaauuauuuauaaugggua

SEQ ID NO: 2312667 - RNA, 13 nt, Yersinia pestis KIM
auuaauuaacacc

SEQ ID NO: 2312668 - RNA, 16 nt, Yersinia pestis KIM
auuaauuaguuuuaau

SEQ ID NO: 2312669 - RNA, 16 nt, Yersinia pestis KIM
auuaauggauaaugcu

SEQ ID NO: 2312670 - RNA, 20 nt, Yersinia pestis KIM
auuaauggauaaugcugaug

SEQ ID NO: 2312671 - RNA, 23 nt, Yersinia pestis KIM
auuaauggauaaugcugaugcaa

SEQ ID NO: 2312672 - RNA, 15 nt, Yersinia pestis KIM
auuaauggucaaggu

SEQ ID NO: 2312673 - RNA, 20 nt, Yersinia pestis KIM
auuaaugggcgauauauuuc

SEQ ID NO: 2312674 - RNA, 20 nt, Yersinia pestis KIM
auuaaaguuuagcaaagcau

SEQ ID NO: 2312675 - RNA, 18 nt, Yersinia pestis KIM
auuaaaguuuagcaaagc

SEQ ID NO: 2312676 - RNA, 13 nt, Yersinia pestis KIM
auuaaauuauuua

SEQ ID NO: 2312677 - RNA, 21 nt, Yersinia pestis KIM
auuaaauucuaccuggcucaa

SEQ ID NO: 2312678 - RNA, 17 nt, Yersinia pestis KIM
auuaaauuuuauauuau

SEQ ID NO: 2312679 - RNA, 14 nt, Yersinia pestis KIM
auuaaauuuuauga

SEQ ID NO: 2312680 - RNA, 20 nt, Yersinia pestis KIM
auuaaacgucucuuuuucau

SEQ ID NO: 2312681 - RNA, 16 nt, Yersinia pestis KIM
auuaaacgcucaucaa

SEQ ID NO: 2312682 - RNA, 17 nt, Yersinia pestis KIM
auuaaacgcucaucaac

SEQ ID NO: 2312683 - RNA, 22 nt, Yersinia pestis KIM
auuaaacgccugggauccauag

SEQ ID NO: 2312684 - RNA, 12 nt, Yersinia pestis KIM
auuaaaccugac

SEQ ID NO: 2312685 - RNA, 18 nt, Yersinia pestis KIM
auuaaagguacguaauuu

SEQ ID NO: 2312686 - RNA, 16 nt, Yersinia pestis KIM
auuaaacagucuuauu

SEQ ID NO: 2312687 - RNA, 23 nt, Yersinia pestis KIM
auuaaacagucuuauuacucauu

SEQ ID NO: 2312688 - RNA, 21 nt, Yersinia pestis KIM
auuaaaaucacccgcaagaau

SEQ ID NO: 2312689 - RNA, 11 nt, Yersinia pestis KIM
auuaaaaugau

SEQ ID NO: 2312690 - RNA, 22 nt, Yersinia pestis KIM
auuaaaaugauaugcuuauaaa

SEQ ID NO: 2312691 - RNA, 14 nt, Yersinia pestis KIM
auuaaaaaauaauu

SEQ ID NO: 2312692 - RNA, 20 nt, Yersinia pestis KIM
auuaaaaaauaauuuuaugg

SEQ ID NO: 2312693 - RNA, 12 nt, Yersinia pestis KIM
auuaaaaacaaa

SEQ ID NO: 2312694 - RNA, 14 nt, Yersinia pestis KIM
auguugcaacaugc

SEQ ID NO: 2312695 - RNA, 21 nt, Yersinia pestis KIM
auguugauuccguauuauuua

SEQ ID NO: 2312696 - RNA, 15 nt, Yersinia pestis KIM
auguuauuugaauaa

SEQ ID NO: 2312697 - RNA, 16 nt, Yersinia pestis KIM
auguuauuugaauaaa

SEQ ID NO: 2312698 - RNA, 17 nt, Yersinia pestis KIM
auguccucaccauuuau

SEQ ID NO: 2312699 - RNA, 21 nt, Yersinia pestis KIM
auguccucaccauuuauugcc

SEQ ID NO: 2312700 - RNA, 23 nt, Yersinia pestis KIM
auguccucaccauuuauugccac

SEQ ID NO: 2312701 - RNA, 13 nt, Yersinia pestis KIM
augucccucuguc

SEQ ID NO: 2312702 - RNA, 18 nt, Yersinia pestis KIM
auguugcgggaauagcuc

SEQ ID NO: 2312703 - RNA, 17 nt, Yersinia pestis KIM
auguuuauauugauaaa

SEQ ID NO: 2312704 - RNA, 23 nt, Yersinia pestis KIM
auguuuacuuuaccgcuuaaggc

SEQ ID NO: 2312705 - RNA, 14 nt, Yersinia pestis KIM
auaugcaaaaaaag

SEQ ID NO: 2312706 - RNA, 18 nt, Yersinia pestis KIM
auaugcaaaucaugcuca

SEQ ID NO: 2312707 - RNA, 22 nt, Yersinia pestis KIM
auauucaccaccauuaacaagc

SEQ ID NO: 2312708 - RNA, 22 nt, Yersinia pestis KIM
auauucaccaucugccugcaaa

SEQ ID NO: 2312709 - RNA, 22 nt, Yersinia pestis KIM
auauucaccguuuccagaauca

SEQ ID NO: 2312710 - RNA, 13 nt, Yersinia pestis KIM
auauucauuaaaa

SEQ ID NO: 2312711 - RNA, 15 nt, Yersinia pestis KIM
auauugccaucuugu

SEQ ID NO: 2312712 - RNA, 16 nt, Yersinia pestis KIM
auauugaucuuuaaua

SEQ ID NO: 2312713 - RNA, 15 nt, Yersinia pestis KIM
auauuggauaauaac

SEQ ID NO: 2312714 - RNA, 12 nt, Yersinia pestis KIM
auauugcucagu

SEQ ID NO: 2312715 - RNA, 23 nt, Yersinia pestis KIM
auauucccugcguugcgaaauaa

SEQ ID NO: 2312716 - RNA, 18 nt, Yersinia pestis KIM
auauugauagccacauca

SEQ ID NO: 2312717 - RNA, 21 nt, Yersinia pestis KIM
auauugauaauggcauuuuca

SEQ ID NO: 2312718 - RNA, 20 nt, Yersinia pestis KIM
auauugauccaaauggcugc

SEQ ID NO: 2312719 - RNA, 17 nt, Yersinia pestis KIM
auauugauaaaaguaau

SEQ ID NO: 2312720 - RNA, 15 nt, Yersinia pestis KIM
auauugagaaucagu

SEQ ID NO: 2312721 - RNA, 20 nt, Yersinia pestis KIM
auauuucgcccugcauauca

SEQ ID NO: 2312722 - RNA, 21 nt, Yersinia pestis KIM
auauuucgguaggaauaaggu

SEQ ID NO: 2312723 - RNA, 19 nt, Yersinia pestis KIM
auauuuguuugaauuuuag

SEQ ID NO: 2312724 - RNA, 12 nt, Yersinia pestis KIM
auauuuuaaaua

SEQ ID NO: 2312725 - RNA, 19 nt, Yersinia pestis KIM
auauuuugcuuuaaauuca

SEQ ID NO: 2312726 - RNA, 20 nt, Yersinia pestis KIM
auauuuugaauauuuuuaau

SEQ ID NO: 2312727 - RNA, 21 nt, Yersinia pestis KIM
aucaaaacggaugaugccgau

SEQ ID NO: 2312728 - RNA, 17 nt, Yersinia pestis KIM
auauuguuuugacuaaa

SEQ ID NO: 2312729 - RNA, 19 nt, Yersinia pestis KIM
auauuuauuuauccuauuu

SEQ ID NO: 2312730 - RNA, 14 nt, Yersinia pestis KIM
auauuucaggcugu

SEQ ID NO: 2312731 - RNA, 22 nt, Yersinia pestis KIM
auauuucacguucaucaauacc

SEQ ID NO: 2312732 - RNA, 15 nt, Yersinia pestis KIM
auauuguccaaagga

SEQ ID NO: 2312733 - RNA, 23 nt, Yersinia pestis KIM
auauuguggggccuuuauucauu

SEQ ID NO: 2312734 - RNA, 19 nt, Yersinia pestis KIM
auauuggccgucagcagau

SEQ ID NO: 2312735 - RNA, 16 nt, Yersinia pestis KIM
auauuggcaacaacag

SEQ ID NO: 2312736 - RNA, 19 nt, Yersinia pestis KIM
auauuggcaauauucagua

SEQ ID NO: 2312737 - RNA, 22 nt, Yersinia pestis KIM
auauuggggggcaguuuuuuau

SEQ ID NO: 2312738 - RNA, 17 nt, Yersinia pestis KIM
auauuggucauuuuucc

SEQ ID NO: 2312739 - RNA, 21 nt, Yersinia pestis KIM
auauuggucauuuuucccuuc

SEQ ID NO: 2312740 - RNA, 19 nt, Yersinia pestis KIM
aucaaucagcugauaugaa

SEQ ID NO: 2312741 - RNA, 22 nt, Yersinia pestis KIM
aucaaucagcugauaugaaaaa

SEQ ID NO: 2312742 - RNA, 13 nt, Yersinia pestis KIM
aucaaucagcuga

SEQ ID NO: 2312743 - RNA, 20 nt, Yersinia pestis KIM
aucaaucagcggggcauuca

SEQ ID NO: 2312744 - RNA, 19 nt, Yersinia pestis KIM
aucaauauaacgcccggca

SEQ ID NO: 2312745 - RNA, 17 nt, Yersinia pestis KIM
aucaauagguguugccg

SEQ ID NO: 2312746 - RNA, 15 nt, Yersinia pestis KIM
aucaaucaaaaaaua

SEQ ID NO: 2312747 - RNA, 22 nt, Yersinia pestis KIM
aucaauggccagcgggaaucaa

SEQ ID NO: 2312748 - RNA, 15 nt, Yersinia pestis KIM
aucaaucgagaagaa

SEQ ID NO: 2312749 - RNA, 16 nt, Yersinia pestis KIM
aucaagucuugaagag

SEQ ID NO: 2312750 - RNA, 18 nt, Yersinia pestis KIM
aucaaggcuuuaauaucu

SEQ ID NO: 2312751 - RNA, 14 nt, Yersinia pestis KIM
aucaaggauaagca

SEQ ID NO: 2312752 - RNA, 24 nt, Yersinia pestis KIM
aucaagcauacguugccagccauc

SEQ ID NO: 2312753 - RNA, 19 nt, Yersinia pestis KIM
aucaagcccgcaauuuuaa

SEQ ID NO: 2312754 - RNA, 14 nt, Yersinia pestis KIM
aucaagcuacaugu

SEQ ID NO: 2312755 - RNA, 17 nt, Yersinia pestis KIM
aucaauacuguuaucac

SEQ ID NO: 2312756 - RNA, 18 nt, Yersinia pestis KIM
aucaauaccuuacugcau

SEQ ID NO: 2312757 - RNA, 16 nt, Yersinia pestis KIM
aucaauacccugccac

SEQ ID NO: 2312758 - RNA, 17 nt, Yersinia pestis KIM
aucaauaccaauaaaac

SEQ ID NO: 2312759 - RNA, 18 nt, Yersinia pestis KIM
aucaaguugaaugaagcg

SEQ ID NO: 2312760 - RNA, 14 nt, Yersinia pestis KIM
aucaauaagcuaca

SEQ ID NO: 2312761 - RNA, 20 nt, Yersinia pestis KIM
aucaauaagugcaaacuuaa

SEQ ID NO: 2312762 - RNA, 18 nt, Yersinia pestis KIM
aucaacgcgccuuucggc

SEQ ID NO: 2312763 - RNA, 22 nt, Yersinia pestis KIM
aucaacgccguauuuuauaucu

SEQ ID NO: 2312764 - RNA, 14 nt, Yersinia pestis KIM
aucaacgcccagcu

SEQ ID NO: 2312765 - RNA, 18 nt, Yersinia pestis KIM
aucaacuuucaccccuuu

SEQ ID NO: 2312766 - RNA, 23 nt, Yersinia pestis KIM
aucaacuuucaccccuuucuugc

SEQ ID NO: 2312767 - RNA, 14 nt, Yersinia pestis KIM
aucaacuuugguuu

SEQ ID NO: 2312768 - RNA, 15 nt, Yersinia pestis KIM
aucaacgccaaaaua

SEQ ID NO: 2312769 - RNA, 17 nt, Yersinia pestis KIM
aucaacgccaaaauaac

SEQ ID NO: 2312770 - RNA, 18 nt, Yersinia pestis KIM
aucaacgacagcagcagg

SEQ ID NO: 2312771 - RNA, 14 nt, Yersinia pestis KIM
aucaaccucagccu

SEQ ID NO: 2312772 - RNA, 16 nt, Yersinia pestis KIM
aucaaccucagccuca

SEQ ID NO: 2312773 - RNA, 17 nt, Yersinia pestis KIM
aucaaccucagccucau

SEQ ID NO: 2312774 - RNA, 22 nt, Yersinia pestis KIM
aucaaccucagccucauucaug

SEQ ID NO: 2312775 - RNA, 14 nt, Yersinia pestis KIM
aucaagcaauaauu

SEQ ID NO: 2312776 - RNA, 21 nt, Yersinia pestis KIM
aucaagcacauucgcccgcgc

SEQ ID NO: 2312777 - RNA, 15 nt, Yersinia pestis KIM
aucaacacauaaaau

SEQ ID NO: 2312778 - RNA, 17 nt, Yersinia pestis KIM
aucaacagauaugcauu

SEQ ID NO: 2312779 - RNA, 14 nt, Yersinia pestis KIM
aucaacagaacuaa

SEQ ID NO: 2312780 - RNA, 23 nt, Yersinia pestis KIM
aucaacaggccaccuaacacuuu

SEQ ID NO: 2312781 - RNA, 16 nt, Yersinia pestis KIM
aucaaacggcuuuuua

SEQ ID NO: 2312782 - RNA, 19 nt, Yersinia pestis KIM
aucaaacaccgguacugag

SEQ ID NO: 2312783 - RNA, 14 nt, Yersinia pestis KIM
aucaaacauaaaaa

SEQ ID NO: 2312784 - RNA, 16 nt, Yersinia pestis KIM
aucaaaagcaagaccg

SEQ ID NO: 2312785 - RNA, 19 nt, Yersinia pestis KIM
aucaaaacugauuaauagu

SEQ ID NO: 2312786 - RNA, 21 nt, Yersinia pestis KIM
aucaaaagggaucaccaggcu

SEQ ID NO: 2312787 - RNA, 15 nt, Yersinia pestis KIM
aucagugaagagaua

SEQ ID NO: 2312788 - RNA, 11 nt, Yersinia pestis KIM
aucaguggcac

SEQ ID NO: 2312789 - RNA, 23 nt, Yersinia pestis KIM
aucaguggcgguucgagcggcau

SEQ ID NO: 2312790 - RNA, 18 nt, Yersinia pestis KIM
aucauaaaaauacauauc

SEQ ID NO: 2312791 - RNA, 12 nt, Yersinia pestis KIM
aucaguggguca

SEQ ID NO: 2312792 - RNA, 17 nt, Yersinia pestis KIM
aucaguguauuuaucaa

SEQ ID NO: 2312793 - RNA, 18 nt, Yersinia pestis KIM
aucaguguauuuaucaaa

SEQ ID NO: 2312794 - RNA, 16 nt, Yersinia pestis KIM
aucauaagacuaacag

SEQ ID NO: 2312795 - RNA, 20 nt, Yersinia pestis KIM
aucauaggccacuagccauu

SEQ ID NO: 2312796 - RNA, 19 nt, Yersinia pestis KIM
aucauaucaaaauaaaaau

SEQ ID NO: 2312797 - RNA, 18 nt, Yersinia pestis KIM
aucaggccuucuuuucuc

SEQ ID NO: 2312798 - RNA, 16 nt, Yersinia pestis KIM
aucaggcgcuuuucua

SEQ ID NO: 2312799 - RNA, 16 nt, Yersinia pestis KIM
aaaacgcacgaaaaca

SEQ ID NO: 2312800 - RNA, 14 nt, Yersinia pestis KIM
aucaucaccauuca

SEQ ID NO: 2312801 - RNA, 15 nt, Yersinia pestis KIM
aucaucaccauucaa

SEQ ID NO: 2312802 - RNA, 15 nt, Yersinia pestis KIM
aucaucaagccaaug

SEQ ID NO: 2312803 - RNA, 15 nt, Yersinia pestis KIM
aucaucaccaucaga

SEQ ID NO: 2312804 - RNA, 22 nt, Yersinia pestis KIM
aucaucaauggauucuugcugc

SEQ ID NO: 2312805 - RNA, 15 nt, Yersinia pestis KIM
aucaucaggcaggua

SEQ ID NO: 2312806 - RNA, 14 nt, Yersinia pestis KIM
aucaucaucccagu

SEQ ID NO: 2312807 - RNA, 20 nt, Yersinia pestis KIM
aucaucaucgguaccgccag

SEQ ID NO: 2312808 - RNA, 22 nt, Yersinia pestis KIM
aucaucaucgguaccgccagaa

SEQ ID NO: 2312809 - RNA, 17 nt, Yersinia pestis KIM
aucaucaguuuauuguu

SEQ ID NO: 2312810 - RNA, 22 nt, Yersinia pestis KIM
aucaucccagucgucuucagcu

SEQ ID NO: 2312811 - RNA, 15 nt, Yersinia pestis KIM
aucaucaucuuuaau

SEQ ID NO: 2312812 - RNA, 22 nt, Yersinia pestis KIM
aucauccaguuuggcugccaug

SEQ ID NO: 2312813 - RNA, 20 nt, Yersinia pestis KIM
aucauccagauauuuuacca

SEQ ID NO: 2312814 - RNA, 15 nt, Yersinia pestis KIM
aaaacuaaggggcca

SEQ ID NO: 2312815 - RNA, 18 nt, Yersinia pestis KIM
aucauccgcucagcaaaa

SEQ ID NO: 2312816 - RNA, 22 nt, Yersinia pestis KIM
aucagcgcccuugccagugcaa

SEQ ID NO: 2312817 - RNA, 23 nt, Yersinia pestis KIM
aucagcgccuuugccccgauuug

SEQ ID NO: 2312818 - RNA, 22 nt, Yersinia pestis KIM
aucagcgcuagauuuucuuuca

SEQ ID NO: 2312819 - RNA, 16 nt, Yersinia pestis KIM
aucagcgcuggcuuuu

SEQ ID NO: 2312820 - RNA, 17 nt, Yersinia pestis KIM
aucagcuuucugucgau

SEQ ID NO: 2312821 - RNA, 20 nt, Yersinia pestis KIM
aucagccagccacugggcua

SEQ ID NO: 2312822 - RNA, 17 nt, Yersinia pestis KIM
aucagcgauuuuaaaaa

SEQ ID NO: 2312823 - RNA, 19 nt, Yersinia pestis KIM
aucagcgcacugcaugcca

SEQ ID NO: 2312824 - RNA, 19 nt, Yersinia pestis KIM
aucagagucugucauggca

SEQ ID NO: 2312825 - RNA, 15 nt, Yersinia pestis KIM
aucagaguccaauag

SEQ ID NO: 2312826 - RNA, 17 nt, Yersinia pestis KIM
aucagcaucaauaaaau

SEQ ID NO: 2312827 - RNA, 21 nt, Yersinia pestis KIM
aucagauuguuuauaaauuaa

SEQ ID NO: 2312828 - RNA, 19 nt, Yersinia pestis KIM
aucacuuuuaugacggcau

SEQ ID NO: 2312829 - RNA, 15 nt, Yersinia pestis KIM
aucacggguuuuucc

SEQ ID NO: 2312830 - RNA, 17 nt, Yersinia pestis KIM
aucacggccaaaaaugg

SEQ ID NO: 2312831 - RNA, 13 nt, Yersinia pestis KIM
aucacgcguucaa

SEQ ID NO: 2312832 - RNA, 18 nt, Yersinia pestis KIM
aucacgguuuaucccccu

SEQ ID NO: 2312833 - RNA, 14 nt, Yersinia pestis KIM
aucacgcagcagac

SEQ ID NO: 2312834 - RNA, 19 nt, Yersinia pestis KIM
aucacgcagcuuuuucuca

SEQ ID NO: 2312835 - RNA, 20 nt, Yersinia pestis KIM
aucacgcagcuuuuucucac

SEQ ID NO: 2312836 - RNA, 22 nt, Yersinia pestis KIM
aucacgauacgacuucuuauua

SEQ ID NO: 2312837 - RNA, 14 nt, Yersinia pestis KIM
aucaccucaccagc

SEQ ID NO: 2312838 - RNA, 15 nt, Yersinia pestis KIM
aucaauguuggccca

SEQ ID NO: 2312839 - RNA, 17 nt, Yersinia pestis KIM
aucaauguuaucgccaa

SEQ ID NO: 2312840 - RNA, 19 nt, Yersinia pestis KIM
aucaauggauucuugcugc

SEQ ID NO: 2312841 - RNA, 23 nt, Yersinia pestis KIM
aucaauuccauaucggcaaacau

SEQ ID NO: 2312842 - RNA, 19 nt, Yersinia pestis KIM
aucaccgggugaaaauggc

SEQ ID NO: 2312843 - RNA, 11 nt, Yersinia pestis KIM
aucaccgccug

SEQ ID NO: 2312844 - RNA, 16 nt, Yersinia pestis KIM
auaucaaaauaaaaau

SEQ ID NO: 2312845 - RNA, 21 nt, Yersinia pestis KIM
auaucaaaaggauaaccuauu

SEQ ID NO: 2312846 - RNA, 15 nt, Yersinia pestis KIM
auaucaggcacugua

SEQ ID NO: 2312847 - RNA, 17 nt, Yersinia pestis KIM
auaucaaaacugauuaa

SEQ ID NO: 2312848 - RNA, 19 nt, Yersinia pestis KIM
auauauuuuuucauauccg

SEQ ID NO: 2312849 - RNA, 17 nt, Yersinia pestis KIM
auaucaucuuuuucugc

SEQ ID NO: 2312850 - RNA, 15 nt, Yersinia pestis KIM
auaucaucagcagag

SEQ ID NO: 2312851 - RNA, 15 nt, Yersinia pestis KIM
auaucgauuuuuaag

SEQ ID NO: 2312852 - RNA, 22 nt, Yersinia pestis KIM
auaucgcggauacguuccaaca

SEQ ID NO: 2312853 - RNA, 15 nt, Yersinia pestis KIM
auaucgguaaaaaau

SEQ ID NO: 2312854 - RNA, 22 nt, Yersinia pestis KIM
auaucccgagaaacaaaaccaa

SEQ ID NO: 2312855 - RNA, 17 nt, Yersinia pestis KIM
auaucccgagaaacaaa

SEQ ID NO: 2312856 - RNA, 18 nt, Yersinia pestis KIM
auaucccgagaaacaaaa

SEQ ID NO: 2312857 - RNA, 20 nt, Yersinia pestis KIM
auaucccgagaaacaaaacc

SEQ ID NO: 2312858 - RNA, 18 nt, Yersinia pestis KIM
auaucccccccaagagaa

SEQ ID NO: 2312859 - RNA, 17 nt, Yersinia pestis KIM
auaucccuguuuucuag

SEQ ID NO: 2312860 - RNA, 16 nt, Yersinia pestis KIM
auaucgagguucgacu

SEQ ID NO: 2312861 - RNA, 20 nt, Yersinia pestis KIM
auaucgaaggggauaaacca

SEQ ID NO: 2312862 - RNA, 13 nt, Yersinia pestis KIM
auaucuaacugau

SEQ ID NO: 2312863 - RNA, 15 nt, Yersinia pestis KIM
auaucuaacugaugu

SEQ ID NO: 2312864 - RNA, 18 nt, Yersinia pestis KIM
auaucucaccgccaauau

SEQ ID NO: 2312865 - RNA, 20 nt, Yersinia pestis KIM
auaucuagcaacacaucggu

SEQ ID NO: 2312866 - RNA, 12 nt, Yersinia pestis KIM
auaucucuuuau

SEQ ID NO: 2312867 - RNA, 16 nt, Yersinia pestis KIM
auaucuccguugaaac

SEQ ID NO: 2312868 - RNA, 18 nt, Yersinia pestis KIM
auaucuccguugaaaccu

SEQ ID NO: 2312869 - RNA, 16 nt, Yersinia pestis KIM
auaucugcguuuucug

SEQ ID NO: 2312870 - RNA, 16 nt, Yersinia pestis KIM
auaugaucaguggggu

SEQ ID NO: 2312871 - RNA, 14 nt, Yersinia pestis KIM
auaugacuaaacug

SEQ ID NO: 2312872 - RNA, 23 nt, Yersinia pestis KIM
auaucuugcugaaaacaauauaa

SEQ ID NO: 2312873 - RNA, 22 nt, Yersinia pestis KIM
auaucuucggcggcuaaagcug

SEQ ID NO: 2312874 - RNA, 15 nt, Yersinia pestis KIM
auauaauucaauaua

SEQ ID NO: 2312875 - RNA, 16 nt, Yersinia pestis KIM
auauaauugaagauuu

SEQ ID NO: 2312876 - RNA, 14 nt, Yersinia pestis KIM
auauaaucauacug

SEQ ID NO: 2312877 - RNA, 21 nt, Yersinia pestis KIM
auauaagauuccuuaccugau

SEQ ID NO: 2312878 - RNA, 13 nt, Yersinia pestis KIM
auauaagagaaau

SEQ ID NO: 2312879 - RNA, 14 nt, Yersinia pestis KIM
auauaagagaaauu

SEQ ID NO: 2312880 - RNA, 13 nt, Yersinia pestis KIM
auauaauagcugg

SEQ ID NO: 2312881 - RNA, 20 nt, Yersinia pestis KIM
auauaauagcuggcggauaa

SEQ ID NO: 2312882 - RNA, 14 nt, Yersinia pestis KIM
auauaauaaugcug

SEQ ID NO: 2312883 - RNA, 17 nt, Yersinia pestis KIM
auauaucacuauuucag

SEQ ID NO: 2312884 - RNA, 15 nt, Yersinia pestis KIM
auauauagagaaauc

SEQ ID NO: 2312885 - RNA, 23 nt, Yersinia pestis KIM
auauagaaauaaggaauaacuuc

SEQ ID NO: 2312886 - RNA, 16 nt, Yersinia pestis KIM
auauacuuuacauaua

SEQ ID NO: 2312887 - RNA, 13 nt, Yersinia pestis KIM
auagcuaacaccg

SEQ ID NO: 2312888 - RNA, 24 nt, Yersinia pestis KIM
auagcuaacaccgcuguagcguca

SEQ ID NO: 2312889 - RNA, 20 nt, Yersinia pestis KIM
auagcuaccccuucagucag

SEQ ID NO: 2312890 - RNA, 20 nt, Yersinia pestis KIM
auagcuaucuugccuguuga

SEQ ID NO: 2312891 - RNA, 15 nt, Yersinia pestis KIM
auagcugauugcucc

SEQ ID NO: 2312892 - RNA, 12 nt, Yersinia pestis KIM
auauaaaaaaug

SEQ ID NO: 2312893 - RNA, 19 nt, Yersinia pestis KIM
auauaaaagcacagacaaa

SEQ ID NO: 2312894 - RNA, 22 nt, Yersinia pestis KIM
auauaaaagcacagacaaacaa

SEQ ID NO: 2312895 - RNA, 15 nt, Yersinia pestis KIM
auauaaaacacgcau

SEQ ID NO: 2312896 - RNA, 17 nt, Yersinia pestis KIM
auauaaaauaauaagau

SEQ ID NO: 2312897 - RNA, 21 nt, Yersinia pestis KIM
auauaaagcauuuaucauauu

SEQ ID NO: 2312898 - RNA, 17 nt, Yersinia pestis KIM
auauaaacuaauaucuu

SEQ ID NO: 2312899 - RNA, 14 nt, Yersinia pestis KIM
auauaaacauaaaa

SEQ ID NO: 2312900 - RNA, 20 nt, Yersinia pestis KIM
auaguuuagauagaaaucac

SEQ ID NO: 2312901 - RNA, 14 nt, Yersinia pestis KIM
auagccuucccugg

SEQ ID NO: 2312902 - RNA, 14 nt, Yersinia pestis KIM
auagccuuccuugg

SEQ ID NO: 2312903 - RNA, 23 nt, Yersinia pestis KIM
auagccuguaauccggcaaaaac

SEQ ID NO: 2312904 - RNA, 14 nt, Yersinia pestis KIM
auagcgugcaguaa

SEQ ID NO: 2312905 - RNA, 20 nt, Yersinia pestis KIM
auagcagggccgguuaauug

SEQ ID NO: 2312906 - RNA, 12 nt, Yersinia pestis KIM
auagcauaaaua

SEQ ID NO: 2312907 - RNA, 14 nt, Yersinia pestis KIM
auagcaacuaaaca

SEQ ID NO: 2312908 - RNA, 14 nt, Yersinia pestis KIM
auagcaacugccaa

SEQ ID NO: 2312909 - RNA, 18 nt, Yersinia pestis KIM
auagcaaaagaaucagua

SEQ ID NO: 2312910 - RNA, 16 nt, Yersinia pestis KIM
auagcaccgagcaugc

SEQ ID NO: 2312911 - RNA, 16 nt, Yersinia pestis KIM
auagacuguuuuauua

SEQ ID NO: 2312912 - RNA, 20 nt, Yersinia pestis KIM
auagacuguuuuauuauaua

SEQ ID NO: 2312913 - RNA, 22 nt, Yersinia pestis KIM
auagacucaucuaauuuucuca

SEQ ID NO: 2312914 - RNA, 19 nt, Yersinia pestis KIM
auagaaacaucagauagau

SEQ ID NO: 2312915 - RNA, 18 nt, Yersinia pestis KIM
auagagaauaaauuuagg

SEQ ID NO: 2312916 - RNA, 20 nt, Yersinia pestis KIM
auacuuuuagccagcaacau

SEQ ID NO: 2312917 - RNA, 16 nt, Yersinia pestis KIM
auacuuuucauuuccu

SEQ ID NO: 2312918 - RNA, 21 nt, Yersinia pestis KIM
auagauuaaucgaaacaccac

SEQ ID NO: 2312919 - RNA, 13 nt, Yersinia pestis KIM
auagauuaagaaa

SEQ ID NO: 2312920 - RNA, 18 nt, Yersinia pestis KIM
auagauuaagaaaacauu

SEQ ID NO: 2312921 - RNA, 15 nt, Yersinia pestis KIM
auagcaaaauugaga

SEQ ID NO: 2312922 - RNA, 17 nt, Yersinia pestis KIM
auagauuuauucaacau

SEQ ID NO: 2312923 - RNA, 16 nt, Yersinia pestis KIM
auagaucccauaccca

SEQ ID NO: 2312924 - RNA, 20 nt, Yersinia pestis KIM
auagagugaaguaucaccac

SEQ ID NO: 2312925 - RNA, 14 nt, Yersinia pestis KIM
auagauaaaaacau

SEQ ID NO: 2312926 - RNA, 16 nt, Yersinia pestis KIM
auagauagcaaucaau

SEQ ID NO: 2312927 - RNA, 15 nt, Yersinia pestis KIM
auagauacacuccau

SEQ ID NO: 2312928 - RNA, 18 nt, Yersinia pestis KIM
auacugccgaccauaucu

SEQ ID NO: 2312929 - RNA, 17 nt, Yersinia pestis KIM
auacugccaaucgcucu

SEQ ID NO: 2312930 - RNA, 15 nt, Yersinia pestis KIM
auacuacuuucucuu

SEQ ID NO: 2312931 - RNA, 18 nt, Yersinia pestis KIM
auacucauccagauuauu

SEQ ID NO: 2312932 - RNA, 15 nt, Yersinia pestis KIM
auacuccauuugaac

SEQ ID NO: 2312933 - RNA, 23 nt, Yersinia pestis KIM
auacugcacguuuaauuucacuu

SEQ ID NO: 2312934 - RNA, 19 nt, Yersinia pestis KIM
auacaggcuauauugcuga

SEQ ID NO: 2312935 - RNA, 16 nt, Yersinia pestis KIM
auaccgcugcuaccag

SEQ ID NO: 2312936 - RNA, 16 nt, Yersinia pestis KIM
auaccgccgguuuuug

SEQ ID NO: 2312937 - RNA, 18 nt, Yersinia pestis KIM
auaccgccacacaauaca

SEQ ID NO: 2312938 - RNA, 19 nt, Yersinia pestis KIM
auaccucaguuaucagggc

SEQ ID NO: 2312939 - RNA, 22 nt, Yersinia pestis KIM
auaccgcuuuuaccaacccagc

SEQ ID NO: 2312940 - RNA, 18 nt, Yersinia pestis KIM
auaccggcggcacacugg

SEQ ID NO: 2312941 - RNA, 22 nt, Yersinia pestis KIM
auaccugcaccaaugacuaauu

SEQ ID NO: 2312942 - RNA, 18 nt, Yersinia pestis KIM
auacgcgcgucaucaacg

SEQ ID NO: 2312943 - RNA, 21 nt, Yersinia pestis KIM
auacgaucuuauuaauuggua

SEQ ID NO: 2312944 - RNA, 17 nt, Yersinia pestis KIM
auacgaucaucugguga

SEQ ID NO: 2312945 - RNA, 14 nt, Yersinia pestis KIM
auacgaauuuuucc

SEQ ID NO: 2312946 - RNA, 16 nt, Yersinia pestis KIM
aucauuacaucaucuu

SEQ ID NO: 2312947 - RNA, 15 nt, Yersinia pestis KIM
aucauuaagaugcau

SEQ ID NO: 2312948 - RNA, 21 nt, Yersinia pestis KIM
aaaacuacgguaauaaacaga

SEQ ID NO: 2312949 - RNA, 16 nt, Yersinia pestis KIM
aaaacuuaucuaaaaa

SEQ ID NO: 2312950 - RNA, 21 nt, Yersinia pestis KIM
aaaacuuuuauugucuuuaau

SEQ ID NO: 2312951 - RNA, 13 nt, Yersinia pestis KIM
aaaagaaaaaaac

SEQ ID NO: 2312952 - RNA, 16 nt, Yersinia pestis KIM
aaaagaaaaaaacaga

SEQ ID NO: 2312953 - RNA, 18 nt, Yersinia pestis KIM
aucauucauuuuaaaaaa

SEQ ID NO: 2312954 - RNA, 18 nt, Yersinia pestis KIM
aucauuuauuuuuccagg

SEQ ID NO: 2312955 - RNA, 20 nt, Yersinia pestis KIM
aucauuauauauuuuuucau

SEQ ID NO: 2312956 - RNA, 23 nt, Yersinia pestis KIM
aucauuauuauguauuuuuaugc

SEQ ID NO: 2312957 - RNA, 17 nt, Yersinia pestis KIM
auccacuuuucagauag

SEQ ID NO: 2312958 - RNA, 18 nt, Yersinia pestis KIM
auccacuuauaucuccac

SEQ ID NO: 2312959 - RNA, 17 nt, Yersinia pestis KIM
auccacuuauaucucca

SEQ ID NO: 2312960 - RNA, 16 nt, Yersinia pestis KIM
auccacuuggcuaauu

SEQ ID NO: 2312961 - RNA, 20 nt, Yersinia pestis KIM
auccagaacgucagauaacu

SEQ ID NO: 2312962 - RNA, 16 nt, Yersinia pestis KIM
aucauuuuuuaucuug

SEQ ID NO: 2312963 - RNA, 18 nt, Yersinia pestis KIM
aucauuuguuucucaccg

SEQ ID NO: 2312964 - RNA, 23 nt, Yersinia pestis KIM
auccaccagcgggcggcagauau

SEQ ID NO: 2312965 - RNA, 19 nt, Yersinia pestis KIM
auccaauaccaccaaugcg

SEQ ID NO: 2312966 - RNA, 12 nt, Yersinia pestis KIM
auccaauaggau

SEQ ID NO: 2312967 - RNA, 23 nt, Yersinia pestis KIM
aucccaguuuuuaauuuaaacuc

SEQ ID NO: 2312968 - RNA, 21 nt, Yersinia pestis KIM
auccagcgcggcgaaacugac

SEQ ID NO: 2312969 - RNA, 17 nt, Yersinia pestis KIM
auccauuuucugccaac

SEQ ID NO: 2312970 - RNA, 21 nt, Yersinia pestis KIM
auccauuuaauaacuuaaaua

SEQ ID NO: 2312971 - RNA, 18 nt, Yersinia pestis KIM
auccauuucaaucacugc

SEQ ID NO: 2312972 - RNA, 13 nt, Yersinia pestis KIM
aucccacuggacg

SEQ ID NO: 2312973 - RNA, 16 nt, Yersinia pestis KIM
aucccagaaccucaac

SEQ ID NO: 2312974 - RNA, 18 nt, Yersinia pestis KIM
auccauucggcuaaauaa

SEQ ID NO: 2312975 - RNA, 22 nt, Yersinia pestis KIM
auccauuaauuaaacuguaaua

SEQ ID NO: 2312976 - RNA, 14 nt, Yersinia pestis KIM
aucccggugaucau

SEQ ID NO: 2312977 - RNA, 20 nt, Yersinia pestis KIM
aucccuugcggcauagcaaa

SEQ ID NO: 2312978 - RNA, 22 nt, Yersinia pestis KIM
aucccuggcucaucaaaggagu

SEQ ID NO: 2312979 - RNA, 14 nt, Yersinia pestis KIM
aucccugugcugag

SEQ ID NO: 2312980 - RNA, 20 nt, Yersinia pestis KIM
auccgccucggugaaauaag

SEQ ID NO: 2312981 - RNA, 17 nt, Yersinia pestis KIM
auccgcccuuguaagcg

SEQ ID NO: 2312982 - RNA, 21 nt, Yersinia pestis KIM
auccgaccacugacaaaaaca

SEQ ID NO: 2312983 - RNA, 14 nt, Yersinia pestis KIM
auccgaauauguca

SEQ ID NO: 2312984 - RNA, 14 nt, Yersinia pestis KIM
aucggcccugccau

SEQ ID NO: 2312985 - RNA, 18 nt, Yersinia pestis KIM
aucggcggaaaucaccaa

SEQ ID NO: 2312986 - RNA, 17 nt, Yersinia pestis KIM
aucgggcaauugaaaau

SEQ ID NO: 2312987 - RNA, 21 nt, Yersinia pestis KIM
aucgggcggauagccgaagaa

SEQ ID NO: 2312988 - RNA, 12 nt, Yersinia pestis KIM
aucggguuuaau

SEQ ID NO: 2312989 - RNA, 17 nt, Yersinia pestis KIM
aucggguuuaauucagg

SEQ ID NO: 2312990 - RNA, 15 nt, Yersinia pestis KIM
aucgguaaaaaauca

SEQ ID NO: 2312991 - RNA, 18 nt, Yersinia pestis KIM
aucgguggcuauaagccu

SEQ ID NO: 2312992 - RNA, 15 nt, Yersinia pestis KIM
aucgguuagcuacug

SEQ ID NO: 2312993 - RNA, 16 nt, Yersinia pestis KIM
aucgguuucagcuugc

SEQ ID NO: 2312994 - RNA, 15 nt, Yersinia pestis KIM
aucgcccugcucuuc

SEQ ID NO: 2312995 - RNA, 13 nt, Yersinia pestis KIM
aucgcgcuucagg

SEQ ID NO: 2312996 - RNA, 19 nt, Yersinia pestis KIM
aucgcgcccauccgcagga

SEQ ID NO: 2312997 - RNA, 22 nt, Yersinia pestis KIM
aucgcuaaccgccaguucugga

SEQ ID NO: 2312998 - RNA, 24 nt, Yersinia pestis KIM
aucgcuuuuaugguuuugugucac

SEQ ID NO: 2312999 - RNA, 18 nt, Yersinia pestis KIM
aucgcuuuuagauaaagg

SEQ ID NO: 2313000 - RNA, 19 nt, Yersinia pestis KIM
aucgcucugcguuuuuccc

SEQ ID NO: 2313001 - RNA, 17 nt, Yersinia pestis KIM
aucggccaaugcuuuuu

SEQ ID NO: 2313002 - RNA, 20 nt, Yersinia pestis KIM
aucggccagugcgccggccu

SEQ ID NO: 2313003 - RNA, 16 nt, Yersinia pestis KIM
aucggccagugcgccg

SEQ ID NO: 2313004 - RNA, 19 nt, Yersinia pestis KIM
aucgccagcaaaucacauu

SEQ ID NO: 2313005 - RNA, 18 nt, Yersinia pestis KIM
aucgccagcaaaucacau

SEQ ID NO: 2313006 - RNA, 23 nt, Yersinia pestis KIM
aucgccagacuguucacaagcca

SEQ ID NO: 2313007 - RNA, 20 nt, Yersinia pestis KIM
aucgccagcugcaauugccg

SEQ ID NO: 2313008 - RNA, 22 nt, Yersinia pestis KIM
aucgccagcggguacacugucg

SEQ ID NO: 2313009 - RNA, 19 nt, Yersinia pestis KIM
aucgccaauaaccgcagca

SEQ ID NO: 2313010 - RNA, 16 nt, Yersinia pestis KIM
aucgccaauagaaagg

SEQ ID NO: 2313011 - RNA, 19 nt, Yersinia pestis KIM
aucgccaauagaaaggcua

SEQ ID NO: 2313012 - RNA, 16 nt, Yersinia pestis KIM
aucgccaacauaagua

SEQ ID NO: 2313013 - RNA, 12 nt, Yersinia pestis KIM
aucgccaauugg

SEQ ID NO: 2313014 - RNA, 17 nt, Yersinia pestis KIM
aucgccaacaggccuaa

SEQ ID NO: 2313015 - RNA, 23 nt, Yersinia pestis KIM
aucgcauuggguaauaucaccau

SEQ ID NO: 2313016 - RNA, 15 nt, Yersinia pestis KIM
aucgauacggcaccg

SEQ ID NO: 2313017 - RNA, 16 nt, Yersinia pestis KIM
aucgacggcagugacg

SEQ ID NO: 2313018 - RNA, 20 nt, Yersinia pestis KIM
aucgacuggccgauaucaug

SEQ ID NO: 2313019 - RNA, 20 nt, Yersinia pestis KIM
aucgaguggucgauaguggc

SEQ ID NO: 2313020 - RNA, 19 nt, Yersinia pestis KIM
aucgaaugaucagaggcug

SEQ ID NO: 2313021 - RNA, 18 nt, Yersinia pestis KIM
aucgaauugaucugauau

SEQ ID NO: 2313022 - RNA, 23 nt, Yersinia pestis KIM
aucgaccacgcccuucacacugg

SEQ ID NO: 2313023 - RNA, 18 nt, Yersinia pestis KIM
auccugcucagcuaaaga

SEQ ID NO: 2313024 - RNA, 16 nt, Yersinia pestis KIM
auccggauuaaauucu

SEQ ID NO: 2313025 - RNA, 22 nt, Yersinia pestis KIM
auccgcuucgcuggucauaauc

SEQ ID NO: 2313026 - RNA, 23 nt, Yersinia pestis KIM
auccgcuggcggcguugucuuau

SEQ ID NO: 2313027 - RNA, 21 nt, Yersinia pestis KIM
aucgaacccgcuaacaugcca

SEQ ID NO: 2313028 - RNA, 15 nt, Yersinia pestis KIM
aucuucacucagcgc

SEQ ID NO: 2313029 - RNA, 21 nt, Yersinia pestis KIM
aucuucaaugguguuaucuuc

SEQ ID NO: 2313030 - RNA, 13 nt, Yersinia pestis KIM
aucuuccaaagga

SEQ ID NO: 2313031 - RNA, 18 nt, Yersinia pestis KIM
aucuuccacucuuucaau

SEQ ID NO: 2313032 - RNA, 15 nt, Yersinia pestis KIM
aucuuccacaugcuu

SEQ ID NO: 2313033 - RNA, 23 nt, Yersinia pestis KIM
aucuuccacaugcuuuuuuuaag

SEQ ID NO: 2313034 - RNA, 17 nt, Yersinia pestis KIM
aucuuccagcggcaaau

SEQ ID NO: 2313035 - RNA, 19 nt, Yersinia pestis KIM
aucuuaccuucaguuuauu

SEQ ID NO: 2313036 - RNA, 17 nt, Yersinia pestis KIM
aucuuacugauacccgc

SEQ ID NO: 2313037 - RNA, 17 nt, Yersinia pestis KIM
aucuuauuaauugguau

SEQ ID NO: 2313038 - RNA, 23 nt, Yersinia pestis KIM
aucuuauucauaucgcucaucau

SEQ ID NO: 2313039 - RNA, 16 nt, Yersinia pestis KIM
aucuuauccacagcau

SEQ ID NO: 2313040 - RNA, 20 nt, Yersinia pestis KIM
aucuggguaucgugguaaac

SEQ ID NO: 2313041 - RNA, 15 nt, Yersinia pestis KIM
aucuguaaucaccag

SEQ ID NO: 2313042 - RNA, 19 nt, Yersinia pestis KIM
aucuggcuuucucaacagc

SEQ ID NO: 2313043 - RNA, 22 nt, Yersinia pestis KIM
aucuggcucaggaaucuucaau

SEQ ID NO: 2313044 - RNA, 16 nt, Yersinia pestis KIM
aucuuaaauugaagag

SEQ ID NO: 2313045 - RNA, 12 nt, Yersinia pestis KIM
aucugccuguuc

SEQ ID NO: 2313046 - RNA, 17 nt, Yersinia pestis KIM
aucugccuguucucucc

SEQ ID NO: 2313047 - RNA, 19 nt, Yersinia pestis KIM
aucugacucuguaaaaauc

SEQ ID NO: 2313048 - RNA, 15 nt, Yersinia pestis KIM
aucugaccaaacauu

SEQ ID NO: 2313049 - RNA, 18 nt, Yersinia pestis KIM
aucugaaacggugaggau

SEQ ID NO: 2313050 - RNA, 19 nt, Yersinia pestis KIM
aucugaaacggugaggaua

SEQ ID NO: 2313051 - RNA, 21 nt, Yersinia pestis KIM
aucugaaacggugaggauagg

SEQ ID NO: 2313052 - RNA, 17 nt, Yersinia pestis KIM
aucugaaugcugugacu

SEQ ID NO: 2313053 - RNA, 15 nt, Yersinia pestis KIM
aucucugccgcugaa

SEQ ID NO: 2313054 - RNA, 16 nt, Yersinia pestis KIM
aucucugcgacaucag

SEQ ID NO: 2313055 - RNA, 16 nt, Yersinia pestis KIM
aucucugcaguacaga

SEQ ID NO: 2313056 - RNA, 21 nt, Yersinia pestis KIM
aucucuuuauauucaauauca

SEQ ID NO: 2313057 - RNA, 23 nt, Yersinia pestis KIM
aucucuggccguggucuugguca

SEQ ID NO: 2313058 - RNA, 15 nt, Yersinia pestis KIM
aucugaaaauauuau

SEQ ID NO: 2313059 - RNA, 18 nt, Yersinia pestis KIM
aucucgauacauaccaua

SEQ ID NO: 2313060 - RNA, 15 nt, Yersinia pestis KIM
aucucucgaacccgc

SEQ ID NO: 2313061 - RNA, 22 nt, Yersinia pestis KIM
aucucucgaacccgcagauaaa

SEQ ID NO: 2313062 - RNA, 14 nt, Yersinia pestis KIM
aucucgacaaaucc

SEQ ID NO: 2313063 - RNA, 21 nt, Yersinia pestis KIM
aucuccuguggcacaucaaua

SEQ ID NO: 2313064 - RNA, 16 nt, Yersinia pestis KIM
aucuccugguucacuc

SEQ ID NO: 2313065 - RNA, 19 nt, Yersinia pestis KIM
aucuccuccggagaggaga

SEQ ID NO: 2313066 - RNA, 20 nt, Yersinia pestis KIM
aucucauccagcaacucaag

SEQ ID NO: 2313067 - RNA, 23 nt, Yersinia pestis KIM
aucucaucaaucgucaauccaau

SEQ ID NO: 2313068 - RNA, 15 nt, Yersinia pestis KIM
aucucagaauuuuuu

SEQ ID NO: 2313069 - RNA, 14 nt, Yersinia pestis KIM
aucuaucuguucac

SEQ ID NO: 2313070 - RNA, 16 nt, Yersinia pestis KIM
aucuauccaauccuuu

SEQ ID NO: 2313071 - RNA, 13 nt, Yersinia pestis KIM
aucuauaucggcc

SEQ ID NO: 2313072 - RNA, 18 nt, Yersinia pestis KIM
aucuauauagggaaauaa

SEQ ID NO: 2313073 - RNA, 17 nt, Yersinia pestis KIM
aucuauaaacuucacga

SEQ ID NO: 2313074 - RNA, 13 nt, Yersinia pestis KIM
aucuagcagugau

SEQ ID NO: 2313075 - RNA, 20 nt, Yersinia pestis KIM
aucuagcagugauuucagug

SEQ ID NO: 2313076 - RNA, 15 nt, Yersinia pestis KIM
aucuaggugcaguaa

SEQ ID NO: 2313077 - RNA, 16 nt, Yersinia pestis KIM
aucuaggccugggugu

SEQ ID NO: 2313078 - RNA, 13 nt, Yersinia pestis KIM
aucuacaacauca

SEQ ID NO: 2313079 - RNA, 17 nt, Yersinia pestis KIM
aucgucacuggcaccau

SEQ ID NO: 2313080 - RNA, 22 nt, Yersinia pestis KIM
aucgucagccccugccagaauc

SEQ ID NO: 2313081 - RNA, 18 nt, Yersinia pestis KIM
augaucaacgccaaaaua

SEQ ID NO: 2313082 - RNA, 20 nt, Yersinia pestis KIM
augaucaacgccaaaauaac

SEQ ID NO: 2313083 - RNA, 16 nt, Yersinia pestis KIM
augaucaucaagccaa

SEQ ID NO: 2313084 - RNA, 14 nt, Yersinia pestis KIM
augaucaugcucac

SEQ ID NO: 2313085 - RNA, 20 nt, Yersinia pestis KIM
augaucccugguuugccaua

SEQ ID NO: 2313086 - RNA, 21 nt, Yersinia pestis KIM
augauaggcacggcacuaaua

SEQ ID NO: 2313087 - RNA, 15 nt, Yersinia pestis KIM
augauauugaugacg

SEQ ID NO: 2313088 - RNA, 21 nt, Yersinia pestis KIM
augauauugaucuuuaauauu

SEQ ID NO: 2313089 - RNA, 13 nt, Yersinia pestis KIM
augauaaugccau

SEQ ID NO: 2313090 - RNA, 13 nt, Yersinia pestis KIM
augauagacagca

SEQ ID NO: 2313091 - RNA, 18 nt, Yersinia pestis KIM
augauaccgcggucauca

SEQ ID NO: 2313092 - RNA, 14 nt, Yersinia pestis KIM
augauaaaacuauu

SEQ ID NO: 2313093 - RNA, 17 nt, Yersinia pestis KIM
augaguuuuguccugag

SEQ ID NO: 2313094 - RNA, 22 nt, Yersinia pestis KIM
augaguuacgucaaaacuauuu

SEQ ID NO: 2313095 - RNA, 18 nt, Yersinia pestis KIM
augaguguuggccucaga

SEQ ID NO: 2313096 - RNA, 20 nt, Yersinia pestis KIM
augaguguuuuucucagcau

SEQ ID NO: 2313097 - RNA, 18 nt, Yersinia pestis KIM
augacuuaacugaaagcc

SEQ ID NO: 2313098 - RNA, 20 nt, Yersinia pestis KIM
augacaguauuuguagugga

SEQ ID NO: 2313099 - RNA, 21 nt, Yersinia pestis KIM
augacaggggauagcaacugc

SEQ ID NO: 2313100 - RNA, 19 nt, Yersinia pestis KIM
augacaguauuugcagugg

SEQ ID NO: 2313101 - RNA, 20 nt, Yersinia pestis KIM
augacaguauuugcagugga

SEQ ID NO: 2313102 - RNA, 22 nt, Yersinia pestis KIM
augacaguauuugcaguggaug

SEQ ID NO: 2313103 - RNA, 19 nt, Yersinia pestis KIM
augacagcauuauauuauu

SEQ ID NO: 2313104 - RNA, 20 nt, Yersinia pestis KIM
augacauauucaaccgccag

SEQ ID NO: 2313105 - RNA, 16 nt, Yersinia pestis KIM
augacauauugugcua

SEQ ID NO: 2313106 - RNA, 19 nt, Yersinia pestis KIM
augacauugcgaauauugc

SEQ ID NO: 2313107 - RNA, 12 nt, Yersinia pestis KIM
augacuaaccaa

SEQ ID NO: 2313108 - RNA, 18 nt, Yersinia pestis KIM
augacuaaccaagccauc

SEQ ID NO: 2313109 - RNA, 21 nt, Yersinia pestis KIM
augagugauauccgccaaaga

SEQ ID NO: 2313110 - RNA, 18 nt, Yersinia pestis KIM
augagugaaaauauguag

SEQ ID NO: 2313111 - RNA, 13 nt, Yersinia pestis KIM
augaggcugaggu

SEQ ID NO: 2313112 - RNA, 18 nt, Yersinia pestis KIM
augagcugaauagccuug

SEQ ID NO: 2313113 - RNA, 21 nt, Yersinia pestis KIM
aucuuuuacaaauuugacauu

SEQ ID NO: 2313114 - RNA, 14 nt, Yersinia pestis KIM
augaaaaauacaaa

SEQ ID NO: 2313115 - RNA, 19 nt, Yersinia pestis KIM
augaaaaauacaaauauaa

SEQ ID NO: 2313116 - RNA, 15 nt, Yersinia pestis KIM
augaaaauagccaac

SEQ ID NO: 2313117 - RNA, 21 nt, Yersinia pestis KIM
augaaauaaacuuuuaugcau

SEQ ID NO: 2313118 - RNA, 22 nt, Yersinia pestis KIM
augaaauauggugauaacugcc

SEQ ID NO: 2313119 - RNA, 19 nt, Yersinia pestis KIM
aucuuccuuuccauuuuca

SEQ ID NO: 2313120 - RNA, 19 nt, Yersinia pestis KIM
aucuucgcuuucaucuucu

SEQ ID NO: 2313121 - RNA, 22 nt, Yersinia pestis KIM
aucuucgguaaauuuauauuua

SEQ ID NO: 2313122 - RNA, 23 nt, Yersinia pestis KIM
aucuucgguaaauuuauauuuac

SEQ ID NO: 2313123 - RNA, 14 nt, Yersinia pestis KIM
aucuuuauuuauga

SEQ ID NO: 2313124 - RNA, 14 nt, Yersinia pestis KIM
aucuuuccagccaa

SEQ ID NO: 2313125 - RNA, 15 nt, Yersinia pestis KIM
aucuuuccagccaau

SEQ ID NO: 2313126 - RNA, 12 nt, Yersinia pestis KIM
augaacauuauu

SEQ ID NO: 2313127 - RNA, 14 nt, Yersinia pestis KIM
augaaccaaaauuc

SEQ ID NO: 2313128 - RNA, 17 nt, Yersinia pestis KIM
augaaccgucauagcau

SEQ ID NO: 2313129 - RNA, 18 nt, Yersinia pestis KIM
augaacccuuucagcgcu

SEQ ID NO: 2313130 - RNA, 23 nt, Yersinia pestis KIM
augaacguguuagguaauaccaa

SEQ ID NO: 2313131 - RNA, 13 nt, Yersinia pestis KIM
augaacucaacuu

SEQ ID NO: 2313132 - RNA, 12 nt, Yersinia pestis KIM
augaacgugccg

SEQ ID NO: 2313133 - RNA, 14 nt, Yersinia pestis KIM
augaaggccauaau

SEQ ID NO: 2313134 - RNA, 15 nt, Yersinia pestis KIM
augaagcucauuaau

SEQ ID NO: 2313135 - RNA, 16 nt, Yersinia pestis KIM
augaaugaggcugagg

SEQ ID NO: 2313136 - RNA, 22 nt, Yersinia pestis KIM
augaaugagguuuacauuuaaa

SEQ ID NO: 2313137 - RNA, 16 nt, Yersinia pestis KIM
augacagcaucaauau

SEQ ID NO: 2313138 - RNA, 19 nt, Yersinia pestis KIM
augaagggggcuuauucua

SEQ ID NO: 2313139 - RNA, 14 nt, Yersinia pestis KIM
augaauccguauuc

SEQ ID NO: 2313140 - RNA, 15 nt, Yersinia pestis KIM
aguuacgucagaaau

SEQ ID NO: 2313141 - RNA, 14 nt, Yersinia pestis KIM
aguuacucagcauc

SEQ ID NO: 2313142 - RNA, 15 nt, Yersinia pestis KIM
aguuacuauauaaau

SEQ ID NO: 2313143 - RNA, 14 nt, Yersinia pestis KIM
aguuaauuuucacc

SEQ ID NO: 2313144 - RNA, 16 nt, Yersinia pestis KIM
aguuacaauaaaucaa

SEQ ID NO: 2313145 - RNA, 22 nt, Yersinia pestis KIM
aguuaccgugagcagcaauaau

SEQ ID NO: 2313146 - RNA, 13 nt, Yersinia pestis KIM
aguuaccauggca

SEQ ID NO: 2313147 - RNA, 15 nt, Yersinia pestis KIM
aguuaaucgcagcag

SEQ ID NO: 2313148 - RNA, 23 nt, Yersinia pestis KIM
agugucgaaagacgcaaacgggu

SEQ ID NO: 2313149 - RNA, 16 nt, Yersinia pestis KIM
aguguccgcgccauaa

SEQ ID NO: 2313150 - RNA, 21 nt, Yersinia pestis KIM
aguguccgcgccauaaaagau

SEQ ID NO: 2313151 - RNA, 20 nt, Yersinia pestis KIM
agugucaguaugaaauuuug

SEQ ID NO: 2313152 - RNA, 20 nt, Yersinia pestis KIM
aguguauucgcaucuuccaa

SEQ ID NO: 2313153 - RNA, 22 nt, Yersinia pestis KIM
agugucaacgacggaugaaaag

SEQ ID NO: 2313154 - RNA, 21 nt, Yersinia pestis KIM
aguuaucuguuucaaauaagu

SEQ ID NO: 2313155 - RNA, 15 nt, Yersinia pestis KIM
aguuagcaggcagca

SEQ ID NO: 2313156 - RNA, 14 nt, Yersinia pestis KIM
aguucauggccaug

SEQ ID NO: 2313157 - RNA, 21 nt, Yersinia pestis KIM
aguucagauuuagcgauauaa

SEQ ID NO: 2313158 - RNA, 16 nt, Yersinia pestis KIM
aguucacucuguuuua

SEQ ID NO: 2313159 - RNA, 20 nt, Yersinia pestis KIM
aguucacugaguugcaggaa

SEQ ID NO: 2313160 - RNA, 16 nt, Yersinia pestis KIM
aguuauuauuuuuaau

SEQ ID NO: 2313161 - RNA, 16 nt, Yersinia pestis KIM
aguucacgaauuugcu

SEQ ID NO: 2313162 - RNA, 18 nt, Yersinia pestis KIM
aguucacccaacaaugaa

SEQ ID NO: 2313163 - RNA, 23 nt, Yersinia pestis KIM
aguucacgauggaaaaaauacag

SEQ ID NO: 2313164 - RNA, 21 nt, Yersinia pestis KIM
aguuccagccccaaacacuua

SEQ ID NO: 2313165 - RNA, 11 nt, Yersinia pestis KIM
aguucauucgc

SEQ ID NO: 2313166 - RNA, 18 nt, Yersinia pestis KIM
aguucauuccccaucgcc

SEQ ID NO: 2313167 - RNA, 19 nt, Yersinia pestis KIM
aguuccaauaugcggcaua

SEQ ID NO: 2313168 - RNA, 18 nt, Yersinia pestis KIM
aguucgguugccaaaauu

SEQ ID NO: 2313169 - RNA, 14 nt, Yersinia pestis KIM
aguugaucacccgc

SEQ ID NO: 2313170 - RNA, 23 nt, Yersinia pestis KIM
aguugauauaccgauuaccgggu

SEQ ID NO: 2313171 - RNA, 20 nt, Yersinia pestis KIM
aguugaucggccaauaugau

SEQ ID NO: 2313172 - RNA, 16 nt, Yersinia pestis KIM
aguugaugcaauggca

SEQ ID NO: 2313173 - RNA, 22 nt, Yersinia pestis KIM
aguucugguagcugcucacgau

SEQ ID NO: 2313174 - RNA, 19 nt, Yersinia pestis KIM
aguucuggaucggcauacu

SEQ ID NO: 2313175 - RNA, 16 nt, Yersinia pestis KIM
aguuucacuuucaacu

SEQ ID NO: 2313176 - RNA, 16 nt, Yersinia pestis KIM
aguuucacccucugcg

SEQ ID NO: 2313177 - RNA, 14 nt, Yersinia pestis KIM
aguuuccaguucaa

SEQ ID NO: 2313178 - RNA, 15 nt, Yersinia pestis KIM
aguuucccuuuucca

SEQ ID NO: 2313179 - RNA, 15 nt, Yersinia pestis KIM
aguuucagguuguua

SEQ ID NO: 2313180 - RNA, 15 nt, Yersinia pestis KIM
aguuugacgcuguau

SEQ ID NO: 2313181 - RNA, 16 nt, Yersinia pestis KIM
aguuugagacccccaa

SEQ ID NO: 2313182 - RNA, 20 nt, Yersinia pestis KIM
aguuugcuacuggccuggcu

SEQ ID NO: 2313183 - RNA, 18 nt, Yersinia pestis KIM
aguuuuaaacgucagauu

SEQ ID NO: 2313184 - RNA, 15 nt, Yersinia pestis KIM
aguuguugccacaga

SEQ ID NO: 2313185 - RNA, 13 nt, Yersinia pestis KIM
aguuuauuuuccc

SEQ ID NO: 2313186 - RNA, 21 nt, Yersinia pestis KIM
aguuuauuuucccuuucucag

SEQ ID NO: 2313187 - RNA, 23 nt, Yersinia pestis KIM
aguuuagucuagucuagcugcgc

SEQ ID NO: 2313188 - RNA, 18 nt, Yersinia pestis KIM
aguuuagcgagaaaguca

SEQ ID NO: 2313189 - RNA, 17 nt, Yersinia pestis KIM
aguugcccuaaacagca

SEQ ID NO: 2313190 - RNA, 20 nt, Yersinia pestis KIM
aguugcaguuggaucugcac

SEQ ID NO: 2313191 - RNA, 22 nt, Yersinia pestis KIM
aguugccagcaggcugcaccca

SEQ ID NO: 2313192 - RNA, 14 nt, Yersinia pestis KIM
aguuguacgugaag

SEQ ID NO: 2313193 - RNA, 19 nt, Yersinia pestis KIM
aguugucuauuuucauuau

SEQ ID NO: 2313194 - RNA, 20 nt, Yersinia pestis KIM
aguuguauuaccgauaaagg

SEQ ID NO: 2313195 - RNA, 20 nt, Yersinia pestis KIM
aguuguuggagaauaguggg

SEQ ID NO: 2313196 - RNA, 15 nt, Yersinia pestis KIM
agugauagcgggccu

SEQ ID NO: 2313197 - RNA, 11 nt, Yersinia pestis KIM
agugaaucagc

SEQ ID NO: 2313198 - RNA, 15 nt, Yersinia pestis KIM
agugaauaacgcuga

SEQ ID NO: 2313199 - RNA, 16 nt, Yersinia pestis KIM
agugaaguaucaccac

SEQ ID NO: 2313200 - RNA, 15 nt, Yersinia pestis KIM
agugaauaaaucaaa

SEQ ID NO: 2313201 - RNA, 18 nt, Yersinia pestis KIM
agugaaugacaguauuug

SEQ ID NO: 2313202 - RNA, 17 nt, Yersinia pestis KIM
agugcaaacuuaaaaau

SEQ ID NO: 2313203 - RNA, 16 nt, Yersinia pestis KIM
agugcaacauuaaaaa

SEQ ID NO: 2313204 - RNA, 21 nt, Yersinia pestis KIM
agugcaacauuaaaaauacaa

SEQ ID NO: 2313205 - RNA, 14 nt, Yersinia pestis KIM
agugauuuuaacca

SEQ ID NO: 2313206 - RNA, 22 nt, Yersinia pestis KIM
agugauuucagugucaguucga

SEQ ID NO: 2313207 - RNA, 14 nt, Yersinia pestis KIM
agugauucggguga

SEQ ID NO: 2313208 - RNA, 20 nt, Yersinia pestis KIM
agugauuguuugauuauugu

SEQ ID NO: 2313209 - RNA, 21 nt, Yersinia pestis KIM
agugauuauagcggcaaggau

SEQ ID NO: 2313210 - RNA, 15 nt, Yersinia pestis KIM
agugaugggggcaau

SEQ ID NO: 2313211 - RNA, 20 nt, Yersinia pestis KIM
agugaugggggcaauugauu

SEQ ID NO: 2313212 - RNA, 13 nt, Yersinia pestis KIM
agugaugauauuu

SEQ ID NO: 2313213 - RNA, 16 nt, Yersinia pestis KIM
agugaugcaguaaaua

SEQ ID NO: 2313214 - RNA, 22 nt, Yersinia pestis KIM
agugccaucgccaacaggccua

SEQ ID NO: 2313215 - RNA, 13 nt, Yersinia pestis KIM
agugccaacagcg

SEQ ID NO: 2313216 - RNA, 17 nt, Yersinia pestis KIM
agugcauuaucuuuaau

SEQ ID NO: 2313217 - RNA, 22 nt, Yersinia pestis KIM
agugcauuaucuuuaauuuuuc

SEQ ID NO: 2313218 - RNA, 14 nt, Yersinia pestis KIM
agugcacaucaaua

SEQ ID NO: 2313219 - RNA, 21 nt, Yersinia pestis KIM
agugcaauuauuuagccugcc

SEQ ID NO: 2313220 - RNA, 17 nt, Yersinia pestis KIM
agugcaauaaauucaaa

SEQ ID NO: 2313221 - RNA, 14 nt, Yersinia pestis KIM
agugcagccaagau

SEQ ID NO: 2313222 - RNA, 22 nt, Yersinia pestis KIM
agugcauccagcguaaacagua

SEQ ID NO: 2313223 - RNA, 21 nt, Yersinia pestis KIM
agugccgucaauuaucaaaaa

SEQ ID NO: 2313224 - RNA, 21 nt, Yersinia pestis KIM
agugccugcaacggagagaac

SEQ ID NO: 2313225 - RNA, 18 nt, Yersinia pestis KIM
agugcggcauguacaccg

SEQ ID NO: 2313226 - RNA, 17 nt, Yersinia pestis KIM
agugcgcuacgcaugau

SEQ ID NO: 2313227 - RNA, 16 nt, Yersinia pestis KIM
agugcuggcaagcccu

SEQ ID NO: 2313228 - RNA, 19 nt, Yersinia pestis KIM
agugcugaacguaaaacaa

SEQ ID NO: 2313229 - RNA, 16 nt, Yersinia pestis KIM
aguggaugauaaauau

SEQ ID NO: 2313230 - RNA, 15 nt, Yersinia pestis KIM
agugcuucaaauccu

SEQ ID NO: 2313231 - RNA, 15 nt, Yersinia pestis KIM
aguggcacaaauaaa

SEQ ID NO: 2313232 - RNA, 16 nt, Yersinia pestis KIM
aguggcacaaauaaaa

SEQ ID NO: 2313233 - RNA, 13 nt, Yersinia pestis KIM
agugguucaccac

SEQ ID NO: 2313234 - RNA, 19 nt, Yersinia pestis KIM
aguggucauuaauuucacc

SEQ ID NO: 2313235 - RNA, 22 nt, Yersinia pestis KIM
aguccguuaaaaaauucaucuu

SEQ ID NO: 2313236 - RNA, 14 nt, Yersinia pestis KIM
agucaaaacaauau

SEQ ID NO: 2313237 - RNA, 17 nt, Yersinia pestis KIM
aguauuuuaagaaaacu

SEQ ID NO: 2313238 - RNA, 22 nt, Yersinia pestis KIM
agucgcgauaaaauucagccac

SEQ ID NO: 2313239 - RNA, 17 nt, Yersinia pestis KIM
agucgaugaaacacaac

SEQ ID NO: 2313240 - RNA, 14 nt, Yersinia pestis KIM
agucgauagcuuuc

SEQ ID NO: 2313241 - RNA, 15 nt, Yersinia pestis KIM
aguccucucaccaag

SEQ ID NO: 2313242 - RNA, 23 nt, Yersinia pestis KIM
aguccguucgcgguaugaaacaa

SEQ ID NO: 2313243 - RNA, 19 nt, Yersinia pestis KIM
agucgacaguguaaaaagc

SEQ ID NO: 2313244 - RNA, 17 nt, Yersinia pestis KIM
agucgcuuuuuguauuu

SEQ ID NO: 2313245 - RNA, 20 nt, Yersinia pestis KIM
agucugaaggguauugaaga

SEQ ID NO: 2313246 - RNA, 18 nt, Yersinia pestis KIM
agucugagccucaugaau

SEQ ID NO: 2313247 - RNA, 14 nt, Yersinia pestis KIM
agucugaggagcca

SEQ ID NO: 2313248 - RNA, 15 nt, Yersinia pestis KIM
agucugaggagccau

SEQ ID NO: 2313249 - RNA, 15 nt, Yersinia pestis KIM
agucugaagccuacg

SEQ ID NO: 2313250 - RNA, 19 nt, Yersinia pestis KIM
agucugaaaccccuuguuu

SEQ ID NO: 2313251 - RNA, 22 nt, Yersinia pestis KIM
agucugaaacgccagccucugc

SEQ ID NO: 2313252 - RNA, 15 nt, Yersinia pestis KIM
agucugcggauaaac

SEQ ID NO: 2313253 - RNA, 17 nt, Yersinia pestis KIM
agugaaguaauaaaaau

SEQ ID NO: 2313254 - RNA, 15 nt, Yersinia pestis KIM
agugaaguaucacca

SEQ ID NO: 2313255 - RNA, 22 nt, Yersinia pestis KIM
agugaaaacguuaacugcagua

SEQ ID NO: 2313256 - RNA, 20 nt, Yersinia pestis KIM
agugaaaacguuaacugcag

SEQ ID NO: 2313257 - RNA, 19 nt, Yersinia pestis KIM
agucuuuuuaauaugugac

SEQ ID NO: 2313258 - RNA, 20 nt, Yersinia pestis KIM
auacacuccauuaauuuauu

SEQ ID NO: 2313259 - RNA, 17 nt, Yersinia pestis KIM
auacacuaauggcacgc

SEQ ID NO: 2313260 - RNA, 21 nt, Yersinia pestis KIM
auacacccgaaggccauugcc

SEQ ID NO: 2313261 - RNA, 12 nt, Yersinia pestis KIM
auacaccgccag

SEQ ID NO: 2313262 - RNA, 18 nt, Yersinia pestis KIM
auacaccguaucugccaa

SEQ ID NO: 2313263 - RNA, 14 nt, Yersinia pestis KIM
auacaccgcaccac

SEQ ID NO: 2313264 - RNA, 18 nt, Yersinia pestis KIM
auacacuugcucuaccac

SEQ ID NO: 2313265 - RNA, 12 nt, Yersinia pestis KIM
auacacuugcuc

SEQ ID NO: 2313266 - RNA, 16 nt, Yersinia pestis KIM
auacagccagcgggcg

SEQ ID NO: 2313267 - RNA, 15 nt, Yersinia pestis KIM
auacaaccauuucaa

SEQ ID NO: 2313268 - RNA, 20 nt, Yersinia pestis KIM
auacaaccacugaacaccau

SEQ ID NO: 2313269 - RNA, 16 nt, Yersinia pestis KIM
auacaaccaacaaaca

SEQ ID NO: 2313270 - RNA, 14 nt, Yersinia pestis KIM
auacaaauaaaaua

SEQ ID NO: 2313271 - RNA, 15 nt, Yersinia pestis KIM
auacaaauaaaauaa

SEQ ID NO: 2313272 - RNA, 12 nt, Yersinia pestis KIM
auacaauuuuug

SEQ ID NO: 2313273 - RNA, 15 nt, Yersinia pestis KIM
auacaauuauuuuua

SEQ ID NO: 2313274 - RNA, 18 nt, Yersinia pestis KIM
auacaauccaaccuauau

SEQ ID NO: 2313275 - RNA, 24 nt, Yersinia pestis KIM
auaauuuguuuauggcaauucgcu

SEQ ID NO: 2313276 - RNA, 21 nt, Yersinia pestis KIM
auaauuguucauaaaccugau

SEQ ID NO: 2313277 - RNA, 23 nt, Yersinia pestis KIM
auaauugcuacgacaguuuuuug

SEQ ID NO: 2313278 - RNA, 14 nt, Yersinia pestis KIM
auaauugcacccca

SEQ ID NO: 2313279 - RNA, 18 nt, Yersinia pestis KIM
auaauucugccgacuaau

SEQ ID NO: 2313280 - RNA, 22 nt, Yersinia pestis KIM
auaauugaguggcgaucuuaau

SEQ ID NO: 2313281 - RNA, 17 nt, Yersinia pestis KIM
auaauugaagauuuaaa

SEQ ID NO: 2313282 - RNA, 18 nt, Yersinia pestis KIM
auaaugguauuugaaaua

SEQ ID NO: 2313283 - RNA, 16 nt, Yersinia pestis KIM
auaaucuuuacugcau

SEQ ID NO: 2313284 - RNA, 22 nt, Yersinia pestis KIM
auaaucuugugaugaaauuaaa

SEQ ID NO: 2313285 - RNA, 14 nt, Yersinia pestis KIM
auaaugauauucau

SEQ ID NO: 2313286 - RNA, 19 nt, Yersinia pestis KIM
auaaugauguaguguguuu

SEQ ID NO: 2313287 - RNA, 14 nt, Yersinia pestis KIM
auaaugcuuuggua

SEQ ID NO: 2313288 - RNA, 15 nt, Yersinia pestis KIM
auaaucaccagacaa

SEQ ID NO: 2313289 - RNA, 21 nt, Yersinia pestis KIM
auaaucagaggugaaaaaaua

SEQ ID NO: 2313290 - RNA, 12 nt, Yersinia pestis KIM
auaaucaucuac

SEQ ID NO: 2313291 - RNA, 13 nt, Yersinia pestis KIM
auaaucaucuaca

SEQ ID NO: 2313292 - RNA, 17 nt, Yersinia pestis KIM
auaaucaucuacaacau

SEQ ID NO: 2313293 - RNA, 18 nt, Yersinia pestis KIM
auaauccucaaccugauc

SEQ ID NO: 2313294 - RNA, 13 nt, Yersinia pestis KIM
auaaucaccagac

SEQ ID NO: 2313295 - RNA, 14 nt, Yersinia pestis KIM
auaaucacauaaua

SEQ ID NO: 2313296 - RNA, 17 nt, Yersinia pestis KIM
auaaucacauaauauuu

SEQ ID NO: 2313297 - RNA, 20 nt, Yersinia pestis KIM
auaauaagggcgcauauccu

SEQ ID NO: 2313298 - RNA, 13 nt, Yersinia pestis KIM
auaauaauauuga

SEQ ID NO: 2313299 - RNA, 11 nt, Yersinia pestis KIM
auaauaauggc

SEQ ID NO: 2313300 - RNA, 12 nt, Yersinia pestis KIM
auaauaaauuaa

SEQ ID NO: 2313301 - RNA, 19 nt, Yersinia pestis KIM
auaauaacgaauuucauuu

SEQ ID NO: 2313302 - RNA, 12 nt, Yersinia pestis KIM
auaauaaaaaaa

SEQ ID NO: 2313303 - RNA, 13 nt, Yersinia pestis KIM
auaauaaaaaaaa

SEQ ID NO: 2313304 - RNA, 11 nt, Yersinia pestis KIM
auaaguuuuaa

SEQ ID NO: 2313305 - RNA, 20 nt, Yersinia pestis KIM
auaaguguuucaaauaagua

SEQ ID NO: 2313306 - RNA, 20 nt, Yersinia pestis KIM
auaaguguguguauuuaaaa

SEQ ID NO: 2313307 - RNA, 23 nt, Yersinia pestis KIM
auaaguguguguauuuaaaagau

SEQ ID NO: 2313308 - RNA, 22 nt, Yersinia pestis KIM
auaagugcaaacuuaaaaauca

SEQ ID NO: 2313309 - RNA, 19 nt, Yersinia pestis KIM
auaagugccgggaauauag

SEQ ID NO: 2313310 - RNA, 13 nt, Yersinia pestis KIM
auaaguugaacca

SEQ ID NO: 2313311 - RNA, 23 nt, Yersinia pestis KIM
auaaguuccggcagauaugaugc

SEQ ID NO: 2313312 - RNA, 22 nt, Yersinia pestis KIM
auaagugaauaacgcugaauaa

SEQ ID NO: 2313313 - RNA, 14 nt, Yersinia pestis KIM
auaagugaauaaau

SEQ ID NO: 2313314 - RNA, 21 nt, Yersinia pestis KIM
auaagugaaacaaauacaccu

SEQ ID NO: 2313315 - RNA, 14 nt, Yersinia pestis KIM
auaacuuaaauaau

SEQ ID NO: 2313316 - RNA, 16 nt, Yersinia pestis KIM
auaaaauccugaauaa

SEQ ID NO: 2313317 - RNA, 20 nt, Yersinia pestis KIM
auaaaauccugaauaauacu

SEQ ID NO: 2313318 - RNA, 13 nt, Yersinia pestis KIM
auaaaaucaaaac

SEQ ID NO: 2313319 - RNA, 14 nt, Yersinia pestis KIM
aguuuuagacguca

SEQ ID NO: 2313320 - RNA, 21 nt, Yersinia pestis KIM
aguuuuagaugucagauuagu

SEQ ID NO: 2313321 - RNA, 16 nt, Yersinia pestis KIM
auaaaauaauaauggu

SEQ ID NO: 2313322 - RNA, 16 nt, Yersinia pestis KIM
auaaaccaaaugguua

SEQ ID NO: 2313323 - RNA, 21 nt, Yersinia pestis KIM
auaaaccaacugaaacuggag

SEQ ID NO: 2313324 - RNA, 22 nt, Yersinia pestis KIM
auaaaccaauaucugccaauuc

SEQ ID NO: 2313325 - RNA, 21 nt, Yersinia pestis KIM
auaaacaaucugaugaauuaa

SEQ ID NO: 2313326 - RNA, 15 nt, Yersinia pestis KIM
auaaaauuacccagc

SEQ ID NO: 2313327 - RNA, 12 nt, Yersinia pestis KIM
auaaaauuaacg

SEQ ID NO: 2313328 - RNA, 20 nt, Yersinia pestis KIM
auaaaauuaacggaaaagag

SEQ ID NO: 2313329 - RNA, 13 nt, Yersinia pestis KIM
auaaaccugauuu

SEQ ID NO: 2313330 - RNA, 19 nt, Yersinia pestis KIM
auaaaccuagucucacuaa

SEQ ID NO: 2313331 - RNA, 17 nt, Yersinia pestis KIM
auaaaccauacauaaca

SEQ ID NO: 2313332 - RNA, 14 nt, Yersinia pestis KIM
auaaagcaucagac

SEQ ID NO: 2313333 - RNA, 18 nt, Yersinia pestis KIM
auaaagcaucagacugcu

SEQ ID NO: 2313334 - RNA, 20 nt, Yersinia pestis KIM
auaaaguaaaagccagucag

SEQ ID NO: 2313335 - RNA, 22 nt, Yersinia pestis KIM
auaaagccgagcaagugaauaa

SEQ ID NO: 2313336 - RNA, 20 nt, Yersinia pestis KIM
auaaagcaucagacugcucu

SEQ ID NO: 2313337 - RNA, 19 nt, Yersinia pestis KIM
auaaagcgaugcucaauac

SEQ ID NO: 2313338 - RNA, 20 nt, Yersinia pestis KIM
auaaagcgaugcucaauacu

SEQ ID NO: 2313339 - RNA, 14 nt, Yersinia pestis KIM
auaaauauccuccg

SEQ ID NO: 2313340 - RNA, 15 nt, Yersinia pestis KIM
auaaaucaugucccu

SEQ ID NO: 2313341 - RNA, 20 nt, Yersinia pestis KIM
auaaauaccgccaaauacaa

SEQ ID NO: 2313342 - RNA, 19 nt, Yersinia pestis KIM
auaaauaccggcaggaaag

SEQ ID NO: 2313343 - RNA, 17 nt, Yersinia pestis KIM
auaaauaucauuaacaa

SEQ ID NO: 2313344 - RNA, 14 nt, Yersinia pestis KIM
auaaauaauaucaa

SEQ ID NO: 2313345 - RNA, 15 nt, Yersinia pestis KIM
auaaauaauaucaau

SEQ ID NO: 2313346 - RNA, 14 nt, Yersinia pestis KIM
auaaauaauuacuu

SEQ ID NO: 2313347 - RNA, 14 nt, Yersinia pestis KIM
auaaauaccaauuu

SEQ ID NO: 2313348 - RNA, 13 nt, Yersinia pestis KIM
auaaauaccaauu

SEQ ID NO: 2313349 - RNA, 23 nt, Yersinia pestis KIM
auaaauaaccgagcgugaagagc

SEQ ID NO: 2313350 - RNA, 14 nt, Yersinia pestis KIM
auaaauaaccgagc

SEQ ID NO: 2313351 - RNA, 17 nt, Yersinia pestis KIM
auaacauccauguaagc

SEQ ID NO: 2313352 - RNA, 12 nt, Yersinia pestis KIM
auaacaguuuac

SEQ ID NO: 2313353 - RNA, 16 nt, Yersinia pestis KIM
auaacauuuuuucuuu

SEQ ID NO: 2313354 - RNA, 13 nt, Yersinia pestis KIM
auaacauuuuuuc

SEQ ID NO: 2313355 - RNA, 14 nt, Yersinia pestis KIM
auaaccaaaucacc

SEQ ID NO: 2313356 - RNA, 16 nt, Yersinia pestis KIM
auaacacagucggcau

SEQ ID NO: 2313357 - RNA, 16 nt, Yersinia pestis KIM
auaacacauauauuau

SEQ ID NO: 2313358 - RNA, 20 nt, Yersinia pestis KIM
auaacacggccuauugaaua

SEQ ID NO: 2313359 - RNA, 13 nt, Yersinia pestis KIM
auaaauuuucuaa

SEQ ID NO: 2313360 - RNA, 22 nt, Yersinia pestis KIM
auaacaacgacuccaucaccgu

SEQ ID NO: 2313361 - RNA, 17 nt, Yersinia pestis KIM
auaacaacacaauuaau

SEQ ID NO: 2313362 - RNA, 17 nt, Yersinia pestis KIM
auaacgguaucagucau

SEQ ID NO: 2313363 - RNA, 16 nt, Yersinia pestis KIM
auaacggcgguaccag

SEQ ID NO: 2313364 - RNA, 22 nt, Yersinia pestis KIM
auaacgcuuuuucauugguaau

SEQ ID NO: 2313365 - RNA, 22 nt, Yersinia pestis KIM
auaacugguccaacuaaacagg

SEQ ID NO: 2313366 - RNA, 15 nt, Yersinia pestis KIM
auaacuggagaauuu

SEQ ID NO: 2313367 - RNA, 14 nt, Yersinia pestis KIM
auaacugccagggc

SEQ ID NO: 2313368 - RNA, 14 nt, Yersinia pestis KIM
auaacugccauaca

SEQ ID NO: 2313369 - RNA, 19 nt, Yersinia pestis KIM
auaacugagguauaucgug

SEQ ID NO: 2313370 - RNA, 23 nt, Yersinia pestis KIM
auaaccauuaauugguuuuaaua

SEQ ID NO: 2313371 - RNA, 21 nt, Yersinia pestis KIM
auaaccauaaaauaaauaauu

SEQ ID NO: 2313372 - RNA, 23 nt, Yersinia pestis KIM
auaacccgccuagcaucauaaau

SEQ ID NO: 2313373 - RNA, 21 nt, Yersinia pestis KIM
auaaccucagccucauucaug

SEQ ID NO: 2313374 - RNA, 22 nt, Yersinia pestis KIM
auaaccucagggcgucucuacg

SEQ ID NO: 2313375 - RNA, 14 nt, Yersinia pestis KIM
auaaccucagccuc

SEQ ID NO: 2313376 - RNA, 15 nt, Yersinia pestis KIM
auaaccucagccuca

SEQ ID NO: 2313377 - RNA, 23 nt, Yersinia pestis KIM
auaaccucgguggcucaauccaa

SEQ ID NO: 2313378 - RNA, 20 nt, Yersinia pestis KIM
auaaccugaccguuaucauc

SEQ ID NO: 2313379 - RNA, 18 nt, Yersinia pestis KIM
auaaccugagcaccagaa

SEQ ID NO: 2313380 - RNA, 17 nt, Yersinia pestis KIM
auaaccgucaccaaaau

SEQ ID NO: 2313381 - RNA, 21 nt, Yersinia pestis KIM
auaaccguuaaggccagcaga

SEQ ID NO: 2313382 - RNA, 22 nt, Yersinia pestis KIM
auaaccgcgaagaggguuuuuu

SEQ ID NO: 2313383 - RNA, 21 nt, Yersinia pestis KIM
auaaccgcguuauggagaggc

SEQ ID NO: 2313384 - RNA, 20 nt, Yersinia pestis KIM
auaaccgcuaaggccaaugg

SEQ ID NO: 2313385 - RNA, 21 nt, Yersinia pestis KIM
auaaccgcuaaggccaaugga

SEQ ID NO: 2313386 - RNA, 15 nt, Yersinia pestis KIM
auaaccgccggauaa

SEQ ID NO: 2313387 - RNA, 19 nt, Yersinia pestis KIM
auaaccgcgaagaggguuu

SEQ ID NO: 2313388 - RNA, 22 nt, Yersinia pestis KIM
auaaccgcagcaggcagagcaa

SEQ ID NO: 2313389 - RNA, 16 nt, Yersinia pestis KIM
auaaccgaguuuuuug

SEQ ID NO: 2313390 - RNA, 22 nt, Yersinia pestis KIM
agcuucugcuauaaccccggcc

SEQ ID NO: 2313391 - RNA, 24 nt, Yersinia pestis KIM
agcuugacgaccaauaucauaaua

SEQ ID NO: 2313392 - RNA, 14 nt, Yersinia pestis KIM
agcuuggggauggc

SEQ ID NO: 2313393 - RNA, 22 nt, Yersinia pestis KIM
agcuuguugauaucaaucucuu

SEQ ID NO: 2313394 - RNA, 23 nt, Yersinia pestis KIM
agcuuguugauaucaaucucuug

SEQ ID NO: 2313395 - RNA, 17 nt, Yersinia pestis KIM
agcuuccgcuucaacuu

SEQ ID NO: 2313396 - RNA, 11 nt, Yersinia pestis KIM
agcuucccugg

SEQ ID NO: 2313397 - RNA, 19 nt, Yersinia pestis KIM
agcuucgccaccagauagu

SEQ ID NO: 2313398 - RNA, 18 nt, Yersinia pestis KIM
agcuuccaacugauaaac

SEQ ID NO: 2313399 - RNA, 12 nt, Yersinia pestis KIM
agcuuagcccac

SEQ ID NO: 2313400 - RNA, 21 nt, Yersinia pestis KIM
agcuuacaccauguucuucaa

SEQ ID NO: 2313401 - RNA, 17 nt, Yersinia pestis KIM
agcuuaccgcggugaag

SEQ ID NO: 2313402 - RNA, 19 nt, Yersinia pestis KIM
agcuuaucagcguagauuu

SEQ ID NO: 2313403 - RNA, 13 nt, Yersinia pestis KIM
agcugccugugcg

SEQ ID NO: 2313404 - RNA, 21 nt, Yersinia pestis KIM
agcugcuuuaucguagccaau

SEQ ID NO: 2313405 - RNA, 18 nt, Yersinia pestis KIM
agcuguaaaggcaaagaa

SEQ ID NO: 2313406 - RNA, 17 nt, Yersinia pestis KIM
agcuuaaucaucaucac

SEQ ID NO: 2313407 - RNA, 18 nt, Yersinia pestis KIM
agcuguagcaauauaucu

SEQ ID NO: 2313408 - RNA, 15 nt, Yersinia pestis KIM
agcuguauugcccga

SEQ ID NO: 2313409 - RNA, 21 nt, Yersinia pestis KIM
aggaaaggccggauguaaaac

SEQ ID NO: 2313410 - RNA, 13 nt, Yersinia pestis KIM
aggaaauuucagu

SEQ ID NO: 2313411 - RNA, 20 nt, Yersinia pestis KIM
agcuuugugcaaaauacaaa

SEQ ID NO: 2313412 - RNA, 19 nt, Yersinia pestis KIM
aggaaaggccggauguaaa

SEQ ID NO: 2313413 - RNA, 18 nt, Yersinia pestis KIM
agcuuuucacgagagagc

SEQ ID NO: 2313414 - RNA, 15 nt, Yersinia pestis KIM
aggaagagaaaagca

SEQ ID NO: 2313415 - RNA, 14 nt, Yersinia pestis KIM
aggaagagaaaagc

SEQ ID NO: 2313416 - RNA, 22 nt, Yersinia pestis KIM
aggaacccauuugcacagcauu

SEQ ID NO: 2313417 - RNA, 13 nt, Yersinia pestis KIM
aggacuuccugcc

SEQ ID NO: 2313418 - RNA, 21 nt, Yersinia pestis KIM
aggagacagggggauaaaaac

SEQ ID NO: 2313419 - RNA, 20 nt, Yersinia pestis KIM
aggagauuucagacugcuga

SEQ ID NO: 2313420 - RNA, 17 nt, Yersinia pestis KIM
aggagauuucagacugc

SEQ ID NO: 2313421 - RNA, 16 nt, Yersinia pestis KIM
aggaaguccaguaaua

SEQ ID NO: 2313422 - RNA, 17 nt, Yersinia pestis KIM
aggacaaauagauuuaa

SEQ ID NO: 2313423 - RNA, 19 nt, Yersinia pestis KIM
aggcgauagcuucagcauu

SEQ ID NO: 2313424 - RNA, 22 nt, Yersinia pestis KIM
aggcgaguuucccuuuuccauc

SEQ ID NO: 2313425 - RNA, 13 nt, Yersinia pestis KIM
aggcgcuccccug

SEQ ID NO: 2313426 - RNA, 16 nt, Yersinia pestis KIM
aggccccucggggccu

SEQ ID NO: 2313427 - RNA, 20 nt, Yersinia pestis KIM
aggccccuuaaauaugaugu

SEQ ID NO: 2313428 - RNA, 17 nt, Yersinia pestis KIM
aggccguucacccuuug

SEQ ID NO: 2313429 - RNA, 18 nt, Yersinia pestis KIM
aggccgugggcaauaaca

SEQ ID NO: 2313430 - RNA, 18 nt, Yersinia pestis KIM
aggccuauaacccccaca

SEQ ID NO: 2313431 - RNA, 13 nt, Yersinia pestis KIM
aggccuaaacccc

SEQ ID NO: 2313432 - RNA, 20 nt, Yersinia pestis KIM
aggccguuuaaaggucccuu

SEQ ID NO: 2313433 - RNA, 15 nt, Yersinia pestis KIM
aggccuucugggccg

SEQ ID NO: 2313434 - RNA, 11 nt, Yersinia pestis KIM
aggcaagaaac

SEQ ID NO: 2313435 - RNA, 16 nt, Yersinia pestis KIM
aggcaccagcgcacug

SEQ ID NO: 2313436 - RNA, 13 nt, Yersinia pestis KIM
aggcaccaccaug

SEQ ID NO: 2313437 - RNA, 16 nt, Yersinia pestis KIM
aggcaccaccaugaug

SEQ ID NO: 2313438 - RNA, 17 nt, Yersinia pestis KIM
aggcaaaaagagucagu

SEQ ID NO: 2313439 - RNA, 20 nt, Yersinia pestis KIM
aggcaaaaugaucaucagca

SEQ ID NO: 2313440 - RNA, 18 nt, Yersinia pestis KIM
aggcaaccuuggugaaga

SEQ ID NO: 2313441 - RNA, 15 nt, Yersinia pestis KIM
aggcaaccaucagga

SEQ ID NO: 2313442 - RNA, 16 nt, Yersinia pestis KIM
aggcaacaacacccga

SEQ ID NO: 2313443 - RNA, 19 nt, Yersinia pestis KIM
aggauucuguuaccucgcc

SEQ ID NO: 2313444 - RNA, 15 nt, Yersinia pestis KIM
aggagcccucuguca

SEQ ID NO: 2313445 - RNA, 23 nt, Yersinia pestis KIM
aggagcgauaacauuuuuucuuu

SEQ ID NO: 2313446 - RNA, 16 nt, Yersinia pestis KIM
aggagccauugauugg

SEQ ID NO: 2313447 - RNA, 15 nt, Yersinia pestis KIM
aggauuagcuucugc

SEQ ID NO: 2313448 - RNA, 17 nt, Yersinia pestis KIM
aggauuagcuucugcua

SEQ ID NO: 2313449 - RNA, 12 nt, Yersinia pestis KIM
aggccauuggca

SEQ ID NO: 2313450 - RNA, 15 nt, Yersinia pestis KIM
aggcccagcagugcu

SEQ ID NO: 2313451 - RNA, 11 nt, Yersinia pestis KIM
aggccaaugga

SEQ ID NO: 2313452 - RNA, 20 nt, Yersinia pestis KIM
aggccaauagaaaaacacug

SEQ ID NO: 2313453 - RNA, 15 nt, Yersinia pestis KIM
aggcauuggcgcuca

SEQ ID NO: 2313454 - RNA, 22 nt, Yersinia pestis KIM
aggcauuggcgcucagguggcu

SEQ ID NO: 2313455 - RNA, 12 nt, Yersinia pestis KIM
aggccaaccucu

SEQ ID NO: 2313456 - RNA, 15 nt, Yersinia pestis KIM
aggcacugcagaaaa

SEQ ID NO: 2313457 - RNA, 16 nt, Yersinia pestis KIM
aggcacgugccgcugg

SEQ ID NO: 2313458 - RNA, 13 nt, Yersinia pestis KIM
aggcagaaauaau

SEQ ID NO: 2313459 - RNA, 14 nt, Yersinia pestis KIM
aggcagaaauaaua

SEQ ID NO: 2313460 - RNA, 18 nt, Yersinia pestis KIM
aggcagaaauaauaucaa

SEQ ID NO: 2313461 - RNA, 18 nt, Yersinia pestis KIM
aggcacuuguuuugccag

SEQ ID NO: 2313462 - RNA, 22 nt, Yersinia pestis KIM
aggcacuuugucaauaaccuca

SEQ ID NO: 2313463 - RNA, 18 nt, Yersinia pestis KIM
aggcaugauaagcaggaa

SEQ ID NO: 2313464 - RNA, 15 nt, Yersinia pestis KIM
aggcaugguaagaau

SEQ ID NO: 2313465 - RNA, 14 nt, Yersinia pestis KIM
aggcaugcucccuc

SEQ ID NO: 2313466 - RNA, 19 nt, Yersinia pestis KIM
aggguggaaacagguagug

SEQ ID NO: 2313467 - RNA, 23 nt, Yersinia pestis KIM
agguaacggaaggggaauauaau

SEQ ID NO: 2313468 - RNA, 15 nt, Yersinia pestis KIM
agguaacuaagcugc

SEQ ID NO: 2313469 - RNA, 16 nt, Yersinia pestis KIM
agguaacuaagcugcc

SEQ ID NO: 2313470 - RNA, 12 nt, Yersinia pestis KIM
agguaagaaaga

SEQ ID NO: 2313471 - RNA, 12 nt, Yersinia pestis KIM
agguaagcagag

SEQ ID NO: 2313472 - RNA, 19 nt, Yersinia pestis KIM
agguaagccuuucuccaca

SEQ ID NO: 2313473 - RNA, 20 nt, Yersinia pestis KIM
agguaagccuuucuccacau

SEQ ID NO: 2313474 - RNA, 19 nt, Yersinia pestis KIM
agguaaucagacugcugac

SEQ ID NO: 2313475 - RNA, 18 nt, Yersinia pestis KIM
agguaaucagacugcuga

SEQ ID NO: 2313476 - RNA, 16 nt, Yersinia pestis KIM
agguaaucagacugcu

SEQ ID NO: 2313477 - RNA, 15 nt, Yersinia pestis KIM
agguaauaccaaugc

SEQ ID NO: 2313478 - RNA, 19 nt, Yersinia pestis KIM
agguaauacucauccagau

SEQ ID NO: 2313479 - RNA, 22 nt, Yersinia pestis KIM
aggguacuguugaugcagauga

SEQ ID NO: 2313480 - RNA, 22 nt, Yersinia pestis KIM
agguaccgcugcccggcucauc

SEQ ID NO: 2313481 - RNA, 22 nt, Yersinia pestis KIM
agguagaucaaacauaaccugc

SEQ ID NO: 2313482 - RNA, 16 nt, Yersinia pestis KIM
aggucaucccagcaca

SEQ ID NO: 2313483 - RNA, 21 nt, Yersinia pestis KIM
agguaugacggggauauaugg

SEQ ID NO: 2313484 - RNA, 23 nt, Yersinia pestis KIM
agguaucucguaacaacggcugg

SEQ ID NO: 2313485 - RNA, 21 nt, Yersinia pestis KIM
aggugcauccacauauauaga

SEQ ID NO: 2313486 - RNA, 17 nt, Yersinia pestis KIM
aggugcaguuucuaccg

SEQ ID NO: 2313487 - RNA, 15 nt, Yersinia pestis KIM
aggucgggcgcugag

SEQ ID NO: 2313488 - RNA, 16 nt, Yersinia pestis KIM
aggugaugucagccgu

SEQ ID NO: 2313489 - RNA, 21 nt, Yersinia pestis KIM
agggcguuuaccauccagugc

SEQ ID NO: 2313490 - RNA, 19 nt, Yersinia pestis KIM
agggcguucugucacaauc

SEQ ID NO: 2313491 - RNA, 20 nt, Yersinia pestis KIM
agggccacuucgguggcccu

SEQ ID NO: 2313492 - RNA, 14 nt, Yersinia pestis KIM
agggcaaucaggaa

SEQ ID NO: 2313493 - RNA, 21 nt, Yersinia pestis KIM
agggcaauaaaaaaggcagcg

SEQ ID NO: 2313494 - RNA, 20 nt, Yersinia pestis KIM
agggccacccugccaaaaaa

SEQ ID NO: 2313495 - RNA, 17 nt, Yersinia pestis KIM
aggggcuuagaagagau

SEQ ID NO: 2313496 - RNA, 20 nt, Yersinia pestis KIM
aggggcuuagaagagauaga

SEQ ID NO: 2313497 - RNA, 14 nt, Yersinia pestis KIM
agggguucuuccaa

SEQ ID NO: 2313498 - RNA, 19 nt, Yersinia pestis KIM
aggguaaguccaucagccu

SEQ ID NO: 2313499 - RNA, 14 nt, Yersinia pestis KIM
aggguaaccaaugu

SEQ ID NO: 2313500 - RNA, 15 nt, Yersinia pestis KIM
aggggcuagccagcg

SEQ ID NO: 2313501 - RNA, 20 nt, Yersinia pestis KIM
aggggcaguuguuggagaau

SEQ ID NO: 2313502 - RNA, 22 nt, Yersinia pestis KIM
agggcuucuggcgugucaucuu

SEQ ID NO: 2313503 - RNA, 16 nt, Yersinia pestis KIM
agggcuguuauccggg

SEQ ID NO: 2313504 - RNA, 14 nt, Yersinia pestis KIM
agggcugacagagc

SEQ ID NO: 2313505 - RNA, 17 nt, Yersinia pestis KIM
agggcguuaccgaggcu

SEQ ID NO: 2313506 - RNA, 21 nt, Yersinia pestis KIM
agggcuauuuuuaugcaggga

SEQ ID NO: 2313507 - RNA, 18 nt, Yersinia pestis KIM
agggacgcgaaucccccc

SEQ ID NO: 2313508 - RNA, 23 nt, Yersinia pestis KIM
agggacaacaucauauauuaaau

SEQ ID NO: 2313509 - RNA, 18 nt, Yersinia pestis KIM
agggagccaauagaggcu

SEQ ID NO: 2313510 - RNA, 19 nt, Yersinia pestis KIM
agggagccaauagaggcuc

SEQ ID NO: 2313511 - RNA, 12 nt, Yersinia pestis KIM
agggagggcgcg

SEQ ID NO: 2313512 - RNA, 18 nt, Yersinia pestis KIM
agggagcuuugcuaguga

SEQ ID NO: 2313513 - RNA, 14 nt, Yersinia pestis KIM
agggagucagggag

SEQ ID NO: 2313514 - RNA, 15 nt, Yersinia pestis KIM
agggagucagggagu

SEQ ID NO: 2313515 - RNA, 16 nt, Yersinia pestis KIM
agggagucagggaguc

SEQ ID NO: 2313516 - RNA, 19 nt, Yersinia pestis KIM
agggagucagggagucagg

SEQ ID NO: 2313517 - RNA, 21 nt, Yersinia pestis KIM
agggagucagggagucaggga

SEQ ID NO: 2313518 - RNA, 16 nt, Yersinia pestis KIM
aggcuuuaggugcgca

SEQ ID NO: 2313519 - RNA, 17 nt, Yersinia pestis KIM
aggcuuggcgggcuggc

SEQ ID NO: 2313520 - RNA, 14 nt, Yersinia pestis KIM
aggcuuuuuacuuu

SEQ ID NO: 2313521 - RNA, 15 nt, Yersinia pestis KIM
agggaaaaacgcaga

SEQ ID NO: 2313522 - RNA, 21 nt, Yersinia pestis KIM
aggcuuuuguuaauucaccua

SEQ ID NO: 2313523 - RNA, 18 nt, Yersinia pestis KIM
agggaacggauagagggc

SEQ ID NO: 2313524 - RNA, 21 nt, Yersinia pestis KIM
aguauccgcgccagacuggcc

SEQ ID NO: 2313525 - RNA, 15 nt, Yersinia pestis KIM
aguaucuaugcagcg

SEQ ID NO: 2313526 - RNA, 15 nt, Yersinia pestis KIM
aguaugaaauuuugu

SEQ ID NO: 2313527 - RNA, 17 nt, Yersinia pestis KIM
aguauacggucaaaagc

SEQ ID NO: 2313528 - RNA, 23 nt, Yersinia pestis KIM
aguauucuuaucaaucaaaaaau

SEQ ID NO: 2313529 - RNA, 13 nt, Yersinia pestis KIM
aguauuccccacu

SEQ ID NO: 2313530 - RNA, 18 nt, Yersinia pestis KIM
aguauugcagagcaaaac

SEQ ID NO: 2313531 - RNA, 18 nt, Yersinia pestis KIM
aguauucgccagauacaa

SEQ ID NO: 2313532 - RNA, 19 nt, Yersinia pestis KIM
aguauucgccagauacaag

SEQ ID NO: 2313533 - RNA, 19 nt, Yersinia pestis KIM
aguauuuaacgccaccaau

SEQ ID NO: 2313534 - RNA, 13 nt, Yersinia pestis KIM
aguauuuguagug

SEQ ID NO: 2313535 - RNA, 15 nt, Yersinia pestis KIM
aguauguauccaucu

SEQ ID NO: 2313536 - RNA, 15 nt, Yersinia pestis KIM
aguaugcaacaguga

SEQ ID NO: 2313537 - RNA, 15 nt, Yersinia pestis KIM
aguauuaccucauca

SEQ ID NO: 2313538 - RNA, 17 nt, Yersinia pestis KIM
aguauuaccucaucauu

SEQ ID NO: 2313539 - RNA, 19 nt, Yersinia pestis KIM
aguauuaccucaucauuau

SEQ ID NO: 2313540 - RNA, 16 nt, Yersinia pestis KIM
aguagcacaaugccua

SEQ ID NO: 2313541 - RNA, 23 nt, Yersinia pestis KIM
aguagcagggccgcccagauaaa

SEQ ID NO: 2313542 - RNA, 14 nt, Yersinia pestis KIM
aguagcauaaaaau

SEQ ID NO: 2313543 - RNA, 18 nt, Yersinia pestis KIM
aguagcuaauaaaauggc

SEQ ID NO: 2313544 - RNA, 13 nt, Yersinia pestis KIM
aguagagcuucca

SEQ ID NO: 2313545 - RNA, 19 nt, Yersinia pestis KIM
aguaguggaaaaacugaaa

SEQ ID NO: 2313546 - RNA, 21 nt, Yersinia pestis KIM
aguagggauuuaugcaaauaa

SEQ ID NO: 2313547 - RNA, 22 nt, Yersinia pestis KIM
aguaaaaauauuaacugcagug

SEQ ID NO: 2313548 - RNA, 23 nt, Yersinia pestis KIM
aguaaaaauauuaacugcaguga

SEQ ID NO: 2313549 - RNA, 16 nt, Yersinia pestis KIM
agguuuggccuaacaa

SEQ ID NO: 2313550 - RNA, 21 nt, Yersinia pestis KIM
aguaaaacugauauaaagcau

SEQ ID NO: 2313551 - RNA, 13 nt, Yersinia pestis KIM
aguaaaagucagc

SEQ ID NO: 2313552 - RNA, 18 nt, Yersinia pestis KIM
aguaaaagauucauaaaa

SEQ ID NO: 2313553 - RNA, 16 nt, Yersinia pestis KIM
aguaaaaucaucagcc

SEQ ID NO: 2313554 - RNA, 15 nt, Yersinia pestis KIM
agguugcagcuaaac

SEQ ID NO: 2313555 - RNA, 18 nt, Yersinia pestis KIM
agguugcagcuaaacacg

SEQ ID NO: 2313556 - RNA, 20 nt, Yersinia pestis KIM
agguugcgccauuaccacug

SEQ ID NO: 2313557 - RNA, 18 nt, Yersinia pestis KIM
agguggcacccagugacc

SEQ ID NO: 2313558 - RNA, 21 nt, Yersinia pestis KIM
agguggcgauaaagagugaaa

SEQ ID NO: 2313559 - RNA, 18 nt, Yersinia pestis KIM
agguuggggaugccauuu

SEQ ID NO: 2313560 - RNA, 17 nt, Yersinia pestis KIM
agguuguauuuugcagg

SEQ ID NO: 2313561 - RNA, 15 nt, Yersinia pestis KIM
aguacaaaaaacaaa

SEQ ID NO: 2313562 - RNA, 13 nt, Yersinia pestis KIM
aguacaaaaaaca

SEQ ID NO: 2313563 - RNA, 19 nt, Yersinia pestis KIM
aguaauuucagauaaaaau

SEQ ID NO: 2313564 - RNA, 21 nt, Yersinia pestis KIM
aguacaaaaaacaaaccgggg

SEQ ID NO: 2313565 - RNA, 23 nt, Yersinia pestis KIM
aguaaucgccugcugagccaaau

SEQ ID NO: 2313566 - RNA, 22 nt, Yersinia pestis KIM
aguaaccccuucgagcaccgcg

SEQ ID NO: 2313567 - RNA, 20 nt, Yersinia pestis KIM
aguaaccccuucgagcaccg

SEQ ID NO: 2313568 - RNA, 12 nt, Yersinia pestis KIM
aguaagguuuua

SEQ ID NO: 2313569 - RNA, 18 nt, Yersinia pestis KIM
aguaaguucgucagugau

SEQ ID NO: 2313570 - RNA, 20 nt, Yersinia pestis KIM
aguaauacuggcaguaaaac

SEQ ID NO: 2313571 - RNA, 13 nt, Yersinia pestis KIM
aguaauagcaaaa

SEQ ID NO: 2313572 - RNA, 19 nt, Yersinia pestis KIM
aguaauagcaaaaaaaaag

SEQ ID NO: 2313573 - RNA, 23 nt, Yersinia pestis KIM
aguaacaccagcauccugcaaau

SEQ ID NO: 2313574 - RNA, 17 nt, Yersinia pestis KIM
aguaacaccagcauccu

SEQ ID NO: 2313575 - RNA, 22 nt, Yersinia pestis KIM
aguaacaaaaugcgguggcacu

SEQ ID NO: 2313576 - RNA, 18 nt, Yersinia pestis KIM
aguaacacuucagacuga

SEQ ID NO: 2313577 - RNA, 21 nt, Yersinia pestis KIM
aguaacacuucagacugaaag

SEQ ID NO: 2313578 - RNA, 18 nt, Yersinia pestis KIM
aguaaagauccccacaaa

SEQ ID NO: 2313579 - RNA, 19 nt, Yersinia pestis KIM
agcuagauggaaaucacac

SEQ ID NO: 2313580 - RNA, 13 nt, Yersinia pestis KIM
agcuacagcucag

SEQ ID NO: 2313581 - RNA, 13 nt, Yersinia pestis KIM
agcuaccagcacc

SEQ ID NO: 2313582 - RNA, 20 nt, Yersinia pestis KIM
agcuacuaauggagagaugu

SEQ ID NO: 2313583 - RNA, 21 nt, Yersinia pestis KIM
agcuacgggcaaacuccucca

SEQ ID NO: 2313584 - RNA, 17 nt, Yersinia pestis KIM
agcuaauaauuguucau

SEQ ID NO: 2313585 - RNA, 20 nt, Yersinia pestis KIM
agcuaauaaccguuucagga

SEQ ID NO: 2313586 - RNA, 24 nt, Yersinia pestis KIM
agcuaauuuucauugauacaaaua

SEQ ID NO: 2313587 - RNA, 17 nt, Yersinia pestis KIM
agcuaacaaaaccggga

SEQ ID NO: 2313588 - RNA, 22 nt, Yersinia pestis KIM
agcuaacgcuuucagguuguua

SEQ ID NO: 2313589 - RNA, 13 nt, Yersinia pestis KIM
agcuaagcucuuc

SEQ ID NO: 2313590 - RNA, 14 nt, Yersinia pestis KIM
agcuaaaaugaucu

SEQ ID NO: 2313591 - RNA, 16 nt, Yersinia pestis KIM
agcguuuaaauacccg

SEQ ID NO: 2313592 - RNA, 13 nt, Yersinia pestis KIM
agcuaucauuaaa

SEQ ID NO: 2313593 - RNA, 15 nt, Yersinia pestis KIM
agcuauccaccaucg

SEQ ID NO: 2313594 - RNA, 13 nt, Yersinia pestis KIM
agcuaucuugccu

SEQ ID NO: 2313595 - RNA, 16 nt, Yersinia pestis KIM
agcuauguucacguaa

SEQ ID NO: 2313596 - RNA, 14 nt, Yersinia pestis KIM
agcuauaaauaaau

SEQ ID NO: 2313597 - RNA, 13 nt, Yersinia pestis KIM
agcucaagcuggc

SEQ ID NO: 2313598 - RNA, 13 nt, Yersinia pestis KIM
agcucaagcuggu

SEQ ID NO: 2313599 - RNA, 17 nt, Yersinia pestis KIM
agcucaagggcacaguu

SEQ ID NO: 2313600 - RNA, 20 nt, Yersinia pestis KIM
agcuauugcaacgcuugcag

SEQ ID NO: 2313601 - RNA, 22 nt, Yersinia pestis KIM
agcucacggaagguugccccca

SEQ ID NO: 2313602 - RNA, 13 nt, Yersinia pestis KIM
agcucaucaccaa

SEQ ID NO: 2313603 - RNA, 14 nt, Yersinia pestis KIM
agcucauauaauca

SEQ ID NO: 2313604 - RNA, 20 nt, Yersinia pestis KIM
agcgugcgguagaccaccaa

SEQ ID NO: 2313605 - RNA, 22 nt, Yersinia pestis KIM
agcgugcgguagaccaccaacu

SEQ ID NO: 2313606 - RNA, 22 nt, Yersinia pestis KIM
agcgugguauaaauggcacugg

SEQ ID NO: 2313607 - RNA, 20 nt, Yersinia pestis KIM
agcguuaauuauagugaaaa

SEQ ID NO: 2313608 - RNA, 15 nt, Yersinia pestis KIM
agcguuauuuuugua

SEQ ID NO: 2313609 - RNA, 21 nt, Yersinia pestis KIM
agcgucuucugugauuuguca

SEQ ID NO: 2313610 - RNA, 21 nt, Yersinia pestis KIM
agcgucaugauagacagcaaa

SEQ ID NO: 2313611 - RNA, 17 nt, Yersinia pestis KIM
agcgguuuguuaaaaag

SEQ ID NO: 2313612 - RNA, 15 nt, Yersinia pestis KIM
agcgguuuguugcua

SEQ ID NO: 2313613 - RNA, 22 nt, Yersinia pestis KIM
agcguaacuccuuuguuauuuc

SEQ ID NO: 2313614 - RNA, 22 nt, Yersinia pestis KIM
agcgguuuuuucuuucuucagc

SEQ ID NO: 2313615 - RNA, 16 nt, Yersinia pestis KIM
agcggcgggcuaaccc

SEQ ID NO: 2313616 - RNA, 20 nt, Yersinia pestis KIM
agcggcguauuaucaguaac

SEQ ID NO: 2313617 - RNA, 20 nt, Yersinia pestis KIM
agcggggcggauaguuuuua

SEQ ID NO: 2313618 - RNA, 19 nt, Yersinia pestis KIM
agcgggcuaaaugcucgcu

SEQ ID NO: 2313619 - RNA, 17 nt, Yersinia pestis KIM
agcgggcggccucugcu

SEQ ID NO: 2313620 - RNA, 14 nt, Yersinia pestis KIM
agcggcuagcagca

SEQ ID NO: 2313621 - RNA, 17 nt, Yersinia pestis KIM
agcgcaucggaaaucug

SEQ ID NO: 2313622 - RNA, 13 nt, Yersinia pestis KIM
agcgccagcaauu

SEQ ID NO: 2313623 - RNA, 17 nt, Yersinia pestis KIM
agcgccagcggaauaug

SEQ ID NO: 2313624 - RNA, 16 nt, Yersinia pestis KIM
agcgcaauucagccuc

SEQ ID NO: 2313625 - RNA, 15 nt, Yersinia pestis KIM
agcgauuuuaaaaaa

SEQ ID NO: 2313626 - RNA, 20 nt, Yersinia pestis KIM
agcgauuuuaaaaaaucagu

SEQ ID NO: 2313627 - RNA, 22 nt, Yersinia pestis KIM
agcgccgauauacaccccauca

SEQ ID NO: 2313628 - RNA, 23 nt, Yersinia pestis KIM
agcgccgauauacaccccaucag

SEQ ID NO: 2313629 - RNA, 23 nt, Yersinia pestis KIM
agcgcccuugccagugcaauccg

SEQ ID NO: 2313630 - RNA, 20 nt, Yersinia pestis KIM
agcgccucaguaucuuucca

SEQ ID NO: 2313631 - RNA, 11 nt, Yersinia pestis KIM
agcgccugccc

SEQ ID NO: 2313632 - RNA, 17 nt, Yersinia pestis KIM
agcgccugugggcggcu

SEQ ID NO: 2313633 - RNA, 15 nt, Yersinia pestis KIM
agcgccuuccuuuua

SEQ ID NO: 2313634 - RNA, 18 nt, Yersinia pestis KIM
agcgaugaggcucuucug

SEQ ID NO: 2313635 - RNA, 18 nt, Yersinia pestis KIM
agcgaguucccgauuauu

SEQ ID NO: 2313636 - RNA, 20 nt, Yersinia pestis KIM
agcgauagaguugauaaaca

SEQ ID NO: 2313637 - RNA, 21 nt, Yersinia pestis KIM
agcgauagaguugauaaacaa

SEQ ID NO: 2313638 - RNA, 23 nt, Yersinia pestis KIM
agcgaauugacuuaacaguuaaa

SEQ ID NO: 2313639 - RNA, 13 nt, Yersinia pestis KIM
agcgacaaccugu

SEQ ID NO: 2313640 - RNA, 14 nt, Yersinia pestis KIM
agcgacaaccugua

SEQ ID NO: 2313641 - RNA, 17 nt, Yersinia pestis KIM
agcgacaaaagugucau

SEQ ID NO: 2313642 - RNA, 11 nt, Yersinia pestis KIM
agcgaggauaa

SEQ ID NO: 2313643 - RNA, 16 nt, Yersinia pestis KIM
agcgagcacugccccg

SEQ ID NO: 2313644 - RNA, 21 nt, Yersinia pestis KIM
agcgacuggucccgacaaaua

SEQ ID NO: 2313645 - RNA, 15 nt, Yersinia pestis KIM
agccgcauuguucgg

SEQ ID NO: 2313646 - RNA, 15 nt, Yersinia pestis KIM
agccugaauauucac

SEQ ID NO: 2313647 - RNA, 18 nt, Yersinia pestis KIM
agccgccagccauuaaau

SEQ ID NO: 2313648 - RNA, 12 nt, Yersinia pestis KIM
agccugauacac

SEQ ID NO: 2313649 - RNA, 18 nt, Yersinia pestis KIM
agccugccauacccgcug

SEQ ID NO: 2313650 - RNA, 15 nt, Yersinia pestis KIM
agcgaauaaauaauu

SEQ ID NO: 2313651 - RNA, 21 nt, Yersinia pestis KIM
agccuuuuuugcuuaaaacag

SEQ ID NO: 2313652 - RNA, 22 nt, Yersinia pestis KIM
agccuuuuuugcuuaaaacagg

SEQ ID NO: 2313653 - RNA, 21 nt, Yersinia pestis KIM
agccuguuauuuuucuucuuu

SEQ ID NO: 2313654 - RNA, 14 nt, Yersinia pestis KIM
agccuguaggccag

SEQ ID NO: 2313655 - RNA, 20 nt, Yersinia pestis KIM
agccugucggaagagauaga

SEQ ID NO: 2313656 - RNA, 16 nt, Yersinia pestis KIM
agccuguacauaaauu

SEQ ID NO: 2313657 - RNA, 15 nt, Yersinia pestis KIM
agcagcguggugcgg

SEQ ID NO: 2313658 - RNA, 14 nt, Yersinia pestis KIM
agcaggaauacccg

SEQ ID NO: 2313659 - RNA, 19 nt, Yersinia pestis KIM
agcaguaacguccaacuga

SEQ ID NO: 2313660 - RNA, 20 nt, Yersinia pestis KIM
agcaguaacguccaacugac

SEQ ID NO: 2313661 - RNA, 23 nt, Yersinia pestis KIM
agcaguaaguuaaaaagaaaaag

SEQ ID NO: 2313662 - RNA, 18 nt, Yersinia pestis KIM
agcauagacgaaggcacg

SEQ ID NO: 2313663 - RNA, 21 nt, Yersinia pestis KIM
agcauacguugccagccaucu

SEQ ID NO: 2313664 - RNA, 13 nt, Yersinia pestis KIM
agcauauaaaaaa

SEQ ID NO: 2313665 - RNA, 14 nt, Yersinia pestis KIM
agcauauaaaaaag

SEQ ID NO: 2313666 - RNA, 13 nt, Yersinia pestis KIM
agcagucagcaug

SEQ ID NO: 2313667 - RNA, 15 nt, Yersinia pestis KIM
agcagucaaaaugaa

SEQ ID NO: 2313668 - RNA, 21 nt, Yersinia pestis KIM
agcagucugagccucaugaau

SEQ ID NO: 2313669 - RNA, 19 nt, Yersinia pestis KIM
agcagucugagccucauga

SEQ ID NO: 2313670 - RNA, 15 nt, Yersinia pestis KIM
agcagucugaagggu

SEQ ID NO: 2313671 - RNA, 23 nt, Yersinia pestis KIM
agcagucugagccucaugaauga

SEQ ID NO: 2313672 - RNA, 17 nt, Yersinia pestis KIM
agcagucugagggccac

SEQ ID NO: 2313673 - RNA, 19 nt, Yersinia pestis KIM
agcagucugagggccacuu

SEQ ID NO: 2313674 - RNA, 19 nt, Yersinia pestis KIM
agcagucugauuaccuucu

SEQ ID NO: 2313675 - RNA, 18 nt, Yersinia pestis KIM
agcagugauuucaguguc

SEQ ID NO: 2313676 - RNA, 22 nt, Yersinia pestis KIM
agcagugauuucuuacagugau

SEQ ID NO: 2313677 - RNA, 23 nt, Yersinia pestis KIM
agcagugauuucuuacagugauc

SEQ ID NO: 2313678 - RNA, 15 nt, Yersinia pestis KIM
agcagugcagccaag

SEQ ID NO: 2313679 - RNA, 17 nt, Yersinia pestis KIM
agcaucgcggaaccuuu

SEQ ID NO: 2313680 - RNA, 18 nt, Yersinia pestis KIM
agcaucgucauugccagu

SEQ ID NO: 2313681 - RNA, 14 nt, Yersinia pestis KIM
agcaucacuucaua

SEQ ID NO: 2313682 - RNA, 20 nt, Yersinia pestis KIM
agcaucacugucuauuuuua

SEQ ID NO: 2313683 - RNA, 22 nt, Yersinia pestis KIM
agcaucauaagacuaacagaau

SEQ ID NO: 2313684 - RNA, 16 nt, Yersinia pestis KIM
agcacuccccgcccgu

SEQ ID NO: 2313685 - RNA, 21 nt, Yersinia pestis KIM
agcacucaaugucaugcaauu

SEQ ID NO: 2313686 - RNA, 21 nt, Yersinia pestis KIM
agcacguucaccaaagcaaug

SEQ ID NO: 2313687 - RNA, 21 nt, Yersinia pestis KIM
agcacguuuuucagcuucuuc

SEQ ID NO: 2313688 - RNA, 21 nt, Yersinia pestis KIM
agcaaccggauacaaagugaa

SEQ ID NO: 2313689 - RNA, 13 nt, Yersinia pestis KIM
agcaccuaucgcc

SEQ ID NO: 2313690 - RNA, 13 nt, Yersinia pestis KIM
agcagaaagcagc

SEQ ID NO: 2313691 - RNA, 18 nt, Yersinia pestis KIM
agcagaaagcagcagcuu

SEQ ID NO: 2313692 - RNA, 13 nt, Yersinia pestis KIM
agcagaacaaaac

SEQ ID NO: 2313693 - RNA, 16 nt, Yersinia pestis KIM
agcagaacaaaacaag

SEQ ID NO: 2313694 - RNA, 14 nt, Yersinia pestis KIM
agcagaaagggcgc

SEQ ID NO: 2313695 - RNA, 14 nt, Yersinia pestis KIM
agcagcaaacgccu

SEQ ID NO: 2313696 - RNA, 12 nt, Yersinia pestis KIM
agcagagaauga

SEQ ID NO: 2313697 - RNA, 21 nt, Yersinia pestis KIM
agcagagauccggugaagaau

SEQ ID NO: 2313698 - RNA, 14 nt, Yersinia pestis KIM
agcagauaauaaau

SEQ ID NO: 2313699 - RNA, 18 nt, Yersinia pestis KIM
agcagccaccaaaaaacg

SEQ ID NO: 2313700 - RNA, 14 nt, Yersinia pestis KIM
agcagcccaacacu

SEQ ID NO: 2313701 - RNA, 15 nt, Yersinia pestis KIM
agcagcccaacacuu

SEQ ID NO: 2313702 - RNA, 21 nt, Yersinia pestis KIM
agcccaggcgacgcaguaaga

SEQ ID NO: 2313703 - RNA, 19 nt, Yersinia pestis KIM
agcccacgaggacaggugg

SEQ ID NO: 2313704 - RNA, 22 nt, Yersinia pestis KIM
agcccacaggguaagccucaag

SEQ ID NO: 2313705 - RNA, 20 nt, Yersinia pestis KIM
agccccaaaugccagcgaaa

SEQ ID NO: 2313706 - RNA, 15 nt, Yersinia pestis KIM
agcccauccuguuca

SEQ ID NO: 2313707 - RNA, 15 nt, Yersinia pestis KIM
agcccccucaauacc

SEQ ID NO: 2313708 - RNA, 18 nt, Yersinia pestis KIM
agccccagugcgcaaaaa

SEQ ID NO: 2313709 - RNA, 19 nt, Yersinia pestis KIM
agccccacaguacaaaaaa

SEQ ID NO: 2313710 - RNA, 14 nt, Yersinia pestis KIM
agccccugccagaa

SEQ ID NO: 2313711 - RNA, 15 nt, Yersinia pestis KIM
agccccuuugaacug

SEQ ID NO: 2313712 - RNA, 16 nt, Yersinia pestis KIM
agccccuaacagcagu

SEQ ID NO: 2313713 - RNA, 22 nt, Yersinia pestis KIM
agcccggcucauccgccaagau

SEQ ID NO: 2313714 - RNA, 19 nt, Yersinia pestis KIM
agcccgcaacgggagagaa

SEQ ID NO: 2313715 - RNA, 17 nt, Yersinia pestis KIM
agcccgauggggagagc

SEQ ID NO: 2313716 - RNA, 19 nt, Yersinia pestis KIM
agcccgauggggagagcgu

SEQ ID NO: 2313717 - RNA, 19 nt, Yersinia pestis KIM
agccgagcaagugaauaac

SEQ ID NO: 2313718 - RNA, 14 nt, Yersinia pestis KIM
agccgauaaucaau

SEQ ID NO: 2313719 - RNA, 18 nt, Yersinia pestis KIM
agccgauaauccaccuga

SEQ ID NO: 2313720 - RNA, 13 nt, Yersinia pestis KIM
agccgauaauccc

SEQ ID NO: 2313721 - RNA, 23 nt, Yersinia pestis KIM
agccgcagaugccagacuugggu

SEQ ID NO: 2313722 - RNA, 15 nt, Yersinia pestis KIM
agcccuucuuuaacc

SEQ ID NO: 2313723 - RNA, 18 nt, Yersinia pestis KIM
agcccuuauucaaagaau

SEQ ID NO: 2313724 - RNA, 16 nt, Yersinia pestis KIM
agccauguguuuguuu

SEQ ID NO: 2313725 - RNA, 17 nt, Yersinia pestis KIM
agccaugggucauuaau

SEQ ID NO: 2313726 - RNA, 21 nt, Yersinia pestis KIM
agccaugggucauuaauuaag

SEQ ID NO: 2313727 - RNA, 23 nt, Yersinia pestis KIM
agccauggcuuuagguugagaau

SEQ ID NO: 2313728 - RNA, 17 nt, Yersinia pestis KIM
agccaugucauggggga

SEQ ID NO: 2313729 - RNA, 16 nt, Yersinia pestis KIM
agccauuucaaaacgc

SEQ ID NO: 2313730 - RNA, 19 nt, Yersinia pestis KIM
agccauucugaaucgcugc

SEQ ID NO: 2313731 - RNA, 20 nt, Yersinia pestis KIM
agccauuuuuuauaaacacu

SEQ ID NO: 2313732 - RNA, 13 nt, Yersinia pestis KIM
agcccaagagaaa

SEQ ID NO: 2313733 - RNA, 13 nt, Yersinia pestis KIM
agcccaacacuuu

SEQ ID NO: 2313734 - RNA, 15 nt, Yersinia pestis KIM
agccagugcgggaga

SEQ ID NO: 2313735 - RNA, 22 nt, Yersinia pestis KIM
agccagugaugcugcacaucaa

SEQ ID NO: 2313736 - RNA, 16 nt, Yersinia pestis KIM
agccaggcagcuauca

SEQ ID NO: 2313737 - RNA, 17 nt, Yersinia pestis KIM
agccaguugaucggcca

SEQ ID NO: 2313738 - RNA, 13 nt, Yersinia pestis KIM
agccaucgccauc

SEQ ID NO: 2313739 - RNA, 23 nt, Yersinia pestis KIM
agccaucuugggccgacucugca

SEQ ID NO: 2313740 - RNA, 14 nt, Yersinia pestis KIM
agccauauuuuaaa

SEQ ID NO: 2313741 - RNA, 15 nt, Yersinia pestis KIM
agccauauuuuucaa

SEQ ID NO: 2313742 - RNA, 17 nt, Yersinia pestis KIM
agccauacccaaaccaa

SEQ ID NO: 2313743 - RNA, 15 nt, Yersinia pestis KIM
agcauggaagauauc

SEQ ID NO: 2313744 - RNA, 14 nt, Yersinia pestis KIM
agcaugcccagccu

SEQ ID NO: 2313745 - RNA, 19 nt, Yersinia pestis KIM
agcaugcccagccucugga

SEQ ID NO: 2313746 - RNA, 13 nt, Yersinia pestis KIM
agccaacggagcg

SEQ ID NO: 2313747 - RNA, 15 nt, Yersinia pestis KIM
agccaacuuucgguu

SEQ ID NO: 2313748 - RNA, 16 nt, Yersinia pestis KIM
agccaagaucccaagc

SEQ ID NO: 2313749 - RNA, 15 nt, Yersinia pestis KIM
agccaccgcauucca

SEQ ID NO: 2313750 - RNA, 15 nt, Yersinia pestis KIM
agccaccccguggca

SEQ ID NO: 2313751 - RNA, 16 nt, Yersinia pestis KIM
agccagcgucaucaca

SEQ ID NO: 2313752 - RNA, 21 nt, Yersinia pestis KIM
agccagauaggcgaaauugac

SEQ ID NO: 2313753 - RNA, 20 nt, Yersinia pestis KIM
agcaaauugcugaaaaaaaa

SEQ ID NO: 2313754 - RNA, 15 nt, Yersinia pestis KIM
agcaaauugcugaaa

SEQ ID NO: 2313755 - RNA, 17 nt, Yersinia pestis KIM
agcaaauucccaccaua

SEQ ID NO: 2313756 - RNA, 14 nt, Yersinia pestis KIM
agcaacaauaacuu

SEQ ID NO: 2313757 - RNA, 19 nt, Yersinia pestis KIM
agcaacacaucuuccagua

SEQ ID NO: 2313758 - RNA, 16 nt, Yersinia pestis KIM
agcaacaaccccauga

SEQ ID NO: 2313759 - RNA, 13 nt, Yersinia pestis KIM
agcaaaucacauu

SEQ ID NO: 2313760 - RNA, 14 nt, Yersinia pestis KIM
agcaaaucaaacaa

SEQ ID NO: 2313761 - RNA, 15 nt, Yersinia pestis KIM
agcaaaucaaacaaa

SEQ ID NO: 2313762 - RNA, 20 nt, Yersinia pestis KIM
agcaaaucgauacaguggcu

SEQ ID NO: 2313763 - RNA, 23 nt, Yersinia pestis KIM
agcaaagcgauaucguuaucaac

SEQ ID NO: 2313764 - RNA, 12 nt, Yersinia pestis KIM
agcaaaggccac

SEQ ID NO: 2313765 - RNA, 12 nt, Yersinia pestis KIM
agcaaacagugc

SEQ ID NO: 2313766 - RNA, 13 nt, Yersinia pestis KIM
agcaaacagugca

SEQ ID NO: 2313767 - RNA, 14 nt, Yersinia pestis KIM
agcaaacgaacgaa

SEQ ID NO: 2313768 - RNA, 15 nt, Yersinia pestis KIM
agcaaaaguccuuuc

SEQ ID NO: 2313769 - RNA, 12 nt, Yersinia pestis KIM
agcaaaagccuc

SEQ ID NO: 2313770 - RNA, 21 nt, Yersinia pestis KIM
agcaaaauccgguaauggcca

SEQ ID NO: 2313771 - RNA, 13 nt, Yersinia pestis KIM
agcaaaaaggcug

SEQ ID NO: 2313772 - RNA, 18 nt, Yersinia pestis KIM
agauuuucuuucaggcug

SEQ ID NO: 2313773 - RNA, 21 nt, Yersinia pestis KIM
agcaaaaaaacugacugccau

SEQ ID NO: 2313774 - RNA, 16 nt, Yersinia pestis KIM
agauuugguauuacgc

SEQ ID NO: 2313775 - RNA, 18 nt, Yersinia pestis KIM
agauuugugcauauucau

SEQ ID NO: 2313776 - RNA, 22 nt, Yersinia pestis KIM
agauuucaucggcaaaaacagu

SEQ ID NO: 2313777 - RNA, 21 nt, Yersinia pestis KIM
agauuucaucggcaaaaacag

SEQ ID NO: 2313778 - RNA, 19 nt, Yersinia pestis KIM
agauuucaucauucaauac

SEQ ID NO: 2313779 - RNA, 18 nt, Yersinia pestis KIM
agauuuaaccccaauucu

SEQ ID NO: 2313780 - RNA, 21 nt, Yersinia pestis KIM
agauuuaaaggcaugcucccu

SEQ ID NO: 2313781 - RNA, 13 nt, Yersinia pestis KIM
agauuuaaauaac

SEQ ID NO: 2313782 - RNA, 17 nt, Yersinia pestis KIM
agauuuaaccccaauuc

SEQ ID NO: 2313783 - RNA, 20 nt, Yersinia pestis KIM
agauuggcagcguaaagguu

SEQ ID NO: 2313784 - RNA, 19 nt, Yersinia pestis KIM
agauugccaaucagaacua

SEQ ID NO: 2313785 - RNA, 16 nt, Yersinia pestis KIM
agauugaucaguggcu

SEQ ID NO: 2313786 - RNA, 23 nt, Yersinia pestis KIM
agauuagucuuagacgucagauu

SEQ ID NO: 2313787 - RNA, 17 nt, Yersinia pestis KIM
agauuacgcgucaucau

SEQ ID NO: 2313788 - RNA, 12 nt, Yersinia pestis KIM
agauucagcugc

SEQ ID NO: 2313789 - RNA, 12 nt, Yersinia pestis KIM
agauucaccagu

SEQ ID NO: 2313790 - RNA, 14 nt, Yersinia pestis KIM
agauucaaguugca

SEQ ID NO: 2313791 - RNA, 20 nt, Yersinia pestis KIM
aaaaccccgacauuauucau

SEQ ID NO: 2313792 - RNA, 13 nt, Yersinia pestis KIM
aaaaccauuuuua

SEQ ID NO: 2313793 - RNA, 19 nt, Yersinia pestis KIM
aaaaccgcagcagacaacu

SEQ ID NO: 2313794 - RNA, 21 nt, Yersinia pestis KIM
aaaaccgcagcagacaacuga

SEQ ID NO: 2313795 - RNA, 15 nt, Yersinia pestis KIM
agaugaaugagggag

SEQ ID NO: 2313796 - RNA, 15 nt, Yersinia pestis KIM
agaugagugguuuau

SEQ ID NO: 2313797 - RNA, 20 nt, Yersinia pestis KIM
agaugagaaucucuccagug

SEQ ID NO: 2313798 - RNA, 14 nt, Yersinia pestis KIM
agaugccaaucaaa

SEQ ID NO: 2313799 - RNA, 20 nt, Yersinia pestis KIM
agaugcauauuugcagaaag

SEQ ID NO: 2313800 - RNA, 13 nt, Yersinia pestis KIM
agaugccagacuu

SEQ ID NO: 2313801 - RNA, 19 nt, Yersinia pestis KIM
agaugccuauuugcagaaa

SEQ ID NO: 2313802 - RNA, 20 nt, Yersinia pestis KIM
agaugccuauuugcagaaag

SEQ ID NO: 2313803 - RNA, 21 nt, Yersinia pestis KIM
agauggccagauucaccagua

SEQ ID NO: 2313804 - RNA, 16 nt, Yersinia pestis KIM
agauaagaucucagca

SEQ ID NO: 2313805 - RNA, 20 nt, Yersinia pestis KIM
agauaaagcuugaucacaau

SEQ ID NO: 2313806 - RNA, 23 nt, Yersinia pestis KIM
agaguugauccgauaaacuucac

SEQ ID NO: 2313807 - RNA, 22 nt, Yersinia pestis KIM
agauaaacaaggcagaaguaug

SEQ ID NO: 2313808 - RNA, 19 nt, Yersinia pestis KIM
agagugugggauucguuag

SEQ ID NO: 2313809 - RNA, 17 nt, Yersinia pestis KIM
agaguacgcuuugguaa

SEQ ID NO: 2313810 - RNA, 22 nt, Yersinia pestis KIM
agaguacuaacgucaacagaac

SEQ ID NO: 2313811 - RNA, 13 nt, Yersinia pestis KIM
agauacucaugau

SEQ ID NO: 2313812 - RNA, 12 nt, Yersinia pestis KIM
agaucagugcca

SEQ ID NO: 2313813 - RNA, 15 nt, Yersinia pestis KIM
agaucauccagauau

SEQ ID NO: 2313814 - RNA, 13 nt, Yersinia pestis KIM
agauccagaacac

SEQ ID NO: 2313815 - RNA, 17 nt, Yersinia pestis KIM
agauccagaauuucauu

SEQ ID NO: 2313816 - RNA, 23 nt, Yersinia pestis KIM
agauccugccgccucugcuccgg

SEQ ID NO: 2313817 - RNA, 22 nt, Yersinia pestis KIM
agauccuguggcuauugaccac

SEQ ID NO: 2313818 - RNA, 18 nt, Yersinia pestis KIM
agauccuggcccgccagc

SEQ ID NO: 2313819 - RNA, 21 nt, Yersinia pestis KIM
agauaucgaaacacauacaaa

SEQ ID NO: 2313820 - RNA, 20 nt, Yersinia pestis KIM
agauaucuaauuuauaaccu

SEQ ID NO: 2313821 - RNA, 19 nt, Yersinia pestis KIM
agauaucagccagugcuaa

SEQ ID NO: 2313822 - RNA, 16 nt, Yersinia pestis KIM
agauagccggauuauu

SEQ ID NO: 2313823 - RNA, 14 nt, Yersinia pestis KIM
agauagcaucaucc

SEQ ID NO: 2313824 - RNA, 14 nt, Yersinia pestis KIM
agauauuacgcagc

SEQ ID NO: 2313825 - RNA, 19 nt, Yersinia pestis KIM
agauauuagugacagccac

SEQ ID NO: 2313826 - RNA, 19 nt, Yersinia pestis KIM
agauaugccaggcaucauc

SEQ ID NO: 2313827 - RNA, 15 nt, Yersinia pestis KIM
agauaugaucaaaaa

SEQ ID NO: 2313828 - RNA, 22 nt, Yersinia pestis KIM
agauaugcauuauugauguuau

SEQ ID NO: 2313829 - RNA, 15 nt, Yersinia pestis KIM
agauauugcauggua

SEQ ID NO: 2313830 - RNA, 18 nt, Yersinia pestis KIM
agagguaaugucaugaau

SEQ ID NO: 2313831 - RNA, 16 nt, Yersinia pestis KIM
agagguuaaauuguuc

SEQ ID NO: 2313832 - RNA, 15 nt, Yersinia pestis KIM
agagguuauugacaa

SEQ ID NO: 2313833 - RNA, 19 nt, Yersinia pestis KIM
agagguuauugacaaagag

SEQ ID NO: 2313834 - RNA, 14 nt, Yersinia pestis KIM
agagguuaaauugu

SEQ ID NO: 2313835 - RNA, 16 nt, Yersinia pestis KIM
agaguaacggaggggc

SEQ ID NO: 2313836 - RNA, 17 nt, Yersinia pestis KIM
agaguaaggccaauugg

SEQ ID NO: 2313837 - RNA, 14 nt, Yersinia pestis KIM
agaggcaaugauuu

SEQ ID NO: 2313838 - RNA, 16 nt, Yersinia pestis KIM
agaggcgcuagccucu

SEQ ID NO: 2313839 - RNA, 16 nt, Yersinia pestis KIM
agagcgauugacugaa

SEQ ID NO: 2313840 - RNA, 18 nt, Yersinia pestis KIM
agagcgauugacugaaug

SEQ ID NO: 2313841 - RNA, 22 nt, Yersinia pestis KIM
agagcgauugacugaaugugaa

SEQ ID NO: 2313842 - RNA, 18 nt, Yersinia pestis KIM
agagcgcagcagugauac

SEQ ID NO: 2313843 - RNA, 20 nt, Yersinia pestis KIM
agagcauagacgaaggcacg

SEQ ID NO: 2313844 - RNA, 12 nt, Yersinia pestis KIM
agagcauaaccc

SEQ ID NO: 2313845 - RNA, 18 nt, Yersinia pestis KIM
agagcaggcgcgaagaaa

SEQ ID NO: 2313846 - RNA, 21 nt, Yersinia pestis KIM
agagcaggcgcgaagaaagcg

SEQ ID NO: 2313847 - RNA, 16 nt, Yersinia pestis KIM
agagcagaaagcagca

SEQ ID NO: 2313848 - RNA, 18 nt, Yersinia pestis KIM
agagcaccaaaucuucca

SEQ ID NO: 2313849 - RNA, 15 nt, Yersinia pestis KIM
agacuaaccucugca

SEQ ID NO: 2313850 - RNA, 19 nt, Yersinia pestis KIM
agagauccggugaagaauu

SEQ ID NO: 2313851 - RNA, 22 nt, Yersinia pestis KIM
agagaucauguaguacuuaccu

SEQ ID NO: 2313852 - RNA, 23 nt, Yersinia pestis KIM
agagaucguaggcuuuuuacuuu

SEQ ID NO: 2313853 - RNA, 21 nt, Yersinia pestis KIM
agagaugacccaaagucauug

SEQ ID NO: 2313854 - RNA, 13 nt, Yersinia pestis KIM
agagaugcagaga

SEQ ID NO: 2313855 - RNA, 21 nt, Yersinia pestis KIM
agagaugaaacccagaaugga

SEQ ID NO: 2313856 - RNA, 17 nt, Yersinia pestis KIM
agaccaguuaauaucaa

SEQ ID NO: 2313857 - RNA, 15 nt, Yersinia pestis KIM
agaccacagauaaau

SEQ ID NO: 2313858 - RNA, 19 nt, Yersinia pestis KIM
agaccaaauuccccagccc

SEQ ID NO: 2313859 - RNA, 22 nt, Yersinia pestis KIM
agacauaaagcccgcuucaaag

SEQ ID NO: 2313860 - RNA, 18 nt, Yersinia pestis KIM
agacauaccccacgccgc

SEQ ID NO: 2313861 - RNA, 20 nt, Yersinia pestis KIM
agacagggggauaaaaaccc

SEQ ID NO: 2313862 - RNA, 19 nt, Yersinia pestis KIM
agacaguaaauccugauga

SEQ ID NO: 2313863 - RNA, 12 nt, Yersinia pestis KIM
agacauaaagaa

SEQ ID NO: 2313864 - RNA, 15 nt, Yersinia pestis KIM
agacauaaagaaaag

SEQ ID NO: 2313865 - RNA, 24 nt, Yersinia pestis KIM
agacaguuuauuugaguaagacaa

SEQ ID NO: 2313866 - RNA, 22 nt, Yersinia pestis KIM
agacaugggcagugcacaguca

SEQ ID NO: 2313867 - RNA, 14 nt, Yersinia pestis KIM
agacaucuuuacca

SEQ ID NO: 2313868 - RNA, 16 nt, Yersinia pestis KIM
agacaucgccagauuc

SEQ ID NO: 2313869 - RNA, 19 nt, Yersinia pestis KIM
agacauugcgcaagccccu

SEQ ID NO: 2313870 - RNA, 22 nt, Yersinia pestis KIM
agacauuccgucagcaugaaug

SEQ ID NO: 2313871 - RNA, 12 nt, Yersinia pestis KIM
agacggggagga

SEQ ID NO: 2313872 - RNA, 22 nt, Yersinia pestis KIM
aaaacagcgaucuauucucugu

SEQ ID NO: 2313873 - RNA, 20 nt, Yersinia pestis KIM
aaaacagcagccaccaaaaa

SEQ ID NO: 2313874 - RNA, 19 nt, Yersinia pestis KIM
aaaacagcagccaccaaaa

SEQ ID NO: 2313875 - RNA, 15 nt, Yersinia pestis KIM
aaaacagcaacacca

SEQ ID NO: 2313876 - RNA, 22 nt, Yersinia pestis KIM
agaccgcguuaauaccuuguuc

SEQ ID NO: 2313877 - RNA, 18 nt, Yersinia pestis KIM
agaccgcaugcugcaguu

SEQ ID NO: 2313878 - RNA, 21 nt, Yersinia pestis KIM
agacacuuugguuugcagcga

SEQ ID NO: 2313879 - RNA, 13 nt, Yersinia pestis KIM
agacacaagauaa

SEQ ID NO: 2313880 - RNA, 14 nt, Yersinia pestis KIM
agacacagcaacaa

SEQ ID NO: 2313881 - RNA, 20 nt, Yersinia pestis KIM
agaauuuaccuccauauccu

SEQ ID NO: 2313882 - RNA, 14 nt, Yersinia pestis KIM
agacaacucuucua

SEQ ID NO: 2313883 - RNA, 22 nt, Yersinia pestis KIM
agacaaggauacgcauuacccu

SEQ ID NO: 2313884 - RNA, 22 nt, Yersinia pestis KIM
agaaugucaugguuaaacugac

SEQ ID NO: 2313885 - RNA, 19 nt, Yersinia pestis KIM
agaauugguuauccuaaga

SEQ ID NO: 2313886 - RNA, 19 nt, Yersinia pestis KIM
agaauugugccccaagaag

SEQ ID NO: 2313887 - RNA, 14 nt, Yersinia pestis KIM
agaaguagaaugag

SEQ ID NO: 2313888 - RNA, 14 nt, Yersinia pestis KIM
agaagguaagccag

SEQ ID NO: 2313889 - RNA, 14 nt, Yersinia pestis KIM
agaagguuaaauuu

SEQ ID NO: 2313890 - RNA, 15 nt, Yersinia pestis KIM
agaaggcuagucugu

SEQ ID NO: 2313891 - RNA, 18 nt, Yersinia pestis KIM
agaagggcggccagcaag

SEQ ID NO: 2313892 - RNA, 23 nt, Yersinia pestis KIM
agaagggcggccagcaagagcag

SEQ ID NO: 2313893 - RNA, 20 nt, Yersinia pestis KIM
agaauccacauaaaaagaaa

SEQ ID NO: 2313894 - RNA, 15 nt, Yersinia pestis KIM
agaauccacauaaaa

SEQ ID NO: 2313895 - RNA, 21 nt, Yersinia pestis KIM
agaauccucugaauaaaaaau

SEQ ID NO: 2313896 - RNA, 23 nt, Yersinia pestis KIM
aaaacacagcgaagcguaaauuu

SEQ ID NO: 2313897 - RNA, 22 nt, Yersinia pestis KIM
aaaacacagucugucguacuuu

SEQ ID NO: 2313898 - RNA, 12 nt, Yersinia pestis KIM
aaaacaauuucg

SEQ ID NO: 2313899 - RNA, 22 nt, Yersinia pestis KIM
agaaauucaacuugccugaaau

SEQ ID NO: 2313900 - RNA, 23 nt, Yersinia pestis KIM
agaaauucauaccuuaauuaacu

SEQ ID NO: 2313901 - RNA, 21 nt, Yersinia pestis KIM
agaacaccaacaccacacuga

SEQ ID NO: 2313902 - RNA, 21 nt, Yersinia pestis KIM
agaacccccgcgaacagcaga

SEQ ID NO: 2313903 - RNA, 22 nt, Yersinia pestis KIM
agaacccccgcgaacagcagaa

SEQ ID NO: 2313904 - RNA, 22 nt, Yersinia pestis KIM
agaaccgacaagcgcugcgcca

SEQ ID NO: 2313905 - RNA, 21 nt, Yersinia pestis KIM
agaacagguuuuuuccccaug

SEQ ID NO: 2313906 - RNA, 21 nt, Yersinia pestis KIM
agaacaggcagaucguaaaga

SEQ ID NO: 2313907 - RNA, 12 nt, Yersinia pestis KIM
agaacaggcaga

SEQ ID NO: 2313908 - RNA, 15 nt, Yersinia pestis KIM
agaaccggaauaaau

SEQ ID NO: 2313909 - RNA, 21 nt, Yersinia pestis KIM
agaaggauugaccaauaaaau

SEQ ID NO: 2313910 - RNA, 16 nt, Yersinia pestis KIM
agaaacauuaaaccca

SEQ ID NO: 2313911 - RNA, 20 nt, Yersinia pestis KIM
agaaacaucuucauuuggcu

SEQ ID NO: 2313912 - RNA, 14 nt, Yersinia pestis KIM
agaaaauaauaucg

SEQ ID NO: 2313913 - RNA, 18 nt, Yersinia pestis KIM
agaaaagcgaaucuggua

SEQ ID NO: 2313914 - RNA, 19 nt, Yersinia pestis KIM
agaaaaccuugacucuuca

SEQ ID NO: 2313915 - RNA, 19 nt, Yersinia pestis KIM
acuuuuuaucuaaacagua

SEQ ID NO: 2313916 - RNA, 16 nt, Yersinia pestis KIM
agaaacccauagcaaa

SEQ ID NO: 2313917 - RNA, 19 nt, Yersinia pestis KIM
agaaacugugauaaccaac

SEQ ID NO: 2313918 - RNA, 15 nt, Yersinia pestis KIM
agaaacuucauuuca

SEQ ID NO: 2313919 - RNA, 15 nt, Yersinia pestis KIM
agaaagaaaaauaga

SEQ ID NO: 2313920 - RNA, 14 nt, Yersinia pestis KIM
agaaagcagcagcu

SEQ ID NO: 2313921 - RNA, 15 nt, Yersinia pestis KIM
agaaauaaguugaac

SEQ ID NO: 2313922 - RNA, 13 nt, Yersinia pestis KIM
agaaauaaauuca

SEQ ID NO: 2313923 - RNA, 13 nt, Yersinia pestis KIM
agaaauaaaaacc

SEQ ID NO: 2313924 - RNA, 13 nt, Yersinia pestis KIM
agaaauaaaagaa

SEQ ID NO: 2313925 - RNA, 16 nt, Yersinia pestis KIM
agaaauaauaucaagu

SEQ ID NO: 2313926 - RNA, 18 nt, Yersinia pestis KIM
agaaauacagaaaaauag

SEQ ID NO: 2313927 - RNA, 13 nt, Yersinia pestis KIM
agaaauacccccc

SEQ ID NO: 2313928 - RNA, 22 nt, Yersinia pestis KIM
agaaauaccugaguuaccuugu

SEQ ID NO: 2313929 - RNA, 20 nt, Yersinia pestis KIM
agaaaguugauccuggguuu

SEQ ID NO: 2313930 - RNA, 21 nt, Yersinia pestis KIM
agaaagguaugugccaaaaaa

SEQ ID NO: 2313931 - RNA, 23 nt, Yersinia pestis KIM
agaaagguaugugccaaaaaaag

SEQ ID NO: 2313932 - RNA, 17 nt, Yersinia pestis KIM
accccccauugccaaau

SEQ ID NO: 2313933 - RNA, 12 nt, Yersinia pestis KIM
acccccccgacc

SEQ ID NO: 2313934 - RNA, 19 nt, Yersinia pestis KIM
accccgcguugucagccau

SEQ ID NO: 2313935 - RNA, 15 nt, Yersinia pestis KIM
accccauaaaucccg

SEQ ID NO: 2313936 - RNA, 23 nt, Yersinia pestis KIM
accccauuuaucgccaagccagu

SEQ ID NO: 2313937 - RNA, 16 nt, Yersinia pestis KIM
acccauccaguauuuc

SEQ ID NO: 2313938 - RNA, 22 nt, Yersinia pestis KIM
acccauccaguauuucaguaac

SEQ ID NO: 2313939 - RNA, 13 nt, Yersinia pestis KIM
accccaauucuua

SEQ ID NO: 2313940 - RNA, 14 nt, Yersinia pestis KIM
accccacaaccugc

SEQ ID NO: 2313941 - RNA, 22 nt, Yersinia pestis KIM
acccacaucccggcagcaguug

SEQ ID NO: 2313942 - RNA, 14 nt, Yersinia pestis KIM
acccacauucaggc

SEQ ID NO: 2313943 - RNA, 13 nt, Yersinia pestis KIM
acccaucaagcgg

SEQ ID NO: 2313944 - RNA, 17 nt, Yersinia pestis KIM
acccaucaauaauuaag

SEQ ID NO: 2313945 - RNA, 14 nt, Yersinia pestis KIM
accccuuggcucuc

SEQ ID NO: 2313946 - RNA, 16 nt, Yersinia pestis KIM
accccugucuuauuuu

SEQ ID NO: 2313947 - RNA, 22 nt, Yersinia pestis KIM
accccuucaccgggaucuauca

SEQ ID NO: 2313948 - RNA, 14 nt, Yersinia pestis KIM
accauaacaauggc

SEQ ID NO: 2313949 - RNA, 13 nt, Yersinia pestis KIM
accauacagcagu

SEQ ID NO: 2313950 - RNA, 22 nt, Yersinia pestis KIM
accauacagcagucaaaaugaa

SEQ ID NO: 2313951 - RNA, 18 nt, Yersinia pestis KIM
accaucaauauaagagaa

SEQ ID NO: 2313952 - RNA, 16 nt, Yersinia pestis KIM
accauccccagaacag

SEQ ID NO: 2313953 - RNA, 19 nt, Yersinia pestis KIM
accaucagguguuguauaa

SEQ ID NO: 2313954 - RNA, 18 nt, Yersinia pestis KIM
accaucacuuccagcgcc

SEQ ID NO: 2313955 - RNA, 17 nt, Yersinia pestis KIM
accaucagaguccaaua

SEQ ID NO: 2313956 - RNA, 15 nt, Yersinia pestis KIM
accaucaggauuaau

SEQ ID NO: 2313957 - RNA, 22 nt, Yersinia pestis KIM
accaucaggauuaaugcggaua

SEQ ID NO: 2313958 - RNA, 16 nt, Yersinia pestis KIM
accaugagugaaaaua

SEQ ID NO: 2313959 - RNA, 13 nt, Yersinia pestis KIM
accaugaugacaa

SEQ ID NO: 2313960 - RNA, 14 nt, Yersinia pestis KIM
accauggcaggucu

SEQ ID NO: 2313961 - RNA, 22 nt, Yersinia pestis KIM
accaugcgauacgcccgcccca

SEQ ID NO: 2313962 - RNA, 14 nt, Yersinia pestis KIM
accauucagccacu

SEQ ID NO: 2313963 - RNA, 15 nt, Yersinia pestis KIM
accauucgccaggaa

SEQ ID NO: 2313964 - RNA, 16 nt, Yersinia pestis KIM
accauuuauugccacg

SEQ ID NO: 2313965 - RNA, 15 nt, Yersinia pestis KIM
accauuuccaggcua

SEQ ID NO: 2313966 - RNA, 16 nt, Yersinia pestis KIM
acccaauaauaaucca

SEQ ID NO: 2313967 - RNA, 17 nt, Yersinia pestis KIM
acccaacaguaccuucu

SEQ ID NO: 2313968 - RNA, 16 nt, Yersinia pestis KIM
acccaacaguaccuuc

SEQ ID NO: 2313969 - RNA, 20 nt, Yersinia pestis KIM
acccaaaggggagccaaugu

SEQ ID NO: 2313970 - RNA, 14 nt, Yersinia pestis KIM
acccaaagucauug

SEQ ID NO: 2313971 - RNA, 23 nt, Yersinia pestis KIM
acccaaaguggugagcugaucug

SEQ ID NO: 2313972 - RNA, 17 nt, Yersinia pestis KIM
acccaaaccaacaauau

SEQ ID NO: 2313973 - RNA, 21 nt, Yersinia pestis KIM
accauuugcccuggagcaaga

SEQ ID NO: 2313974 - RNA, 16 nt, Yersinia pestis KIM
accauuugcccuggag

SEQ ID NO: 2313975 - RNA, 15 nt, Yersinia pestis KIM
accauuuuuaugcca

SEQ ID NO: 2313976 - RNA, 21 nt, Yersinia pestis KIM
accgcccccaauaagggccac

SEQ ID NO: 2313977 - RNA, 17 nt, Yersinia pestis KIM
accgccccccaucccca

SEQ ID NO: 2313978 - RNA, 20 nt, Yersinia pestis KIM
accgccgcaacaauaaagcg

SEQ ID NO: 2313979 - RNA, 14 nt, Yersinia pestis KIM
accgccagugccac

SEQ ID NO: 2313980 - RNA, 13 nt, Yersinia pestis KIM
accgccagugccg

SEQ ID NO: 2313981 - RNA, 22 nt, Yersinia pestis KIM
accgccagcaauaagccacgcu

SEQ ID NO: 2313982 - RNA, 15 nt, Yersinia pestis KIM
accgccagcaacagc

SEQ ID NO: 2313983 - RNA, 15 nt, Yersinia pestis KIM
accgccacacaauac

SEQ ID NO: 2313984 - RNA, 17 nt, Yersinia pestis KIM
accgccaauauaaggcu

SEQ ID NO: 2313985 - RNA, 15 nt, Yersinia pestis KIM
accgccaaauacaaa

SEQ ID NO: 2313986 - RNA, 17 nt, Yersinia pestis KIM
accgccaaauacaaacc

SEQ ID NO: 2313987 - RNA, 14 nt, Yersinia pestis KIM
accgccaaaugaaa

SEQ ID NO: 2313988 - RNA, 20 nt, Yersinia pestis KIM
accgcauuaugcccccaggu

SEQ ID NO: 2313989 - RNA, 16 nt, Yersinia pestis KIM
accgcagauaaaagaa

SEQ ID NO: 2313990 - RNA, 17 nt, Yersinia pestis KIM
accgcagauaaaagaaa

SEQ ID NO: 2313991 - RNA, 11 nt, Yersinia pestis KIM
accgcagauau

SEQ ID NO: 2313992 - RNA, 19 nt, Yersinia pestis KIM
accgcagccuucagaugaa

SEQ ID NO: 2313993 - RNA, 16 nt, Yersinia pestis KIM
accgcagucgauaaac

SEQ ID NO: 2313994 - RNA, 20 nt, Yersinia pestis KIM
accgcagucgauaaacauca

SEQ ID NO: 2313995 - RNA, 21 nt, Yersinia pestis KIM
acccucucuuuccagcaaaag

SEQ ID NO: 2313996 - RNA, 17 nt, Yersinia pestis KIM
acccucauguaagccaa

SEQ ID NO: 2313997 - RNA, 17 nt, Yersinia pestis KIM
acccguugcaaggccuc

SEQ ID NO: 2313998 - RNA, 23 nt, Yersinia pestis KIM
acccguugcauuuuucuguucag

SEQ ID NO: 2313999 - RNA, 19 nt, Yersinia pestis KIM
accgauauugauagccaca

SEQ ID NO: 2314000 - RNA, 20 nt, Yersinia pestis KIM
accgagcgucaagccaaccc

SEQ ID NO: 2314001 - RNA, 18 nt, Yersinia pestis KIM
accgaugagugaaaucuc

SEQ ID NO: 2314002 - RNA, 22 nt, Yersinia pestis KIM
accgcaaccaccuuuaccaugc

SEQ ID NO: 2314003 - RNA, 13 nt, Yersinia pestis KIM
accgcaccacgau

SEQ ID NO: 2314004 - RNA, 11 nt, Yersinia pestis KIM
accgcaccaca

SEQ ID NO: 2314005 - RNA, 22 nt, Yersinia pestis KIM
accggcgaagggcgcagccccc

SEQ ID NO: 2314006 - RNA, 19 nt, Yersinia pestis KIM
accggcuaauaccaggcug

SEQ ID NO: 2314007 - RNA, 18 nt, Yersinia pestis KIM
accggcuggcauuuuuau

SEQ ID NO: 2314008 - RNA, 21 nt, Yersinia pestis KIM
accgcugcuaccagcagugca

SEQ ID NO: 2314009 - RNA, 21 nt, Yersinia pestis KIM
accggauaacguuucagggug

SEQ ID NO: 2314010 - RNA, 21 nt, Yersinia pestis KIM
accggauaaaacaauagcuga

SEQ ID NO: 2314011 - RNA, 16 nt, Yersinia pestis KIM
accggagcaagggcgc

SEQ ID NO: 2314012 - RNA, 16 nt, Yersinia pestis KIM
accgcgcucugcuggg

SEQ ID NO: 2314013 - RNA, 12 nt, Yersinia pestis KIM
accgcugauaac

SEQ ID NO: 2314014 - RNA, 13 nt, Yersinia pestis KIM
accgcgcaggagc

SEQ ID NO: 2314015 - RNA, 23 nt, Yersinia pestis KIM
accgccugugacgcuugaauaua

SEQ ID NO: 2314016 - RNA, 16 nt, Yersinia pestis KIM
accgccugccgugcuu

SEQ ID NO: 2314017 - RNA, 15 nt, Yersinia pestis KIM
accgccggcaacagc

SEQ ID NO: 2314018 - RNA, 14 nt, Yersinia pestis KIM
acgcagagcuaaau

SEQ ID NO: 2314019 - RNA, 23 nt, Yersinia pestis KIM
acgcagagucucaccgcuggaag

SEQ ID NO: 2314020 - RNA, 21 nt, Yersinia pestis KIM
acgcagcaggcguagcgugug

SEQ ID NO: 2314021 - RNA, 23 nt, Yersinia pestis KIM
acgcacugagagcauaaccccaa

SEQ ID NO: 2314022 - RNA, 17 nt, Yersinia pestis KIM
acgcacucgaaucacuu

SEQ ID NO: 2314023 - RNA, 19 nt, Yersinia pestis KIM
acgcaggcacugcagaaaa

SEQ ID NO: 2314024 - RNA, 22 nt, Yersinia pestis KIM
acgcagcuccagcgucacuuca

SEQ ID NO: 2314025 - RNA, 14 nt, Yersinia pestis KIM
acgcagcgaaaugu

SEQ ID NO: 2314026 - RNA, 23 nt, Yersinia pestis KIM
acgcaacguaauaucugccaccg

SEQ ID NO: 2314027 - RNA, 17 nt, Yersinia pestis KIM
acgcaaguaaaagucag

SEQ ID NO: 2314028 - RNA, 16 nt, Yersinia pestis KIM
acgcaaguaaaaguca

SEQ ID NO: 2314029 - RNA, 14 nt, Yersinia pestis KIM
acgcaauuuuaugg

SEQ ID NO: 2314030 - RNA, 18 nt, Yersinia pestis KIM
acgcacaucaauccgcau

SEQ ID NO: 2314031 - RNA, 23 nt, Yersinia pestis KIM
acgcauucauaucguccaaaggg

SEQ ID NO: 2314032 - RNA, 17 nt, Yersinia pestis KIM
acgcauucaucagggca

SEQ ID NO: 2314033 - RNA, 17 nt, Yersinia pestis KIM
acgcauuccaucagcca

SEQ ID NO: 2314034 - RNA, 15 nt, Yersinia pestis KIM
acgcaguacgugacg

SEQ ID NO: 2314035 - RNA, 19 nt, Yersinia pestis KIM
acgccacuacgaccccaac

SEQ ID NO: 2314036 - RNA, 18 nt, Yersinia pestis KIM
acgccacuuaucccaacu

SEQ ID NO: 2314037 - RNA, 14 nt, Yersinia pestis KIM
acgccaauucacgc

SEQ ID NO: 2314038 - RNA, 14 nt, Yersinia pestis KIM
acgccaccccuccc

SEQ ID NO: 2314039 - RNA, 17 nt, Yersinia pestis KIM
acgccaaguaugcaggc

SEQ ID NO: 2314040 - RNA, 15 nt, Yersinia pestis KIM
acgcaaaccccgaac

SEQ ID NO: 2314041 - RNA, 16 nt, Yersinia pestis KIM
acgcaaacggguggcc

SEQ ID NO: 2314042 - RNA, 22 nt, Yersinia pestis KIM
acgcaaauaaagggccugcaaa

SEQ ID NO: 2314043 - RNA, 20 nt, Yersinia pestis KIM
acgauuaccugcauauccuc

SEQ ID NO: 2314044 - RNA, 22 nt, Yersinia pestis KIM
acgauuaucucuuacauaaaga

SEQ ID NO: 2314045 - RNA, 19 nt, Yersinia pestis KIM
acgauuguuacgccuucag

SEQ ID NO: 2314046 - RNA, 23 nt, Yersinia pestis KIM
acgauuguuacgccuucagcgau

SEQ ID NO: 2314047 - RNA, 21 nt, Yersinia pestis KIM
acgaucccucggugauaaguu

SEQ ID NO: 2314048 - RNA, 23 nt, Yersinia pestis KIM
acgauccacgauugguugcauuu

SEQ ID NO: 2314049 - RNA, 13 nt, Yersinia pestis KIM
acgaugucggcag

SEQ ID NO: 2314050 - RNA, 14 nt, Yersinia pestis KIM
acgauggaaaaaau

SEQ ID NO: 2314051 - RNA, 22 nt, Yersinia pestis KIM
acgauggaguggucaugcucac

SEQ ID NO: 2314052 - RNA, 22 nt, Yersinia pestis KIM
acgaauaaacacgucuaauucc

SEQ ID NO: 2314053 - RNA, 16 nt, Yersinia pestis KIM
acgaauaaauauccuc

SEQ ID NO: 2314054 - RNA, 20 nt, Yersinia pestis KIM
acgaaggcaacaacacccga

SEQ ID NO: 2314055 - RNA, 16 nt, Yersinia pestis KIM
acgauacgacuucuua

SEQ ID NO: 2314056 - RNA, 14 nt, Yersinia pestis KIM
acgaucauuauaua

SEQ ID NO: 2314057 - RNA, 14 nt, Yersinia pestis KIM
acgaucaguggcac

SEQ ID NO: 2314058 - RNA, 18 nt, Yersinia pestis KIM
acgauacguugcagguca

SEQ ID NO: 2314059 - RNA, 17 nt, Yersinia pestis KIM
acgagagaucguaggcu

SEQ ID NO: 2314060 - RNA, 21 nt, Yersinia pestis KIM
acgaggacuuccugcccagcg

SEQ ID NO: 2314061 - RNA, 13 nt, Yersinia pestis KIM
acgaguaaauaca

SEQ ID NO: 2314062 - RNA, 16 nt, Yersinia pestis KIM
acgaaaaccuaauacu

SEQ ID NO: 2314063 - RNA, 18 nt, Yersinia pestis KIM
acgaaauagcgccugccc

SEQ ID NO: 2314064 - RNA, 13 nt, Yersinia pestis KIM
acgaaaagcagca

SEQ ID NO: 2314065 - RNA, 23 nt, Yersinia pestis KIM
acgaacagugccaacagcgagau

SEQ ID NO: 2314066 - RNA, 17 nt, Yersinia pestis KIM
acgaacccgauaaccca

SEQ ID NO: 2314067 - RNA, 17 nt, Yersinia pestis KIM
acgaaccgaacgaaccc

SEQ ID NO: 2314068 - RNA, 23 nt, Yersinia pestis KIM
acgaaaugucgaaagauagcaaa

SEQ ID NO: 2314069 - RNA, 16 nt, Yersinia pestis KIM
acgaaauuuaagaaau

SEQ ID NO: 2314070 - RNA, 12 nt, Yersinia pestis KIM
acgaaaugccgc

SEQ ID NO: 2314071 - RNA, 22 nt, Yersinia pestis KIM
acgaacagugccaacagcgaga

SEQ ID NO: 2314072 - RNA, 19 nt, Yersinia pestis KIM
accuuuacaauuacacacc

SEQ ID NO: 2314073 - RNA, 22 nt, Yersinia pestis KIM
accuugcuccgcaauuugccca

SEQ ID NO: 2314074 - RNA, 14 nt, Yersinia pestis KIM
accuucgagagcua

SEQ ID NO: 2314075 - RNA, 14 nt, Yersinia pestis KIM
accuugauccgcca

SEQ ID NO: 2314076 - RNA, 16 nt, Yersinia pestis KIM
accuuaaccaacauga

SEQ ID NO: 2314077 - RNA, 14 nt, Yersinia pestis KIM
accuuacugcauca

SEQ ID NO: 2314078 - RNA, 16 nt, Yersinia pestis KIM
accuuacgucacccgc

SEQ ID NO: 2314079 - RNA, 19 nt, Yersinia pestis KIM
accuuaucaccaacguuua

SEQ ID NO: 2314080 - RNA, 11 nt, Yersinia pestis KIM
accuuaucacu

SEQ ID NO: 2314081 - RNA, 13 nt, Yersinia pestis KIM
accuuauccaaua

SEQ ID NO: 2314082 - RNA, 23 nt, Yersinia pestis KIM
accuuauuuuugcauauaaaaca

SEQ ID NO: 2314083 - RNA, 21 nt, Yersinia pestis KIM
accuuaucuggccccugaaua

SEQ ID NO: 2314084 - RNA, 18 nt, Yersinia pestis KIM
accuuccgucccaagaaa

SEQ ID NO: 2314085 - RNA, 22 nt, Yersinia pestis KIM
accuuccgucccaagaaaagca

SEQ ID NO: 2314086 - RNA, 13 nt, Yersinia pestis KIM
accuucaaucauu

SEQ ID NO: 2314087 - RNA, 22 nt, Yersinia pestis KIM
accuucaaucauugagaucagu

SEQ ID NO: 2314088 - RNA, 13 nt, Yersinia pestis KIM
accugguggacca

SEQ ID NO: 2314089 - RNA, 20 nt, Yersinia pestis KIM
accuguuuuuguuguucuug

SEQ ID NO: 2314090 - RNA, 12 nt, Yersinia pestis KIM
accuuaaaacag

SEQ ID NO: 2314091 - RNA, 16 nt, Yersinia pestis KIM
accugaucgugccauu

SEQ ID NO: 2314092 - RNA, 22 nt, Yersinia pestis KIM
accugauccaguuucaguggcu

SEQ ID NO: 2314093 - RNA, 14 nt, Yersinia pestis KIM
accugauaggccaa

SEQ ID NO: 2314094 - RNA, 19 nt, Yersinia pestis KIM
accugauaggccaaaaaug

SEQ ID NO: 2314095 - RNA, 22 nt, Yersinia pestis KIM
accugauaggccaaaaaugcga

SEQ ID NO: 2314096 - RNA, 19 nt, Yersinia pestis KIM
accugaggauaaaaacuac

SEQ ID NO: 2314097 - RNA, 15 nt, Yersinia pestis KIM
accugaguaauauua

SEQ ID NO: 2314098 - RNA, 18 nt, Yersinia pestis KIM
accugggcgcucuuuacg

SEQ ID NO: 2314099 - RNA, 22 nt, Yersinia pestis KIM
accucaccguuaauggcaccau

SEQ ID NO: 2314100 - RNA, 13 nt, Yersinia pestis KIM
accucacgggcuu

SEQ ID NO: 2314101 - RNA, 15 nt, Yersinia pestis KIM
accucagggagccaa

SEQ ID NO: 2314102 - RNA, 15 nt, Yersinia pestis KIM
accucagucaucgcc

SEQ ID NO: 2314103 - RNA, 16 nt, Yersinia pestis KIM
accucagccucauuca

SEQ ID NO: 2314104 - RNA, 13 nt, Yersinia pestis KIM
accucagaaaaau

SEQ ID NO: 2314105 - RNA, 21 nt, Yersinia pestis KIM
accucgaagggauaucucacc

SEQ ID NO: 2314106 - RNA, 17 nt, Yersinia pestis KIM
accucgaaaucauccgc

SEQ ID NO: 2314107 - RNA, 22 nt, Yersinia pestis KIM
accuccggugguuucgccgcca

SEQ ID NO: 2314108 - RNA, 23 nt, Yersinia pestis KIM
accggucgcguaccuucacauuu

SEQ ID NO: 2314109 - RNA, 16 nt, Yersinia pestis KIM
accggggugaucaacu

SEQ ID NO: 2314110 - RNA, 16 nt, Yersinia pestis KIM
accuaguagauaauca

SEQ ID NO: 2314111 - RNA, 22 nt, Yersinia pestis KIM
accuaucguuuguaccuguuca

SEQ ID NO: 2314112 - RNA, 15 nt, Yersinia pestis KIM
accgguuaaaacaga

SEQ ID NO: 2314113 - RNA, 14 nt, Yersinia pestis KIM
accucuaaugcacg

SEQ ID NO: 2314114 - RNA, 16 nt, Yersinia pestis KIM
accucgggcgcuuaaa

SEQ ID NO: 2314115 - RNA, 15 nt, Yersinia pestis KIM
accugaaugccauuc

SEQ ID NO: 2314116 - RNA, 21 nt, Yersinia pestis KIM
accugaaugcgccgcggcccu

SEQ ID NO: 2314117 - RNA, 13 nt, Yersinia pestis KIM
accugaaccugac

SEQ ID NO: 2314118 - RNA, 20 nt, Yersinia pestis KIM
accugacuguggcugcucug

SEQ ID NO: 2314119 - RNA, 16 nt, Yersinia pestis KIM
accugacacugcaucu

SEQ ID NO: 2314120 - RNA, 14 nt, Yersinia pestis KIM
accucugcugaugu

SEQ ID NO: 2314121 - RNA, 15 nt, Yersinia pestis KIM
accucuucagguaag

SEQ ID NO: 2314122 - RNA, 17 nt, Yersinia pestis KIM
accucuuguaaaccagc

SEQ ID NO: 2314123 - RNA, 19 nt, Yersinia pestis KIM
accucuucuuccgccaccg

SEQ ID NO: 2314124 - RNA, 14 nt, Yersinia pestis KIM
acggugccucaaau

SEQ ID NO: 2314125 - RNA, 18 nt, Yersinia pestis KIM
acgguggguacuccucgc

SEQ ID NO: 2314126 - RNA, 12 nt, Yersinia pestis KIM
acgguaaugaau

SEQ ID NO: 2314127 - RNA, 20 nt, Yersinia pestis KIM
acgggugccgcgucugaggu

SEQ ID NO: 2314128 - RNA, 13 nt, Yersinia pestis KIM
acgggcugauuac

SEQ ID NO: 2314129 - RNA, 18 nt, Yersinia pestis KIM
acguaacgacgauaagaa

SEQ ID NO: 2314130 - RNA, 13 nt, Yersinia pestis KIM
acguaauacccuc

SEQ ID NO: 2314131 - RNA, 16 nt, Yersinia pestis KIM
acguacauauaucacu

SEQ ID NO: 2314132 - RNA, 18 nt, Yersinia pestis KIM
acggcaauuaagcaaaaa

SEQ ID NO: 2314133 - RNA, 16 nt, Yersinia pestis KIM
acggcguuugacaaua

SEQ ID NO: 2314134 - RNA, 14 nt, Yersinia pestis KIM
acggcguuugacaa

SEQ ID NO: 2314135 - RNA, 19 nt, Yersinia pestis KIM
acgggccgcauucaccacc

SEQ ID NO: 2314136 - RNA, 22 nt, Yersinia pestis KIM
acggcucaucgcuaaccgccag

SEQ ID NO: 2314137 - RNA, 13 nt, Yersinia pestis KIM
acggcucacacac

SEQ ID NO: 2314138 - RNA, 17 nt, Yersinia pestis KIM
acggcucuauuucauga

SEQ ID NO: 2314139 - RNA, 18 nt, Yersinia pestis KIM
acggcuucucgaccaccg

SEQ ID NO: 2314140 - RNA, 15 nt, Yersinia pestis KIM
acggcuuaucaaucu

SEQ ID NO: 2314141 - RNA, 22 nt, Yersinia pestis KIM
acggagugcugacugcauucac

SEQ ID NO: 2314142 - RNA, 16 nt, Yersinia pestis KIM
acggaggucaaaugag

SEQ ID NO: 2314143 - RNA, 17 nt, Yersinia pestis KIM
acggaggucaaaugagu

SEQ ID NO: 2314144 - RNA, 17 nt, Yersinia pestis KIM
acggagagucagcaagg

SEQ ID NO: 2314145 - RNA, 17 nt, Yersinia pestis KIM
acggauagcgcuucagu

SEQ ID NO: 2314146 - RNA, 15 nt, Yersinia pestis KIM
acggaacucaucuuu

SEQ ID NO: 2314147 - RNA, 17 nt, Yersinia pestis KIM
acggaaggggaauauaa

SEQ ID NO: 2314148 - RNA, 14 nt, Yersinia pestis KIM
acggaacucaucuu

SEQ ID NO: 2314149 - RNA, 16 nt, Yersinia pestis KIM
acgcuuugacuuuggc

SEQ ID NO: 2314150 - RNA, 23 nt, Yersinia pestis KIM
acgcuuuacucuucagccuaucc

SEQ ID NO: 2314151 - RNA, 20 nt, Yersinia pestis KIM
acgcuuuacuccucugccua

SEQ ID NO: 2314152 - RNA, 15 nt, Yersinia pestis KIM
acgcuuuacuccucu

SEQ ID NO: 2314153 - RNA, 15 nt, Yersinia pestis KIM
acgcugauagccaau

SEQ ID NO: 2314154 - RNA, 21 nt, Yersinia pestis KIM
acgcucgguuguucagcacca

SEQ ID NO: 2314155 - RNA, 17 nt, Yersinia pestis KIM
acgcucaucgguaccag

SEQ ID NO: 2314156 - RNA, 18 nt, Yersinia pestis KIM
acgcugaaacuuuucagu

SEQ ID NO: 2314157 - RNA, 21 nt, Yersinia pestis KIM
acgccaguugggauguucagc

SEQ ID NO: 2314158 - RNA, 18 nt, Yersinia pestis KIM
acgcuaucgcgaaacucu

SEQ ID NO: 2314159 - RNA, 17 nt, Yersinia pestis KIM
acgucugcaauagcuca

SEQ ID NO: 2314160 - RNA, 17 nt, Yersinia pestis KIM
acguagcugaauugcuu

SEQ ID NO: 2314161 - RNA, 16 nt, Yersinia pestis KIM
acguagcuaacaccgc

SEQ ID NO: 2314162 - RNA, 15 nt, Yersinia pestis KIM
acguagcgauaacag

SEQ ID NO: 2314163 - RNA, 16 nt, Yersinia pestis KIM
acgugaagugagcuga

SEQ ID NO: 2314164 - RNA, 19 nt, Yersinia pestis KIM
acgugccccaaugaugacu

SEQ ID NO: 2314165 - RNA, 12 nt, Yersinia pestis KIM
acguuagagcac

SEQ ID NO: 2314166 - RNA, 15 nt, Yersinia pestis KIM
acguuauaacucaag

SEQ ID NO: 2314167 - RNA, 15 nt, Yersinia pestis KIM
acguuaucaauacug

SEQ ID NO: 2314168 - RNA, 18 nt, Yersinia pestis KIM
acguucaacgaccucauc

SEQ ID NO: 2314169 - RNA, 13 nt, Yersinia pestis KIM
acguucaaaugau

SEQ ID NO: 2314170 - RNA, 13 nt, Yersinia pestis KIM
acguugagauaau

SEQ ID NO: 2314171 - RNA, 21 nt, Yersinia pestis KIM
acguuguuuucccucagccaa

SEQ ID NO: 2314172 - RNA, 19 nt, Yersinia pestis KIM
acguuguuucugaagggca

SEQ ID NO: 2314173 - RNA, 15 nt, Yersinia pestis KIM
acguuuccaaaacuc

SEQ ID NO: 2314174 - RNA, 18 nt, Yersinia pestis KIM
acguuuccccuucauuug

SEQ ID NO: 2314175 - RNA, 15 nt, Yersinia pestis KIM
acguuggcuucaccu

SEQ ID NO: 2314176 - RNA, 21 nt, Yersinia pestis KIM
acguuggccuuucaccgguuc

SEQ ID NO: 2314177 - RNA, 12 nt, Yersinia pestis KIM
acguugcagggg

SEQ ID NO: 2314178 - RNA, 17 nt, Yersinia pestis KIM
acuaaauuagaaaacaa

SEQ ID NO: 2314179 - RNA, 18 nt, Yersinia pestis KIM
acuaaauuagaaaacaag

SEQ ID NO: 2314180 - RNA, 17 nt, Yersinia pestis KIM
acuaaaucgcaggcuuu

SEQ ID NO: 2314181 - RNA, 17 nt, Yersinia pestis KIM
acuaaauagauaaaaac

SEQ ID NO: 2314182 - RNA, 18 nt, Yersinia pestis KIM
acuaaauagauaaaaaca

SEQ ID NO: 2314183 - RNA, 19 nt, Yersinia pestis KIM
acuaaagaaauaaucauau

SEQ ID NO: 2314184 - RNA, 23 nt, Yersinia pestis KIM
acuaaaauaaucuugugaugaaa

SEQ ID NO: 2314185 - RNA, 16 nt, Yersinia pestis KIM
acuaaaauucaaacaa

SEQ ID NO: 2314186 - RNA, 20 nt, Yersinia pestis KIM
acuagagcguuacacaucag

SEQ ID NO: 2314187 - RNA, 17 nt, Yersinia pestis KIM
acuagccauuuggugau

SEQ ID NO: 2314188 - RNA, 22 nt, Yersinia pestis KIM
acuagcggauuuauaaggaaau

SEQ ID NO: 2314189 - RNA, 18 nt, Yersinia pestis KIM
acuauaagcgcucaaaua

SEQ ID NO: 2314190 - RNA, 13 nt, Yersinia pestis KIM
acuacaucgaguu

SEQ ID NO: 2314191 - RNA, 18 nt, Yersinia pestis KIM
acuauuccgucgauaucu

SEQ ID NO: 2314192 - RNA, 18 nt, Yersinia pestis KIM
acuauucaucccuaaaau

SEQ ID NO: 2314193 - RNA, 16 nt, Yersinia pestis KIM
acuauuucagacauac

SEQ ID NO: 2314194 - RNA, 22 nt, Yersinia pestis KIM
acuauuuauuaaucuauuaaua

SEQ ID NO: 2314195 - RNA, 20 nt, Yersinia pestis KIM
acuauugcaucuuuaauuaa

SEQ ID NO: 2314196 - RNA, 19 nt, Yersinia pestis KIM
acuauuuaaauacaaaaau

SEQ ID NO: 2314197 - RNA, 18 nt, Yersinia pestis KIM
acuauuggucaaucuaga

SEQ ID NO: 2314198 - RNA, 15 nt, Yersinia pestis KIM
acuauagauacccac

SEQ ID NO: 2314199 - RNA, 15 nt, Yersinia pestis KIM
acuauauaaaugauu

SEQ ID NO: 2314200 - RNA, 13 nt, Yersinia pestis KIM
acuaaccucugca

SEQ ID NO: 2314201 - RNA, 15 nt, Yersinia pestis KIM
acuaacgucaacaga

SEQ ID NO: 2314202 - RNA, 16 nt, Yersinia pestis KIM
acuaacgucaacagaa

SEQ ID NO: 2314203 - RNA, 18 nt, Yersinia pestis KIM
acuaacgucaacagaacu

SEQ ID NO: 2314204 - RNA, 21 nt, Yersinia pestis KIM
acuaacgucaacagaacuaau

SEQ ID NO: 2314205 - RNA, 17 nt, Yersinia pestis KIM
acuaacaugccagccug

SEQ ID NO: 2314206 - RNA, 19 nt, Yersinia pestis KIM
acuaaauuuagugccaaca

SEQ ID NO: 2314207 - RNA, 18 nt, Yersinia pestis KIM
acuaagagucacagcauu

SEQ ID NO: 2314208 - RNA, 21 nt, Yersinia pestis KIM
acuaagcagauggucaacuaa

SEQ ID NO: 2314209 - RNA, 22 nt, Yersinia pestis KIM
acuaagggcgauagacuuucac

SEQ ID NO: 2314210 - RNA, 13 nt, Yersinia pestis KIM
acuaauguuuguu

SEQ ID NO: 2314211 - RNA, 22 nt, Yersinia pestis KIM
acuaauggguuagcgguuaaaa

SEQ ID NO: 2314212 - RNA, 15 nt, Yersinia pestis KIM
acuaauaauaauuaa

SEQ ID NO: 2314213 - RNA, 22 nt, Yersinia pestis KIM
acuaauacucuguuaccaaugg

SEQ ID NO: 2314214 - RNA, 16 nt, Yersinia pestis KIM
acuaauaucaacagaa

SEQ ID NO: 2314215 - RNA, 19 nt, Yersinia pestis KIM
acuuaaaaaucaaaaguua

SEQ ID NO: 2314216 - RNA, 12 nt, Yersinia pestis KIM
acuguugguaaa

SEQ ID NO: 2314217 - RNA, 16 nt, Yersinia pestis KIM
acuguugguaaauaac

SEQ ID NO: 2314218 - RNA, 22 nt, Yersinia pestis KIM
acuuacccuacccauuauaaau

SEQ ID NO: 2314219 - RNA, 15 nt, Yersinia pestis KIM
acuuaccccuugcga

SEQ ID NO: 2314220 - RNA, 18 nt, Yersinia pestis KIM
acuuaccuugauccgcca

SEQ ID NO: 2314221 - RNA, 16 nt, Yersinia pestis KIM
acuuaauugguuuaua

SEQ ID NO: 2314222 - RNA, 16 nt, Yersinia pestis KIM
acuuaauuccaugcaa

SEQ ID NO: 2314223 - RNA, 19 nt, Yersinia pestis KIM
acuuacaggcugccugccu

SEQ ID NO: 2314224 - RNA, 13 nt, Yersinia pestis KIM
acuggauggccau

SEQ ID NO: 2314225 - RNA, 20 nt, Yersinia pestis KIM
acuggcaauaauucagauga

SEQ ID NO: 2314226 - RNA, 12 nt, Yersinia pestis KIM
acuggcaccgcu

SEQ ID NO: 2314227 - RNA, 18 nt, Yersinia pestis KIM
acugucuauuuuuauaau

SEQ ID NO: 2314228 - RNA, 18 nt, Yersinia pestis KIM
acuguugaugcagaugac

SEQ ID NO: 2314229 - RNA, 14 nt, Yersinia pestis KIM
acuguucuugaugg

SEQ ID NO: 2314230 - RNA, 12 nt, Yersinia pestis KIM
acugugccaacc

SEQ ID NO: 2314231 - RNA, 20 nt, Yersinia pestis KIM
acuuagcacggcaucgcugc

SEQ ID NO: 2314232 - RNA, 18 nt, Yersinia pestis KIM
acuuagaagcgauaaccc

SEQ ID NO: 2314233 - RNA, 20 nt, Yersinia pestis KIM
acuuaugaugugauuauuuu

SEQ ID NO: 2314234 - RNA, 22 nt, Yersinia pestis KIM
acuuaugaugugauuauuuugu

SEQ ID NO: 2314235 - RNA, 17 nt, Yersinia pestis KIM
acuuaucuaaaaaacca

SEQ ID NO: 2314236 - RNA, 15 nt, Yersinia pestis KIM
acuuaucuaaaaaac

SEQ ID NO: 2314237 - RNA, 14 nt, Yersinia pestis KIM
acuuaucuaaaaaa

SEQ ID NO: 2314238 - RNA, 16 nt, Yersinia pestis KIM
acuuauuugaaacacu

SEQ ID NO: 2314239 - RNA, 14 nt, Yersinia pestis KIM
acuuauuugaaaua

SEQ ID NO: 2314240 - RNA, 15 nt, Yersinia pestis KIM
acuuauuauaaagcu

SEQ ID NO: 2314241 - RNA, 16 nt, Yersinia pestis KIM
acuuauugauuauaug

SEQ ID NO: 2314242 - RNA, 21 nt, Yersinia pestis KIM
acuucacucgcgacuacagaa

SEQ ID NO: 2314243 - RNA, 18 nt, Yersinia pestis KIM
acuucacuuugacuuaaa

SEQ ID NO: 2314244 - RNA, 12 nt, Yersinia pestis KIM
acuucaggccaa

SEQ ID NO: 2314245 - RNA, 21 nt, Yersinia pestis KIM
acuucaauuuggccauuaacc

SEQ ID NO: 2314246 - RNA, 23 nt, Yersinia pestis KIM
acuucaauuuggccauuaaccua

SEQ ID NO: 2314247 - RNA, 17 nt, Yersinia pestis KIM
acuucacaaugcacagu

SEQ ID NO: 2314248 - RNA, 15 nt, Yersinia pestis KIM
acuucaaaucgccaa

SEQ ID NO: 2314249 - RNA, 21 nt, Yersinia pestis KIM
acuucuccuguauuugguuau

SEQ ID NO: 2314250 - RNA, 14 nt, Yersinia pestis KIM
acuucuauuuuucg

SEQ ID NO: 2314251 - RNA, 13 nt, Yersinia pestis KIM
acuucggucaaga

SEQ ID NO: 2314252 - RNA, 18 nt, Yersinia pestis KIM
acuucguagggcacuuuc

SEQ ID NO: 2314253 - RNA, 15 nt, Yersinia pestis KIM
acuucuuauuaauca

SEQ ID NO: 2314254 - RNA, 14 nt, Yersinia pestis KIM
acuucuuauuaauc

SEQ ID NO: 2314255 - RNA, 21 nt, Yersinia pestis KIM
acuucuuucacuaaugaggaa

SEQ ID NO: 2314256 - RNA, 20 nt, Yersinia pestis KIM
acuucuucgcuaucgagauu

SEQ ID NO: 2314257 - RNA, 15 nt, Yersinia pestis KIM
acuugagagaaacuu

SEQ ID NO: 2314258 - RNA, 16 nt, Yersinia pestis KIM
acuucgcgaacacaau

SEQ ID NO: 2314259 - RNA, 17 nt, Yersinia pestis KIM
acuucgccgggucagga

SEQ ID NO: 2314260 - RNA, 21 nt, Yersinia pestis KIM
acuucgccgggucaggaagag

SEQ ID NO: 2314261 - RNA, 17 nt, Yersinia pestis KIM
acuucgccaggucagga

SEQ ID NO: 2314262 - RNA, 16 nt, Yersinia pestis KIM
acuucgaugauuauuu

SEQ ID NO: 2314263 - RNA, 19 nt, Yersinia pestis KIM
acuucgauacuacaaucau

SEQ ID NO: 2314264 - RNA, 22 nt, Yersinia pestis KIM
acuucgaaagaaauaaaagaaa

SEQ ID NO: 2314265 - RNA, 17 nt, Yersinia pestis KIM
acuucgaaagaaauaaa

SEQ ID NO: 2314266 - RNA, 15 nt, Yersinia pestis KIM
acuucgaaagaaaua

SEQ ID NO: 2314267 - RNA, 13 nt, Yersinia pestis KIM
acuucgaaagaaa

SEQ ID NO: 2314268 - RNA, 24 nt, Yersinia pestis KIM
acuucaucaucaacaaccagugcu

SEQ ID NO: 2314269 - RNA, 14 nt, Yersinia pestis KIM
acuucaucuuuuuu

SEQ ID NO: 2314270 - RNA, 19 nt, Yersinia pestis KIM
acuucauuggcuugguugu

SEQ ID NO: 2314271 - RNA, 13 nt, Yersinia pestis KIM
acuuccgccgcca

SEQ ID NO: 2314272 - RNA, 12 nt, Yersinia pestis KIM
acuuccauuccg

SEQ ID NO: 2314273 - RNA, 12 nt, Yersinia pestis KIM
acuuccagcacc

SEQ ID NO: 2314274 - RNA, 14 nt, Yersinia pestis KIM
acuuccacggccag

SEQ ID NO: 2314275 - RNA, 18 nt, Yersinia pestis KIM
acuuccacggccagccug

SEQ ID NO: 2314276 - RNA, 19 nt, Yersinia pestis KIM
acuuccagcguauguuccu

SEQ ID NO: 2314277 - RNA, 15 nt, Yersinia pestis KIM
acucuguaccgcccg

SEQ ID NO: 2314278 - RNA, 14 nt, Yersinia pestis KIM
acucuguaccgccc

SEQ ID NO: 2314279 - RNA, 15 nt, Yersinia pestis KIM
acucuguuaccaaug

SEQ ID NO: 2314280 - RNA, 18 nt, Yersinia pestis KIM
acucuggaauuaaaguau

SEQ ID NO: 2314281 - RNA, 23 nt, Yersinia pestis KIM
acucugggccgugaguuuucgau

SEQ ID NO: 2314282 - RNA, 23 nt, Yersinia pestis KIM
acucuggggcaaucaauguauug

SEQ ID NO: 2314283 - RNA, 18 nt, Yersinia pestis KIM
acucuucgcaaaauuuau

SEQ ID NO: 2314284 - RNA, 16 nt, Yersinia pestis KIM
acucuucggccuauca

SEQ ID NO: 2314285 - RNA, 18 nt, Yersinia pestis KIM
acucugccagauagucau

SEQ ID NO: 2314286 - RNA, 21 nt, Yersinia pestis KIM
acucugccagauagucaucuu

SEQ ID NO: 2314287 - RNA, 19 nt, Yersinia pestis KIM
acucucuucaucagucacu

SEQ ID NO: 2314288 - RNA, 16 nt, Yersinia pestis KIM
acucguuuuacauuga

SEQ ID NO: 2314289 - RNA, 22 nt, Yersinia pestis KIM
acucgcuuaacugugcagccca

SEQ ID NO: 2314290 - RNA, 21 nt, Yersinia pestis KIM
acucggcaaaggcuucggcca

SEQ ID NO: 2314291 - RNA, 19 nt, Yersinia pestis KIM
acucggcucaccugcggga

SEQ ID NO: 2314292 - RNA, 13 nt, Yersinia pestis KIM
acucgaauuauuu

SEQ ID NO: 2314293 - RNA, 19 nt, Yersinia pestis KIM
acuccucuuucuuaauaau

SEQ ID NO: 2314294 - RNA, 19 nt, Yersinia pestis KIM
acuccucugccuauccuca

SEQ ID NO: 2314295 - RNA, 13 nt, Yersinia pestis KIM
acuccucuucuuc

SEQ ID NO: 2314296 - RNA, 13 nt, Yersinia pestis KIM
acuccucugccua

SEQ ID NO: 2314297 - RNA, 22 nt, Yersinia pestis KIM
acuccucuuucuuaauaauauc

SEQ ID NO: 2314298 - RNA, 21 nt, Yersinia pestis KIM
acucccgauucagcucugcca

SEQ ID NO: 2314299 - RNA, 18 nt, Yersinia pestis KIM
acuccggcaucauccuca

SEQ ID NO: 2314300 - RNA, 12 nt, Yersinia pestis KIM
acucaaaacaau

SEQ ID NO: 2314301 - RNA, 13 nt, Yersinia pestis KIM
acucaaaacaauu

SEQ ID NO: 2314302 - RNA, 18 nt, Yersinia pestis KIM
acucccauucgcgcccca

SEQ ID NO: 2314303 - RNA, 13 nt, Yersinia pestis KIM
acugccaaucgcu

SEQ ID NO: 2314304 - RNA, 15 nt, Yersinia pestis KIM
acugccaaucgcucu

SEQ ID NO: 2314305 - RNA, 20 nt, Yersinia pestis KIM
acugccaaccaccaaagaua

SEQ ID NO: 2314306 - RNA, 14 nt, Yersinia pestis KIM
acugcauuaucuaa

SEQ ID NO: 2314307 - RNA, 17 nt, Yersinia pestis KIM
acugcauuaccuuuaaa

SEQ ID NO: 2314308 - RNA, 21 nt, Yersinia pestis KIM
acugcauuaccuuuaaaacug

SEQ ID NO: 2314309 - RNA, 12 nt, Yersinia pestis KIM
acugcaugccau

SEQ ID NO: 2314310 - RNA, 22 nt, Yersinia pestis KIM
acugccuguucuggcaaauaag

SEQ ID NO: 2314311 - RNA, 13 nt, Yersinia pestis KIM
acugccugcagca

SEQ ID NO: 2314312 - RNA, 20 nt, Yersinia pestis KIM
acugcgcuagaccaguuaau

SEQ ID NO: 2314313 - RNA, 20 nt, Yersinia pestis KIM
acugcggauugaaaggagaa

SEQ ID NO: 2314314 - RNA, 15 nt, Yersinia pestis KIM
acugcucuuucccuu

SEQ ID NO: 2314315 - RNA, 16 nt, Yersinia pestis KIM
acugcucuaucucuuc

SEQ ID NO: 2314316 - RNA, 13 nt, Yersinia pestis KIM
acugcugacaacc

SEQ ID NO: 2314317 - RNA, 15 nt, Yersinia pestis KIM
acugcugacaacccu

SEQ ID NO: 2314318 - RNA, 15 nt, Yersinia pestis KIM
acugcugacaacccc

SEQ ID NO: 2314319 - RNA, 16 nt, Yersinia pestis KIM
acugcugcaacucauu

SEQ ID NO: 2314320 - RNA, 16 nt, Yersinia pestis KIM
acuggauauuuuuaac

SEQ ID NO: 2314321 - RNA, 22 nt, Yersinia pestis KIM
acuggaagccgacgaucuugcc

SEQ ID NO: 2314322 - RNA, 22 nt, Yersinia pestis KIM
acugcuuuuuauugucucuacu

SEQ ID NO: 2314323 - RNA, 21 nt, Yersinia pestis KIM
acuggaaacugacauaagcua

SEQ ID NO: 2314324 - RNA, 17 nt, Yersinia pestis KIM
acugcauacggcaguuu

SEQ ID NO: 2314325 - RNA, 22 nt, Yersinia pestis KIM
acugcaaauguucaacaagaaa

SEQ ID NO: 2314326 - RNA, 23 nt, Yersinia pestis KIM
acugcaaauguucaacaagaaau

SEQ ID NO: 2314327 - RNA, 18 nt, Yersinia pestis KIM
acugauaggucauauaca

SEQ ID NO: 2314328 - RNA, 14 nt, Yersinia pestis KIM
acugauagccaaca

SEQ ID NO: 2314329 - RNA, 14 nt, Yersinia pestis KIM
acugauacccaguu

SEQ ID NO: 2314330 - RNA, 18 nt, Yersinia pestis KIM
acugaguuggaaaugaca

SEQ ID NO: 2314331 - RNA, 16 nt, Yersinia pestis KIM
acugaguucugcugcc

SEQ ID NO: 2314332 - RNA, 13 nt, Yersinia pestis KIM
acugauugaccau

SEQ ID NO: 2314333 - RNA, 16 nt, Yersinia pestis KIM
acugauugaccaucaa

SEQ ID NO: 2314334 - RNA, 20 nt, Yersinia pestis KIM
acugauauagccuucuucac

SEQ ID NO: 2314335 - RNA, 17 nt, Yersinia pestis KIM
acugauaucuucacuca

SEQ ID NO: 2314336 - RNA, 22 nt, Yersinia pestis KIM
acugaucaauaucccgagaaac

SEQ ID NO: 2314337 - RNA, 17 nt, Yersinia pestis KIM
acugaaaagaggcacac

SEQ ID NO: 2314338 - RNA, 15 nt, Yersinia pestis KIM
acucuuuauuuaugg

SEQ ID NO: 2314339 - RNA, 22 nt, Yersinia pestis KIM
acucuuugggggcagugacuga

SEQ ID NO: 2314340 - RNA, 23 nt, Yersinia pestis KIM
acugaaaucauagcuaaaugaca

SEQ ID NO: 2314341 - RNA, 18 nt, Yersinia pestis KIM
acugaaaguagaaauaaa

SEQ ID NO: 2314342 - RNA, 18 nt, Yersinia pestis KIM
acugaaacggugaggaua

SEQ ID NO: 2314343 - RNA, 11 nt, Yersinia pestis KIM
acugagcaccg

SEQ ID NO: 2314344 - RNA, 13 nt, Yersinia pestis KIM
acugagcaccgca

SEQ ID NO: 2314345 - RNA, 14 nt, Yersinia pestis KIM
acugagauuugcca

SEQ ID NO: 2314346 - RNA, 11 nt, Yersinia pestis KIM
acugaggcaga

SEQ ID NO: 2314347 - RNA, 15 nt, Yersinia pestis KIM
acugagucuugauau

SEQ ID NO: 2314348 - RNA, 13 nt, Yersinia pestis KIM
acugaguaugagc

SEQ ID NO: 2314349 - RNA, 21 nt, Yersinia pestis KIM
aauccaccacugauaggucau

SEQ ID NO: 2314350 - RNA, 18 nt, Yersinia pestis KIM
aauccacauaaaaagaaa

SEQ ID NO: 2314351 - RNA, 17 nt, Yersinia pestis KIM
aauccaguugaguaauu

SEQ ID NO: 2314352 - RNA, 15 nt, Yersinia pestis KIM
aauccagguaaacaa

SEQ ID NO: 2314353 - RNA, 19 nt, Yersinia pestis KIM
aaucauugagaucaguuca

SEQ ID NO: 2314354 - RNA, 18 nt, Yersinia pestis KIM
aaucauucugucaucaag

SEQ ID NO: 2314355 - RNA, 19 nt, Yersinia pestis KIM
aaucauucugucaucaaga

SEQ ID NO: 2314356 - RNA, 21 nt, Yersinia pestis KIM
aauccaaaugcccauuaguaa

SEQ ID NO: 2314357 - RNA, 18 nt, Yersinia pestis KIM
aauccaaccuauauagcc

SEQ ID NO: 2314358 - RNA, 16 nt, Yersinia pestis KIM
aauccaagccauggua

SEQ ID NO: 2314359 - RNA, 18 nt, Yersinia pestis KIM
aaucaucuacaacaucau

SEQ ID NO: 2314360 - RNA, 17 nt, Yersinia pestis KIM
aaucaucgcucaucgcc

SEQ ID NO: 2314361 - RNA, 19 nt, Yersinia pestis KIM
aaaaauucacaacagugca

SEQ ID NO: 2314362 - RNA, 18 nt, Yersinia pestis KIM
aaaaauuauuaaauaaga

SEQ ID NO: 2314363 - RNA, 18 nt, Yersinia pestis KIM
aaucaucaucacaaauaa

SEQ ID NO: 2314364 - RNA, 11 nt, Yersinia pestis KIM
aaucaucaucc

SEQ ID NO: 2314365 - RNA, 16 nt, Yersinia pestis KIM
aaucagcuaauaucau

SEQ ID NO: 2314366 - RNA, 13 nt, Yersinia pestis KIM
aaucagcucauua

SEQ ID NO: 2314367 - RNA, 23 nt, Yersinia pestis KIM
aaucagcgaaugccggugccuau

SEQ ID NO: 2314368 - RNA, 14 nt, Yersinia pestis KIM
aaucagcauucuca

SEQ ID NO: 2314369 - RNA, 18 nt, Yersinia pestis KIM
aaucagcauuaacccaua

SEQ ID NO: 2314370 - RNA, 21 nt, Yersinia pestis KIM
aaucagcaucuuaccggccuc

SEQ ID NO: 2314371 - RNA, 14 nt, Yersinia pestis KIM
aaucagugcaauaa

SEQ ID NO: 2314372 - RNA, 17 nt, Yersinia pestis KIM
aaucaguguaucaauag

SEQ ID NO: 2314373 - RNA, 20 nt, Yersinia pestis KIM
aaucagugaaggaugaauaa

SEQ ID NO: 2314374 - RNA, 21 nt, Yersinia pestis KIM
aaucaguaccgacaccaauac

SEQ ID NO: 2314375 - RNA, 13 nt, Yersinia pestis KIM
aaucaguaaauau

SEQ ID NO: 2314376 - RNA, 17 nt, Yersinia pestis KIM
aaucagcugauaugaaa

SEQ ID NO: 2314377 - RNA, 15 nt, Yersinia pestis KIM
aaucagcugauauga

SEQ ID NO: 2314378 - RNA, 14 nt, Yersinia pestis KIM
aaucagggcacucu

SEQ ID NO: 2314379 - RNA, 15 nt, Yersinia pestis KIM
aaucagggcacucug

SEQ ID NO: 2314380 - RNA, 21 nt, Yersinia pestis KIM
aaucauaggccacuagccauu

SEQ ID NO: 2314381 - RNA, 17 nt, Yersinia pestis KIM
aaaaauuaaaauaauga

SEQ ID NO: 2314382 - RNA, 13 nt, Yersinia pestis KIM
aaaaauuaaaaua

SEQ ID NO: 2314383 - RNA, 12 nt, Yersinia pestis KIM
aaaaauuaucau

SEQ ID NO: 2314384 - RNA, 14 nt, Yersinia pestis KIM
aaaaauuaucauca

SEQ ID NO: 2314385 - RNA, 16 nt, Yersinia pestis KIM
aaucuccaucauggcu

SEQ ID NO: 2314386 - RNA, 22 nt, Yersinia pestis KIM
aaucuauucuuuuuagcggaac

SEQ ID NO: 2314387 - RNA, 19 nt, Yersinia pestis KIM
aaucuccuggugguuuggu

SEQ ID NO: 2314388 - RNA, 16 nt, Yersinia pestis KIM
aaucuccuccggagag

SEQ ID NO: 2314389 - RNA, 18 nt, Yersinia pestis KIM
aaucgguagacacaaggg

SEQ ID NO: 2314390 - RNA, 13 nt, Yersinia pestis KIM
aaucgguggcuau

SEQ ID NO: 2314391 - RNA, 22 nt, Yersinia pestis KIM
aaucgguguuagaucggccaau

SEQ ID NO: 2314392 - RNA, 18 nt, Yersinia pestis KIM
aaucguauaacauaauaa

SEQ ID NO: 2314393 - RNA, 19 nt, Yersinia pestis KIM
aaucgcucugcguuuuucc

SEQ ID NO: 2314394 - RNA, 20 nt, Yersinia pestis KIM
aaucgcucugcguuuuuccc

SEQ ID NO: 2314395 - RNA, 14 nt, Yersinia pestis KIM
aaucggauaaccgc

SEQ ID NO: 2314396 - RNA, 16 nt, Yersinia pestis KIM
aauccccggaccagcc

SEQ ID NO: 2314397 - RNA, 22 nt, Yersinia pestis KIM
aauccccggucacuuaaauaac

SEQ ID NO: 2314398 - RNA, 15 nt, Yersinia pestis KIM
aauccccucaaaauu

SEQ ID NO: 2314399 - RNA, 13 nt, Yersinia pestis KIM
aaucccgauaaaa

SEQ ID NO: 2314400 - RNA, 14 nt, Yersinia pestis KIM
aaucccgauaaaaa

SEQ ID NO: 2314401 - RNA, 18 nt, Yersinia pestis KIM
aauccccaugaugauauc

SEQ ID NO: 2314402 - RNA, 22 nt, Yersinia pestis KIM
aauccauagugauuauuuaaac

SEQ ID NO: 2314403 - RNA, 21 nt, Yersinia pestis KIM
aauccugcaaauuaaccugcu

SEQ ID NO: 2314404 - RNA, 13 nt, Yersinia pestis KIM
aaaaauuuuccca

SEQ ID NO: 2314405 - RNA, 18 nt, Yersinia pestis KIM
aaaaauuuucccaaagug

SEQ ID NO: 2314406 - RNA, 18 nt, Yersinia pestis KIM
aaucgcccaaugucagga

SEQ ID NO: 2314407 - RNA, 14 nt, Yersinia pestis KIM
aaucgaaacaccac

SEQ ID NO: 2314408 - RNA, 12 nt, Yersinia pestis KIM
aaugcuauauuu

SEQ ID NO: 2314409 - RNA, 17 nt, Yersinia pestis KIM
aaugcuaccuguaacau

SEQ ID NO: 2314410 - RNA, 21 nt, Yersinia pestis KIM
aaugcucgcucaucauaaaaa

SEQ ID NO: 2314411 - RNA, 20 nt, Yersinia pestis KIM
aaugcucuucaccaaaggaa

SEQ ID NO: 2314412 - RNA, 20 nt, Yersinia pestis KIM
aaugccggcggcccauaucc

SEQ ID NO: 2314413 - RNA, 15 nt, Yersinia pestis KIM
aaugcggguuucauc

SEQ ID NO: 2314414 - RNA, 18 nt, Yersinia pestis KIM
aauggcacuggaaacaaa

SEQ ID NO: 2314415 - RNA, 17 nt, Yersinia pestis KIM
aauggcaaaacagauau

SEQ ID NO: 2314416 - RNA, 18 nt, Yersinia pestis KIM
aauggauugaucauucuc

SEQ ID NO: 2314417 - RNA, 20 nt, Yersinia pestis KIM
aauggcuuucgaucaucacg

SEQ ID NO: 2314418 - RNA, 13 nt, Yersinia pestis KIM
aauggcugccccc

SEQ ID NO: 2314419 - RNA, 19 nt, Yersinia pestis KIM
aauggcguuuaaaguaaau

SEQ ID NO: 2314420 - RNA, 18 nt, Yersinia pestis KIM
aaugaucgucaauguaac

SEQ ID NO: 2314421 - RNA, 20 nt, Yersinia pestis KIM
aaugaugaaaauugcaggug

SEQ ID NO: 2314422 - RNA, 18 nt, Yersinia pestis KIM
aaugaucaucagcagcag

SEQ ID NO: 2314423 - RNA, 17 nt, Yersinia pestis KIM
aaugauauugaucuuua

SEQ ID NO: 2314424 - RNA, 13 nt, Yersinia pestis KIM
aaugauauucaua

SEQ ID NO: 2314425 - RNA, 23 nt, Yersinia pestis KIM
aaugauggcggcuaaauguucaa

SEQ ID NO: 2314426 - RNA, 17 nt, Yersinia pestis KIM
aaugaugguauuaauca

SEQ ID NO: 2314427 - RNA, 18 nt, Yersinia pestis KIM
aaugaugguauuaaucaa

SEQ ID NO: 2314428 - RNA, 14 nt, Yersinia pestis KIM
aaugauuauugacc

SEQ ID NO: 2314429 - RNA, 21 nt, Yersinia pestis KIM
aaugccgcgcccccagccauu

SEQ ID NO: 2314430 - RNA, 20 nt, Yersinia pestis KIM
aaugccgcgcuuggaagggu

SEQ ID NO: 2314431 - RNA, 14 nt, Yersinia pestis KIM
aaugauucagugau

SEQ ID NO: 2314432 - RNA, 20 nt, Yersinia pestis KIM
aaugcagguucauuacacag

SEQ ID NO: 2314433 - RNA, 14 nt, Yersinia pestis KIM
aaugcagguuuugc

SEQ ID NO: 2314434 - RNA, 21 nt, Yersinia pestis KIM
aaugacagcaucaauaucgcc

SEQ ID NO: 2314435 - RNA, 23 nt, Yersinia pestis KIM
aaugacaguauuuguaguggaug

SEQ ID NO: 2314436 - RNA, 17 nt, Yersinia pestis KIM
aaugaauuuuuuuaacu

SEQ ID NO: 2314437 - RNA, 21 nt, Yersinia pestis KIM
aaugaccacccacguuccccc

SEQ ID NO: 2314438 - RNA, 22 nt, Yersinia pestis KIM
aaugaccacgcaucaauaauaa

SEQ ID NO: 2314439 - RNA, 20 nt, Yersinia pestis KIM
aaugacuaucccuucaauca

SEQ ID NO: 2314440 - RNA, 17 nt, Yersinia pestis KIM
aaugacuacuaaucaau

SEQ ID NO: 2314441 - RNA, 16 nt, Yersinia pestis KIM
aaugacgaucacugcu

SEQ ID NO: 2314442 - RNA, 17 nt, Yersinia pestis KIM
aaugacgcgaucugaaa

SEQ ID NO: 2314443 - RNA, 17 nt, Yersinia pestis KIM
aaugaguguuuuucuca

SEQ ID NO: 2314444 - RNA, 16 nt, Yersinia pestis KIM
aaugaguuaaugagaa

SEQ ID NO: 2314445 - RNA, 20 nt, Yersinia pestis KIM
aaugagguuuacauuuaaac

SEQ ID NO: 2314446 - RNA, 12 nt, Yersinia pestis KIM
aaugagggauga

SEQ ID NO: 2314447 - RNA, 17 nt, Yersinia pestis KIM
aaugaggguaagugaau

SEQ ID NO: 2314448 - RNA, 12 nt, Yersinia pestis KIM
aaugauagcgag

SEQ ID NO: 2314449 - RNA, 20 nt, Yersinia pestis KIM
aaugaguuuuguccugagcc

SEQ ID NO: 2314450 - RNA, 22 nt, Yersinia pestis KIM
aaugauaacguuccauggcuga

SEQ ID NO: 2314451 - RNA, 17 nt, Yersinia pestis KIM
aaugacuuaacugaaag

SEQ ID NO: 2314452 - RNA, 16 nt, Yersinia pestis KIM
aaugagaauaucuaua

SEQ ID NO: 2314453 - RNA, 14 nt, Yersinia pestis KIM
aaugagauugauca

SEQ ID NO: 2314454 - RNA, 15 nt, Yersinia pestis KIM
aaugagccugaauaa

SEQ ID NO: 2314455 - RNA, 22 nt, Yersinia pestis KIM
aaugaaauugggggucagggcg

SEQ ID NO: 2314456 - RNA, 23 nt, Yersinia pestis KIM
aaugaaauugcgauuaggacaaa

SEQ ID NO: 2314457 - RNA, 17 nt, Yersinia pestis KIM
aaugaacggguuaauca

SEQ ID NO: 2314458 - RNA, 15 nt, Yersinia pestis KIM
aaugaauauuauuca

SEQ ID NO: 2314459 - RNA, 12 nt, Yersinia pestis KIM
aaucuuguuaau

SEQ ID NO: 2314460 - RNA, 17 nt, Yersinia pestis KIM
aaucuuguuaauuuaaa

SEQ ID NO: 2314461 - RNA, 22 nt, Yersinia pestis KIM
aaucuugugaugaaauuaaaau

SEQ ID NO: 2314462 - RNA, 22 nt, Yersinia pestis KIM
aaucuugugaugcauauuauaa

SEQ ID NO: 2314463 - RNA, 18 nt, Yersinia pestis KIM
aaucuuugccuauuucag

SEQ ID NO: 2314464 - RNA, 20 nt, Yersinia pestis KIM
aaucuuugccuauuucaggg

SEQ ID NO: 2314465 - RNA, 20 nt, Yersinia pestis KIM
aaucuuuuuguaauguuucu

SEQ ID NO: 2314466 - RNA, 18 nt, Yersinia pestis KIM
aauucuuaggauaaccaa

SEQ ID NO: 2314467 - RNA, 17 nt, Yersinia pestis KIM
aauucuguagaguaaaa

SEQ ID NO: 2314468 - RNA, 15 nt, Yersinia pestis KIM
aauucuguagaguaa

SEQ ID NO: 2314469 - RNA, 18 nt, Yersinia pestis KIM
aauucuguguaacugcca

SEQ ID NO: 2314470 - RNA, 23 nt, Yersinia pestis KIM
aauucgggcugaguaaagcccag

SEQ ID NO: 2314471 - RNA, 23 nt, Yersinia pestis KIM
aauucgccggggacuacacuacc

SEQ ID NO: 2314472 - RNA, 16 nt, Yersinia pestis KIM
aauucaaaauguauua

SEQ ID NO: 2314473 - RNA, 23 nt, Yersinia pestis KIM
aauucaaaauguauuauuuugua

SEQ ID NO: 2314474 - RNA, 11 nt, Yersinia pestis KIM
aauucaaaaua

SEQ ID NO: 2314475 - RNA, 16 nt, Yersinia pestis KIM
aauucgauaacagcua

SEQ ID NO: 2314476 - RNA, 18 nt, Yersinia pestis KIM
aauuccgccaguggcuuu

SEQ ID NO: 2314477 - RNA, 23 nt, Yersinia pestis KIM
aauugacgccacuuaucccaacu

SEQ ID NO: 2314478 - RNA, 23 nt, Yersinia pestis KIM
aauugacuuuaaaaaaauuauca

SEQ ID NO: 2314479 - RNA, 21 nt, Yersinia pestis KIM
aauucuuucaacgcauccaaa

SEQ ID NO: 2314480 - RNA, 18 nt, Yersinia pestis KIM
aauugaagcagauaaaga

SEQ ID NO: 2314481 - RNA, 23 nt, Yersinia pestis KIM
aauugauauuauuuauaugauaa

SEQ ID NO: 2314482 - RNA, 14 nt, Yersinia pestis KIM
aauugaucagggca

SEQ ID NO: 2314483 - RNA, 21 nt, Yersinia pestis KIM
aauugauauuauuuauaugau

SEQ ID NO: 2314484 - RNA, 16 nt, Yersinia pestis KIM
aauugaucugauauua

SEQ ID NO: 2314485 - RNA, 22 nt, Yersinia pestis KIM
aauugaugcacaguaggcugaa

SEQ ID NO: 2314486 - RNA, 21 nt, Yersinia pestis KIM
aauuacacacccucaacucaa

SEQ ID NO: 2314487 - RNA, 14 nt, Yersinia pestis KIM
aauuacgcacugcc

SEQ ID NO: 2314488 - RNA, 13 nt, Yersinia pestis KIM
aauuacacacccu

SEQ ID NO: 2314489 - RNA, 13 nt, Yersinia pestis KIM
aauuaauuuaaac

SEQ ID NO: 2314490 - RNA, 22 nt, Yersinia pestis KIM
aauuaaucuuguaaagacgcua

SEQ ID NO: 2314491 - RNA, 22 nt, Yersinia pestis KIM
aauggugucaucgcuaaauacu

SEQ ID NO: 2314492 - RNA, 12 nt, Yersinia pestis KIM
aauggucuugau

SEQ ID NO: 2314493 - RNA, 12 nt, Yersinia pestis KIM
aauggguauauu

SEQ ID NO: 2314494 - RNA, 14 nt, Yersinia pestis KIM
aaugggguaaugac

SEQ ID NO: 2314495 - RNA, 17 nt, Yersinia pestis KIM
aaugguaccggcaccaa

SEQ ID NO: 2314496 - RNA, 13 nt, Yersinia pestis KIM
aauuaaggaaaag

SEQ ID NO: 2314497 - RNA, 17 nt, Yersinia pestis KIM
aauuaaggaaacucaug

SEQ ID NO: 2314498 - RNA, 18 nt, Yersinia pestis KIM
aauuaaggugguuuuggc

SEQ ID NO: 2314499 - RNA, 23 nt, Yersinia pestis KIM
aauuaauaugccgacaaccaaca

SEQ ID NO: 2314500 - RNA, 17 nt, Yersinia pestis KIM
aauuaauaacaguauca

SEQ ID NO: 2314501 - RNA, 19 nt, Yersinia pestis KIM
aauuaauaaccauaaaaua

SEQ ID NO: 2314502 - RNA, 20 nt, Yersinia pestis KIM
aauuacugacgcuuauccug

SEQ ID NO: 2314503 - RNA, 14 nt, Yersinia pestis KIM
aauuagcgaaauau

SEQ ID NO: 2314504 - RNA, 23 nt, Yersinia pestis KIM
aauuagcggcaacgaucagaacg

SEQ ID NO: 2314505 - RNA, 16 nt, Yersinia pestis KIM
aauuagcacauaugca

SEQ ID NO: 2314506 - RNA, 18 nt, Yersinia pestis KIM
aauuacuucgcuuuaccc

SEQ ID NO: 2314507 - RNA, 12 nt, Yersinia pestis KIM
aauuaugauaaa

SEQ ID NO: 2314508 - RNA, 20 nt, Yersinia pestis KIM
aauuaguuuuaauaaccauu

SEQ ID NO: 2314509 - RNA, 15 nt, Yersinia pestis KIM
aauuagucucuuauu

SEQ ID NO: 2314510 - RNA, 17 nt, Yersinia pestis KIM
aauuagguaacuuucca

SEQ ID NO: 2314511 - RNA, 19 nt, Yersinia pestis KIM
aauuaggcuucuaacaaua

SEQ ID NO: 2314512 - RNA, 24 nt, Yersinia pestis KIM
aauuagggguugcaggcugucagg

SEQ ID NO: 2314513 - RNA, 17 nt, Yersinia pestis KIM
aauuauggcuauacuua

SEQ ID NO: 2314514 - RNA, 14 nt, Yersinia pestis KIM
aauuauuucaguag

SEQ ID NO: 2314515 - RNA, 18 nt, Yersinia pestis KIM
aauuauuucucugaugaa

SEQ ID NO: 2314516 - RNA, 16 nt, Yersinia pestis KIM
aauuauuuuauuuaaa

SEQ ID NO: 2314517 - RNA, 20 nt, Yersinia pestis KIM
aauuauuuuccagaugaaua

SEQ ID NO: 2314518 - RNA, 13 nt, Yersinia pestis KIM
aauuugaucacca

SEQ ID NO: 2314519 - RNA, 14 nt, Yersinia pestis KIM
aauuugaucaccaa

SEQ ID NO: 2314520 - RNA, 19 nt, Yersinia pestis KIM
aauuugauacagugauaaa

SEQ ID NO: 2314521 - RNA, 22 nt, Yersinia pestis KIM
aauuucuugucaccugaguaau

SEQ ID NO: 2314522 - RNA, 16 nt, Yersinia pestis KIM
aauuugcacugcaggg

SEQ ID NO: 2314523 - RNA, 14 nt, Yersinia pestis KIM
aauuugccauacca

SEQ ID NO: 2314524 - RNA, 19 nt, Yersinia pestis KIM
aauuugcuccuggcaugca

SEQ ID NO: 2314525 - RNA, 14 nt, Yersinia pestis KIM
aauuugcugcucga

SEQ ID NO: 2314526 - RNA, 21 nt, Yersinia pestis KIM
aauuugguucacggaaaguag

SEQ ID NO: 2314527 - RNA, 21 nt, Yersinia pestis KIM
aauuugucguuuacuggcugc

SEQ ID NO: 2314528 - RNA, 15 nt, Yersinia pestis KIM
aauuuuacguucaga

SEQ ID NO: 2314529 - RNA, 13 nt, Yersinia pestis KIM
aauuuuauucagc

SEQ ID NO: 2314530 - RNA, 16 nt, Yersinia pestis KIM
aauuuuauucagcaag

SEQ ID NO: 2314531 - RNA, 12 nt, Yersinia pestis KIM
aauuuuauauua

SEQ ID NO: 2314532 - RNA, 15 nt, Yersinia pestis KIM
aauuuuauauuauua

SEQ ID NO: 2314533 - RNA, 19 nt, Yersinia pestis KIM
aauuuuauauuauuauaaa

SEQ ID NO: 2314534 - RNA, 13 nt, Yersinia pestis KIM
aauuuucaguuca

SEQ ID NO: 2314535 - RNA, 22 nt, Yersinia pestis KIM
aauuuuauucgcguuucauuuu

SEQ ID NO: 2314536 - RNA, 20 nt, Yersinia pestis KIM
aauuuuauuguuuucguuua

SEQ ID NO: 2314537 - RNA, 16 nt, Yersinia pestis KIM
aauuuugguacaggug

SEQ ID NO: 2314538 - RNA, 21 nt, Yersinia pestis KIM
aauuuuguacaacuucuucau

SEQ ID NO: 2314539 - RNA, 15 nt, Yersinia pestis KIM
aauuuucucagaaaa

SEQ ID NO: 2314540 - RNA, 15 nt, Yersinia pestis KIM
aauugcucacucacc

SEQ ID NO: 2314541 - RNA, 16 nt, Yersinia pestis KIM
aauuuacgagagugua

SEQ ID NO: 2314542 - RNA, 20 nt, Yersinia pestis KIM
aauuuagacagcuuaaaauc

SEQ ID NO: 2314543 - RNA, 13 nt, Yersinia pestis KIM
aauuuauuauuua

SEQ ID NO: 2314544 - RNA, 19 nt, Yersinia pestis KIM
aauuuaucugcuaauuaaa

SEQ ID NO: 2314545 - RNA, 20 nt, Yersinia pestis KIM
aauuuaucugcuaauuaaac

SEQ ID NO: 2314546 - RNA, 23 nt, Yersinia pestis KIM
aauuuaucugcuaauuaaaccug

SEQ ID NO: 2314547 - RNA, 14 nt, Yersinia pestis KIM
aauuuaucagacaa

SEQ ID NO: 2314548 - RNA, 13 nt, Yersinia pestis KIM
aauuuaucaaaca

SEQ ID NO: 2314549 - RNA, 14 nt, Yersinia pestis KIM
aauuuagcaaagcg

SEQ ID NO: 2314550 - RNA, 13 nt, Yersinia pestis KIM
aauuucauuuacg

SEQ ID NO: 2314551 - RNA, 20 nt, Yersinia pestis KIM
aauuucauuuuaaaaucgua

SEQ ID NO: 2314552 - RNA, 18 nt, Yersinia pestis KIM
aauuucacuggcaccgcu

SEQ ID NO: 2314553 - RNA, 21 nt, Yersinia pestis KIM
aauuucacuaucguuagcaua

SEQ ID NO: 2314554 - RNA, 14 nt, Yersinia pestis KIM
aauuucaccacauc

SEQ ID NO: 2314555 - RNA, 20 nt, Yersinia pestis KIM
aauuucaggucgauuacaua

SEQ ID NO: 2314556 - RNA, 15 nt, Yersinia pestis KIM
aauuucagcuuuuag

SEQ ID NO: 2314557 - RNA, 23 nt, Yersinia pestis KIM
aauuucagcagcacguucaccaa

SEQ ID NO: 2314558 - RNA, 13 nt, Yersinia pestis KIM
aauuucagauaaa

SEQ ID NO: 2314559 - RNA, 19 nt, Yersinia pestis KIM
aauuucagauaaaaauaau

SEQ ID NO: 2314560 - RNA, 23 nt, Yersinia pestis KIM
aauuucucucaauauauucucuu

SEQ ID NO: 2314561 - RNA, 23 nt, Yersinia pestis KIM
aauuucucggccaacaucuucca

SEQ ID NO: 2314562 - RNA, 16 nt, Yersinia pestis KIM
aauuucuguuaccaga

SEQ ID NO: 2314563 - RNA, 15 nt, Yersinia pestis KIM
accaccauuaacaag

SEQ ID NO: 2314564 - RNA, 11 nt, Yersinia pestis KIM
accacccacgu

SEQ ID NO: 2314565 - RNA, 21 nt, Yersinia pestis KIM
accacccguugcauuuuucug

SEQ ID NO: 2314566 - RNA, 13 nt, Yersinia pestis KIM
accaccgucaaga

SEQ ID NO: 2314567 - RNA, 20 nt, Yersinia pestis KIM
accaccgucaagacaacaaa

SEQ ID NO: 2314568 - RNA, 15 nt, Yersinia pestis KIM
accaccuaauacagc

SEQ ID NO: 2314569 - RNA, 20 nt, Yersinia pestis KIM
accaccuaauacagcaccac

SEQ ID NO: 2314570 - RNA, 22 nt, Yersinia pestis KIM
accaccuaauacagcaccaccg

SEQ ID NO: 2314571 - RNA, 19 nt, Yersinia pestis KIM
accacuugcuaccaagacu

SEQ ID NO: 2314572 - RNA, 14 nt, Yersinia pestis KIM
accacuuuccaggu

SEQ ID NO: 2314573 - RNA, 18 nt, Yersinia pestis KIM
accacugacaaaaacagc

SEQ ID NO: 2314574 - RNA, 12 nt, Yersinia pestis KIM
accacugaccua

SEQ ID NO: 2314575 - RNA, 14 nt, Yersinia pestis KIM
accacugaccuauu

SEQ ID NO: 2314576 - RNA, 21 nt, Yersinia pestis KIM
accacugaccuauugauaaaa

SEQ ID NO: 2314577 - RNA, 18 nt, Yersinia pestis KIM
accacugaguugcucaag

SEQ ID NO: 2314578 - RNA, 14 nt, Yersinia pestis KIM
accacugauuaaga

SEQ ID NO: 2314579 - RNA, 17 nt, Yersinia pestis KIM
accacuaguuaaaacca

SEQ ID NO: 2314580 - RNA, 19 nt, Yersinia pestis KIM
accacgcauuccaucagcc

SEQ ID NO: 2314581 - RNA, 16 nt, Yersinia pestis KIM
accacggccagaauca

SEQ ID NO: 2314582 - RNA, 16 nt, Yersinia pestis KIM
accacgguaucaauca

SEQ ID NO: 2314583 - RNA, 19 nt, Yersinia pestis KIM
accacagauaaauaaaaua

SEQ ID NO: 2314584 - RNA, 22 nt, Yersinia pestis KIM
accacacugagcaccgcaggaa

SEQ ID NO: 2314585 - RNA, 20 nt, Yersinia pestis KIM
accacacugagcaccgcagg

SEQ ID NO: 2314586 - RNA, 18 nt, Yersinia pestis KIM
accacagauaaauaaaau

SEQ ID NO: 2314587 - RNA, 15 nt, Yersinia pestis KIM
accacaccggcugca

SEQ ID NO: 2314588 - RNA, 15 nt, Yersinia pestis KIM
accacaucacgcagc

SEQ ID NO: 2314589 - RNA, 13 nt, Yersinia pestis KIM
accacaucaaacc

SEQ ID NO: 2314590 - RNA, 18 nt, Yersinia pestis KIM
accacaucaaccugauca

SEQ ID NO: 2314591 - RNA, 14 nt, Yersinia pestis KIM
accaccacggccag

SEQ ID NO: 2314592 - RNA, 17 nt, Yersinia pestis KIM
accaccaacuccugccu

SEQ ID NO: 2314593 - RNA, 13 nt, Yersinia pestis KIM
accaccaccaaca

SEQ ID NO: 2314594 - RNA, 15 nt, Yersinia pestis KIM
accaccaccaacagc

SEQ ID NO: 2314595 - RNA, 14 nt, Yersinia pestis KIM
accaccaacagcau

SEQ ID NO: 2314596 - RNA, 22 nt, Yersinia pestis KIM
accacaauauggggugcuucaa

SEQ ID NO: 2314597 - RNA, 16 nt, Yersinia pestis KIM
accacaaaggcaaaau

SEQ ID NO: 2314598 - RNA, 19 nt, Yersinia pestis KIM
accacaaaggcaaaaugau

SEQ ID NO: 2314599 - RNA, 16 nt, Yersinia pestis KIM
accacaaaaacagugu

SEQ ID NO: 2314600 - RNA, 18 nt, Yersinia pestis KIM
accacaaaaacaguguca

SEQ ID NO: 2314601 - RNA, 17 nt, Yersinia pestis KIM
accaaugguuucaccgu

SEQ ID NO: 2314602 - RNA, 21 nt, Yersinia pestis KIM
accaaugggguaaucacuaca

SEQ ID NO: 2314603 - RNA, 19 nt, Yersinia pestis KIM
accaaugucucaggauaca

SEQ ID NO: 2314604 - RNA, 12 nt, Yersinia pestis KIM
accaauuaauaa

SEQ ID NO: 2314605 - RNA, 12 nt, Yersinia pestis KIM
accaauucuuag

SEQ ID NO: 2314606 - RNA, 16 nt, Yersinia pestis KIM
accaauugguuugaca

SEQ ID NO: 2314607 - RNA, 22 nt, Yersinia pestis KIM
accaauuguauaaggcggugca

SEQ ID NO: 2314608 - RNA, 21 nt, Yersinia pestis KIM
accaauugaugucaugauaaa

SEQ ID NO: 2314609 - RNA, 19 nt, Yersinia pestis KIM
accaacgaaaucacccggc

SEQ ID NO: 2314610 - RNA, 18 nt, Yersinia pestis KIM
acauuucguuuaaagccu

SEQ ID NO: 2314611 - RNA, 14 nt, Yersinia pestis KIM
accaagcuuugccu

SEQ ID NO: 2314612 - RNA, 20 nt, Yersinia pestis KIM
accaagcccuuuggcaauca

SEQ ID NO: 2314613 - RNA, 17 nt, Yersinia pestis KIM
accaaguucggagauuu

SEQ ID NO: 2314614 - RNA, 17 nt, Yersinia pestis KIM
accaaugccgguccaga

SEQ ID NO: 2314615 - RNA, 21 nt, Yersinia pestis KIM
accaaugcacguaaagaguua

SEQ ID NO: 2314616 - RNA, 15 nt, Yersinia pestis KIM
accaaucuccaauga

SEQ ID NO: 2314617 - RNA, 18 nt, Yersinia pestis KIM
accaaucguugcugguua

SEQ ID NO: 2314618 - RNA, 17 nt, Yersinia pestis KIM
accaauagucacgucuu

SEQ ID NO: 2314619 - RNA, 14 nt, Yersinia pestis KIM
accaauauaaaagc

SEQ ID NO: 2314620 - RNA, 20 nt, Yersinia pestis KIM
accaaucaaaaauugcccca

SEQ ID NO: 2314621 - RNA, 21 nt, Yersinia pestis KIM
accaaucaaaaauugccccac

SEQ ID NO: 2314622 - RNA, 21 nt, Yersinia pestis KIM
acaggccgcuuccgauaacca

SEQ ID NO: 2314623 - RNA, 18 nt, Yersinia pestis KIM
acaggccccaauccacca

SEQ ID NO: 2314624 - RNA, 14 nt, Yersinia pestis KIM
acaggauuaaauaa

SEQ ID NO: 2314625 - RNA, 17 nt, Yersinia pestis KIM
acauacucaccucccug

SEQ ID NO: 2314626 - RNA, 21 nt, Yersinia pestis KIM
acauacuuuucauuuccucug

SEQ ID NO: 2314627 - RNA, 20 nt, Yersinia pestis KIM
acauagaagcucauaugcag

SEQ ID NO: 2314628 - RNA, 14 nt, Yersinia pestis KIM
acauagguuuuuuc

SEQ ID NO: 2314629 - RNA, 15 nt, Yersinia pestis KIM
acauagcgcauccaa

SEQ ID NO: 2314630 - RNA, 18 nt, Yersinia pestis KIM
acauagcgcauccaaccu

SEQ ID NO: 2314631 - RNA, 21 nt, Yersinia pestis KIM
acauaucuuuauuaucaaugg

SEQ ID NO: 2314632 - RNA, 19 nt, Yersinia pestis KIM
acauaucuuuauuaucaau

SEQ ID NO: 2314633 - RNA, 14 nt, Yersinia pestis KIM
acauauauuaucua

SEQ ID NO: 2314634 - RNA, 18 nt, Yersinia pestis KIM
acauauccugugccaaca

SEQ ID NO: 2314635 - RNA, 17 nt, Yersinia pestis KIM
acauauaaccaucaaau

SEQ ID NO: 2314636 - RNA, 21 nt, Yersinia pestis KIM
acauauaaaccagccagugau

SEQ ID NO: 2314637 - RNA, 15 nt, Yersinia pestis KIM
acauauaaaccagcc

SEQ ID NO: 2314638 - RNA, 12 nt, Yersinia pestis KIM
acaucaucaccu

SEQ ID NO: 2314639 - RNA, 11 nt, Yersinia pestis KIM
acauccacauu

SEQ ID NO: 2314640 - RNA, 16 nt, Yersinia pestis KIM
acauccagauauggca

SEQ ID NO: 2314641 - RNA, 23 nt, Yersinia pestis KIM
acaucaggcuuagcgacacccac

SEQ ID NO: 2314642 - RNA, 18 nt, Yersinia pestis KIM
acaucaggccuucuuuuc

SEQ ID NO: 2314643 - RNA, 14 nt, Yersinia pestis KIM
acaucagcgccaca

SEQ ID NO: 2314644 - RNA, 16 nt, Yersinia pestis KIM
acaucaaaccggcuaa

SEQ ID NO: 2314645 - RNA, 15 nt, Yersinia pestis KIM
acauuauuuuucacg

SEQ ID NO: 2314646 - RNA, 13 nt, Yersinia pestis KIM
acauuauuuuuca

SEQ ID NO: 2314647 - RNA, 16 nt, Yersinia pestis KIM
acauuccaguaaaaaa

SEQ ID NO: 2314648 - RNA, 16 nt, Yersinia pestis KIM
acauuaacuucagguu

SEQ ID NO: 2314649 - RNA, 11 nt, Yersinia pestis KIM
acauuaacaca

SEQ ID NO: 2314650 - RNA, 18 nt, Yersinia pestis KIM
acauuauccguuugcaac

SEQ ID NO: 2314651 - RNA, 23 nt, Yersinia pestis KIM
acauuauccguuugcaacaguua

SEQ ID NO: 2314652 - RNA, 19 nt, Yersinia pestis KIM
acauuaaaaauacaaccaa

SEQ ID NO: 2314653 - RNA, 23 nt, Yersinia pestis KIM
acauucucuacucgcucaccacu

SEQ ID NO: 2314654 - RNA, 19 nt, Yersinia pestis KIM
acauucugauagugauuuu

SEQ ID NO: 2314655 - RNA, 20 nt, Yersinia pestis KIM
acaucgaccauagagcaacc

SEQ ID NO: 2314656 - RNA, 17 nt, Yersinia pestis KIM
acaucgagcgggcuuca

SEQ ID NO: 2314657 - RNA, 21 nt, Yersinia pestis KIM
acaucgagcgggcuucaccau

SEQ ID NO: 2314658 - RNA, 16 nt, Yersinia pestis KIM
acauccgaauuuuuac

SEQ ID NO: 2314659 - RNA, 21 nt, Yersinia pestis KIM
acaucgaagcugucuuuuaaa

SEQ ID NO: 2314660 - RNA, 17 nt, Yersinia pestis KIM
acaugaguaagugauuc

SEQ ID NO: 2314661 - RNA, 21 nt, Yersinia pestis KIM
acaugcagcccgaccaaacgg

SEQ ID NO: 2314662 - RNA, 14 nt, Yersinia pestis KIM
acaugcaacuugag

SEQ ID NO: 2314663 - RNA, 14 nt, Yersinia pestis KIM
acaugccagaaacg

SEQ ID NO: 2314664 - RNA, 18 nt, Yersinia pestis KIM
acaugauugaaaaacaga

SEQ ID NO: 2314665 - RNA, 19 nt, Yersinia pestis KIM
acauggcggcagcacagag

SEQ ID NO: 2314666 - RNA, 15 nt, Yersinia pestis KIM
acauguuccagugcu

SEQ ID NO: 2314667 - RNA, 15 nt, Yersinia pestis KIM
acagacaaacaaccu

SEQ ID NO: 2314668 - RNA, 21 nt, Yersinia pestis KIM
acagacaaacaaccuaaaaaa

SEQ ID NO: 2314669 - RNA, 15 nt, Yersinia pestis KIM
acagacacagcaaca

SEQ ID NO: 2314670 - RNA, 15 nt, Yersinia pestis KIM
acagacauuugcaac

SEQ ID NO: 2314671 - RNA, 16 nt, Yersinia pestis KIM
acagaccccagaagau

SEQ ID NO: 2314672 - RNA, 23 nt, Yersinia pestis KIM
acagacguuuaaauaagcuauca

SEQ ID NO: 2314673 - RNA, 14 nt, Yersinia pestis KIM
acacuuuugcuggu

SEQ ID NO: 2314674 - RNA, 23 nt, Yersinia pestis KIM
acacuuuugcuggugucacaauc

SEQ ID NO: 2314675 - RNA, 17 nt, Yersinia pestis KIM
acagaaaaauaacaucc

SEQ ID NO: 2314676 - RNA, 22 nt, Yersinia pestis KIM
acacuucgccaggucaggaaga

SEQ ID NO: 2314677 - RNA, 22 nt, Yersinia pestis KIM
acagaacccccgcgaacagcag

SEQ ID NO: 2314678 - RNA, 13 nt, Yersinia pestis KIM
acagaacgcaauc

SEQ ID NO: 2314679 - RNA, 21 nt, Yersinia pestis KIM
acagaacuaauaucaacagaa

SEQ ID NO: 2314680 - RNA, 12 nt, Yersinia pestis KIM
acagaaaucaau

SEQ ID NO: 2314681 - RNA, 15 nt, Yersinia pestis KIM
acagaaacgauuacc

SEQ ID NO: 2314682 - RNA, 19 nt, Yersinia pestis KIM
acacccucaacucaaaaca

SEQ ID NO: 2314683 - RNA, 20 nt, Yersinia pestis KIM
acacccucaacucaaaacaa

SEQ ID NO: 2314684 - RNA, 22 nt, Yersinia pestis KIM
acacccguuccuucagccacca

SEQ ID NO: 2314685 - RNA, 17 nt, Yersinia pestis KIM
acaccauuuccaggcua

SEQ ID NO: 2314686 - RNA, 12 nt, Yersinia pestis KIM
acaccauuucca

SEQ ID NO: 2314687 - RNA, 17 nt, Yersinia pestis KIM
acacccuccuauuaaua

SEQ ID NO: 2314688 - RNA, 20 nt, Yersinia pestis KIM
acacccucucuuuccagcaa

SEQ ID NO: 2314689 - RNA, 19 nt, Yersinia pestis KIM
acacuaccuucaucugcac

SEQ ID NO: 2314690 - RNA, 21 nt, Yersinia pestis KIM
acacuaccuucaucugcacug

SEQ ID NO: 2314691 - RNA, 14 nt, Yersinia pestis KIM
acacguuaaacccu

SEQ ID NO: 2314692 - RNA, 22 nt, Yersinia pestis KIM
acacucagaugaaaaacugugc

SEQ ID NO: 2314693 - RNA, 13 nt, Yersinia pestis KIM
acacuccauuaau

SEQ ID NO: 2314694 - RNA, 21 nt, Yersinia pestis KIM
acacugauuuauaaauaauua

SEQ ID NO: 2314695 - RNA, 15 nt, Yersinia pestis KIM
acacugccugaugcu

SEQ ID NO: 2314696 - RNA, 19 nt, Yersinia pestis KIM
acacugcaucucugcaucu

SEQ ID NO: 2314697 - RNA, 18 nt, Yersinia pestis KIM
acacuuauuugaaauacu

SEQ ID NO: 2314698 - RNA, 13 nt, Yersinia pestis KIM
acacuuaccuaua

SEQ ID NO: 2314699 - RNA, 23 nt, Yersinia pestis KIM
acacuuaccuauaaacauuuacu

SEQ ID NO: 2314700 - RNA, 16 nt, Yersinia pestis KIM
acacuguuuaguucac

SEQ ID NO: 2314701 - RNA, 17 nt, Yersinia pestis KIM
acagccccaaccaucuc

SEQ ID NO: 2314702 - RNA, 17 nt, Yersinia pestis KIM
acagcauucugcuucca

SEQ ID NO: 2314703 - RNA, 18 nt, Yersinia pestis KIM
acagcauuaccaaggaaa

SEQ ID NO: 2314704 - RNA, 23 nt, Yersinia pestis KIM
acagcauuaccaaggaaaccacc

SEQ ID NO: 2314705 - RNA, 17 nt, Yersinia pestis KIM
acagcauuuaugcugcc

SEQ ID NO: 2314706 - RNA, 12 nt, Yersinia pestis KIM
acagcccaagag

SEQ ID NO: 2314707 - RNA, 15 nt, Yersinia pestis KIM
acagcccaagagaaa

SEQ ID NO: 2314708 - RNA, 19 nt, Yersinia pestis KIM
acagcucggccagcauuca

SEQ ID NO: 2314709 - RNA, 21 nt, Yersinia pestis KIM
acaggaucaggccagagacac

SEQ ID NO: 2314710 - RNA, 16 nt, Yersinia pestis KIM
acaggauaaucaucag

SEQ ID NO: 2314711 - RNA, 14 nt, Yersinia pestis KIM
acagagcacaacgg

SEQ ID NO: 2314712 - RNA, 21 nt, Yersinia pestis KIM
acagagccagaauaucgugga

SEQ ID NO: 2314713 - RNA, 14 nt, Yersinia pestis KIM
acagauaauaugac

SEQ ID NO: 2314714 - RNA, 15 nt, Yersinia pestis KIM
acagauaaauaaaau

SEQ ID NO: 2314715 - RNA, 20 nt, Yersinia pestis KIM
acagauaaaaaauaauuaaa

SEQ ID NO: 2314716 - RNA, 22 nt, Yersinia pestis KIM
acagauauuacgcagccauacc

SEQ ID NO: 2314717 - RNA, 15 nt, Yersinia pestis KIM
acagauauagcgugc

SEQ ID NO: 2314718 - RNA, 17 nt, Yersinia pestis KIM
acagcaccauuaucuuc

SEQ ID NO: 2314719 - RNA, 14 nt, Yersinia pestis KIM
acagcacucaguac

SEQ ID NO: 2314720 - RNA, 15 nt, Yersinia pestis KIM
acagcacucaguaca

SEQ ID NO: 2314721 - RNA, 15 nt, Yersinia pestis KIM
acagcacguaccgcu

SEQ ID NO: 2314722 - RNA, 22 nt, Yersinia pestis KIM
acagcagaacaaaacaagcccc

SEQ ID NO: 2314723 - RNA, 16 nt, Yersinia pestis KIM
acagcacgguaaccuu

SEQ ID NO: 2314724 - RNA, 16 nt, Yersinia pestis KIM
acagcacggcaacagg

SEQ ID NO: 2314725 - RNA, 15 nt, Yersinia pestis KIM
acagcauauaaaaaa

SEQ ID NO: 2314726 - RNA, 16 nt, Yersinia pestis KIM
acagcaucacugucua

SEQ ID NO: 2314727 - RNA, 21 nt, Yersinia pestis KIM
acacaccagucugcauacaga

SEQ ID NO: 2314728 - RNA, 14 nt, Yersinia pestis KIM
acaauuucgcuggu

SEQ ID NO: 2314729 - RNA, 19 nt, Yersinia pestis KIM
acaauuaauaugccgacaa

SEQ ID NO: 2314730 - RNA, 13 nt, Yersinia pestis KIM
acaauuacacacc

SEQ ID NO: 2314731 - RNA, 15 nt, Yersinia pestis KIM
acaauuauagccaaa

SEQ ID NO: 2314732 - RNA, 17 nt, Yersinia pestis KIM
acaauugcuccaguuga

SEQ ID NO: 2314733 - RNA, 14 nt, Yersinia pestis KIM
acaaugcuguuuug

SEQ ID NO: 2314734 - RNA, 16 nt, Yersinia pestis KIM
acaauggccggacuca

SEQ ID NO: 2314735 - RNA, 22 nt, Yersinia pestis KIM
acaaugucacgcuuuaaaacug

SEQ ID NO: 2314736 - RNA, 21 nt, Yersinia pestis KIM
acaauauguuuagucuguuac

SEQ ID NO: 2314737 - RNA, 15 nt, Yersinia pestis KIM
acaauaucuucccug

SEQ ID NO: 2314738 - RNA, 17 nt, Yersinia pestis KIM
acaauauggguauuagg

SEQ ID NO: 2314739 - RNA, 20 nt, Yersinia pestis KIM
acaauauccguuuacgacaa

SEQ ID NO: 2314740 - RNA, 14 nt, Yersinia pestis KIM
acaaucuucuucag

SEQ ID NO: 2314741 - RNA, 19 nt, Yersinia pestis KIM
acacaucuuccaguacaga

SEQ ID NO: 2314742 - RNA, 17 nt, Yersinia pestis KIM
acacaucgaagcugucu

SEQ ID NO: 2314743 - RNA, 21 nt, Yersinia pestis KIM
acacauacuucgaugauuauu

SEQ ID NO: 2314744 - RNA, 13 nt, Yersinia pestis KIM
acacauaaccauc

SEQ ID NO: 2314745 - RNA, 12 nt, Yersinia pestis KIM
acaccaucagua

SEQ ID NO: 2314746 - RNA, 15 nt, Yersinia pestis KIM
acaccauagccacgc

SEQ ID NO: 2314747 - RNA, 18 nt, Yersinia pestis KIM
acaccauagcgguuuauu

SEQ ID NO: 2314748 - RNA, 14 nt, Yersinia pestis KIM
acacaguauucugc

SEQ ID NO: 2314749 - RNA, 14 nt, Yersinia pestis KIM
acacagguucccau

SEQ ID NO: 2314750 - RNA, 22 nt, Yersinia pestis KIM
acacagguucccaucccuuuga

SEQ ID NO: 2314751 - RNA, 23 nt, Yersinia pestis KIM
acacagcccugccuggcaggaag

SEQ ID NO: 2314752 - RNA, 14 nt, Yersinia pestis KIM
acacagccagccuu

SEQ ID NO: 2314753 - RNA, 23 nt, Yersinia pestis KIM
acacaccugcaacguuaaagaug

SEQ ID NO: 2314754 - RNA, 13 nt, Yersinia pestis KIM
acacaccugcaac

SEQ ID NO: 2314755 - RNA, 16 nt, Yersinia pestis KIM
acacagaaucaccaac

SEQ ID NO: 2314756 - RNA, 19 nt, Yersinia pestis KIM
acacagacuggugaacgaa

SEQ ID NO: 2314757 - RNA, 21 nt, Yersinia pestis KIM
acaagccagcgaggcuucuca

SEQ ID NO: 2314758 - RNA, 14 nt, Yersinia pestis KIM
acaagccaacauug

SEQ ID NO: 2314759 - RNA, 12 nt, Yersinia pestis KIM
acaagccaaaca

SEQ ID NO: 2314760 - RNA, 15 nt, Yersinia pestis KIM
acaagugccaaaugg

SEQ ID NO: 2314761 - RNA, 15 nt, Yersinia pestis KIM
acaauaaauauccuc

SEQ ID NO: 2314762 - RNA, 13 nt, Yersinia pestis KIM
acaauaaaucaau

SEQ ID NO: 2314763 - RNA, 13 nt, Yersinia pestis KIM
acaacguuucugg

SEQ ID NO: 2314764 - RNA, 18 nt, Yersinia pestis KIM
acaacugacaacaucaaa

SEQ ID NO: 2314765 - RNA, 18 nt, Yersinia pestis KIM
acaacucaccgccgacca

SEQ ID NO: 2314766 - RNA, 18 nt, Yersinia pestis KIM
acaacugguuaucacugu

SEQ ID NO: 2314767 - RNA, 15 nt, Yersinia pestis KIM
acaacuuccacacaa

SEQ ID NO: 2314768 - RNA, 15 nt, Yersinia pestis KIM
acaacuuucccaguc

SEQ ID NO: 2314769 - RNA, 20 nt, Yersinia pestis KIM
acaacgcuuaucaaagugcu

SEQ ID NO: 2314770 - RNA, 15 nt, Yersinia pestis KIM
acaacgcuccagguu

SEQ ID NO: 2314771 - RNA, 18 nt, Yersinia pestis KIM
acaacgcugaaaaaucuu

SEQ ID NO: 2314772 - RNA, 21 nt, Yersinia pestis KIM
acaacggguuuucuguuuuug

SEQ ID NO: 2314773 - RNA, 16 nt, Yersinia pestis KIM
aauuuuugauacuguu

SEQ ID NO: 2314774 - RNA, 16 nt, Yersinia pestis KIM
aagccucaugaaugag

SEQ ID NO: 2314775 - RNA, 19 nt, Yersinia pestis KIM
aagccucggucacugccug

SEQ ID NO: 2314776 - RNA, 21 nt, Yersinia pestis KIM
aagccugcaccauauucccag

SEQ ID NO: 2314777 - RNA, 22 nt, Yersinia pestis KIM
aagcgaucgaccgaguguaaaa

SEQ ID NO: 2314778 - RNA, 16 nt, Yersinia pestis KIM
aagcgacacuuauugg

SEQ ID NO: 2314779 - RNA, 16 nt, Yersinia pestis KIM
aagccgugaccaaagu

SEQ ID NO: 2314780 - RNA, 22 nt, Yersinia pestis KIM
aagccgugaccaaagugcucac

SEQ ID NO: 2314781 - RNA, 22 nt, Yersinia pestis KIM
aagccguaacugaccgcagccu

SEQ ID NO: 2314782 - RNA, 22 nt, Yersinia pestis KIM
aagcgauuagucccuaaagagc

SEQ ID NO: 2314783 - RNA, 20 nt, Yersinia pestis KIM
aagcgauugccggaagguca

SEQ ID NO: 2314784 - RNA, 12 nt, Yersinia pestis KIM
aagcgcagugcu

SEQ ID NO: 2314785 - RNA, 22 nt, Yersinia pestis KIM
aagcgccgugcauaauggacga

SEQ ID NO: 2314786 - RNA, 11 nt, Yersinia pestis KIM
aagcgcccuga

SEQ ID NO: 2314787 - RNA, 21 nt, Yersinia pestis KIM
aagcgcccuucggacggcuga

SEQ ID NO: 2314788 - RNA, 23 nt, Yersinia pestis KIM
aagcgccuuccuuuuauuuagag

SEQ ID NO: 2314789 - RNA, 21 nt, Yersinia pestis KIM
aagcuacuaauggagagaugu

SEQ ID NO: 2314790 - RNA, 17 nt, Yersinia pestis KIM
aagcuacagcucagacu

SEQ ID NO: 2314791 - RNA, 17 nt, Yersinia pestis KIM
aagcgguuucauggcug

SEQ ID NO: 2314792 - RNA, 18 nt, Yersinia pestis KIM
aagcgguuuguuaaaaag

SEQ ID NO: 2314793 - RNA, 18 nt, Yersinia pestis KIM
aagcgguuuuaucaauag

SEQ ID NO: 2314794 - RNA, 19 nt, Yersinia pestis KIM
aagcucauaugcagcaucc

SEQ ID NO: 2314795 - RNA, 13 nt, Yersinia pestis KIM
aagcucauaugca

SEQ ID NO: 2314796 - RNA, 11 nt, Yersinia pestis KIM
aagcucaagcu

SEQ ID NO: 2314797 - RNA, 20 nt, Yersinia pestis KIM
aagcuggcgcacucauccuc

SEQ ID NO: 2314798 - RNA, 22 nt, Yersinia pestis KIM
aagcugcuuuuaccgcagggcg

SEQ ID NO: 2314799 - RNA, 14 nt, Yersinia pestis KIM
aaggauggcccaag

SEQ ID NO: 2314800 - RNA, 14 nt, Yersinia pestis KIM
aaggaugaauaaau

SEQ ID NO: 2314801 - RNA, 16 nt, Yersinia pestis KIM
aaggacaaugaaucga

SEQ ID NO: 2314802 - RNA, 21 nt, Yersinia pestis KIM
aaggacgacggguauauugcc

SEQ ID NO: 2314803 - RNA, 19 nt, Yersinia pestis KIM
aaggaagggguucuuccaa

SEQ ID NO: 2314804 - RNA, 14 nt, Yersinia pestis KIM
aaggccaauuggcu

SEQ ID NO: 2314805 - RNA, 16 nt, Yersinia pestis KIM
aaggcccuaaccaauu

SEQ ID NO: 2314806 - RNA, 16 nt, Yersinia pestis KIM
aaggccagcagaacua

SEQ ID NO: 2314807 - RNA, 17 nt, Yersinia pestis KIM
aaggccagcagaacuaa

SEQ ID NO: 2314808 - RNA, 16 nt, Yersinia pestis KIM
aaggcaucaaccaguu

SEQ ID NO: 2314809 - RNA, 13 nt, Yersinia pestis KIM
aaggcauccacau

SEQ ID NO: 2314810 - RNA, 23 nt, Yersinia pestis KIM
aaggcacaucuccagaauauaaa

SEQ ID NO: 2314811 - RNA, 13 nt, Yersinia pestis KIM
aaggcagugacag

SEQ ID NO: 2314812 - RNA, 16 nt, Yersinia pestis KIM
aaggcagcaagugaau

SEQ ID NO: 2314813 - RNA, 22 nt, Yersinia pestis KIM
aaggcacaucuccagaauauaa

SEQ ID NO: 2314814 - RNA, 13 nt, Yersinia pestis KIM
aaggcaccagcgc

SEQ ID NO: 2314815 - RNA, 19 nt, Yersinia pestis KIM
aaggccggauguaaaacac

SEQ ID NO: 2314816 - RNA, 21 nt, Yersinia pestis KIM
aaggcuaaccggguggcccaa

SEQ ID NO: 2314817 - RNA, 16 nt, Yersinia pestis KIM
aaggcuuuauauugcc

SEQ ID NO: 2314818 - RNA, 14 nt, Yersinia pestis KIM
aaggcucuguuacc

SEQ ID NO: 2314819 - RNA, 22 nt, Yersinia pestis KIM
aaggcuggagcaagugcuucaa

SEQ ID NO: 2314820 - RNA, 14 nt, Yersinia pestis KIM
aaggcugauuaaua

SEQ ID NO: 2314821 - RNA, 15 nt, Yersinia pestis KIM
aaguuacgucagaaa

SEQ ID NO: 2314822 - RNA, 15 nt, Yersinia pestis KIM
aaguugaacaguggu

SEQ ID NO: 2314823 - RNA, 14 nt, Yersinia pestis KIM
aaguugagaucaac

SEQ ID NO: 2314824 - RNA, 22 nt, Yersinia pestis KIM
aaguuaaacaauguuaaacuuu

SEQ ID NO: 2314825 - RNA, 11 nt, Yersinia pestis KIM
aaguuaaaaaa

SEQ ID NO: 2314826 - RNA, 15 nt, Yersinia pestis KIM
aaguuaaacaauguu

SEQ ID NO: 2314827 - RNA, 14 nt, Yersinia pestis KIM
aaguguuucaaaua

SEQ ID NO: 2314828 - RNA, 16 nt, Yersinia pestis KIM
aaguguuucaaauaag

SEQ ID NO: 2314829 - RNA, 21 nt, Yersinia pestis KIM
aaguguucacucaguugauca

SEQ ID NO: 2314830 - RNA, 18 nt, Yersinia pestis KIM
aagugacccaagaugacc

SEQ ID NO: 2314831 - RNA, 21 nt, Yersinia pestis KIM
aagugcccccuguaacgcuaa

SEQ ID NO: 2314832 - RNA, 15 nt, Yersinia pestis KIM
aaguccgucuuguau

SEQ ID NO: 2314833 - RNA, 23 nt, Yersinia pestis KIM
aaguccuucggacgcuccucacu

SEQ ID NO: 2314834 - RNA, 17 nt, Yersinia pestis KIM
aagucaugguacaacug

SEQ ID NO: 2314835 - RNA, 22 nt, Yersinia pestis KIM
aagucaugguacaacugcggcg

SEQ ID NO: 2314836 - RNA, 21 nt, Yersinia pestis KIM
aagucauuggcguuacagcaa

SEQ ID NO: 2314837 - RNA, 21 nt, Yersinia pestis KIM
aagucauucuugguggagccu

SEQ ID NO: 2314838 - RNA, 15 nt, Yersinia pestis KIM
aagugaacaugauga

SEQ ID NO: 2314839 - RNA, 20 nt, Yersinia pestis KIM
aagucgugaucguuuuaugg

SEQ ID NO: 2314840 - RNA, 14 nt, Yersinia pestis KIM
aagucgucugauau

SEQ ID NO: 2314841 - RNA, 22 nt, Yersinia pestis KIM
aagucgucugauauuaaaaaag

SEQ ID NO: 2314842 - RNA, 19 nt, Yersinia pestis KIM
aaguagccacuuaauaaug

SEQ ID NO: 2314843 - RNA, 23 nt, Yersinia pestis KIM
aaguaugcguggguucuucaaag

SEQ ID NO: 2314844 - RNA, 13 nt, Yersinia pestis KIM
aagucagcaaauc

SEQ ID NO: 2314845 - RNA, 17 nt, Yersinia pestis KIM
aagucaauaaauaaaaa

SEQ ID NO: 2314846 - RNA, 20 nt, Yersinia pestis KIM
aagucaauuucagcuuuuag

SEQ ID NO: 2314847 - RNA, 19 nt, Yersinia pestis KIM
aaguacggugccagcagca

SEQ ID NO: 2314848 - RNA, 15 nt, Yersinia pestis KIM
aaguaccgaaggcag

SEQ ID NO: 2314849 - RNA, 15 nt, Yersinia pestis KIM
aagggcgcaucccca

SEQ ID NO: 2314850 - RNA, 21 nt, Yersinia pestis KIM
aagggcggccagcaagagcag

SEQ ID NO: 2314851 - RNA, 22 nt, Yersinia pestis KIM
aagggaaauacccaaagucauu

SEQ ID NO: 2314852 - RNA, 12 nt, Yersinia pestis KIM
aaguaaaagcca

SEQ ID NO: 2314853 - RNA, 11 nt, Yersinia pestis KIM
aaguaaaaaaa

SEQ ID NO: 2314854 - RNA, 12 nt, Yersinia pestis KIM
aaguaaaaaaaa

SEQ ID NO: 2314855 - RNA, 14 nt, Yersinia pestis KIM
aaguaaaaaaaacc

SEQ ID NO: 2314856 - RNA, 14 nt, Yersinia pestis KIM
aauauccaauggug

SEQ ID NO: 2314857 - RNA, 20 nt, Yersinia pestis KIM
aauauccauauuaaaugcau

SEQ ID NO: 2314858 - RNA, 21 nt, Yersinia pestis KIM
aauaucccgagaaacaaaacc

SEQ ID NO: 2314859 - RNA, 21 nt, Yersinia pestis KIM
aauauccgugauuaaccuuaa

SEQ ID NO: 2314860 - RNA, 16 nt, Yersinia pestis KIM
aauauccgugggcaaa

SEQ ID NO: 2314861 - RNA, 19 nt, Yersinia pestis KIM
aauauccugcucagcuaaa

SEQ ID NO: 2314862 - RNA, 16 nt, Yersinia pestis KIM
aauauccuggaagcag

SEQ ID NO: 2314863 - RNA, 18 nt, Yersinia pestis KIM
aauauccuggaagcagaa

SEQ ID NO: 2314864 - RNA, 19 nt, Yersinia pestis KIM
aauaucauauaguuuuugc

SEQ ID NO: 2314865 - RNA, 12 nt, Yersinia pestis KIM
aauaucaucauc

SEQ ID NO: 2314866 - RNA, 18 nt, Yersinia pestis KIM
aauaucauccccuuucug

SEQ ID NO: 2314867 - RNA, 15 nt, Yersinia pestis KIM
aauaucacugauauc

SEQ ID NO: 2314868 - RNA, 16 nt, Yersinia pestis KIM
aauaucagcgauuaaa

SEQ ID NO: 2314869 - RNA, 22 nt, Yersinia pestis KIM
aauaucaggcacuguagaccuc

SEQ ID NO: 2314870 - RNA, 23 nt, Yersinia pestis KIM
aauaucagucgcuuuuuaacaaa

SEQ ID NO: 2314871 - RNA, 18 nt, Yersinia pestis KIM
aauaucgguaaaaaauca

SEQ ID NO: 2314872 - RNA, 17 nt, Yersinia pestis KIM
aauaucgcuaaacuuau

SEQ ID NO: 2314873 - RNA, 12 nt, Yersinia pestis KIM
aauaucuauuuc

SEQ ID NO: 2314874 - RNA, 17 nt, Yersinia pestis KIM
aauaucuauauagggaa

SEQ ID NO: 2314875 - RNA, 23 nt, Yersinia pestis KIM
aauaucuauauagggaaauaaca

SEQ ID NO: 2314876 - RNA, 22 nt, Yersinia pestis KIM
aauaucugccaccgcacaguua

SEQ ID NO: 2314877 - RNA, 20 nt, Yersinia pestis KIM
aauaucuguggugacaugau

SEQ ID NO: 2314878 - RNA, 20 nt, Yersinia pestis KIM
aauaucuuccacaugcuuuu

SEQ ID NO: 2314879 - RNA, 22 nt, Yersinia pestis KIM
aauaucuuccacaugcuuuuuu

SEQ ID NO: 2314880 - RNA, 17 nt, Yersinia pestis KIM
aauauaugauaccaaac

SEQ ID NO: 2314881 - RNA, 21 nt, Yersinia pestis KIM
aauaucaacagaacuaauauc

SEQ ID NO: 2314882 - RNA, 18 nt, Yersinia pestis KIM
aauaucaaaacugauuaa

SEQ ID NO: 2314883 - RNA, 14 nt, Yersinia pestis KIM
aauaucaaaacuga

SEQ ID NO: 2314884 - RNA, 19 nt, Yersinia pestis KIM
aauauaacguuuaccuauu

SEQ ID NO: 2314885 - RNA, 21 nt, Yersinia pestis KIM
aauauacuuuacauauaggaa

SEQ ID NO: 2314886 - RNA, 18 nt, Yersinia pestis KIM
aauauaaaagcacagaca

SEQ ID NO: 2314887 - RNA, 14 nt, Yersinia pestis KIM
aauauaaaagcaca

SEQ ID NO: 2314888 - RNA, 14 nt, Yersinia pestis KIM
aauauaaaauaaua

SEQ ID NO: 2314889 - RNA, 15 nt, Yersinia pestis KIM
aauagucauauauuu

SEQ ID NO: 2314890 - RNA, 16 nt, Yersinia pestis KIM
aauagucauauauuuu

SEQ ID NO: 2314891 - RNA, 13 nt, Yersinia pestis KIM
aauagucaguaaa

SEQ ID NO: 2314892 - RNA, 15 nt, Yersinia pestis KIM
aauagucguuauaua

SEQ ID NO: 2314893 - RNA, 23 nt, Yersinia pestis KIM
aauagugauuguuugauuauugu

SEQ ID NO: 2314894 - RNA, 20 nt, Yersinia pestis KIM
aauaguguuguaagauuuca

SEQ ID NO: 2314895 - RNA, 15 nt, Yersinia pestis KIM
aauaguuacuauaua

SEQ ID NO: 2314896 - RNA, 19 nt, Yersinia pestis KIM
aauaguucuucgcaaugau

SEQ ID NO: 2314897 - RNA, 13 nt, Yersinia pestis KIM
aauaguucauuuu

SEQ ID NO: 2314898 - RNA, 16 nt, Yersinia pestis KIM
aauaggauuuucauga

SEQ ID NO: 2314899 - RNA, 14 nt, Yersinia pestis KIM
aauaggcugaucaa

SEQ ID NO: 2314900 - RNA, 14 nt, Yersinia pestis KIM
aauaggucaguggu

SEQ ID NO: 2314901 - RNA, 15 nt, Yersinia pestis KIM
aauaggucagugguu

SEQ ID NO: 2314902 - RNA, 19 nt, Yersinia pestis KIM
aauagggcgccccgauaaa

SEQ ID NO: 2314903 - RNA, 22 nt, Yersinia pestis KIM
aauaguaauuaauuaugauaaa

SEQ ID NO: 2314904 - RNA, 16 nt, Yersinia pestis KIM
aauagguuggcauuag

SEQ ID NO: 2314905 - RNA, 14 nt, Yersinia pestis KIM
aauagauaguacgu

SEQ ID NO: 2314906 - RNA, 17 nt, Yersinia pestis KIM
aauagacgaauggccgc

SEQ ID NO: 2314907 - RNA, 16 nt, Yersinia pestis KIM
aauagacucgguagcg

SEQ ID NO: 2314908 - RNA, 13 nt, Yersinia pestis KIM
aauagcaaaccca

SEQ ID NO: 2314909 - RNA, 13 nt, Yersinia pestis KIM
aauagcaagccaa

SEQ ID NO: 2314910 - RNA, 23 nt, Yersinia pestis KIM
aauaccguuuucuuucaacugcu

SEQ ID NO: 2314911 - RNA, 16 nt, Yersinia pestis KIM
aauaccugcaccaaug

SEQ ID NO: 2314912 - RNA, 20 nt, Yersinia pestis KIM
aauagaagguuaaauuuaau

SEQ ID NO: 2314913 - RNA, 15 nt, Yersinia pestis KIM
aauagaagguaauca

SEQ ID NO: 2314914 - RNA, 23 nt, Yersinia pestis KIM
aauagcuaucuugccuguugaua

SEQ ID NO: 2314915 - RNA, 19 nt, Yersinia pestis KIM
aauagcuaccccuucaguc

SEQ ID NO: 2314916 - RNA, 22 nt, Yersinia pestis KIM
aauagcugguagugauccccca

SEQ ID NO: 2314917 - RNA, 17 nt, Yersinia pestis KIM
aauagcuguaaaauacc

SEQ ID NO: 2314918 - RNA, 19 nt, Yersinia pestis KIM
aauagcuggcggauaaaaa

SEQ ID NO: 2314919 - RNA, 13 nt, Yersinia pestis KIM
aauagcuuccauu

SEQ ID NO: 2314920 - RNA, 18 nt, Yersinia pestis KIM
aauagcaccgagcaugcu

SEQ ID NO: 2314921 - RNA, 21 nt, Yersinia pestis KIM
aauagccggcucuucucgaau

SEQ ID NO: 2314922 - RNA, 16 nt, Yersinia pestis KIM
aauagccguaggccac

SEQ ID NO: 2314923 - RNA, 13 nt, Yersinia pestis KIM
aauagcgcugcau

SEQ ID NO: 2314924 - RNA, 21 nt, Yersinia pestis KIM
aauagcggccauuaggcguga

SEQ ID NO: 2314925 - RNA, 16 nt, Yersinia pestis KIM
aauagcgccugcccuc

SEQ ID NO: 2314926 - RNA, 17 nt, Yersinia pestis KIM
aauaccagaugcauaua

SEQ ID NO: 2314927 - RNA, 16 nt, Yersinia pestis KIM
aauaccaauuaauaag

SEQ ID NO: 2314928 - RNA, 18 nt, Yersinia pestis KIM
aauaccaauuaauaagau

SEQ ID NO: 2314929 - RNA, 13 nt, Yersinia pestis KIM
aauaccaaauuua

SEQ ID NO: 2314930 - RNA, 16 nt, Yersinia pestis KIM
aauaccaaaaaucucu

SEQ ID NO: 2314931 - RNA, 20 nt, Yersinia pestis KIM
aauacaccuucuuuaucugu

SEQ ID NO: 2314932 - RNA, 23 nt, Yersinia pestis KIM
aauacacgaaugcgacaccugcu

SEQ ID NO: 2314933 - RNA, 20 nt, Yersinia pestis KIM
aauacauguacuagaucaca

SEQ ID NO: 2314934 - RNA, 20 nt, Yersinia pestis KIM
aauacagaaaaauaggccau

SEQ ID NO: 2314935 - RNA, 17 nt, Yersinia pestis KIM
aauaccauaacgcugcu

SEQ ID NO: 2314936 - RNA, 19 nt, Yersinia pestis KIM
aauaccauuuucagacuga

SEQ ID NO: 2314937 - RNA, 16 nt, Yersinia pestis KIM
aauaauagauaguacu

SEQ ID NO: 2314938 - RNA, 15 nt, Yersinia pestis KIM
aauaaugaacaaaua

SEQ ID NO: 2314939 - RNA, 13 nt, Yersinia pestis KIM
aauaauagauagu

SEQ ID NO: 2314940 - RNA, 17 nt, Yersinia pestis KIM
aaaaauaggccauucaa

SEQ ID NO: 2314941 - RNA, 15 nt, Yersinia pestis KIM
aauaaugagccauaa

SEQ ID NO: 2314942 - RNA, 21 nt, Yersinia pestis KIM
aauaaugaccacgcaucaaua

SEQ ID NO: 2314943 - RNA, 22 nt, Yersinia pestis KIM
aauaaugaccacgcaucaauaa

SEQ ID NO: 2314944 - RNA, 16 nt, Yersinia pestis KIM
aaaaaucuuguuaauu

SEQ ID NO: 2314945 - RNA, 20 nt, Yersinia pestis KIM
aaaaaucuuguuaauuuaaa

SEQ ID NO: 2314946 - RNA, 14 nt, Yersinia pestis KIM
aauaauuuguaaau

SEQ ID NO: 2314947 - RNA, 12 nt, Yersinia pestis KIM
aauaagcguagg

SEQ ID NO: 2314948 - RNA, 21 nt, Yersinia pestis KIM
aaaaagugcuauccucuuaau

SEQ ID NO: 2314949 - RNA, 14 nt, Yersinia pestis KIM
aaaaauaaauuaga

SEQ ID NO: 2314950 - RNA, 15 nt, Yersinia pestis KIM
aauaauaauggugaa

SEQ ID NO: 2314951 - RNA, 12 nt, Yersinia pestis KIM
aauaauaaaauc

SEQ ID NO: 2314952 - RNA, 11 nt, Yersinia pestis KIM
aauaauaaaaa

SEQ ID NO: 2314953 - RNA, 17 nt, Yersinia pestis KIM
aauaaguugaaccauaa

SEQ ID NO: 2314954 - RNA, 20 nt, Yersinia pestis KIM
aauaaguguguguauuuaaa

SEQ ID NO: 2314955 - RNA, 23 nt, Yersinia pestis KIM
aauaaguguguguauuuaaaaga

SEQ ID NO: 2314956 - RNA, 22 nt, Yersinia pestis KIM
aauaaguucagguugaaauaaa

SEQ ID NO: 2314957 - RNA, 12 nt, Yersinia pestis KIM
aauaaguucaga

SEQ ID NO: 2314958 - RNA, 19 nt, Yersinia pestis KIM
aauaagugcaaacuuaaaa

SEQ ID NO: 2314959 - RNA, 23 nt, Yersinia pestis KIM
aauaaguaggcaucugccacacu

SEQ ID NO: 2314960 - RNA, 15 nt, Yersinia pestis KIM
aauaaguacuuccaa

SEQ ID NO: 2314961 - RNA, 18 nt, Yersinia pestis KIM
aauaagggauaugaauaa

SEQ ID NO: 2314962 - RNA, 13 nt, Yersinia pestis KIM
aaguugauaacgc

SEQ ID NO: 2314963 - RNA, 20 nt, Yersinia pestis KIM
aaguugaguugaauuuuuau

SEQ ID NO: 2314964 - RNA, 13 nt, Yersinia pestis KIM
aaguugauaaaag

SEQ ID NO: 2314965 - RNA, 23 nt, Yersinia pestis KIM
aaguugaugggaggaaacugccg

SEQ ID NO: 2314966 - RNA, 20 nt, Yersinia pestis KIM
aauaaaugaccaacuguaaa

SEQ ID NO: 2314967 - RNA, 19 nt, Yersinia pestis KIM
aauaaauauccuccggcau

SEQ ID NO: 2314968 - RNA, 10 nt, Yersinia pestis KIM
aauaaccauu

SEQ ID NO: 2314969 - RNA, 14 nt, Yersinia pestis KIM
aauaaccauuaauu

SEQ ID NO: 2314970 - RNA, 23 nt, Yersinia pestis KIM
aauaaccauuaauugguuuuaau

SEQ ID NO: 2314971 - RNA, 23 nt, Yersinia pestis KIM
aauaacugccagggcguuuacca

SEQ ID NO: 2314972 - RNA, 23 nt, Yersinia pestis KIM
aauaacugggccacgaugugaag

SEQ ID NO: 2314973 - RNA, 18 nt, Yersinia pestis KIM
aauaacuucaguuacuca

SEQ ID NO: 2314974 - RNA, 19 nt, Yersinia pestis KIM
aauaacuuauuacaccuua

SEQ ID NO: 2314975 - RNA, 13 nt, Yersinia pestis KIM
aauaacuuaaaua

SEQ ID NO: 2314976 - RNA, 15 nt, Yersinia pestis KIM
aauaacuuaaauaau

SEQ ID NO: 2314977 - RNA, 16 nt, Yersinia pestis KIM
aauaacuuaaauaauu

SEQ ID NO: 2314978 - RNA, 20 nt, Yersinia pestis KIM
aauaacuucgcgaacacaau

SEQ ID NO: 2314979 - RNA, 12 nt, Yersinia pestis KIM
aauaagaaugac

SEQ ID NO: 2314980 - RNA, 15 nt, Yersinia pestis KIM
aauaagaaugacuuu

SEQ ID NO: 2314981 - RNA, 11 nt, Yersinia pestis KIM
aauaagaucca

SEQ ID NO: 2314982 - RNA, 15 nt, Yersinia pestis KIM
aauaagaugggcuua

SEQ ID NO: 2314983 - RNA, 16 nt, Yersinia pestis KIM
aagaguaaauaaauau

SEQ ID NO: 2314984 - RNA, 18 nt, Yersinia pestis KIM
aagaggguuuuuaaauuu

SEQ ID NO: 2314985 - RNA, 18 nt, Yersinia pestis KIM
aagaguacuaacgucaac

SEQ ID NO: 2314986 - RNA, 22 nt, Yersinia pestis KIM
aagaguacuaacgucaacagaa

SEQ ID NO: 2314987 - RNA, 13 nt, Yersinia pestis KIM
aagaguaucucug

SEQ ID NO: 2314988 - RNA, 19 nt, Yersinia pestis KIM
aagagggcgguuaaauaca

SEQ ID NO: 2314989 - RNA, 14 nt, Yersinia pestis KIM
aagagcgauugacu

SEQ ID NO: 2314990 - RNA, 18 nt, Yersinia pestis KIM
aagagaggcaaugauuuu

SEQ ID NO: 2314991 - RNA, 11 nt, Yersinia pestis KIM
aagagaugacc

SEQ ID NO: 2314992 - RNA, 15 nt, Yersinia pestis KIM
aagagaugaaauuuu

SEQ ID NO: 2314993 - RNA, 16 nt, Yersinia pestis KIM
aagauagcaaaagaau

SEQ ID NO: 2314994 - RNA, 14 nt, Yersinia pestis KIM
aagauagccacuaa

SEQ ID NO: 2314995 - RNA, 17 nt, Yersinia pestis KIM
aagauaggcagaaaagc

SEQ ID NO: 2314996 - RNA, 22 nt, Yersinia pestis KIM
aagauagacauauuguccaaca

SEQ ID NO: 2314997 - RNA, 20 nt, Yersinia pestis KIM
aagauacccuucucuuuauc

SEQ ID NO: 2314998 - RNA, 18 nt, Yersinia pestis KIM
aagaucacucauggcucu

SEQ ID NO: 2314999 - RNA, 14 nt, Yersinia pestis KIM
aagaucaauauguu

SEQ ID NO: 2315000 - RNA, 20 nt, Yersinia pestis KIM
aagagucacagcauucagau

SEQ ID NO: 2315001 - RNA, 22 nt, Yersinia pestis KIM
aagagucgcuuugggauucaau

SEQ ID NO: 2315002 - RNA, 21 nt, Yersinia pestis KIM
aagagucgcaaaacuucacuu

SEQ ID NO: 2315003 - RNA, 21 nt, Yersinia pestis KIM
aagaguguucauaaauuaaaa

SEQ ID NO: 2315004 - RNA, 18 nt, Yersinia pestis KIM
aagagucuggauuugaga

SEQ ID NO: 2315005 - RNA, 13 nt, Yersinia pestis KIM
aagagugaaauau

SEQ ID NO: 2315006 - RNA, 19 nt, Yersinia pestis KIM
aagagugaccaaagcagua

SEQ ID NO: 2315007 - RNA, 21 nt, Yersinia pestis KIM
aagagugaccaaagcaguaaa

SEQ ID NO: 2315008 - RNA, 23 nt, Yersinia pestis KIM
aagagugaccaaagcaguaaaca

SEQ ID NO: 2315009 - RNA, 15 nt, Yersinia pestis KIM
aagaguuagggcugg

SEQ ID NO: 2315010 - RNA, 22 nt, Yersinia pestis KIM
aagauaacgaacagguagauca

SEQ ID NO: 2315011 - RNA, 20 nt, Yersinia pestis KIM
aagaauccucugaauaaaaa

SEQ ID NO: 2315012 - RNA, 15 nt, Yersinia pestis KIM
aagaaaucaaaaggg

SEQ ID NO: 2315013 - RNA, 18 nt, Yersinia pestis KIM
aagaaugccugccgcaau

SEQ ID NO: 2315014 - RNA, 23 nt, Yersinia pestis KIM
aagaaugcgaagacgaauaaaua

SEQ ID NO: 2315015 - RNA, 18 nt, Yersinia pestis KIM
aagaauugagguaaacca

SEQ ID NO: 2315016 - RNA, 14 nt, Yersinia pestis KIM
aagaauugcgcagc

SEQ ID NO: 2315017 - RNA, 16 nt, Yersinia pestis KIM
aagaauugcagauacc

SEQ ID NO: 2315018 - RNA, 21 nt, Yersinia pestis KIM
aagaauugguuauccuaagaa

SEQ ID NO: 2315019 - RNA, 19 nt, Yersinia pestis KIM
aagaauugugccccaagaa

SEQ ID NO: 2315020 - RNA, 22 nt, Yersinia pestis KIM
aagacauaaugccggcggccca

SEQ ID NO: 2315021 - RNA, 23 nt, Yersinia pestis KIM
aagacagggguuuuuaucccccu

SEQ ID NO: 2315022 - RNA, 19 nt, Yersinia pestis KIM
aagacauugcgcaagcccc

SEQ ID NO: 2315023 - RNA, 20 nt, Yersinia pestis KIM
aagacauugcgcaagccccu

SEQ ID NO: 2315024 - RNA, 13 nt, Yersinia pestis KIM
aagacaacaaaca

SEQ ID NO: 2315025 - RNA, 22 nt, Yersinia pestis KIM
aagaauuuuauauuauuauaaa

SEQ ID NO: 2315026 - RNA, 23 nt, Yersinia pestis KIM
aagaccgcuuuaucaaagaauuc

SEQ ID NO: 2315027 - RNA, 14 nt, Yersinia pestis KIM
aagaccgcuuuugc

SEQ ID NO: 2315028 - RNA, 18 nt, Yersinia pestis KIM
aagaccgguggcuuuuuc

SEQ ID NO: 2315029 - RNA, 21 nt, Yersinia pestis KIM
aagaccgcuuuaucaaagaau

SEQ ID NO: 2315030 - RNA, 16 nt, Yersinia pestis KIM
aagacgaguaaugaaa

SEQ ID NO: 2315031 - RNA, 21 nt, Yersinia pestis KIM
aagacgccguaaauacaucca

SEQ ID NO: 2315032 - RNA, 19 nt, Yersinia pestis KIM
aagacgaguaaugaaaucu

SEQ ID NO: 2315033 - RNA, 13 nt, Yersinia pestis KIM
aagacgccauuaa

SEQ ID NO: 2315034 - RNA, 18 nt, Yersinia pestis KIM
aagacgccggcuucccug

SEQ ID NO: 2315035 - RNA, 16 nt, Yersinia pestis KIM
aagacguccgucguuu

SEQ ID NO: 2315036 - RNA, 11 nt, Yersinia pestis KIM
aagacugaagu

SEQ ID NO: 2315037 - RNA, 13 nt, Yersinia pestis KIM
aagagaaaagcag

SEQ ID NO: 2315038 - RNA, 18 nt, Yersinia pestis KIM
aacucaugacaucccagc

SEQ ID NO: 2315039 - RNA, 23 nt, Yersinia pestis KIM
aacucauccuaccgccagcugac

SEQ ID NO: 2315040 - RNA, 23 nt, Yersinia pestis KIM
aacucaucggcguuacaguaagg

SEQ ID NO: 2315041 - RNA, 17 nt, Yersinia pestis KIM
aacucaccuaaaucaua

SEQ ID NO: 2315042 - RNA, 18 nt, Yersinia pestis KIM
aacucaccuaaaucauac

SEQ ID NO: 2315043 - RNA, 16 nt, Yersinia pestis KIM
aacucagccaucaguu

SEQ ID NO: 2315044 - RNA, 23 nt, Yersinia pestis KIM
aacucagccaucaguucacugaa

SEQ ID NO: 2315045 - RNA, 15 nt, Yersinia pestis KIM
aacucagccauugcu

SEQ ID NO: 2315046 - RNA, 18 nt, Yersinia pestis KIM
aacucagccacaagauag

SEQ ID NO: 2315047 - RNA, 22 nt, Yersinia pestis KIM
aacucagcagagucgcaaaaaa

SEQ ID NO: 2315048 - RNA, 17 nt, Yersinia pestis KIM
aacucaggugaguaaau

SEQ ID NO: 2315049 - RNA, 18 nt, Yersinia pestis KIM
aacucaguauauugguac

SEQ ID NO: 2315050 - RNA, 18 nt, Yersinia pestis KIM
aacucagugaaaccauug

SEQ ID NO: 2315051 - RNA, 20 nt, Yersinia pestis KIM
aacucagcgaauaaauaauu

SEQ ID NO: 2315052 - RNA, 22 nt, Yersinia pestis KIM
aacucaggauccucgucguaau

SEQ ID NO: 2315053 - RNA, 14 nt, Yersinia pestis KIM
aacgggcaaccugu

SEQ ID NO: 2315054 - RNA, 17 nt, Yersinia pestis KIM
aacggcuggucaucacg

SEQ ID NO: 2315055 - RNA, 20 nt, Yersinia pestis KIM
aacgggccgcauucaccacc

SEQ ID NO: 2315056 - RNA, 12 nt, Yersinia pestis KIM
aacgggcggcug

SEQ ID NO: 2315057 - RNA, 20 nt, Yersinia pestis KIM
aacggcgcggcaucaccaaa

SEQ ID NO: 2315058 - RNA, 19 nt, Yersinia pestis KIM
aacgggcuuccaucaggaa

SEQ ID NO: 2315059 - RNA, 21 nt, Yersinia pestis KIM
aacuccaucgccacuucuaac

SEQ ID NO: 2315060 - RNA, 19 nt, Yersinia pestis KIM
aacucgcgcuauuuaucca

SEQ ID NO: 2315061 - RNA, 17 nt, Yersinia pestis KIM
aacucgagcauuugacc

SEQ ID NO: 2315062 - RNA, 16 nt, Yersinia pestis KIM
aacucgccacucacaa

SEQ ID NO: 2315063 - RNA, 19 nt, Yersinia pestis KIM
aacugacacacaccaguga

SEQ ID NO: 2315064 - RNA, 23 nt, Yersinia pestis KIM
aacugaguuggaaaugacaaauc

SEQ ID NO: 2315065 - RNA, 19 nt, Yersinia pestis KIM
aacucuacauugacuaauu

SEQ ID NO: 2315066 - RNA, 22 nt, Yersinia pestis KIM
aacucuaaggguaaaaucccca

SEQ ID NO: 2315067 - RNA, 15 nt, Yersinia pestis KIM
aacucuauggcguca

SEQ ID NO: 2315068 - RNA, 13 nt, Yersinia pestis KIM
aacuuuuuucauc

SEQ ID NO: 2315069 - RNA, 21 nt, Yersinia pestis KIM
aacuuuuuucuuaaggacccg

SEQ ID NO: 2315070 - RNA, 14 nt, Yersinia pestis KIM
aagaaaaucaggau

SEQ ID NO: 2315071 - RNA, 12 nt, Yersinia pestis KIM
aagaaaaugauu

SEQ ID NO: 2315072 - RNA, 22 nt, Yersinia pestis KIM
aacuuugcuuugacuaauacug

SEQ ID NO: 2315073 - RNA, 12 nt, Yersinia pestis KIM
aacuuugccagu

SEQ ID NO: 2315074 - RNA, 20 nt, Yersinia pestis KIM
aacuuuuauugucuuuaaua

SEQ ID NO: 2315075 - RNA, 23 nt, Yersinia pestis KIM
aacuuuucaguuuuaauuuauga

SEQ ID NO: 2315076 - RNA, 22 nt, Yersinia pestis KIM
aacuuuucaucgcauaggccaa

SEQ ID NO: 2315077 - RNA, 15 nt, Yersinia pestis KIM
aacuuuaucagucug

SEQ ID NO: 2315078 - RNA, 18 nt, Yersinia pestis KIM
aacuuuaucagucuguag

SEQ ID NO: 2315079 - RNA, 20 nt, Yersinia pestis KIM
aacuuuauugacuguaaaua

SEQ ID NO: 2315080 - RNA, 15 nt, Yersinia pestis KIM
aacuuucccagucau

SEQ ID NO: 2315081 - RNA, 18 nt, Yersinia pestis KIM
aacuucgaaagaaauaaa

SEQ ID NO: 2315082 - RNA, 17 nt, Yersinia pestis KIM
aacuucgaaagaaauaa

SEQ ID NO: 2315083 - RNA, 22 nt, Yersinia pestis KIM
aacuuccuuugcccuuacuauu

SEQ ID NO: 2315084 - RNA, 14 nt, Yersinia pestis KIM
aacuuccuugauuu

SEQ ID NO: 2315085 - RNA, 21 nt, Yersinia pestis KIM
aacuuccuugauuuucauuuc

SEQ ID NO: 2315086 - RNA, 15 nt, Yersinia pestis KIM
aacuucccggcgauu

SEQ ID NO: 2315087 - RNA, 15 nt, Yersinia pestis KIM
aacuuccacacaaac

SEQ ID NO: 2315088 - RNA, 15 nt, Yersinia pestis KIM
aacuguuaaaacagg

SEQ ID NO: 2315089 - RNA, 13 nt, Yersinia pestis KIM
aacuguugcaaac

SEQ ID NO: 2315090 - RNA, 22 nt, Yersinia pestis KIM
aacuguugcaaacggauaaugu

SEQ ID NO: 2315091 - RNA, 19 nt, Yersinia pestis KIM
aacuguucuuauugcuauc

SEQ ID NO: 2315092 - RNA, 17 nt, Yersinia pestis KIM
aacuucaguuacucacu

SEQ ID NO: 2315093 - RNA, 16 nt, Yersinia pestis KIM
aacuucagguucaccu

SEQ ID NO: 2315094 - RNA, 12 nt, Yersinia pestis KIM
aacuucagagcc

SEQ ID NO: 2315095 - RNA, 12 nt, Yersinia pestis KIM
aacuucacuuug

SEQ ID NO: 2315096 - RNA, 19 nt, Yersinia pestis KIM
aacuguggauuaugugcgg

SEQ ID NO: 2315097 - RNA, 12 nt, Yersinia pestis KIM
aacugugcgaau

SEQ ID NO: 2315098 - RNA, 19 nt, Yersinia pestis KIM
aacugugcgaauggaaaaa

SEQ ID NO: 2315099 - RNA, 22 nt, Yersinia pestis KIM
aacugugccaaugccucuucaa

SEQ ID NO: 2315100 - RNA, 20 nt, Yersinia pestis KIM
aacugucgggggcucguugg

SEQ ID NO: 2315101 - RNA, 20 nt, Yersinia pestis KIM
aacugucagucaaaagaaac

SEQ ID NO: 2315102 - RNA, 22 nt, Yersinia pestis KIM
aacugcauuucaauucguucaa

SEQ ID NO: 2315103 - RNA, 20 nt, Yersinia pestis KIM
aacugccagcuaaaagggga

SEQ ID NO: 2315104 - RNA, 20 nt, Yersinia pestis KIM
aacgcgccuuucggcaauau

SEQ ID NO: 2315105 - RNA, 14 nt, Yersinia pestis KIM
aacgcgaccaacac

SEQ ID NO: 2315106 - RNA, 12 nt, Yersinia pestis KIM
aacggccccuca

SEQ ID NO: 2315107 - RNA, 14 nt, Yersinia pestis KIM
aacgcucggcaccg

SEQ ID NO: 2315108 - RNA, 22 nt, Yersinia pestis KIM
aacgcuaccaugagugaaaaua

SEQ ID NO: 2315109 - RNA, 16 nt, Yersinia pestis KIM
aacggauaauguugca

SEQ ID NO: 2315110 - RNA, 20 nt, Yersinia pestis KIM
aacggauaauguugcaaaca

SEQ ID NO: 2315111 - RNA, 16 nt, Yersinia pestis KIM
aacggauacccagcac

SEQ ID NO: 2315112 - RNA, 12 nt, Yersinia pestis KIM
aacgccaaaaua

SEQ ID NO: 2315113 - RNA, 21 nt, Yersinia pestis KIM
aacgcaggcacugcagaaaau

SEQ ID NO: 2315114 - RNA, 13 nt, Yersinia pestis KIM
aacgcagauaaau

SEQ ID NO: 2315115 - RNA, 12 nt, Yersinia pestis KIM
aacgaguaaaua

SEQ ID NO: 2315116 - RNA, 21 nt, Yersinia pestis KIM
aacgagggcucaaucucugcc

SEQ ID NO: 2315117 - RNA, 24 nt, Yersinia pestis KIM
aacgacggccaaacguauugguaa

SEQ ID NO: 2315118 - RNA, 14 nt, Yersinia pestis KIM
aacgacggaugaaa

SEQ ID NO: 2315119 - RNA, 19 nt, Yersinia pestis KIM
aacgaccaauuucaauaau

SEQ ID NO: 2315120 - RNA, 17 nt, Yersinia pestis KIM
aacgacaugugaguggu

SEQ ID NO: 2315121 - RNA, 14 nt, Yersinia pestis KIM
aacgaccaguaagu

SEQ ID NO: 2315122 - RNA, 18 nt, Yersinia pestis KIM
aacgaauaauucagauaa

SEQ ID NO: 2315123 - RNA, 18 nt, Yersinia pestis KIM
aacgaauuucauuuuaaa

SEQ ID NO: 2315124 - RNA, 12 nt, Yersinia pestis KIM
aaccuaauacuu

SEQ ID NO: 2315125 - RNA, 19 nt, Yersinia pestis KIM
aaccuacgccauuaaaagg

SEQ ID NO: 2315126 - RNA, 23 nt, Yersinia pestis KIM
aaccuccgcuuuaaccuuucuaa

SEQ ID NO: 2315127 - RNA, 19 nt, Yersinia pestis KIM
aaccuccgcgauaccaaua

SEQ ID NO: 2315128 - RNA, 17 nt, Yersinia pestis KIM
aaccucagccucauuca

SEQ ID NO: 2315129 - RNA, 18 nt, Yersinia pestis KIM
aaccucagggagccaaua

SEQ ID NO: 2315130 - RNA, 14 nt, Yersinia pestis KIM
aaccucagaggcgc

SEQ ID NO: 2315131 - RNA, 16 nt, Yersinia pestis KIM
aaccucacgggcuucc

SEQ ID NO: 2315132 - RNA, 17 nt, Yersinia pestis KIM
aaccucacgccaccuuc

SEQ ID NO: 2315133 - RNA, 17 nt, Yersinia pestis KIM
aaccucaaaaggauggc

SEQ ID NO: 2315134 - RNA, 20 nt, Yersinia pestis KIM
aaccucaaaaggauggccca

SEQ ID NO: 2315135 - RNA, 18 nt, Yersinia pestis KIM
aaccucaacgcgaauauc

SEQ ID NO: 2315136 - RNA, 20 nt, Yersinia pestis KIM
aaccucaauuuacucaauau

SEQ ID NO: 2315137 - RNA, 22 nt, Yersinia pestis KIM
aaccgggguucgcaaugaaccc

SEQ ID NO: 2315138 - RNA, 17 nt, Yersinia pestis KIM
aacccgcgggagucagu

SEQ ID NO: 2315139 - RNA, 17 nt, Yersinia pestis KIM
aacccgcagauaaaccc

SEQ ID NO: 2315140 - RNA, 20 nt, Yersinia pestis KIM
aaccgguauugaccagauag

SEQ ID NO: 2315141 - RNA, 15 nt, Yersinia pestis KIM
aaccguacagauaua

SEQ ID NO: 2315142 - RNA, 21 nt, Yersinia pestis KIM
aaccgugcaccauacccuuug

SEQ ID NO: 2315143 - RNA, 17 nt, Yersinia pestis KIM
aaccguuuuuucaacug

SEQ ID NO: 2315144 - RNA, 22 nt, Yersinia pestis KIM
aaccguuuuuucaacuggcugu

SEQ ID NO: 2315145 - RNA, 17 nt, Yersinia pestis KIM
aaccuaaaaaaaacaac

SEQ ID NO: 2315146 - RNA, 13 nt, Yersinia pestis KIM
aaccguucaguuu

SEQ ID NO: 2315147 - RNA, 22 nt, Yersinia pestis KIM
aaccuguuacaucagagcucaa

SEQ ID NO: 2315148 - RNA, 21 nt, Yersinia pestis KIM
aaccuuaauuugcuuuaaaua

SEQ ID NO: 2315149 - RNA, 24 nt, Yersinia pestis KIM
aaccuuauuuuugcauauaaaaca

SEQ ID NO: 2315150 - RNA, 21 nt, Yersinia pestis KIM
aaccuggcaccggacaaacca

SEQ ID NO: 2315151 - RNA, 15 nt, Yersinia pestis KIM
aaccugcguaaacaa

SEQ ID NO: 2315152 - RNA, 22 nt, Yersinia pestis KIM
aaccucuaaucuccucuccgga

SEQ ID NO: 2315153 - RNA, 23 nt, Yersinia pestis KIM
aaccucgggcgcuuaaauaaaac

SEQ ID NO: 2315154 - RNA, 20 nt, Yersinia pestis KIM
aaccucggucugaauaagag

SEQ ID NO: 2315155 - RNA, 17 nt, Yersinia pestis KIM
aaccucgguggcucaau

SEQ ID NO: 2315156 - RNA, 18 nt, Yersinia pestis KIM
aacgaaacuaacgcguga

SEQ ID NO: 2315157 - RNA, 20 nt, Yersinia pestis KIM
aacgaacccgauaacccaca

SEQ ID NO: 2315158 - RNA, 18 nt, Yersinia pestis KIM
aacgaacgcucuuuaaca

SEQ ID NO: 2315159 - RNA, 18 nt, Yersinia pestis KIM
aaccuuuauguaacacau

SEQ ID NO: 2315160 - RNA, 13 nt, Yersinia pestis KIM
aaccuucucugca

SEQ ID NO: 2315161 - RNA, 14 nt, Yersinia pestis KIM
aaccuucucugcac

SEQ ID NO: 2315162 - RNA, 20 nt, Yersinia pestis KIM
aaccuugggggaccagcaca

SEQ ID NO: 2315163 - RNA, 16 nt, Yersinia pestis KIM
aaccuuuacaauuaca

SEQ ID NO: 2315164 - RNA, 22 nt, Yersinia pestis KIM
aaccuuguuuuaccuuggaaca

SEQ ID NO: 2315165 - RNA, 22 nt, Yersinia pestis KIM
aaccuuguuuuaucgcaguaau

SEQ ID NO: 2315166 - RNA, 21 nt, Yersinia pestis KIM
aaccagagcggagccucaguu

SEQ ID NO: 2315167 - RNA, 17 nt, Yersinia pestis KIM
aaccagauaacaacaaa

SEQ ID NO: 2315168 - RNA, 19 nt, Yersinia pestis KIM
aaccagcagcgcauaaaaa

SEQ ID NO: 2315169 - RNA, 20 nt, Yersinia pestis KIM
aaccaggccgccaucaucau

SEQ ID NO: 2315170 - RNA, 17 nt, Yersinia pestis KIM
aaccaggucaguuuuac

SEQ ID NO: 2315171 - RNA, 18 nt, Yersinia pestis KIM
aaccagcguccugugcaa

SEQ ID NO: 2315172 - RNA, 15 nt, Yersinia pestis KIM
aacccgaauuaauaa

SEQ ID NO: 2315173 - RNA, 13 nt, Yersinia pestis KIM
aaccccuagccag

SEQ ID NO: 2315174 - RNA, 22 nt, Yersinia pestis KIM
aaccccuagccagccaccgcac

SEQ ID NO: 2315175 - RNA, 22 nt, Yersinia pestis KIM
aaccccguagcacacacagccu

SEQ ID NO: 2315176 - RNA, 20 nt, Yersinia pestis KIM
aaccauaaaauaaauaauuu

SEQ ID NO: 2315177 - RNA, 19 nt, Yersinia pestis KIM
aaccauaaaauaaauaauu

SEQ ID NO: 2315178 - RNA, 21 nt, Yersinia pestis KIM
aacccauuugcacagcauuua

SEQ ID NO: 2315179 - RNA, 19 nt, Yersinia pestis KIM
aacccauuugcacagcauu

SEQ ID NO: 2315180 - RNA, 16 nt, Yersinia pestis KIM
aacccauugguuuuua

SEQ ID NO: 2315181 - RNA, 18 nt, Yersinia pestis KIM
aaccaccggguuuaguau

SEQ ID NO: 2315182 - RNA, 14 nt, Yersinia pestis KIM
aaccaccaaagaua

SEQ ID NO: 2315183 - RNA, 14 nt, Yersinia pestis KIM
aacauuuuuucuuu

SEQ ID NO: 2315184 - RNA, 13 nt, Yersinia pestis KIM
aaccaaacauugu

SEQ ID NO: 2315185 - RNA, 14 nt, Yersinia pestis KIM
aacaucuaccucug

SEQ ID NO: 2315186 - RNA, 18 nt, Yersinia pestis KIM
aacaucguuaauccauuu

SEQ ID NO: 2315187 - RNA, 16 nt, Yersinia pestis KIM
aacaucucgccaaagu

SEQ ID NO: 2315188 - RNA, 16 nt, Yersinia pestis KIM
aacauggacggcauau

SEQ ID NO: 2315189 - RNA, 19 nt, Yersinia pestis KIM
aacaugcugaagccagcac

SEQ ID NO: 2315190 - RNA, 21 nt, Yersinia pestis KIM
aacaugcugaagccagcaccg

SEQ ID NO: 2315191 - RNA, 15 nt, Yersinia pestis KIM
aacauuuuuagcuuc

SEQ ID NO: 2315192 - RNA, 18 nt, Yersinia pestis KIM
aacauuuucuaagcugcc

SEQ ID NO: 2315193 - RNA, 18 nt, Yersinia pestis KIM
aacaugggguaaucccga

SEQ ID NO: 2315194 - RNA, 19 nt, Yersinia pestis KIM
aacaugguccacagucagu

SEQ ID NO: 2315195 - RNA, 12 nt, Yersinia pestis KIM
aacauuucauuc

SEQ ID NO: 2315196 - RNA, 21 nt, Yersinia pestis KIM
aacauuucauuccagauaaaa

SEQ ID NO: 2315197 - RNA, 17 nt, Yersinia pestis KIM
aacauuuacuuauaaac

SEQ ID NO: 2315198 - RNA, 21 nt, Yersinia pestis KIM
aacauuuaucuaucuguucac

SEQ ID NO: 2315199 - RNA, 13 nt, Yersinia pestis KIM
aacauuuaaauau

SEQ ID NO: 2315200 - RNA, 14 nt, Yersinia pestis KIM
aacaguaaauuauu

SEQ ID NO: 2315201 - RNA, 22 nt, Yersinia pestis KIM
aacagguuggcgguacggucac

SEQ ID NO: 2315202 - RNA, 20 nt, Yersinia pestis KIM
aacagguaguggaaauaggu

SEQ ID NO: 2315203 - RNA, 20 nt, Yersinia pestis KIM
aacagguagaucaaacauaa

SEQ ID NO: 2315204 - RNA, 15 nt, Yersinia pestis KIM
aacagucacaccaac

SEQ ID NO: 2315205 - RNA, 17 nt, Yersinia pestis KIM
aacaguaucaaguaugu

SEQ ID NO: 2315206 - RNA, 14 nt, Yersinia pestis KIM
aacaguagcagggc

SEQ ID NO: 2315207 - RNA, 21 nt, Yersinia pestis KIM
aacaguagcagggccgcccag

SEQ ID NO: 2315208 - RNA, 18 nt, Yersinia pestis KIM
aacaggcgaguuucccuu

SEQ ID NO: 2315209 - RNA, 14 nt, Yersinia pestis KIM
aacagggcagaaaa

SEQ ID NO: 2315210 - RNA, 22 nt, Yersinia pestis KIM
aacagggcagccaauuacgcug

SEQ ID NO: 2315211 - RNA, 16 nt, Yersinia pestis KIM
aacaagggguuucaga

SEQ ID NO: 2315212 - RNA, 16 nt, Yersinia pestis KIM
aacaaggcaaauagag

SEQ ID NO: 2315213 - RNA, 15 nt, Yersinia pestis KIM
aacagcguugaccaa

SEQ ID NO: 2315214 - RNA, 19 nt, Yersinia pestis KIM
aacagcuaaucauugcaau

SEQ ID NO: 2315215 - RNA, 14 nt, Yersinia pestis KIM
aacagcuucgccac

SEQ ID NO: 2315216 - RNA, 21 nt, Yersinia pestis KIM
aacagcuugauagggcugaag

SEQ ID NO: 2315217 - RNA, 14 nt, Yersinia pestis KIM
aacaucgcgcugcu

SEQ ID NO: 2315218 - RNA, 22 nt, Yersinia pestis KIM
aacaucgacaccaagacugaag

SEQ ID NO: 2315219 - RNA, 16 nt, Yersinia pestis KIM
aacaucgacaccaaga

SEQ ID NO: 2315220 - RNA, 13 nt, Yersinia pestis KIM
aacaucacacuug

SEQ ID NO: 2315221 - RNA, 12 nt, Yersinia pestis KIM
aacauaucaaua

SEQ ID NO: 2315222 - RNA, 16 nt, Yersinia pestis KIM
aacauauccugugcca

SEQ ID NO: 2315223 - RNA, 17 nt, Yersinia pestis KIM
aacauaguugaauaacu

SEQ ID NO: 2315224 - RNA, 20 nt, Yersinia pestis KIM
aacauauaaaccagccagug

SEQ ID NO: 2315225 - RNA, 17 nt, Yersinia pestis KIM
aacauauaaaccagcca

SEQ ID NO: 2315226 - RNA, 12 nt, Yersinia pestis KIM
aacauagcuaac

SEQ ID NO: 2315227 - RNA, 15 nt, Yersinia pestis KIM
aacauagcuaacacc

SEQ ID NO: 2315228 - RNA, 19 nt, Yersinia pestis KIM
aacaguuguuucaauaaau

SEQ ID NO: 2315229 - RNA, 15 nt, Yersinia pestis KIM
aacaguuguuucaau

SEQ ID NO: 2315230 - RNA, 22 nt, Yersinia pestis KIM
aacauaaaaaaugccagcccca

SEQ ID NO: 2315231 - RNA, 16 nt, Yersinia pestis KIM
aacauaacuuugccag

SEQ ID NO: 2315232 - RNA, 19 nt, Yersinia pestis KIM
aacagugcacaucaauacc

SEQ ID NO: 2315233 - RNA, 22 nt, Yersinia pestis KIM
aacagugucacuuccgccgcca

SEQ ID NO: 2315234 - RNA, 17 nt, Yersinia pestis KIM
aacagugguuugcucuc

SEQ ID NO: 2315235 - RNA, 15 nt, Yersinia pestis KIM
cgccugauccaacau

SEQ ID NO: 2315236 - RNA, 22 nt, Yersinia pestis KIM
cgccugauaaaauuaccgcccc

SEQ ID NO: 2315237 - RNA, 13 nt, Yersinia pestis KIM
cgccucugcuccg

SEQ ID NO: 2315238 - RNA, 17 nt, Yersinia pestis KIM
cgccucuucugucggag

SEQ ID NO: 2315239 - RNA, 12 nt, Yersinia pestis KIM
cgccucucuggc

SEQ ID NO: 2315240 - RNA, 14 nt, Yersinia pestis KIM
cgccugauggcgcu

SEQ ID NO: 2315241 - RNA, 19 nt, Yersinia pestis KIM
cgccuucccacaaacucca

SEQ ID NO: 2315242 - RNA, 12 nt, Yersinia pestis KIM
cgcgaccagcag

SEQ ID NO: 2315243 - RNA, 15 nt, Yersinia pestis KIM
cgcgaccagcagaau

SEQ ID NO: 2315244 - RNA, 17 nt, Yersinia pestis KIM
cgcgacggagagaacag

SEQ ID NO: 2315245 - RNA, 19 nt, Yersinia pestis KIM
cgcgacggagagaacaggc

SEQ ID NO: 2315246 - RNA, 15 nt, Yersinia pestis KIM
cgccgugagaaaaaa

SEQ ID NO: 2315247 - RNA, 21 nt, Yersinia pestis KIM
cgccgucaugcugaaucugua

SEQ ID NO: 2315248 - RNA, 14 nt, Yersinia pestis KIM
cgccgucagcucuu

SEQ ID NO: 2315249 - RNA, 15 nt, Yersinia pestis KIM
cgccgccgcaccgcu

SEQ ID NO: 2315250 - RNA, 21 nt, Yersinia pestis KIM
cgccucaguaucuuuccagcc

SEQ ID NO: 2315251 - RNA, 23 nt, Yersinia pestis KIM
cgccgugucggaugccgcuccag

SEQ ID NO: 2315252 - RNA, 15 nt, Yersinia pestis KIM
cgccuaguuaaacuc

SEQ ID NO: 2315253 - RNA, 18 nt, Yersinia pestis KIM
cgccuaucugaaugaauu

SEQ ID NO: 2315254 - RNA, 12 nt, Yersinia pestis KIM
cgccuaccauca

SEQ ID NO: 2315255 - RNA, 12 nt, Yersinia pestis KIM
cgccuagcauca

SEQ ID NO: 2315256 - RNA, 23 nt, Yersinia pestis KIM
cgccuaaagcgccuuccuuuuau

SEQ ID NO: 2315257 - RNA, 17 nt, Yersinia pestis KIM
cgcgcuuuugauuuucu

SEQ ID NO: 2315258 - RNA, 11 nt, Yersinia pestis KIM
cgcgcuaacca

SEQ ID NO: 2315259 - RNA, 18 nt, Yersinia pestis KIM
cgcggcuagcccccaggg

SEQ ID NO: 2315260 - RNA, 23 nt, Yersinia pestis KIM
cgcggaugguacggaucagugug

SEQ ID NO: 2315261 - RNA, 17 nt, Yersinia pestis KIM
cgcggaugcgcgcguca

SEQ ID NO: 2315262 - RNA, 15 nt, Yersinia pestis KIM
cgcgccgacugcuga

SEQ ID NO: 2315263 - RNA, 15 nt, Yersinia pestis KIM
cgcgccacuucuuuc

SEQ ID NO: 2315264 - RNA, 16 nt, Yersinia pestis KIM
cgcgccacucuagcug

SEQ ID NO: 2315265 - RNA, 22 nt, Yersinia pestis KIM
cgcgagugaaccgcgcucugcu

SEQ ID NO: 2315266 - RNA, 16 nt, Yersinia pestis KIM
cgcgagucacauuuuu

SEQ ID NO: 2315267 - RNA, 16 nt, Yersinia pestis KIM
cgcugauaaccagcag

SEQ ID NO: 2315268 - RNA, 17 nt, Yersinia pestis KIM
cgcugauaaccagcagc

SEQ ID NO: 2315269 - RNA, 18 nt, Yersinia pestis KIM
cgcugauaacuuccuuug

SEQ ID NO: 2315270 - RNA, 20 nt, Yersinia pestis KIM
cgcugauguaggcaauacac

SEQ ID NO: 2315271 - RNA, 19 nt, Yersinia pestis KIM
cgcugcaacuccuuaccac

SEQ ID NO: 2315272 - RNA, 17 nt, Yersinia pestis KIM
cgcugcagcaucaagga

SEQ ID NO: 2315273 - RNA, 22 nt, Yersinia pestis KIM
cgcuggcaauacgugguuugau

SEQ ID NO: 2315274 - RNA, 17 nt, Yersinia pestis KIM
cgcugcucaaucaccga

SEQ ID NO: 2315275 - RNA, 19 nt, Yersinia pestis KIM
cgcuguuugauuaaaaccc

SEQ ID NO: 2315276 - RNA, 18 nt, Yersinia pestis KIM
cgcuuaaauaaaacaccc

SEQ ID NO: 2315277 - RNA, 14 nt, Yersinia pestis KIM
cgcuuaaggcauca

SEQ ID NO: 2315278 - RNA, 17 nt, Yersinia pestis KIM
cgcuuagcaggcccuuu

SEQ ID NO: 2315279 - RNA, 15 nt, Yersinia pestis KIM
cgcuucguccagaug

SEQ ID NO: 2315280 - RNA, 22 nt, Yersinia pestis KIM
cgcuuccagcgcuuccacugcg

SEQ ID NO: 2315281 - RNA, 18 nt, Yersinia pestis KIM
cgcuggcgaccacuuccu

SEQ ID NO: 2315282 - RNA, 19 nt, Yersinia pestis KIM
cgcugguuaucacagcaaa

SEQ ID NO: 2315283 - RNA, 22 nt, Yersinia pestis KIM
cgcuccaggcuggccacuucca

SEQ ID NO: 2315284 - RNA, 17 nt, Yersinia pestis KIM
cgcuccagauugucaau

SEQ ID NO: 2315285 - RNA, 16 nt, Yersinia pestis KIM
cgcucaucacggcggc

SEQ ID NO: 2315286 - RNA, 21 nt, Yersinia pestis KIM
cgcucauccaacguaaacauu

SEQ ID NO: 2315287 - RNA, 13 nt, Yersinia pestis KIM
cgcucaucgccaa

SEQ ID NO: 2315288 - RNA, 17 nt, Yersinia pestis KIM
cgcucaucgccaaagcc

SEQ ID NO: 2315289 - RNA, 22 nt, Yersinia pestis KIM
cgcucaucaaccgggauaucaa

SEQ ID NO: 2315290 - RNA, 14 nt, Yersinia pestis KIM
cgcuccacacaaaa

SEQ ID NO: 2315291 - RNA, 14 nt, Yersinia pestis KIM
cgcuccgagcgugc

SEQ ID NO: 2315292 - RNA, 18 nt, Yersinia pestis KIM
cgcuccggcaaccagcgu

SEQ ID NO: 2315293 - RNA, 15 nt, Yersinia pestis KIM
cgcucgaaccgccac

SEQ ID NO: 2315294 - RNA, 14 nt, Yersinia pestis KIM
cgcugacagaguac

SEQ ID NO: 2315295 - RNA, 20 nt, Yersinia pestis KIM
cgcugacagcuaucuugaaa

SEQ ID NO: 2315296 - RNA, 22 nt, Yersinia pestis KIM
cgcucggcaccgauuugcccca

SEQ ID NO: 2315297 - RNA, 23 nt, Yersinia pestis KIM
cgcucggcucgaaccugaacgca

SEQ ID NO: 2315298 - RNA, 21 nt, Yersinia pestis KIM
cgcucacuuuuauauccgcca

SEQ ID NO: 2315299 - RNA, 14 nt, Yersinia pestis KIM
cgcucacuuuuauu

SEQ ID NO: 2315300 - RNA, 23 nt, Yersinia pestis KIM
cgcuauucacuccuugaaguguu

SEQ ID NO: 2315301 - RNA, 15 nt, Yersinia pestis KIM
cgcuauaucaucagc

SEQ ID NO: 2315302 - RNA, 19 nt, Yersinia pestis KIM
cgcuaucacuagcgggccu

SEQ ID NO: 2315303 - RNA, 22 nt, Yersinia pestis KIM
cgcuauaaaacagcuugauagg

SEQ ID NO: 2315304 - RNA, 20 nt, Yersinia pestis KIM
cgcguugucagccaugccug

SEQ ID NO: 2315305 - RNA, 14 nt, Yersinia pestis KIM
cgccagcacgguua

SEQ ID NO: 2315306 - RNA, 19 nt, Yersinia pestis KIM
cgccagccccgcuaccaag

SEQ ID NO: 2315307 - RNA, 23 nt, Yersinia pestis KIM
cgccagauucgcaaagcgggcca

SEQ ID NO: 2315308 - RNA, 21 nt, Yersinia pestis KIM
cgccagcaaaucacauuucaa

SEQ ID NO: 2315309 - RNA, 19 nt, Yersinia pestis KIM
cgccagauuauccagcccu

SEQ ID NO: 2315310 - RNA, 18 nt, Yersinia pestis KIM
cgccagauggucacccuc

SEQ ID NO: 2315311 - RNA, 20 nt, Yersinia pestis KIM
cgccacgcagugccgaugag

SEQ ID NO: 2315312 - RNA, 15 nt, Yersinia pestis KIM
cgccacuuaucccaa

SEQ ID NO: 2315313 - RNA, 22 nt, Yersinia pestis KIM
cgcauccccaucgccaauacaa

SEQ ID NO: 2315314 - RNA, 15 nt, Yersinia pestis KIM
cgccauauauugauc

SEQ ID NO: 2315315 - RNA, 22 nt, Yersinia pestis KIM
cgccauauccaacuucuuccau

SEQ ID NO: 2315316 - RNA, 19 nt, Yersinia pestis KIM
cgccaguguugccauggcc

SEQ ID NO: 2315317 - RNA, 19 nt, Yersinia pestis KIM
cgccaguaaaccuggcggg

SEQ ID NO: 2315318 - RNA, 19 nt, Yersinia pestis KIM
cgccaguaaacagccagca

SEQ ID NO: 2315319 - RNA, 22 nt, Yersinia pestis KIM
cgccagucagcuagccugcccc

SEQ ID NO: 2315320 - RNA, 22 nt, Yersinia pestis KIM
cgccagggguaagauccaccac

SEQ ID NO: 2315321 - RNA, 20 nt, Yersinia pestis KIM
cgccaggaaaucaugacgcu

SEQ ID NO: 2315322 - RNA, 15 nt, Yersinia pestis KIM
cgccagcuauugcuu

SEQ ID NO: 2315323 - RNA, 20 nt, Yersinia pestis KIM
cgccagcggaauaugacgau

SEQ ID NO: 2315324 - RNA, 23 nt, Yersinia pestis KIM
cgccgaacgacaaauuuuuccuu

SEQ ID NO: 2315325 - RNA, 21 nt, Yersinia pestis KIM
cgcccguuggccggccaacau

SEQ ID NO: 2315326 - RNA, 11 nt, Yersinia pestis KIM
cgcccaggcca

SEQ ID NO: 2315327 - RNA, 20 nt, Yersinia pestis KIM
cgcccagcuaauugauccuc

SEQ ID NO: 2315328 - RNA, 23 nt, Yersinia pestis KIM
cgccccuuccaaugucaguggcg

SEQ ID NO: 2315329 - RNA, 20 nt, Yersinia pestis KIM
cgccccguuaauccuucacu

SEQ ID NO: 2315330 - RNA, 18 nt, Yersinia pestis KIM
cgccccuaacucgcgcuu

SEQ ID NO: 2315331 - RNA, 20 nt, Yersinia pestis KIM
cgccccgugcuacuccugcu

SEQ ID NO: 2315332 - RNA, 21 nt, Yersinia pestis KIM
cgcccccaauaagggccaccc

SEQ ID NO: 2315333 - RNA, 23 nt, Yersinia pestis KIM
cgccauauauugauccaaauggc

SEQ ID NO: 2315334 - RNA, 15 nt, Yersinia pestis KIM
cgccaucaauaauuu

SEQ ID NO: 2315335 - RNA, 14 nt, Yersinia pestis KIM
cgccaucaauaauu

SEQ ID NO: 2315336 - RNA, 21 nt, Yersinia pestis KIM
cgccaucagcgccgccucuuc

SEQ ID NO: 2315337 - RNA, 14 nt, Yersinia pestis KIM
cgccauuaaaaggu

SEQ ID NO: 2315338 - RNA, 17 nt, Yersinia pestis KIM
cgccauuaaaaggugcc

SEQ ID NO: 2315339 - RNA, 23 nt, Yersinia pestis KIM
cgccauuuuuauguuuaucaccc

SEQ ID NO: 2315340 - RNA, 16 nt, Yersinia pestis KIM
cgcccagacgccggcc

SEQ ID NO: 2315341 - RNA, 18 nt, Yersinia pestis KIM
cgcccaagcuuggccccu

SEQ ID NO: 2315342 - RNA, 16 nt, Yersinia pestis KIM
cgcacguaccacggcg

SEQ ID NO: 2315343 - RNA, 16 nt, Yersinia pestis KIM
cgcacgggucauuaac

SEQ ID NO: 2315344 - RNA, 13 nt, Yersinia pestis KIM
cgcacggcuacug

SEQ ID NO: 2315345 - RNA, 18 nt, Yersinia pestis KIM
cgcaccgaaauagucgcg

SEQ ID NO: 2315346 - RNA, 21 nt, Yersinia pestis KIM
cgcacugagagcauaacccca

SEQ ID NO: 2315347 - RNA, 20 nt, Yersinia pestis KIM
cgcagacugcugacaaaccc

SEQ ID NO: 2315348 - RNA, 20 nt, Yersinia pestis KIM
cgcagacggcguaagccuuc

SEQ ID NO: 2315349 - RNA, 17 nt, Yersinia pestis KIM
cgcagcaaauaaacaaa

SEQ ID NO: 2315350 - RNA, 18 nt, Yersinia pestis KIM
cgcaccauaaccaaucca

SEQ ID NO: 2315351 - RNA, 17 nt, Yersinia pestis KIM
cgcacccgcuacgguag

SEQ ID NO: 2315352 - RNA, 20 nt, Yersinia pestis KIM
cgcaaucaggauaaugagug

SEQ ID NO: 2315353 - RNA, 19 nt, Yersinia pestis KIM
cgcaauaaauggcauuuuu

SEQ ID NO: 2315354 - RNA, 23 nt, Yersinia pestis KIM
cgcaauaaaauaaauauccuccg

SEQ ID NO: 2315355 - RNA, 14 nt, Yersinia pestis KIM
cgauuucagcugcu

SEQ ID NO: 2315356 - RNA, 21 nt, Yersinia pestis KIM
cgauuucaucagcguuaccca

SEQ ID NO: 2315357 - RNA, 19 nt, Yersinia pestis KIM
cgcaguacucggcauugcc

SEQ ID NO: 2315358 - RNA, 16 nt, Yersinia pestis KIM
cgcaguuaucauugcu

SEQ ID NO: 2315359 - RNA, 15 nt, Yersinia pestis KIM
cgcaguguaaaaccu

SEQ ID NO: 2315360 - RNA, 21 nt, Yersinia pestis KIM
aaacggucauuguagauggcc

SEQ ID NO: 2315361 - RNA, 13 nt, Yersinia pestis KIM
aaacgguugcugu

SEQ ID NO: 2315362 - RNA, 15 nt, Yersinia pestis KIM
cgcagguucaucaga

SEQ ID NO: 2315363 - RNA, 16 nt, Yersinia pestis KIM
cgcagguuggcggcaa

SEQ ID NO: 2315364 - RNA, 14 nt, Yersinia pestis KIM
cgcaggucccucuu

SEQ ID NO: 2315365 - RNA, 17 nt, Yersinia pestis KIM
cgcagguaacgccgcug

SEQ ID NO: 2315366 - RNA, 11 nt, Yersinia pestis KIM
cgcagcuucca

SEQ ID NO: 2315367 - RNA, 22 nt, Yersinia pestis KIM
cgcagccaacggagcguacacg

SEQ ID NO: 2315368 - RNA, 22 nt, Yersinia pestis KIM
cgauccaaaacaucggccagcg

SEQ ID NO: 2315369 - RNA, 12 nt, Yersinia pestis KIM
cgaucauuuucu

SEQ ID NO: 2315370 - RNA, 16 nt, Yersinia pestis KIM
cgaucauaaaucacaa

SEQ ID NO: 2315371 - RNA, 17 nt, Yersinia pestis KIM
cgaucaguguaacggcc

SEQ ID NO: 2315372 - RNA, 16 nt, Yersinia pestis KIM
cgaucaggaagcccgu

SEQ ID NO: 2315373 - RNA, 17 nt, Yersinia pestis KIM
cgauccgggaaaaaaua

SEQ ID NO: 2315374 - RNA, 20 nt, Yersinia pestis KIM
cgaucccaauauuaaaauag

SEQ ID NO: 2315375 - RNA, 16 nt, Yersinia pestis KIM
cgauaacguuguuucu

SEQ ID NO: 2315376 - RNA, 20 nt, Yersinia pestis KIM
cgauaacggcgguaccaguc

SEQ ID NO: 2315377 - RNA, 15 nt, Yersinia pestis KIM
cgauaacgccccggc

SEQ ID NO: 2315378 - RNA, 17 nt, Yersinia pestis KIM
cgauaacguuguuucug

SEQ ID NO: 2315379 - RNA, 22 nt, Yersinia pestis KIM
cgauaacuuuuggcagcaccag

SEQ ID NO: 2315380 - RNA, 21 nt, Yersinia pestis KIM
cgauaagaaugaauauuuuca

SEQ ID NO: 2315381 - RNA, 20 nt, Yersinia pestis KIM
cgacgucccuaaagccaucg

SEQ ID NO: 2315382 - RNA, 21 nt, Yersinia pestis KIM
cgacgucccuaaagccaucgc

SEQ ID NO: 2315383 - RNA, 14 nt, Yersinia pestis KIM
cgacguccaaccca

SEQ ID NO: 2315384 - RNA, 18 nt, Yersinia pestis KIM
cgauacguugcaggucaa

SEQ ID NO: 2315385 - RNA, 18 nt, Yersinia pestis KIM
cgauacgcgccgcagcag

SEQ ID NO: 2315386 - RNA, 16 nt, Yersinia pestis KIM
cgauacgaucaucugg

SEQ ID NO: 2315387 - RNA, 18 nt, Yersinia pestis KIM
cgauacccauuuuaaucu

SEQ ID NO: 2315388 - RNA, 19 nt, Yersinia pestis KIM
cgauacccauuuuaaucuc

SEQ ID NO: 2315389 - RNA, 13 nt, Yersinia pestis KIM
cgauauaaauaaa

SEQ ID NO: 2315390 - RNA, 14 nt, Yersinia pestis KIM
cgauauacacccca

SEQ ID NO: 2315391 - RNA, 23 nt, Yersinia pestis KIM
cgauauauuucaacccgaucacc

SEQ ID NO: 2315392 - RNA, 22 nt, Yersinia pestis KIM
cgaucaacaggccaccuaacac

SEQ ID NO: 2315393 - RNA, 18 nt, Yersinia pestis KIM
cgaucacuuucccgcguc

SEQ ID NO: 2315394 - RNA, 19 nt, Yersinia pestis KIM
cgaucagcaauaugcugaa

SEQ ID NO: 2315395 - RNA, 16 nt, Yersinia pestis KIM
cgaucacaugcucagu

SEQ ID NO: 2315396 - RNA, 16 nt, Yersinia pestis KIM
cgaugacucgaacuga

SEQ ID NO: 2315397 - RNA, 19 nt, Yersinia pestis KIM
cgaugaggcucuucugggc

SEQ ID NO: 2315398 - RNA, 21 nt, Yersinia pestis KIM
cgaugcagcguauucaguaaa

SEQ ID NO: 2315399 - RNA, 16 nt, Yersinia pestis KIM
cgaucugaaacgguga

SEQ ID NO: 2315400 - RNA, 16 nt, Yersinia pestis KIM
cgaucuauucucugua

SEQ ID NO: 2315401 - RNA, 15 nt, Yersinia pestis KIM
cgaugguuucuccac

SEQ ID NO: 2315402 - RNA, 22 nt, Yersinia pestis KIM
cgauggauaaauucagccgcuc

SEQ ID NO: 2315403 - RNA, 22 nt, Yersinia pestis KIM
cgauuccaucagcgcacugcau

SEQ ID NO: 2315404 - RNA, 18 nt, Yersinia pestis KIM
cgauuaccugcauauccu

SEQ ID NO: 2315405 - RNA, 16 nt, Yersinia pestis KIM
cgauuaggacaaauag

SEQ ID NO: 2315406 - RNA, 16 nt, Yersinia pestis KIM
cgauuacccaccaccu

SEQ ID NO: 2315407 - RNA, 20 nt, Yersinia pestis KIM
cgauuaaaauaaagcgaguu

SEQ ID NO: 2315408 - RNA, 19 nt, Yersinia pestis KIM
cggcggcgagcacugcccc

SEQ ID NO: 2315409 - RNA, 17 nt, Yersinia pestis KIM
cggcggcgagcacugcc

SEQ ID NO: 2315410 - RNA, 16 nt, Yersinia pestis KIM
cggcggagagaaauag

SEQ ID NO: 2315411 - RNA, 21 nt, Yersinia pestis KIM
cggcgcgcuugccacgccagu

SEQ ID NO: 2315412 - RNA, 17 nt, Yersinia pestis KIM
cggcgaugaaaaacaga

SEQ ID NO: 2315413 - RNA, 16 nt, Yersinia pestis KIM
cggcgaguucgauaau

SEQ ID NO: 2315414 - RNA, 23 nt, Yersinia pestis KIM
cggcgaaagcauggcagguauca

SEQ ID NO: 2315415 - RNA, 15 nt, Yersinia pestis KIM
cggcgagcacugccc

SEQ ID NO: 2315416 - RNA, 12 nt, Yersinia pestis KIM
cggccccagccc

SEQ ID NO: 2315417 - RNA, 21 nt, Yersinia pestis KIM
cggcccauccaugggccucgc

SEQ ID NO: 2315418 - RNA, 23 nt, Yersinia pestis KIM
cggcccauccaugggccucgcuu

SEQ ID NO: 2315419 - RNA, 15 nt, Yersinia pestis KIM
cggccacccgccauc

SEQ ID NO: 2315420 - RNA, 16 nt, Yersinia pestis KIM
cggccagcauucaggc

SEQ ID NO: 2315421 - RNA, 18 nt, Yersinia pestis KIM
cggccaguguuuucucca

SEQ ID NO: 2315422 - RNA, 15 nt, Yersinia pestis KIM
cggcaugcaacuugg

SEQ ID NO: 2315423 - RNA, 22 nt, Yersinia pestis KIM
cggcaucgaguccguuaaaaaa

SEQ ID NO: 2315424 - RNA, 12 nt, Yersinia pestis KIM
cggcaucaccaa

SEQ ID NO: 2315425 - RNA, 13 nt, Yersinia pestis KIM
cggcaucaccaaa

SEQ ID NO: 2315426 - RNA, 17 nt, Yersinia pestis KIM
cggcauacuccauuuuu

SEQ ID NO: 2315427 - RNA, 18 nt, Yersinia pestis KIM
cggcauacuccauuuuuu

SEQ ID NO: 2315428 - RNA, 12 nt, Yersinia pestis KIM
cggcauaacagg

SEQ ID NO: 2315429 - RNA, 19 nt, Yersinia pestis KIM
cggcagcgagcacugcccc

SEQ ID NO: 2315430 - RNA, 17 nt, Yersinia pestis KIM
cggcagagaucauguag

SEQ ID NO: 2315431 - RNA, 21 nt, Yersinia pestis KIM
cggcacgcguugguuguccug

SEQ ID NO: 2315432 - RNA, 12 nt, Yersinia pestis KIM
cgcuugcaucaa

SEQ ID NO: 2315433 - RNA, 15 nt, Yersinia pestis KIM
ccccacaucaggccg

SEQ ID NO: 2315434 - RNA, 22 nt, Yersinia pestis KIM
ccccaaauaaucagcucauuaa

SEQ ID NO: 2315435 - RNA, 12 nt, Yersinia pestis KIM
ccccaccucuua

SEQ ID NO: 2315436 - RNA, 13 nt, Yersinia pestis KIM
cccauuuuauccu

SEQ ID NO: 2315437 - RNA, 14 nt, Yersinia pestis KIM
cccauggggccacc

SEQ ID NO: 2315438 - RNA, 10 nt, Yersinia pestis KIM
cccaucuuuc

SEQ ID NO: 2315439 - RNA, 15 nt, Yersinia pestis KIM
cccaugaccacuugg

SEQ ID NO: 2315440 - RNA, 18 nt, Yersinia pestis KIM
ccccgcgauguaaauauc

SEQ ID NO: 2315441 - RNA, 15 nt, Yersinia pestis KIM
cccccuguaaaacaa

SEQ ID NO: 2315442 - RNA, 12 nt, Yersinia pestis KIM
cccccaucccca

SEQ ID NO: 2315443 - RNA, 19 nt, Yersinia pestis KIM
cccccacucgccccacaau

SEQ ID NO: 2315444 - RNA, 13 nt, Yersinia pestis KIM
ccccaucgccaau

SEQ ID NO: 2315445 - RNA, 23 nt, Yersinia pestis KIM
ccccaucgccaauacaaucguca

SEQ ID NO: 2315446 - RNA, 12 nt, Yersinia pestis KIM
ccccaucucuuc

SEQ ID NO: 2315447 - RNA, 18 nt, Yersinia pestis KIM
ccccaucaauuuccccaa

SEQ ID NO: 2315448 - RNA, 12 nt, Yersinia pestis KIM
ccccauauuuuc

SEQ ID NO: 2315449 - RNA, 20 nt, Yersinia pestis KIM
cccgccaggaaaacgccccc

SEQ ID NO: 2315450 - RNA, 18 nt, Yersinia pestis KIM
cccgcaagcaaacugaua

SEQ ID NO: 2315451 - RNA, 14 nt, Yersinia pestis KIM
ccccguauaacgca

SEQ ID NO: 2315452 - RNA, 15 nt, Yersinia pestis KIM
ccccgcguugucagc

SEQ ID NO: 2315453 - RNA, 21 nt, Yersinia pestis KIM
cccgacagaacugauuucagg

SEQ ID NO: 2315454 - RNA, 12 nt, Yersinia pestis KIM
cccgagccgcac

SEQ ID NO: 2315455 - RNA, 20 nt, Yersinia pestis KIM
cccaggcaaucucuccccaa

SEQ ID NO: 2315456 - RNA, 17 nt, Yersinia pestis KIM
cccaagggcuauugcug

SEQ ID NO: 2315457 - RNA, 21 nt, Yersinia pestis KIM
cccacuuguaccugugccagu

SEQ ID NO: 2315458 - RNA, 16 nt, Yersinia pestis KIM
cccacuuuuugaauaa

SEQ ID NO: 2315459 - RNA, 20 nt, Yersinia pestis KIM
cccacuuuauuuuuuuccag

SEQ ID NO: 2315460 - RNA, 14 nt, Yersinia pestis KIM
cccaggcguucugu

SEQ ID NO: 2315461 - RNA, 18 nt, Yersinia pestis KIM
cccagguuacugcccugg

SEQ ID NO: 2315462 - RNA, 15 nt, Yersinia pestis KIM
cccagguuacugccc

SEQ ID NO: 2315463 - RNA, 22 nt, Yersinia pestis KIM
cccaguaaagcaaauucccacc

SEQ ID NO: 2315464 - RNA, 21 nt, Yersinia pestis KIM
cccaucgccaauacaaucguc

SEQ ID NO: 2315465 - RNA, 16 nt, Yersinia pestis KIM
cccauccgcaggaagc

SEQ ID NO: 2315466 - RNA, 15 nt, Yersinia pestis KIM
cccaucagcaucaau

SEQ ID NO: 2315467 - RNA, 15 nt, Yersinia pestis KIM
cccaucagcacuccc

SEQ ID NO: 2315468 - RNA, 11 nt, Yersinia pestis KIM
cccaucagacg

SEQ ID NO: 2315469 - RNA, 13 nt, Yersinia pestis KIM
cccaucagcacuc

SEQ ID NO: 2315470 - RNA, 11 nt, Yersinia pestis KIM
cccaucacuag

SEQ ID NO: 2315471 - RNA, 12 nt, Yersinia pestis KIM
cccaucaccauu

SEQ ID NO: 2315472 - RNA, 17 nt, Yersinia pestis KIM
cccaucaauuuccccaa

SEQ ID NO: 2315473 - RNA, 16 nt, Yersinia pestis KIM
cccauagcuggcuuca

SEQ ID NO: 2315474 - RNA, 21 nt, Yersinia pestis KIM
cccauagaugggccaggcaau

SEQ ID NO: 2315475 - RNA, 20 nt, Yersinia pestis KIM
cccauauaaaaaacuaaugu

SEQ ID NO: 2315476 - RNA, 18 nt, Yersinia pestis KIM
cccauaucuuuaaaaacc

SEQ ID NO: 2315477 - RNA, 11 nt, Yersinia pestis KIM
cccauaacaau

SEQ ID NO: 2315478 - RNA, 23 nt, Yersinia pestis KIM
aaacaauuuugguacagguguug

SEQ ID NO: 2315479 - RNA, 14 nt, Yersinia pestis KIM
ccauaaugugccuc

SEQ ID NO: 2315480 - RNA, 12 nt, Yersinia pestis KIM
ccauaauuccac

SEQ ID NO: 2315481 - RNA, 19 nt, Yersinia pestis KIM
ccauaaaaggauggcccaa

SEQ ID NO: 2315482 - RNA, 23 nt, Yersinia pestis KIM
ccaguugccacucauauucaaaa

SEQ ID NO: 2315483 - RNA, 20 nt, Yersinia pestis KIM
ccaguuuuccagagcccggg

SEQ ID NO: 2315484 - RNA, 14 nt, Yersinia pestis KIM
ccaguugucuauuu

SEQ ID NO: 2315485 - RNA, 22 nt, Yersinia pestis KIM
ccaguugggauguucagcucaa

SEQ ID NO: 2315486 - RNA, 18 nt, Yersinia pestis KIM
ccauacagugucaguaug

SEQ ID NO: 2315487 - RNA, 14 nt, Yersinia pestis KIM
ccauacccaaacca

SEQ ID NO: 2315488 - RNA, 19 nt, Yersinia pestis KIM
ccauacgaauuuuucccug

SEQ ID NO: 2315489 - RNA, 21 nt, Yersinia pestis KIM
ccauacccuuuggucaauaaa

SEQ ID NO: 2315490 - RNA, 18 nt, Yersinia pestis KIM
ccauagccgaucaccgca

SEQ ID NO: 2315491 - RNA, 14 nt, Yersinia pestis KIM
ccauaugcauggca

SEQ ID NO: 2315492 - RNA, 13 nt, Yersinia pestis KIM
ccauaugccauga

SEQ ID NO: 2315493 - RNA, 16 nt, Yersinia pestis KIM
ccaguucaguccagcc

SEQ ID NO: 2315494 - RNA, 17 nt, Yersinia pestis KIM
ccaguucaguccagcca

SEQ ID NO: 2315495 - RNA, 13 nt, Yersinia pestis KIM
ccaguuauuauuu

SEQ ID NO: 2315496 - RNA, 23 nt, Yersinia pestis KIM
ccaguucaagauaaaguucuucg

SEQ ID NO: 2315497 - RNA, 17 nt, Yersinia pestis KIM
ccagugcaaauuuaugc

SEQ ID NO: 2315498 - RNA, 20 nt, Yersinia pestis KIM
ccagugcaaaaugcucuuca

SEQ ID NO: 2315499 - RNA, 19 nt, Yersinia pestis KIM
ccagugccgcggcggccag

SEQ ID NO: 2315500 - RNA, 17 nt, Yersinia pestis KIM
ccagucucuuugccaag

SEQ ID NO: 2315501 - RNA, 18 nt, Yersinia pestis KIM
ccagucuaaacgccgcgu

SEQ ID NO: 2315502 - RNA, 21 nt, Yersinia pestis KIM
ccagucacuaccgcucagaua

SEQ ID NO: 2315503 - RNA, 13 nt, Yersinia pestis KIM
ccagucauucacc

SEQ ID NO: 2315504 - RNA, 15 nt, Yersinia pestis KIM
ccagucauaaauauc

SEQ ID NO: 2315505 - RNA, 22 nt, Yersinia pestis KIM
ccaguagaucucuguuuuccau

SEQ ID NO: 2315506 - RNA, 15 nt, Yersinia pestis KIM
ccaguaggggccacc

SEQ ID NO: 2315507 - RNA, 22 nt, Yersinia pestis KIM
ccaguaauaccuuaauggcuuu

SEQ ID NO: 2315508 - RNA, 17 nt, Yersinia pestis KIM
ccaguaagcuguugacc

SEQ ID NO: 2315509 - RNA, 23 nt, Yersinia pestis KIM
ccaguaagcuguugaccugaaga

SEQ ID NO: 2315510 - RNA, 21 nt, Yersinia pestis KIM
ccaguaagccugaugccuuga

SEQ ID NO: 2315511 - RNA, 13 nt, Yersinia pestis KIM
ccaguaaaaaaau

SEQ ID NO: 2315512 - RNA, 14 nt, Yersinia pestis KIM
ccaguaaaaaaaua

SEQ ID NO: 2315513 - RNA, 15 nt, Yersinia pestis KIM
ccagguucaauuuca

SEQ ID NO: 2315514 - RNA, 19 nt, Yersinia pestis KIM
ccagguucauuauuuauuc

SEQ ID NO: 2315515 - RNA, 21 nt, Yersinia pestis KIM
ccagguaagaaagagaugacc

SEQ ID NO: 2315516 - RNA, 20 nt, Yersinia pestis KIM
ccaggggucgacguucauau

SEQ ID NO: 2315517 - RNA, 17 nt, Yersinia pestis KIM
ccauggcugaaauaacu

SEQ ID NO: 2315518 - RNA, 15 nt, Yersinia pestis KIM
ccaugggaaaucaaa

SEQ ID NO: 2315519 - RNA, 15 nt, Yersinia pestis KIM
ccaugguaaccaccu

SEQ ID NO: 2315520 - RNA, 21 nt, Yersinia pestis KIM
ccaugguuacgccagcagcau

SEQ ID NO: 2315521 - RNA, 15 nt, Yersinia pestis KIM
ccauggugacuuacg

SEQ ID NO: 2315522 - RNA, 20 nt, Yersinia pestis KIM
ccauguaggcucgagccgcg

SEQ ID NO: 2315523 - RNA, 20 nt, Yersinia pestis KIM
ccaugucacuguucuugaug

SEQ ID NO: 2315524 - RNA, 17 nt, Yersinia pestis KIM
ccauuccguuauuaaac

SEQ ID NO: 2315525 - RNA, 22 nt, Yersinia pestis KIM
ccauuauuggcuggcaaaguua

SEQ ID NO: 2315526 - RNA, 19 nt, Yersinia pestis KIM
ccauuaucuuuaauuuucu

SEQ ID NO: 2315527 - RNA, 16 nt, Yersinia pestis KIM
ccauguugugugugaa

SEQ ID NO: 2315528 - RNA, 19 nt, Yersinia pestis KIM
ccauuaaacguuugggaua

SEQ ID NO: 2315529 - RNA, 22 nt, Yersinia pestis KIM
ccauuaaacguuugggauaacu

SEQ ID NO: 2315530 - RNA, 17 nt, Yersinia pestis KIM
ccauuaaccuaaaaacg

SEQ ID NO: 2315531 - RNA, 13 nt, Yersinia pestis KIM
cccaacugacuga

SEQ ID NO: 2315532 - RNA, 18 nt, Yersinia pestis KIM
cccaaggcgacuuugaug

SEQ ID NO: 2315533 - RNA, 20 nt, Yersinia pestis KIM
cccaaccgaccaaaggccaa

SEQ ID NO: 2315534 - RNA, 20 nt, Yersinia pestis KIM
ccauuuuuauaucagauuca

SEQ ID NO: 2315535 - RNA, 17 nt, Yersinia pestis KIM
ccauuuuuuauaaacac

SEQ ID NO: 2315536 - RNA, 18 nt, Yersinia pestis KIM
ccauuuucaauaccauau

SEQ ID NO: 2315537 - RNA, 17 nt, Yersinia pestis KIM
ccauuuuaauauuaugg

SEQ ID NO: 2315538 - RNA, 20 nt, Yersinia pestis KIM
ccauuuuaaucucuccauga

SEQ ID NO: 2315539 - RNA, 12 nt, Yersinia pestis KIM
ccauugccagaa

SEQ ID NO: 2315540 - RNA, 17 nt, Yersinia pestis KIM
ccauucugaaucgcugc

SEQ ID NO: 2315541 - RNA, 17 nt, Yersinia pestis KIM
ccauugcucgcgucaua

SEQ ID NO: 2315542 - RNA, 16 nt, Yersinia pestis KIM
ccaucgucagccccug

SEQ ID NO: 2315543 - RNA, 13 nt, Yersinia pestis KIM
ccaucgucucugc

SEQ ID NO: 2315544 - RNA, 20 nt, Yersinia pestis KIM
ccaucguauauccaccgauu

SEQ ID NO: 2315545 - RNA, 19 nt, Yersinia pestis KIM
ccaucuuucggccuccccu

SEQ ID NO: 2315546 - RNA, 20 nt, Yersinia pestis KIM
ccaucuuguucuaauaauaa

SEQ ID NO: 2315547 - RNA, 22 nt, Yersinia pestis KIM
ccaucuugggccgacucugcau

SEQ ID NO: 2315548 - RNA, 22 nt, Yersinia pestis KIM
ccaugacaaaauacgguucacu

SEQ ID NO: 2315549 - RNA, 21 nt, Yersinia pestis KIM
ccaugacacauauuucaggcu

SEQ ID NO: 2315550 - RNA, 19 nt, Yersinia pestis KIM
ccaugacagguugauaagu

SEQ ID NO: 2315551 - RNA, 13 nt, Yersinia pestis KIM
ccauggccgccag

SEQ ID NO: 2315552 - RNA, 18 nt, Yersinia pestis KIM
ccaugagaaccaguucug

SEQ ID NO: 2315553 - RNA, 15 nt, Yersinia pestis KIM
ccaugcacuccacua

SEQ ID NO: 2315554 - RNA, 18 nt, Yersinia pestis KIM
ccaugcacuccacuaugc

SEQ ID NO: 2315555 - RNA, 16 nt, Yersinia pestis KIM
ccauccaguauuucag

SEQ ID NO: 2315556 - RNA, 13 nt, Yersinia pestis KIM
ccauccacuaggu

SEQ ID NO: 2315557 - RNA, 22 nt, Yersinia pestis KIM
ccaucgcccccuguaguucauc

SEQ ID NO: 2315558 - RNA, 16 nt, Yersinia pestis KIM
ccaucgccgacaaaau

SEQ ID NO: 2315559 - RNA, 22 nt, Yersinia pestis KIM
ccaucgccgacaaaauccccca

SEQ ID NO: 2315560 - RNA, 19 nt, Yersinia pestis KIM
ccaucgccacuucuaacaa

SEQ ID NO: 2315561 - RNA, 17 nt, Yersinia pestis KIM
ccaucaggucaguaaug

SEQ ID NO: 2315562 - RNA, 16 nt, Yersinia pestis KIM
ccaucauaaaggcuaa

SEQ ID NO: 2315563 - RNA, 23 nt, Yersinia pestis KIM
ccaucaggcgcuuuucuauugga

SEQ ID NO: 2315564 - RNA, 23 nt, Yersinia pestis KIM
ccaucaggcuacggcugaucugc

SEQ ID NO: 2315565 - RNA, 16 nt, Yersinia pestis KIM
ccauauuacucacaca

SEQ ID NO: 2315566 - RNA, 18 nt, Yersinia pestis KIM
ccauauucccagccaacu

SEQ ID NO: 2315567 - RNA, 12 nt, Yersinia pestis KIM
ccauauuccccc

SEQ ID NO: 2315568 - RNA, 20 nt, Yersinia pestis KIM
ccauauucgcggccugcugu

SEQ ID NO: 2315569 - RNA, 21 nt, Yersinia pestis KIM
ccauauucgcggccugcuguu

SEQ ID NO: 2315570 - RNA, 18 nt, Yersinia pestis KIM
ccauauguugccaccagc

SEQ ID NO: 2315571 - RNA, 11 nt, Yersinia pestis KIM
ccgcaaaacug

SEQ ID NO: 2315572 - RNA, 13 nt, Yersinia pestis KIM
ccgcaccacaaag

SEQ ID NO: 2315573 - RNA, 17 nt, Yersinia pestis KIM
ccgcaccacaaaggcaa

SEQ ID NO: 2315574 - RNA, 13 nt, Yersinia pestis KIM
ccgcaccaaacag

SEQ ID NO: 2315575 - RNA, 20 nt, Yersinia pestis KIM
ccgcacugggucaucaccca

SEQ ID NO: 2315576 - RNA, 16 nt, Yersinia pestis KIM
ccgauuuaaacccucu

SEQ ID NO: 2315577 - RNA, 15 nt, Yersinia pestis KIM
ccgauuauaugaauc

SEQ ID NO: 2315578 - RNA, 23 nt, Yersinia pestis KIM
ccgcaguuugagaaacugaugcc

SEQ ID NO: 2315579 - RNA, 17 nt, Yersinia pestis KIM
ccgcaggucccucuuga

SEQ ID NO: 2315580 - RNA, 13 nt, Yersinia pestis KIM
ccgcaggaagcaa

SEQ ID NO: 2315581 - RNA, 16 nt, Yersinia pestis KIM
ccgcaucgugcuccgc

SEQ ID NO: 2315582 - RNA, 16 nt, Yersinia pestis KIM
ccgcaugcaacagaua

SEQ ID NO: 2315583 - RNA, 13 nt, Yersinia pestis KIM
ccgcauuccagcg

SEQ ID NO: 2315584 - RNA, 20 nt, Yersinia pestis KIM
ccgcauugaccgcuguuuga

SEQ ID NO: 2315585 - RNA, 18 nt, Yersinia pestis KIM
ccgcaucaccgcccauau

SEQ ID NO: 2315586 - RNA, 20 nt, Yersinia pestis KIM
ccgcauauucucgccccgug

SEQ ID NO: 2315587 - RNA, 19 nt, Yersinia pestis KIM
ccgccagauuauccagccc

SEQ ID NO: 2315588 - RNA, 19 nt, Yersinia pestis KIM
ccgccagcaauaagccacg

SEQ ID NO: 2315589 - RNA, 14 nt, Yersinia pestis KIM
ccgccagccccgcu

SEQ ID NO: 2315590 - RNA, 21 nt, Yersinia pestis KIM
ccgccacacaauacauagaag

SEQ ID NO: 2315591 - RNA, 20 nt, Yersinia pestis KIM
ccgcauuuucaaagguacgc

SEQ ID NO: 2315592 - RNA, 22 nt, Yersinia pestis KIM
ccgccagugccaccguaaaaaa

SEQ ID NO: 2315593 - RNA, 21 nt, Yersinia pestis KIM
ccgccaguggcuuugcaccau

SEQ ID NO: 2315594 - RNA, 14 nt, Yersinia pestis KIM
ccgccaguugcuca

SEQ ID NO: 2315595 - RNA, 17 nt, Yersinia pestis KIM
ccgccaguaaaccuggc

SEQ ID NO: 2315596 - RNA, 17 nt, Yersinia pestis KIM
aaaccaugagaauacuu

SEQ ID NO: 2315597 - RNA, 22 nt, Yersinia pestis KIM
ccgccaggaaauuugcacugca

SEQ ID NO: 2315598 - RNA, 19 nt, Yersinia pestis KIM
aaaccagcagcgcauaaaa

SEQ ID NO: 2315599 - RNA, 12 nt, Yersinia pestis KIM
aaaccacuuggc

SEQ ID NO: 2315600 - RNA, 15 nt, Yersinia pestis KIM
ccgccgucaaaccaa

SEQ ID NO: 2315601 - RNA, 16 nt, Yersinia pestis KIM
ccgccgguuuuugccc

SEQ ID NO: 2315602 - RNA, 14 nt, Yersinia pestis KIM
ccgccccccauccc

SEQ ID NO: 2315603 - RNA, 21 nt, Yersinia pestis KIM
ccgcccccaauaagggccacc

SEQ ID NO: 2315604 - RNA, 12 nt, Yersinia pestis KIM
ccgccccgggca

SEQ ID NO: 2315605 - RNA, 15 nt, Yersinia pestis KIM
ccgccauugccagaa

SEQ ID NO: 2315606 - RNA, 14 nt, Yersinia pestis KIM
ccgcccucuugaac

SEQ ID NO: 2315607 - RNA, 18 nt, Yersinia pestis KIM
ccgcccuugaccucauua

SEQ ID NO: 2315608 - RNA, 19 nt, Yersinia pestis KIM
aaacccgcgcagccuaaaa

SEQ ID NO: 2315609 - RNA, 14 nt, Yersinia pestis KIM
aaacccaaccccau

SEQ ID NO: 2315610 - RNA, 17 nt, Yersinia pestis KIM
aaacccauagcaaagau

SEQ ID NO: 2315611 - RNA, 13 nt, Yersinia pestis KIM
aaaccauuuuuau

SEQ ID NO: 2315612 - RNA, 18 nt, Yersinia pestis KIM
cccucgaacgaagccacg

SEQ ID NO: 2315613 - RNA, 12 nt, Yersinia pestis KIM
cccucaauaccg

SEQ ID NO: 2315614 - RNA, 12 nt, Yersinia pestis KIM
cccuauuuuugc

SEQ ID NO: 2315615 - RNA, 22 nt, Yersinia pestis KIM
cccugccagaaucagccccaag

SEQ ID NO: 2315616 - RNA, 19 nt, Yersinia pestis KIM
cccugccagaaucagcccc

SEQ ID NO: 2315617 - RNA, 18 nt, Yersinia pestis KIM
cccugcugauaauuuauu

SEQ ID NO: 2315618 - RNA, 13 nt, Yersinia pestis KIM
cccugcucuucug

SEQ ID NO: 2315619 - RNA, 22 nt, Yersinia pestis KIM
cccugaauuucaauaacaccgu

SEQ ID NO: 2315620 - RNA, 22 nt, Yersinia pestis KIM
cccucuugcuuaucaccccuuc

SEQ ID NO: 2315621 - RNA, 11 nt, Yersinia pestis KIM
cccugacuccc

SEQ ID NO: 2315622 - RNA, 16 nt, Yersinia pestis KIM
cccugacucccugacu

SEQ ID NO: 2315623 - RNA, 18 nt, Yersinia pestis KIM
cccugacucccugacucc

SEQ ID NO: 2315624 - RNA, 20 nt, Yersinia pestis KIM
cccugacucccugacucccu

SEQ ID NO: 2315625 - RNA, 20 nt, Yersinia pestis KIM
cccugaguuaucuguuucaa

SEQ ID NO: 2315626 - RNA, 23 nt, Yersinia pestis KIM
cccugagugugccuuggucucag

SEQ ID NO: 2315627 - RNA, 20 nt, Yersinia pestis KIM
cccugauaauuuucgcgcac

SEQ ID NO: 2315628 - RNA, 20 nt, Yersinia pestis KIM
cccugauccacuacuuauuu

SEQ ID NO: 2315629 - RNA, 19 nt, Yersinia pestis KIM
cccugauagucaauaaauc

SEQ ID NO: 2315630 - RNA, 20 nt, Yersinia pestis KIM
cccggugaucaucgcaccau

SEQ ID NO: 2315631 - RNA, 13 nt, Yersinia pestis KIM
cccggugcggcua

SEQ ID NO: 2315632 - RNA, 22 nt, Yersinia pestis KIM
cccgguaccgaggucauucagg

SEQ ID NO: 2315633 - RNA, 16 nt, Yersinia pestis KIM
cccggcucauccgcca

SEQ ID NO: 2315634 - RNA, 16 nt, Yersinia pestis KIM
cccgggaggagcugcg

SEQ ID NO: 2315635 - RNA, 23 nt, Yersinia pestis KIM
cccggcugaccuguuguaacacu

SEQ ID NO: 2315636 - RNA, 12 nt, Yersinia pestis KIM
cccuacagaaaa

SEQ ID NO: 2315637 - RNA, 19 nt, Yersinia pestis KIM
cccuaaugcgcucaccaag

SEQ ID NO: 2315638 - RNA, 16 nt, Yersinia pestis KIM
cccguugcauuuuucu

SEQ ID NO: 2315639 - RNA, 22 nt, Yersinia pestis KIM
cccuagccagccaccgcacacu

SEQ ID NO: 2315640 - RNA, 23 nt, Yersinia pestis KIM
cccuacauaaaaauagcuucccu

SEQ ID NO: 2315641 - RNA, 17 nt, Yersinia pestis KIM
cccgugcuacuccugcu

SEQ ID NO: 2315642 - RNA, 13 nt, Yersinia pestis KIM
cccgugcggcagu

SEQ ID NO: 2315643 - RNA, 22 nt, Yersinia pestis KIM
cccguucacuuacugccaaaga

SEQ ID NO: 2315644 - RNA, 16 nt, Yersinia pestis KIM
cccguucaucacccau

SEQ ID NO: 2315645 - RNA, 12 nt, Yersinia pestis KIM
cccguuccuuca

SEQ ID NO: 2315646 - RNA, 16 nt, Yersinia pestis KIM
cccguucuaguagugg

SEQ ID NO: 2315647 - RNA, 13 nt, Yersinia pestis KIM
ccgaauaaaaccu

SEQ ID NO: 2315648 - RNA, 14 nt, Yersinia pestis KIM
aaacaucaugacaa

SEQ ID NO: 2315649 - RNA, 17 nt, Yersinia pestis KIM
aaacaucaugacaaaaa

SEQ ID NO: 2315650 - RNA, 18 nt, Yersinia pestis KIM
aaacaucaugacaaaaau

SEQ ID NO: 2315651 - RNA, 22 nt, Yersinia pestis KIM
ccgaaagcgccugugggcggcu

SEQ ID NO: 2315652 - RNA, 22 nt, Yersinia pestis KIM
aaacagauauuuucggguaucu

SEQ ID NO: 2315653 - RNA, 14 nt, Yersinia pestis KIM
aaacagauaaaaaa

SEQ ID NO: 2315654 - RNA, 19 nt, Yersinia pestis KIM
aaacagauaacucagggcg

SEQ ID NO: 2315655 - RNA, 13 nt, Yersinia pestis KIM
cccuucagucagu

SEQ ID NO: 2315656 - RNA, 22 nt, Yersinia pestis KIM
cccuucagaugaauccagccau

SEQ ID NO: 2315657 - RNA, 14 nt, Yersinia pestis KIM
cccuucaagcaccc

SEQ ID NO: 2315658 - RNA, 19 nt, Yersinia pestis KIM
cccuuauccguuaacccaa

SEQ ID NO: 2315659 - RNA, 19 nt, Yersinia pestis KIM
cccuuaucggauuacuuca

SEQ ID NO: 2315660 - RNA, 19 nt, Yersinia pestis KIM
cccuuuuugguuuucuauu

SEQ ID NO: 2315661 - RNA, 24 nt, Yersinia pestis KIM
ccgaaaaaacagcgaucuauucuc

SEQ ID NO: 2315662 - RNA, 23 nt, Yersinia pestis KIM
aaacagguaaugcgcgcagcaag

SEQ ID NO: 2315663 - RNA, 15 nt, Yersinia pestis KIM
ccgacuugcccaaug

SEQ ID NO: 2315664 - RNA, 19 nt, Yersinia pestis KIM
ccgacuugcccaauggcaa

SEQ ID NO: 2315665 - RNA, 15 nt, Yersinia pestis KIM
ccgagccgcaccauc

SEQ ID NO: 2315666 - RNA, 16 nt, Yersinia pestis KIM
ccgagccgcaccaucu

SEQ ID NO: 2315667 - RNA, 15 nt, Yersinia pestis KIM
aaaccacuguuuuuc

SEQ ID NO: 2315668 - RNA, 21 nt, Yersinia pestis KIM
aaaccacugaccuauugauaa

SEQ ID NO: 2315669 - RNA, 20 nt, Yersinia pestis KIM
aaacauuuauguaugauauu

SEQ ID NO: 2315670 - RNA, 23 nt, Yersinia pestis KIM
aaacauuguuaccuaaccaaaca

SEQ ID NO: 2315671 - RNA, 18 nt, Yersinia pestis KIM
aaacauuuacuuauaaac

SEQ ID NO: 2315672 - RNA, 19 nt, Yersinia pestis KIM
aaacauuuacuuauaaaca

SEQ ID NO: 2315673 - RNA, 12 nt, Yersinia pestis KIM
ccgguauuugcu

SEQ ID NO: 2315674 - RNA, 17 nt, Yersinia pestis KIM
ccggucgcguaccuuca

SEQ ID NO: 2315675 - RNA, 23 nt, Yersinia pestis KIM
ccgguaaaaucacguuuccaaaa

SEQ ID NO: 2315676 - RNA, 14 nt, Yersinia pestis KIM
ccgggugcagcgcc

SEQ ID NO: 2315677 - RNA, 17 nt, Yersinia pestis KIM
ccgggucguaccggccc

SEQ ID NO: 2315678 - RNA, 15 nt, Yersinia pestis KIM
ccgggcgaacagaaa

SEQ ID NO: 2315679 - RNA, 19 nt, Yersinia pestis KIM
ccggcugcaauaagccaga

SEQ ID NO: 2315680 - RNA, 20 nt, Yersinia pestis KIM
ccggcugcgccauaugccau

SEQ ID NO: 2315681 - RNA, 15 nt, Yersinia pestis KIM
aaaccguuugccguu

SEQ ID NO: 2315682 - RNA, 20 nt, Yersinia pestis KIM
ccgggcaaacgccagugcaa

SEQ ID NO: 2315683 - RNA, 18 nt, Yersinia pestis KIM
ccgggauucaaacaaggc

SEQ ID NO: 2315684 - RNA, 19 nt, Yersinia pestis KIM
ccggcugggccgaugccag

SEQ ID NO: 2315685 - RNA, 17 nt, Yersinia pestis KIM
ccggcuaaugccgagaa

SEQ ID NO: 2315686 - RNA, 16 nt, Yersinia pestis KIM
aaaccgcuauaucauc

SEQ ID NO: 2315687 - RNA, 14 nt, Yersinia pestis KIM
ccggauaugccgcu

SEQ ID NO: 2315688 - RNA, 21 nt, Yersinia pestis KIM
ccggauagggggcaaccauau

SEQ ID NO: 2315689 - RNA, 17 nt, Yersinia pestis KIM
ccggauggucacccuuu

SEQ ID NO: 2315690 - RNA, 21 nt, Yersinia pestis KIM
ccggacauaaugcauccacuu

SEQ ID NO: 2315691 - RNA, 17 nt, Yersinia pestis KIM
ccgcuguaggugucacc

SEQ ID NO: 2315692 - RNA, 17 nt, Yersinia pestis KIM
ccgcuucgcgcccgccc

SEQ ID NO: 2315693 - RNA, 19 nt, Yersinia pestis KIM
ccgcuucgcgcccgcccca

SEQ ID NO: 2315694 - RNA, 17 nt, Yersinia pestis KIM
ccgcuuaucccuccauc

SEQ ID NO: 2315695 - RNA, 19 nt, Yersinia pestis KIM
ccgcuuauggggacucuuu

SEQ ID NO: 2315696 - RNA, 21 nt, Yersinia pestis KIM
ccggcgaagggcgcagccccc

SEQ ID NO: 2315697 - RNA, 16 nt, Yersinia pestis KIM
ccggcgaagcucuuug

SEQ ID NO: 2315698 - RNA, 20 nt, Yersinia pestis KIM
ccggcaugagauccugaaaa

SEQ ID NO: 2315699 - RNA, 20 nt, Yersinia pestis KIM
ccggcacaggcgcuggcaac

SEQ ID NO: 2315700 - RNA, 17 nt, Yersinia pestis KIM
ccggcaucaaccaagac

SEQ ID NO: 2315701 - RNA, 14 nt, Yersinia pestis KIM
ccguguucauggug

SEQ ID NO: 2315702 - RNA, 21 nt, Yersinia pestis KIM
ccguggcgacagcuauuuauu

SEQ ID NO: 2315703 - RNA, 19 nt, Yersinia pestis KIM
ccgugcaaucuguuauaaa

SEQ ID NO: 2315704 - RNA, 12 nt, Yersinia pestis KIM
ccgugcagggcg

SEQ ID NO: 2315705 - RNA, 16 nt, Yersinia pestis KIM
aaacgacgggcugcug

SEQ ID NO: 2315706 - RNA, 18 nt, Yersinia pestis KIM
aaacgacgggcugcugca

SEQ ID NO: 2315707 - RNA, 21 nt, Yersinia pestis KIM
aaacgaccaauuucaauaauu

SEQ ID NO: 2315708 - RNA, 19 nt, Yersinia pestis KIM
aaacgaauggucugcaacu

SEQ ID NO: 2315709 - RNA, 15 nt, Yersinia pestis KIM
ccgguuggcccucgg

SEQ ID NO: 2315710 - RNA, 19 nt, Yersinia pestis KIM
ccgguguuuuugacacggg

SEQ ID NO: 2315711 - RNA, 13 nt, Yersinia pestis KIM
ccguuccaaccgg

SEQ ID NO: 2315712 - RNA, 17 nt, Yersinia pestis KIM
ccguucccacuuccauc

SEQ ID NO: 2315713 - RNA, 17 nt, Yersinia pestis KIM
ccguucggucacacugg

SEQ ID NO: 2315714 - RNA, 18 nt, Yersinia pestis KIM
ccguuacaaccgccgccg

SEQ ID NO: 2315715 - RNA, 23 nt, Yersinia pestis KIM
ccguuaacacggcgaucagugua

SEQ ID NO: 2315716 - RNA, 17 nt, Yersinia pestis KIM
ccguuaacccaaagccc

SEQ ID NO: 2315717 - RNA, 19 nt, Yersinia pestis KIM
ccguuggccggccaacauc

SEQ ID NO: 2315718 - RNA, 19 nt, Yersinia pestis KIM
ccguuguguaucagcaacu

SEQ ID NO: 2315719 - RNA, 20 nt, Yersinia pestis KIM
ccguugugaguaauucgcag

SEQ ID NO: 2315720 - RNA, 15 nt, Yersinia pestis KIM
ccguugcauuuuucu

SEQ ID NO: 2315721 - RNA, 18 nt, Yersinia pestis KIM
ccguugcauuuuucuguu

SEQ ID NO: 2315722 - RNA, 13 nt, Yersinia pestis KIM
ccuaaauccugca

SEQ ID NO: 2315723 - RNA, 20 nt, Yersinia pestis KIM
ccuaacacguuaaauuucuu

SEQ ID NO: 2315724 - RNA, 12 nt, Yersinia pestis KIM
ccuaaccgcugu

SEQ ID NO: 2315725 - RNA, 21 nt, Yersinia pestis KIM
ccuaaccaaacauugucaccu

SEQ ID NO: 2315726 - RNA, 21 nt, Yersinia pestis KIM
ccuaagccggucuuuuuacaa

SEQ ID NO: 2315727 - RNA, 17 nt, Yersinia pestis KIM
ccuaauacagcaccacc

SEQ ID NO: 2315728 - RNA, 20 nt, Yersinia pestis KIM
ccuaauaaccgacagugcau

SEQ ID NO: 2315729 - RNA, 17 nt, Yersinia pestis KIM
ccguuuuauuucccccu

SEQ ID NO: 2315730 - RNA, 23 nt, Yersinia pestis KIM
ccguuuuaacgcugcccaauaaa

SEQ ID NO: 2315731 - RNA, 18 nt, Yersinia pestis KIM
ccuaaagcgccuuccuuu

SEQ ID NO: 2315732 - RNA, 18 nt, Yersinia pestis KIM
ccuaaagccaucgccauc

SEQ ID NO: 2315733 - RNA, 14 nt, Yersinia pestis KIM
ccuaaaaaaaacaa

SEQ ID NO: 2315734 - RNA, 21 nt, Yersinia pestis KIM
ccucgacuaaacgcccagcua

SEQ ID NO: 2315735 - RNA, 22 nt, Yersinia pestis KIM
ccucgcccuucgggucaacgcu

SEQ ID NO: 2315736 - RNA, 22 nt, Yersinia pestis KIM
ccucagccuuuuuugcuuaaaa

SEQ ID NO: 2315737 - RNA, 13 nt, Yersinia pestis KIM
ccucagccucauu

SEQ ID NO: 2315738 - RNA, 19 nt, Yersinia pestis KIM
ccuccggcgcccuucccau

SEQ ID NO: 2315739 - RNA, 18 nt, Yersinia pestis KIM
ccuccugcggcggagcaa

SEQ ID NO: 2315740 - RNA, 18 nt, Yersinia pestis KIM
ccuccuugagauccucca

SEQ ID NO: 2315741 - RNA, 18 nt, Yersinia pestis KIM
ccuccuuggggccucacu

SEQ ID NO: 2315742 - RNA, 19 nt, Yersinia pestis KIM
ccucacuuugcauuuucug

SEQ ID NO: 2315743 - RNA, 15 nt, Yersinia pestis KIM
ccucagacuaaugac

SEQ ID NO: 2315744 - RNA, 19 nt, Yersinia pestis KIM
ccucagacugcugacaaac

SEQ ID NO: 2315745 - RNA, 14 nt, Yersinia pestis KIM
ccuauuucaccgcu

SEQ ID NO: 2315746 - RNA, 22 nt, Yersinia pestis KIM
ccuauuuauugccauuuuaauc

SEQ ID NO: 2315747 - RNA, 11 nt, Yersinia pestis KIM
ccuauuuuuac

SEQ ID NO: 2315748 - RNA, 19 nt, Yersinia pestis KIM
ccuauagcucagaaaauaa

SEQ ID NO: 2315749 - RNA, 21 nt, Yersinia pestis KIM
ccuauagcaauauaauaaucu

SEQ ID NO: 2315750 - RNA, 14 nt, Yersinia pestis KIM
ccuauccucaccgu

SEQ ID NO: 2315751 - RNA, 14 nt, Yersinia pestis KIM
ccuauccugacacc

SEQ ID NO: 2315752 - RNA, 15 nt, Yersinia pestis KIM
ccuauugauaaaacc

SEQ ID NO: 2315753 - RNA, 22 nt, Yersinia pestis KIM
ccuaggcggugagggagucagg

SEQ ID NO: 2315754 - RNA, 20 nt, Yersinia pestis KIM
ccuaggcggugagggaguca

SEQ ID NO: 2315755 - RNA, 16 nt, Yersinia pestis KIM
ccuacguucaggcccc

SEQ ID NO: 2315756 - RNA, 18 nt, Yersinia pestis KIM
ccuacgccuaaaaaugau

SEQ ID NO: 2315757 - RNA, 17 nt, Yersinia pestis KIM
ccuacgccauuaaaagg

SEQ ID NO: 2315758 - RNA, 17 nt, Yersinia pestis KIM
ccuaccgcaccaaugcc

SEQ ID NO: 2315759 - RNA, 12 nt, Yersinia pestis KIM
ccuacuaccaaa

SEQ ID NO: 2315760 - RNA, 12 nt, Yersinia pestis KIM
ccuacugucaac

SEQ ID NO: 2315761 - RNA, 15 nt, Yersinia pestis KIM
ccuacagaaaaauaa

SEQ ID NO: 2315762 - RNA, 21 nt, Yersinia pestis KIM
ccuacacagucuuuuucccaa

SEQ ID NO: 2315763 - RNA, 18 nt, Yersinia pestis KIM
ccuaccaucaaaauaugu

SEQ ID NO: 2315764 - RNA, 19 nt, Yersinia pestis KIM
ccuacccuuugagaaagga

SEQ ID NO: 2315765 - RNA, 14 nt, Yersinia pestis KIM
ccuaccgcaccaau

SEQ ID NO: 2315766 - RNA, 13 nt, Yersinia pestis KIM
ccuacauggaugu

SEQ ID NO: 2315767 - RNA, 14 nt, Yersinia pestis KIM
ccuaaugccgcgcc

SEQ ID NO: 2315768 - RNA, 16 nt, Yersinia pestis KIM
cgaauuaauaaaaccu

SEQ ID NO: 2315769 - RNA, 14 nt, Yersinia pestis KIM
cgaauuauuuagag

SEQ ID NO: 2315770 - RNA, 17 nt, Yersinia pestis KIM
cgaauggccgcugcagg

SEQ ID NO: 2315771 - RNA, 22 nt, Yersinia pestis KIM
cgaaugagcaguaauagcaaaa

SEQ ID NO: 2315772 - RNA, 17 nt, Yersinia pestis KIM
cgaaugaguuuuguccu

SEQ ID NO: 2315773 - RNA, 17 nt, Yersinia pestis KIM
cgaaugaucagaggcug

SEQ ID NO: 2315774 - RNA, 16 nt, Yersinia pestis KIM
cgaaugagcaguaaua

SEQ ID NO: 2315775 - RNA, 15 nt, Yersinia pestis KIM
cgaauaaauaauugg

SEQ ID NO: 2315776 - RNA, 17 nt, Yersinia pestis KIM
cgaauaaauauccuccg

SEQ ID NO: 2315777 - RNA, 12 nt, Yersinia pestis KIM
cgaauaaaaccu

SEQ ID NO: 2315778 - RNA, 19 nt, Yersinia pestis KIM
cgaaguuuuagccuaaaag

SEQ ID NO: 2315779 - RNA, 18 nt, Yersinia pestis KIM
cgaauaacucucaucuau

SEQ ID NO: 2315780 - RNA, 21 nt, Yersinia pestis KIM
cgaacguaaaaaguagauccc

SEQ ID NO: 2315781 - RNA, 21 nt, Yersinia pestis KIM
cgaacugaaacggugaggaua

SEQ ID NO: 2315782 - RNA, 14 nt, Yersinia pestis KIM
cgaacuaucuuuuc

SEQ ID NO: 2315783 - RNA, 15 nt, Yersinia pestis KIM
cgaagcauuacacca

SEQ ID NO: 2315784 - RNA, 22 nt, Yersinia pestis KIM
cgaagccccaggccacauggcg

SEQ ID NO: 2315785 - RNA, 13 nt, Yersinia pestis KIM
cgacagggacucc

SEQ ID NO: 2315786 - RNA, 18 nt, Yersinia pestis KIM
cgacaggguuuaacgggc

SEQ ID NO: 2315787 - RNA, 14 nt, Yersinia pestis KIM
cgacagcagcaggc

SEQ ID NO: 2315788 - RNA, 14 nt, Yersinia pestis KIM
cgacaccaagaggc

SEQ ID NO: 2315789 - RNA, 17 nt, Yersinia pestis KIM
cgacaccguugauugau

SEQ ID NO: 2315790 - RNA, 20 nt, Yersinia pestis KIM
cgacaauaccgccacacaau

SEQ ID NO: 2315791 - RNA, 23 nt, Yersinia pestis KIM
cgacaauaccgccacacaauaca

SEQ ID NO: 2315792 - RNA, 17 nt, Yersinia pestis KIM
cgacaauauuccaaaaa

SEQ ID NO: 2315793 - RNA, 19 nt, Yersinia pestis KIM
cgacaauauuccaaaaaau

SEQ ID NO: 2315794 - RNA, 13 nt, Yersinia pestis KIM
cgacacaaaugcu

SEQ ID NO: 2315795 - RNA, 17 nt, Yersinia pestis KIM
cgacaaauuuuuccuuu

SEQ ID NO: 2315796 - RNA, 14 nt, Yersinia pestis KIM
cgaauugaucugau

SEQ ID NO: 2315797 - RNA, 13 nt, Yersinia pestis KIM
cgaauuuuauuca

SEQ ID NO: 2315798 - RNA, 21 nt, Yersinia pestis KIM
cgacggaugaaaagugaucca

SEQ ID NO: 2315799 - RNA, 17 nt, Yersinia pestis KIM
cgaccugaugccccaug

SEQ ID NO: 2315800 - RNA, 18 nt, Yersinia pestis KIM
cgaccggggaucaauaaa

SEQ ID NO: 2315801 - RNA, 16 nt, Yersinia pestis KIM
cgaccgcugauaucau

SEQ ID NO: 2315802 - RNA, 12 nt, Yersinia pestis KIM
cgaccagcagaa

SEQ ID NO: 2315803 - RNA, 14 nt, Yersinia pestis KIM
cgacccacgccccu

SEQ ID NO: 2315804 - RNA, 16 nt, Yersinia pestis KIM
cgaccaauucaucagc

SEQ ID NO: 2315805 - RNA, 17 nt, Yersinia pestis KIM
cgaccaccacugcauca

SEQ ID NO: 2315806 - RNA, 21 nt, Yersinia pestis KIM
cgaccaccacugcaucaucgc

SEQ ID NO: 2315807 - RNA, 22 nt, Yersinia pestis KIM
cgacauuaagcauauccaacgc

SEQ ID NO: 2315808 - RNA, 22 nt, Yersinia pestis KIM
cgacauuccagauaucccaacu

SEQ ID NO: 2315809 - RNA, 22 nt, Yersinia pestis KIM
cgaccaaauggacgaacagccc

SEQ ID NO: 2315810 - RNA, 17 nt, Yersinia pestis KIM
ccuuuaccuacaaccug

SEQ ID NO: 2315811 - RNA, 15 nt, Yersinia pestis KIM
ccuuuacuaucacua

SEQ ID NO: 2315812 - RNA, 14 nt, Yersinia pestis KIM
ccuuuaaaacuggu

SEQ ID NO: 2315813 - RNA, 13 nt, Yersinia pestis KIM
ccuuuauuaccuu

SEQ ID NO: 2315814 - RNA, 16 nt, Yersinia pestis KIM
ccuuuauucauucaga

SEQ ID NO: 2315815 - RNA, 12 nt, Yersinia pestis KIM
ccuuucaaaauu

SEQ ID NO: 2315816 - RNA, 15 nt, Yersinia pestis KIM
ccuuuugaauucacc

SEQ ID NO: 2315817 - RNA, 15 nt, Yersinia pestis KIM
ccuuucgaguugaac

SEQ ID NO: 2315818 - RNA, 14 nt, Yersinia pestis KIM
ccuuucguucacuu

SEQ ID NO: 2315819 - RNA, 21 nt, Yersinia pestis KIM
ccuuucguucacuuaucccuu

SEQ ID NO: 2315820 - RNA, 22 nt, Yersinia pestis KIM
ccuuggcauugucugcuggccu

SEQ ID NO: 2315821 - RNA, 13 nt, Yersinia pestis KIM
ccuuguggaucca

SEQ ID NO: 2315822 - RNA, 15 nt, Yersinia pestis KIM
ccuuguugccuuucu

SEQ ID NO: 2315823 - RNA, 23 nt, Yersinia pestis KIM
ccuuguaagaccaauugguaaga

SEQ ID NO: 2315824 - RNA, 24 nt, Yersinia pestis KIM
ccuuggcgcggacgcuuuacuccu

SEQ ID NO: 2315825 - RNA, 16 nt, Yersinia pestis KIM
ccuucagcgauacaac

SEQ ID NO: 2315826 - RNA, 19 nt, Yersinia pestis KIM
ccuucaggccuuuacuguu

SEQ ID NO: 2315827 - RNA, 14 nt, Yersinia pestis KIM
ccuucaggaauaaa

SEQ ID NO: 2315828 - RNA, 21 nt, Yersinia pestis KIM
ccuucaguuuauuuaagcuga

SEQ ID NO: 2315829 - RNA, 20 nt, Yersinia pestis KIM
ccuucuuguaaaucuugagc

SEQ ID NO: 2315830 - RNA, 11 nt, Yersinia pestis KIM
ccuucuucaau

SEQ ID NO: 2315831 - RNA, 15 nt, Yersinia pestis KIM
ccuucuuccauugau

SEQ ID NO: 2315832 - RNA, 13 nt, Yersinia pestis KIM
ccuucggacgcuc

SEQ ID NO: 2315833 - RNA, 19 nt, Yersinia pestis KIM
ccuuauccguuaacccaaa

SEQ ID NO: 2315834 - RNA, 18 nt, Yersinia pestis KIM
ccuuauucaaagaauaac

SEQ ID NO: 2315835 - RNA, 15 nt, Yersinia pestis KIM
ccuuaugguuaucac

SEQ ID NO: 2315836 - RNA, 21 nt, Yersinia pestis KIM
ccuguaccaccaccaacagca

SEQ ID NO: 2315837 - RNA, 14 nt, Yersinia pestis KIM
ccuguaccaccacc

SEQ ID NO: 2315838 - RNA, 19 nt, Yersinia pestis KIM
ccuuaauguuuuacgauca

SEQ ID NO: 2315839 - RNA, 15 nt, Yersinia pestis KIM
ccuucacuuacucuc

SEQ ID NO: 2315840 - RNA, 11 nt, Yersinia pestis KIM
ccuucacccag

SEQ ID NO: 2315841 - RNA, 15 nt, Yersinia pestis KIM
ccuucacccaggcug

SEQ ID NO: 2315842 - RNA, 13 nt, Yersinia pestis KIM
ccuucaccaauac

SEQ ID NO: 2315843 - RNA, 14 nt, Yersinia pestis KIM
ccuucaccaauaca

SEQ ID NO: 2315844 - RNA, 13 nt, Yersinia pestis KIM
ccuucaacucuac

SEQ ID NO: 2315845 - RNA, 13 nt, Yersinia pestis KIM
ccuucaaucagca

SEQ ID NO: 2315846 - RNA, 16 nt, Yersinia pestis KIM
ccuggcaccggacaaa

SEQ ID NO: 2315847 - RNA, 20 nt, Yersinia pestis KIM
ccuggccguguuuuucccua

SEQ ID NO: 2315848 - RNA, 15 nt, Yersinia pestis KIM
ccuggcuaauuuuau

SEQ ID NO: 2315849 - RNA, 13 nt, Yersinia pestis KIM
ccuggcucaaauu

SEQ ID NO: 2315850 - RNA, 16 nt, Yersinia pestis KIM
ccuguaaugcauuccc

SEQ ID NO: 2315851 - RNA, 19 nt, Yersinia pestis KIM
ccuguaacgcuaaacuaaa

SEQ ID NO: 2315852 - RNA, 16 nt, Yersinia pestis KIM
ccuguaacuuuauuga

SEQ ID NO: 2315853 - RNA, 19 nt, Yersinia pestis KIM
ccugccagaaucagcccca

SEQ ID NO: 2315854 - RNA, 16 nt, Yersinia pestis KIM
ccugccagaacagcag

SEQ ID NO: 2315855 - RNA, 15 nt, Yersinia pestis KIM
ccugccaugucacug

SEQ ID NO: 2315856 - RNA, 22 nt, Yersinia pestis KIM
ccugcagguaagaaggcaauau

SEQ ID NO: 2315857 - RNA, 24 nt, Yersinia pestis KIM
ccugcaccauauucccagccaacu

SEQ ID NO: 2315858 - RNA, 15 nt, Yersinia pestis KIM
ccugcaccagugcca

SEQ ID NO: 2315859 - RNA, 22 nt, Yersinia pestis KIM
ccugcacuuaacgcuuuaucuc

SEQ ID NO: 2315860 - RNA, 19 nt, Yersinia pestis KIM
ccugcuuaaugcgaacagc

SEQ ID NO: 2315861 - RNA, 19 nt, Yersinia pestis KIM
ccugcuccaaagcuuccaa

SEQ ID NO: 2315862 - RNA, 19 nt, Yersinia pestis KIM
ccugccugggccgcugggc

SEQ ID NO: 2315863 - RNA, 19 nt, Yersinia pestis KIM
ccugcgaggcacuucauug

SEQ ID NO: 2315864 - RNA, 18 nt, Yersinia pestis KIM
ccugcggcgguuacccuc

SEQ ID NO: 2315865 - RNA, 13 nt, Yersinia pestis KIM
ccugcgggccagc

SEQ ID NO: 2315866 - RNA, 14 nt, Yersinia pestis KIM
ccugcucacgcaaa

SEQ ID NO: 2315867 - RNA, 12 nt, Yersinia pestis KIM
ccugcucagcua

SEQ ID NO: 2315868 - RNA, 17 nt, Yersinia pestis KIM
cauucauuuuaaaaaaa

SEQ ID NO: 2315869 - RNA, 18 nt, Yersinia pestis KIM
cauucauuuuaaaaaaau

SEQ ID NO: 2315870 - RNA, 14 nt, Yersinia pestis KIM
cauucagcaauauu

SEQ ID NO: 2315871 - RNA, 18 nt, Yersinia pestis KIM
cauucagcacccaacuua

SEQ ID NO: 2315872 - RNA, 19 nt, Yersinia pestis KIM
cauucaugaggcucagacu

SEQ ID NO: 2315873 - RNA, 20 nt, Yersinia pestis KIM
cauuccaauuagauuugagc

SEQ ID NO: 2315874 - RNA, 16 nt, Yersinia pestis KIM
cauuccaguaaaaaaa

SEQ ID NO: 2315875 - RNA, 17 nt, Yersinia pestis KIM
cauuauugaacgcuugc

SEQ ID NO: 2315876 - RNA, 19 nt, Yersinia pestis KIM
cauuauugaacgcuugcaa

SEQ ID NO: 2315877 - RNA, 13 nt, Yersinia pestis KIM
cauucaauguaaa

SEQ ID NO: 2315878 - RNA, 22 nt, Yersinia pestis KIM
cauucaauggaauguucauuca

SEQ ID NO: 2315879 - RNA, 14 nt, Yersinia pestis KIM
cauuauuaaacuga

SEQ ID NO: 2315880 - RNA, 23 nt, Yersinia pestis KIM
cauuaucuaaacaauugccuuug

SEQ ID NO: 2315881 - RNA, 22 nt, Yersinia pestis KIM
cauuaucucgccuuuaaacgca

SEQ ID NO: 2315882 - RNA, 18 nt, Yersinia pestis KIM
cauuaucuuuaauuuuuc

SEQ ID NO: 2315883 - RNA, 19 nt, Yersinia pestis KIM
cauuauccggccauuuuuu

SEQ ID NO: 2315884 - RNA, 18 nt, Yersinia pestis KIM
cauuauccguuugcaaca

SEQ ID NO: 2315885 - RNA, 20 nt, Yersinia pestis KIM
cauuauccguuugcaacagu

SEQ ID NO: 2315886 - RNA, 19 nt, Yersinia pestis KIM
cauuauccguuugcaacau

SEQ ID NO: 2315887 - RNA, 17 nt, Yersinia pestis KIM
cauuaauugguuuuaau

SEQ ID NO: 2315888 - RNA, 21 nt, Yersinia pestis KIM
cauuaauugguuuuaauaacc

SEQ ID NO: 2315889 - RNA, 13 nt, Yersinia pestis KIM
cauuaauuucacc

SEQ ID NO: 2315890 - RNA, 14 nt, Yersinia pestis KIM
cauuauauuauuua

SEQ ID NO: 2315891 - RNA, 17 nt, Yersinia pestis KIM
cauuacaagugccaaau

SEQ ID NO: 2315892 - RNA, 15 nt, Yersinia pestis KIM
cauucccugcgguua

SEQ ID NO: 2315893 - RNA, 22 nt, Yersinia pestis KIM
cauucccugcgguuauuugcua

SEQ ID NO: 2315894 - RNA, 16 nt, Yersinia pestis KIM
cauuccccaucgccaa

SEQ ID NO: 2315895 - RNA, 20 nt, Yersinia pestis KIM
cauuccccaucgccaauugg

SEQ ID NO: 2315896 - RNA, 23 nt, Yersinia pestis KIM
cauucucuacucgcucaccacug

SEQ ID NO: 2315897 - RNA, 16 nt, Yersinia pestis KIM
cauucugauagugauu

SEQ ID NO: 2315898 - RNA, 14 nt, Yersinia pestis KIM
cauucucuuuuaau

SEQ ID NO: 2315899 - RNA, 20 nt, Yersinia pestis KIM
cauucugauagugauuuuuu

SEQ ID NO: 2315900 - RNA, 21 nt, Yersinia pestis KIM
cauucuggggcgguuuuccuc

SEQ ID NO: 2315901 - RNA, 22 nt, Yersinia pestis KIM
cauugaauggugcuguauuuaa

SEQ ID NO: 2315902 - RNA, 22 nt, Yersinia pestis KIM
cauugagcauaucaaucagcau

SEQ ID NO: 2315903 - RNA, 15 nt, Yersinia pestis KIM
cauucugucaucaag

SEQ ID NO: 2315904 - RNA, 19 nt, Yersinia pestis KIM
cauucuuuuuguuaaaaua

SEQ ID NO: 2315905 - RNA, 20 nt, Yersinia pestis KIM
cauuaacgacauuucguuua

SEQ ID NO: 2315906 - RNA, 21 nt, Yersinia pestis KIM
cauuaacacauuaauuuaucu

SEQ ID NO: 2315907 - RNA, 13 nt, Yersinia pestis KIM
cauuaacaaacug

SEQ ID NO: 2315908 - RNA, 22 nt, Yersinia pestis KIM
cauuaagauaauagcuaaacau

SEQ ID NO: 2315909 - RNA, 12 nt, Yersinia pestis KIM
cauuaagaugca

SEQ ID NO: 2315910 - RNA, 11 nt, Yersinia pestis KIM
cauuaaacaga

SEQ ID NO: 2315911 - RNA, 21 nt, Yersinia pestis KIM
cauuaaagauuucaucauuca

SEQ ID NO: 2315912 - RNA, 15 nt, Yersinia pestis KIM
cauuaaacuguucuu

SEQ ID NO: 2315913 - RNA, 17 nt, Yersinia pestis KIM
cauuaaauccaauauuc

SEQ ID NO: 2315914 - RNA, 17 nt, Yersinia pestis KIM
cauuaaaugcuuuuugc

SEQ ID NO: 2315915 - RNA, 14 nt, Yersinia pestis KIM
cauuaaaaauacaa

SEQ ID NO: 2315916 - RNA, 20 nt, Yersinia pestis KIM
caugucagacagcacgggcu

SEQ ID NO: 2315917 - RNA, 16 nt, Yersinia pestis KIM
caugucacuguucuug

SEQ ID NO: 2315918 - RNA, 17 nt, Yersinia pestis KIM
cauguucgcacugcucu

SEQ ID NO: 2315919 - RNA, 13 nt, Yersinia pestis KIM
cauguugcaacau

SEQ ID NO: 2315920 - RNA, 24 nt, Yersinia pestis KIM
caugcggcgugggcaaucuccagu

SEQ ID NO: 2315921 - RNA, 16 nt, Yersinia pestis KIM
caugcggauugaacug

SEQ ID NO: 2315922 - RNA, 20 nt, Yersinia pestis KIM
caugcggauugaacugcgcu

SEQ ID NO: 2315923 - RNA, 16 nt, Yersinia pestis KIM
cauggcgaaaauccuu

SEQ ID NO: 2315924 - RNA, 23 nt, Yersinia pestis KIM
caugcucagaaaccugugugacc

SEQ ID NO: 2315925 - RNA, 16 nt, Yersinia pestis KIM
caugcucaaucugcaa

SEQ ID NO: 2315926 - RNA, 19 nt, Yersinia pestis KIM
caugcuaacuuguucagaa

SEQ ID NO: 2315927 - RNA, 22 nt, Yersinia pestis KIM
caugcguugaugcucuucuuca

SEQ ID NO: 2315928 - RNA, 22 nt, Yersinia pestis KIM
caugggcaagcucugggcugau

SEQ ID NO: 2315929 - RNA, 18 nt, Yersinia pestis KIM
cauggcggcagcacagag

SEQ ID NO: 2315930 - RNA, 13 nt, Yersinia pestis KIM
caugguuucgcag

SEQ ID NO: 2315931 - RNA, 17 nt, Yersinia pestis KIM
caugguugcuagcccaa

SEQ ID NO: 2315932 - RNA, 22 nt, Yersinia pestis KIM
caugggguuuauugguuauuuu

SEQ ID NO: 2315933 - RNA, 23 nt, Yersinia pestis KIM
caugguuaagagaucccgugcca

SEQ ID NO: 2315934 - RNA, 20 nt, Yersinia pestis KIM
caugguucugcucaauagcc

SEQ ID NO: 2315935 - RNA, 15 nt, Yersinia pestis KIM
caugaauauucacca

SEQ ID NO: 2315936 - RNA, 16 nt, Yersinia pestis KIM
caugaaguugauaaaa

SEQ ID NO: 2315937 - RNA, 15 nt, Yersinia pestis KIM
caugacaaauugcaa

SEQ ID NO: 2315938 - RNA, 13 nt, Yersinia pestis KIM
caugacaaaauac

SEQ ID NO: 2315939 - RNA, 13 nt, Yersinia pestis KIM
caugaauggcuuu

SEQ ID NO: 2315940 - RNA, 14 nt, Yersinia pestis KIM
caugacaucccagc

SEQ ID NO: 2315941 - RNA, 23 nt, Yersinia pestis KIM
caugagaauacuucaggccaaua

SEQ ID NO: 2315942 - RNA, 14 nt, Yersinia pestis KIM
caugagauaaauau

SEQ ID NO: 2315943 - RNA, 20 nt, Yersinia pestis KIM
caugacgguggcacgagggu

SEQ ID NO: 2315944 - RNA, 19 nt, Yersinia pestis KIM
caugauaaaacuauucugc

SEQ ID NO: 2315945 - RNA, 15 nt, Yersinia pestis KIM
caugagugaaaauau

SEQ ID NO: 2315946 - RNA, 19 nt, Yersinia pestis KIM
caugaguguuggccucaga

SEQ ID NO: 2315947 - RNA, 22 nt, Yersinia pestis KIM
caucgugcuccgcuuccaucac

SEQ ID NO: 2315948 - RNA, 21 nt, Yersinia pestis KIM
caucuuucucauuagcgucuu

SEQ ID NO: 2315949 - RNA, 22 nt, Yersinia pestis KIM
caucuuuaccccauugcaccaa

SEQ ID NO: 2315950 - RNA, 16 nt, Yersinia pestis KIM
caucuuuaauuaaugg

SEQ ID NO: 2315951 - RNA, 22 nt, Yersinia pestis KIM
caucuuuaauaaauuuucuaag

SEQ ID NO: 2315952 - RNA, 15 nt, Yersinia pestis KIM
caucuuuaacaacaa

SEQ ID NO: 2315953 - RNA, 19 nt, Yersinia pestis KIM
caucuuguucuaauaauaa

SEQ ID NO: 2315954 - RNA, 12 nt, Yersinia pestis KIM
caucuuuugcua

SEQ ID NO: 2315955 - RNA, 22 nt, Yersinia pestis KIM
caucuuuuuuuuuauuaucauc

SEQ ID NO: 2315956 - RNA, 18 nt, Yersinia pestis KIM
caugcccagccucuggau

SEQ ID NO: 2315957 - RNA, 15 nt, Yersinia pestis KIM
caugccacuucgcua

SEQ ID NO: 2315958 - RNA, 23 nt, Yersinia pestis KIM
caugccagaaacggcaucugcca

SEQ ID NO: 2315959 - RNA, 18 nt, Yersinia pestis KIM
caugccccaauguagaca

SEQ ID NO: 2315960 - RNA, 19 nt, Yersinia pestis KIM
caugcgauacgcccgcccc

SEQ ID NO: 2315961 - RNA, 14 nt, Yersinia pestis KIM
caugcgauacgccc

SEQ ID NO: 2315962 - RNA, 17 nt, Yersinia pestis KIM
caugcauuggaaaaaau

SEQ ID NO: 2315963 - RNA, 15 nt, Yersinia pestis KIM
caugcauuaaggcgc

SEQ ID NO: 2315964 - RNA, 23 nt, Yersinia pestis KIM
caugcauuaaggcgcgacugauu

SEQ ID NO: 2315965 - RNA, 15 nt, Yersinia pestis KIM
caugauuuguugaug

SEQ ID NO: 2315966 - RNA, 20 nt, Yersinia pestis KIM
caugauuuguugaugaauga

SEQ ID NO: 2315967 - RNA, 16 nt, Yersinia pestis KIM
caugaugacaaugcgu

SEQ ID NO: 2315968 - RNA, 21 nt, Yersinia pestis KIM
caugauagcuugggcgauagu

SEQ ID NO: 2315969 - RNA, 21 nt, Yersinia pestis KIM
caugauggcaccgugggcaaa

SEQ ID NO: 2315970 - RNA, 15 nt, Yersinia pestis KIM
caugauucucuauuc

SEQ ID NO: 2315971 - RNA, 12 nt, Yersinia pestis KIM
caugauucucua

SEQ ID NO: 2315972 - RNA, 21 nt, Yersinia pestis KIM
caugaugucgcgacucaagcc

SEQ ID NO: 2315973 - RNA, 14 nt, Yersinia pestis KIM
cauccagugccaac

SEQ ID NO: 2315974 - RNA, 18 nt, Yersinia pestis KIM
cauccaguaagcuguuga

SEQ ID NO: 2315975 - RNA, 14 nt, Yersinia pestis KIM
cauccaguaagcug

SEQ ID NO: 2315976 - RNA, 15 nt, Yersinia pestis KIM
cauccaugccauggc

SEQ ID NO: 2315977 - RNA, 22 nt, Yersinia pestis KIM
cauccaucgggaugaccuuccc

SEQ ID NO: 2315978 - RNA, 14 nt, Yersinia pestis KIM
caucccacucugua

SEQ ID NO: 2315979 - RNA, 19 nt, Yersinia pestis KIM
cauccccacugacaucauu

SEQ ID NO: 2315980 - RNA, 20 nt, Yersinia pestis KIM
caucccagucgucuucagcu

SEQ ID NO: 2315981 - RNA, 11 nt, Yersinia pestis KIM
cauccccagaa

SEQ ID NO: 2315982 - RNA, 16 nt, Yersinia pestis KIM
cauccccaucgccaau

SEQ ID NO: 2315983 - RNA, 15 nt, Yersinia pestis KIM
cauccgcauaaguua

SEQ ID NO: 2315984 - RNA, 20 nt, Yersinia pestis KIM
cauccgcaggaagcaaugaa

SEQ ID NO: 2315985 - RNA, 13 nt, Yersinia pestis KIM
cauccgaugaaau

SEQ ID NO: 2315986 - RNA, 23 nt, Yersinia pestis KIM
cauccgaugaaauaaacuuuuau

SEQ ID NO: 2315987 - RNA, 17 nt, Yersinia pestis KIM
cauccagcucauauaau

SEQ ID NO: 2315988 - RNA, 15 nt, Yersinia pestis KIM
cauccagcucauaua

SEQ ID NO: 2315989 - RNA, 16 nt, Yersinia pestis KIM
cauccagauucagacg

SEQ ID NO: 2315990 - RNA, 20 nt, Yersinia pestis KIM
cauccaauuuuuucaucaua

SEQ ID NO: 2315991 - RNA, 12 nt, Yersinia pestis KIM
cauccacaucuu

SEQ ID NO: 2315992 - RNA, 22 nt, Yersinia pestis KIM
caucauuuuuuaucuuguaaau

SEQ ID NO: 2315993 - RNA, 15 nt, Yersinia pestis KIM
cauccaaauagccuu

SEQ ID NO: 2315994 - RNA, 17 nt, Yersinia pestis KIM
cauccaaauagccuugc

SEQ ID NO: 2315995 - RNA, 20 nt, Yersinia pestis KIM
cauccaaccugcaaugccua

SEQ ID NO: 2315996 - RNA, 20 nt, Yersinia pestis KIM
cauccaauaccaccaaugcg

SEQ ID NO: 2315997 - RNA, 23 nt, Yersinia pestis KIM
cauccaacguaaacauuggcuuu

SEQ ID NO: 2315998 - RNA, 14 nt, Yersinia pestis KIM
caucaugaguaaaa

SEQ ID NO: 2315999 - RNA, 21 nt, Yersinia pestis KIM
caucaugguuucgcaggauug

SEQ ID NO: 2316000 - RNA, 18 nt, Yersinia pestis KIM
caucaugcucauguugca

SEQ ID NO: 2316001 - RNA, 19 nt, Yersinia pestis KIM
caucagcauauuacccagu

SEQ ID NO: 2316002 - RNA, 15 nt, Yersinia pestis KIM
caucagcagcaggaa

SEQ ID NO: 2316003 - RNA, 19 nt, Yersinia pestis KIM
caucagcagcaggaauacc

SEQ ID NO: 2316004 - RNA, 17 nt, Yersinia pestis KIM
caucagcaucaauaaaa

SEQ ID NO: 2316005 - RNA, 23 nt, Yersinia pestis KIM
caucgguaaaucgcccaauguca

SEQ ID NO: 2316006 - RNA, 18 nt, Yersinia pestis KIM
caucgguaauacucuggc

SEQ ID NO: 2316007 - RNA, 21 nt, Yersinia pestis KIM
caucgucgcuguuacccaugg

SEQ ID NO: 2316008 - RNA, 19 nt, Yersinia pestis KIM
caucgggguuugucagcag

SEQ ID NO: 2316009 - RNA, 16 nt, Yersinia pestis KIM
caucgggccacugagc

SEQ ID NO: 2316010 - RNA, 22 nt, Yersinia pestis KIM
caucgggaacaggaucugcucc

SEQ ID NO: 2316011 - RNA, 15 nt, Yersinia pestis KIM
caucggcguucggua

SEQ ID NO: 2316012 - RNA, 14 nt, Yersinia pestis KIM
caucgcccugcucu

SEQ ID NO: 2316013 - RNA, 15 nt, Yersinia pestis KIM
caucgccccugugcu

SEQ ID NO: 2316014 - RNA, 15 nt, Yersinia pestis KIM
caucggcaaaaacag

SEQ ID NO: 2316015 - RNA, 16 nt, Yersinia pestis KIM
caucggauugcaacaa

SEQ ID NO: 2316016 - RNA, 21 nt, Yersinia pestis KIM
caucggaucacggauaucaau

SEQ ID NO: 2316017 - RNA, 23 nt, Yersinia pestis KIM
caucggaaacagaggguggaaac

SEQ ID NO: 2316018 - RNA, 14 nt, Yersinia pestis KIM
cauccggcgggcaa

SEQ ID NO: 2316019 - RNA, 22 nt, Yersinia pestis KIM
cauccgcgaugacacaauuccc

SEQ ID NO: 2316020 - RNA, 15 nt, Yersinia pestis KIM
caucgccacuucuaa

SEQ ID NO: 2316021 - RNA, 12 nt, Yersinia pestis KIM
caucgacuggcc

SEQ ID NO: 2316022 - RNA, 16 nt, Yersinia pestis KIM
caucgagaauaaauau

SEQ ID NO: 2316023 - RNA, 19 nt, Yersinia pestis KIM
caucgagcgggcuucacca

SEQ ID NO: 2316024 - RNA, 16 nt, Yersinia pestis KIM
caucaccgcuaucacu

SEQ ID NO: 2316025 - RNA, 12 nt, Yersinia pestis KIM
caucaccacccu

SEQ ID NO: 2316026 - RNA, 13 nt, Yersinia pestis KIM
caucaccacccug

SEQ ID NO: 2316027 - RNA, 18 nt, Yersinia pestis KIM
caucacacuuguuugccc

SEQ ID NO: 2316028 - RNA, 13 nt, Yersinia pestis KIM
caucacccagcaa

SEQ ID NO: 2316029 - RNA, 20 nt, Yersinia pestis KIM
caucacccagcaaaauagca

SEQ ID NO: 2316030 - RNA, 12 nt, Yersinia pestis KIM
caucaauaccaa

SEQ ID NO: 2316031 - RNA, 12 nt, Yersinia pestis KIM
caucaauaauaa

SEQ ID NO: 2316032 - RNA, 22 nt, Yersinia pestis KIM
caucaauaaauagagugaagua

SEQ ID NO: 2316033 - RNA, 17 nt, Yersinia pestis KIM
caucaauuggcagcggc

SEQ ID NO: 2316034 - RNA, 23 nt, Yersinia pestis KIM
caucaauguuggcccaagauacu

SEQ ID NO: 2316035 - RNA, 20 nt, Yersinia pestis KIM
caucaacaugggcaagcucu

SEQ ID NO: 2316036 - RNA, 22 nt, Yersinia pestis KIM
caucaacagaggcauuuuuguu

SEQ ID NO: 2316037 - RNA, 21 nt, Yersinia pestis KIM
caucaaaugaauaaccuugcu

SEQ ID NO: 2316038 - RNA, 19 nt, Yersinia pestis KIM
cauauugcucugccgcagu

SEQ ID NO: 2316039 - RNA, 17 nt, Yersinia pestis KIM
cauauuuuuuagaucuc

SEQ ID NO: 2316040 - RNA, 16 nt, Yersinia pestis KIM
cauaucgcuaaaacac

SEQ ID NO: 2316041 - RNA, 15 nt, Yersinia pestis KIM
cauaucgcucaucau

SEQ ID NO: 2316042 - RNA, 17 nt, Yersinia pestis KIM
cauaucgcucaucaugg

SEQ ID NO: 2316043 - RNA, 19 nt, Yersinia pestis KIM
cauauucaugguuucaaaa

SEQ ID NO: 2316044 - RNA, 15 nt, Yersinia pestis KIM
cauauucccagccaa

SEQ ID NO: 2316045 - RNA, 21 nt, Yersinia pestis KIM
cauauucgguaaguuggcauc

SEQ ID NO: 2316046 - RNA, 19 nt, Yersinia pestis KIM
cauauugaauuaaauuuua

SEQ ID NO: 2316047 - RNA, 21 nt, Yersinia pestis KIM
cauauugaauuaaauuuuaua

SEQ ID NO: 2316048 - RNA, 15 nt, Yersinia pestis KIM
cauaucaaaauaaaa

SEQ ID NO: 2316049 - RNA, 19 nt, Yersinia pestis KIM
cauauauuuuucuuucucg

SEQ ID NO: 2316050 - RNA, 14 nt, Yersinia pestis KIM
cauaucaaaauaaa

SEQ ID NO: 2316051 - RNA, 21 nt, Yersinia pestis KIM
cauaucaaaauaaaaauucac

SEQ ID NO: 2316052 - RNA, 16 nt, Yersinia pestis KIM
cauaucaaaauaaaaa

SEQ ID NO: 2316053 - RNA, 16 nt, Yersinia pestis KIM
cauauccgaugauaua

SEQ ID NO: 2316054 - RNA, 16 nt, Yersinia pestis KIM
cauauccgguuguuca

SEQ ID NO: 2316055 - RNA, 17 nt, Yersinia pestis KIM
cauauccguuuucaccc

SEQ ID NO: 2316056 - RNA, 19 nt, Yersinia pestis KIM
cauauccguuuucacccaa

SEQ ID NO: 2316057 - RNA, 14 nt, Yersinia pestis KIM
cauauccugugcca

SEQ ID NO: 2316058 - RNA, 22 nt, Yersinia pestis KIM
cauauagcggcguucagcaaua

SEQ ID NO: 2316059 - RNA, 17 nt, Yersinia pestis KIM
cauauaucacuauuuca

SEQ ID NO: 2316060 - RNA, 24 nt, Yersinia pestis KIM
cauauagcggcguucagcaauaug

SEQ ID NO: 2316061 - RNA, 13 nt, Yersinia pestis KIM
cauauaucacuau

SEQ ID NO: 2316062 - RNA, 22 nt, Yersinia pestis KIM
cauauaucacuauuucaggcau

SEQ ID NO: 2316063 - RNA, 13 nt, Yersinia pestis KIM
cauauaaccaugc

SEQ ID NO: 2316064 - RNA, 23 nt, Yersinia pestis KIM
cauauaaccauuuuaauauuaug

SEQ ID NO: 2316065 - RNA, 12 nt, Yersinia pestis KIM
cauauaaaccag

SEQ ID NO: 2316066 - RNA, 14 nt, Yersinia pestis KIM
cauauaaaccagcc

SEQ ID NO: 2316067 - RNA, 20 nt, Yersinia pestis KIM
cauauaaaaaacuaauguuu

SEQ ID NO: 2316068 - RNA, 17 nt, Yersinia pestis KIM
cauauaaaacacgcaua

SEQ ID NO: 2316069 - RNA, 15 nt, Yersinia pestis KIM
cauauaaaaaacuaa

SEQ ID NO: 2316070 - RNA, 17 nt, Yersinia pestis KIM
cauagguagaauagcaa

SEQ ID NO: 2316071 - RNA, 20 nt, Yersinia pestis KIM
cauagguuggggaugccauu

SEQ ID NO: 2316072 - RNA, 18 nt, Yersinia pestis KIM
cauagcgguuuuguuguc

SEQ ID NO: 2316073 - RNA, 15 nt, Yersinia pestis KIM
cauagcgugauuuuu

SEQ ID NO: 2316074 - RNA, 15 nt, Yersinia pestis KIM
cauagcgcauuauaa

SEQ ID NO: 2316075 - RNA, 17 nt, Yersinia pestis KIM
cauagcgugauuuuuau

SEQ ID NO: 2316076 - RNA, 13 nt, Yersinia pestis KIM
cauagcuaacacc

SEQ ID NO: 2316077 - RNA, 22 nt, Yersinia pestis KIM
cauagcuacgggcaaacuccuc

SEQ ID NO: 2316078 - RNA, 16 nt, Yersinia pestis KIM
cauagcuggcuucaaa

SEQ ID NO: 2316079 - RNA, 20 nt, Yersinia pestis KIM
cauagcuggcuuucgcuuua

SEQ ID NO: 2316080 - RNA, 12 nt, Yersinia pestis KIM
cauagaauuuaa

SEQ ID NO: 2316081 - RNA, 20 nt, Yersinia pestis KIM
cauagacaugagacagcgcg

SEQ ID NO: 2316082 - RNA, 13 nt, Yersinia pestis KIM
cauagaaaauaau

SEQ ID NO: 2316083 - RNA, 21 nt, Yersinia pestis KIM
cauagaagcucauaugcagca

SEQ ID NO: 2316084 - RNA, 22 nt, Yersinia pestis KIM
cauagaagaagaauugcagaua

SEQ ID NO: 2316085 - RNA, 18 nt, Yersinia pestis KIM
cauagauuauuuuuauac

SEQ ID NO: 2316086 - RNA, 12 nt, Yersinia pestis KIM
cagugccaauaa

SEQ ID NO: 2316087 - RNA, 18 nt, Yersinia pestis KIM
cagugccaauccccacca

SEQ ID NO: 2316088 - RNA, 16 nt, Yersinia pestis KIM
cagugccaacagcgag

SEQ ID NO: 2316089 - RNA, 17 nt, Yersinia pestis KIM
cagugcauccccacuga

SEQ ID NO: 2316090 - RNA, 21 nt, Yersinia pestis KIM
cauacucucgcccucuggugc

SEQ ID NO: 2316091 - RNA, 12 nt, Yersinia pestis KIM
cauacucuucca

SEQ ID NO: 2316092 - RNA, 13 nt, Yersinia pestis KIM
cauacuuugccuu

SEQ ID NO: 2316093 - RNA, 19 nt, Yersinia pestis KIM
cauacuggcuaauauaucu

SEQ ID NO: 2316094 - RNA, 20 nt, Yersinia pestis KIM
cauacuucgaugauuauuuu

SEQ ID NO: 2316095 - RNA, 14 nt, Yersinia pestis KIM
ccagacucaaaaua

SEQ ID NO: 2316096 - RNA, 20 nt, Yersinia pestis KIM
ccagacuguucacaagccaa

SEQ ID NO: 2316097 - RNA, 15 nt, Yersinia pestis KIM
ccagacugcugacaa

SEQ ID NO: 2316098 - RNA, 15 nt, Yersinia pestis KIM
ccagagagcugagau

SEQ ID NO: 2316099 - RNA, 16 nt, Yersinia pestis KIM
ccagagugacaacaaa

SEQ ID NO: 2316100 - RNA, 23 nt, Yersinia pestis KIM
ccagagugacaacaaaaaauaag

SEQ ID NO: 2316101 - RNA, 15 nt, Yersinia pestis KIM
ccagaggauaaucac

SEQ ID NO: 2316102 - RNA, 13 nt, Yersinia pestis KIM
ccagagcccgggu

SEQ ID NO: 2316103 - RNA, 15 nt, Yersinia pestis KIM
ccagagcgacuuaau

SEQ ID NO: 2316104 - RNA, 21 nt, Yersinia pestis KIM
ccagacgauuauccgcaccau

SEQ ID NO: 2316105 - RNA, 19 nt, Yersinia pestis KIM
ccagauaucccaacugaaa

SEQ ID NO: 2316106 - RNA, 12 nt, Yersinia pestis KIM
ccagauggccag

SEQ ID NO: 2316107 - RNA, 15 nt, Yersinia pestis KIM
ccagauggucacccu

SEQ ID NO: 2316108 - RNA, 14 nt, Yersinia pestis KIM
ccagauuggcgugu

SEQ ID NO: 2316109 - RNA, 20 nt, Yersinia pestis KIM
ccagauucaccaguagccca

SEQ ID NO: 2316110 - RNA, 20 nt, Yersinia pestis KIM
ccagauugccaaucagaacu

SEQ ID NO: 2316111 - RNA, 20 nt, Yersinia pestis KIM
ccagaucuuuuucauucuga

SEQ ID NO: 2316112 - RNA, 19 nt, Yersinia pestis KIM
ccagaaaaccuucagcaaa

SEQ ID NO: 2316113 - RNA, 17 nt, Yersinia pestis KIM
ccagaaaacccccagcu

SEQ ID NO: 2316114 - RNA, 20 nt, Yersinia pestis KIM
ccacuuuuaccgcaaccacc

SEQ ID NO: 2316115 - RNA, 13 nt, Yersinia pestis KIM
ccagaacaccaac

SEQ ID NO: 2316116 - RNA, 20 nt, Yersinia pestis KIM
ccagaaccucaacauucuuu

SEQ ID NO: 2316117 - RNA, 23 nt, Yersinia pestis KIM
ccagacacugacaucaucaccua

SEQ ID NO: 2316118 - RNA, 14 nt, Yersinia pestis KIM
ccagacaacaguca

SEQ ID NO: 2316119 - RNA, 16 nt, Yersinia pestis KIM
ccagacaaccaauaca

SEQ ID NO: 2316120 - RNA, 20 nt, Yersinia pestis KIM
ccagacaaccaauacacagc

SEQ ID NO: 2316121 - RNA, 21 nt, Yersinia pestis KIM
ccagaauuucauuguggagga

SEQ ID NO: 2316122 - RNA, 16 nt, Yersinia pestis KIM
ccagaauauaaaagca

SEQ ID NO: 2316123 - RNA, 16 nt, Yersinia pestis KIM
ccacuggccugagaac

SEQ ID NO: 2316124 - RNA, 20 nt, Yersinia pestis KIM
ccacuggguuacauccugaa

SEQ ID NO: 2316125 - RNA, 14 nt, Yersinia pestis KIM
ccacugguugaaag

SEQ ID NO: 2316126 - RNA, 18 nt, Yersinia pestis KIM
ccacgccaacccucuucc

SEQ ID NO: 2316127 - RNA, 17 nt, Yersinia pestis KIM
ccacgccaacccucuuc

SEQ ID NO: 2316128 - RNA, 22 nt, Yersinia pestis KIM
ccacgccaacccucuuccgguu

SEQ ID NO: 2316129 - RNA, 23 nt, Yersinia pestis KIM
ccacgccagccuguuaauaauuc

SEQ ID NO: 2316130 - RNA, 20 nt, Yersinia pestis KIM
ccacuuguaccugugccagu

SEQ ID NO: 2316131 - RNA, 14 nt, Yersinia pestis KIM
ccacuugcaacauu

SEQ ID NO: 2316132 - RNA, 18 nt, Yersinia pestis KIM
ccacuuuauuuuuuucca

SEQ ID NO: 2316133 - RNA, 12 nt, Yersinia pestis KIM
ccacuuauaucu

SEQ ID NO: 2316134 - RNA, 14 nt, Yersinia pestis KIM
ccacuguuuuucau

SEQ ID NO: 2316135 - RNA, 21 nt, Yersinia pestis KIM
ccacuuaacacgaaccuucuc

SEQ ID NO: 2316136 - RNA, 18 nt, Yersinia pestis KIM
ccacuucaucaucaacaa

SEQ ID NO: 2316137 - RNA, 14 nt, Yersinia pestis KIM
ccagcccaucacca

SEQ ID NO: 2316138 - RNA, 19 nt, Yersinia pestis KIM
ccagccccaaucaccggcu

SEQ ID NO: 2316139 - RNA, 17 nt, Yersinia pestis KIM
ccagccccuaacagcag

SEQ ID NO: 2316140 - RNA, 20 nt, Yersinia pestis KIM
ccagccaugcgacaccaaga

SEQ ID NO: 2316141 - RNA, 16 nt, Yersinia pestis KIM
ccagccauuaaauugc

SEQ ID NO: 2316142 - RNA, 16 nt, Yersinia pestis KIM
ccagccauucugaauc

SEQ ID NO: 2316143 - RNA, 18 nt, Yersinia pestis KIM
ccagccauaaugccccgc

SEQ ID NO: 2316144 - RNA, 16 nt, Yersinia pestis KIM
ccagccaacuccuuga

SEQ ID NO: 2316145 - RNA, 22 nt, Yersinia pestis KIM
ccagcaggcgugcugcuuccug

SEQ ID NO: 2316146 - RNA, 20 nt, Yersinia pestis KIM
ccagcaggcgugcugcuucc

SEQ ID NO: 2316147 - RNA, 20 nt, Yersinia pestis KIM
ccagcagugcugcgcccagu

SEQ ID NO: 2316148 - RNA, 23 nt, Yersinia pestis KIM
ccagcaugugguuaccaucaacc

SEQ ID NO: 2316149 - RNA, 12 nt, Yersinia pestis KIM
ccagcacagccu

SEQ ID NO: 2316150 - RNA, 22 nt, Yersinia pestis KIM
ccagcaagagcagccaacacac

SEQ ID NO: 2316151 - RNA, 17 nt, Yersinia pestis KIM
ccagcaauaagccacgc

SEQ ID NO: 2316152 - RNA, 18 nt, Yersinia pestis KIM
ccagcaauaagccacgcu

SEQ ID NO: 2316153 - RNA, 13 nt, Yersinia pestis KIM
ccagcaagagcag

SEQ ID NO: 2316154 - RNA, 19 nt, Yersinia pestis KIM
ccagcaacucaagccacuc

SEQ ID NO: 2316155 - RNA, 18 nt, Yersinia pestis KIM
ccagcaacguaacaugca

SEQ ID NO: 2316156 - RNA, 20 nt, Yersinia pestis KIM
ccagcaacgaauaaaaaagc

SEQ ID NO: 2316157 - RNA, 18 nt, Yersinia pestis KIM
ccagcaaagccucuacca

SEQ ID NO: 2316158 - RNA, 16 nt, Yersinia pestis KIM
ccagauugucaaucac

SEQ ID NO: 2316159 - RNA, 20 nt, Yersinia pestis KIM
ccagauugugcuccagcacu

SEQ ID NO: 2316160 - RNA, 17 nt, Yersinia pestis KIM
ccagcagaaguuguugc

SEQ ID NO: 2316161 - RNA, 14 nt, Yersinia pestis KIM
ccagcagaauaauc

SEQ ID NO: 2316162 - RNA, 21 nt, Yersinia pestis KIM
ccagcagcauaaccagugccg

SEQ ID NO: 2316163 - RNA, 23 nt, Yersinia pestis KIM
ccagcagcauaauacgaucagcg

SEQ ID NO: 2316164 - RNA, 9 nt, Yersinia pestis KIM
ccagcagca

SEQ ID NO: 2316165 - RNA, 22 nt, Yersinia pestis KIM
ccaccguggcgcgccacuucuu

SEQ ID NO: 2316166 - RNA, 14 nt, Yersinia pestis KIM
ccacgcaucaauaa

SEQ ID NO: 2316167 - RNA, 16 nt, Yersinia pestis KIM
ccaccuuuaccaugcu

SEQ ID NO: 2316168 - RNA, 21 nt, Yersinia pestis KIM
ccaccugcccguuuauuaaug

SEQ ID NO: 2316169 - RNA, 14 nt, Yersinia pestis KIM
ccaccuuaaaauaa

SEQ ID NO: 2316170 - RNA, 15 nt, Yersinia pestis KIM
ccaccuucggcugcc

SEQ ID NO: 2316171 - RNA, 18 nt, Yersinia pestis KIM
ccaccuucggcugccgug

SEQ ID NO: 2316172 - RNA, 14 nt, Yersinia pestis KIM
ccaccccguggcag

SEQ ID NO: 2316173 - RNA, 14 nt, Yersinia pestis KIM
ccaccccccccuua

SEQ ID NO: 2316174 - RNA, 15 nt, Yersinia pestis KIM
ccacccccagugcug

SEQ ID NO: 2316175 - RNA, 14 nt, Yersinia pestis KIM
ccaccgcagugccc

SEQ ID NO: 2316176 - RNA, 22 nt, Yersinia pestis KIM
ccacaugguuucaaugagcaua

SEQ ID NO: 2316177 - RNA, 21 nt, Yersinia pestis KIM
ccacaucggccccuuaccuac

SEQ ID NO: 2316178 - RNA, 19 nt, Yersinia pestis KIM
ccacagucgccgucaauuu

SEQ ID NO: 2316179 - RNA, 22 nt, Yersinia pestis KIM
ccacauaaaaagaaaaaaacag

SEQ ID NO: 2316180 - RNA, 19 nt, Yersinia pestis KIM
ccacaucaaaccggcuaau

SEQ ID NO: 2316181 - RNA, 21 nt, Yersinia pestis KIM
ccacauauauagagaaaucua

SEQ ID NO: 2316182 - RNA, 14 nt, Yersinia pestis KIM
ccacacuuuugcug

SEQ ID NO: 2316183 - RNA, 20 nt, Yersinia pestis KIM
ccacaauggcagagcuuuuc

SEQ ID NO: 2316184 - RNA, 24 nt, Yersinia pestis KIM
ccacaccggcugcaauaagccaga

SEQ ID NO: 2316185 - RNA, 21 nt, Yersinia pestis KIM
ccacaccuccgcccucuugcu

SEQ ID NO: 2316186 - RNA, 19 nt, Yersinia pestis KIM
ccaauaaagcucugacaaa

SEQ ID NO: 2316187 - RNA, 21 nt, Yersinia pestis KIM
ccaauaaagcucugacaaaau

SEQ ID NO: 2316188 - RNA, 13 nt, Yersinia pestis KIM
ccaauaaaaggua

SEQ ID NO: 2316189 - RNA, 23 nt, Yersinia pestis KIM
ccaauaauaaaaaaaaauaaaau

SEQ ID NO: 2316190 - RNA, 18 nt, Yersinia pestis KIM
ccaauaauaaaaaaaaau

SEQ ID NO: 2316191 - RNA, 17 nt, Yersinia pestis KIM
ccaauaauaauccauaa

SEQ ID NO: 2316192 - RNA, 12 nt, Yersinia pestis KIM
ccaauaauucac

SEQ ID NO: 2316193 - RNA, 13 nt, Yersinia pestis KIM
ccaaugccgugcg

SEQ ID NO: 2316194 - RNA, 13 nt, Yersinia pestis KIM
ccaaugauuaacg

SEQ ID NO: 2316195 - RNA, 16 nt, Yersinia pestis KIM
ccaaugcacguaaaga

SEQ ID NO: 2316196 - RNA, 20 nt, Yersinia pestis KIM
ccaaugaguagcuguagcca

SEQ ID NO: 2316197 - RNA, 19 nt, Yersinia pestis KIM
ccacaaaggucagcauggu

SEQ ID NO: 2316198 - RNA, 12 nt, Yersinia pestis KIM
ccacaacugaau

SEQ ID NO: 2316199 - RNA, 11 nt, Yersinia pestis KIM
ccacaauccgg

SEQ ID NO: 2316200 - RNA, 22 nt, Yersinia pestis KIM
ccacaauccgguguuccacaau

SEQ ID NO: 2316201 - RNA, 14 nt, Yersinia pestis KIM
ccacaauaaaauaa

SEQ ID NO: 2316202 - RNA, 16 nt, Yersinia pestis KIM
ccacaauaauuaggaa

SEQ ID NO: 2316203 - RNA, 18 nt, Yersinia pestis KIM
ccaauucacgcaaggcca

SEQ ID NO: 2316204 - RNA, 22 nt, Yersinia pestis KIM
ccaauucacgcagguaguuagu

SEQ ID NO: 2316205 - RNA, 13 nt, Yersinia pestis KIM
ccaauucaucagc

SEQ ID NO: 2316206 - RNA, 16 nt, Yersinia pestis KIM
ccaacauugauaagcc

SEQ ID NO: 2316207 - RNA, 18 nt, Yersinia pestis KIM
ccaacaugagccacacau

SEQ ID NO: 2316208 - RNA, 14 nt, Yersinia pestis KIM
ccaaccaggccgcc

SEQ ID NO: 2316209 - RNA, 13 nt, Yersinia pestis KIM
ccaacaccaccau

SEQ ID NO: 2316210 - RNA, 14 nt, Yersinia pestis KIM
ccaacaccaccauc

SEQ ID NO: 2316211 - RNA, 18 nt, Yersinia pestis KIM
ccaacaauuugcgcccgc

SEQ ID NO: 2316212 - RNA, 21 nt, Yersinia pestis KIM
ccaacacuccucuuucuuaau

SEQ ID NO: 2316213 - RNA, 16 nt, Yersinia pestis KIM
ccaacacuggggcgca

SEQ ID NO: 2316214 - RNA, 23 nt, Yersinia pestis KIM
ccaaauguuggauaacccccuga

SEQ ID NO: 2316215 - RNA, 21 nt, Yersinia pestis KIM
ccaaauguuggauaacccccu

SEQ ID NO: 2316216 - RNA, 13 nt, Yersinia pestis KIM
ccaacaauuugcg

SEQ ID NO: 2316217 - RNA, 16 nt, Yersinia pestis KIM
ccaacaauuugcgccc

SEQ ID NO: 2316218 - RNA, 17 nt, Yersinia pestis KIM
ccaacaauugcuccagu

SEQ ID NO: 2316219 - RNA, 21 nt, Yersinia pestis KIM
ccaaagcaguaaacauuuuga

SEQ ID NO: 2316220 - RNA, 18 nt, Yersinia pestis KIM
ccaaagauauguucuucc

SEQ ID NO: 2316221 - RNA, 16 nt, Yersinia pestis KIM
ccaaagauaauacaua

SEQ ID NO: 2316222 - RNA, 22 nt, Yersinia pestis KIM
ccaaauacauauaaccaucaaa

SEQ ID NO: 2316223 - RNA, 23 nt, Yersinia pestis KIM
ccaaauagcaagccaaaacagcc

SEQ ID NO: 2316224 - RNA, 20 nt, Yersinia pestis KIM
ccaaauaaccucuaauaaac

SEQ ID NO: 2316225 - RNA, 18 nt, Yersinia pestis KIM
ccaaauaaauauccuccg

SEQ ID NO: 2316226 - RNA, 18 nt, Yersinia pestis KIM
ccaaauggacgaacagcc

SEQ ID NO: 2316227 - RNA, 19 nt, Yersinia pestis KIM
ccaaauggacgaacagccc

SEQ ID NO: 2316228 - RNA, 13 nt, Yersinia pestis KIM
ccaaaugagaugg

SEQ ID NO: 2316229 - RNA, 16 nt, Yersinia pestis KIM
ccaaaugagaugggcc

SEQ ID NO: 2316230 - RNA, 14 nt, Yersinia pestis KIM
ccaaaucuuccagc

SEQ ID NO: 2316231 - RNA, 15 nt, Yersinia pestis KIM
ccaaaucuuccagcg

SEQ ID NO: 2316232 - RNA, 21 nt, Yersinia pestis KIM
ccaacucaccuuuaucgcgga

SEQ ID NO: 2316233 - RNA, 20 nt, Yersinia pestis KIM
ccaacuaaacagggcagaaa

SEQ ID NO: 2316234 - RNA, 21 nt, Yersinia pestis KIM
ccaacuccaucgccacuucua

SEQ ID NO: 2316235 - RNA, 17 nt, Yersinia pestis KIM
ccaagaaaagcaccgca

SEQ ID NO: 2316236 - RNA, 14 nt, Yersinia pestis KIM
ccaacuugcuggca

SEQ ID NO: 2316237 - RNA, 14 nt, Yersinia pestis KIM
ccaacuugccgcgg

SEQ ID NO: 2316238 - RNA, 14 nt, Yersinia pestis KIM
ccaacccuuuuuga

SEQ ID NO: 2316239 - RNA, 13 nt, Yersinia pestis KIM
ccaaccgguauug

SEQ ID NO: 2316240 - RNA, 17 nt, Yersinia pestis KIM
ccaagaacgccaaauga

SEQ ID NO: 2316241 - RNA, 19 nt, Yersinia pestis KIM
ccaacuugcuggcaggaaa

SEQ ID NO: 2316242 - RNA, 22 nt, Yersinia pestis KIM
ccaagcauauaaccauuuuaau

SEQ ID NO: 2316243 - RNA, 18 nt, Yersinia pestis KIM
ccaagcggcaggggcgcg

SEQ ID NO: 2316244 - RNA, 21 nt, Yersinia pestis KIM
ccaagguugcauugccuccca

SEQ ID NO: 2316245 - RNA, 15 nt, Yersinia pestis KIM
ccaagguuauacacu

SEQ ID NO: 2316246 - RNA, 14 nt, Yersinia pestis KIM
ccaaguaaaaaaaa

SEQ ID NO: 2316247 - RNA, 22 nt, Yersinia pestis KIM
ccaaaaccgugacuaaaacaag

SEQ ID NO: 2316248 - RNA, 16 nt, Yersinia pestis KIM
ccaaaacguugaggca

SEQ ID NO: 2316249 - RNA, 11 nt, Yersinia pestis KIM
ccaaaauaacc

SEQ ID NO: 2316250 - RNA, 21 nt, Yersinia pestis KIM
ccaaaaucaccccacuagaaa

SEQ ID NO: 2316251 - RNA, 22 nt, Yersinia pestis KIM
ccaaaauaugauaguguaaaaa

SEQ ID NO: 2316252 - RNA, 11 nt, Yersinia pestis KIM
ccaaacagaau

SEQ ID NO: 2316253 - RNA, 19 nt, Yersinia pestis KIM
ccaaaauuuagaagcccug

SEQ ID NO: 2316254 - RNA, 14 nt, Yersinia pestis KIM
ccaaacaaaugaac

SEQ ID NO: 2316255 - RNA, 20 nt, Yersinia pestis KIM
ccaaacaaaugaacccuuuc

SEQ ID NO: 2316256 - RNA, 18 nt, Yersinia pestis KIM
ccaaacauuuucaucuga

SEQ ID NO: 2316257 - RNA, 21 nt, Yersinia pestis KIM
ccaaacauacauccacccauc

SEQ ID NO: 2316258 - RNA, 14 nt, Yersinia pestis KIM
ccaaacgugcuacu

SEQ ID NO: 2316259 - RNA, 17 nt, Yersinia pestis KIM
cauuuuuuaccauuacc

SEQ ID NO: 2316260 - RNA, 18 nt, Yersinia pestis KIM
cauuuuuuauaaacacuu

SEQ ID NO: 2316261 - RNA, 14 nt, Yersinia pestis KIM
cauuuuucuauuuc

SEQ ID NO: 2316262 - RNA, 16 nt, Yersinia pestis KIM
cauuuuuuuuauuuuc

SEQ ID NO: 2316263 - RNA, 16 nt, Yersinia pestis KIM
cauuuuguuacccacu

SEQ ID NO: 2316264 - RNA, 15 nt, Yersinia pestis KIM
cauugaguuucaaug

SEQ ID NO: 2316265 - RNA, 20 nt, Yersinia pestis KIM
cauugaggguugucagcagu

SEQ ID NO: 2316266 - RNA, 23 nt, Yersinia pestis KIM
cauugaggguugucagcagucug

SEQ ID NO: 2316267 - RNA, 23 nt, Yersinia pestis KIM
cauugagucacggauggaucccc

SEQ ID NO: 2316268 - RNA, 16 nt, Yersinia pestis KIM
cauuuucuaagcugcc

SEQ ID NO: 2316269 - RNA, 18 nt, Yersinia pestis KIM
cauuuucuaagcugccug

SEQ ID NO: 2316270 - RNA, 18 nt, Yersinia pestis KIM
cauugauccucguuaguc

SEQ ID NO: 2316271 - RNA, 13 nt, Yersinia pestis KIM
cauuuugcugcca

SEQ ID NO: 2316272 - RNA, 21 nt, Yersinia pestis KIM
cauuuucuggugagcaucaac

SEQ ID NO: 2316273 - RNA, 17 nt, Yersinia pestis KIM
cagguggauccgucauc

SEQ ID NO: 2316274 - RNA, 15 nt, Yersinia pestis KIM
caggugcuugacuaa

SEQ ID NO: 2316275 - RNA, 23 nt, Yersinia pestis KIM
cagguggcugaggccagcggcau

SEQ ID NO: 2316276 - RNA, 17 nt, Yersinia pestis KIM
cagguguauagcggcca

SEQ ID NO: 2316277 - RNA, 18 nt, Yersinia pestis KIM
cagguucauuacacagca

SEQ ID NO: 2316278 - RNA, 14 nt, Yersinia pestis KIM
cagguucaauuccc

SEQ ID NO: 2316279 - RNA, 22 nt, Yersinia pestis KIM
caggugauaauggcauuuuucg

SEQ ID NO: 2316280 - RNA, 13 nt, Yersinia pestis KIM
caggugacugaag

SEQ ID NO: 2316281 - RNA, 15 nt, Yersinia pestis KIM
caggucgauuacaua

SEQ ID NO: 2316282 - RNA, 22 nt, Yersinia pestis KIM
caggucaggaagagaaaagcag

SEQ ID NO: 2316283 - RNA, 15 nt, Yersinia pestis KIM
caggucaggaagaga

SEQ ID NO: 2316284 - RNA, 13 nt, Yersinia pestis KIM
cagguauuucucc

SEQ ID NO: 2316285 - RNA, 22 nt, Yersinia pestis KIM
cagguauuugggcuucagcggu

SEQ ID NO: 2316286 - RNA, 16 nt, Yersinia pestis KIM
caggggcgaugucacc

SEQ ID NO: 2316287 - RNA, 23 nt, Yersinia pestis KIM
caggggcguuauucucaauugac

SEQ ID NO: 2316288 - RNA, 20 nt, Yersinia pestis KIM
cagggggaugccuuguuucu

SEQ ID NO: 2316289 - RNA, 18 nt, Yersinia pestis KIM
cagggggaaacgaacagg

SEQ ID NO: 2316290 - RNA, 19 nt, Yersinia pestis KIM
cagggggaaacgaacaggg

SEQ ID NO: 2316291 - RNA, 20 nt, Yersinia pestis KIM
cagggguaagauccaccaca

SEQ ID NO: 2316292 - RNA, 21 nt, Yersinia pestis KIM
caggggguuauccaacauuug

SEQ ID NO: 2316293 - RNA, 18 nt, Yersinia pestis KIM
caguaaucaaacauaaaa

SEQ ID NO: 2316294 - RNA, 13 nt, Yersinia pestis KIM
caguacaaaaaac

SEQ ID NO: 2316295 - RNA, 16 nt, Yersinia pestis KIM
caguaaugaauucauu

SEQ ID NO: 2316296 - RNA, 17 nt, Yersinia pestis KIM
caguacaucacgcagug

SEQ ID NO: 2316297 - RNA, 19 nt, Yersinia pestis KIM
caguaccgacaccaauacc

SEQ ID NO: 2316298 - RNA, 23 nt, Yersinia pestis KIM
caguacaccgauaaaagugacca

SEQ ID NO: 2316299 - RNA, 14 nt, Yersinia pestis KIM
caguaaaaccagca

SEQ ID NO: 2316300 - RNA, 17 nt, Yersinia pestis KIM
caguaaaaccagcagcg

SEQ ID NO: 2316301 - RNA, 16 nt, Yersinia pestis KIM
caguaaaaucaucagc

SEQ ID NO: 2316302 - RNA, 18 nt, Yersinia pestis KIM
caguaaacgguugcugua

SEQ ID NO: 2316303 - RNA, 16 nt, Yersinia pestis KIM
caguaaacgcagaguc

SEQ ID NO: 2316304 - RNA, 17 nt, Yersinia pestis KIM
caguaaacgccaaucac

SEQ ID NO: 2316305 - RNA, 22 nt, Yersinia pestis KIM
caguaaagauuauguagauccc

SEQ ID NO: 2316306 - RNA, 13 nt, Yersinia pestis KIM
caguaacaacauc

SEQ ID NO: 2316307 - RNA, 18 nt, Yersinia pestis KIM
caguaaccccuucgagca

SEQ ID NO: 2316308 - RNA, 16 nt, Yersinia pestis KIM
caguaacuacuauaua

SEQ ID NO: 2316309 - RNA, 16 nt, Yersinia pestis KIM
caguaacugaucaaua

SEQ ID NO: 2316310 - RNA, 12 nt, Yersinia pestis KIM
caguaagcucua

SEQ ID NO: 2316311 - RNA, 16 nt, Yersinia pestis KIM
caguaaggcagcaagu

SEQ ID NO: 2316312 - RNA, 15 nt, Yersinia pestis KIM
cagguucccaucccu

SEQ ID NO: 2316313 - RNA, 13 nt, Yersinia pestis KIM
cagguugaaauaa

SEQ ID NO: 2316314 - RNA, 20 nt, Yersinia pestis KIM
aaacaaccuaaaaaaaacaa

SEQ ID NO: 2316315 - RNA, 15 nt, Yersinia pestis KIM
aaacaaccuaaaaaa

SEQ ID NO: 2316316 - RNA, 13 nt, Yersinia pestis KIM
aaacaaccuaaaa

SEQ ID NO: 2316317 - RNA, 22 nt, Yersinia pestis KIM
aaacaaaucuuaaauugaagag

SEQ ID NO: 2316318 - RNA, 11 nt, Yersinia pestis KIM
caguaaaaacu

SEQ ID NO: 2316319 - RNA, 20 nt, Yersinia pestis KIM
cagguuuuuuccccauggcg

SEQ ID NO: 2316320 - RNA, 22 nt, Yersinia pestis KIM
aaacaacgcugaaaaaucuuug

SEQ ID NO: 2316321 - RNA, 14 nt, Yersinia pestis KIM
cagugcagccaaga

SEQ ID NO: 2316322 - RNA, 22 nt, Yersinia pestis KIM
cagugcacaucaauaccugucg

SEQ ID NO: 2316323 - RNA, 23 nt, Yersinia pestis KIM
cagugcaaaaugcucuucaccaa

SEQ ID NO: 2316324 - RNA, 20 nt, Yersinia pestis KIM
cagugcaacauuaaaaauac

SEQ ID NO: 2316325 - RNA, 18 nt, Yersinia pestis KIM
cagugaugcugcacauca

SEQ ID NO: 2316326 - RNA, 14 nt, Yersinia pestis KIM
cagugaugagaauc

SEQ ID NO: 2316327 - RNA, 16 nt, Yersinia pestis KIM
cagugaugagaaucuc

SEQ ID NO: 2316328 - RNA, 13 nt, Yersinia pestis KIM
cagugaucagucc

SEQ ID NO: 2316329 - RNA, 13 nt, Yersinia pestis KIM
cagugagcaaauu

SEQ ID NO: 2316330 - RNA, 15 nt, Yersinia pestis KIM
cagugagcaauccaa

SEQ ID NO: 2316331 - RNA, 19 nt, Yersinia pestis KIM
cagugagcauuuuguuacc

SEQ ID NO: 2316332 - RNA, 16 nt, Yersinia pestis KIM
cagugaguccuuuacu

SEQ ID NO: 2316333 - RNA, 14 nt, Yersinia pestis KIM
cagugacugaaugg

SEQ ID NO: 2316334 - RNA, 22 nt, Yersinia pestis KIM
cagugacugaauggcuauuuac

SEQ ID NO: 2316335 - RNA, 21 nt, Yersinia pestis KIM
cagugaauaacugguccaacu

SEQ ID NO: 2316336 - RNA, 14 nt, Yersinia pestis KIM
cagugaagagauaa

SEQ ID NO: 2316337 - RNA, 20 nt, Yersinia pestis KIM
cagugaagagauaaccguua

SEQ ID NO: 2316338 - RNA, 21 nt, Yersinia pestis KIM
cagucugaggcccgcuaguga

SEQ ID NO: 2316339 - RNA, 22 nt, Yersinia pestis KIM
cagugaaaagguuaacugcagu

SEQ ID NO: 2316340 - RNA, 14 nt, Yersinia pestis KIM
cagucuuuuuccca

SEQ ID NO: 2316341 - RNA, 16 nt, Yersinia pestis KIM
cagucgcuuuuuaaca

SEQ ID NO: 2316342 - RNA, 18 nt, Yersinia pestis KIM
cagucgcuuuuuaacaaa

SEQ ID NO: 2316343 - RNA, 13 nt, Yersinia pestis KIM
cagucgcgaugcg

SEQ ID NO: 2316344 - RNA, 18 nt, Yersinia pestis KIM
cagucgcgaugcgcugcu

SEQ ID NO: 2316345 - RNA, 22 nt, Yersinia pestis KIM
cagucugagccucaugaaugag

SEQ ID NO: 2316346 - RNA, 19 nt, Yersinia pestis KIM
cagucugaaggguauugaa

SEQ ID NO: 2316347 - RNA, 15 nt, Yersinia pestis KIM
cagucugaagccuac

SEQ ID NO: 2316348 - RNA, 22 nt, Yersinia pestis KIM
cagucugaaacgccagccucug

SEQ ID NO: 2316349 - RNA, 18 nt, Yersinia pestis KIM
cagucccugugcgcccac

SEQ ID NO: 2316350 - RNA, 13 nt, Yersinia pestis KIM
caguccguaaauc

SEQ ID NO: 2316351 - RNA, 15 nt, Yersinia pestis KIM
cagucgacaguguaa

SEQ ID NO: 2316352 - RNA, 22 nt, Yersinia pestis KIM
caguagagcgguuuguugcuac

SEQ ID NO: 2316353 - RNA, 15 nt, Yersinia pestis KIM
caguaccugcuaacc

SEQ ID NO: 2316354 - RNA, 13 nt, Yersinia pestis KIM
caguacgcuggcc

SEQ ID NO: 2316355 - RNA, 20 nt, Yersinia pestis KIM
caguagcagggccgcccaga

SEQ ID NO: 2316356 - RNA, 15 nt, Yersinia pestis KIM
caguagcaggcgcac

SEQ ID NO: 2316357 - RNA, 20 nt, Yersinia pestis KIM
caguagcauucgauguaacg

SEQ ID NO: 2316358 - RNA, 17 nt, Yersinia pestis KIM
caguagcauugguuuca

SEQ ID NO: 2316359 - RNA, 14 nt, Yersinia pestis KIM
caguagcccagccg

SEQ ID NO: 2316360 - RNA, 19 nt, Yersinia pestis KIM
caguagcccagccggaaca

SEQ ID NO: 2316361 - RNA, 15 nt, Yersinia pestis KIM
caguaggggccacca

SEQ ID NO: 2316362 - RNA, 16 nt, Yersinia pestis KIM
caguagcgucaguuuc

SEQ ID NO: 2316363 - RNA, 17 nt, Yersinia pestis KIM
caguagcgucaguuuca

SEQ ID NO: 2316364 - RNA, 20 nt, Yersinia pestis KIM
caguaucgaagacaaacacg

SEQ ID NO: 2316365 - RNA, 20 nt, Yersinia pestis KIM
caguaucagcgauuuuaaaa

SEQ ID NO: 2316366 - RNA, 17 nt, Yersinia pestis KIM
caguaucgaagacaaac

SEQ ID NO: 2316367 - RNA, 15 nt, Yersinia pestis KIM
caguaucaaccaccg

SEQ ID NO: 2316368 - RNA, 14 nt, Yersinia pestis KIM
caguagugaagaua

SEQ ID NO: 2316369 - RNA, 22 nt, Yersinia pestis KIM
caguagucaauacaauuauuuu

SEQ ID NO: 2316370 - RNA, 22 nt, Yersinia pestis KIM
cagucauucaccugcccgucac

SEQ ID NO: 2316371 - RNA, 19 nt, Yersinia pestis KIM
cagucauucaccugcccgu

SEQ ID NO: 2316372 - RNA, 19 nt, Yersinia pestis KIM
caguccaaaauacggccag

SEQ ID NO: 2316373 - RNA, 13 nt, Yersinia pestis KIM
caguauucugcuu

SEQ ID NO: 2316374 - RNA, 21 nt, Yersinia pestis KIM
caguauugcagagcaaaacug

SEQ ID NO: 2316375 - RNA, 23 nt, Yersinia pestis KIM
caguauuugcaguggaugauaaa

SEQ ID NO: 2316376 - RNA, 15 nt, Yersinia pestis KIM
caguauuuuaagaaa

SEQ ID NO: 2316377 - RNA, 17 nt, Yersinia pestis KIM
caguauuuuaagaaaac

SEQ ID NO: 2316378 - RNA, 21 nt, Yersinia pestis KIM
caguauuuuaagaaaacugug

SEQ ID NO: 2316379 - RNA, 22 nt, Yersinia pestis KIM
caguauuuagcgugacacuguc

SEQ ID NO: 2316380 - RNA, 14 nt, Yersinia pestis KIM
caguaugaaauuuu

SEQ ID NO: 2316381 - RNA, 19 nt, Yersinia pestis KIM
caguaucuuuccagccaau

SEQ ID NO: 2316382 - RNA, 18 nt, Yersinia pestis KIM
cagucaccgcuguaaaug

SEQ ID NO: 2316383 - RNA, 12 nt, Yersinia pestis KIM
cagucacuggcc

SEQ ID NO: 2316384 - RNA, 22 nt, Yersinia pestis KIM
cagucacuaccgcucagauaaa

SEQ ID NO: 2316385 - RNA, 16 nt, Yersinia pestis KIM
cagucacuaaaccauu

SEQ ID NO: 2316386 - RNA, 20 nt, Yersinia pestis KIM
cagucacuuugggcugauca

SEQ ID NO: 2316387 - RNA, 11 nt, Yersinia pestis KIM
cagucaaaaga

SEQ ID NO: 2316388 - RNA, 13 nt, Yersinia pestis KIM
cagucaaaagaaa

SEQ ID NO: 2316389 - RNA, 14 nt, Yersinia pestis KIM
caggcucaucaccu

SEQ ID NO: 2316390 - RNA, 17 nt, Yersinia pestis KIM
caggcucaucaccuucc

SEQ ID NO: 2316391 - RNA, 18 nt, Yersinia pestis KIM
caggcgguuacagccgcc

SEQ ID NO: 2316392 - RNA, 13 nt, Yersinia pestis KIM
caggcuuauauuu

SEQ ID NO: 2316393 - RNA, 16 nt, Yersinia pestis KIM
caggcugccugccuga

SEQ ID NO: 2316394 - RNA, 21 nt, Yersinia pestis KIM
cagggcaucgaaaagcgccuu

SEQ ID NO: 2316395 - RNA, 16 nt, Yersinia pestis KIM
cagggcagcaucguca

SEQ ID NO: 2316396 - RNA, 14 nt, Yersinia pestis KIM
cagggagccaauag

SEQ ID NO: 2316397 - RNA, 22 nt, Yersinia pestis KIM
cagggcgguaacgcagauaaau

SEQ ID NO: 2316398 - RNA, 21 nt, Yersinia pestis KIM
cagggcgcuuucugggugacg

SEQ ID NO: 2316399 - RNA, 16 nt, Yersinia pestis KIM
caggcgaugcaaggaa

SEQ ID NO: 2316400 - RNA, 14 nt, Yersinia pestis KIM
caggccugcaccgg

SEQ ID NO: 2316401 - RNA, 15 nt, Yersinia pestis KIM
caggccuucuucaau

SEQ ID NO: 2316402 - RNA, 20 nt, Yersinia pestis KIM
caggccgguauucagccaaa

SEQ ID NO: 2316403 - RNA, 18 nt, Yersinia pestis KIM
caggccccaauccaccac

SEQ ID NO: 2316404 - RNA, 17 nt, Yersinia pestis KIM
caggcccgcuaucacua

SEQ ID NO: 2316405 - RNA, 21 nt, Yersinia pestis KIM
caggccauuggcaaaggccag

SEQ ID NO: 2316406 - RNA, 22 nt, Yersinia pestis KIM
caggccauuggcaaaggccagc

SEQ ID NO: 2316407 - RNA, 23 nt, Yersinia pestis KIM
caggaucaccagcaaaggccacc

SEQ ID NO: 2316408 - RNA, 18 nt, Yersinia pestis KIM
caggaucaccagcaaagg

SEQ ID NO: 2316409 - RNA, 22 nt, Yersinia pestis KIM
caggaucaccagcaaaggccac

SEQ ID NO: 2316410 - RNA, 13 nt, Yersinia pestis KIM
caggcaucaucug

SEQ ID NO: 2316411 - RNA, 16 nt, Yersinia pestis KIM
caggccaccuaacacu

SEQ ID NO: 2316412 - RNA, 14 nt, Yersinia pestis KIM
cagcucaucaccaa

SEQ ID NO: 2316413 - RNA, 16 nt, Yersinia pestis KIM
cagcucaucaccaaaa

SEQ ID NO: 2316414 - RNA, 23 nt, Yersinia pestis KIM
aaaauuuauauucauauuucacu

SEQ ID NO: 2316415 - RNA, 15 nt, Yersinia pestis KIM
cagcucuagaccuga

SEQ ID NO: 2316416 - RNA, 12 nt, Yersinia pestis KIM
cagcgcuggcuu

SEQ ID NO: 2316417 - RNA, 15 nt, Yersinia pestis KIM
cagcgcuuccacugc

SEQ ID NO: 2316418 - RNA, 21 nt, Yersinia pestis KIM
cagcucacucgguaaugagcc

SEQ ID NO: 2316419 - RNA, 15 nt, Yersinia pestis KIM
aaaauuguuugacuu

SEQ ID NO: 2316420 - RNA, 19 nt, Yersinia pestis KIM
cagcuauugcuuuuauugc

SEQ ID NO: 2316421 - RNA, 21 nt, Yersinia pestis KIM
cagcucaagaauuucgucuuc

SEQ ID NO: 2316422 - RNA, 20 nt, Yersinia pestis KIM
cagcuacugcacgcauucuu

SEQ ID NO: 2316423 - RNA, 20 nt, Yersinia pestis KIM
cagcuaucuugaaacaaccc

SEQ ID NO: 2316424 - RNA, 15 nt, Yersinia pestis KIM
cagcuaugcgcggca

SEQ ID NO: 2316425 - RNA, 11 nt, Yersinia pestis KIM
aaaauuuuaag

SEQ ID NO: 2316426 - RNA, 18 nt, Yersinia pestis KIM
aaaauuugcuucguuucc

SEQ ID NO: 2316427 - RNA, 22 nt, Yersinia pestis KIM
caggaagguaccugaucagcau

SEQ ID NO: 2316428 - RNA, 14 nt, Yersinia pestis KIM
caggauagccaacc

SEQ ID NO: 2316429 - RNA, 21 nt, Yersinia pestis KIM
caggauaauaccugaauagaa

SEQ ID NO: 2316430 - RNA, 22 nt, Yersinia pestis KIM
cagcuuugggucaguuauaaaa

SEQ ID NO: 2316431 - RNA, 15 nt, Yersinia pestis KIM
cagcuuccagcaccc

SEQ ID NO: 2316432 - RNA, 20 nt, Yersinia pestis KIM
cagcuuccagcaccccuuca

SEQ ID NO: 2316433 - RNA, 17 nt, Yersinia pestis KIM
cagcuucagcucuucua

SEQ ID NO: 2316434 - RNA, 13 nt, Yersinia pestis KIM
cagcucuucuaac

SEQ ID NO: 2316435 - RNA, 19 nt, Yersinia pestis KIM
cagcucuucuaacacuuca

SEQ ID NO: 2316436 - RNA, 13 nt, Yersinia pestis KIM
cagcgcgcagcca

SEQ ID NO: 2316437 - RNA, 15 nt, Yersinia pestis KIM
cagcgcgcagccaac

SEQ ID NO: 2316438 - RNA, 22 nt, Yersinia pestis KIM
cagcgcccuugccagugcaauc

SEQ ID NO: 2316439 - RNA, 16 nt, Yersinia pestis KIM
cagcgcacugcaugcc

SEQ ID NO: 2316440 - RNA, 23 nt, Yersinia pestis KIM
cagcgcacugaauaacgcggcac

SEQ ID NO: 2316441 - RNA, 20 nt, Yersinia pestis KIM
cagcccugaucgcugugcaa

SEQ ID NO: 2316442 - RNA, 14 nt, Yersinia pestis KIM
cagcccugccuggc

SEQ ID NO: 2316443 - RNA, 15 nt, Yersinia pestis KIM
cagcccuuugaccau

SEQ ID NO: 2316444 - RNA, 15 nt, Yersinia pestis KIM
cagccaucggucauu

SEQ ID NO: 2316445 - RNA, 23 nt, Yersinia pestis KIM
cagccaucuugggccgacucugc

SEQ ID NO: 2316446 - RNA, 16 nt, Yersinia pestis KIM
cagcgaauaguaucua

SEQ ID NO: 2316447 - RNA, 17 nt, Yersinia pestis KIM
cagcgaauaguaucuac

SEQ ID NO: 2316448 - RNA, 13 nt, Yersinia pestis KIM
cagcgacaaccug

SEQ ID NO: 2316449 - RNA, 14 nt, Yersinia pestis KIM
cagccuguaggcca

SEQ ID NO: 2316450 - RNA, 14 nt, Yersinia pestis KIM
cagcgaaauguaag

SEQ ID NO: 2316451 - RNA, 19 nt, Yersinia pestis KIM
cagccucauucaugaggcu

SEQ ID NO: 2316452 - RNA, 14 nt, Yersinia pestis KIM
cagccucauucaug

SEQ ID NO: 2316453 - RNA, 14 nt, Yersinia pestis KIM
cagcauauuguaaa

SEQ ID NO: 2316454 - RNA, 16 nt, Yersinia pestis KIM
cagcaucaaacuuccc

SEQ ID NO: 2316455 - RNA, 14 nt, Yersinia pestis KIM
cagcaucaccgccg

SEQ ID NO: 2316456 - RNA, 15 nt, Yersinia pestis KIM
cagcaucccaaugaa

SEQ ID NO: 2316457 - RNA, 23 nt, Yersinia pestis KIM
cagcaucgcugaggucagugcug

SEQ ID NO: 2316458 - RNA, 18 nt, Yersinia pestis KIM
cagcaucgcugaggucag

SEQ ID NO: 2316459 - RNA, 16 nt, Yersinia pestis KIM
cagcauccugcaaauu

SEQ ID NO: 2316460 - RNA, 17 nt, Yersinia pestis KIM
cagcaucugcaauggcu

SEQ ID NO: 2316461 - RNA, 15 nt, Yersinia pestis KIM
cagcaucuagcagug

SEQ ID NO: 2316462 - RNA, 20 nt, Yersinia pestis KIM
cagcauuaccaaggaaacca

SEQ ID NO: 2316463 - RNA, 15 nt, Yersinia pestis KIM
cagcauucaggcuuu

SEQ ID NO: 2316464 - RNA, 19 nt, Yersinia pestis KIM
cagcaugaauggcuuuugc

SEQ ID NO: 2316465 - RNA, 18 nt, Yersinia pestis KIM
cagccagccuuaacugca

SEQ ID NO: 2316466 - RNA, 19 nt, Yersinia pestis KIM
cagccagcgggcgcagcca

SEQ ID NO: 2316467 - RNA, 21 nt, Yersinia pestis KIM
cagccagcuccugccacagac

SEQ ID NO: 2316468 - RNA, 13 nt, Yersinia pestis KIM
cagccacaugauu

SEQ ID NO: 2316469 - RNA, 17 nt, Yersinia pestis KIM
cagccaccgcacacuga

SEQ ID NO: 2316470 - RNA, 21 nt, Yersinia pestis KIM
cagcauucaggcuuuuuucua

SEQ ID NO: 2316471 - RNA, 18 nt, Yersinia pestis KIM
cagcauucucacuuacua

SEQ ID NO: 2316472 - RNA, 22 nt, Yersinia pestis KIM
cagcauuucaggaucgaucugg

SEQ ID NO: 2316473 - RNA, 14 nt, Yersinia pestis KIM
cagcauuucaggau

SEQ ID NO: 2316474 - RNA, 13 nt, Yersinia pestis KIM
cagcagcuuuugu

SEQ ID NO: 2316475 - RNA, 16 nt, Yersinia pestis KIM
cagcaggcgugcugcu

SEQ ID NO: 2316476 - RNA, 19 nt, Yersinia pestis KIM
cagcagagucgcaaaaaau

SEQ ID NO: 2316477 - RNA, 23 nt, Yersinia pestis KIM
cagcagggauucugucagagcua

SEQ ID NO: 2316478 - RNA, 20 nt, Yersinia pestis KIM
cagcauaguaagcuggcccu

SEQ ID NO: 2316479 - RNA, 16 nt, Yersinia pestis KIM
cagcauacgugccaaa

SEQ ID NO: 2316480 - RNA, 14 nt, Yersinia pestis KIM
cagcauaaccagug

SEQ ID NO: 2316481 - RNA, 20 nt, Yersinia pestis KIM
cagcauaacgguuguauaca

SEQ ID NO: 2316482 - RNA, 23 nt, Yersinia pestis KIM
cagcagucugacaccggggaucc

SEQ ID NO: 2316483 - RNA, 22 nt, Yersinia pestis KIM
cagcagucugaaacgccagccu

SEQ ID NO: 2316484 - RNA, 16 nt, Yersinia pestis KIM
cagcagucugaagcga

SEQ ID NO: 2316485 - RNA, 21 nt, Yersinia pestis KIM
cagcagucugacagauacuuu

SEQ ID NO: 2316486 - RNA, 21 nt, Yersinia pestis KIM
cagcagucugagccucaugaa

SEQ ID NO: 2316487 - RNA, 17 nt, Yersinia pestis KIM
cagcaguggcuuggcaa

SEQ ID NO: 2316488 - RNA, 13 nt, Yersinia pestis KIM
cagcaguuccagu

SEQ ID NO: 2316489 - RNA, 16 nt, Yersinia pestis KIM
cagcaguuccaguacg

SEQ ID NO: 2316490 - RNA, 21 nt, Yersinia pestis KIM
cacgucuacgcucuccucucc

SEQ ID NO: 2316491 - RNA, 23 nt, Yersinia pestis KIM
cacgucuaauuccgccaguggcu

SEQ ID NO: 2316492 - RNA, 15 nt, Yersinia pestis KIM
cacgucguacugccu

SEQ ID NO: 2316493 - RNA, 22 nt, Yersinia pestis KIM
cacuuucagaauugugccccuu

SEQ ID NO: 2316494 - RNA, 20 nt, Yersinia pestis KIM
cacuuucaucgccgucagcu

SEQ ID NO: 2316495 - RNA, 23 nt, Yersinia pestis KIM
cagaaacauugcguucaauacug

SEQ ID NO: 2316496 - RNA, 22 nt, Yersinia pestis KIM
cagaaauaaauauccuccggca

SEQ ID NO: 2316497 - RNA, 19 nt, Yersinia pestis KIM
cagaaauaaauauccuccg

SEQ ID NO: 2316498 - RNA, 21 nt, Yersinia pestis KIM
cagaacagagugugaaaucac

SEQ ID NO: 2316499 - RNA, 16 nt, Yersinia pestis KIM
cagaacaaaacaagcc

SEQ ID NO: 2316500 - RNA, 17 nt, Yersinia pestis KIM
cagaauggcaaagcaca

SEQ ID NO: 2316501 - RNA, 19 nt, Yersinia pestis KIM
cagaauuagcggcaacgau

SEQ ID NO: 2316502 - RNA, 15 nt, Yersinia pestis KIM
cagaauuaaccguua

SEQ ID NO: 2316503 - RNA, 14 nt, Yersinia pestis KIM
cagaagcauaugga

SEQ ID NO: 2316504 - RNA, 16 nt, Yersinia pestis KIM
cagaagcauauggaug

SEQ ID NO: 2316505 - RNA, 14 nt, Yersinia pestis KIM
cagacaccugauag

SEQ ID NO: 2316506 - RNA, 15 nt, Yersinia pestis KIM
cagacacguaaaaca

SEQ ID NO: 2316507 - RNA, 15 nt, Yersinia pestis KIM
cagacauaucugaac

SEQ ID NO: 2316508 - RNA, 18 nt, Yersinia pestis KIM
cagacaagaaugccugcc

SEQ ID NO: 2316509 - RNA, 15 nt, Yersinia pestis KIM
cagacacaagauaaa

SEQ ID NO: 2316510 - RNA, 18 nt, Yersinia pestis KIM
cagacacaagauaaauac

SEQ ID NO: 2316511 - RNA, 18 nt, Yersinia pestis KIM
aaaaucaguuuacaugau

SEQ ID NO: 2316512 - RNA, 16 nt, Yersinia pestis KIM
aaaaucaguacgcuaa

SEQ ID NO: 2316513 - RNA, 18 nt, Yersinia pestis KIM
aaaaucauggcauaaacc

SEQ ID NO: 2316514 - RNA, 22 nt, Yersinia pestis KIM
cagagauaauagauaacaaacu

SEQ ID NO: 2316515 - RNA, 13 nt, Yersinia pestis KIM
cagagagguuuca

SEQ ID NO: 2316516 - RNA, 21 nt, Yersinia pestis KIM
cagagcacaacggaaggccca

SEQ ID NO: 2316517 - RNA, 14 nt, Yersinia pestis KIM
cagagcagaaagca

SEQ ID NO: 2316518 - RNA, 16 nt, Yersinia pestis KIM
cagagcagaaagcagc

SEQ ID NO: 2316519 - RNA, 12 nt, Yersinia pestis KIM
aaaaucauugac

SEQ ID NO: 2316520 - RNA, 17 nt, Yersinia pestis KIM
cagagucgcaaaaaaua

SEQ ID NO: 2316521 - RNA, 16 nt, Yersinia pestis KIM
cagaguucggucauaa

SEQ ID NO: 2316522 - RNA, 21 nt, Yersinia pestis KIM
cagagccaauccccagaagcg

SEQ ID NO: 2316523 - RNA, 13 nt, Yersinia pestis KIM
cagagcucaauuu

SEQ ID NO: 2316524 - RNA, 18 nt, Yersinia pestis KIM
cagaggaaagagagccau

SEQ ID NO: 2316525 - RNA, 19 nt, Yersinia pestis KIM
cagacguuggcucaucaaa

SEQ ID NO: 2316526 - RNA, 15 nt, Yersinia pestis KIM
cagacuaaaaaccau

SEQ ID NO: 2316527 - RNA, 16 nt, Yersinia pestis KIM
cagacuaaaaaccgcc

SEQ ID NO: 2316528 - RNA, 16 nt, Yersinia pestis KIM
cagaccauggccuugc

SEQ ID NO: 2316529 - RNA, 19 nt, Yersinia pestis KIM
cagacgcacccggcuggca

SEQ ID NO: 2316530 - RNA, 18 nt, Yersinia pestis KIM
cagagaccacagauaaau

SEQ ID NO: 2316531 - RNA, 21 nt, Yersinia pestis KIM
cagagaccacagauaaauaaa

SEQ ID NO: 2316532 - RNA, 16 nt, Yersinia pestis KIM
cagagaaugaguaaag

SEQ ID NO: 2316533 - RNA, 12 nt, Yersinia pestis KIM
cagacuaaugac

SEQ ID NO: 2316534 - RNA, 17 nt, Yersinia pestis KIM
cagacuuggguaaccaa

SEQ ID NO: 2316535 - RNA, 20 nt, Yersinia pestis KIM
cagauggccagauucaccag

SEQ ID NO: 2316536 - RNA, 19 nt, Yersinia pestis KIM
cagauguauuagcgcugcu

SEQ ID NO: 2316537 - RNA, 11 nt, Yersinia pestis KIM
cagauguguac

SEQ ID NO: 2316538 - RNA, 18 nt, Yersinia pestis KIM
cagauguuaacuggcucc

SEQ ID NO: 2316539 - RNA, 19 nt, Yersinia pestis KIM
cagauguuauuugaauaaa

SEQ ID NO: 2316540 - RNA, 22 nt, Yersinia pestis KIM
cagauguuuaaauugcgcccgg

SEQ ID NO: 2316541 - RNA, 13 nt, Yersinia pestis KIM
cagauguuuaaau

SEQ ID NO: 2316542 - RNA, 14 nt, Yersinia pestis KIM
cagauuaaucaccu

SEQ ID NO: 2316543 - RNA, 18 nt, Yersinia pestis KIM
cagauuugcccaaucuaa

SEQ ID NO: 2316544 - RNA, 23 nt, Yersinia pestis KIM
cagauuuuaagcugucuaaauug

SEQ ID NO: 2316545 - RNA, 12 nt, Yersinia pestis KIM
cagauuugguau

SEQ ID NO: 2316546 - RNA, 12 nt, Yersinia pestis KIM
cagauuuaccau

SEQ ID NO: 2316547 - RNA, 23 nt, Yersinia pestis KIM
cagauuuacuccccaaagccuac

SEQ ID NO: 2316548 - RNA, 19 nt, Yersinia pestis KIM
aaaaugaaauuuuauuacu

SEQ ID NO: 2316549 - RNA, 20 nt, Yersinia pestis KIM
aaaaucuuguuaauuuaaac

SEQ ID NO: 2316550 - RNA, 17 nt, Yersinia pestis KIM
cagauuuuccauccccu

SEQ ID NO: 2316551 - RNA, 15 nt, Yersinia pestis KIM
aaaaucuuucuguuc

SEQ ID NO: 2316552 - RNA, 18 nt, Yersinia pestis KIM
aaaaucuuucuguucagc

SEQ ID NO: 2316553 - RNA, 23 nt, Yersinia pestis KIM
cagaugaucugaugaucaucugg

SEQ ID NO: 2316554 - RNA, 22 nt, Yersinia pestis KIM
cagaugaugaugagaaguaaaa

SEQ ID NO: 2316555 - RNA, 20 nt, Yersinia pestis KIM
cagaugaucaacgccaaaau

SEQ ID NO: 2316556 - RNA, 22 nt, Yersinia pestis KIM
cagaugaucaacgccaaaauaa

SEQ ID NO: 2316557 - RNA, 14 nt, Yersinia pestis KIM
cagaugacgggcga

SEQ ID NO: 2316558 - RNA, 15 nt, Yersinia pestis KIM
cagaugaauauguuc

SEQ ID NO: 2316559 - RNA, 19 nt, Yersinia pestis KIM
cagaucguaaagacgccgu

SEQ ID NO: 2316560 - RNA, 20 nt, Yersinia pestis KIM
cagaucgcccugaauagccu

SEQ ID NO: 2316561 - RNA, 15 nt, Yersinia pestis KIM
cagauaacucagggc

SEQ ID NO: 2316562 - RNA, 17 nt, Yersinia pestis KIM
cagcaaccacuucaacg

SEQ ID NO: 2316563 - RNA, 20 nt, Yersinia pestis KIM
cagcaacccgcccaagcccu

SEQ ID NO: 2316564 - RNA, 18 nt, Yersinia pestis KIM
cagcaaccgucaccgugu

SEQ ID NO: 2316565 - RNA, 21 nt, Yersinia pestis KIM
cagcaaccuggcggcccgaga

SEQ ID NO: 2316566 - RNA, 15 nt, Yersinia pestis KIM
cagcaacgaauaaaa

SEQ ID NO: 2316567 - RNA, 12 nt, Yersinia pestis KIM
cagcaagagcag

SEQ ID NO: 2316568 - RNA, 23 nt, Yersinia pestis KIM
cagcaagauugggaucaacgccc

SEQ ID NO: 2316569 - RNA, 15 nt, Yersinia pestis KIM
aaaauggcaacauca

SEQ ID NO: 2316570 - RNA, 20 nt, Yersinia pestis KIM
cagcaaggcgggcaaauuca

SEQ ID NO: 2316571 - RNA, 12 nt, Yersinia pestis KIM
cagcaaggcaga

SEQ ID NO: 2316572 - RNA, 17 nt, Yersinia pestis KIM
cagcaaggcagcaagca

SEQ ID NO: 2316573 - RNA, 18 nt, Yersinia pestis KIM
cagcaaggcagcaagcaa

SEQ ID NO: 2316574 - RNA, 14 nt, Yersinia pestis KIM
cagcacaagcgccu

SEQ ID NO: 2316575 - RNA, 18 nt, Yersinia pestis KIM
cagcacaaacagcuuuuu

SEQ ID NO: 2316576 - RNA, 13 nt, Yersinia pestis KIM
cagcacaaugacu

SEQ ID NO: 2316577 - RNA, 21 nt, Yersinia pestis KIM
cagcacaccggccaaaaucac

SEQ ID NO: 2316578 - RNA, 21 nt, Yersinia pestis KIM
cagcacauaaagcgcauuauu

SEQ ID NO: 2316579 - RNA, 12 nt, Yersinia pestis KIM
cagcacagccug

SEQ ID NO: 2316580 - RNA, 19 nt, Yersinia pestis KIM
cagcagaacaaaacaagcc

SEQ ID NO: 2316581 - RNA, 12 nt, Yersinia pestis KIM
uuuuuuaaaaaa

SEQ ID NO: 2316582 - RNA, 21 nt, Yersinia pestis KIM
uuuuuguaucuauaauucagc

SEQ ID NO: 2316583 - RNA, 22 nt, Yersinia pestis KIM
uuuuugugcccagaaaaccccc

SEQ ID NO: 2316584 - RNA, 17 nt, Yersinia pestis KIM
uuuuucuuuuuaacuua

SEQ ID NO: 2316585 - RNA, 17 nt, Yersinia pestis KIM
uuuuugaacgauauuuu

SEQ ID NO: 2316586 - RNA, 17 nt, Yersinia pestis KIM
uuuuugagcucagccag

SEQ ID NO: 2316587 - RNA, 15 nt, Yersinia pestis KIM
uuuuugcuuuuugcu

SEQ ID NO: 2316588 - RNA, 21 nt, Yersinia pestis KIM
uuuuugcccggcugauauaac

SEQ ID NO: 2316589 - RNA, 15 nt, Yersinia pestis KIM
uuuuucccuucaacu

SEQ ID NO: 2316590 - RNA, 23 nt, Yersinia pestis KIM
uuuuuccauucgauagaaacauc

SEQ ID NO: 2316591 - RNA, 13 nt, Yersinia pestis KIM
uuuuucucuacau

SEQ ID NO: 2316592 - RNA, 14 nt, Yersinia pestis KIM
uuuuacucaggauu

SEQ ID NO: 2316593 - RNA, 13 nt, Yersinia pestis KIM
uuuuaccuaguag

SEQ ID NO: 2316594 - RNA, 23 nt, Yersinia pestis KIM
uuuuaccgggcgacuauagauac

SEQ ID NO: 2316595 - RNA, 19 nt, Yersinia pestis KIM
uuuuacgccuauccucaug

SEQ ID NO: 2316596 - RNA, 13 nt, Yersinia pestis KIM
uuuuagacgucag

SEQ ID NO: 2316597 - RNA, 16 nt, Yersinia pestis KIM
uuuuagauaucagaaa

SEQ ID NO: 2316598 - RNA, 17 nt, Yersinia pestis KIM
uuuuacugccacugacu

SEQ ID NO: 2316599 - RNA, 22 nt, Yersinia pestis KIM
uuuuacugucggucgauuuuua

SEQ ID NO: 2316600 - RNA, 14 nt, Yersinia pestis KIM
uuuuacuuugaaau

SEQ ID NO: 2316601 - RNA, 16 nt, Yersinia pestis KIM
uuuuaauuuaaacucu

SEQ ID NO: 2316602 - RNA, 20 nt, Yersinia pestis KIM
uuuuaaucuccuggugguuu

SEQ ID NO: 2316603 - RNA, 18 nt, Yersinia pestis KIM
uuuuaaucucuccaugau

SEQ ID NO: 2316604 - RNA, 16 nt, Yersinia pestis KIM
uuuuaaugaaaacuac

SEQ ID NO: 2316605 - RNA, 18 nt, Yersinia pestis KIM
uuuuaauggcauuaaaaa

SEQ ID NO: 2316606 - RNA, 13 nt, Yersinia pestis KIM
uuuuacaauuacg

SEQ ID NO: 2316607 - RNA, 18 nt, Yersinia pestis KIM
uuuuaguaacaaaaugcg

SEQ ID NO: 2316608 - RNA, 17 nt, Yersinia pestis KIM
uuuuagugauuaauuaa

SEQ ID NO: 2316609 - RNA, 17 nt, Yersinia pestis KIM
uuuuagcgcuuuuacau

SEQ ID NO: 2316610 - RNA, 20 nt, Yersinia pestis KIM
uuuuaggcaauccaaacaua

SEQ ID NO: 2316611 - RNA, 15 nt, Yersinia pestis KIM
uuuuauaaucaucua

SEQ ID NO: 2316612 - RNA, 17 nt, Yersinia pestis KIM
uuuuauaggucauccca

SEQ ID NO: 2316613 - RNA, 22 nt, Yersinia pestis KIM
uuuuauauccgccauccuucaa

SEQ ID NO: 2316614 - RNA, 14 nt, Yersinia pestis KIM
uuuuauaucagauu

SEQ ID NO: 2316615 - RNA, 16 nt, Yersinia pestis KIM
uuuuauauauccaaaa

SEQ ID NO: 2316616 - RNA, 12 nt, Yersinia pestis KIM
uuuuaucaauag

SEQ ID NO: 2316617 - RNA, 15 nt, Yersinia pestis KIM
uuuuaucauuuaaau

SEQ ID NO: 2316618 - RNA, 12 nt, Yersinia pestis KIM
uuuuaugccuuu

SEQ ID NO: 2316619 - RNA, 15 nt, Yersinia pestis KIM
uuuucuauaccaauu

SEQ ID NO: 2316620 - RNA, 14 nt, Yersinia pestis KIM
uuuucucagcauaa

SEQ ID NO: 2316621 - RNA, 18 nt, Yersinia pestis KIM
uuuucuacugaauaaaca

SEQ ID NO: 2316622 - RNA, 18 nt, Yersinia pestis KIM
uuuucuaagcugccugug

SEQ ID NO: 2316623 - RNA, 13 nt, Yersinia pestis KIM
uuuucuaaccuca

SEQ ID NO: 2316624 - RNA, 14 nt, Yersinia pestis KIM
uuuucccucagcca

SEQ ID NO: 2316625 - RNA, 19 nt, Yersinia pestis KIM
uuuucgucauuauuaaacu

SEQ ID NO: 2316626 - RNA, 22 nt, Yersinia pestis KIM
uuuucccaguaagcucuacuaa

SEQ ID NO: 2316627 - RNA, 23 nt, Yersinia pestis KIM
uuuucccgaccuuguucagauaa

SEQ ID NO: 2316628 - RNA, 19 nt, Yersinia pestis KIM
uuuugaauagguaaaacau

SEQ ID NO: 2316629 - RNA, 20 nt, Yersinia pestis KIM
uuuucuuaacgauauuuacu

SEQ ID NO: 2316630 - RNA, 19 nt, Yersinia pestis KIM
uuuucuucugagauaugua

SEQ ID NO: 2316631 - RNA, 16 nt, Yersinia pestis KIM
uuuuauugucuuuaau

SEQ ID NO: 2316632 - RNA, 19 nt, Yersinia pestis KIM
uuuuauugucuuuaauaaa

SEQ ID NO: 2316633 - RNA, 13 nt, Yersinia pestis KIM
uuuuauuuuacuu

SEQ ID NO: 2316634 - RNA, 14 nt, Yersinia pestis KIM
uuuuauuucccccu

SEQ ID NO: 2316635 - RNA, 21 nt, Yersinia pestis KIM
uuuuauggcauaaacugaagu

SEQ ID NO: 2316636 - RNA, 21 nt, Yersinia pestis KIM
uuuuaugucagagauaaaccc

SEQ ID NO: 2316637 - RNA, 15 nt, Yersinia pestis KIM
uuuuauguuaaauca

SEQ ID NO: 2316638 - RNA, 22 nt, Yersinia pestis KIM
uuuuauggcauaaacugaaguu

SEQ ID NO: 2316639 - RNA, 14 nt, Yersinia pestis KIM
uuuuauuaaaucac

SEQ ID NO: 2316640 - RNA, 13 nt, Yersinia pestis KIM
uuuuccaggucaa

SEQ ID NO: 2316641 - RNA, 13 nt, Yersinia pestis KIM
uuuucaaccaaca

SEQ ID NO: 2316642 - RNA, 17 nt, Yersinia pestis KIM
uuuucaaucuauucuuu

SEQ ID NO: 2316643 - RNA, 21 nt, Yersinia pestis KIM
uuugcuguucuaucucaucuu

SEQ ID NO: 2316644 - RNA, 18 nt, Yersinia pestis KIM
uuugcuuuuugcuuuuug

SEQ ID NO: 2316645 - RNA, 23 nt, Yersinia pestis KIM
uuuggaaccgccauaggcuguuu

SEQ ID NO: 2316646 - RNA, 13 nt, Yersinia pestis KIM
uuugcuuuuugcu

SEQ ID NO: 2316647 - RNA, 18 nt, Yersinia pestis KIM
uuuggaucaggaucacca

SEQ ID NO: 2316648 - RNA, 15 nt, Yersinia pestis KIM
uuuggcaaauuuagc

SEQ ID NO: 2316649 - RNA, 13 nt, Yersinia pestis KIM
uuuggcaucaaug

SEQ ID NO: 2316650 - RNA, 13 nt, Yersinia pestis KIM
uuugcucuucccu

SEQ ID NO: 2316651 - RNA, 21 nt, Yersinia pestis KIM
uuugcugacggggucagauau

SEQ ID NO: 2316652 - RNA, 14 nt, Yersinia pestis KIM
uuugcuauugaaca

SEQ ID NO: 2316653 - RNA, 19 nt, Yersinia pestis KIM
uuugcugccugcaccagug

SEQ ID NO: 2316654 - RNA, 13 nt, Yersinia pestis KIM
uuugcugcuuaua

SEQ ID NO: 2316655 - RNA, 15 nt, Yersinia pestis KIM
uuugcguuaucuuuu

SEQ ID NO: 2316656 - RNA, 23 nt, Yersinia pestis KIM
uuugcggucuggcaacugcaaau

SEQ ID NO: 2316657 - RNA, 22 nt, Yersinia pestis KIM
uuugcgggacauuuuaaagaau

SEQ ID NO: 2316658 - RNA, 23 nt, Yersinia pestis KIM
uuuguaauaacucagccauugcu

SEQ ID NO: 2316659 - RNA, 15 nt, Yersinia pestis KIM
uuuguacaacuucuu

SEQ ID NO: 2316660 - RNA, 17 nt, Yersinia pestis KIM
uuuguacaacuucuuca

SEQ ID NO: 2316661 - RNA, 20 nt, Yersinia pestis KIM
uuugucaauaaccucagccu

SEQ ID NO: 2316662 - RNA, 15 nt, Yersinia pestis KIM
uuugucaauaaccuc

SEQ ID NO: 2316663 - RNA, 18 nt, Yersinia pestis KIM
uuuguagugacguaaaaa

SEQ ID NO: 2316664 - RNA, 18 nt, Yersinia pestis KIM
uuugguuauaucccaaua

SEQ ID NO: 2316665 - RNA, 14 nt, Yersinia pestis KIM
uuugguuaaagaag

SEQ ID NO: 2316666 - RNA, 23 nt, Yersinia pestis KIM
uuuggucaguugaauauuccauu

SEQ ID NO: 2316667 - RNA, 13 nt, Yersinia pestis KIM
uuugggaacaaca

SEQ ID NO: 2316668 - RNA, 18 nt, Yersinia pestis KIM
uuugggaacaacagcauc

SEQ ID NO: 2316669 - RNA, 13 nt, Yersinia pestis KIM
uuugggcuaaaac

SEQ ID NO: 2316670 - RNA, 14 nt, Yersinia pestis KIM
uuuggcauuuucag

SEQ ID NO: 2316671 - RNA, 18 nt, Yersinia pestis KIM
uuuuaaacuuguaucaaa

SEQ ID NO: 2316672 - RNA, 16 nt, Yersinia pestis KIM
uuuuaaagaaaaaacg

SEQ ID NO: 2316673 - RNA, 19 nt, Yersinia pestis KIM
uuuuaaacgucagauuagu

SEQ ID NO: 2316674 - RNA, 16 nt, Yersinia pestis KIM
uuuuaaagaaugcaac

SEQ ID NO: 2316675 - RNA, 14 nt, Yersinia pestis KIM
uuuuaaaaaaaaag

SEQ ID NO: 2316676 - RNA, 15 nt, Yersinia pestis KIM
uuuuaaaaaaucagu

SEQ ID NO: 2316677 - RNA, 16 nt, Yersinia pestis KIM
uuuuaauaaaaaacug

SEQ ID NO: 2316678 - RNA, 17 nt, Yersinia pestis KIM
uuuuaaguuuauuuaac

SEQ ID NO: 2316679 - RNA, 14 nt, Yersinia pestis KIM
uuuuaagcaauuua

SEQ ID NO: 2316680 - RNA, 23 nt, Yersinia pestis KIM
uuuuaaggacucuuaguuucuac

SEQ ID NO: 2316681 - RNA, 20 nt, Yersinia pestis KIM
uuuuaaauauggguuaaaaa

SEQ ID NO: 2316682 - RNA, 13 nt, Yersinia pestis KIM
uuuguuuguaaau

SEQ ID NO: 2316683 - RNA, 14 nt, Yersinia pestis KIM
uuuguuugugagag

SEQ ID NO: 2316684 - RNA, 13 nt, Yersinia pestis KIM
uuuguuuuuauau

SEQ ID NO: 2316685 - RNA, 20 nt, Yersinia pestis KIM
uuuguuuccccuaauucucc

SEQ ID NO: 2316686 - RNA, 12 nt, Yersinia pestis KIM
uuuguuaaaaag

SEQ ID NO: 2316687 - RNA, 21 nt, Yersinia pestis KIM
uuuguuaaaauaguggcacaa

SEQ ID NO: 2316688 - RNA, 23 nt, Yersinia pestis KIM
uuugugucgggauuuuuuuuccu

SEQ ID NO: 2316689 - RNA, 17 nt, Yersinia pestis KIM
uuugugcccagaaaacc

SEQ ID NO: 2316690 - RNA, 23 nt, Yersinia pestis KIM
uuugucagcagucugagggccac

SEQ ID NO: 2316691 - RNA, 24 nt, Yersinia pestis KIM
uuugucauacacggucuggcaacg

SEQ ID NO: 2316692 - RNA, 15 nt, Yersinia pestis KIM
uuugucaucaaccuc

SEQ ID NO: 2316693 - RNA, 13 nt, Yersinia pestis KIM
uuugucauguuga

SEQ ID NO: 2316694 - RNA, 21 nt, Yersinia pestis KIM
uuuacgccuauccucaugauu

SEQ ID NO: 2316695 - RNA, 18 nt, Yersinia pestis KIM
uuuacggcuuaucaaucu

SEQ ID NO: 2316696 - RNA, 17 nt, Yersinia pestis KIM
uuuacuaaauuagaaaa

SEQ ID NO: 2316697 - RNA, 14 nt, Yersinia pestis KIM
uuuacgaucggccu

SEQ ID NO: 2316698 - RNA, 19 nt, Yersinia pestis KIM
uuuacgcaaguaaaaguca

SEQ ID NO: 2316699 - RNA, 23 nt, Yersinia pestis KIM
uuuacaccacuaguuaaaaccag

SEQ ID NO: 2316700 - RNA, 16 nt, Yersinia pestis KIM
uuuacugaucucauca

SEQ ID NO: 2316701 - RNA, 15 nt, Yersinia pestis KIM
uuuacugccacugac

SEQ ID NO: 2316702 - RNA, 14 nt, Yersinia pestis KIM
uuuacuccucugcc

SEQ ID NO: 2316703 - RNA, 21 nt, Yersinia pestis KIM
uuuacugcuuuucuaccugag

SEQ ID NO: 2316704 - RNA, 21 nt, Yersinia pestis KIM
uuuacuggcgggcauuuucua

SEQ ID NO: 2316705 - RNA, 21 nt, Yersinia pestis KIM
uuuacuguuaauccaguugag

SEQ ID NO: 2316706 - RNA, 15 nt, Yersinia pestis KIM
uuuacuuuuuccuua

SEQ ID NO: 2316707 - RNA, 21 nt, Yersinia pestis KIM
uuuacuuuaucguccaugcuu

SEQ ID NO: 2316708 - RNA, 20 nt, Yersinia pestis KIM
uuuacuugguuacuuuccug

SEQ ID NO: 2316709 - RNA, 20 nt, Yersinia pestis KIM
uuuaggcaauccaaacauac

SEQ ID NO: 2316710 - RNA, 14 nt, Yersinia pestis KIM
uuuauaaaaccacu

SEQ ID NO: 2316711 - RNA, 19 nt, Yersinia pestis KIM
uuuauaaaaaauggaguuu

SEQ ID NO: 2316712 - RNA, 18 nt, Yersinia pestis KIM
uuuagugggugagcagag

SEQ ID NO: 2316713 - RNA, 21 nt, Yersinia pestis KIM
uuuagugaugauauuuaucga

SEQ ID NO: 2316714 - RNA, 16 nt, Yersinia pestis KIM
uuuagcccguugagug

SEQ ID NO: 2316715 - RNA, 12 nt, Yersinia pestis KIM
uuuagcauugca

SEQ ID NO: 2316716 - RNA, 14 nt, Yersinia pestis KIM
uuuagcauuuucca

SEQ ID NO: 2316717 - RNA, 11 nt, Yersinia pestis KIM
uuuagcaaagc

SEQ ID NO: 2316718 - RNA, 14 nt, Yersinia pestis KIM
uuuaucgcaguaau

SEQ ID NO: 2316719 - RNA, 15 nt, Yersinia pestis KIM
uuuaucaucauaaau

SEQ ID NO: 2316720 - RNA, 13 nt, Yersinia pestis KIM
uuuaucggcauuu

SEQ ID NO: 2316721 - RNA, 21 nt, Yersinia pestis KIM
uuuaucucacgcugaauaaca

SEQ ID NO: 2316722 - RNA, 14 nt, Yersinia pestis KIM
uuuaucuucuucag

SEQ ID NO: 2316723 - RNA, 20 nt, Yersinia pestis KIM
uuuauuaauggggccgggac

SEQ ID NO: 2316724 - RNA, 21 nt, Yersinia pestis KIM
uuuauggcgaugaugauuauu

SEQ ID NO: 2316725 - RNA, 17 nt, Yersinia pestis KIM
uuuauggugugggcgca

SEQ ID NO: 2316726 - RNA, 15 nt, Yersinia pestis KIM
uuuauguaacacaua

SEQ ID NO: 2316727 - RNA, 21 nt, Yersinia pestis KIM
uuuauguacauccaauuuuuu

SEQ ID NO: 2316728 - RNA, 15 nt, Yersinia pestis KIM
uuuaugcaugaaaac

SEQ ID NO: 2316729 - RNA, 16 nt, Yersinia pestis KIM
uuuaugcaugaaaacc

SEQ ID NO: 2316730 - RNA, 17 nt, Yersinia pestis KIM
uuuauauuauuauaaau

SEQ ID NO: 2316731 - RNA, 13 nt, Yersinia pestis KIM
uuuauauccccua

SEQ ID NO: 2316732 - RNA, 19 nt, Yersinia pestis KIM
uuuaucaaucagcugauau

SEQ ID NO: 2316733 - RNA, 22 nt, Yersinia pestis KIM
uuuaucaguagucaauacaauu

SEQ ID NO: 2316734 - RNA, 19 nt, Yersinia pestis KIM
uuuaucacuuagcucaauc

SEQ ID NO: 2316735 - RNA, 18 nt, Yersinia pestis KIM
uuuauaaccgucaccaaa

SEQ ID NO: 2316736 - RNA, 16 nt, Yersinia pestis KIM
uuuauacccaaaauaa

SEQ ID NO: 2316737 - RNA, 20 nt, Yersinia pestis KIM
uuuauacagcauauaaaaaa

SEQ ID NO: 2316738 - RNA, 23 nt, Yersinia pestis KIM
uuuauacagcauauaaaaaagca

SEQ ID NO: 2316739 - RNA, 15 nt, Yersinia pestis KIM
uuuauacauaucaga

SEQ ID NO: 2316740 - RNA, 18 nt, Yersinia pestis KIM
uuuauacggcuauuuuua

SEQ ID NO: 2316741 - RNA, 14 nt, Yersinia pestis KIM
uuucauuauuuuca

SEQ ID NO: 2316742 - RNA, 17 nt, Yersinia pestis KIM
uuucauuagucaauguu

SEQ ID NO: 2316743 - RNA, 20 nt, Yersinia pestis KIM
uuucauuuuaacaauuuuau

SEQ ID NO: 2316744 - RNA, 21 nt, Yersinia pestis KIM
uuucauuuguuggcaaauuaa

SEQ ID NO: 2316745 - RNA, 15 nt, Yersinia pestis KIM
uuucaucugugccug

SEQ ID NO: 2316746 - RNA, 16 nt, Yersinia pestis KIM
uuucaucgcugaauuu

SEQ ID NO: 2316747 - RNA, 19 nt, Yersinia pestis KIM
uuucaugauccacaaugau

SEQ ID NO: 2316748 - RNA, 23 nt, Yersinia pestis KIM
uuucagcaccauaaaaacuucag

SEQ ID NO: 2316749 - RNA, 19 nt, Yersinia pestis KIM
uuucagcuucaagguacug

SEQ ID NO: 2316750 - RNA, 18 nt, Yersinia pestis KIM
uuucagcuugcaacaaaa

SEQ ID NO: 2316751 - RNA, 12 nt, Yersinia pestis KIM
uuucagcugcuu

SEQ ID NO: 2316752 - RNA, 22 nt, Yersinia pestis KIM
uuucagacugcugacaacccuc

SEQ ID NO: 2316753 - RNA, 13 nt, Yersinia pestis KIM
uuucacuuccauu

SEQ ID NO: 2316754 - RNA, 20 nt, Yersinia pestis KIM
uuucaggacugucuucaacu

SEQ ID NO: 2316755 - RNA, 17 nt, Yersinia pestis KIM
uuucagugagcauuuug

SEQ ID NO: 2316756 - RNA, 12 nt, Yersinia pestis KIM
uuucauauguca

SEQ ID NO: 2316757 - RNA, 17 nt, Yersinia pestis KIM
uuucaccaaccaauuug

SEQ ID NO: 2316758 - RNA, 23 nt, Yersinia pestis KIM
uuucacccaaccgggaugaaucg

SEQ ID NO: 2316759 - RNA, 18 nt, Yersinia pestis KIM
uuucaauucucccauuua

SEQ ID NO: 2316760 - RNA, 22 nt, Yersinia pestis KIM
uuucacuggccuauuaagauaa

SEQ ID NO: 2316761 - RNA, 23 nt, Yersinia pestis KIM
uuucacuguuauauuuuacuucc

SEQ ID NO: 2316762 - RNA, 17 nt, Yersinia pestis KIM
uuucacggauaucaaca

SEQ ID NO: 2316763 - RNA, 14 nt, Yersinia pestis KIM
uuucacccucugcg

SEQ ID NO: 2316764 - RNA, 20 nt, Yersinia pestis KIM
uuucacccuugauuuuacca

SEQ ID NO: 2316765 - RNA, 23 nt, Yersinia pestis KIM
uuucacccuugauuuuaccaaca

SEQ ID NO: 2316766 - RNA, 19 nt, Yersinia pestis KIM
uuucaccuugcgcaauuug

SEQ ID NO: 2316767 - RNA, 23 nt, Yersinia pestis KIM
uuucacgaggaaaacgccagcag

SEQ ID NO: 2316768 - RNA, 22 nt, Yersinia pestis KIM
uuucaaaccacuguuuuucauu

SEQ ID NO: 2316769 - RNA, 20 nt, Yersinia pestis KIM
uuucaaaccacuguuuuuca

SEQ ID NO: 2316770 - RNA, 21 nt, Yersinia pestis KIM
uuucaaauuaucgaucacaug

SEQ ID NO: 2316771 - RNA, 11 nt, Yersinia pestis KIM
uuuauuauuca

SEQ ID NO: 2316772 - RNA, 23 nt, Yersinia pestis KIM
uuuauucagcaacucgguuuuaa

SEQ ID NO: 2316773 - RNA, 23 nt, Yersinia pestis KIM
uuuauucacagcagaacaaaaca

SEQ ID NO: 2316774 - RNA, 19 nt, Yersinia pestis KIM
uuuauugucuuuaauaaaa

SEQ ID NO: 2316775 - RNA, 16 nt, Yersinia pestis KIM
uuuauugggaaccccu

SEQ ID NO: 2316776 - RNA, 15 nt, Yersinia pestis KIM
uuuauuuaacuguuc

SEQ ID NO: 2316777 - RNA, 20 nt, Yersinia pestis KIM
uuuauuuaagcugaaauuuu

SEQ ID NO: 2316778 - RNA, 19 nt, Yersinia pestis KIM
uuucuuucaggcugguugg

SEQ ID NO: 2316779 - RNA, 14 nt, Yersinia pestis KIM
uuucuuuaugucuu

SEQ ID NO: 2316780 - RNA, 11 nt, Yersinia pestis KIM
uuucuugccag

SEQ ID NO: 2316781 - RNA, 18 nt, Yersinia pestis KIM
uuucuuguauauaaaaaa

SEQ ID NO: 2316782 - RNA, 22 nt, Yersinia pestis KIM
uuucuugccuuuuuauaagcgu

SEQ ID NO: 2316783 - RNA, 17 nt, Yersinia pestis KIM
uuucuuacuaaaauauc

SEQ ID NO: 2316784 - RNA, 23 nt, Yersinia pestis KIM
uuucuguugaugaguaaacagag

SEQ ID NO: 2316785 - RNA, 13 nt, Yersinia pestis KIM
uuucugucgaucu

SEQ ID NO: 2316786 - RNA, 20 nt, Yersinia pestis KIM
uuucugugguuggcagcuca

SEQ ID NO: 2316787 - RNA, 21 nt, Yersinia pestis KIM
uuugaaauaacgccacaauau

SEQ ID NO: 2316788 - RNA, 22 nt, Yersinia pestis KIM
uuugaagauuuaacgcauuagc

SEQ ID NO: 2316789 - RNA, 15 nt, Yersinia pestis KIM
uuugaacgugcucuc

SEQ ID NO: 2316790 - RNA, 18 nt, Yersinia pestis KIM
uuugaacgauauuuuuau

SEQ ID NO: 2316791 - RNA, 21 nt, Yersinia pestis KIM
uuugaacgcgacuuguaguga

SEQ ID NO: 2316792 - RNA, 23 nt, Yersinia pestis KIM
uuugacuuugucagcagucugag

SEQ ID NO: 2316793 - RNA, 19 nt, Yersinia pestis KIM
uuugacacgggaucaacau

SEQ ID NO: 2316794 - RNA, 15 nt, Yersinia pestis KIM
uuugacauuuccuug

SEQ ID NO: 2316795 - RNA, 15 nt, Yersinia pestis KIM
uuugaauggcugcca

SEQ ID NO: 2316796 - RNA, 18 nt, Yersinia pestis KIM
uuugaauggcugccauca

SEQ ID NO: 2316797 - RNA, 21 nt, Yersinia pestis KIM
uuugaauuaagcgaaggggaa

SEQ ID NO: 2316798 - RNA, 18 nt, Yersinia pestis KIM
uuugacacgggaucaaca

SEQ ID NO: 2316799 - RNA, 15 nt, Yersinia pestis KIM
uuugcauauuucucu

SEQ ID NO: 2316800 - RNA, 12 nt, Yersinia pestis KIM
uuugcaucaacg

SEQ ID NO: 2316801 - RNA, 19 nt, Yersinia pestis KIM
uuugcaguggaugauaaau

SEQ ID NO: 2316802 - RNA, 13 nt, Yersinia pestis KIM
uuugcagaaagua

SEQ ID NO: 2316803 - RNA, 22 nt, Yersinia pestis KIM
uuugcagauaaaacgccgccag

SEQ ID NO: 2316804 - RNA, 23 nt, Yersinia pestis KIM
uuugcaacgcaggcacugcagaa

SEQ ID NO: 2316805 - RNA, 19 nt, Yersinia pestis KIM
uuugcaauuaauuggccca

SEQ ID NO: 2316806 - RNA, 23 nt, Yersinia pestis KIM
uuugcgcagcaaauaaacaaaau

SEQ ID NO: 2316807 - RNA, 21 nt, Yersinia pestis KIM
uuugcgcaaaauuaagacauu

SEQ ID NO: 2316808 - RNA, 21 nt, Yersinia pestis KIM
uuugccuucacugguuuucag

SEQ ID NO: 2316809 - RNA, 19 nt, Yersinia pestis KIM
uuugcgauacaccauuucc

SEQ ID NO: 2316810 - RNA, 24 nt, Yersinia pestis KIM
uuugcgauacaccauuuccaggcu

SEQ ID NO: 2316811 - RNA, 18 nt, Yersinia pestis KIM
uuugcauugaccgccaaa

SEQ ID NO: 2316812 - RNA, 22 nt, Yersinia pestis KIM
uuugcauugaccgccaaaucca

SEQ ID NO: 2316813 - RNA, 21 nt, Yersinia pestis KIM
uuugccaccuccgcauccggc

SEQ ID NO: 2316814 - RNA, 21 nt, Yersinia pestis KIM
uuugauaaggccaugucacua

SEQ ID NO: 2316815 - RNA, 20 nt, Yersinia pestis KIM
uuugauaacgucauuccagu

SEQ ID NO: 2316816 - RNA, 21 nt, Yersinia pestis KIM
uuugagccaccgcauuccagc

SEQ ID NO: 2316817 - RNA, 20 nt, Yersinia pestis KIM
uuugaggaaauuucaguuuu

SEQ ID NO: 2316818 - RNA, 10 nt, Yersinia pestis KIM
uuugagaaag

SEQ ID NO: 2316819 - RNA, 14 nt, Yersinia pestis KIM
uuugagaaacugau

SEQ ID NO: 2316820 - RNA, 15 nt, Yersinia pestis KIM
uuugauuaaaacccc

SEQ ID NO: 2316821 - RNA, 16 nt, Yersinia pestis KIM
uuugaucauggcuugu

SEQ ID NO: 2316822 - RNA, 17 nt, Yersinia pestis KIM
uuugaucgaccacgccc

SEQ ID NO: 2316823 - RNA, 19 nt, Yersinia pestis KIM
uuucgcgguucggauaaau

SEQ ID NO: 2316824 - RNA, 17 nt, Yersinia pestis KIM
uuucgcuuuacauugcu

SEQ ID NO: 2316825 - RNA, 18 nt, Yersinia pestis KIM
uuucgcuggucuuaauca

SEQ ID NO: 2316826 - RNA, 15 nt, Yersinia pestis KIM
uuucguuucugucug

SEQ ID NO: 2316827 - RNA, 17 nt, Yersinia pestis KIM
uuucguuccagugagca

SEQ ID NO: 2316828 - RNA, 14 nt, Yersinia pestis KIM
uuucgggcaaaaaa

SEQ ID NO: 2316829 - RNA, 15 nt, Yersinia pestis KIM
uuucgguaauacuga

SEQ ID NO: 2316830 - RNA, 13 nt, Yersinia pestis KIM
uuucgguaccauc

SEQ ID NO: 2316831 - RNA, 17 nt, Yersinia pestis KIM
uuucuaacaaaccuaaa

SEQ ID NO: 2316832 - RNA, 18 nt, Yersinia pestis KIM
uuucuaaccucacaacca

SEQ ID NO: 2316833 - RNA, 21 nt, Yersinia pestis KIM
uuucguuuaaaaaauaucuau

SEQ ID NO: 2316834 - RNA, 16 nt, Yersinia pestis KIM
uuucuaagcugccugu

SEQ ID NO: 2316835 - RNA, 17 nt, Yersinia pestis KIM
uuucuggcaauuucugu

SEQ ID NO: 2316836 - RNA, 14 nt, Yersinia pestis KIM
uuucugauuuuuua

SEQ ID NO: 2316837 - RNA, 17 nt, Yersinia pestis KIM
uuucugauuuuuuacuu

SEQ ID NO: 2316838 - RNA, 12 nt, Yersinia pestis KIM
uuucucugccgc

SEQ ID NO: 2316839 - RNA, 19 nt, Yersinia pestis KIM
uuucucugauaaucccaac

SEQ ID NO: 2316840 - RNA, 19 nt, Yersinia pestis KIM
uuucucgacauccaauuca

SEQ ID NO: 2316841 - RNA, 14 nt, Yersinia pestis KIM
uuucucccuuucac

SEQ ID NO: 2316842 - RNA, 15 nt, Yersinia pestis KIM
uuucucaucgcuuuu

SEQ ID NO: 2316843 - RNA, 12 nt, Yersinia pestis KIM
uuucuauuucug

SEQ ID NO: 2316844 - RNA, 13 nt, Yersinia pestis KIM
uuucuauuuucag

SEQ ID NO: 2316845 - RNA, 17 nt, Yersinia pestis KIM
uuucuauccgaaaaaua

SEQ ID NO: 2316846 - RNA, 13 nt, Yersinia pestis KIM
uuucuaucccuau

SEQ ID NO: 2316847 - RNA, 15 nt, Yersinia pestis KIM
uuuccccuucauuug

SEQ ID NO: 2316848 - RNA, 17 nt, Yersinia pestis KIM
uuucccgcuccaaauua

SEQ ID NO: 2316849 - RNA, 18 nt, Yersinia pestis KIM
uuucccgcucuucaccaa

SEQ ID NO: 2316850 - RNA, 13 nt, Yersinia pestis KIM
uuucccguugaua

SEQ ID NO: 2316851 - RNA, 15 nt, Yersinia pestis KIM
uuucccuuucucagu

SEQ ID NO: 2316852 - RNA, 13 nt, Yersinia pestis KIM
uuuccaucacugc

SEQ ID NO: 2316853 - RNA, 20 nt, Yersinia pestis KIM
uuuccauuggagauccguuu

SEQ ID NO: 2316854 - RNA, 14 nt, Yersinia pestis KIM
uuuccagcaaaagc

SEQ ID NO: 2316855 - RNA, 17 nt, Yersinia pestis KIM
uuuccagaaucaauggg

SEQ ID NO: 2316856 - RNA, 18 nt, Yersinia pestis KIM
uuuccacgucgcaagaga

SEQ ID NO: 2316857 - RNA, 14 nt, Yersinia pestis KIM
uuucgaguugaacu

SEQ ID NO: 2316858 - RNA, 14 nt, Yersinia pestis KIM
uuuccuuauuucuu

SEQ ID NO: 2316859 - RNA, 19 nt, Yersinia pestis KIM
uuuccuuggcagcaauagc

SEQ ID NO: 2316860 - RNA, 12 nt, Yersinia pestis KIM
uuuccugcugcu

SEQ ID NO: 2316861 - RNA, 14 nt, Yersinia pestis KIM
uuuccugagucugu

SEQ ID NO: 2316862 - RNA, 22 nt, Yersinia pestis KIM
uuuccugagucuguuuccacuc

SEQ ID NO: 2316863 - RNA, 11 nt, Yersinia pestis KIM
uuuccucuuua

SEQ ID NO: 2316864 - RNA, 22 nt, Yersinia pestis KIM
uugcagagguugcgcacaauca

SEQ ID NO: 2316865 - RNA, 14 nt, Yersinia pestis KIM
uugcagaaaguaau

SEQ ID NO: 2316866 - RNA, 14 nt, Yersinia pestis KIM
uugcagauaaacau

SEQ ID NO: 2316867 - RNA, 16 nt, Yersinia pestis KIM
uugcagcacaccggcc

SEQ ID NO: 2316868 - RNA, 20 nt, Yersinia pestis KIM
uugcagcacaccggccaaaa

SEQ ID NO: 2316869 - RNA, 13 nt, Yersinia pestis KIM
uugcacugcaggg

SEQ ID NO: 2316870 - RNA, 14 nt, Yersinia pestis KIM
uugcauauuucucu

SEQ ID NO: 2316871 - RNA, 15 nt, Yersinia pestis KIM
uugcaucgcacugau

SEQ ID NO: 2316872 - RNA, 24 nt, Yersinia pestis KIM
uugcauguaacggucauaaucagg

SEQ ID NO: 2316873 - RNA, 16 nt, Yersinia pestis KIM
uugcauugccucccau

SEQ ID NO: 2316874 - RNA, 13 nt, Yersinia pestis KIM
uugcccggaguuu

SEQ ID NO: 2316875 - RNA, 20 nt, Yersinia pestis KIM
uugcccgcgcuuccaggcug

SEQ ID NO: 2316876 - RNA, 16 nt, Yersinia pestis KIM
uugccgauaguuggca

SEQ ID NO: 2316877 - RNA, 13 nt, Yersinia pestis KIM
uugccacauuucc

SEQ ID NO: 2316878 - RNA, 15 nt, Yersinia pestis KIM
uugccacauuucccu

SEQ ID NO: 2316879 - RNA, 20 nt, Yersinia pestis KIM
uugccaaaugcaaaccaggc

SEQ ID NO: 2316880 - RNA, 13 nt, Yersinia pestis KIM
uugcgugcaauaa

SEQ ID NO: 2316881 - RNA, 19 nt, Yersinia pestis KIM
uugcguuaccuaaaacuga

SEQ ID NO: 2316882 - RNA, 14 nt, Yersinia pestis KIM
uugcgcuccacgcc

SEQ ID NO: 2316883 - RNA, 23 nt, Yersinia pestis KIM
uugcucacccauuuuauccucuu

SEQ ID NO: 2316884 - RNA, 17 nt, Yersinia pestis KIM
uugcucagauacaucaa

SEQ ID NO: 2316885 - RNA, 16 nt, Yersinia pestis KIM
uugcucacucaccgcc

SEQ ID NO: 2316886 - RNA, 17 nt, Yersinia pestis KIM
uugcucauagcccugcu

SEQ ID NO: 2316887 - RNA, 23 nt, Yersinia pestis KIM
uugcuauuuacucguuuugcuau

SEQ ID NO: 2316888 - RNA, 20 nt, Yersinia pestis KIM
uugcgugacauacuuugccu

SEQ ID NO: 2316889 - RNA, 15 nt, Yersinia pestis KIM
uugccgccgggcagc

SEQ ID NO: 2316890 - RNA, 16 nt, Yersinia pestis KIM
uugccgccuuccugcu

SEQ ID NO: 2316891 - RNA, 16 nt, Yersinia pestis KIM
uugggcaucaacgccc

SEQ ID NO: 2316892 - RNA, 13 nt, Yersinia pestis KIM
uugggcuaaaacu

SEQ ID NO: 2316893 - RNA, 21 nt, Yersinia pestis KIM
uugguagucccgguauuugcu

SEQ ID NO: 2316894 - RNA, 15 nt, Yersinia pestis KIM
uuggucaauaaaauu

SEQ ID NO: 2316895 - RNA, 23 nt, Yersinia pestis KIM
uuggucaagcgggugagauauug

SEQ ID NO: 2316896 - RNA, 14 nt, Yersinia pestis KIM
uugguguugcaaaa

SEQ ID NO: 2316897 - RNA, 20 nt, Yersinia pestis KIM
uugguggcucaaagaaaaau

SEQ ID NO: 2316898 - RNA, 13 nt, Yersinia pestis KIM
uuggcggcaccuu

SEQ ID NO: 2316899 - RNA, 18 nt, Yersinia pestis KIM
uuggcggaagacuuccag

SEQ ID NO: 2316900 - RNA, 15 nt, Yersinia pestis KIM
uuggcauuuaaaagg

SEQ ID NO: 2316901 - RNA, 16 nt, Yersinia pestis KIM
uuggcgggauccaucu

SEQ ID NO: 2316902 - RNA, 16 nt, Yersinia pestis KIM
uugcugauuugccaga

SEQ ID NO: 2316903 - RNA, 19 nt, Yersinia pestis KIM
uugcuccaguugauacagg

SEQ ID NO: 2316904 - RNA, 15 nt, Yersinia pestis KIM
uugcucauguucgca

SEQ ID NO: 2316905 - RNA, 17 nt, Yersinia pestis KIM
uugcuuauccagccgcu

SEQ ID NO: 2316906 - RNA, 22 nt, Yersinia pestis KIM
uuggaaaaaucaguauuauaaa

SEQ ID NO: 2316907 - RNA, 14 nt, Yersinia pestis KIM
uuggaaaacagcaa

SEQ ID NO: 2316908 - RNA, 22 nt, Yersinia pestis KIM
uugcuuuuaacuccuugaaacu

SEQ ID NO: 2316909 - RNA, 16 nt, Yersinia pestis KIM
uuggacuaaccccaau

SEQ ID NO: 2316910 - RNA, 17 nt, Yersinia pestis KIM
uuggcagcggcaaauag

SEQ ID NO: 2316911 - RNA, 22 nt, Yersinia pestis KIM
uuguuuaaucaccgcuguggaa

SEQ ID NO: 2316912 - RNA, 15 nt, Yersinia pestis KIM
uuguucuuacuguuu

SEQ ID NO: 2316913 - RNA, 17 nt, Yersinia pestis KIM
uuuaacaacccauuucc

SEQ ID NO: 2316914 - RNA, 17 nt, Yersinia pestis KIM
uuuaacaauuuaucaga

SEQ ID NO: 2316915 - RNA, 10 nt, Yersinia pestis KIM
uuuaaaaggc

SEQ ID NO: 2316916 - RNA, 13 nt, Yersinia pestis KIM
uuuaaaaucccuc

SEQ ID NO: 2316917 - RNA, 16 nt, Yersinia pestis KIM
uuuaauuuaugaacac

SEQ ID NO: 2316918 - RNA, 13 nt, Yersinia pestis KIM
uuuaauuuucuga

SEQ ID NO: 2316919 - RNA, 17 nt, Yersinia pestis KIM
uuuaauugcugauguca

SEQ ID NO: 2316920 - RNA, 18 nt, Yersinia pestis KIM
uuuaauugagaauuauaa

SEQ ID NO: 2316921 - RNA, 14 nt, Yersinia pestis KIM
uuuaauucaggcca

SEQ ID NO: 2316922 - RNA, 15 nt, Yersinia pestis KIM
uuuaauucaggccaa

SEQ ID NO: 2316923 - RNA, 14 nt, Yersinia pestis KIM
uuuaacgucgcuga

SEQ ID NO: 2316924 - RNA, 15 nt, Yersinia pestis KIM
uuuaaccuuucuaau

SEQ ID NO: 2316925 - RNA, 17 nt, Yersinia pestis KIM
uuuaaccgaugcaauaa

SEQ ID NO: 2316926 - RNA, 17 nt, Yersinia pestis KIM
uuuaaccgcucaguauu

SEQ ID NO: 2316927 - RNA, 16 nt, Yersinia pestis KIM
uuuaagucaauuucag

SEQ ID NO: 2316928 - RNA, 17 nt, Yersinia pestis KIM
uuuaagucaauuucagc

SEQ ID NO: 2316929 - RNA, 15 nt, Yersinia pestis KIM
uuuaacucaaauaaa

SEQ ID NO: 2316930 - RNA, 19 nt, Yersinia pestis KIM
uuuaauaacuuaaauaauu

SEQ ID NO: 2316931 - RNA, 16 nt, Yersinia pestis KIM
uugucaugaaaaucuu

SEQ ID NO: 2316932 - RNA, 19 nt, Yersinia pestis KIM
uugucaggcugaugccauc

SEQ ID NO: 2316933 - RNA, 18 nt, Yersinia pestis KIM
uugucauggccugaugca

SEQ ID NO: 2316934 - RNA, 19 nt, Yersinia pestis KIM
uugucauguugaccaaaca

SEQ ID NO: 2316935 - RNA, 16 nt, Yersinia pestis KIM
uuguccaacaucuccg

SEQ ID NO: 2316936 - RNA, 14 nt, Yersinia pestis KIM
uugucaccuaacca

SEQ ID NO: 2316937 - RNA, 14 nt, Yersinia pestis KIM
uuguaucggggggu

SEQ ID NO: 2316938 - RNA, 14 nt, Yersinia pestis KIM
uuguauagucucca

SEQ ID NO: 2316939 - RNA, 13 nt, Yersinia pestis KIM
uuguaucacagca

SEQ ID NO: 2316940 - RNA, 14 nt, Yersinia pestis KIM
uuguaucacagcaa

SEQ ID NO: 2316941 - RNA, 15 nt, Yersinia pestis KIM
uuguaccccugaauc

SEQ ID NO: 2316942 - RNA, 14 nt, Yersinia pestis KIM
uuguaccuguuuuu

SEQ ID NO: 2316943 - RNA, 15 nt, Yersinia pestis KIM
uugguguugcaaaac

SEQ ID NO: 2316944 - RNA, 23 nt, Yersinia pestis KIM
uugguuagcgccuuuuuuauaau

SEQ ID NO: 2316945 - RNA, 16 nt, Yersinia pestis KIM
uugguucacugaacca

SEQ ID NO: 2316946 - RNA, 23 nt, Yersinia pestis KIM
uuguaauaacgauuaauuaguuu

SEQ ID NO: 2316947 - RNA, 22 nt, Yersinia pestis KIM
uuguaauuguauuauaugcgcu

SEQ ID NO: 2316948 - RNA, 18 nt, Yersinia pestis KIM
uugugcguaaagaaaaaa

SEQ ID NO: 2316949 - RNA, 19 nt, Yersinia pestis KIM
uugugcguaaagaaaaaau

SEQ ID NO: 2316950 - RNA, 18 nt, Yersinia pestis KIM
uugugcccagaaaacccc

SEQ ID NO: 2316951 - RNA, 18 nt, Yersinia pestis KIM
uugugccaguagaucucu

SEQ ID NO: 2316952 - RNA, 20 nt, Yersinia pestis KIM
uugugcaaaaucagcauaac

SEQ ID NO: 2316953 - RNA, 17 nt, Yersinia pestis KIM
uugugcugccgcuauug

SEQ ID NO: 2316954 - RNA, 18 nt, Yersinia pestis KIM
uugugcuaucccucccca

SEQ ID NO: 2316955 - RNA, 22 nt, Yersinia pestis KIM
uucuaccuggcucaaauuuggg

SEQ ID NO: 2316956 - RNA, 17 nt, Yersinia pestis KIM
uucuaccguaucagccc

SEQ ID NO: 2316957 - RNA, 16 nt, Yersinia pestis KIM
uucuacagggaaaaac

SEQ ID NO: 2316958 - RNA, 16 nt, Yersinia pestis KIM
uucuacagggcauauc

SEQ ID NO: 2316959 - RNA, 22 nt, Yersinia pestis KIM
uucuaauucgugggcauuuuuu

SEQ ID NO: 2316960 - RNA, 18 nt, Yersinia pestis KIM
uucucaacagcaucauca

SEQ ID NO: 2316961 - RNA, 18 nt, Yersinia pestis KIM
uucuauuuccacaagcgu

SEQ ID NO: 2316962 - RNA, 13 nt, Yersinia pestis KIM
uucuauuacccuu

SEQ ID NO: 2316963 - RNA, 18 nt, Yersinia pestis KIM
uucuacucugucugcugu

SEQ ID NO: 2316964 - RNA, 23 nt, Yersinia pestis KIM
uucuauccgaaaaauauucucaa

SEQ ID NO: 2316965 - RNA, 17 nt, Yersinia pestis KIM
uucuaucgggcagguaa

SEQ ID NO: 2316966 - RNA, 23 nt, Yersinia pestis KIM
uucgggugagugagcgcggguaa

SEQ ID NO: 2316967 - RNA, 22 nt, Yersinia pestis KIM
uucgggugagugagcgcaggua

SEQ ID NO: 2316968 - RNA, 17 nt, Yersinia pestis KIM
uucggggguugucagca

SEQ ID NO: 2316969 - RNA, 17 nt, Yersinia pestis KIM
uucggguaucuguuuuu

SEQ ID NO: 2316970 - RNA, 21 nt, Yersinia pestis KIM
uucgguaaugccagcccugau

SEQ ID NO: 2316971 - RNA, 22 nt, Yersinia pestis KIM
uuaucacuguccaagaagccaa

SEQ ID NO: 2316972 - RNA, 17 nt, Yersinia pestis KIM
uucggcgucgccacccc

SEQ ID NO: 2316973 - RNA, 21 nt, Yersinia pestis KIM
uucguuucccccuguaaaaca

SEQ ID NO: 2316974 - RNA, 13 nt, Yersinia pestis KIM
uucguuucugucu

SEQ ID NO: 2316975 - RNA, 22 nt, Yersinia pestis KIM
uucguagaaacaucgccagcgg

SEQ ID NO: 2316976 - RNA, 15 nt, Yersinia pestis KIM
uucggugcaaaaccc

SEQ ID NO: 2316977 - RNA, 17 nt, Yersinia pestis KIM
uucggugcaaaacccca

SEQ ID NO: 2316978 - RNA, 19 nt, Yersinia pestis KIM
uucucagaaaagguauauu

SEQ ID NO: 2316979 - RNA, 20 nt, Yersinia pestis KIM
uucuccccacuucaucauca

SEQ ID NO: 2316980 - RNA, 14 nt, Yersinia pestis KIM
uucuccaguugcca

SEQ ID NO: 2316981 - RNA, 11 nt, Yersinia pestis KIM
uucucaccaag

SEQ ID NO: 2316982 - RNA, 24 nt, Yersinia pestis KIM
uucucuacugaauggaucacauca

SEQ ID NO: 2316983 - RNA, 15 nt, Yersinia pestis KIM
uucucucaauauauu

SEQ ID NO: 2316984 - RNA, 20 nt, Yersinia pestis KIM
uucucucaauauauucucuu

SEQ ID NO: 2316985 - RNA, 19 nt, Yersinia pestis KIM
uucucuauucugcuuuuug

SEQ ID NO: 2316986 - RNA, 16 nt, Yersinia pestis KIM
uucugccuauccucac

SEQ ID NO: 2316987 - RNA, 17 nt, Yersinia pestis KIM
uucugccuauccucacc

SEQ ID NO: 2316988 - RNA, 22 nt, Yersinia pestis KIM
uucucugaugaacggagaugau

SEQ ID NO: 2316989 - RNA, 13 nt, Yersinia pestis KIM
uucucuuuaucaa

SEQ ID NO: 2316990 - RNA, 16 nt, Yersinia pestis KIM
uucucuuucaauggcu

SEQ ID NO: 2316991 - RNA, 16 nt, Yersinia pestis KIM
uucuguuccaggcaag

SEQ ID NO: 2316992 - RNA, 13 nt, Yersinia pestis KIM
uucuguugcuuca

SEQ ID NO: 2316993 - RNA, 22 nt, Yersinia pestis KIM
uucuguugcuucacggacagca

SEQ ID NO: 2316994 - RNA, 21 nt, Yersinia pestis KIM
uucugcgaauuagucucuuau

SEQ ID NO: 2316995 - RNA, 20 nt, Yersinia pestis KIM
uucugcucccaugucagaca

SEQ ID NO: 2316996 - RNA, 15 nt, Yersinia pestis KIM
uucuucucucacuuu

SEQ ID NO: 2316997 - RNA, 21 nt, Yersinia pestis KIM
uucuucgcaaugauuacauca

SEQ ID NO: 2316998 - RNA, 14 nt, Yersinia pestis KIM
uucuuagugcuaca

SEQ ID NO: 2316999 - RNA, 14 nt, Yersinia pestis KIM
uucuuaauaauauc

SEQ ID NO: 2317000 - RNA, 12 nt, Yersinia pestis KIM
uugauucaccag

SEQ ID NO: 2317001 - RNA, 19 nt, Yersinia pestis KIM
uugauuaccaauaauuaau

SEQ ID NO: 2317002 - RNA, 16 nt, Yersinia pestis KIM
uugauuauaugcguuu

SEQ ID NO: 2317003 - RNA, 16 nt, Yersinia pestis KIM
uugcaaacggauaaug

SEQ ID NO: 2317004 - RNA, 23 nt, Yersinia pestis KIM
uugcaacugggcgacaaucaaug

SEQ ID NO: 2317005 - RNA, 22 nt, Yersinia pestis KIM
uugcaacgcaggcacugcagaa

SEQ ID NO: 2317006 - RNA, 13 nt, Yersinia pestis KIM
uugcaacauuauc

SEQ ID NO: 2317007 - RNA, 18 nt, Yersinia pestis KIM
uugcaacauuauccguuu

SEQ ID NO: 2317008 - RNA, 19 nt, Yersinia pestis KIM
uugcaacauuauccguuug

SEQ ID NO: 2317009 - RNA, 19 nt, Yersinia pestis KIM
uugcaacaacgccagauaa

SEQ ID NO: 2317010 - RNA, 17 nt, Yersinia pestis KIM
uugcacacgauuaccug

SEQ ID NO: 2317011 - RNA, 17 nt, Yersinia pestis KIM
uugcacacccauacaua

SEQ ID NO: 2317012 - RNA, 19 nt, Yersinia pestis KIM
uugcaccccacaugccacc

SEQ ID NO: 2317013 - RNA, 16 nt, Yersinia pestis KIM
uugcaccuuugcgagg

SEQ ID NO: 2317014 - RNA, 20 nt, Yersinia pestis KIM
uugauggccuugaaucaaaa

SEQ ID NO: 2317015 - RNA, 18 nt, Yersinia pestis KIM
uugauggaguuguugcca

SEQ ID NO: 2317016 - RNA, 20 nt, Yersinia pestis KIM
uugaugcucuucuucacuga

SEQ ID NO: 2317017 - RNA, 20 nt, Yersinia pestis KIM
uugaugguuauguguauuug

SEQ ID NO: 2317018 - RNA, 11 nt, Yersinia pestis KIM
uugauggcugu

SEQ ID NO: 2317019 - RNA, 15 nt, Yersinia pestis KIM
uugauggcuguuuuu

SEQ ID NO: 2317020 - RNA, 22 nt, Yersinia pestis KIM
uugauguaagcugggaaggcgu

SEQ ID NO: 2317021 - RNA, 22 nt, Yersinia pestis KIM
uugauuaacauccauuguauug

SEQ ID NO: 2317022 - RNA, 16 nt, Yersinia pestis KIM
uugauuaauuuuucau

SEQ ID NO: 2317023 - RNA, 16 nt, Yersinia pestis KIM
uugauuacaaaauaua

SEQ ID NO: 2317024 - RNA, 19 nt, Yersinia pestis KIM
uugaucaucaaacuauuca

SEQ ID NO: 2317025 - RNA, 12 nt, Yersinia pestis KIM
uugacguucagg

SEQ ID NO: 2317026 - RNA, 19 nt, Yersinia pestis KIM
uugaccgacgcugaacuga

SEQ ID NO: 2317027 - RNA, 14 nt, Yersinia pestis KIM
uugacccucuuaau

SEQ ID NO: 2317028 - RNA, 17 nt, Yersinia pestis KIM
uugagauuuucccagug

SEQ ID NO: 2317029 - RNA, 11 nt, Yersinia pestis KIM
uugagcagcaa

SEQ ID NO: 2317030 - RNA, 15 nt, Yersinia pestis KIM
uugaggaaauuucag

SEQ ID NO: 2317031 - RNA, 17 nt, Yersinia pestis KIM
uugagauaaucacugag

SEQ ID NO: 2317032 - RNA, 14 nt, Yersinia pestis KIM
uugacuuaacaguu

SEQ ID NO: 2317033 - RNA, 16 nt, Yersinia pestis KIM
uugaggguugucagca

SEQ ID NO: 2317034 - RNA, 13 nt, Yersinia pestis KIM
uugauacagugau

SEQ ID NO: 2317035 - RNA, 19 nt, Yersinia pestis KIM
uugaggagcgauaacauuu

SEQ ID NO: 2317036 - RNA, 19 nt, Yersinia pestis KIM
uugagggcgucucuacgac

SEQ ID NO: 2317037 - RNA, 15 nt, Yersinia pestis KIM
uugauauauagaaau

SEQ ID NO: 2317038 - RNA, 13 nt, Yersinia pestis KIM
uugauauauagaa

SEQ ID NO: 2317039 - RNA, 19 nt, Yersinia pestis KIM
uugauacggcuuacuuuua

SEQ ID NO: 2317040 - RNA, 13 nt, Yersinia pestis KIM
uucuuucucgaua

SEQ ID NO: 2317041 - RNA, 13 nt, Yersinia pestis KIM
uucuuucaacgca

SEQ ID NO: 2317042 - RNA, 20 nt, Yersinia pestis KIM
uucuucugggucuaucaggu

SEQ ID NO: 2317043 - RNA, 19 nt, Yersinia pestis KIM
uucuuuaaucacucucaug

SEQ ID NO: 2317044 - RNA, 14 nt, Yersinia pestis KIM
uugaacaaacccca

SEQ ID NO: 2317045 - RNA, 22 nt, Yersinia pestis KIM
uugaacaaaccccacuaacgcu

SEQ ID NO: 2317046 - RNA, 11 nt, Yersinia pestis KIM
uugaagauacc

SEQ ID NO: 2317047 - RNA, 22 nt, Yersinia pestis KIM
uugaaguacggugccagcagca

SEQ ID NO: 2317048 - RNA, 16 nt, Yersinia pestis KIM
uugaagauuuaaauaa

SEQ ID NO: 2317049 - RNA, 12 nt, Yersinia pestis KIM
uugaauaauccg

SEQ ID NO: 2317050 - RNA, 17 nt, Yersinia pestis KIM
uugaccaauaaaaugca

SEQ ID NO: 2317051 - RNA, 12 nt, Yersinia pestis KIM
uugacagcaucu

SEQ ID NO: 2317052 - RNA, 17 nt, Yersinia pestis KIM
uugacacgagagauaau

SEQ ID NO: 2317053 - RNA, 16 nt, Yersinia pestis KIM
uugacauaaacacgca

SEQ ID NO: 2317054 - RNA, 23 nt, Yersinia pestis KIM
uugaauauuuuuaaucugcccag

SEQ ID NO: 2317055 - RNA, 19 nt, Yersinia pestis KIM
ugaugggauuaauaauggu

SEQ ID NO: 2317056 - RNA, 18 nt, Yersinia pestis KIM
ugaugggggauauucauu

SEQ ID NO: 2317057 - RNA, 19 nt, Yersinia pestis KIM
ugauggguauauuaucauu

SEQ ID NO: 2317058 - RNA, 13 nt, Yersinia pestis KIM
ugauguaacucag

SEQ ID NO: 2317059 - RNA, 18 nt, Yersinia pestis KIM
ugauguaacucaggaucc

SEQ ID NO: 2317060 - RNA, 12 nt, Yersinia pestis KIM
ugauggccgcua

SEQ ID NO: 2317061 - RNA, 17 nt, Yersinia pestis KIM
ugauggaguuguugcca

SEQ ID NO: 2317062 - RNA, 19 nt, Yersinia pestis KIM
ugauggaguuguugccaca

SEQ ID NO: 2317063 - RNA, 14 nt, Yersinia pestis KIM
ugauggccuugaau

SEQ ID NO: 2317064 - RNA, 17 nt, Yersinia pestis KIM
ugauggcgaucaaaauc

SEQ ID NO: 2317065 - RNA, 15 nt, Yersinia pestis KIM
ugaugggauuaauaa

SEQ ID NO: 2317066 - RNA, 21 nt, Yersinia pestis KIM
ugaugugacgucacugaugcu

SEQ ID NO: 2317067 - RNA, 19 nt, Yersinia pestis KIM
ugauguaguguguuuucuu

SEQ ID NO: 2317068 - RNA, 24 nt, Yersinia pestis KIM
ugauguaguguguuuucuuguaua

SEQ ID NO: 2317069 - RNA, 14 nt, Yersinia pestis KIM
ugaugucagugcuc

SEQ ID NO: 2317070 - RNA, 20 nt, Yersinia pestis KIM
ugaugucaucuuccgucagu

SEQ ID NO: 2317071 - RNA, 20 nt, Yersinia pestis KIM
ugaugucaugauaaaacuau

SEQ ID NO: 2317072 - RNA, 13 nt, Yersinia pestis KIM
ugauguuauuaau

SEQ ID NO: 2317073 - RNA, 15 nt, Yersinia pestis KIM
ugauguuauuaauga

SEQ ID NO: 2317074 - RNA, 12 nt, Yersinia pestis KIM
ugauguguacca

SEQ ID NO: 2317075 - RNA, 18 nt, Yersinia pestis KIM
ugauuccgguacugugcu

SEQ ID NO: 2317076 - RNA, 13 nt, Yersinia pestis KIM
ugauucaauuucg

SEQ ID NO: 2317077 - RNA, 22 nt, Yersinia pestis KIM
ugauuauuuuguuuguaaauuu

SEQ ID NO: 2317078 - RNA, 22 nt, Yersinia pestis KIM
ugauuaucaaguuaaauacugc

SEQ ID NO: 2317079 - RNA, 13 nt, Yersinia pestis KIM
ugauuaaaacccc

SEQ ID NO: 2317080 - RNA, 17 nt, Yersinia pestis KIM
ugauuauuuaaacaaug

SEQ ID NO: 2317081 - RNA, 17 nt, Yersinia pestis KIM
ugauucucuauucugcu

SEQ ID NO: 2317082 - RNA, 15 nt, Yersinia pestis KIM
ugauucugacguugg

SEQ ID NO: 2317083 - RNA, 14 nt, Yersinia pestis KIM
ugauucucuauucu

SEQ ID NO: 2317084 - RNA, 23 nt, Yersinia pestis KIM
ugauuguuuuuauuacagaguaa

SEQ ID NO: 2317085 - RNA, 16 nt, Yersinia pestis KIM
ugauucgcgaccagca

SEQ ID NO: 2317086 - RNA, 18 nt, Yersinia pestis KIM
ugauucgggugagugagc

SEQ ID NO: 2317087 - RNA, 21 nt, Yersinia pestis KIM
ugauucguuuucggugcaugu

SEQ ID NO: 2317088 - RNA, 13 nt, Yersinia pestis KIM
ugauuuccaucua

SEQ ID NO: 2317089 - RNA, 17 nt, Yersinia pestis KIM
ugcaaacggauaauguu

SEQ ID NO: 2317090 - RNA, 20 nt, Yersinia pestis KIM
ugcaaacggauaauguugca

SEQ ID NO: 2317091 - RNA, 20 nt, Yersinia pestis KIM
ugcaaacccuaauaccaaca

SEQ ID NO: 2317092 - RNA, 11 nt, Yersinia pestis KIM
ugcaaaaaaag

SEQ ID NO: 2317093 - RNA, 14 nt, Yersinia pestis KIM
ugauuuuuuucaug

SEQ ID NO: 2317094 - RNA, 17 nt, Yersinia pestis KIM
ugauuuuagccucugua

SEQ ID NO: 2317095 - RNA, 17 nt, Yersinia pestis KIM
ugauuuguuaaaacagu

SEQ ID NO: 2317096 - RNA, 21 nt, Yersinia pestis KIM
ugaugcucauuuaaaauacuc

SEQ ID NO: 2317097 - RNA, 17 nt, Yersinia pestis KIM
ugaugcugccucucauu

SEQ ID NO: 2317098 - RNA, 16 nt, Yersinia pestis KIM
ugaugcuuuucuuucc

SEQ ID NO: 2317099 - RNA, 15 nt, Yersinia pestis KIM
ugaugcuuuucuuuc

SEQ ID NO: 2317100 - RNA, 22 nt, Yersinia pestis KIM
ugaugcguguaaugcgcaucug

SEQ ID NO: 2317101 - RNA, 18 nt, Yersinia pestis KIM
ugaugcaguaaauagucu

SEQ ID NO: 2317102 - RNA, 19 nt, Yersinia pestis KIM
ugaugcaguaucccuggcu

SEQ ID NO: 2317103 - RNA, 22 nt, Yersinia pestis KIM
ugaugcauauuauaaugaaaua

SEQ ID NO: 2317104 - RNA, 20 nt, Yersinia pestis KIM
ugaugauuuggcugaauacc

SEQ ID NO: 2317105 - RNA, 15 nt, Yersinia pestis KIM
ugaugagaaguaaaa

SEQ ID NO: 2317106 - RNA, 17 nt, Yersinia pestis KIM
ugauccuggguuuuauu

SEQ ID NO: 2317107 - RNA, 17 nt, Yersinia pestis KIM
ugaugacggugaugucc

SEQ ID NO: 2317108 - RNA, 16 nt, Yersinia pestis KIM
ugaugacuauccucgu

SEQ ID NO: 2317109 - RNA, 15 nt, Yersinia pestis KIM
ugaugacaaugcguu

SEQ ID NO: 2317110 - RNA, 22 nt, Yersinia pestis KIM
ugaugaauuugauacagugaua

SEQ ID NO: 2317111 - RNA, 19 nt, Yersinia pestis KIM
ugaugacgccguacaaaua

SEQ ID NO: 2317112 - RNA, 16 nt, Yersinia pestis KIM
ugaugacaaugcguua

SEQ ID NO: 2317113 - RNA, 13 nt, Yersinia pestis KIM
ugaugaaugcgaa

SEQ ID NO: 2317114 - RNA, 21 nt, Yersinia pestis KIM
ugauccgauaaacuucacaau

SEQ ID NO: 2317115 - RNA, 11 nt, Yersinia pestis KIM
ugaucagcagu

SEQ ID NO: 2317116 - RNA, 15 nt, Yersinia pestis KIM
ugaucacgcugaauu

SEQ ID NO: 2317117 - RNA, 19 nt, Yersinia pestis KIM
ugaguggacgauaaauuca

SEQ ID NO: 2317118 - RNA, 18 nt, Yersinia pestis KIM
ugagugguuuuuacaccc

SEQ ID NO: 2317119 - RNA, 19 nt, Yersinia pestis KIM
ugaguguccacauagcugc

SEQ ID NO: 2317120 - RNA, 23 nt, Yersinia pestis KIM
ugagugugccuuggucucagaac

SEQ ID NO: 2317121 - RNA, 18 nt, Yersinia pestis KIM
ugauauaacgaauauuca

SEQ ID NO: 2317122 - RNA, 21 nt, Yersinia pestis KIM
ugcagaaauaaauauccuccg

SEQ ID NO: 2317123 - RNA, 10 nt, Yersinia pestis KIM
ugcagaaaau

SEQ ID NO: 2317124 - RNA, 16 nt, Yersinia pestis KIM
ugcagaaaguaaucuu

SEQ ID NO: 2317125 - RNA, 21 nt, Yersinia pestis KIM
ugcacguaaagaguuaccgug

SEQ ID NO: 2317126 - RNA, 20 nt, Yersinia pestis KIM
ugcacgugaggauucaagaa

SEQ ID NO: 2317127 - RNA, 18 nt, Yersinia pestis KIM
ugcacgacaacaaagccg

SEQ ID NO: 2317128 - RNA, 22 nt, Yersinia pestis KIM
ugcaccaaugacuaauugugca

SEQ ID NO: 2317129 - RNA, 13 nt, Yersinia pestis KIM
ugcaccuguuaaa

SEQ ID NO: 2317130 - RNA, 13 nt, Yersinia pestis KIM
ugcaccacacagc

SEQ ID NO: 2317131 - RNA, 20 nt, Yersinia pestis KIM
ugcaccuuccgggcagugaa

SEQ ID NO: 2317132 - RNA, 13 nt, Yersinia pestis KIM
ugcacaucaauac

SEQ ID NO: 2317133 - RNA, 15 nt, Yersinia pestis KIM
ugcacaucaauaccu

SEQ ID NO: 2317134 - RNA, 18 nt, Yersinia pestis KIM
ugcacaguugucugaggc

SEQ ID NO: 2317135 - RNA, 17 nt, Yersinia pestis KIM
ugcacagguaguaagca

SEQ ID NO: 2317136 - RNA, 16 nt, Yersinia pestis KIM
ugcacagcauuuaugc

SEQ ID NO: 2317137 - RNA, 23 nt, Yersinia pestis KIM
ugcaaugcuuauuucacacuguu

SEQ ID NO: 2317138 - RNA, 17 nt, Yersinia pestis KIM
ugcaauggcuggcaagg

SEQ ID NO: 2317139 - RNA, 15 nt, Yersinia pestis KIM
ugcaaugcuuauuuc

SEQ ID NO: 2317140 - RNA, 13 nt, Yersinia pestis KIM
ugcaauccgcuga

SEQ ID NO: 2317141 - RNA, 16 nt, Yersinia pestis KIM
ugcaaucuguuauaaa

SEQ ID NO: 2317142 - RNA, 19 nt, Yersinia pestis KIM
ugcaaucuguuauaaaaaa

SEQ ID NO: 2317143 - RNA, 13 nt, Yersinia pestis KIM
ugcacaccaucag

SEQ ID NO: 2317144 - RNA, 21 nt, Yersinia pestis KIM
ugcaauaaauucaaaauagag

SEQ ID NO: 2317145 - RNA, 14 nt, Yersinia pestis KIM
ugcaauaagccaga

SEQ ID NO: 2317146 - RNA, 17 nt, Yersinia pestis KIM
ugcaauaaauucaaaau

SEQ ID NO: 2317147 - RNA, 15 nt, Yersinia pestis KIM
ugcaauaacaccagc

SEQ ID NO: 2317148 - RNA, 19 nt, Yersinia pestis KIM
ugcaaggggcgagccacga

SEQ ID NO: 2317149 - RNA, 21 nt, Yersinia pestis KIM
ugcagcgucauggucucacug

SEQ ID NO: 2317150 - RNA, 21 nt, Yersinia pestis KIM
ugcagcucaaagaccacauca

SEQ ID NO: 2317151 - RNA, 22 nt, Yersinia pestis KIM
ugcagcucaaagaccacaucaa

SEQ ID NO: 2317152 - RNA, 19 nt, Yersinia pestis KIM
ugcaggauagccaaccccu

SEQ ID NO: 2317153 - RNA, 22 nt, Yersinia pestis KIM
ugcaggauaaaccuacagccau

SEQ ID NO: 2317154 - RNA, 16 nt, Yersinia pestis KIM
ugcaggcccagcagug

SEQ ID NO: 2317155 - RNA, 14 nt, Yersinia pestis KIM
ugcagcauuucagg

SEQ ID NO: 2317156 - RNA, 15 nt, Yersinia pestis KIM
ugcagccaagauccc

SEQ ID NO: 2317157 - RNA, 21 nt, Yersinia pestis KIM
ugcagcauuuucagcaacuga

SEQ ID NO: 2317158 - RNA, 21 nt, Yersinia pestis KIM
ugcagccguuccuuggcuaua

SEQ ID NO: 2317159 - RNA, 17 nt, Yersinia pestis KIM
ugcagauacucggcaaa

SEQ ID NO: 2317160 - RNA, 16 nt, Yersinia pestis KIM
ugcagaucaaucgcau

SEQ ID NO: 2317161 - RNA, 21 nt, Yersinia pestis KIM
ugcagaucaaucgcauuguca

SEQ ID NO: 2317162 - RNA, 15 nt, Yersinia pestis KIM
ugcagagaugcagag

SEQ ID NO: 2317163 - RNA, 20 nt, Yersinia pestis KIM
ugcagagaugcagugucagg

SEQ ID NO: 2317164 - RNA, 15 nt, Yersinia pestis KIM
ugagcgcuauuuauc

SEQ ID NO: 2317165 - RNA, 23 nt, Yersinia pestis KIM
ugagcgccaugcgcuuucagcac

SEQ ID NO: 2317166 - RNA, 23 nt, Yersinia pestis KIM
ugagcgcagaguccucucaccaa

SEQ ID NO: 2317167 - RNA, 21 nt, Yersinia pestis KIM
ugagcguagcugucaccuaac

SEQ ID NO: 2317168 - RNA, 17 nt, Yersinia pestis KIM
ugagcucagccaggcag

SEQ ID NO: 2317169 - RNA, 15 nt, Yersinia pestis KIM
ugagcuugcugcuga

SEQ ID NO: 2317170 - RNA, 22 nt, Yersinia pestis KIM
ugagcuguaaauauaaaauaau

SEQ ID NO: 2317171 - RNA, 15 nt, Yersinia pestis KIM
ugagcuguaaauaua

SEQ ID NO: 2317172 - RNA, 20 nt, Yersinia pestis KIM
ugagcuguaaauauaaaaua

SEQ ID NO: 2317173 - RNA, 15 nt, Yersinia pestis KIM
ugaguaauuucagau

SEQ ID NO: 2317174 - RNA, 19 nt, Yersinia pestis KIM
ugaguaauucgcagacaga

SEQ ID NO: 2317175 - RNA, 16 nt, Yersinia pestis KIM
ugaguaauauuauuca

SEQ ID NO: 2317176 - RNA, 22 nt, Yersinia pestis KIM
ugaguaaauaccuucagacuga

SEQ ID NO: 2317177 - RNA, 13 nt, Yersinia pestis KIM
ugaguaaaaauuc

SEQ ID NO: 2317178 - RNA, 21 nt, Yersinia pestis KIM
ugagguuagcgagggacgcga

SEQ ID NO: 2317179 - RNA, 13 nt, Yersinia pestis KIM
ugagguucccaac

SEQ ID NO: 2317180 - RNA, 19 nt, Yersinia pestis KIM
ugaguaauuucagauaaaa

SEQ ID NO: 2317181 - RNA, 19 nt, Yersinia pestis KIM
ugaguacugcgcuagacca

SEQ ID NO: 2317182 - RNA, 18 nt, Yersinia pestis KIM
ugaguauuaccucaucau

SEQ ID NO: 2317183 - RNA, 17 nt, Yersinia pestis KIM
ugagugaaaauauguag

SEQ ID NO: 2317184 - RNA, 18 nt, Yersinia pestis KIM
ugaggcuaccugcaccaa

SEQ ID NO: 2317185 - RNA, 17 nt, Yersinia pestis KIM
ugaggcuaccugcacca

SEQ ID NO: 2317186 - RNA, 12 nt, Yersinia pestis KIM
ugaggcugaggu

SEQ ID NO: 2317187 - RNA, 21 nt, Yersinia pestis KIM
ugaggcagugaauagggaaua

SEQ ID NO: 2317188 - RNA, 20 nt, Yersinia pestis KIM
ugaggauuauaauucauuuu

SEQ ID NO: 2317189 - RNA, 21 nt, Yersinia pestis KIM
ugaggauuauaauucauuuuu

SEQ ID NO: 2317190 - RNA, 22 nt, Yersinia pestis KIM
ugagggccacuucgguggcccu

SEQ ID NO: 2317191 - RNA, 12 nt, Yersinia pestis KIM
ugagggccacuu

SEQ ID NO: 2317192 - RNA, 16 nt, Yersinia pestis KIM
ugagggagucagggag

SEQ ID NO: 2317193 - RNA, 21 nt, Yersinia pestis KIM
ugaggguugucagcagucuga

SEQ ID NO: 2317194 - RNA, 15 nt, Yersinia pestis KIM
ugaggguugucagca

SEQ ID NO: 2317195 - RNA, 17 nt, Yersinia pestis KIM
ugaggguugucagcagu

SEQ ID NO: 2317196 - RNA, 18 nt, Yersinia pestis KIM
ugaggguugucagcaguc

SEQ ID NO: 2317197 - RNA, 14 nt, Yersinia pestis KIM
ugagguaaaccaag

SEQ ID NO: 2317198 - RNA, 18 nt, Yersinia pestis KIM
ugagaauacuucaggcca

SEQ ID NO: 2317199 - RNA, 18 nt, Yersinia pestis KIM
ugagaaucaaaaaacaga

SEQ ID NO: 2317200 - RNA, 22 nt, Yersinia pestis KIM
ugagaaucaguggucuuccgcc

SEQ ID NO: 2317201 - RNA, 18 nt, Yersinia pestis KIM
ugagaaguaaaacgugaa

SEQ ID NO: 2317202 - RNA, 14 nt, Yersinia pestis KIM
ugagaacucgguau

SEQ ID NO: 2317203 - RNA, 15 nt, Yersinia pestis KIM
ugagauggcgcaaug

SEQ ID NO: 2317204 - RNA, 14 nt, Yersinia pestis KIM
ugagauuaauucaa

SEQ ID NO: 2317205 - RNA, 12 nt, Yersinia pestis KIM
ugagcagcucua

SEQ ID NO: 2317206 - RNA, 21 nt, Yersinia pestis KIM
ugagccagguuuuuuuuacuu

SEQ ID NO: 2317207 - RNA, 16 nt, Yersinia pestis KIM
ugagcaccgcaggaac

SEQ ID NO: 2317208 - RNA, 14 nt, Yersinia pestis KIM
ugagcaaacagugc

SEQ ID NO: 2317209 - RNA, 20 nt, Yersinia pestis KIM
ugagccucaugaaugaggcu

SEQ ID NO: 2317210 - RNA, 22 nt, Yersinia pestis KIM
ugagcgaacugaaugcguugcc

SEQ ID NO: 2317211 - RNA, 12 nt, Yersinia pestis KIM
ugagccauuauc

SEQ ID NO: 2317212 - RNA, 14 nt, Yersinia pestis KIM
ugacggcagcgagc

SEQ ID NO: 2317213 - RNA, 14 nt, Yersinia pestis KIM
ugacgcuugaauau

SEQ ID NO: 2317214 - RNA, 15 nt, Yersinia pestis KIM
ugacucacguauuuu

SEQ ID NO: 2317215 - RNA, 16 nt, Yersinia pestis KIM
ugacucaucaaaacaa

SEQ ID NO: 2317216 - RNA, 21 nt, Yersinia pestis KIM
ugacucaucuggcguucuacu

SEQ ID NO: 2317217 - RNA, 21 nt, Yersinia pestis KIM
ugacucccugacucccugacu

SEQ ID NO: 2317218 - RNA, 18 nt, Yersinia pestis KIM
ugacucccugacucccug

SEQ ID NO: 2317219 - RNA, 19 nt, Yersinia pestis KIM
ugacucccugacucccuga

SEQ ID NO: 2317220 - RNA, 20 nt, Yersinia pestis KIM
ugacucccuguucguuuccc

SEQ ID NO: 2317221 - RNA, 14 nt, Yersinia pestis KIM
ugacugcuggcagg

SEQ ID NO: 2317222 - RNA, 10 nt, Yersinia pestis KIM
ugagaaaaaa

SEQ ID NO: 2317223 - RNA, 19 nt, Yersinia pestis KIM
ugagaagaaaucauuuagg

SEQ ID NO: 2317224 - RNA, 18 nt, Yersinia pestis KIM
ugacuuugucagcagucu

SEQ ID NO: 2317225 - RNA, 12 nt, Yersinia pestis KIM
ugacuuucuaag

SEQ ID NO: 2317226 - RNA, 13 nt, Yersinia pestis KIM
ugacuuucuaagc

SEQ ID NO: 2317227 - RNA, 17 nt, Yersinia pestis KIM
ugacuuucuaagcugcc

SEQ ID NO: 2317228 - RNA, 18 nt, Yersinia pestis KIM
ugacuuucuaagcugccu

SEQ ID NO: 2317229 - RNA, 15 nt, Yersinia pestis KIM
ugaccguuguaugug

SEQ ID NO: 2317230 - RNA, 13 nt, Yersinia pestis KIM
ugaccuaaaccgc

SEQ ID NO: 2317231 - RNA, 21 nt, Yersinia pestis KIM
ugaccuaaaccgcucucaccu

SEQ ID NO: 2317232 - RNA, 20 nt, Yersinia pestis KIM
ugaccuauugauaaaaccgc

SEQ ID NO: 2317233 - RNA, 20 nt, Yersinia pestis KIM
ugaccuauugauaaaaccac

SEQ ID NO: 2317234 - RNA, 20 nt, Yersinia pestis KIM
ugacgcuggaaauaagccuc

SEQ ID NO: 2317235 - RNA, 15 nt, Yersinia pestis KIM
ugacgcuggcacugg

SEQ ID NO: 2317236 - RNA, 15 nt, Yersinia pestis KIM
ugacgaugauaaauc

SEQ ID NO: 2317237 - RNA, 15 nt, Yersinia pestis KIM
ugaccgcuguuugau

SEQ ID NO: 2317238 - RNA, 18 nt, Yersinia pestis KIM
ugaccggaugauaaaacg

SEQ ID NO: 2317239 - RNA, 13 nt, Yersinia pestis KIM
ugaccgguauaga

SEQ ID NO: 2317240 - RNA, 22 nt, Yersinia pestis KIM
ugaccauuuguuuuugaaucau

SEQ ID NO: 2317241 - RNA, 16 nt, Yersinia pestis KIM
ugaccagugaauaagu

SEQ ID NO: 2317242 - RNA, 17 nt, Yersinia pestis KIM
ugaccagugaauaaguu

SEQ ID NO: 2317243 - RNA, 17 nt, Yersinia pestis KIM
ugaccaucaaccgugac

SEQ ID NO: 2317244 - RNA, 18 nt, Yersinia pestis KIM
ugaccacgcaucaauaau

SEQ ID NO: 2317245 - RNA, 19 nt, Yersinia pestis KIM
ugaccacgcaucaauaaua

SEQ ID NO: 2317246 - RNA, 18 nt, Yersinia pestis KIM
ugaccacaaaaacagugu

SEQ ID NO: 2317247 - RNA, 19 nt, Yersinia pestis KIM
ugaccacaaaaacaguguc

SEQ ID NO: 2317248 - RNA, 14 nt, Yersinia pestis KIM
ugaccaauagucac

SEQ ID NO: 2317249 - RNA, 13 nt, Yersinia pestis KIM
ugaccaauacuac

SEQ ID NO: 2317250 - RNA, 19 nt, Yersinia pestis KIM
ugacaguauuuguagugga

SEQ ID NO: 2317251 - RNA, 17 nt, Yersinia pestis KIM
ugacaguagugaguuaa

SEQ ID NO: 2317252 - RNA, 18 nt, Yersinia pestis KIM
ugacacgagagauaauag

SEQ ID NO: 2317253 - RNA, 16 nt, Yersinia pestis KIM
ugacacggguauuggc

SEQ ID NO: 2317254 - RNA, 18 nt, Yersinia pestis KIM
ugacacgggaucaacaug

SEQ ID NO: 2317255 - RNA, 19 nt, Yersinia pestis KIM
ugacaccggggauccauag

SEQ ID NO: 2317256 - RNA, 19 nt, Yersinia pestis KIM
ugacacugacauuuaugcc

SEQ ID NO: 2317257 - RNA, 21 nt, Yersinia pestis KIM
ugacagccacaaccgccacuu

SEQ ID NO: 2317258 - RNA, 23 nt, Yersinia pestis KIM
ugacagcauacauccuaaauaau

SEQ ID NO: 2317259 - RNA, 17 nt, Yersinia pestis KIM
ugacaggaucaggccag

SEQ ID NO: 2317260 - RNA, 19 nt, Yersinia pestis KIM
ugacagguugauaaguuga

SEQ ID NO: 2317261 - RNA, 17 nt, Yersinia pestis KIM
ugaaugagguuuacauu

SEQ ID NO: 2317262 - RNA, 21 nt, Yersinia pestis KIM
ugaaucuguaagucauucuug

SEQ ID NO: 2317263 - RNA, 12 nt, Yersinia pestis KIM
ugaaucuguaag

SEQ ID NO: 2317264 - RNA, 13 nt, Yersinia pestis KIM
ugaauauuauuca

SEQ ID NO: 2317265 - RNA, 16 nt, Yersinia pestis KIM
ugaauauccgccgccc

SEQ ID NO: 2317266 - RNA, 17 nt, Yersinia pestis KIM
ugaauacgauaaagaag

SEQ ID NO: 2317267 - RNA, 17 nt, Yersinia pestis KIM
ucuuuauuauuauuuau

SEQ ID NO: 2317268 - RNA, 15 nt, Yersinia pestis KIM
ucuuuauauucaaua

SEQ ID NO: 2317269 - RNA, 17 nt, Yersinia pestis KIM
ucuuuauuaucaauggc

SEQ ID NO: 2317270 - RNA, 14 nt, Yersinia pestis KIM
ucuuuauacccaaa

SEQ ID NO: 2317271 - RNA, 18 nt, Yersinia pestis KIM
ucuuuauacccaaaauaa

SEQ ID NO: 2317272 - RNA, 15 nt, Yersinia pestis KIM
ucuuucaaagugaca

SEQ ID NO: 2317273 - RNA, 16 nt, Yersinia pestis KIM
ucuuucaacugcucau

SEQ ID NO: 2317274 - RNA, 19 nt, Yersinia pestis KIM
ugaauuuuuauaauuaauu

SEQ ID NO: 2317275 - RNA, 20 nt, Yersinia pestis KIM
ugaauuuuuauaauuaauuu

SEQ ID NO: 2317276 - RNA, 20 nt, Yersinia pestis KIM
ugaaugaguuucaagucaau

SEQ ID NO: 2317277 - RNA, 12 nt, Yersinia pestis KIM
ugaaugauggua

SEQ ID NO: 2317278 - RNA, 12 nt, Yersinia pestis KIM
ugaauucaccaa

SEQ ID NO: 2317279 - RNA, 14 nt, Yersinia pestis KIM
ugaauucaagaagg

SEQ ID NO: 2317280 - RNA, 15 nt, Yersinia pestis KIM
ugacaaagugcccgc

SEQ ID NO: 2317281 - RNA, 17 nt, Yersinia pestis KIM
ugacaaaguuaaaugaa

SEQ ID NO: 2317282 - RNA, 19 nt, Yersinia pestis KIM
ugacaaaggguaauuaauu

SEQ ID NO: 2317283 - RNA, 16 nt, Yersinia pestis KIM
ugacaaagagcccgca

SEQ ID NO: 2317284 - RNA, 18 nt, Yersinia pestis KIM
ugacaaaccccgauaacg

SEQ ID NO: 2317285 - RNA, 19 nt, Yersinia pestis KIM
ugacaaaaacagcacuauc

SEQ ID NO: 2317286 - RNA, 16 nt, Yersinia pestis KIM
ugaauuuuuuuaacuu

SEQ ID NO: 2317287 - RNA, 16 nt, Yersinia pestis KIM
ugacaacaucaaauga

SEQ ID NO: 2317288 - RNA, 17 nt, Yersinia pestis KIM
ugacaacaucaaaugaa

SEQ ID NO: 2317289 - RNA, 22 nt, Yersinia pestis KIM
ugacaacaaaaaauaaggcgcu

SEQ ID NO: 2317290 - RNA, 19 nt, Yersinia pestis KIM
ugacaacaccguaacgccc

SEQ ID NO: 2317291 - RNA, 19 nt, Yersinia pestis KIM
ugacaacgucacuuccauc

SEQ ID NO: 2317292 - RNA, 21 nt, Yersinia pestis KIM
ugacaccauugauaauaauau

SEQ ID NO: 2317293 - RNA, 17 nt, Yersinia pestis KIM
ugcgacgacgacaauga

SEQ ID NO: 2317294 - RNA, 16 nt, Yersinia pestis KIM
ugcgagauauaaacua

SEQ ID NO: 2317295 - RNA, 14 nt, Yersinia pestis KIM
ugcgagcaaggcau

SEQ ID NO: 2317296 - RNA, 21 nt, Yersinia pestis KIM
ugcgacaggcucagcacaaac

SEQ ID NO: 2317297 - RNA, 13 nt, Yersinia pestis KIM
ugcgacaauuucc

SEQ ID NO: 2317298 - RNA, 13 nt, Yersinia pestis KIM
ugcgaauuaucau

SEQ ID NO: 2317299 - RNA, 14 nt, Yersinia pestis KIM
ugcgaagcgcaccc

SEQ ID NO: 2317300 - RNA, 19 nt, Yersinia pestis KIM
ugcgaauauugcguuaccu

SEQ ID NO: 2317301 - RNA, 17 nt, Yersinia pestis KIM
ugccuuuuuugaacgau

SEQ ID NO: 2317302 - RNA, 14 nt, Yersinia pestis KIM
ugcgaaaaaagaug

SEQ ID NO: 2317303 - RNA, 20 nt, Yersinia pestis KIM
ugcgauuucacggauaucaa

SEQ ID NO: 2317304 - RNA, 21 nt, Yersinia pestis KIM
ugcgauguuuuccaacuccau

SEQ ID NO: 2317305 - RNA, 12 nt, Yersinia pestis KIM
ugcgcaaaauua

SEQ ID NO: 2317306 - RNA, 18 nt, Yersinia pestis KIM
ugcgcaaaauuaagacau

SEQ ID NO: 2317307 - RNA, 21 nt, Yersinia pestis KIM
ugcgauacaccauuuccaggc

SEQ ID NO: 2317308 - RNA, 18 nt, Yersinia pestis KIM
ugcgaucaauuggcccuu

SEQ ID NO: 2317309 - RNA, 20 nt, Yersinia pestis KIM
ugccggcguuaaugccaccc

SEQ ID NO: 2317310 - RNA, 21 nt, Yersinia pestis KIM
ugccggcguuaaugccacccc

SEQ ID NO: 2317311 - RNA, 19 nt, Yersinia pestis KIM
ugccgucauuaugcauuuc

SEQ ID NO: 2317312 - RNA, 22 nt, Yersinia pestis KIM
ugccguaucuuguaguaaccac

SEQ ID NO: 2317313 - RNA, 13 nt, Yersinia pestis KIM
ugccuguucucuc

SEQ ID NO: 2317314 - RNA, 19 nt, Yersinia pestis KIM
ugccugugcggcagugaac

SEQ ID NO: 2317315 - RNA, 19 nt, Yersinia pestis KIM
ugccuuagguaagucagcg

SEQ ID NO: 2317316 - RNA, 18 nt, Yersinia pestis KIM
ugccuuacaaagcauuuc

SEQ ID NO: 2317317 - RNA, 15 nt, Yersinia pestis KIM
ugccuuauccccgcc

SEQ ID NO: 2317318 - RNA, 23 nt, Yersinia pestis KIM
ugccuuucuguaacucaaauuau

SEQ ID NO: 2317319 - RNA, 13 nt, Yersinia pestis KIM
ugccuuuucuucc

SEQ ID NO: 2317320 - RNA, 14 nt, Yersinia pestis KIM
ugccuuuucuuccg

SEQ ID NO: 2317321 - RNA, 14 nt, Yersinia pestis KIM
ugccuuuaauggca

SEQ ID NO: 2317322 - RNA, 16 nt, Yersinia pestis KIM
ugccuuggucucagaa

SEQ ID NO: 2317323 - RNA, 20 nt, Yersinia pestis KIM
ugccuuggucucagaacaag

SEQ ID NO: 2317324 - RNA, 21 nt, Yersinia pestis KIM
ugccuauccugacaccggaua

SEQ ID NO: 2317325 - RNA, 14 nt, Yersinia pestis KIM
ugccuauccucacc

SEQ ID NO: 2317326 - RNA, 13 nt, Yersinia pestis KIM
ugccuauccucac

SEQ ID NO: 2317327 - RNA, 15 nt, Yersinia pestis KIM
ugccuacugaagagu

SEQ ID NO: 2317328 - RNA, 15 nt, Yersinia pestis KIM
ugccugcaccagugc

SEQ ID NO: 2317329 - RNA, 16 nt, Yersinia pestis KIM
ugccugcaccagugcc

SEQ ID NO: 2317330 - RNA, 21 nt, Yersinia pestis KIM
ugccugacagccugugcccaa

SEQ ID NO: 2317331 - RNA, 22 nt, Yersinia pestis KIM
ugccugacggcaaagaaguacu

SEQ ID NO: 2317332 - RNA, 21 nt, Yersinia pestis KIM
ugccgcaaacgcucaguuaaa

SEQ ID NO: 2317333 - RNA, 16 nt, Yersinia pestis KIM
ugccgcacacagcccu

SEQ ID NO: 2317334 - RNA, 20 nt, Yersinia pestis KIM
ugcccuguucgccauaaaug

SEQ ID NO: 2317335 - RNA, 16 nt, Yersinia pestis KIM
ugcccuuacuauuuuu

SEQ ID NO: 2317336 - RNA, 15 nt, Yersinia pestis KIM
ugcccgguugccuga

SEQ ID NO: 2317337 - RNA, 22 nt, Yersinia pestis KIM
ugcccuucagaugaauccagcc

SEQ ID NO: 2317338 - RNA, 18 nt, Yersinia pestis KIM
ugcccuuugcuauucaga

SEQ ID NO: 2317339 - RNA, 14 nt, Yersinia pestis KIM
ugcccuuuuagccu

SEQ ID NO: 2317340 - RNA, 20 nt, Yersinia pestis KIM
ugccccuuuuuucuauuuau

SEQ ID NO: 2317341 - RNA, 18 nt, Yersinia pestis KIM
ugccccuucaaagccgcu

SEQ ID NO: 2317342 - RNA, 14 nt, Yersinia pestis KIM
ugcccgcacacuga

SEQ ID NO: 2317343 - RNA, 15 nt, Yersinia pestis KIM
ugccccugauaguca

SEQ ID NO: 2317344 - RNA, 20 nt, Yersinia pestis KIM
ugccccucacccguaaacac

SEQ ID NO: 2317345 - RNA, 14 nt, Yersinia pestis KIM
ugcccagccucugg

SEQ ID NO: 2317346 - RNA, 19 nt, Yersinia pestis KIM
ugcccagagcgcggcuuca

SEQ ID NO: 2317347 - RNA, 15 nt, Yersinia pestis KIM
ugcccagagugacaa

SEQ ID NO: 2317348 - RNA, 16 nt, Yersinia pestis KIM
ugcccagaaaaccccc

SEQ ID NO: 2317349 - RNA, 19 nt, Yersinia pestis KIM
ugcccaguuuaccauccac

SEQ ID NO: 2317350 - RNA, 16 nt, Yersinia pestis KIM
ugcaguaucuggguga

SEQ ID NO: 2317351 - RNA, 17 nt, Yersinia pestis KIM
ugccaacgucucuucca

SEQ ID NO: 2317352 - RNA, 23 nt, Yersinia pestis KIM
ugccaaccggauaaaacaauagc

SEQ ID NO: 2317353 - RNA, 18 nt, Yersinia pestis KIM
ugccaaggccgaucaaca

SEQ ID NO: 2317354 - RNA, 15 nt, Yersinia pestis KIM
ugcaguaacauaauc

SEQ ID NO: 2317355 - RNA, 14 nt, Yersinia pestis KIM
ugcaguacagauaa

SEQ ID NO: 2317356 - RNA, 17 nt, Yersinia pestis KIM
ugcaguaaaaauauuaa

SEQ ID NO: 2317357 - RNA, 23 nt, Yersinia pestis KIM
ugccaaucgcucugcguuuuucc

SEQ ID NO: 2317358 - RNA, 19 nt, Yersinia pestis KIM
ugccacagacuuucuuuaa

SEQ ID NO: 2317359 - RNA, 22 nt, Yersinia pestis KIM
ugccaagguucgaaaaaacauc

SEQ ID NO: 2317360 - RNA, 19 nt, Yersinia pestis KIM
ugccaauauguuagcagca

SEQ ID NO: 2317361 - RNA, 15 nt, Yersinia pestis KIM
ugccacugacugcuu

SEQ ID NO: 2317362 - RNA, 16 nt, Yersinia pestis KIM
ugccacugacugcuuu

SEQ ID NO: 2317363 - RNA, 13 nt, Yersinia pestis KIM
ugccacuguuuuu

SEQ ID NO: 2317364 - RNA, 15 nt, Yersinia pestis KIM
ugccacuguuuuucc

SEQ ID NO: 2317365 - RNA, 21 nt, Yersinia pestis KIM
ugccacuguuuuuccagcccu

SEQ ID NO: 2317366 - RNA, 22 nt, Yersinia pestis KIM
ugccauaagcggacauggcaac

SEQ ID NO: 2317367 - RNA, 23 nt, Yersinia pestis KIM
ugccauaagcggacauggcaaca

SEQ ID NO: 2317368 - RNA, 16 nt, Yersinia pestis KIM
ugccauacggcgucuu

SEQ ID NO: 2317369 - RNA, 13 nt, Yersinia pestis KIM
ugccagugcaauc

SEQ ID NO: 2317370 - RNA, 16 nt, Yersinia pestis KIM
ugcccaauggcaaaac

SEQ ID NO: 2317371 - RNA, 18 nt, Yersinia pestis KIM
ugccaucaauaccaauaa

SEQ ID NO: 2317372 - RNA, 19 nt, Yersinia pestis KIM
ugccaucaauaccaauaaa

SEQ ID NO: 2317373 - RNA, 15 nt, Yersinia pestis KIM
ugccaguagcaauaa

SEQ ID NO: 2317374 - RNA, 18 nt, Yersinia pestis KIM
ugccagcaaagacaauaa

SEQ ID NO: 2317375 - RNA, 21 nt, Yersinia pestis KIM
ugcucacgguagguuucuggg

SEQ ID NO: 2317376 - RNA, 14 nt, Yersinia pestis KIM
ugcucacucaccgc

SEQ ID NO: 2317377 - RNA, 16 nt, Yersinia pestis KIM
ugcucagcuaaagaac

SEQ ID NO: 2317378 - RNA, 16 nt, Yersinia pestis KIM
ugcucgcuaaucaagc

SEQ ID NO: 2317379 - RNA, 21 nt, Yersinia pestis KIM
ugcuccaucuuuuacaaauuu

SEQ ID NO: 2317380 - RNA, 13 nt, Yersinia pestis KIM
ugcucccauguca

SEQ ID NO: 2317381 - RNA, 17 nt, Yersinia pestis KIM
ugcucuaacguuaaaag

SEQ ID NO: 2317382 - RNA, 20 nt, Yersinia pestis KIM
ugcucuucaccaaaggaagc

SEQ ID NO: 2317383 - RNA, 16 nt, Yersinia pestis KIM
ugcucucguugcauua

SEQ ID NO: 2317384 - RNA, 15 nt, Yersinia pestis KIM
ugcucugcaauacug

SEQ ID NO: 2317385 - RNA, 13 nt, Yersinia pestis KIM
ugcuacagcagca

SEQ ID NO: 2317386 - RNA, 20 nt, Yersinia pestis KIM
ugcuaauaccaccaccacac

SEQ ID NO: 2317387 - RNA, 22 nt, Yersinia pestis KIM
ugcuacggauugcaaauccguc

SEQ ID NO: 2317388 - RNA, 15 nt, Yersinia pestis KIM
ugcuacggcaaaaua

SEQ ID NO: 2317389 - RNA, 21 nt, Yersinia pestis KIM
ugcuacguaaugaugaugagu

SEQ ID NO: 2317390 - RNA, 18 nt, Yersinia pestis KIM
ugcguuuuugaaauacca

SEQ ID NO: 2317391 - RNA, 16 nt, Yersinia pestis KIM
ugcuaacaaaguccug

SEQ ID NO: 2317392 - RNA, 14 nt, Yersinia pestis KIM
ugcuauuaaacauu

SEQ ID NO: 2317393 - RNA, 16 nt, Yersinia pestis KIM
ugcuauuaaacauuua

SEQ ID NO: 2317394 - RNA, 22 nt, Yersinia pestis KIM
ugcuauuuagguaguuuuauuc

SEQ ID NO: 2317395 - RNA, 17 nt, Yersinia pestis KIM
ugcucaaacuugaucag

SEQ ID NO: 2317396 - RNA, 15 nt, Yersinia pestis KIM
ugcucacgcaaauaa

SEQ ID NO: 2317397 - RNA, 19 nt, Yersinia pestis KIM
ugcucacccauuuuauccu

SEQ ID NO: 2317398 - RNA, 23 nt, Yersinia pestis KIM
ugcucacccauuuuauccucuuc

SEQ ID NO: 2317399 - RNA, 15 nt, Yersinia pestis KIM
ugcuauuuuauaucg

SEQ ID NO: 2317400 - RNA, 17 nt, Yersinia pestis KIM
ugcuacuuaauaucuaa

SEQ ID NO: 2317401 - RNA, 20 nt, Yersinia pestis KIM
ugcuagcagaggcaaauucc

SEQ ID NO: 2317402 - RNA, 18 nt, Yersinia pestis KIM
ugcuaucggcggagagaa

SEQ ID NO: 2317403 - RNA, 19 nt, Yersinia pestis KIM
ugcuauccucuuaaugucu

SEQ ID NO: 2317404 - RNA, 18 nt, Yersinia pestis KIM
ugcgccaaaugucaccag

SEQ ID NO: 2317405 - RNA, 17 nt, Yersinia pestis KIM
ugcgccaaguccuccuu

SEQ ID NO: 2317406 - RNA, 12 nt, Yersinia pestis KIM
ugcgcuggcucu

SEQ ID NO: 2317407 - RNA, 19 nt, Yersinia pestis KIM
ugcgcucuguauuguaaua

SEQ ID NO: 2317408 - RNA, 16 nt, Yersinia pestis KIM
ugcgcugagugauagu

SEQ ID NO: 2317409 - RNA, 19 nt, Yersinia pestis KIM
ugcggcaauaagcauuauu

SEQ ID NO: 2317410 - RNA, 18 nt, Yersinia pestis KIM
ugcggcggcugaccacaa

SEQ ID NO: 2317411 - RNA, 13 nt, Yersinia pestis KIM
ugcgggaauagcu

SEQ ID NO: 2317412 - RNA, 14 nt, Yersinia pestis KIM
ugcgggugccgcau

SEQ ID NO: 2317413 - RNA, 23 nt, Yersinia pestis KIM
ugcggguauuugucgucccaggc

SEQ ID NO: 2317414 - RNA, 18 nt, Yersinia pestis KIM
ugcgguagaccaccaacu

SEQ ID NO: 2317415 - RNA, 13 nt, Yersinia pestis KIM
ugcgguaguucag

SEQ ID NO: 2317416 - RNA, 19 nt, Yersinia pestis KIM
ugcguacgccaacuuuugc

SEQ ID NO: 2317417 - RNA, 23 nt, Yersinia pestis KIM
ugcguaccauauggaugaugcac

SEQ ID NO: 2317418 - RNA, 18 nt, Yersinia pestis KIM
ugcguaauuacccaagau

SEQ ID NO: 2317419 - RNA, 16 nt, Yersinia pestis KIM
ugcguacaacauccag

SEQ ID NO: 2317420 - RNA, 16 nt, Yersinia pestis KIM
ugcguauuaucaucac

SEQ ID NO: 2317421 - RNA, 15 nt, Yersinia pestis KIM
uggaaguuaaaaaaa

SEQ ID NO: 2317422 - RNA, 16 nt, Yersinia pestis KIM
uggaaguuaaaaaaau

SEQ ID NO: 2317423 - RNA, 13 nt, Yersinia pestis KIM
uggaauuaauauc

SEQ ID NO: 2317424 - RNA, 15 nt, Yersinia pestis KIM
uggaauuaaaguauc

SEQ ID NO: 2317425 - RNA, 16 nt, Yersinia pestis KIM
uggaauuuaugcacca

SEQ ID NO: 2317426 - RNA, 18 nt, Yersinia pestis KIM
uggacgauaaauucaaau

SEQ ID NO: 2317427 - RNA, 14 nt, Yersinia pestis KIM
uggacaucugcuuu

SEQ ID NO: 2317428 - RNA, 19 nt, Yersinia pestis KIM
uggacccgucaccacaaag

SEQ ID NO: 2317429 - RNA, 17 nt, Yersinia pestis KIM
uggacaaauaaaacaga

SEQ ID NO: 2317430 - RNA, 24 nt, Yersinia pestis KIM
uggacaguaaguugaugacaugcu

SEQ ID NO: 2317431 - RNA, 17 nt, Yersinia pestis KIM
uggaacaggauuuucaa

SEQ ID NO: 2317432 - RNA, 14 nt, Yersinia pestis KIM
uggaagaccagaua

SEQ ID NO: 2317433 - RNA, 18 nt, Yersinia pestis KIM
uggaacguugcacccugc

SEQ ID NO: 2317434 - RNA, 12 nt, Yersinia pestis KIM
uggaagagccug

SEQ ID NO: 2317435 - RNA, 17 nt, Yersinia pestis KIM
uggaagcagaauacugu

SEQ ID NO: 2317436 - RNA, 18 nt, Yersinia pestis KIM
uggaagcagaauacugug

SEQ ID NO: 2317437 - RNA, 15 nt, Yersinia pestis KIM
uggaaguacuuauuu

SEQ ID NO: 2317438 - RNA, 20 nt, Yersinia pestis KIM
uggaagggaguuacucagca

SEQ ID NO: 2317439 - RNA, 14 nt, Yersinia pestis KIM
uggaagggccgcua

SEQ ID NO: 2317440 - RNA, 18 nt, Yersinia pestis KIM
ugcuuuuugcuuuuugcu

SEQ ID NO: 2317441 - RNA, 14 nt, Yersinia pestis KIM
ugcuuuuuucacac

SEQ ID NO: 2317442 - RNA, 16 nt, Yersinia pestis KIM
ugcuuuuugcgcugcg

SEQ ID NO: 2317443 - RNA, 17 nt, Yersinia pestis KIM
uggaaaccggcaauagc

SEQ ID NO: 2317444 - RNA, 16 nt, Yersinia pestis KIM
ugcuuucuaacaaacc

SEQ ID NO: 2317445 - RNA, 15 nt, Yersinia pestis KIM
ugcuuugcuucaucc

SEQ ID NO: 2317446 - RNA, 22 nt, Yersinia pestis KIM
ugcuuugcgaaauaaguuaaua

SEQ ID NO: 2317447 - RNA, 14 nt, Yersinia pestis KIM
ugcuuuucugccua

SEQ ID NO: 2317448 - RNA, 18 nt, Yersinia pestis KIM
ugcuuguuguugauaguu

SEQ ID NO: 2317449 - RNA, 22 nt, Yersinia pestis KIM
ugcuuggauuccgucgccaaca

SEQ ID NO: 2317450 - RNA, 16 nt, Yersinia pestis KIM
ugcuucaucacuguug

SEQ ID NO: 2317451 - RNA, 22 nt, Yersinia pestis KIM
ugcuuaccuuguuuguuacugc

SEQ ID NO: 2317452 - RNA, 13 nt, Yersinia pestis KIM
ugcuuaaaacagg

SEQ ID NO: 2317453 - RNA, 16 nt, Yersinia pestis KIM
ugcugcgggcacuauc

SEQ ID NO: 2317454 - RNA, 22 nt, Yersinia pestis KIM
ugcugacaaaguuaaaugaagg

SEQ ID NO: 2317455 - RNA, 14 nt, Yersinia pestis KIM
ugcugacaacccuc

SEQ ID NO: 2317456 - RNA, 18 nt, Yersinia pestis KIM
ugcugaccccaaauuuga

SEQ ID NO: 2317457 - RNA, 17 nt, Yersinia pestis KIM
ugcugcgaagaucacuc

SEQ ID NO: 2317458 - RNA, 18 nt, Yersinia pestis KIM
ugcuggucuccgcuggca

SEQ ID NO: 2317459 - RNA, 14 nt, Yersinia pestis KIM
ugcuggugucacaa

SEQ ID NO: 2317460 - RNA, 14 nt, Yersinia pestis KIM
ugcuguauuuuucg

SEQ ID NO: 2317461 - RNA, 23 nt, Yersinia pestis KIM
ugcugugagccagagacauaaag

SEQ ID NO: 2317462 - RNA, 16 nt, Yersinia pestis KIM
ugcugugcgauuucac

SEQ ID NO: 2317463 - RNA, 21 nt, Yersinia pestis KIM
ugcugugacucuuaguuauga

SEQ ID NO: 2317464 - RNA, 18 nt, Yersinia pestis KIM
uuaggggcuagccagcgu

SEQ ID NO: 2317465 - RNA, 18 nt, Yersinia pestis KIM
uuagguaauaccaaugcu

SEQ ID NO: 2317466 - RNA, 14 nt, Yersinia pestis KIM
uuaggugacaggca

SEQ ID NO: 2317467 - RNA, 22 nt, Yersinia pestis KIM
uuaguauacuaugggauaaacu

SEQ ID NO: 2317468 - RNA, 20 nt, Yersinia pestis KIM
uuaguugguaauaaggucac

SEQ ID NO: 2317469 - RNA, 13 nt, Yersinia pestis KIM
uuauaaaaacccc

SEQ ID NO: 2317470 - RNA, 23 nt, Yersinia pestis KIM
uuagucacucaagccaguaacua

SEQ ID NO: 2317471 - RNA, 21 nt, Yersinia pestis KIM
uuagucagcgcggcccauaua

SEQ ID NO: 2317472 - RNA, 19 nt, Yersinia pestis KIM
uuagucacuaaagcggaau

SEQ ID NO: 2317473 - RNA, 13 nt, Yersinia pestis KIM
uuagucucuuauu

SEQ ID NO: 2317474 - RNA, 18 nt, Yersinia pestis KIM
uuagugcuacagcagcag

SEQ ID NO: 2317475 - RNA, 13 nt, Yersinia pestis KIM
uuaguggcuuuaa

SEQ ID NO: 2317476 - RNA, 21 nt, Yersinia pestis KIM
uuaguggcuuuaagauccagu

SEQ ID NO: 2317477 - RNA, 17 nt, Yersinia pestis KIM
uuauacccguuauauuu

SEQ ID NO: 2317478 - RNA, 16 nt, Yersinia pestis KIM
uuauaccuacccuuua

SEQ ID NO: 2317479 - RNA, 17 nt, Yersinia pestis KIM
uuauacccaaaauaauu

SEQ ID NO: 2317480 - RNA, 16 nt, Yersinia pestis KIM
uuauaaaucagggcag

SEQ ID NO: 2317481 - RNA, 15 nt, Yersinia pestis KIM
uuauagguauacacc

SEQ ID NO: 2317482 - RNA, 14 nt, Yersinia pestis KIM
uuauaggcucuguu

SEQ ID NO: 2317483 - RNA, 20 nt, Yersinia pestis KIM
uuauaguuaaacugauuggu

SEQ ID NO: 2317484 - RNA, 20 nt, Yersinia pestis KIM
uuaucaccaguauuauuggc

SEQ ID NO: 2317485 - RNA, 21 nt, Yersinia pestis KIM
uuaucaccaacguuuauaucc

SEQ ID NO: 2317486 - RNA, 18 nt, Yersinia pestis KIM
uuauauucauauuucacu

SEQ ID NO: 2317487 - RNA, 16 nt, Yersinia pestis KIM
uuauauugcucaguuc

SEQ ID NO: 2317488 - RNA, 18 nt, Yersinia pestis KIM
uuauaugaucaguggggu

SEQ ID NO: 2317489 - RNA, 21 nt, Yersinia pestis KIM
uuauaucuugcugaaaacaau

SEQ ID NO: 2317490 - RNA, 20 nt, Yersinia pestis KIM
uuauauaaauggcuguuaua

SEQ ID NO: 2317491 - RNA, 14 nt, Yersinia pestis KIM
uuauauuauuuauc

SEQ ID NO: 2317492 - RNA, 15 nt, Yersinia pestis KIM
uuauaugcuguauaa

SEQ ID NO: 2317493 - RNA, 21 nt, Yersinia pestis KIM
uuauaugcuguauaaaagaau

SEQ ID NO: 2317494 - RNA, 21 nt, Yersinia pestis KIM
uuaccuuguuuguuacugcuu

SEQ ID NO: 2317495 - RNA, 12 nt, Yersinia pestis KIM
uuacuuauaaac

SEQ ID NO: 2317496 - RNA, 14 nt, Yersinia pestis KIM
uuagauuucaccua

SEQ ID NO: 2317497 - RNA, 20 nt, Yersinia pestis KIM
uuagauaggcuuuccccccu

SEQ ID NO: 2317498 - RNA, 22 nt, Yersinia pestis KIM
uuagacaugggcagugcacagu

SEQ ID NO: 2317499 - RNA, 22 nt, Yersinia pestis KIM
uuagaccggacauuaauuauuu

SEQ ID NO: 2317500 - RNA, 17 nt, Yersinia pestis KIM
uuagacgucagauuagu

SEQ ID NO: 2317501 - RNA, 18 nt, Yersinia pestis KIM
uuagacgucagauuagcu

SEQ ID NO: 2317502 - RNA, 22 nt, Yersinia pestis KIM
uuagacgucagauuagcuuuaa

SEQ ID NO: 2317503 - RNA, 20 nt, Yersinia pestis KIM
uuagcauuaccgguaauauu

SEQ ID NO: 2317504 - RNA, 15 nt, Yersinia pestis KIM
uuagcaugcauccau

SEQ ID NO: 2317505 - RNA, 20 nt, Yersinia pestis KIM
uuagccacugguugaaaguu

SEQ ID NO: 2317506 - RNA, 15 nt, Yersinia pestis KIM
uuagccccaaaugcc

SEQ ID NO: 2317507 - RNA, 15 nt, Yersinia pestis KIM
uuagccgaauauccc

SEQ ID NO: 2317508 - RNA, 21 nt, Yersinia pestis KIM
uuagcaacgguaucccgguga

SEQ ID NO: 2317509 - RNA, 14 nt, Yersinia pestis KIM
uuagcaauaauaga

SEQ ID NO: 2317510 - RNA, 12 nt, Yersinia pestis KIM
uuagcagggcau

SEQ ID NO: 2317511 - RNA, 17 nt, Yersinia pestis KIM
uuagcacauaugcagcu

SEQ ID NO: 2317512 - RNA, 19 nt, Yersinia pestis KIM
uuagcacguuuuucagcuu

SEQ ID NO: 2317513 - RNA, 16 nt, Yersinia pestis KIM
uuaggcaugauaagca

SEQ ID NO: 2317514 - RNA, 15 nt, Yersinia pestis KIM
uuaggcauaaauaau

SEQ ID NO: 2317515 - RNA, 20 nt, Yersinia pestis KIM
uuaggcaauccaaacauaca

SEQ ID NO: 2317516 - RNA, 23 nt, Yersinia pestis KIM
uuaggauuuauuucucugauaau

SEQ ID NO: 2317517 - RNA, 23 nt, Yersinia pestis KIM
uuagcugauuugauauuagccaa

SEQ ID NO: 2317518 - RNA, 23 nt, Yersinia pestis KIM
uuagcgaugaccauuuauuucca

SEQ ID NO: 2317519 - RNA, 18 nt, Yersinia pestis KIM
uuagccuucguuugucaa

SEQ ID NO: 2317520 - RNA, 19 nt, Yersinia pestis KIM
uuaagguuagcuaugcagu

SEQ ID NO: 2317521 - RNA, 23 nt, Yersinia pestis KIM
uuaaguaaguuuaaacuguuauu

SEQ ID NO: 2317522 - RNA, 14 nt, Yersinia pestis KIM
uuaagagagaugca

SEQ ID NO: 2317523 - RNA, 20 nt, Yersinia pestis KIM
uuaaggacccguuuauaaag

SEQ ID NO: 2317524 - RNA, 16 nt, Yersinia pestis KIM
uuaaggacucuuaguu

SEQ ID NO: 2317525 - RNA, 19 nt, Yersinia pestis KIM
uuaaggagcccucugucau

SEQ ID NO: 2317526 - RNA, 20 nt, Yersinia pestis KIM
uuaagggggggaagcucccc

SEQ ID NO: 2317527 - RNA, 15 nt, Yersinia pestis KIM
uuaagguaacggcau

SEQ ID NO: 2317528 - RNA, 20 nt, Yersinia pestis KIM
uuaaggccagcagaacuaac

SEQ ID NO: 2317529 - RNA, 20 nt, Yersinia pestis KIM
uuaaggcgauauuauuagua

SEQ ID NO: 2317530 - RNA, 21 nt, Yersinia pestis KIM
uuaagaauccucugaauaaaa

SEQ ID NO: 2317531 - RNA, 22 nt, Yersinia pestis KIM
uuaagaauccucugaauaaaaa

SEQ ID NO: 2317532 - RNA, 19 nt, Yersinia pestis KIM
uuaaaugaccacccacguu

SEQ ID NO: 2317533 - RNA, 13 nt, Yersinia pestis KIM
uuaaaugaagcag

SEQ ID NO: 2317534 - RNA, 13 nt, Yersinia pestis KIM
uuaaauaaagaua

SEQ ID NO: 2317535 - RNA, 23 nt, Yersinia pestis KIM
uuaaauaaagauaaugugacuga

SEQ ID NO: 2317536 - RNA, 13 nt, Yersinia pestis KIM
uuaaauccaauau

SEQ ID NO: 2317537 - RNA, 14 nt, Yersinia pestis KIM
uuaaauccaauauu

SEQ ID NO: 2317538 - RNA, 19 nt, Yersinia pestis KIM
uuaaauccaauauucccug

SEQ ID NO: 2317539 - RNA, 12 nt, Yersinia pestis KIM
uuaacuguuuua

SEQ ID NO: 2317540 - RNA, 14 nt, Yersinia pestis KIM
uuaacuguuaaaac

SEQ ID NO: 2317541 - RNA, 17 nt, Yersinia pestis KIM
uuaagaaaucuauuaau

SEQ ID NO: 2317542 - RNA, 21 nt, Yersinia pestis KIM
uuaacuggccaauuaacggau

SEQ ID NO: 2317543 - RNA, 18 nt, Yersinia pestis KIM
uuaacugcaguaaaaaua

SEQ ID NO: 2317544 - RNA, 11 nt, Yersinia pestis KIM
uuaacugcagu

SEQ ID NO: 2317545 - RNA, 15 nt, Yersinia pestis KIM
uuaacugcaguaaaa

SEQ ID NO: 2317546 - RNA, 14 nt, Yersinia pestis KIM
uuaauaauaucaaa

SEQ ID NO: 2317547 - RNA, 23 nt, Yersinia pestis KIM
uuaauccccaugaugauaucacc

SEQ ID NO: 2317548 - RNA, 21 nt, Yersinia pestis KIM
uuaauccauagugauuauuua

SEQ ID NO: 2317549 - RNA, 18 nt, Yersinia pestis KIM
uuaaucauuggcaacuua

SEQ ID NO: 2317550 - RNA, 22 nt, Yersinia pestis KIM
uuaaucaguggcugaaggggcu

SEQ ID NO: 2317551 - RNA, 16 nt, Yersinia pestis KIM
uuaaucagaaaauuca

SEQ ID NO: 2317552 - RNA, 11 nt, Yersinia pestis KIM
uuaauauuaau

SEQ ID NO: 2317553 - RNA, 22 nt, Yersinia pestis KIM
uuaauaugcaaaaaaagacacu

SEQ ID NO: 2317554 - RNA, 16 nt, Yersinia pestis KIM
uuaauaucaaaacuga

SEQ ID NO: 2317555 - RNA, 18 nt, Yersinia pestis KIM
uuaccgccgucaugcuga

SEQ ID NO: 2317556 - RNA, 21 nt, Yersinia pestis KIM
uuacccguuacacaaucagua

SEQ ID NO: 2317557 - RNA, 14 nt, Yersinia pestis KIM
uuacccguacaaaa

SEQ ID NO: 2317558 - RNA, 23 nt, Yersinia pestis KIM
uuacccuacccauuauaaauaau

SEQ ID NO: 2317559 - RNA, 17 nt, Yersinia pestis KIM
uuaccgugguuauuggc

SEQ ID NO: 2317560 - RNA, 15 nt, Yersinia pestis KIM
uuaccguaagauucg

SEQ ID NO: 2317561 - RNA, 16 nt, Yersinia pestis KIM
uuaccgggcgaacaga

SEQ ID NO: 2317562 - RNA, 20 nt, Yersinia pestis KIM
uuaccuauaaacuugauuca

SEQ ID NO: 2317563 - RNA, 11 nt, Yersinia pestis KIM
uuaccuaacca

SEQ ID NO: 2317564 - RNA, 18 nt, Yersinia pestis KIM
uuaccuaaccaaacauug

SEQ ID NO: 2317565 - RNA, 14 nt, Yersinia pestis KIM
uuaccugcucaacu

SEQ ID NO: 2317566 - RNA, 21 nt, Yersinia pestis KIM
uuaccugacacugcaucucug

SEQ ID NO: 2317567 - RNA, 15 nt, Yersinia pestis KIM
uuacaauuacacacc

SEQ ID NO: 2317568 - RNA, 22 nt, Yersinia pestis KIM
uuacacacccucaacucaaaac

SEQ ID NO: 2317569 - RNA, 22 nt, Yersinia pestis KIM
uuacaggauuaaauaaagauaa

SEQ ID NO: 2317570 - RNA, 19 nt, Yersinia pestis KIM
uuacaggccccuucuggug

SEQ ID NO: 2317571 - RNA, 17 nt, Yersinia pestis KIM
uuaccacuggccuccca

SEQ ID NO: 2317572 - RNA, 13 nt, Yersinia pestis KIM
uuacaguuuaauu

SEQ ID NO: 2317573 - RNA, 16 nt, Yersinia pestis KIM
uuacaguaaggcagca

SEQ ID NO: 2317574 - RNA, 17 nt, Yersinia pestis KIM
uuacaguaaggcagcaa

SEQ ID NO: 2317575 - RNA, 18 nt, Yersinia pestis KIM
uuacaguaaggcagcaag

SEQ ID NO: 2317576 - RNA, 15 nt, Yersinia pestis KIM
uuaauguuuauauug

SEQ ID NO: 2317577 - RNA, 17 nt, Yersinia pestis KIM
uuaaucgucuuguuggu

SEQ ID NO: 2317578 - RNA, 16 nt, Yersinia pestis KIM
uuaaucgcugaacaga

SEQ ID NO: 2317579 - RNA, 17 nt, Yersinia pestis KIM
uuaaucgcaguuaucau

SEQ ID NO: 2317580 - RNA, 23 nt, Yersinia pestis KIM
uuaauccccggucacuuaaauaa

SEQ ID NO: 2317581 - RNA, 13 nt, Yersinia pestis KIM
uuaauccuucacu

SEQ ID NO: 2317582 - RNA, 15 nt, Yersinia pestis KIM
uuaauccuucacuua

SEQ ID NO: 2317583 - RNA, 23 nt, Yersinia pestis KIM
uuaauuggcucauaacacuuaau

SEQ ID NO: 2317584 - RNA, 20 nt, Yersinia pestis KIM
uuaauugagaauuauaacua

SEQ ID NO: 2317585 - RNA, 17 nt, Yersinia pestis KIM
uuaauuuuucauaauaa

SEQ ID NO: 2317586 - RNA, 16 nt, Yersinia pestis KIM
uuacaauaaucuggau

SEQ ID NO: 2317587 - RNA, 19 nt, Yersinia pestis KIM
uguggguucaucgaggaau

SEQ ID NO: 2317588 - RNA, 14 nt, Yersinia pestis KIM
uguggcuaaaccca

SEQ ID NO: 2317589 - RNA, 14 nt, Yersinia pestis KIM
ugugcguuggcagc

SEQ ID NO: 2317590 - RNA, 14 nt, Yersinia pestis KIM
uguggcagucacug

SEQ ID NO: 2317591 - RNA, 18 nt, Yersinia pestis KIM
uguggcagucacugcugc

SEQ ID NO: 2317592 - RNA, 17 nt, Yersinia pestis KIM
uguuaaauucgcuuuuc

SEQ ID NO: 2317593 - RNA, 22 nt, Yersinia pestis KIM
uguuaaacccccuguaaccgca

SEQ ID NO: 2317594 - RNA, 16 nt, Yersinia pestis KIM
uguguuuguuuggaua

SEQ ID NO: 2317595 - RNA, 24 nt, Yersinia pestis KIM
ugugucagaccaaauagcaagcca

SEQ ID NO: 2317596 - RNA, 13 nt, Yersinia pestis KIM
ugugcggcaguga

SEQ ID NO: 2317597 - RNA, 21 nt, Yersinia pestis KIM
ugugccucgucgaggaucacc

SEQ ID NO: 2317598 - RNA, 12 nt, Yersinia pestis KIM
ugugcagcauca

SEQ ID NO: 2317599 - RNA, 15 nt, Yersinia pestis KIM
ugugcaccacacagc

SEQ ID NO: 2317600 - RNA, 22 nt, Yersinia pestis KIM
ugucaccacggcuuucaauaaa

SEQ ID NO: 2317601 - RNA, 17 nt, Yersinia pestis KIM
ugucacugccaucucau

SEQ ID NO: 2317602 - RNA, 12 nt, Yersinia pestis KIM
ugucagauuagu

SEQ ID NO: 2317603 - RNA, 20 nt, Yersinia pestis KIM
ugucagcagucugaagggua

SEQ ID NO: 2317604 - RNA, 13 nt, Yersinia pestis KIM
ugucagccagcga

SEQ ID NO: 2317605 - RNA, 14 nt, Yersinia pestis KIM
ugugagagugaaug

SEQ ID NO: 2317606 - RNA, 16 nt, Yersinia pestis KIM
uguuggguugugguau

SEQ ID NO: 2317607 - RNA, 17 nt, Yersinia pestis KIM
uguuggugaucuggcuu

SEQ ID NO: 2317608 - RNA, 13 nt, Yersinia pestis KIM
uguuggcccgcau

SEQ ID NO: 2317609 - RNA, 19 nt, Yersinia pestis KIM
uguuguagcgccagguaag

SEQ ID NO: 2317610 - RNA, 13 nt, Yersinia pestis KIM
uguuguauaaccc

SEQ ID NO: 2317611 - RNA, 14 nt, Yersinia pestis KIM
uguuguagcgccag

SEQ ID NO: 2317612 - RNA, 17 nt, Yersinia pestis KIM
uguugguagcguuuuuu

SEQ ID NO: 2317613 - RNA, 22 nt, Yersinia pestis KIM
uguuguuggcuaaugcgagugc

SEQ ID NO: 2317614 - RNA, 15 nt, Yersinia pestis KIM
uguuggcaauuucac

SEQ ID NO: 2317615 - RNA, 16 nt, Yersinia pestis KIM
uguuggcaaauaaucc

SEQ ID NO: 2317616 - RNA, 16 nt, Yersinia pestis KIM
uguugccauggccgcc

SEQ ID NO: 2317617 - RNA, 21 nt, Yersinia pestis KIM
uguugccaaugggccaagguc

SEQ ID NO: 2317618 - RNA, 22 nt, Yersinia pestis KIM
uguugccaaugggccaagguca

SEQ ID NO: 2317619 - RNA, 18 nt, Yersinia pestis KIM
uguugcaaacggauaaug

SEQ ID NO: 2317620 - RNA, 23 nt, Yersinia pestis KIM
uguucucacgaauaaacacgucu

SEQ ID NO: 2317621 - RNA, 15 nt, Yersinia pestis KIM
uguucuaucucaucu

SEQ ID NO: 2317622 - RNA, 18 nt, Yersinia pestis KIM
uguucuacagggaaaaac

SEQ ID NO: 2317623 - RNA, 22 nt, Yersinia pestis KIM
uguucucuggguaagaacagag

SEQ ID NO: 2317624 - RNA, 16 nt, Yersinia pestis KIM
uguuauggauuuuuaa

SEQ ID NO: 2317625 - RNA, 18 nt, Yersinia pestis KIM
uguuaugaggggaggcug

SEQ ID NO: 2317626 - RNA, 16 nt, Yersinia pestis KIM
uguuauuauuaaauuu

SEQ ID NO: 2317627 - RNA, 14 nt, Yersinia pestis KIM
uguuaucugcuauu

SEQ ID NO: 2317628 - RNA, 16 nt, Yersinia pestis KIM
uguuaacucagccaca

SEQ ID NO: 2317629 - RNA, 17 nt, Yersinia pestis KIM
uguucagcauuguuggc

SEQ ID NO: 2317630 - RNA, 17 nt, Yersinia pestis KIM
uguucagcauaaauauu

SEQ ID NO: 2317631 - RNA, 20 nt, Yersinia pestis KIM
uguucacccacuugccauaa

SEQ ID NO: 2317632 - RNA, 17 nt, Yersinia pestis KIM
uguucacgaucucuauc

SEQ ID NO: 2317633 - RNA, 13 nt, Yersinia pestis KIM
uguucacggcuuu

SEQ ID NO: 2317634 - RNA, 13 nt, Yersinia pestis KIM
uguucgugaaagc

SEQ ID NO: 2317635 - RNA, 22 nt, Yersinia pestis KIM
uguuccagugcguuuuauucaa

SEQ ID NO: 2317636 - RNA, 14 nt, Yersinia pestis KIM
uuaaaaaucaaaag

SEQ ID NO: 2317637 - RNA, 13 nt, Yersinia pestis KIM
uuaaaaaucugca

SEQ ID NO: 2317638 - RNA, 15 nt, Yersinia pestis KIM
uuaaaacagauaaaa

SEQ ID NO: 2317639 - RNA, 13 nt, Yersinia pestis KIM
uuaaaacaggcga

SEQ ID NO: 2317640 - RNA, 22 nt, Yersinia pestis KIM
uuaaaacaggcgaguuucccuu

SEQ ID NO: 2317641 - RNA, 19 nt, Yersinia pestis KIM
uuaaaaacugugccugaau

SEQ ID NO: 2317642 - RNA, 17 nt, Yersinia pestis KIM
uuaaaaagccugaauuc

SEQ ID NO: 2317643 - RNA, 23 nt, Yersinia pestis KIM
uuaaaaauacaaccaacaaacaa

SEQ ID NO: 2317644 - RNA, 23 nt, Yersinia pestis KIM
uuaaaaagaaaaagacauaaaga

SEQ ID NO: 2317645 - RNA, 17 nt, Yersinia pestis KIM
uuaaaaaaauuaaaaua

SEQ ID NO: 2317646 - RNA, 17 nt, Yersinia pestis KIM
uuaaaaaaauuaucauc

SEQ ID NO: 2317647 - RNA, 12 nt, Yersinia pestis KIM
uguuuuuuugau

SEQ ID NO: 2317648 - RNA, 13 nt, Yersinia pestis KIM
uguuuuuuugaua

SEQ ID NO: 2317649 - RNA, 18 nt, Yersinia pestis KIM
uuaaacuuguaucaaaac

SEQ ID NO: 2317650 - RNA, 19 nt, Yersinia pestis KIM
uuaaacuugcucuuucacg

SEQ ID NO: 2317651 - RNA, 19 nt, Yersinia pestis KIM
uuaaagauuucaucauuca

SEQ ID NO: 2317652 - RNA, 17 nt, Yersinia pestis KIM
uuaaagauuaagacuuu

SEQ ID NO: 2317653 - RNA, 19 nt, Yersinia pestis KIM
uuaaaguaucgcuaucacc

SEQ ID NO: 2317654 - RNA, 14 nt, Yersinia pestis KIM
uuaaauaaaacacc

SEQ ID NO: 2317655 - RNA, 12 nt, Yersinia pestis KIM
uuaaauaaaaaa

SEQ ID NO: 2317656 - RNA, 21 nt, Yersinia pestis KIM
uuaaaaucguauaacauaaua

SEQ ID NO: 2317657 - RNA, 18 nt, Yersinia pestis KIM
uuaaaaucuguaauuaau

SEQ ID NO: 2317658 - RNA, 22 nt, Yersinia pestis KIM
uuaaaauacugccaaucgcucu

SEQ ID NO: 2317659 - RNA, 13 nt, Yersinia pestis KIM
uuaaaacugguca

SEQ ID NO: 2317660 - RNA, 14 nt, Yersinia pestis KIM
uguuuauaaauuaa

SEQ ID NO: 2317661 - RNA, 14 nt, Yersinia pestis KIM
uguuuaguaauuuc

SEQ ID NO: 2317662 - RNA, 22 nt, Yersinia pestis KIM
uguuuaacuuucgucaauuuuu

SEQ ID NO: 2317663 - RNA, 19 nt, Yersinia pestis KIM
uguuuaaaaaggcguuauc

SEQ ID NO: 2317664 - RNA, 18 nt, Yersinia pestis KIM
uguuuaaucauaggccac

SEQ ID NO: 2317665 - RNA, 18 nt, Yersinia pestis KIM
uguuucgacgguuuuuug

SEQ ID NO: 2317666 - RNA, 18 nt, Yersinia pestis KIM
uguuuccccuaauucucc

SEQ ID NO: 2317667 - RNA, 19 nt, Yersinia pestis KIM
uguuucauuucgcuccacc

SEQ ID NO: 2317668 - RNA, 17 nt, Yersinia pestis KIM
uguuucaauacuauucc

SEQ ID NO: 2317669 - RNA, 17 nt, Yersinia pestis KIM
uguuuauucucccgaua

SEQ ID NO: 2317670 - RNA, 16 nt, Yersinia pestis KIM
uguuuggauaaaaaca

SEQ ID NO: 2317671 - RNA, 21 nt, Yersinia pestis KIM
uguuugcccgguacaggcaaa

SEQ ID NO: 2317672 - RNA, 13 nt, Yersinia pestis KIM
uguuugcccuaga

SEQ ID NO: 2317673 - RNA, 15 nt, Yersinia pestis KIM
uguuucuauccgaaa

SEQ ID NO: 2317674 - RNA, 18 nt, Yersinia pestis KIM
uguuucuauccgaaaaau

SEQ ID NO: 2317675 - RNA, 14 nt, Yersinia pestis KIM
uguuuguuuggaua

SEQ ID NO: 2317676 - RNA, 22 nt, Yersinia pestis KIM
uguuugguacggaaaauagggg

SEQ ID NO: 2317677 - RNA, 13 nt, Yersinia pestis KIM
uguuuguaaauuu

SEQ ID NO: 2317678 - RNA, 17 nt, Yersinia pestis KIM
uguuuguaaauuuuaaa

SEQ ID NO: 2317679 - RNA, 20 nt, Yersinia pestis KIM
uguuuucuaaccucacaacc

SEQ ID NO: 2317680 - RNA, 21 nt, Yersinia pestis KIM
uguuuucuuguauauaaaaaa

SEQ ID NO: 2317681 - RNA, 13 nt, Yersinia pestis KIM
uguuuuccaacuc

SEQ ID NO: 2317682 - RNA, 14 nt, Yersinia pestis KIM
uguuuuauuauaua

SEQ ID NO: 2317683 - RNA, 14 nt, Yersinia pestis KIM
uggcauaaucaacg

SEQ ID NO: 2317684 - RNA, 14 nt, Yersinia pestis KIM
uggcauauucacca

SEQ ID NO: 2317685 - RNA, 15 nt, Yersinia pestis KIM
uggcauauucaccag

SEQ ID NO: 2317686 - RNA, 18 nt, Yersinia pestis KIM
uggcauauucaccagaca

SEQ ID NO: 2317687 - RNA, 15 nt, Yersinia pestis KIM
uggcaggccccauca

SEQ ID NO: 2317688 - RNA, 16 nt, Yersinia pestis KIM
uggcagcggcaaauag

SEQ ID NO: 2317689 - RNA, 18 nt, Yersinia pestis KIM
uggcagcggcaaauagag

SEQ ID NO: 2317690 - RNA, 23 nt, Yersinia pestis KIM
uggcagcggcaaauagagcacca

SEQ ID NO: 2317691 - RNA, 20 nt, Yersinia pestis KIM
uggcagccuuuauccagcca

SEQ ID NO: 2317692 - RNA, 22 nt, Yersinia pestis KIM
uggcacugcauuugauacuaaa

SEQ ID NO: 2317693 - RNA, 23 nt, Yersinia pestis KIM
uggcacuggaaacaaaaccuaac

SEQ ID NO: 2317694 - RNA, 15 nt, Yersinia pestis KIM
uggcacgggcgcagg

SEQ ID NO: 2317695 - RNA, 16 nt, Yersinia pestis KIM
uggcacugauuuuuuc

SEQ ID NO: 2317696 - RNA, 16 nt, Yersinia pestis KIM
uggcagauuggcuugc

SEQ ID NO: 2317697 - RNA, 12 nt, Yersinia pestis KIM
uggcacccagug

SEQ ID NO: 2317698 - RNA, 14 nt, Yersinia pestis KIM
uggcaauuucucug

SEQ ID NO: 2317699 - RNA, 18 nt, Yersinia pestis KIM
uggcaauuucuguuacca

SEQ ID NO: 2317700 - RNA, 15 nt, Yersinia pestis KIM
uggcaaacucagcca

SEQ ID NO: 2317701 - RNA, 21 nt, Yersinia pestis KIM
uggcaaacgcugcacaucauu

SEQ ID NO: 2317702 - RNA, 22 nt, Yersinia pestis KIM
uggcaaaacucaggugaguaaa

SEQ ID NO: 2317703 - RNA, 17 nt, Yersinia pestis KIM
uggauuaaguccaagaa

SEQ ID NO: 2317704 - RNA, 22 nt, Yersinia pestis KIM
uggauuaucggcggcuugcuug

SEQ ID NO: 2317705 - RNA, 17 nt, Yersinia pestis KIM
uggauugaaaucagauc

SEQ ID NO: 2317706 - RNA, 15 nt, Yersinia pestis KIM
uggauugagccaccg

SEQ ID NO: 2317707 - RNA, 18 nt, Yersinia pestis KIM
uggauuuacguuuuuuua

SEQ ID NO: 2317708 - RNA, 23 nt, Yersinia pestis KIM
uggcaaucacaacccccccgacc

SEQ ID NO: 2317709 - RNA, 14 nt, Yersinia pestis KIM
uggcaauaaaggca

SEQ ID NO: 2317710 - RNA, 18 nt, Yersinia pestis KIM
uggcaaccccuaauccag

SEQ ID NO: 2317711 - RNA, 20 nt, Yersinia pestis KIM
uggcaaccgguaacauauaa

SEQ ID NO: 2317712 - RNA, 14 nt, Yersinia pestis KIM
uggcaacgacuggg

SEQ ID NO: 2317713 - RNA, 23 nt, Yersinia pestis KIM
uggcaacaaaaucgcgaccagca

SEQ ID NO: 2317714 - RNA, 23 nt, Yersinia pestis KIM
uggcaaauuuagccgcaacuacu

SEQ ID NO: 2317715 - RNA, 22 nt, Yersinia pestis KIM
uggcaaauaagggauaugaaua

SEQ ID NO: 2317716 - RNA, 18 nt, Yersinia pestis KIM
uggaucaugaaaaaugag

SEQ ID NO: 2317717 - RNA, 21 nt, Yersinia pestis KIM
uggaucugcacaccacacugg

SEQ ID NO: 2317718 - RNA, 14 nt, Yersinia pestis KIM
uggauaaaaacauu

SEQ ID NO: 2317719 - RNA, 22 nt, Yersinia pestis KIM
uggaguuaaaucccugugcuga

SEQ ID NO: 2317720 - RNA, 15 nt, Yersinia pestis KIM
uggauaauuuaauua

SEQ ID NO: 2317721 - RNA, 19 nt, Yersinia pestis KIM
uggauaauguccuauuuaa

SEQ ID NO: 2317722 - RNA, 17 nt, Yersinia pestis KIM
uggauaacugaccugcg

SEQ ID NO: 2317723 - RNA, 16 nt, Yersinia pestis KIM
uggauagcuucaggaa

SEQ ID NO: 2317724 - RNA, 14 nt, Yersinia pestis KIM
uggauauauuuaca

SEQ ID NO: 2317725 - RNA, 20 nt, Yersinia pestis KIM
uggauauagagauaaaaagg

SEQ ID NO: 2317726 - RNA, 19 nt, Yersinia pestis KIM
uggauauuaucugguuggc

SEQ ID NO: 2317727 - RNA, 19 nt, Yersinia pestis KIM
uggacuacacagacuggug

SEQ ID NO: 2317728 - RNA, 15 nt, Yersinia pestis KIM
uggacguuugcugcu

SEQ ID NO: 2317729 - RNA, 18 nt, Yersinia pestis KIM
uggacggaacacguuuaa

SEQ ID NO: 2317730 - RNA, 17 nt, Yersinia pestis KIM
uggagaacucauuuuuu

SEQ ID NO: 2317731 - RNA, 17 nt, Yersinia pestis KIM
uggagagugugcugcga

SEQ ID NO: 2317732 - RNA, 12 nt, Yersinia pestis KIM
uggagaggcgcu

SEQ ID NO: 2317733 - RNA, 14 nt, Yersinia pestis KIM
uggagaauaguggg

SEQ ID NO: 2317734 - RNA, 18 nt, Yersinia pestis KIM
uggagccgcuagcgcagg

SEQ ID NO: 2317735 - RNA, 22 nt, Yersinia pestis KIM
uggagccuguacauaaauuugu

SEQ ID NO: 2317736 - RNA, 11 nt, Yersinia pestis KIM
uggagccugua

SEQ ID NO: 2317737 - RNA, 16 nt, Yersinia pestis KIM
uggagcuauggaagaa

SEQ ID NO: 2317738 - RNA, 18 nt, Yersinia pestis KIM
uggccgaaauggaaaggc

SEQ ID NO: 2317739 - RNA, 19 nt, Yersinia pestis KIM
uggcccugagguuauugac

SEQ ID NO: 2317740 - RNA, 19 nt, Yersinia pestis KIM
uggcccugauuguuuuuau

SEQ ID NO: 2317741 - RNA, 13 nt, Yersinia pestis KIM
uggcccucugccg

SEQ ID NO: 2317742 - RNA, 16 nt, Yersinia pestis KIM
uggcccuggaacacca

SEQ ID NO: 2317743 - RNA, 20 nt, Yersinia pestis KIM
uggccccaauuguuucuucc

SEQ ID NO: 2317744 - RNA, 17 nt, Yersinia pestis KIM
uggcccaagccauccuu

SEQ ID NO: 2317745 - RNA, 15 nt, Yersinia pestis KIM
uggcccaagccaucc

SEQ ID NO: 2317746 - RNA, 13 nt, Yersinia pestis KIM
uggcccaagccau

SEQ ID NO: 2317747 - RNA, 20 nt, Yersinia pestis KIM
uggcccaaaugagcagcaau

SEQ ID NO: 2317748 - RNA, 12 nt, Yersinia pestis KIM
uggcccaagcca

SEQ ID NO: 2317749 - RNA, 18 nt, Yersinia pestis KIM
uggccauuaaccuaaaaa

SEQ ID NO: 2317750 - RNA, 16 nt, Yersinia pestis KIM
uggcccggaagguuuc

SEQ ID NO: 2317751 - RNA, 13 nt, Yersinia pestis KIM
uggcccgcugguc

SEQ ID NO: 2317752 - RNA, 21 nt, Yersinia pestis KIM
uggccccaucaucucugcccc

SEQ ID NO: 2317753 - RNA, 14 nt, Yersinia pestis KIM
uggccaugaaucaa

SEQ ID NO: 2317754 - RNA, 18 nt, Yersinia pestis KIM
uggccaguugccacucau

SEQ ID NO: 2317755 - RNA, 17 nt, Yersinia pestis KIM
uggccaguaaaaccuga

SEQ ID NO: 2317756 - RNA, 19 nt, Yersinia pestis KIM
uggccagcgggaaucaaac

SEQ ID NO: 2317757 - RNA, 20 nt, Yersinia pestis KIM
uggccacugcgggcaguaac

SEQ ID NO: 2317758 - RNA, 21 nt, Yersinia pestis KIM
uggccagacacugacaucauc

SEQ ID NO: 2317759 - RNA, 12 nt, Yersinia pestis KIM
uggcaugacuga

SEQ ID NO: 2317760 - RNA, 15 nt, Yersinia pestis KIM
uggcaugccaugcac

SEQ ID NO: 2317761 - RNA, 19 nt, Yersinia pestis KIM
uggcauuagacauucaagc

SEQ ID NO: 2317762 - RNA, 13 nt, Yersinia pestis KIM
uggcaugugggca

SEQ ID NO: 2317763 - RNA, 22 nt, Yersinia pestis KIM
uggcaucaccgcuaucacugau

SEQ ID NO: 2317764 - RNA, 15 nt, Yersinia pestis KIM
uggcauuuucaguau

SEQ ID NO: 2317765 - RNA, 12 nt, Yersinia pestis KIM
uggcauuuucag

SEQ ID NO: 2317766 - RNA, 18 nt, Yersinia pestis KIM
uggcauuuaaaaggcgcu

SEQ ID NO: 2317767 - RNA, 20 nt, Yersinia pestis KIM
uggcauuuuuuacgguucca

SEQ ID NO: 2317768 - RNA, 22 nt, Yersinia pestis KIM
uggccaacaggcggguucuuca

SEQ ID NO: 2317769 - RNA, 23 nt, Yersinia pestis KIM
uggccaacaggcggguucuucag

SEQ ID NO: 2317770 - RNA, 22 nt, Yersinia pestis KIM
uggcgauuuaauguauucaagc

SEQ ID NO: 2317771 - RNA, 14 nt, Yersinia pestis KIM
uggcgcacauuaca

SEQ ID NO: 2317772 - RNA, 23 nt, Yersinia pestis KIM
uggcgccauuuuuauaucagauu

SEQ ID NO: 2317773 - RNA, 20 nt, Yersinia pestis KIM
uggcgacgugaugccaguaa

SEQ ID NO: 2317774 - RNA, 15 nt, Yersinia pestis KIM
uggcgacguugccuc

SEQ ID NO: 2317775 - RNA, 22 nt, Yersinia pestis KIM
uggcgagguaccgcugcccggc

SEQ ID NO: 2317776 - RNA, 13 nt, Yersinia pestis KIM
uggcgaucaaaau

SEQ ID NO: 2317777 - RNA, 15 nt, Yersinia pestis KIM
uggcgaucaaaggcg

SEQ ID NO: 2317778 - RNA, 23 nt, Yersinia pestis KIM
uggccgcuuugguugccagauaa

SEQ ID NO: 2317779 - RNA, 13 nt, Yersinia pestis KIM
uggccgcuacugg

SEQ ID NO: 2317780 - RNA, 16 nt, Yersinia pestis KIM
uggccuggcugauacu

SEQ ID NO: 2317781 - RNA, 14 nt, Yersinia pestis KIM
uggcgaaaaucaag

SEQ ID NO: 2317782 - RNA, 21 nt, Yersinia pestis KIM
uguacugcugcaacucauuaa

SEQ ID NO: 2317783 - RNA, 16 nt, Yersinia pestis KIM
uguacuaccaaaacgu

SEQ ID NO: 2317784 - RNA, 19 nt, Yersinia pestis KIM
uguacgugacuugcagugg

SEQ ID NO: 2317785 - RNA, 15 nt, Yersinia pestis KIM
uguacgugaagauaa

SEQ ID NO: 2317786 - RNA, 14 nt, Yersinia pestis KIM
uguaccugugccag

SEQ ID NO: 2317787 - RNA, 21 nt, Yersinia pestis KIM
uguaccuaucguuuguaccug

SEQ ID NO: 2317788 - RNA, 18 nt, Yersinia pestis KIM
uguacccguucaaugugg

SEQ ID NO: 2317789 - RNA, 22 nt, Yersinia pestis KIM
uguaccccggauagcugauugc

SEQ ID NO: 2317790 - RNA, 14 nt, Yersinia pestis KIM
uguaauuuguucug

SEQ ID NO: 2317791 - RNA, 23 nt, Yersinia pestis KIM
uguaccaaauaaaccagaugugu

SEQ ID NO: 2317792 - RNA, 17 nt, Yersinia pestis KIM
uguacauuucguagccu

SEQ ID NO: 2317793 - RNA, 20 nt, Yersinia pestis KIM
uguaccacugauacccaguu

SEQ ID NO: 2317794 - RNA, 13 nt, Yersinia pestis KIM
uguacaacaagau

SEQ ID NO: 2317795 - RNA, 22 nt, Yersinia pestis KIM
uguaacgaugaauuaucaaccg

SEQ ID NO: 2317796 - RNA, 14 nt, Yersinia pestis KIM
uguaauaaaggcug

SEQ ID NO: 2317797 - RNA, 15 nt, Yersinia pestis KIM
uguaaauauaaaaua

SEQ ID NO: 2317798 - RNA, 23 nt, Yersinia pestis KIM
uguaaauaguuacuauauaaaug

SEQ ID NO: 2317799 - RNA, 13 nt, Yersinia pestis KIM
uguaaauauccug

SEQ ID NO: 2317800 - RNA, 19 nt, Yersinia pestis KIM
uguaaagccaguaaacgca

SEQ ID NO: 2317801 - RNA, 14 nt, Yersinia pestis KIM
uguaaaggcaaaga

SEQ ID NO: 2317802 - RNA, 22 nt, Yersinia pestis KIM
uguaaaggcaaagaagaauaag

SEQ ID NO: 2317803 - RNA, 20 nt, Yersinia pestis KIM
uguaaaacgaguaaauacaa

SEQ ID NO: 2317804 - RNA, 11 nt, Yersinia pestis KIM
uguaaaacaag

SEQ ID NO: 2317805 - RNA, 14 nt, Yersinia pestis KIM
uguaaaaaucaccu

SEQ ID NO: 2317806 - RNA, 16 nt, Yersinia pestis KIM
ugguuaguucuucuga

SEQ ID NO: 2317807 - RNA, 15 nt, Yersinia pestis KIM
uguaaacuccuugga

SEQ ID NO: 2317808 - RNA, 11 nt, Yersinia pestis KIM
uguauaaaaau

SEQ ID NO: 2317809 - RNA, 22 nt, Yersinia pestis KIM
uguaguucagucgcgauaaaau

SEQ ID NO: 2317810 - RNA, 18 nt, Yersinia pestis KIM
uguaguucaucauuauua

SEQ ID NO: 2317811 - RNA, 14 nt, Yersinia pestis KIM
uguaguuagaugac

SEQ ID NO: 2317812 - RNA, 18 nt, Yersinia pestis KIM
uguaguuauugauuaauu

SEQ ID NO: 2317813 - RNA, 14 nt, Yersinia pestis KIM
uguaguguuuggua

SEQ ID NO: 2317814 - RNA, 20 nt, Yersinia pestis KIM
uguaguguuugguaaauuuu

SEQ ID NO: 2317815 - RNA, 17 nt, Yersinia pestis KIM
uguaguaacucaaguau

SEQ ID NO: 2317816 - RNA, 22 nt, Yersinia pestis KIM
uguagugacguaaaaaggcagu

SEQ ID NO: 2317817 - RNA, 15 nt, Yersinia pestis KIM
uguagagaaauucau

SEQ ID NO: 2317818 - RNA, 17 nt, Yersinia pestis KIM
uguagacgucauaaaaa

SEQ ID NO: 2317819 - RNA, 14 nt, Yersinia pestis KIM
uguagaccucuuua

SEQ ID NO: 2317820 - RNA, 14 nt, Yersinia pestis KIM
uguagcuuuuuaaa

SEQ ID NO: 2317821 - RNA, 19 nt, Yersinia pestis KIM
uguagcucuuuaucacugg

SEQ ID NO: 2317822 - RNA, 12 nt, Yersinia pestis KIM
uguagccagguc

SEQ ID NO: 2317823 - RNA, 17 nt, Yersinia pestis KIM
uguagcccacugacacu

SEQ ID NO: 2317824 - RNA, 15 nt, Yersinia pestis KIM
uguagcgccagguaa

SEQ ID NO: 2317825 - RNA, 14 nt, Yersinia pestis KIM
uguagcgccaggua

SEQ ID NO: 2317826 - RNA, 17 nt, Yersinia pestis KIM
uguagcgauaagugcag

SEQ ID NO: 2317827 - RNA, 19 nt, Yersinia pestis KIM
uguauaucacuauuucaga

SEQ ID NO: 2317828 - RNA, 13 nt, Yersinia pestis KIM
uguauauaaaaaa

SEQ ID NO: 2317829 - RNA, 15 nt, Yersinia pestis KIM
uguauaugaagauaa

SEQ ID NO: 2317830 - RNA, 20 nt, Yersinia pestis KIM
uguauaugaagauaacgagu

SEQ ID NO: 2317831 - RNA, 21 nt, Yersinia pestis KIM
uguauagucuccaaauucauu

SEQ ID NO: 2317832 - RNA, 21 nt, Yersinia pestis KIM
uguauaaccccccugcugaua

SEQ ID NO: 2317833 - RNA, 13 nt, Yersinia pestis KIM
uguauccaaggca

SEQ ID NO: 2317834 - RNA, 20 nt, Yersinia pestis KIM
uguauccguagacauuaucc

SEQ ID NO: 2317835 - RNA, 13 nt, Yersinia pestis KIM
uguaucaauaccu

SEQ ID NO: 2317836 - RNA, 18 nt, Yersinia pestis KIM
uguauucgcaucuuccaa

SEQ ID NO: 2317837 - RNA, 22 nt, Yersinia pestis KIM
uguauguggcuguauucacgua

SEQ ID NO: 2317838 - RNA, 18 nt, Yersinia pestis KIM
uguaugguauagacuguu

SEQ ID NO: 2317839 - RNA, 14 nt, Yersinia pestis KIM
ugucacaaugcugu

SEQ ID NO: 2317840 - RNA, 21 nt, Yersinia pestis KIM
uguauuugguuauaucccaau

SEQ ID NO: 2317841 - RNA, 18 nt, Yersinia pestis KIM
uguauuuucaaucgcuuu

SEQ ID NO: 2317842 - RNA, 19 nt, Yersinia pestis KIM
uguauuuuguuuuuuugau

SEQ ID NO: 2317843 - RNA, 20 nt, Yersinia pestis KIM
uguauuuuguuuuuuugaua

SEQ ID NO: 2317844 - RNA, 19 nt, Yersinia pestis KIM
uguauucgcaucuuccaaa

SEQ ID NO: 2317845 - RNA, 15 nt, Yersinia pestis KIM
uguauuucucaaacu

SEQ ID NO: 2317846 - RNA, 18 nt, Yersinia pestis KIM
uguauuugguuauauccc

SEQ ID NO: 2317847 - RNA, 16 nt, Yersinia pestis KIM
ugggcaagcucugggc

SEQ ID NO: 2317848 - RNA, 17 nt, Yersinia pestis KIM
ugggcaaagaauugagg

SEQ ID NO: 2317849 - RNA, 19 nt, Yersinia pestis KIM
ugggauuaauaaugguggg

SEQ ID NO: 2317850 - RNA, 18 nt, Yersinia pestis KIM
ugggauguucagcucaag

SEQ ID NO: 2317851 - RNA, 20 nt, Yersinia pestis KIM
ugggcagaagaguaaagcgu

SEQ ID NO: 2317852 - RNA, 13 nt, Yersinia pestis KIM
ugggcagggcagc

SEQ ID NO: 2317853 - RNA, 18 nt, Yersinia pestis KIM
uggcggcagcacagagca

SEQ ID NO: 2317854 - RNA, 21 nt, Yersinia pestis KIM
uggcggcacgcguugguuguc

SEQ ID NO: 2317855 - RNA, 13 nt, Yersinia pestis KIM
uggcuuucgcuuu

SEQ ID NO: 2317856 - RNA, 17 nt, Yersinia pestis KIM
uggcuuucgaucaucac

SEQ ID NO: 2317857 - RNA, 16 nt, Yersinia pestis KIM
uggcuuucucaacagc

SEQ ID NO: 2317858 - RNA, 12 nt, Yersinia pestis KIM
ugggauaaaaua

SEQ ID NO: 2317859 - RNA, 13 nt, Yersinia pestis KIM
ugggauccauagg

SEQ ID NO: 2317860 - RNA, 14 nt, Yersinia pestis KIM
uggcuuuuuuaaua

SEQ ID NO: 2317861 - RNA, 19 nt, Yersinia pestis KIM
uggcuuuuuuaauaaaaaa

SEQ ID NO: 2317862 - RNA, 20 nt, Yersinia pestis KIM
uggcuuuugccucacugucu

SEQ ID NO: 2317863 - RNA, 23 nt, Yersinia pestis KIM
uggcuuuuuuguuuuuauaucaa

SEQ ID NO: 2317864 - RNA, 19 nt, Yersinia pestis KIM
uggcuuuuuuguuuuuaua

SEQ ID NO: 2317865 - RNA, 14 nt, Yersinia pestis KIM
ugggccugaguggg

SEQ ID NO: 2317866 - RNA, 22 nt, Yersinia pestis KIM
ugggcgacaaucaauggccagc

SEQ ID NO: 2317867 - RNA, 11 nt, Yersinia pestis KIM
uggggccaccu

SEQ ID NO: 2317868 - RNA, 21 nt, Yersinia pestis KIM
uggggccaccuaauccaaggc

SEQ ID NO: 2317869 - RNA, 16 nt, Yersinia pestis KIM
uggggcauuuaauuca

SEQ ID NO: 2317870 - RNA, 20 nt, Yersinia pestis KIM
ugggcuucacauccaauggc

SEQ ID NO: 2317871 - RNA, 23 nt, Yersinia pestis KIM
ugggucauuaauuaagcuauugg

SEQ ID NO: 2317872 - RNA, 20 nt, Yersinia pestis KIM
uggggcugccaguaaaauca

SEQ ID NO: 2317873 - RNA, 19 nt, Yersinia pestis KIM
uggguaauccccaccaaca

SEQ ID NO: 2317874 - RNA, 22 nt, Yersinia pestis KIM
uggguauggucagcaauaacca

SEQ ID NO: 2317875 - RNA, 17 nt, Yersinia pestis KIM
uggguaugggugacucu

SEQ ID NO: 2317876 - RNA, 16 nt, Yersinia pestis KIM
uggguaucuggagcca

SEQ ID NO: 2317877 - RNA, 22 nt, Yersinia pestis KIM
ugguauagacuguuuuauuaua

SEQ ID NO: 2317878 - RNA, 20 nt, Yersinia pestis KIM
ugguauagacuguuuuauua

SEQ ID NO: 2317879 - RNA, 14 nt, Yersinia pestis KIM
ugguauaaauggca

SEQ ID NO: 2317880 - RNA, 14 nt, Yersinia pestis KIM
uggucagcaauaac

SEQ ID NO: 2317881 - RNA, 22 nt, Yersinia pestis KIM
uggucacuguaguaaagcagca

SEQ ID NO: 2317882 - RNA, 17 nt, Yersinia pestis KIM
uggguuacauccugaau

SEQ ID NO: 2317883 - RNA, 21 nt, Yersinia pestis KIM
uggguuaaauagugggcuaaa

SEQ ID NO: 2317884 - RNA, 22 nt, Yersinia pestis KIM
uggguuaucccuaccaaauguu

SEQ ID NO: 2317885 - RNA, 13 nt, Yersinia pestis KIM
uggguucuucaaa

SEQ ID NO: 2317886 - RNA, 13 nt, Yersinia pestis KIM
ugggugcugcucc

SEQ ID NO: 2317887 - RNA, 17 nt, Yersinia pestis KIM
ugggugcugcucccgua

SEQ ID NO: 2317888 - RNA, 12 nt, Yersinia pestis KIM
uggguggccagu

SEQ ID NO: 2317889 - RNA, 18 nt, Yersinia pestis KIM
ugggugucaggaagcaag

SEQ ID NO: 2317890 - RNA, 18 nt, Yersinia pestis KIM
ugguaccugcaucaucac

SEQ ID NO: 2317891 - RNA, 19 nt, Yersinia pestis KIM
ugguaccaaucuccaauga

SEQ ID NO: 2317892 - RNA, 20 nt, Yersinia pestis KIM
ugguaccaaauaacaacaca

SEQ ID NO: 2317893 - RNA, 14 nt, Yersinia pestis KIM
uggguuugcgggca

SEQ ID NO: 2317894 - RNA, 14 nt, Yersinia pestis KIM
ugguggauaagcuc

SEQ ID NO: 2317895 - RNA, 12 nt, Yersinia pestis KIM
uggugucuuuac

SEQ ID NO: 2317896 - RNA, 20 nt, Yersinia pestis KIM
uggugucacaaucucuggca

SEQ ID NO: 2317897 - RNA, 17 nt, Yersinia pestis KIM
uggucguauccuuacuu

SEQ ID NO: 2317898 - RNA, 17 nt, Yersinia pestis KIM
uggugaauacagguacu

SEQ ID NO: 2317899 - RNA, 20 nt, Yersinia pestis KIM
ucugguaguuuugcauaauu

SEQ ID NO: 2317900 - RNA, 15 nt, Yersinia pestis KIM
ucugguagcugcuca

SEQ ID NO: 2317901 - RNA, 23 nt, Yersinia pestis KIM
ucuggucacuaaaacugaagcau

SEQ ID NO: 2317902 - RNA, 15 nt, Yersinia pestis KIM
ucuggucuugcaccu

SEQ ID NO: 2317903 - RNA, 21 nt, Yersinia pestis KIM
ucuggucaucauguagccauu

SEQ ID NO: 2317904 - RNA, 18 nt, Yersinia pestis KIM
ucuguacguaaauagguu

SEQ ID NO: 2317905 - RNA, 18 nt, Yersinia pestis KIM
ucuguuucaaauaaguau

SEQ ID NO: 2317906 - RNA, 23 nt, Yersinia pestis KIM
ucuguuucaaauaaguauuucaa

SEQ ID NO: 2317907 - RNA, 12 nt, Yersinia pestis KIM
ucuguuuuacuc

SEQ ID NO: 2317908 - RNA, 18 nt, Yersinia pestis KIM
ucuguggcagggcgcuuu

SEQ ID NO: 2317909 - RNA, 14 nt, Yersinia pestis KIM
ucuguucuuuuggc

SEQ ID NO: 2317910 - RNA, 14 nt, Yersinia pestis KIM
ucuguuuuugccac

SEQ ID NO: 2317911 - RNA, 18 nt, Yersinia pestis KIM
ucuguuuuguuuccccua

SEQ ID NO: 2317912 - RNA, 13 nt, Yersinia pestis KIM
ucuguuuuuuauc

SEQ ID NO: 2317913 - RNA, 11 nt, Yersinia pestis KIM
ucuuaaaaaua

SEQ ID NO: 2317914 - RNA, 16 nt, Yersinia pestis KIM
ucuuaacgauauuuac

SEQ ID NO: 2317915 - RNA, 15 nt, Yersinia pestis KIM
ucuggcaauuucugu

SEQ ID NO: 2317916 - RNA, 22 nt, Yersinia pestis KIM
ucuggccagcgucuucaguggc

SEQ ID NO: 2317917 - RNA, 23 nt, Yersinia pestis KIM
ucuggcgacuaagcgaagauaca

SEQ ID NO: 2317918 - RNA, 14 nt, Yersinia pestis KIM
ucugggugcugcuc

SEQ ID NO: 2317919 - RNA, 13 nt, Yersinia pestis KIM
ucuggguaagaac

SEQ ID NO: 2317920 - RNA, 15 nt, Yersinia pestis KIM
ucuggggcaaucaau

SEQ ID NO: 2317921 - RNA, 19 nt, Yersinia pestis KIM
ucugggacgugcauaaaac

SEQ ID NO: 2317922 - RNA, 22 nt, Yersinia pestis KIM
ucuggcgcaagaguuagggcug

SEQ ID NO: 2317923 - RNA, 22 nt, Yersinia pestis KIM
ucuggcaaacgcugcacaucau

SEQ ID NO: 2317924 - RNA, 20 nt, Yersinia pestis KIM
ucugcgagcguuuaaauacc

SEQ ID NO: 2317925 - RNA, 21 nt, Yersinia pestis KIM
ucugcgagcguuuaaauaccc

SEQ ID NO: 2317926 - RNA, 17 nt, Yersinia pestis KIM
ucugcgaggccgcugca

SEQ ID NO: 2317927 - RNA, 19 nt, Yersinia pestis KIM
ucugcgagcguuuaaauac

SEQ ID NO: 2317928 - RNA, 15 nt, Yersinia pestis KIM
ucugcgcccuuaucu

SEQ ID NO: 2317929 - RNA, 18 nt, Yersinia pestis KIM
ucugcuguugccacagac

SEQ ID NO: 2317930 - RNA, 16 nt, Yersinia pestis KIM
ucugcgccuauaccug

SEQ ID NO: 2317931 - RNA, 13 nt, Yersinia pestis KIM
ucugccuuaucaa

SEQ ID NO: 2317932 - RNA, 16 nt, Yersinia pestis KIM
ucugccuguucucucc

SEQ ID NO: 2317933 - RNA, 17 nt, Yersinia pestis KIM
ucugcgaauuagucucu

SEQ ID NO: 2317934 - RNA, 17 nt, Yersinia pestis KIM
ucugccuaucuuaaaaa

SEQ ID NO: 2317935 - RNA, 15 nt, Yersinia pestis KIM
ucugccgauuuaaac

SEQ ID NO: 2317936 - RNA, 21 nt, Yersinia pestis KIM
ucugccgccccuuccaauguc

SEQ ID NO: 2317937 - RNA, 16 nt, Yersinia pestis KIM
ucugcccagccugguu

SEQ ID NO: 2317938 - RNA, 22 nt, Yersinia pestis KIM
ucugcccagccugguuuuuuaa

SEQ ID NO: 2317939 - RNA, 22 nt, Yersinia pestis KIM
ucugcauacagaucgagcauca

SEQ ID NO: 2317940 - RNA, 12 nt, Yersinia pestis KIM
ucugcauaccug

SEQ ID NO: 2317941 - RNA, 15 nt, Yersinia pestis KIM
ucugccaugguuggg

SEQ ID NO: 2317942 - RNA, 18 nt, Yersinia pestis KIM
ucugccaauucaaggcca

SEQ ID NO: 2317943 - RNA, 17 nt, Yersinia pestis KIM
ucugccacacugaauuu

SEQ ID NO: 2317944 - RNA, 15 nt, Yersinia pestis KIM
ucugccaccgcacag

SEQ ID NO: 2317945 - RNA, 16 nt, Yersinia pestis KIM
ucugccagauagucau

SEQ ID NO: 2317946 - RNA, 23 nt, Yersinia pestis KIM
ucugccagauagucaucuuucca

SEQ ID NO: 2317947 - RNA, 12 nt, Yersinia pestis KIM
ucugccaaccaa

SEQ ID NO: 2317948 - RNA, 20 nt, Yersinia pestis KIM
ucugccaacuggccgccauc

SEQ ID NO: 2317949 - RNA, 22 nt, Yersinia pestis KIM
ucugcaucgguaagauaaccca

SEQ ID NO: 2317950 - RNA, 14 nt, Yersinia pestis KIM
ucugaaacggugag

SEQ ID NO: 2317951 - RNA, 12 nt, Yersinia pestis KIM
ucugaacuauug

SEQ ID NO: 2317952 - RNA, 20 nt, Yersinia pestis KIM
ucugauaaccguuuuuucaa

SEQ ID NO: 2317953 - RNA, 13 nt, Yersinia pestis KIM
ucugauaaaacag

SEQ ID NO: 2317954 - RNA, 19 nt, Yersinia pestis KIM
ucugaggcguggcacaccg

SEQ ID NO: 2317955 - RNA, 19 nt, Yersinia pestis KIM
ucugaaugguuuuagucau

SEQ ID NO: 2317956 - RNA, 12 nt, Yersinia pestis KIM
ucugagccaucc

SEQ ID NO: 2317957 - RNA, 19 nt, Yersinia pestis KIM
ucugagccucaugaaugag

SEQ ID NO: 2317958 - RNA, 13 nt, Yersinia pestis KIM
ucugaccaaacau

SEQ ID NO: 2317959 - RNA, 15 nt, Yersinia pestis KIM
ucugaccaaacauug

SEQ ID NO: 2317960 - RNA, 18 nt, Yersinia pestis KIM
ucuucuggaauggggaug

SEQ ID NO: 2317961 - RNA, 18 nt, Yersinia pestis KIM
ucuucugauucaauuucg

SEQ ID NO: 2317962 - RNA, 17 nt, Yersinia pestis KIM
ucuucugauaaaacagu

SEQ ID NO: 2317963 - RNA, 13 nt, Yersinia pestis KIM
ucuucuguugccc

SEQ ID NO: 2317964 - RNA, 19 nt, Yersinia pestis KIM
ucuucuuuauuguuuugua

SEQ ID NO: 2317965 - RNA, 19 nt, Yersinia pestis KIM
ucuugauuaccaauaauua

SEQ ID NO: 2317966 - RNA, 14 nt, Yersinia pestis KIM
ucuugaacggugag

SEQ ID NO: 2317967 - RNA, 16 nt, Yersinia pestis KIM
ucuuuacggaauaacc

SEQ ID NO: 2317968 - RNA, 14 nt, Yersinia pestis KIM
ucuuuagauuucac

SEQ ID NO: 2317969 - RNA, 18 nt, Yersinia pestis KIM
ucuuuagauuucaccuau

SEQ ID NO: 2317970 - RNA, 14 nt, Yersinia pestis KIM
ucuuuaaagaccuc

SEQ ID NO: 2317971 - RNA, 13 nt, Yersinia pestis KIM
ucuuuaaaaucuu

SEQ ID NO: 2317972 - RNA, 14 nt, Yersinia pestis KIM
ucuuuacgaucugc

SEQ ID NO: 2317973 - RNA, 13 nt, Yersinia pestis KIM
ucuuguaaaucuu

SEQ ID NO: 2317974 - RNA, 12 nt, Yersinia pestis KIM
ucuuguaaccac

SEQ ID NO: 2317975 - RNA, 15 nt, Yersinia pestis KIM
ucuuguaguaaccac

SEQ ID NO: 2317976 - RNA, 14 nt, Yersinia pestis KIM
ucuugugaugcaua

SEQ ID NO: 2317977 - RNA, 21 nt, Yersinia pestis KIM
ucuugugaugcauauuauaau

SEQ ID NO: 2317978 - RNA, 20 nt, Yersinia pestis KIM
ucuugccagauggccagauu

SEQ ID NO: 2317979 - RNA, 23 nt, Yersinia pestis KIM
ucuucgcgagucacauuuuuaau

SEQ ID NO: 2317980 - RNA, 13 nt, Yersinia pestis KIM
ucuucgcaaaauu

SEQ ID NO: 2317981 - RNA, 19 nt, Yersinia pestis KIM
ucuucgcaaugauuacauc

SEQ ID NO: 2317982 - RNA, 22 nt, Yersinia pestis KIM
ucuucgcaaugauuacaucacu

SEQ ID NO: 2317983 - RNA, 21 nt, Yersinia pestis KIM
ucuucgauuugcucuuuuuug

SEQ ID NO: 2317984 - RNA, 18 nt, Yersinia pestis KIM
ucuucgauuuuagcuuug

SEQ ID NO: 2317985 - RNA, 15 nt, Yersinia pestis KIM
ucuuccuugcucucu

SEQ ID NO: 2317986 - RNA, 18 nt, Yersinia pestis KIM
ucuuccuugcucucuuca

SEQ ID NO: 2317987 - RNA, 20 nt, Yersinia pestis KIM
ucuucggccuaucaucacca

SEQ ID NO: 2317988 - RNA, 23 nt, Yersinia pestis KIM
ucuucguugccccaucagcacuc

SEQ ID NO: 2317989 - RNA, 21 nt, Yersinia pestis KIM
ucuuccgacaggcuaacaacu

SEQ ID NO: 2317990 - RNA, 20 nt, Yersinia pestis KIM
ucuuccaauagcaguggcca

SEQ ID NO: 2317991 - RNA, 17 nt, Yersinia pestis KIM
ucuuccaacgcuucacc

SEQ ID NO: 2317992 - RNA, 20 nt, Yersinia pestis KIM
ucuuccaagaaugcagauau

SEQ ID NO: 2317993 - RNA, 14 nt, Yersinia pestis KIM
ucuuccaaaggaag

SEQ ID NO: 2317994 - RNA, 14 nt, Yersinia pestis KIM
ucuucauugccuuc

SEQ ID NO: 2317995 - RNA, 21 nt, Yersinia pestis KIM
ucuuccgucgcauggcuaaaa

SEQ ID NO: 2317996 - RNA, 19 nt, Yersinia pestis KIM
ucuuccgcccguucaucac

SEQ ID NO: 2317997 - RNA, 18 nt, Yersinia pestis KIM
ucuuccggcguaccacaa

SEQ ID NO: 2317998 - RNA, 20 nt, Yersinia pestis KIM
ucuuaauaauaucaaauguc

SEQ ID NO: 2317999 - RNA, 22 nt, Yersinia pestis KIM
ucuuaaucuuuaauucaucaga

SEQ ID NO: 2318000 - RNA, 18 nt, Yersinia pestis KIM
ucuuaaucuuuaauucau

SEQ ID NO: 2318001 - RNA, 21 nt, Yersinia pestis KIM
ucuuaauuuaaauaagaucca

SEQ ID NO: 2318002 - RNA, 19 nt, Yersinia pestis KIM
ucuucagguaagccuuucu

SEQ ID NO: 2318003 - RNA, 21 nt, Yersinia pestis KIM
ucuucagccuauccucaccgu

SEQ ID NO: 2318004 - RNA, 17 nt, Yersinia pestis KIM
ucuuacauaaagaccca

SEQ ID NO: 2318005 - RNA, 20 nt, Yersinia pestis KIM
ucuucauaacgcuuuuucau

SEQ ID NO: 2318006 - RNA, 15 nt, Yersinia pestis KIM
ucuucaguggcugga

SEQ ID NO: 2318007 - RNA, 17 nt, Yersinia pestis KIM
ucguaggccgcuuuagu

SEQ ID NO: 2318008 - RNA, 19 nt, Yersinia pestis KIM
ucgucagccccugccagaa

SEQ ID NO: 2318009 - RNA, 15 nt, Yersinia pestis KIM
ucgucagugaugaca

SEQ ID NO: 2318010 - RNA, 21 nt, Yersinia pestis KIM
ucgucagugcgguaaccagca

SEQ ID NO: 2318011 - RNA, 18 nt, Yersinia pestis KIM
ucguacuuuccuuccucu

SEQ ID NO: 2318012 - RNA, 11 nt, Yersinia pestis KIM
ucggcaggcaa

SEQ ID NO: 2318013 - RNA, 20 nt, Yersinia pestis KIM
ucgugcgggauucgaaccug

SEQ ID NO: 2318014 - RNA, 21 nt, Yersinia pestis KIM
ucguggaaaucgggugauaaa

SEQ ID NO: 2318015 - RNA, 22 nt, Yersinia pestis KIM
ucgugccgcacacagcccugcc

SEQ ID NO: 2318016 - RNA, 18 nt, Yersinia pestis KIM
ucguguaacacgaggcgc

SEQ ID NO: 2318017 - RNA, 19 nt, Yersinia pestis KIM
ucguguauaucacuauuuc

SEQ ID NO: 2318018 - RNA, 18 nt, Yersinia pestis KIM
ucguguauaucacuauuu

SEQ ID NO: 2318019 - RNA, 20 nt, Yersinia pestis KIM
ucguggcguucccgcaggcg

SEQ ID NO: 2318020 - RNA, 20 nt, Yersinia pestis KIM
ucguggaguagagcuuccag

SEQ ID NO: 2318021 - RNA, 19 nt, Yersinia pestis KIM
ucgucuucgcccagaucau

SEQ ID NO: 2318022 - RNA, 18 nt, Yersinia pestis KIM
ucgugauugagcguugau

SEQ ID NO: 2318023 - RNA, 16 nt, Yersinia pestis KIM
ucgucucugcauuaca

SEQ ID NO: 2318024 - RNA, 17 nt, Yersinia pestis KIM
ucgucuucgacagcagu

SEQ ID NO: 2318025 - RNA, 11 nt, Yersinia pestis KIM
ucguccaaagg

SEQ ID NO: 2318026 - RNA, 14 nt, Yersinia pestis KIM
ucguccaaagggag

SEQ ID NO: 2318027 - RNA, 20 nt, Yersinia pestis KIM
ucgucgaacauuuucuaagc

SEQ ID NO: 2318028 - RNA, 17 nt, Yersinia pestis KIM
ucgucgaggaucaccac

SEQ ID NO: 2318029 - RNA, 12 nt, Yersinia pestis KIM
ucguguucggua

SEQ ID NO: 2318030 - RNA, 15 nt, Yersinia pestis KIM
ucguuucucuaaaau

SEQ ID NO: 2318031 - RNA, 20 nt, Yersinia pestis KIM
ucuaaauugcuuaaaaaaag

SEQ ID NO: 2318032 - RNA, 15 nt, Yersinia pestis KIM
ucuaaaaucgcacug

SEQ ID NO: 2318033 - RNA, 17 nt, Yersinia pestis KIM
ucuacccuggcggcaaa

SEQ ID NO: 2318034 - RNA, 17 nt, Yersinia pestis KIM
ucuaccugaaugcgccg

SEQ ID NO: 2318035 - RNA, 23 nt, Yersinia pestis KIM
ucuaccgcagaaccuuguuuuac

SEQ ID NO: 2318036 - RNA, 18 nt, Yersinia pestis KIM
ucuaaugacuacuaauca

SEQ ID NO: 2318037 - RNA, 22 nt, Yersinia pestis KIM
ucuaaugacuacuaaucaaucu

SEQ ID NO: 2318038 - RNA, 14 nt, Yersinia pestis KIM
ucuaauugcugccc

SEQ ID NO: 2318039 - RNA, 14 nt, Yersinia pestis KIM
ucuaauuauuaaac

SEQ ID NO: 2318040 - RNA, 13 nt, Yersinia pestis KIM
ucuauaaaaccgu

SEQ ID NO: 2318041 - RNA, 19 nt, Yersinia pestis KIM
ucuaggugcucugccuuau

SEQ ID NO: 2318042 - RNA, 20 nt, Yersinia pestis KIM
ucuaggugcucugccuuaug

SEQ ID NO: 2318043 - RNA, 19 nt, Yersinia pestis KIM
ucuagcuguagcaauauau

SEQ ID NO: 2318044 - RNA, 17 nt, Yersinia pestis KIM
ucuagcuguguuuuauc

SEQ ID NO: 2318045 - RNA, 22 nt, Yersinia pestis KIM
ucuaguuugugcugcuaauauu

SEQ ID NO: 2318046 - RNA, 16 nt, Yersinia pestis KIM
ucuagcuguagcaaua

SEQ ID NO: 2318047 - RNA, 15 nt, Yersinia pestis KIM
ucuagcgccagcaau

SEQ ID NO: 2318048 - RNA, 20 nt, Yersinia pestis KIM
ucuagcagugauuucagugu

SEQ ID NO: 2318049 - RNA, 23 nt, Yersinia pestis KIM
ucuagcgacggagagucagcaag

SEQ ID NO: 2318050 - RNA, 18 nt, Yersinia pestis KIM
ucuagcagugauuucagu

SEQ ID NO: 2318051 - RNA, 23 nt, Yersinia pestis KIM
ucuagaccugaggauaaaaacua

SEQ ID NO: 2318052 - RNA, 19 nt, Yersinia pestis KIM
ucuagaauuugaucagcca

SEQ ID NO: 2318053 - RNA, 17 nt, Yersinia pestis KIM
ucuauauagggaaauaa

SEQ ID NO: 2318054 - RNA, 16 nt, Yersinia pestis KIM
ucuaucgauaaaguca

SEQ ID NO: 2318055 - RNA, 17 nt, Yersinia pestis KIM
ucuaucgggcagguaaa

SEQ ID NO: 2318056 - RNA, 14 nt, Yersinia pestis KIM
ucuauccgaaaaau

SEQ ID NO: 2318057 - RNA, 16 nt, Yersinia pestis KIM
ucuauccgaaaaauau

SEQ ID NO: 2318058 - RNA, 17 nt, Yersinia pestis KIM
ucuauccgaaaaauauu

SEQ ID NO: 2318059 - RNA, 13 nt, Yersinia pestis KIM
ucuaucauccuug

SEQ ID NO: 2318060 - RNA, 20 nt, Yersinia pestis KIM
ucuaucagaccuuuaggaaa

SEQ ID NO: 2318061 - RNA, 19 nt, Yersinia pestis KIM
ucuauugaaaaaauaaugu

SEQ ID NO: 2318062 - RNA, 20 nt, Yersinia pestis KIM
ucuauugaaaaaauaauguc

SEQ ID NO: 2318063 - RNA, 16 nt, Yersinia pestis KIM
ucuauuaccucaauac

SEQ ID NO: 2318064 - RNA, 22 nt, Yersinia pestis KIM
ucucacaccauagcgguuuauu

SEQ ID NO: 2318065 - RNA, 13 nt, Yersinia pestis KIM
ucucacauagcug

SEQ ID NO: 2318066 - RNA, 16 nt, Yersinia pestis KIM
ucucaauauuaauaau

SEQ ID NO: 2318067 - RNA, 17 nt, Yersinia pestis KIM
ucucaauggcuuuuuua

SEQ ID NO: 2318068 - RNA, 17 nt, Yersinia pestis KIM
ucucaauauuaauaaug

SEQ ID NO: 2318069 - RNA, 20 nt, Yersinia pestis KIM
ucucacgcugaauaacaaaa

SEQ ID NO: 2318070 - RNA, 19 nt, Yersinia pestis KIM
ucucaccugcuuaguuaca

SEQ ID NO: 2318071 - RNA, 16 nt, Yersinia pestis KIM
ucucaccgcuggaagc

SEQ ID NO: 2318072 - RNA, 22 nt, Yersinia pestis KIM
ucucacguucggcgauaaucac

SEQ ID NO: 2318073 - RNA, 19 nt, Yersinia pestis KIM
ucucacugcuccagccaac

SEQ ID NO: 2318074 - RNA, 16 nt, Yersinia pestis KIM
ucucagaacaagacag

SEQ ID NO: 2318075 - RNA, 15 nt, Yersinia pestis KIM
ucucacuuacuauga

SEQ ID NO: 2318076 - RNA, 14 nt, Yersinia pestis KIM
ucuauuuuuauaau

SEQ ID NO: 2318077 - RNA, 17 nt, Yersinia pestis KIM
ucucaagacacuauucc

SEQ ID NO: 2318078 - RNA, 21 nt, Yersinia pestis KIM
ucucaacauaguugaauaacu

SEQ ID NO: 2318079 - RNA, 13 nt, Yersinia pestis KIM
ucucaaccaaaua

SEQ ID NO: 2318080 - RNA, 21 nt, Yersinia pestis KIM
ucuauuuauuuauaaaaccac

SEQ ID NO: 2318081 - RNA, 16 nt, Yersinia pestis KIM
ucuauugugucaauac

SEQ ID NO: 2318082 - RNA, 20 nt, Yersinia pestis KIM
ucuccgucgcgggcacuuug

SEQ ID NO: 2318083 - RNA, 22 nt, Yersinia pestis KIM
ucuccgucgcgggcacuuuguc

SEQ ID NO: 2318084 - RNA, 23 nt, Yersinia pestis KIM
ucuccgucgcgggcacuuuguca

SEQ ID NO: 2318085 - RNA, 15 nt, Yersinia pestis KIM
ucuccuuauacuaaa

SEQ ID NO: 2318086 - RNA, 21 nt, Yersinia pestis KIM
ucuccauggucaaacguucug

SEQ ID NO: 2318087 - RNA, 19 nt, Yersinia pestis KIM
ucucccauuaauuaaucag

SEQ ID NO: 2318088 - RNA, 18 nt, Yersinia pestis KIM
ucucaguugaaacccaca

SEQ ID NO: 2318089 - RNA, 15 nt, Yersinia pestis KIM
ucucaggcucagcgg

SEQ ID NO: 2318090 - RNA, 21 nt, Yersinia pestis KIM
ucucaggugugagguuauuga

SEQ ID NO: 2318091 - RNA, 14 nt, Yersinia pestis KIM
ucucaucaaggaaa

SEQ ID NO: 2318092 - RNA, 17 nt, Yersinia pestis KIM
ucucaucaauaccgaaa

SEQ ID NO: 2318093 - RNA, 20 nt, Yersinia pestis KIM
ucucaucgagaauaaauauu

SEQ ID NO: 2318094 - RNA, 15 nt, Yersinia pestis KIM
ucuccaagcacacug

SEQ ID NO: 2318095 - RNA, 22 nt, Yersinia pestis KIM
uccggccacgggcauccgcuuc

SEQ ID NO: 2318096 - RNA, 20 nt, Yersinia pestis KIM
uccgguaaagaagcauagaa

SEQ ID NO: 2318097 - RNA, 21 nt, Yersinia pestis KIM
uccgggucaaacucagcgaau

SEQ ID NO: 2318098 - RNA, 13 nt, Yersinia pestis KIM
uccgggcaagcgg

SEQ ID NO: 2318099 - RNA, 18 nt, Yersinia pestis KIM
uccgggcagugaaucacc

SEQ ID NO: 2318100 - RNA, 13 nt, Yersinia pestis KIM
uccgggacgcgcc

SEQ ID NO: 2318101 - RNA, 22 nt, Yersinia pestis KIM
uccggcugcgccauaugccaug

SEQ ID NO: 2318102 - RNA, 16 nt, Yersinia pestis KIM
uccgguuguucuacua

SEQ ID NO: 2318103 - RNA, 15 nt, Yersinia pestis KIM
uccguacuuuucgcc

SEQ ID NO: 2318104 - RNA, 19 nt, Yersinia pestis KIM
uccguaacccgccucgcuu

SEQ ID NO: 2318105 - RNA, 20 nt, Yersinia pestis KIM
uccguaaaucauagccagcg

SEQ ID NO: 2318106 - RNA, 13 nt, Yersinia pestis KIM
uccguaaaaaacc

SEQ ID NO: 2318107 - RNA, 15 nt, Yersinia pestis KIM
uccgccauccuucaa

SEQ ID NO: 2318108 - RNA, 18 nt, Yersinia pestis KIM
uccgcaucguaacccaga

SEQ ID NO: 2318109 - RNA, 17 nt, Yersinia pestis KIM
uccgccaaggccagcgc

SEQ ID NO: 2318110 - RNA, 18 nt, Yersinia pestis KIM
uccgcacuuggccccauc

SEQ ID NO: 2318111 - RNA, 16 nt, Yersinia pestis KIM
uccgcacggcuacugc

SEQ ID NO: 2318112 - RNA, 14 nt, Yersinia pestis KIM
uccgcaauagccaa

SEQ ID NO: 2318113 - RNA, 17 nt, Yersinia pestis KIM
uccgcuggcauacugac

SEQ ID NO: 2318114 - RNA, 11 nt, Yersinia pestis KIM
uccgcuggaca

SEQ ID NO: 2318115 - RNA, 22 nt, Yersinia pestis KIM
uccgcuuagcaggcccuuucac

SEQ ID NO: 2318116 - RNA, 20 nt, Yersinia pestis KIM
uccgcuguggcccuugcagc

SEQ ID NO: 2318117 - RNA, 14 nt, Yersinia pestis KIM
uccgcuuccaucac

SEQ ID NO: 2318118 - RNA, 22 nt, Yersinia pestis KIM
uccgcuucucagucgcgaugcg

SEQ ID NO: 2318119 - RNA, 15 nt, Yersinia pestis KIM
uccgcuugcagcaac

SEQ ID NO: 2318120 - RNA, 14 nt, Yersinia pestis KIM
uccgcgccagggag

SEQ ID NO: 2318121 - RNA, 14 nt, Yersinia pestis KIM
uccgcgccaaggca

SEQ ID NO: 2318122 - RNA, 15 nt, Yersinia pestis KIM
uccgcggugcuuuuu

SEQ ID NO: 2318123 - RNA, 22 nt, Yersinia pestis KIM
uccgccucuuuuuccacacccu

SEQ ID NO: 2318124 - RNA, 20 nt, Yersinia pestis KIM
uccgcgaugacacaauuccc

SEQ ID NO: 2318125 - RNA, 18 nt, Yersinia pestis KIM
uccgcgcaaccuggccaa

SEQ ID NO: 2318126 - RNA, 21 nt, Yersinia pestis KIM
uccgucccaagaaaagcaccg

SEQ ID NO: 2318127 - RNA, 16 nt, Yersinia pestis KIM
uccgucuaccucgguu

SEQ ID NO: 2318128 - RNA, 20 nt, Yersinia pestis KIM
uccgucgcgggcacuuuguc

SEQ ID NO: 2318129 - RNA, 14 nt, Yersinia pestis KIM
uccgugauuaaccu

SEQ ID NO: 2318130 - RNA, 14 nt, Yersinia pestis KIM
uccgugcugguccu

SEQ ID NO: 2318131 - RNA, 18 nt, Yersinia pestis KIM
uccgugcugguccuuuug

SEQ ID NO: 2318132 - RNA, 24 nt, Yersinia pestis KIM
uccguuaccaaagcguacucuucu

SEQ ID NO: 2318133 - RNA, 19 nt, Yersinia pestis KIM
uccguguuggcaaaaauaa

SEQ ID NO: 2318134 - RNA, 14 nt, Yersinia pestis KIM
uccguuuaaucagu

SEQ ID NO: 2318135 - RNA, 19 nt, Yersinia pestis KIM
uccguuuacgacaauccua

SEQ ID NO: 2318136 - RNA, 13 nt, Yersinia pestis KIM
uccguugaaaccu

SEQ ID NO: 2318137 - RNA, 12 nt, Yersinia pestis KIM
uccuagaggcuu

SEQ ID NO: 2318138 - RNA, 17 nt, Yersinia pestis KIM
uccuaaagauaauuaau

SEQ ID NO: 2318139 - RNA, 14 nt, Yersinia pestis KIM
uccuaaagauaauu

SEQ ID NO: 2318140 - RNA, 19 nt, Yersinia pestis KIM
uccuaagguagugagauga

SEQ ID NO: 2318141 - RNA, 19 nt, Yersinia pestis KIM
uccuaaugaacacuuaauu

SEQ ID NO: 2318142 - RNA, 12 nt, Yersinia pestis KIM
uccucaugauuu

SEQ ID NO: 2318143 - RNA, 21 nt, Yersinia pestis KIM
uccuccauauccucaagaccg

SEQ ID NO: 2318144 - RNA, 23 nt, Yersinia pestis KIM
uccuccgacauagccggagguuu

SEQ ID NO: 2318145 - RNA, 23 nt, Yersinia pestis KIM
uccuccggcauagccggagguuu

SEQ ID NO: 2318146 - RNA, 19 nt, Yersinia pestis KIM
uccuccuuggggccucacu

SEQ ID NO: 2318147 - RNA, 22 nt, Yersinia pestis KIM
uccucaagaccgauuuguaagc

SEQ ID NO: 2318148 - RNA, 19 nt, Yersinia pestis KIM
uccucaccauuuauugcca

SEQ ID NO: 2318149 - RNA, 13 nt, Yersinia pestis KIM
uccucaccguuca

SEQ ID NO: 2318150 - RNA, 14 nt, Yersinia pestis KIM
uccuaucguuuauu

SEQ ID NO: 2318151 - RNA, 19 nt, Yersinia pestis KIM
uccuauagcucagaaaaua

SEQ ID NO: 2318152 - RNA, 15 nt, Yersinia pestis KIM
uccuauauacaaggc

SEQ ID NO: 2318153 - RNA, 13 nt, Yersinia pestis KIM
uccuauagcucag

SEQ ID NO: 2318154 - RNA, 13 nt, Yersinia pestis KIM
uccuauaaauuuu

SEQ ID NO: 2318155 - RNA, 15 nt, Yersinia pestis KIM
uccuauaaauuuuaa

SEQ ID NO: 2318156 - RNA, 21 nt, Yersinia pestis KIM
uccuagcguuucuacaauggc

SEQ ID NO: 2318157 - RNA, 18 nt, Yersinia pestis KIM
uccugauauuccggugau

SEQ ID NO: 2318158 - RNA, 21 nt, Yersinia pestis KIM
uccugaucuucauugccuucu

SEQ ID NO: 2318159 - RNA, 21 nt, Yersinia pestis KIM
uccugauucgcgaccagcaga

SEQ ID NO: 2318160 - RNA, 19 nt, Yersinia pestis KIM
uccugaucuucauugccuu

SEQ ID NO: 2318161 - RNA, 17 nt, Yersinia pestis KIM
uccugauuacucaggaa

SEQ ID NO: 2318162 - RNA, 17 nt, Yersinia pestis KIM
uccugcaaugcauaagc

SEQ ID NO: 2318163 - RNA, 16 nt, Yersinia pestis KIM
uccugcaauaacacca

SEQ ID NO: 2318164 - RNA, 17 nt, Yersinia pestis KIM
uccugccgccucugcuc

SEQ ID NO: 2318165 - RNA, 16 nt, Yersinia pestis KIM
uccugccgccucugcu

SEQ ID NO: 2318166 - RNA, 21 nt, Yersinia pestis KIM
uccugcacaguagaagcuacc

SEQ ID NO: 2318167 - RNA, 17 nt, Yersinia pestis KIM
uccugccacagacuuuc

SEQ ID NO: 2318168 - RNA, 20 nt, Yersinia pestis KIM
uccuggccguguuuuucccu

SEQ ID NO: 2318169 - RNA, 18 nt, Yersinia pestis KIM
uccuggccguguuuuucc

SEQ ID NO: 2318170 - RNA, 21 nt, Yersinia pestis KIM
uccuggccguguuuuucccua

SEQ ID NO: 2318171 - RNA, 15 nt, Yersinia pestis KIM
uccuggcuauuuauu

SEQ ID NO: 2318172 - RNA, 14 nt, Yersinia pestis KIM
uccugguucacucu

SEQ ID NO: 2318173 - RNA, 21 nt, Yersinia pestis KIM
uccucucaccaagauaccgag

SEQ ID NO: 2318174 - RNA, 22 nt, Yersinia pestis KIM
uccugaacgaggacuuccugcc

SEQ ID NO: 2318175 - RNA, 23 nt, Yersinia pestis KIM
uccugaauaauacugucaaaauc

SEQ ID NO: 2318176 - RNA, 20 nt, Yersinia pestis KIM
uccugacaccggauaugccg

SEQ ID NO: 2318177 - RNA, 16 nt, Yersinia pestis KIM
uccugacgaugauaaa

SEQ ID NO: 2318178 - RNA, 22 nt, Yersinia pestis KIM
uccugacggauacgcaaaccau

SEQ ID NO: 2318179 - RNA, 12 nt, Yersinia pestis KIM
uccucuuccaau

SEQ ID NO: 2318180 - RNA, 12 nt, Yersinia pestis KIM
uccucuucuucg

SEQ ID NO: 2318181 - RNA, 17 nt, Yersinia pestis KIM
uccucuuucuuaauaau

SEQ ID NO: 2318182 - RNA, 19 nt, Yersinia pestis KIM
uccucuuucuuaauaauau

SEQ ID NO: 2318183 - RNA, 13 nt, Yersinia pestis KIM
uccugaaaauaga

SEQ ID NO: 2318184 - RNA, 20 nt, Yersinia pestis KIM
uccucuccccuaccucaucc

SEQ ID NO: 2318185 - RNA, 14 nt, Yersinia pestis KIM
uccucugccuaucc

SEQ ID NO: 2318186 - RNA, 17 nt, Yersinia pestis KIM
ucgagcggggcaaaaau

SEQ ID NO: 2318187 - RNA, 22 nt, Yersinia pestis KIM
ucgauaagcacuccacuggugg

SEQ ID NO: 2318188 - RNA, 19 nt, Yersinia pestis KIM
ucgaucagcgucagcagau

SEQ ID NO: 2318189 - RNA, 15 nt, Yersinia pestis KIM
ucgauagcaacaucg

SEQ ID NO: 2318190 - RNA, 14 nt, Yersinia pestis KIM
ucgauacuuuuuau

SEQ ID NO: 2318191 - RNA, 18 nt, Yersinia pestis KIM
ucgauacuaauuucuaau

SEQ ID NO: 2318192 - RNA, 17 nt, Yersinia pestis KIM
ucgauccgaauauguca

SEQ ID NO: 2318193 - RNA, 16 nt, Yersinia pestis KIM
ucgaucccaauauuaa

SEQ ID NO: 2318194 - RNA, 13 nt, Yersinia pestis KIM
ucgauuuuuauuu

SEQ ID NO: 2318195 - RNA, 18 nt, Yersinia pestis KIM
ucgaugccuucuuucaaa

SEQ ID NO: 2318196 - RNA, 18 nt, Yersinia pestis KIM
ucgccagcggguacacug

SEQ ID NO: 2318197 - RNA, 18 nt, Yersinia pestis KIM
ucgccaggaaaucaugac

SEQ ID NO: 2318198 - RNA, 15 nt, Yersinia pestis KIM
ucgcaucuuccaaag

SEQ ID NO: 2318199 - RNA, 13 nt, Yersinia pestis KIM
ucgcaucuuccaa

SEQ ID NO: 2318200 - RNA, 15 nt, Yersinia pestis KIM
ucgcaugguuaaaac

SEQ ID NO: 2318201 - RNA, 21 nt, Yersinia pestis KIM
ucgaagggauaucucaccgcc

SEQ ID NO: 2318202 - RNA, 20 nt, Yersinia pestis KIM
uccuguuuuugaauagguaa

SEQ ID NO: 2318203 - RNA, 19 nt, Yersinia pestis KIM
ucgacauaaagaugcaagc

SEQ ID NO: 2318204 - RNA, 15 nt, Yersinia pestis KIM
ucgacaguguaaaaa

SEQ ID NO: 2318205 - RNA, 17 nt, Yersinia pestis KIM
ucgacaguguaaaaagc

SEQ ID NO: 2318206 - RNA, 18 nt, Yersinia pestis KIM
ucgagauguauccaaggc

SEQ ID NO: 2318207 - RNA, 19 nt, Yersinia pestis KIM
ucgagauguauccaaggca

SEQ ID NO: 2318208 - RNA, 16 nt, Yersinia pestis KIM
ucgagcaacuuuuacu

SEQ ID NO: 2318209 - RNA, 17 nt, Yersinia pestis KIM
ucgagcaacuuuuacug

SEQ ID NO: 2318210 - RNA, 18 nt, Yersinia pestis KIM
ucgagaguugcucaccca

SEQ ID NO: 2318211 - RNA, 21 nt, Yersinia pestis KIM
ucgagccgcgccauccuuggc

SEQ ID NO: 2318212 - RNA, 13 nt, Yersinia pestis KIM
ucgagccuacaua

SEQ ID NO: 2318213 - RNA, 14 nt, Yersinia pestis KIM
ucgagcaucaccgg

SEQ ID NO: 2318214 - RNA, 14 nt, Yersinia pestis KIM
ucgacgauauugau

SEQ ID NO: 2318215 - RNA, 23 nt, Yersinia pestis KIM
ucgacucugggccgugaguuuuc

SEQ ID NO: 2318216 - RNA, 16 nt, Yersinia pestis KIM
ucgacuaaggcaaccu

SEQ ID NO: 2318217 - RNA, 20 nt, Yersinia pestis KIM
ucggcacugcccugccuggu

SEQ ID NO: 2318218 - RNA, 19 nt, Yersinia pestis KIM
ucggacggcugacaaaccc

SEQ ID NO: 2318219 - RNA, 15 nt, Yersinia pestis KIM
ucgcuucgcucggcu

SEQ ID NO: 2318220 - RNA, 23 nt, Yersinia pestis KIM
ucgcuucugcgaggccgcugcaa

SEQ ID NO: 2318221 - RNA, 21 nt, Yersinia pestis KIM
ucggaaaucugaugauuggag

SEQ ID NO: 2318222 - RNA, 20 nt, Yersinia pestis KIM
ucgcucccccggaucacugg

SEQ ID NO: 2318223 - RNA, 14 nt, Yersinia pestis KIM
ucgcuccucagccu

SEQ ID NO: 2318224 - RNA, 20 nt, Yersinia pestis KIM
ucgcucaggcggucaccgaa

SEQ ID NO: 2318225 - RNA, 15 nt, Yersinia pestis KIM
ucgcugaaaugcuau

SEQ ID NO: 2318226 - RNA, 13 nt, Yersinia pestis KIM
ucgcugaaaugcu

SEQ ID NO: 2318227 - RNA, 12 nt, Yersinia pestis KIM
ucgcucugcguu

SEQ ID NO: 2318228 - RNA, 21 nt, Yersinia pestis KIM
ucgcugaacaauugccaggcc

SEQ ID NO: 2318229 - RNA, 22 nt, Yersinia pestis KIM
ucgcugagacccgauuucacgc

SEQ ID NO: 2318230 - RNA, 17 nt, Yersinia pestis KIM
ucgcggguuuuuaacuu

SEQ ID NO: 2318231 - RNA, 12 nt, Yersinia pestis KIM
ucgcguggcaga

SEQ ID NO: 2318232 - RNA, 22 nt, Yersinia pestis KIM
ucgcuaucugugucaguaccug

SEQ ID NO: 2318233 - RNA, 16 nt, Yersinia pestis KIM
ucgcguuggcuaaaau

SEQ ID NO: 2318234 - RNA, 18 nt, Yersinia pestis KIM
ucgcgccugaaaucauuu

SEQ ID NO: 2318235 - RNA, 17 nt, Yersinia pestis KIM
ucgcgcugcuuuccuga

SEQ ID NO: 2318236 - RNA, 16 nt, Yersinia pestis KIM
ucgccgggucaggaag

SEQ ID NO: 2318237 - RNA, 16 nt, Yersinia pestis KIM
ucgccauaaaugcgua

SEQ ID NO: 2318238 - RNA, 15 nt, Yersinia pestis KIM
ucgcgacgaaaaccu

SEQ ID NO: 2318239 - RNA, 22 nt, Yersinia pestis KIM
ucgcgaccaauucaucagcgcu

SEQ ID NO: 2318240 - RNA, 15 nt, Yersinia pestis KIM
ucgcgaccagcagaa

SEQ ID NO: 2318241 - RNA, 16 nt, Yersinia pestis KIM
ucgcgaccagcagaag

SEQ ID NO: 2318242 - RNA, 18 nt, Yersinia pestis KIM
ucgccugaugcuuuucuu

SEQ ID NO: 2318243 - RNA, 20 nt, Yersinia pestis KIM
ucgccuaccaucaaaauaug

SEQ ID NO: 2318244 - RNA, 20 nt, Yersinia pestis KIM
uccgacugauagcaaacaaa

SEQ ID NO: 2318245 - RNA, 19 nt, Yersinia pestis KIM
uccgaccaccacugcauca

SEQ ID NO: 2318246 - RNA, 16 nt, Yersinia pestis KIM
uccgaaaaauauucuc

SEQ ID NO: 2318247 - RNA, 15 nt, Yersinia pestis KIM
ucccucuugaauaau

SEQ ID NO: 2318248 - RNA, 15 nt, Yersinia pestis KIM
ucccugaacgccuug

SEQ ID NO: 2318249 - RNA, 11 nt, Yersinia pestis KIM
ucccucggcuu

SEQ ID NO: 2318250 - RNA, 16 nt, Yersinia pestis KIM
ucccuuguugccuuuc

SEQ ID NO: 2318251 - RNA, 16 nt, Yersinia pestis KIM
ucccuuguucaggcag

SEQ ID NO: 2318252 - RNA, 20 nt, Yersinia pestis KIM
ucccuugagcauuuuaguga

SEQ ID NO: 2318253 - RNA, 12 nt, Yersinia pestis KIM
ucccuguauaaa

SEQ ID NO: 2318254 - RNA, 14 nt, Yersinia pestis KIM
ucccuucugaaacu

SEQ ID NO: 2318255 - RNA, 19 nt, Yersinia pestis KIM
ucccgauacccauuuuaau

SEQ ID NO: 2318256 - RNA, 19 nt, Yersinia pestis KIM
ucccgauauaaauaaaaua

SEQ ID NO: 2318257 - RNA, 14 nt, Yersinia pestis KIM
ucccgcaaagccug

SEQ ID NO: 2318258 - RNA, 13 nt, Yersinia pestis KIM
ucccgagauaacc

SEQ ID NO: 2318259 - RNA, 18 nt, Yersinia pestis KIM
uccccuuugacagcaucu

SEQ ID NO: 2318260 - RNA, 20 nt, Yersinia pestis KIM
ucccgacaaauacugcugug

SEQ ID NO: 2318261 - RNA, 19 nt, Yersinia pestis KIM
uccccuaauucuccuuucu

SEQ ID NO: 2318262 - RNA, 14 nt, Yersinia pestis KIM
uccccucagagaca

SEQ ID NO: 2318263 - RNA, 20 nt, Yersinia pestis KIM
uccccggcaucccaccuuca

SEQ ID NO: 2318264 - RNA, 18 nt, Yersinia pestis KIM
uccccggcccagaagccu

SEQ ID NO: 2318265 - RNA, 18 nt, Yersinia pestis KIM
ucccgugccagauccucu

SEQ ID NO: 2318266 - RNA, 17 nt, Yersinia pestis KIM
ucccguaggccuuaacc

SEQ ID NO: 2318267 - RNA, 14 nt, Yersinia pestis KIM
ucccguauagauua

SEQ ID NO: 2318268 - RNA, 20 nt, Yersinia pestis KIM
ucccgucagguucaauuccc

SEQ ID NO: 2318269 - RNA, 16 nt, Yersinia pestis KIM
ucccgguugcgauaca

SEQ ID NO: 2318270 - RNA, 15 nt, Yersinia pestis KIM
ucccgguuucagugc

SEQ ID NO: 2318271 - RNA, 17 nt, Yersinia pestis KIM
ucccuaaagagcgauua

SEQ ID NO: 2318272 - RNA, 21 nt, Yersinia pestis KIM
ucccuacgguaccgcagguca

SEQ ID NO: 2318273 - RNA, 16 nt, Yersinia pestis KIM
ucccguuucagcuccg

SEQ ID NO: 2318274 - RNA, 20 nt, Yersinia pestis KIM
uccauucacgcccuacugag

SEQ ID NO: 2318275 - RNA, 13 nt, Yersinia pestis KIM
uccauucugcaga

SEQ ID NO: 2318276 - RNA, 14 nt, Yersinia pestis KIM
uccauucugcagau

SEQ ID NO: 2318277 - RNA, 15 nt, Yersinia pestis KIM
uccauguaggcucga

SEQ ID NO: 2318278 - RNA, 18 nt, Yersinia pestis KIM
uccauuagcguauuaaac

SEQ ID NO: 2318279 - RNA, 23 nt, Yersinia pestis KIM
uccauggacgggccgagucacga

SEQ ID NO: 2318280 - RNA, 19 nt, Yersinia pestis KIM
uccaugagcgcuauuuauc

SEQ ID NO: 2318281 - RNA, 13 nt, Yersinia pestis KIM
uccaugccauucu

SEQ ID NO: 2318282 - RNA, 14 nt, Yersinia pestis KIM
uccaugcaaaauau

SEQ ID NO: 2318283 - RNA, 22 nt, Yersinia pestis KIM
uccaugccagcccaucaccauu

SEQ ID NO: 2318284 - RNA, 17 nt, Yersinia pestis KIM
uccaugacacauauuuc

SEQ ID NO: 2318285 - RNA, 17 nt, Yersinia pestis KIM
uccaucugaaauuuauu

SEQ ID NO: 2318286 - RNA, 23 nt, Yersinia pestis KIM
uccaucuaauagaauagauccca

SEQ ID NO: 2318287 - RNA, 18 nt, Yersinia pestis KIM
ucccagaacauaugccca

SEQ ID NO: 2318288 - RNA, 18 nt, Yersinia pestis KIM
ucccacuuauuauaaagc

SEQ ID NO: 2318289 - RNA, 15 nt, Yersinia pestis KIM
ucccacuuccaucug

SEQ ID NO: 2318290 - RNA, 22 nt, Yersinia pestis KIM
ucccaaugaauauuauucaguu

SEQ ID NO: 2318291 - RNA, 18 nt, Yersinia pestis KIM
ucccaaucgauaauauua

SEQ ID NO: 2318292 - RNA, 17 nt, Yersinia pestis KIM
uccauuuuauuuaacgu

SEQ ID NO: 2318293 - RNA, 20 nt, Yersinia pestis KIM
uccauuguauugcucagggc

SEQ ID NO: 2318294 - RNA, 18 nt, Yersinia pestis KIM
uccauuuucaucguauga

SEQ ID NO: 2318295 - RNA, 14 nt, Yersinia pestis KIM
ucccccaaguaaaa

SEQ ID NO: 2318296 - RNA, 14 nt, Yersinia pestis KIM
uccccauggcuuuc

SEQ ID NO: 2318297 - RNA, 21 nt, Yersinia pestis KIM
uccccauaagcgggguauuuu

SEQ ID NO: 2318298 - RNA, 12 nt, Yersinia pestis KIM
uccccaccaaca

SEQ ID NO: 2318299 - RNA, 21 nt, Yersinia pestis KIM
uccccaccauugcaaacauca

SEQ ID NO: 2318300 - RNA, 16 nt, Yersinia pestis KIM
uccccaccagguaauu

SEQ ID NO: 2318301 - RNA, 20 nt, Yersinia pestis KIM
uccccaccauugcaaacauc

SEQ ID NO: 2318302 - RNA, 15 nt, Yersinia pestis KIM
uccccagaacagcua

SEQ ID NO: 2318303 - RNA, 18 nt, Yersinia pestis KIM
uccccgcuugggugagga

SEQ ID NO: 2318304 - RNA, 15 nt, Yersinia pestis KIM
uccccggcaccaacg

SEQ ID NO: 2318305 - RNA, 18 nt, Yersinia pestis KIM
ucccccgcgccgacugcu

SEQ ID NO: 2318306 - RNA, 15 nt, Yersinia pestis KIM
uccccccuucaucga

SEQ ID NO: 2318307 - RNA, 20 nt, Yersinia pestis KIM
uccccccccacuugaccuuc

SEQ ID NO: 2318308 - RNA, 20 nt, Yersinia pestis KIM
uccccccgugauaugcaaau

SEQ ID NO: 2318309 - RNA, 23 nt, Yersinia pestis KIM
ucccccauggggccaccuaaucc

SEQ ID NO: 2318310 - RNA, 17 nt, Yersinia pestis KIM
ucccccgguuaaugcca

SEQ ID NO: 2318311 - RNA, 19 nt, Yersinia pestis KIM
ucccccggaucacuggcua

SEQ ID NO: 2318312 - RNA, 22 nt, Yersinia pestis KIM
ucccccucuaaucacuuauucc

SEQ ID NO: 2318313 - RNA, 14 nt, Yersinia pestis KIM
ucccaguaagcucu

SEQ ID NO: 2318314 - RNA, 14 nt, Yersinia pestis KIM
ucccaggccuccgc

SEQ ID NO: 2318315 - RNA, 16 nt, Yersinia pestis KIM
ucccagucgucuucag

SEQ ID NO: 2318316 - RNA, 15 nt, Yersinia pestis KIM
ucccagcacagccug

SEQ ID NO: 2318317 - RNA, 16 nt, Yersinia pestis KIM
uccccaacucuuucaa

SEQ ID NO: 2318318 - RNA, 15 nt, Yersinia pestis KIM
ucccaucccuuugau

SEQ ID NO: 2318319 - RNA, 14 nt, Yersinia pestis KIM
ucccauuaauuaau

SEQ ID NO: 2318320 - RNA, 23 nt, Yersinia pestis KIM
uccaccaacggcccaauauugau

SEQ ID NO: 2318321 - RNA, 21 nt, Yersinia pestis KIM
uccacauauauagagaaaucu

SEQ ID NO: 2318322 - RNA, 17 nt, Yersinia pestis KIM
uccacagucaguucauu

SEQ ID NO: 2318323 - RNA, 11 nt, Yersinia pestis KIM
uccacacaaaa

SEQ ID NO: 2318324 - RNA, 22 nt, Yersinia pestis KIM
uccaccguuuuacucaggauua

SEQ ID NO: 2318325 - RNA, 23 nt, Yersinia pestis KIM
uccaccguuuuacucaggauuag

SEQ ID NO: 2318326 - RNA, 20 nt, Yersinia pestis KIM
uccaaucauucugucaucaa

SEQ ID NO: 2318327 - RNA, 23 nt, Yersinia pestis KIM
uccaaucuugguuaauagcauuu

SEQ ID NO: 2318328 - RNA, 21 nt, Yersinia pestis KIM
uccaauaugcggcauaacuga

SEQ ID NO: 2318329 - RNA, 16 nt, Yersinia pestis KIM
uccaauucauaauagc

SEQ ID NO: 2318330 - RNA, 23 nt, Yersinia pestis KIM
uccaauaaugccgaaugauucau

SEQ ID NO: 2318331 - RNA, 18 nt, Yersinia pestis KIM
uccaagcacacugguuga

SEQ ID NO: 2318332 - RNA, 14 nt, Yersinia pestis KIM
uccaagccauggua

SEQ ID NO: 2318333 - RNA, 17 nt, Yersinia pestis KIM
uccaacugauaauucag

SEQ ID NO: 2318334 - RNA, 21 nt, Yersinia pestis KIM
uccaacuaaacagggcagaaa

SEQ ID NO: 2318335 - RNA, 15 nt, Yersinia pestis KIM
uccaacuuuucauug

SEQ ID NO: 2318336 - RNA, 23 nt, Yersinia pestis KIM
uccagaauauaaaagcacagaca

SEQ ID NO: 2318337 - RNA, 19 nt, Yersinia pestis KIM
uccagaauagagaaaucaa

SEQ ID NO: 2318338 - RNA, 15 nt, Yersinia pestis KIM
uccagacaaagugag

SEQ ID NO: 2318339 - RNA, 19 nt, Yersinia pestis KIM
uccagaccgcguaagccgu

SEQ ID NO: 2318340 - RNA, 14 nt, Yersinia pestis KIM
uccagaacaauacc

SEQ ID NO: 2318341 - RNA, 13 nt, Yersinia pestis KIM
uccagaagccauu

SEQ ID NO: 2318342 - RNA, 15 nt, Yersinia pestis KIM
uccagcaccccuuca

SEQ ID NO: 2318343 - RNA, 22 nt, Yersinia pestis KIM
uccagcaaauuagacacgccgg

SEQ ID NO: 2318344 - RNA, 14 nt, Yersinia pestis KIM
uccagcaacucaag

SEQ ID NO: 2318345 - RNA, 20 nt, Yersinia pestis KIM
uccagcaacucaagccacuc

SEQ ID NO: 2318346 - RNA, 14 nt, Yersinia pestis KIM
uccagaugccaaau

SEQ ID NO: 2318347 - RNA, 13 nt, Yersinia pestis KIM
uccagaucggcaa

SEQ ID NO: 2318348 - RNA, 20 nt, Yersinia pestis KIM
uccagauuacgcaucgucag

SEQ ID NO: 2318349 - RNA, 16 nt, Yersinia pestis KIM
uccacgcccaacucuu

SEQ ID NO: 2318350 - RNA, 15 nt, Yersinia pestis KIM
uccaccugaucaugc

SEQ ID NO: 2318351 - RNA, 19 nt, Yersinia pestis KIM
uccaccugacgaaaugccg

SEQ ID NO: 2318352 - RNA, 21 nt, Yersinia pestis KIM
uccacgggcgcaauggaagaa

SEQ ID NO: 2318353 - RNA, 19 nt, Yersinia pestis KIM
uccacgcugaaacuuuuca

SEQ ID NO: 2318354 - RNA, 22 nt, Yersinia pestis KIM
uccacgcuuuaagcuaauucug

SEQ ID NO: 2318355 - RNA, 20 nt, Yersinia pestis KIM
uccacucuuugaguagcagg

SEQ ID NO: 2318356 - RNA, 21 nt, Yersinia pestis KIM
uccacugcggccacucgcauc

SEQ ID NO: 2318357 - RNA, 13 nt, Yersinia pestis KIM
uccacuaauucau

SEQ ID NO: 2318358 - RNA, 20 nt, Yersinia pestis KIM
uccacguuuggauacaguuu

SEQ ID NO: 2318359 - RNA, 18 nt, Yersinia pestis KIM
uccacuacucaguugcag

SEQ ID NO: 2318360 - RNA, 20 nt, Yersinia pestis KIM
uccacuugugguaaccccgu

SEQ ID NO: 2318361 - RNA, 17 nt, Yersinia pestis KIM
uccacuuuuucucuccu

SEQ ID NO: 2318362 - RNA, 16 nt, Yersinia pestis KIM
uccaggcuaccaaggc

SEQ ID NO: 2318363 - RNA, 18 nt, Yersinia pestis KIM
uccagggcaaucaggaaa

SEQ ID NO: 2318364 - RNA, 20 nt, Yersinia pestis KIM
uccaggcgcuguugcaugua

SEQ ID NO: 2318365 - RNA, 16 nt, Yersinia pestis KIM
uccaggcaccagggaa

SEQ ID NO: 2318366 - RNA, 14 nt, Yersinia pestis KIM
uccaggcccgcuuu

SEQ ID NO: 2318367 - RNA, 17 nt, Yersinia pestis KIM
uccagcucauauaauca

SEQ ID NO: 2318368 - RNA, 20 nt, Yersinia pestis KIM
uccagcguaaacaguagcag

SEQ ID NO: 2318369 - RNA, 16 nt, Yersinia pestis KIM
uccagccaccuuaagu

SEQ ID NO: 2318370 - RNA, 17 nt, Yersinia pestis KIM
uccagccaauacaggca

SEQ ID NO: 2318371 - RNA, 18 nt, Yersinia pestis KIM
uccagccaccccguggca

SEQ ID NO: 2318372 - RNA, 17 nt, Yersinia pestis KIM
uccagcgaacguaguug

SEQ ID NO: 2318373 - RNA, 17 nt, Yersinia pestis KIM
uccagcggcaaauagag

SEQ ID NO: 2318374 - RNA, 22 nt, Yersinia pestis KIM
uccagcggcaaauagagcacca

SEQ ID NO: 2318375 - RNA, 16 nt, Yersinia pestis KIM
uccagcgccaucagcg

SEQ ID NO: 2318376 - RNA, 16 nt, Yersinia pestis KIM
uccaggucaaucaauu

SEQ ID NO: 2318377 - RNA, 18 nt, Yersinia pestis KIM
uccaguaagcuguugacc

SEQ ID NO: 2318378 - RNA, 13 nt, Yersinia pestis KIM
uccaguaauaccu

SEQ ID NO: 2318379 - RNA, 14 nt, Yersinia pestis KIM
uccaguaauaccuu

SEQ ID NO: 2318380 - RNA, 12 nt, Yersinia pestis KIM
uccaguaagcug

SEQ ID NO: 2318381 - RNA, 22 nt, Yersinia pestis KIM
uccaguaaaagaauaaauguca

SEQ ID NO: 2318382 - RNA, 14 nt, Yersinia pestis KIM
uccaguaaaaaaau

SEQ ID NO: 2318383 - RNA, 16 nt, Yersinia pestis KIM
uccagugcaaauuuau

SEQ ID NO: 2318384 - RNA, 14 nt, Yersinia pestis KIM
uccagugccaaaau

SEQ ID NO: 2318385 - RNA, 15 nt, Yersinia pestis KIM
uccaguuaucaucgu

SEQ ID NO: 2318386 - RNA, 18 nt, Yersinia pestis KIM
uccaguugccagcaggcu

SEQ ID NO: 2318387 - RNA, 23 nt, Yersinia pestis KIM
uccaucggccagugcgccggccu

SEQ ID NO: 2318388 - RNA, 11 nt, Yersinia pestis KIM
uccaucaggaa

SEQ ID NO: 2318389 - RNA, 20 nt, Yersinia pestis KIM
uccaucagcgcacugcaugc

SEQ ID NO: 2318390 - RNA, 15 nt, Yersinia pestis KIM
uccaucagacauauu

SEQ ID NO: 2318391 - RNA, 21 nt, Yersinia pestis KIM
uccaucacgcagcuuuuucuc

SEQ ID NO: 2318392 - RNA, 23 nt, Yersinia pestis KIM
uccaucaccgucgguuucucuug

SEQ ID NO: 2318393 - RNA, 19 nt, Yersinia pestis KIM
uccauauuuuagcggccuc

SEQ ID NO: 2318394 - RNA, 15 nt, Yersinia pestis KIM
uccaucaaaggagaa

SEQ ID NO: 2318395 - RNA, 20 nt, Yersinia pestis KIM
uccauauagccccaacacug

SEQ ID NO: 2318396 - RNA, 21 nt, Yersinia pestis KIM
uccauaaacggaacucaucuu

SEQ ID NO: 2318397 - RNA, 23 nt, Yersinia pestis KIM
uccauaaacggaacucaucuuuc

SEQ ID NO: 2318398 - RNA, 20 nt, Yersinia pestis KIM
uccauaaacggaacucaucu

SEQ ID NO: 2318399 - RNA, 17 nt, Yersinia pestis KIM
uccauagcuaaaauaag

SEQ ID NO: 2318400 - RNA, 15 nt, Yersinia pestis KIM
uccauacgaauuuuu

SEQ ID NO: 2318401 - RNA, 17 nt, Yersinia pestis KIM
uccauacgaauuuuucc

SEQ ID NO: 2318402 - RNA, 15 nt, Yersinia pestis KIM
uccauacuguugcua

SEQ ID NO: 2318403 - RNA, 19 nt, Yersinia pestis KIM
ucauuuaauuuauccaacu

SEQ ID NO: 2318404 - RNA, 11 nt, Yersinia pestis KIM
ucauuuaacug

SEQ ID NO: 2318405 - RNA, 12 nt, Yersinia pestis KIM
ucauuuaaaaua

SEQ ID NO: 2318406 - RNA, 12 nt, Yersinia pestis KIM
ucauuuaaauac

SEQ ID NO: 2318407 - RNA, 19 nt, Yersinia pestis KIM
ucauuucaacuauuuggug

SEQ ID NO: 2318408 - RNA, 17 nt, Yersinia pestis KIM
ucauuuaucuaaaacug

SEQ ID NO: 2318409 - RNA, 19 nt, Yersinia pestis KIM
ucauuguagauggccaucu

SEQ ID NO: 2318410 - RNA, 19 nt, Yersinia pestis KIM
ucauugguuaacuuauagc

SEQ ID NO: 2318411 - RNA, 18 nt, Yersinia pestis KIM
ucauuucccccaccugau

SEQ ID NO: 2318412 - RNA, 22 nt, Yersinia pestis KIM
ucauuuccguuaacccaaagcc

SEQ ID NO: 2318413 - RNA, 20 nt, Yersinia pestis KIM
ucauuugcucgauuucacuu

SEQ ID NO: 2318414 - RNA, 22 nt, Yersinia pestis KIM
ucauuuguugcugaugcgccca

SEQ ID NO: 2318415 - RNA, 13 nt, Yersinia pestis KIM
ucauuuuaaaaaa

SEQ ID NO: 2318416 - RNA, 22 nt, Yersinia pestis KIM
ucauuuuaaaaaaauuaaaaua

SEQ ID NO: 2318417 - RNA, 16 nt, Yersinia pestis KIM
ucauuuuaacaauuuu

SEQ ID NO: 2318418 - RNA, 18 nt, Yersinia pestis KIM
ucauuuuuaaguggcauc

SEQ ID NO: 2318419 - RNA, 12 nt, Yersinia pestis KIM
uccaaccaaccu

SEQ ID NO: 2318420 - RNA, 13 nt, Yersinia pestis KIM
uccaaccaaccau

SEQ ID NO: 2318421 - RNA, 16 nt, Yersinia pestis KIM
uccaacaucucgccaa

SEQ ID NO: 2318422 - RNA, 13 nt, Yersinia pestis KIM
uccaacucaccuu

SEQ ID NO: 2318423 - RNA, 17 nt, Yersinia pestis KIM
uccaacgcacaccccca

SEQ ID NO: 2318424 - RNA, 20 nt, Yersinia pestis KIM
uccaaaugacagcaucaaua

SEQ ID NO: 2318425 - RNA, 12 nt, Yersinia pestis KIM
uccaacaacugc

SEQ ID NO: 2318426 - RNA, 12 nt, Yersinia pestis KIM
uccaaaggaagg

SEQ ID NO: 2318427 - RNA, 23 nt, Yersinia pestis KIM
ucauuuuuugggaugaaaaauac

SEQ ID NO: 2318428 - RNA, 15 nt, Yersinia pestis KIM
uccaaaaaacugcgg

SEQ ID NO: 2318429 - RNA, 18 nt, Yersinia pestis KIM
ucauuuuucuugccuuuu

SEQ ID NO: 2318430 - RNA, 16 nt, Yersinia pestis KIM
uccaaaauugcauuag

SEQ ID NO: 2318431 - RNA, 15 nt, Yersinia pestis KIM
uccaaacuuugugga

SEQ ID NO: 2318432 - RNA, 17 nt, Yersinia pestis KIM
ucauucccgagauaacc

SEQ ID NO: 2318433 - RNA, 16 nt, Yersinia pestis KIM
ucauucauuuuaaaaa

SEQ ID NO: 2318434 - RNA, 19 nt, Yersinia pestis KIM
ucauucaucaccuuaucca

SEQ ID NO: 2318435 - RNA, 17 nt, Yersinia pestis KIM
ucauuccgccuguuuuc

SEQ ID NO: 2318436 - RNA, 13 nt, Yersinia pestis KIM
ucauugacgugca

SEQ ID NO: 2318437 - RNA, 21 nt, Yersinia pestis KIM
ucauugaggguugucagcagu

SEQ ID NO: 2318438 - RNA, 23 nt, Yersinia pestis KIM
ucauugaggagcgauaacauuuu

SEQ ID NO: 2318439 - RNA, 22 nt, Yersinia pestis KIM
ucauugagaucaguucaguauu

SEQ ID NO: 2318440 - RNA, 21 nt, Yersinia pestis KIM
ucauugauauuaacuggucua

SEQ ID NO: 2318441 - RNA, 23 nt, Yersinia pestis KIM
ucauuauuaaacuugcucuuuca

SEQ ID NO: 2318442 - RNA, 14 nt, Yersinia pestis KIM
ucauuauuaaacug

SEQ ID NO: 2318443 - RNA, 16 nt, Yersinia pestis KIM
ucauuauuaaacugau

SEQ ID NO: 2318444 - RNA, 20 nt, Yersinia pestis KIM
ucauuauuaaacuugcucuu

SEQ ID NO: 2318445 - RNA, 12 nt, Yersinia pestis KIM
ucauuauuuuca

SEQ ID NO: 2318446 - RNA, 22 nt, Yersinia pestis KIM
ucauuauuuucaaccaguuaga

SEQ ID NO: 2318447 - RNA, 13 nt, Yersinia pestis KIM
ucauuauuuucac

SEQ ID NO: 2318448 - RNA, 18 nt, Yersinia pestis KIM
ucauuauggauaauuuaa

SEQ ID NO: 2318449 - RNA, 19 nt, Yersinia pestis KIM
ucauuauggauaauuuaau

SEQ ID NO: 2318450 - RNA, 13 nt, Yersinia pestis KIM
ucauuagucugag

SEQ ID NO: 2318451 - RNA, 18 nt, Yersinia pestis KIM
ucauggccugaugcaccu

SEQ ID NO: 2318452 - RNA, 21 nt, Yersinia pestis KIM
ucauggccugaugcaccucag

SEQ ID NO: 2318453 - RNA, 20 nt, Yersinia pestis KIM
ucauggcacgcuuaaucuuu

SEQ ID NO: 2318454 - RNA, 21 nt, Yersinia pestis KIM
ucauggccaugaaucaaauua

SEQ ID NO: 2318455 - RNA, 14 nt, Yersinia pestis KIM
ucauguagccauug

SEQ ID NO: 2318456 - RNA, 15 nt, Yersinia pestis KIM
ucauguaaggcaaua

SEQ ID NO: 2318457 - RNA, 12 nt, Yersinia pestis KIM
ucauguaacaca

SEQ ID NO: 2318458 - RNA, 13 nt, Yersinia pestis KIM
ucauuaaaaccac

SEQ ID NO: 2318459 - RNA, 19 nt, Yersinia pestis KIM
ucauuaaaugcuuuuugcg

SEQ ID NO: 2318460 - RNA, 19 nt, Yersinia pestis KIM
ucauuaacacaucuauuuu

SEQ ID NO: 2318461 - RNA, 18 nt, Yersinia pestis KIM
ucauuaacuguuaaaaca

SEQ ID NO: 2318462 - RNA, 23 nt, Yersinia pestis KIM
ucauuaagaauccucugaauaaa

SEQ ID NO: 2318463 - RNA, 18 nt, Yersinia pestis KIM
ucauuaauuucaccacau

SEQ ID NO: 2318464 - RNA, 15 nt, Yersinia pestis KIM
ucauuacaucaucuu

SEQ ID NO: 2318465 - RNA, 16 nt, Yersinia pestis KIM
ucauuaccaauaccau

SEQ ID NO: 2318466 - RNA, 14 nt, Yersinia pestis KIM
ucauuaauggcaaa

SEQ ID NO: 2318467 - RNA, 14 nt, Yersinia pestis KIM
ucauuacacugaau

SEQ ID NO: 2318468 - RNA, 13 nt, Yersinia pestis KIM
ucaugcucacaau

SEQ ID NO: 2318469 - RNA, 18 nt, Yersinia pestis KIM
ucaugcugaaucuguaag

SEQ ID NO: 2318470 - RNA, 17 nt, Yersinia pestis KIM
ucaugcuguagcagccu

SEQ ID NO: 2318471 - RNA, 20 nt, Yersinia pestis KIM
ucaugcuguagcagccugua

SEQ ID NO: 2318472 - RNA, 15 nt, Yersinia pestis KIM
ucaucuuuuucugcc

SEQ ID NO: 2318473 - RNA, 18 nt, Yersinia pestis KIM
ucaucuuuuucugccuga

SEQ ID NO: 2318474 - RNA, 14 nt, Yersinia pestis KIM
ucaucuuuuuuaau

SEQ ID NO: 2318475 - RNA, 21 nt, Yersinia pestis KIM
ucaugaaaaaugagcaauuca

SEQ ID NO: 2318476 - RNA, 22 nt, Yersinia pestis KIM
ucaucuuuuuuuuuauuaucau

SEQ ID NO: 2318477 - RNA, 18 nt, Yersinia pestis KIM
ucaucuuucucauuagcg

SEQ ID NO: 2318478 - RNA, 13 nt, Yersinia pestis KIM
ucaucuuuuucug

SEQ ID NO: 2318479 - RNA, 15 nt, Yersinia pestis KIM
ucaucuuuugcuauu

SEQ ID NO: 2318480 - RNA, 16 nt, Yersinia pestis KIM
ucaugaaugaggcuga

SEQ ID NO: 2318481 - RNA, 13 nt, Yersinia pestis KIM
ucaugacaaaaau

SEQ ID NO: 2318482 - RNA, 12 nt, Yersinia pestis KIM
ucaugaggcagu

SEQ ID NO: 2318483 - RNA, 16 nt, Yersinia pestis KIM
ucaugacaucccagca

SEQ ID NO: 2318484 - RNA, 23 nt, Yersinia pestis KIM
ucaucugguuuuuuuauaaauua

SEQ ID NO: 2318485 - RNA, 18 nt, Yersinia pestis KIM
ucaucuggugagaacacg

SEQ ID NO: 2318486 - RNA, 13 nt, Yersinia pestis KIM
ucaucuucuucau

SEQ ID NO: 2318487 - RNA, 17 nt, Yersinia pestis KIM
ucaucuucuucauccca

SEQ ID NO: 2318488 - RNA, 20 nt, Yersinia pestis KIM
ucaucuuauuucaccgguaa

SEQ ID NO: 2318489 - RNA, 17 nt, Yersinia pestis KIM
ucaucuuuaauaauaga

SEQ ID NO: 2318490 - RNA, 20 nt, Yersinia pestis KIM
ucaucgggguuugucagcag

SEQ ID NO: 2318491 - RNA, 21 nt, Yersinia pestis KIM
ucaucgggguuugucagcagu

SEQ ID NO: 2318492 - RNA, 16 nt, Yersinia pestis KIM
ucaucgggguuuguca

SEQ ID NO: 2318493 - RNA, 21 nt, Yersinia pestis KIM
ucaucggggguugucugcaga

SEQ ID NO: 2318494 - RNA, 22 nt, Yersinia pestis KIM
ucaucggggguugucugcagaa

SEQ ID NO: 2318495 - RNA, 17 nt, Yersinia pestis KIM
ucaucggcaaaaacagu

SEQ ID NO: 2318496 - RNA, 17 nt, Yersinia pestis KIM
ucaucgcuugaucacga

SEQ ID NO: 2318497 - RNA, 20 nt, Yersinia pestis KIM
ucaucuaauuuucucagaaa

SEQ ID NO: 2318498 - RNA, 17 nt, Yersinia pestis KIM
ucaucuacaacaucauc

SEQ ID NO: 2318499 - RNA, 19 nt, Yersinia pestis KIM
ucaucuacaacaucaucgu

SEQ ID NO: 2318500 - RNA, 14 nt, Yersinia pestis KIM
ucauccucauugag

SEQ ID NO: 2318501 - RNA, 23 nt, Yersinia pestis KIM
ucaucgacuugaugaaguuauuu

SEQ ID NO: 2318502 - RNA, 19 nt, Yersinia pestis KIM
ucaucgagaauaaauauuc

SEQ ID NO: 2318503 - RNA, 16 nt, Yersinia pestis KIM
ucaucgacucuuuuug

SEQ ID NO: 2318504 - RNA, 22 nt, Yersinia pestis KIM
ucaucgcaccauaaccaaucca

SEQ ID NO: 2318505 - RNA, 20 nt, Yersinia pestis KIM
ucaucgccaaagccgucagu

SEQ ID NO: 2318506 - RNA, 14 nt, Yersinia pestis KIM
ucaucgcaccauaa

SEQ ID NO: 2318507 - RNA, 21 nt, Yersinia pestis KIM
ucaucgccgcaaauuaacaca

SEQ ID NO: 2318508 - RNA, 17 nt, Yersinia pestis KIM
ucaucgcggaugccuuu

SEQ ID NO: 2318509 - RNA, 20 nt, Yersinia pestis KIM
ucaucgcuaacccucaguaa

SEQ ID NO: 2318510 - RNA, 18 nt, Yersinia pestis KIM
ucaucgcggguuuuuaac

SEQ ID NO: 2318511 - RNA, 19 nt, Yersinia pestis KIM
ucaucgcggguuuuuaacu

SEQ ID NO: 2318512 - RNA, 20 nt, Yersinia pestis KIM
ucaucgcugagggccaugcc

SEQ ID NO: 2318513 - RNA, 17 nt, Yersinia pestis KIM
ucaucgcucaucgccaa

SEQ ID NO: 2318514 - RNA, 17 nt, Yersinia pestis KIM
ucauccguaaaaaaccu

SEQ ID NO: 2318515 - RNA, 14 nt, Yersinia pestis KIM
ucauccguaaaaaa

SEQ ID NO: 2318516 - RNA, 21 nt, Yersinia pestis KIM
ucauccuaccgccagcugacc

SEQ ID NO: 2318517 - RNA, 16 nt, Yersinia pestis KIM
ucauccgcucagcaaa

SEQ ID NO: 2318518 - RNA, 19 nt, Yersinia pestis KIM
ucauccgcucagcaaaaau

SEQ ID NO: 2318519 - RNA, 23 nt, Yersinia pestis KIM
ucaucccaaucaucaucccaguc

SEQ ID NO: 2318520 - RNA, 16 nt, Yersinia pestis KIM
ucaucccaaucaucau

SEQ ID NO: 2318521 - RNA, 13 nt, Yersinia pestis KIM
ucauccagcucaa

SEQ ID NO: 2318522 - RNA, 19 nt, Yersinia pestis KIM
ucauccaguuuggcugcca

SEQ ID NO: 2318523 - RNA, 15 nt, Yersinia pestis KIM
ucaucauuaauggca

SEQ ID NO: 2318524 - RNA, 18 nt, Yersinia pestis KIM
ucaucauggauaaagccu

SEQ ID NO: 2318525 - RNA, 23 nt, Yersinia pestis KIM
ucaucaugguucugcucaauagc

SEQ ID NO: 2318526 - RNA, 13 nt, Yersinia pestis KIM
ucaucauuuuuua

SEQ ID NO: 2318527 - RNA, 23 nt, Yersinia pestis KIM
ucauccaacuuaccuugauccgc

SEQ ID NO: 2318528 - RNA, 19 nt, Yersinia pestis KIM
ucaucaucuuuaauaauag

SEQ ID NO: 2318529 - RNA, 13 nt, Yersinia pestis KIM
ucaucauccauca

SEQ ID NO: 2318530 - RNA, 23 nt, Yersinia pestis KIM
ucaucaucaauggauucuugcug

SEQ ID NO: 2318531 - RNA, 13 nt, Yersinia pestis KIM
ucaucauauucaa

SEQ ID NO: 2318532 - RNA, 14 nt, Yersinia pestis KIM
ucaucaguaaaaua

SEQ ID NO: 2318533 - RNA, 13 nt, Yersinia pestis KIM
ucaucaccauuca

SEQ ID NO: 2318534 - RNA, 22 nt, Yersinia pestis KIM
ucaucaauuggcagcggcaaau

SEQ ID NO: 2318535 - RNA, 22 nt, Yersinia pestis KIM
ucaucacauucaaacacuuaug

SEQ ID NO: 2318536 - RNA, 17 nt, Yersinia pestis KIM
ucaucaccuuccaaacu

SEQ ID NO: 2318537 - RNA, 12 nt, Yersinia pestis KIM
ucaucagcagag

SEQ ID NO: 2318538 - RNA, 18 nt, Yersinia pestis KIM
ucaucagcaagugauaga

SEQ ID NO: 2318539 - RNA, 20 nt, Yersinia pestis KIM
ucagcgcuuggcucuggagc

SEQ ID NO: 2318540 - RNA, 21 nt, Yersinia pestis KIM
ucagcgcuuggcucuggagcu

SEQ ID NO: 2318541 - RNA, 23 nt, Yersinia pestis KIM
ucagcgcuuuuucgggaaaaaau

SEQ ID NO: 2318542 - RNA, 23 nt, Yersinia pestis KIM
ucagcggagcugacgucagaucg

SEQ ID NO: 2318543 - RNA, 14 nt, Yersinia pestis KIM
ucagcgcuggcuuu

SEQ ID NO: 2318544 - RNA, 14 nt, Yersinia pestis KIM
ucagcgcuuggcuc

SEQ ID NO: 2318545 - RNA, 17 nt, Yersinia pestis KIM
ucagcguggaauuaaua

SEQ ID NO: 2318546 - RNA, 20 nt, Yersinia pestis KIM
ucagcguuggaugaguuuga

SEQ ID NO: 2318547 - RNA, 22 nt, Yersinia pestis KIM
ucagcgugacguuaucucaacc

SEQ ID NO: 2318548 - RNA, 16 nt, Yersinia pestis KIM
ucagcgucuucaauua

SEQ ID NO: 2318549 - RNA, 14 nt, Yersinia pestis KIM
ucagcgucagcaga

SEQ ID NO: 2318550 - RNA, 14 nt, Yersinia pestis KIM
ucagcgguagcaaa

SEQ ID NO: 2318551 - RNA, 14 nt, Yersinia pestis KIM
ucagcgguugaaaa

SEQ ID NO: 2318552 - RNA, 18 nt, Yersinia pestis KIM
ucagcgguugaaaaguuu

SEQ ID NO: 2318553 - RNA, 15 nt, Yersinia pestis KIM
uaucuuccauagaua

SEQ ID NO: 2318554 - RNA, 17 nt, Yersinia pestis KIM
ucagcgccuuugccccg

SEQ ID NO: 2318555 - RNA, 21 nt, Yersinia pestis KIM
ucaggaaggcggccacugagg

SEQ ID NO: 2318556 - RNA, 13 nt, Yersinia pestis KIM
ucaggaagagaaa

SEQ ID NO: 2318557 - RNA, 20 nt, Yersinia pestis KIM
ucagcuucagcucuucuaac

SEQ ID NO: 2318558 - RNA, 21 nt, Yersinia pestis KIM
ucagcuugcaacaaaauggcc

SEQ ID NO: 2318559 - RNA, 22 nt, Yersinia pestis KIM
ucagcugguuagagcacagcac

SEQ ID NO: 2318560 - RNA, 15 nt, Yersinia pestis KIM
ucagcugacgcagca

SEQ ID NO: 2318561 - RNA, 15 nt, Yersinia pestis KIM
ucagcucuucuaaca

SEQ ID NO: 2318562 - RNA, 21 nt, Yersinia pestis KIM
ucagcucuucuaacacuucau

SEQ ID NO: 2318563 - RNA, 20 nt, Yersinia pestis KIM
ucagcguuuugaucaucaaa

SEQ ID NO: 2318564 - RNA, 15 nt, Yersinia pestis KIM
ucagcucauuaaacu

SEQ ID NO: 2318565 - RNA, 18 nt, Yersinia pestis KIM
ucagggccagcauaguaa

SEQ ID NO: 2318566 - RNA, 22 nt, Yersinia pestis KIM
ucagggccacuucgguggcccu

SEQ ID NO: 2318567 - RNA, 18 nt, Yersinia pestis KIM
ucagggcgucucuacgac

SEQ ID NO: 2318568 - RNA, 21 nt, Yersinia pestis KIM
ucaggcucaucaccuuccaaa

SEQ ID NO: 2318569 - RNA, 21 nt, Yersinia pestis KIM
ucagggagccaauagaggcuc

SEQ ID NO: 2318570 - RNA, 23 nt, Yersinia pestis KIM
ucagggagccaauagaggcuccc

SEQ ID NO: 2318571 - RNA, 18 nt, Yersinia pestis KIM
ucaggcuguugacauaaa

SEQ ID NO: 2318572 - RNA, 23 nt, Yersinia pestis KIM
ucaggugaguaaauaccuucaga

SEQ ID NO: 2318573 - RNA, 15 nt, Yersinia pestis KIM
ucagguucaauuccc

SEQ ID NO: 2318574 - RNA, 16 nt, Yersinia pestis KIM
ucagguguuguauaac

SEQ ID NO: 2318575 - RNA, 22 nt, Yersinia pestis KIM
ucagguaagcagagaauuucaa

SEQ ID NO: 2318576 - RNA, 17 nt, Yersinia pestis KIM
ucagguaccccauaaau

SEQ ID NO: 2318577 - RNA, 21 nt, Yersinia pestis KIM
ucagguaaaccgguuaaaaca

SEQ ID NO: 2318578 - RNA, 18 nt, Yersinia pestis KIM
ucaggauaggcaccggca

SEQ ID NO: 2318579 - RNA, 23 nt, Yersinia pestis KIM
ucaggauuggagucaugaggcag

SEQ ID NO: 2318580 - RNA, 11 nt, Yersinia pestis KIM
ucaggaugaac

SEQ ID NO: 2318581 - RNA, 17 nt, Yersinia pestis KIM
ucaggcauaucacuauu

SEQ ID NO: 2318582 - RNA, 15 nt, Yersinia pestis KIM
ucaggcauuacagac

SEQ ID NO: 2318583 - RNA, 18 nt, Yersinia pestis KIM
ucaggcauuacagacugg

SEQ ID NO: 2318584 - RNA, 15 nt, Yersinia pestis KIM
ucaggccagagacac

SEQ ID NO: 2318585 - RNA, 18 nt, Yersinia pestis KIM
ucauagcgaauaauggca

SEQ ID NO: 2318586 - RNA, 22 nt, Yersinia pestis KIM
ucauagcuaaaugacauauugu

SEQ ID NO: 2318587 - RNA, 20 nt, Yersinia pestis KIM
ucauagcuacgggcaaacuc

SEQ ID NO: 2318588 - RNA, 17 nt, Yersinia pestis KIM
ucauagugauaaaaaga

SEQ ID NO: 2318589 - RNA, 16 nt, Yersinia pestis KIM
ucauacucccccauuu

SEQ ID NO: 2318590 - RNA, 19 nt, Yersinia pestis KIM
ucauacucccccauuuccu

SEQ ID NO: 2318591 - RNA, 18 nt, Yersinia pestis KIM
ucauacggcgauauuuau

SEQ ID NO: 2318592 - RNA, 23 nt, Yersinia pestis KIM
ucauaaucagggauggcgauagu

SEQ ID NO: 2318593 - RNA, 19 nt, Yersinia pestis KIM
ucauaccauucucugucuu

SEQ ID NO: 2318594 - RNA, 22 nt, Yersinia pestis KIM
ucauaccggcggcacacuggau

SEQ ID NO: 2318595 - RNA, 13 nt, Yersinia pestis KIM
ucauacaucauuu

SEQ ID NO: 2318596 - RNA, 18 nt, Yersinia pestis KIM
ucauacacggucuggcaa

SEQ ID NO: 2318597 - RNA, 16 nt, Yersinia pestis KIM
ucauacacaugaaaau

SEQ ID NO: 2318598 - RNA, 21 nt, Yersinia pestis KIM
ucauauucaugguuucaaaau

SEQ ID NO: 2318599 - RNA, 18 nt, Yersinia pestis KIM
ucauaugacaaauaaggc

SEQ ID NO: 2318600 - RNA, 20 nt, Yersinia pestis KIM
ucauaucccagcgucuucug

SEQ ID NO: 2318601 - RNA, 14 nt, Yersinia pestis KIM
ucauaucaaaauaa

SEQ ID NO: 2318602 - RNA, 13 nt, Yersinia pestis KIM
ucauauauuaaau

SEQ ID NO: 2318603 - RNA, 22 nt, Yersinia pestis KIM
ucauauacaccgcaccacgauu

SEQ ID NO: 2318604 - RNA, 11 nt, Yersinia pestis KIM
ucauauaagcg

SEQ ID NO: 2318605 - RNA, 17 nt, Yersinia pestis KIM
ucaucaaaggcaauacc

SEQ ID NO: 2318606 - RNA, 20 nt, Yersinia pestis KIM
ucaucaauggauucuugcug

SEQ ID NO: 2318607 - RNA, 22 nt, Yersinia pestis KIM
ucaucaauggauucuugcugca

SEQ ID NO: 2318608 - RNA, 15 nt, Yersinia pestis KIM
ucaucaauaccgaaa

SEQ ID NO: 2318609 - RNA, 23 nt, Yersinia pestis KIM
ucaucaagauggucauaaauagg

SEQ ID NO: 2318610 - RNA, 20 nt, Yersinia pestis KIM
ucaguuuacaugauugaaaa

SEQ ID NO: 2318611 - RNA, 14 nt, Yersinia pestis KIM
ucaguuuagcgaga

SEQ ID NO: 2318612 - RNA, 16 nt, Yersinia pestis KIM
ucaguuggccaccauu

SEQ ID NO: 2318613 - RNA, 13 nt, Yersinia pestis KIM
ucaguugaaaccc

SEQ ID NO: 2318614 - RNA, 22 nt, Yersinia pestis KIM
ucagugugugugcgcugaguga

SEQ ID NO: 2318615 - RNA, 17 nt, Yersinia pestis KIM
ucaguuuuaauuuauga

SEQ ID NO: 2318616 - RNA, 13 nt, Yersinia pestis KIM
ucaguuuuaauuu

SEQ ID NO: 2318617 - RNA, 14 nt, Yersinia pestis KIM
ucauaaaaauacau

SEQ ID NO: 2318618 - RNA, 15 nt, Yersinia pestis KIM
ucauaaaaagcaccg

SEQ ID NO: 2318619 - RNA, 17 nt, Yersinia pestis KIM
ucauaaauuaaaacuga

SEQ ID NO: 2318620 - RNA, 15 nt, Yersinia pestis KIM
ucauaaauaaagaua

SEQ ID NO: 2318621 - RNA, 12 nt, Yersinia pestis KIM
ucauaaauauug

SEQ ID NO: 2318622 - RNA, 20 nt, Yersinia pestis KIM
ucaguacaccgauaaaagug

SEQ ID NO: 2318623 - RNA, 23 nt, Yersinia pestis KIM
ucaguacgcuaaccaucaccaca

SEQ ID NO: 2318624 - RNA, 18 nt, Yersinia pestis KIM
ucaguagcgucaguuuca

SEQ ID NO: 2318625 - RNA, 22 nt, Yersinia pestis KIM
ucaguaucagcgauuuuaaaaa

SEQ ID NO: 2318626 - RNA, 18 nt, Yersinia pestis KIM
ucaguagucaauacaauu

SEQ ID NO: 2318627 - RNA, 17 nt, Yersinia pestis KIM
ucaguaucuuuccagcc

SEQ ID NO: 2318628 - RNA, 16 nt, Yersinia pestis KIM
ucagguugaggcaggg

SEQ ID NO: 2318629 - RNA, 19 nt, Yersinia pestis KIM
ucagguugaaauaaauaag

SEQ ID NO: 2318630 - RNA, 19 nt, Yersinia pestis KIM
ucagguuuacgccauacau

SEQ ID NO: 2318631 - RNA, 23 nt, Yersinia pestis KIM
ucagguuucaguuggccaccauu

SEQ ID NO: 2318632 - RNA, 15 nt, Yersinia pestis KIM
ucaguaaagcuuuca

SEQ ID NO: 2318633 - RNA, 17 nt, Yersinia pestis KIM
ucaguaauucacccuuu

SEQ ID NO: 2318634 - RNA, 22 nt, Yersinia pestis KIM
ucagugauucgggugagugagc

SEQ ID NO: 2318635 - RNA, 18 nt, Yersinia pestis KIM
ucagugauuuuaaccacu

SEQ ID NO: 2318636 - RNA, 18 nt, Yersinia pestis KIM
ucagugauaacaacccua

SEQ ID NO: 2318637 - RNA, 22 nt, Yersinia pestis KIM
ucagugagcauuuuguuaccca

SEQ ID NO: 2318638 - RNA, 13 nt, Yersinia pestis KIM
ucaguggcuggaa

SEQ ID NO: 2318639 - RNA, 20 nt, Yersinia pestis KIM
ucagugucaguucgacaccu

SEQ ID NO: 2318640 - RNA, 21 nt, Yersinia pestis KIM
ucagugucaguucgacaccuu

SEQ ID NO: 2318641 - RNA, 23 nt, Yersinia pestis KIM
ucaguggugguagauacaauuca

SEQ ID NO: 2318642 - RNA, 16 nt, Yersinia pestis KIM
ucagugucaguucgac

SEQ ID NO: 2318643 - RNA, 17 nt, Yersinia pestis KIM
ucagucagggugaaagc

SEQ ID NO: 2318644 - RNA, 18 nt, Yersinia pestis KIM
ucagucgcgauaaaauuc

SEQ ID NO: 2318645 - RNA, 12 nt, Yersinia pestis KIM
ggcacuggaugu

SEQ ID NO: 2318646 - RNA, 17 nt, Yersinia pestis KIM
ggcacuggaaacaaaac

SEQ ID NO: 2318647 - RNA, 18 nt, Yersinia pestis KIM
ggcacggaucucauucag

SEQ ID NO: 2318648 - RNA, 14 nt, Yersinia pestis KIM
ggcaccguggauaa

SEQ ID NO: 2318649 - RNA, 19 nt, Yersinia pestis KIM
ggcaccgugggcaaagaau

SEQ ID NO: 2318650 - RNA, 14 nt, Yersinia pestis KIM
ggcaauggcucagg

SEQ ID NO: 2318651 - RNA, 21 nt, Yersinia pestis KIM
ggcaauggcucaggcucauca

SEQ ID NO: 2318652 - RNA, 21 nt, Yersinia pestis KIM
ggcaauuaucuuauccacagc

SEQ ID NO: 2318653 - RNA, 14 nt, Yersinia pestis KIM
ggcaagcucugggc

SEQ ID NO: 2318654 - RNA, 16 nt, Yersinia pestis KIM
ggcaagcaagcaaagc

SEQ ID NO: 2318655 - RNA, 14 nt, Yersinia pestis KIM
ggcaagauuucucu

SEQ ID NO: 2318656 - RNA, 22 nt, Yersinia pestis KIM
ggcaagaacaccgucaguaugg

SEQ ID NO: 2318657 - RNA, 20 nt, Yersinia pestis KIM
ggcaacucuagcgccagcaa

SEQ ID NO: 2318658 - RNA, 21 nt, Yersinia pestis KIM
ggcaacucuagcgccagcaau

SEQ ID NO: 2318659 - RNA, 15 nt, Yersinia pestis KIM
ggcaauaaaggcaag

SEQ ID NO: 2318660 - RNA, 20 nt, Yersinia pestis KIM
ggcaauacaccgccaguaug

SEQ ID NO: 2318661 - RNA, 13 nt, Yersinia pestis KIM
ggcaauaauucag

SEQ ID NO: 2318662 - RNA, 17 nt, Yersinia pestis KIM
ggcaaucuccaguaaau

SEQ ID NO: 2318663 - RNA, 19 nt, Yersinia pestis KIM
ggcaaucuggaaggcggcc

SEQ ID NO: 2318664 - RNA, 20 nt, Yersinia pestis KIM
ggaugccggaaucagccaga

SEQ ID NO: 2318665 - RNA, 14 nt, Yersinia pestis KIM
ggauggcccaagcc

SEQ ID NO: 2318666 - RNA, 16 nt, Yersinia pestis KIM
ggauuagcuucugcua

SEQ ID NO: 2318667 - RNA, 20 nt, Yersinia pestis KIM
ggauuggagucaugaggcag

SEQ ID NO: 2318668 - RNA, 15 nt, Yersinia pestis KIM
ggauuaugugcggca

SEQ ID NO: 2318669 - RNA, 11 nt, Yersinia pestis KIM
ggauugcugcc

SEQ ID NO: 2318670 - RNA, 23 nt, Yersinia pestis KIM
ggaucaccaggcucucauauccc

SEQ ID NO: 2318671 - RNA, 17 nt, Yersinia pestis KIM
ggaucaaguuagcaggc

SEQ ID NO: 2318672 - RNA, 17 nt, Yersinia pestis KIM
ggaucucaggugugagg

SEQ ID NO: 2318673 - RNA, 14 nt, Yersinia pestis KIM
ggaucucacccaca

SEQ ID NO: 2318674 - RNA, 23 nt, Yersinia pestis KIM
ggaucugcacaccacacuggaug

SEQ ID NO: 2318675 - RNA, 18 nt, Yersinia pestis KIM
ggaugaucaacagugagg

SEQ ID NO: 2318676 - RNA, 23 nt, Yersinia pestis KIM
ggcaaaaacagucauuaacacau

SEQ ID NO: 2318677 - RNA, 14 nt, Yersinia pestis KIM
ggauuuucaaauca

SEQ ID NO: 2318678 - RNA, 23 nt, Yersinia pestis KIM
ggauuuauuagagauaaauagcc

SEQ ID NO: 2318679 - RNA, 17 nt, Yersinia pestis KIM
ggcaaagucugguggug

SEQ ID NO: 2318680 - RNA, 22 nt, Yersinia pestis KIM
ggcaaccagcguucuaucaaug

SEQ ID NO: 2318681 - RNA, 23 nt, Yersinia pestis KIM
ggcaaauugcgagcugagcuuau

SEQ ID NO: 2318682 - RNA, 24 nt, Yersinia pestis KIM
ggcaacaaaaucgcgaccagcaga

SEQ ID NO: 2318683 - RNA, 17 nt, Yersinia pestis KIM
ggcaaauucaacaauca

SEQ ID NO: 2318684 - RNA, 19 nt, Yersinia pestis KIM
ggcaaccgguaacauauaa

SEQ ID NO: 2318685 - RNA, 20 nt, Yersinia pestis KIM
ggcaacgaaggcaacaacac

SEQ ID NO: 2318686 - RNA, 19 nt, Yersinia pestis KIM
ggacgaauacacagcgaga

SEQ ID NO: 2318687 - RNA, 15 nt, Yersinia pestis KIM
ggacagcaaccacuu

SEQ ID NO: 2318688 - RNA, 19 nt, Yersinia pestis KIM
ggacagauuauuucagcuu

SEQ ID NO: 2318689 - RNA, 19 nt, Yersinia pestis KIM
ggacagcgcgcagccaacg

SEQ ID NO: 2318690 - RNA, 17 nt, Yersinia pestis KIM
ggacauuuagcacuguu

SEQ ID NO: 2318691 - RNA, 18 nt, Yersinia pestis KIM
ggacauuuuacucccuga

SEQ ID NO: 2318692 - RNA, 21 nt, Yersinia pestis KIM
ggaaguacuuauuugaaacac

SEQ ID NO: 2318693 - RNA, 16 nt, Yersinia pestis KIM
gcucggcucgaaccug

SEQ ID NO: 2318694 - RNA, 18 nt, Yersinia pestis KIM
ggacaaauaaaacagaac

SEQ ID NO: 2318695 - RNA, 23 nt, Yersinia pestis KIM
ggacaacuucacuucagaaccga

SEQ ID NO: 2318696 - RNA, 14 nt, Yersinia pestis KIM
ggaaugacuuucag

SEQ ID NO: 2318697 - RNA, 15 nt, Yersinia pestis KIM
ggaaucuaccgcaga

SEQ ID NO: 2318698 - RNA, 22 nt, Yersinia pestis KIM
ggaauaaguguguguauuuaaa

SEQ ID NO: 2318699 - RNA, 11 nt, Yersinia pestis KIM
ggaucaacaug

SEQ ID NO: 2318700 - RNA, 13 nt, Yersinia pestis KIM
ggaucaacauggu

SEQ ID NO: 2318701 - RNA, 16 nt, Yersinia pestis KIM
ggauagcggcuaaagg

SEQ ID NO: 2318702 - RNA, 12 nt, Yersinia pestis KIM
ggauagccccug

SEQ ID NO: 2318703 - RNA, 13 nt, Yersinia pestis KIM
ggagucagggagu

SEQ ID NO: 2318704 - RNA, 15 nt, Yersinia pestis KIM
ggagucagggaguca

SEQ ID NO: 2318705 - RNA, 19 nt, Yersinia pestis KIM
ggagucagggagucaggga

SEQ ID NO: 2318706 - RNA, 18 nt, Yersinia pestis KIM
ggagguugccgguuuauu

SEQ ID NO: 2318707 - RNA, 19 nt, Yersinia pestis KIM
ggaggcacgugccgcuggg

SEQ ID NO: 2318708 - RNA, 19 nt, Yersinia pestis KIM
ggaggagauuucagacugc

SEQ ID NO: 2318709 - RNA, 21 nt, Yersinia pestis KIM
ggaggagauuucagacugcug

SEQ ID NO: 2318710 - RNA, 16 nt, Yersinia pestis KIM
ggaggagguagcaaca

SEQ ID NO: 2318711 - RNA, 13 nt, Yersinia pestis KIM
ggaggaugguaaa

SEQ ID NO: 2318712 - RNA, 16 nt, Yersinia pestis KIM
ggacgacggguauauu

SEQ ID NO: 2318713 - RNA, 17 nt, Yersinia pestis KIM
ggacucuuaguuucuac

SEQ ID NO: 2318714 - RNA, 22 nt, Yersinia pestis KIM
ggagauugcuacugaagguuau

SEQ ID NO: 2318715 - RNA, 19 nt, Yersinia pestis KIM
ggagaucgcucucacccug

SEQ ID NO: 2318716 - RNA, 17 nt, Yersinia pestis KIM
ggagauaguuaucuccc

SEQ ID NO: 2318717 - RNA, 21 nt, Yersinia pestis KIM
ggacuucugcgaccugaucca

SEQ ID NO: 2318718 - RNA, 14 nt, Yersinia pestis KIM
ggagaaacauuaaa

SEQ ID NO: 2318719 - RNA, 23 nt, Yersinia pestis KIM
ggacuuacccuacccauuauaaa

SEQ ID NO: 2318720 - RNA, 19 nt, Yersinia pestis KIM
ggccgccgcggugaagaac

SEQ ID NO: 2318721 - RNA, 20 nt, Yersinia pestis KIM
ggccgccgcggugaagaaca

SEQ ID NO: 2318722 - RNA, 16 nt, Yersinia pestis KIM
ggccgcaugcaacaga

SEQ ID NO: 2318723 - RNA, 20 nt, Yersinia pestis KIM
ggccccuaaugcgcucacca

SEQ ID NO: 2318724 - RNA, 19 nt, Yersinia pestis KIM
ggccccuaaugcgcucacc

SEQ ID NO: 2318725 - RNA, 20 nt, Yersinia pestis KIM
ggccgcuacugguaauaaug

SEQ ID NO: 2318726 - RNA, 14 nt, Yersinia pestis KIM
ggccgcuugccaau

SEQ ID NO: 2318727 - RNA, 23 nt, Yersinia pestis KIM
ggcagaaaagcaaaggcccgcua

SEQ ID NO: 2318728 - RNA, 14 nt, Yersinia pestis KIM
ggcagaaguccuga

SEQ ID NO: 2318729 - RNA, 18 nt, Yersinia pestis KIM
ggcauaaauaauaaauaa

SEQ ID NO: 2318730 - RNA, 17 nt, Yersinia pestis KIM
ggcaucaaugaaaauau

SEQ ID NO: 2318731 - RNA, 21 nt, Yersinia pestis KIM
ggcaguuuuuuauggcauaaa

SEQ ID NO: 2318732 - RNA, 22 nt, Yersinia pestis KIM
ggcaguucauuccccaucgcca

SEQ ID NO: 2318733 - RNA, 23 nt, Yersinia pestis KIM
ggcaucaccgcuaucacugauau

SEQ ID NO: 2318734 - RNA, 12 nt, Yersinia pestis KIM
ggcaugcaacuu

SEQ ID NO: 2318735 - RNA, 22 nt, Yersinia pestis KIM
ggcauuggauaauuugccuggc

SEQ ID NO: 2318736 - RNA, 22 nt, Yersinia pestis KIM
ggcauuuuuuauguuuauauuc

SEQ ID NO: 2318737 - RNA, 19 nt, Yersinia pestis KIM
ggcauuuuuauuuaccgaa

SEQ ID NO: 2318738 - RNA, 13 nt, Yersinia pestis KIM
ggcauuuuuugcc

SEQ ID NO: 2318739 - RNA, 23 nt, Yersinia pestis KIM
ggcauuuuuugccagauaaaaau

SEQ ID NO: 2318740 - RNA, 14 nt, Yersinia pestis KIM
ggccaacaggcccc

SEQ ID NO: 2318741 - RNA, 17 nt, Yersinia pestis KIM
ggccaaguuuacuuugu

SEQ ID NO: 2318742 - RNA, 15 nt, Yersinia pestis KIM
ggccagugcgccggc

SEQ ID NO: 2318743 - RNA, 18 nt, Yersinia pestis KIM
ggcccaaaugagcagcaa

SEQ ID NO: 2318744 - RNA, 17 nt, Yersinia pestis KIM
ggcccaauaaaagguag

SEQ ID NO: 2318745 - RNA, 14 nt, Yersinia pestis KIM
ggcccaagccaucc

SEQ ID NO: 2318746 - RNA, 18 nt, Yersinia pestis KIM
ggcccaagccauccuuuu

SEQ ID NO: 2318747 - RNA, 15 nt, Yersinia pestis KIM
ggccaauaggccccu

SEQ ID NO: 2318748 - RNA, 22 nt, Yersinia pestis KIM
ggccaauagaaaaacacuggca

SEQ ID NO: 2318749 - RNA, 16 nt, Yersinia pestis KIM
ggccaauuuggccaau

SEQ ID NO: 2318750 - RNA, 19 nt, Yersinia pestis KIM
ggccaauuuggccaauaau

SEQ ID NO: 2318751 - RNA, 18 nt, Yersinia pestis KIM
ggccacaauaaaauaagc

SEQ ID NO: 2318752 - RNA, 22 nt, Yersinia pestis KIM
ggccaauuggcuuaacucgcca

SEQ ID NO: 2318753 - RNA, 21 nt, Yersinia pestis KIM
ggccaccaaauugcggccagu

SEQ ID NO: 2318754 - RNA, 14 nt, Yersinia pestis KIM
ggccacucaccuca

SEQ ID NO: 2318755 - RNA, 16 nt, Yersinia pestis KIM
ggccacuucgguggcc

SEQ ID NO: 2318756 - RNA, 22 nt, Yersinia pestis KIM
ggccacuucgguggcccuuauu

SEQ ID NO: 2318757 - RNA, 12 nt, Yersinia pestis KIM
ggcggccagcaa

SEQ ID NO: 2318758 - RNA, 21 nt, Yersinia pestis KIM
ggcggcauaauccucaaccug

SEQ ID NO: 2318759 - RNA, 19 nt, Yersinia pestis KIM
ggcggauauaaaagugagc

SEQ ID NO: 2318760 - RNA, 14 nt, Yersinia pestis KIM
ggcggcgagcacug

SEQ ID NO: 2318761 - RNA, 19 nt, Yersinia pestis KIM
ggcggcguuagccgcccuu

SEQ ID NO: 2318762 - RNA, 14 nt, Yersinia pestis KIM
ggcgcggcucgagc

SEQ ID NO: 2318763 - RNA, 20 nt, Yersinia pestis KIM
ggcgcuaagccauuaaacgu

SEQ ID NO: 2318764 - RNA, 13 nt, Yersinia pestis KIM
ggcgcuaaugaga

SEQ ID NO: 2318765 - RNA, 12 nt, Yersinia pestis KIM
ggcggcucgccu

SEQ ID NO: 2318766 - RNA, 22 nt, Yersinia pestis KIM
ggcgguccuccugccccuacgg

SEQ ID NO: 2318767 - RNA, 13 nt, Yersinia pestis KIM
ggcgucagccgcg

SEQ ID NO: 2318768 - RNA, 14 nt, Yersinia pestis KIM
ggcguauaaacaga

SEQ ID NO: 2318769 - RNA, 19 nt, Yersinia pestis KIM
ggcguauaucguuggugcg

SEQ ID NO: 2318770 - RNA, 20 nt, Yersinia pestis KIM
ggcgguuaaucggaugguca

SEQ ID NO: 2318771 - RNA, 20 nt, Yersinia pestis KIM
ggcgguucauauuggccagu

SEQ ID NO: 2318772 - RNA, 17 nt, Yersinia pestis KIM
ggcgguucgagcggcau

SEQ ID NO: 2318773 - RNA, 14 nt, Yersinia pestis KIM
ggcgguucgcugaa

SEQ ID NO: 2318774 - RNA, 22 nt, Yersinia pestis KIM
ggcguaccauaguuuuucuccu

SEQ ID NO: 2318775 - RNA, 23 nt, Yersinia pestis KIM
ggcguuaauauaacaauguuuau

SEQ ID NO: 2318776 - RNA, 19 nt, Yersinia pestis KIM
ggcuaaaacucaaauagau

SEQ ID NO: 2318777 - RNA, 18 nt, Yersinia pestis KIM
ggcuaaaacucaaauaga

SEQ ID NO: 2318778 - RNA, 12 nt, Yersinia pestis KIM
ggcguucuguca

SEQ ID NO: 2318779 - RNA, 14 nt, Yersinia pestis KIM
ggcguugaugacua

SEQ ID NO: 2318780 - RNA, 22 nt, Yersinia pestis KIM
ggcuagcguuuacuuuaaauuu

SEQ ID NO: 2318781 - RNA, 15 nt, Yersinia pestis KIM
ggcuauauugcugag

SEQ ID NO: 2318782 - RNA, 12 nt, Yersinia pestis KIM
ggcuaucaucaa

SEQ ID NO: 2318783 - RNA, 17 nt, Yersinia pestis KIM
ggcuaucaucaaaggca

SEQ ID NO: 2318784 - RNA, 20 nt, Yersinia pestis KIM
ggcuaucuuaugacgcugca

SEQ ID NO: 2318785 - RNA, 21 nt, Yersinia pestis KIM
ggcuaauagcgucagucuugc

SEQ ID NO: 2318786 - RNA, 21 nt, Yersinia pestis KIM
ggcgauacaacguaggccgag

SEQ ID NO: 2318787 - RNA, 22 nt, Yersinia pestis KIM
ggcgaugaccgauuauaugaau

SEQ ID NO: 2318788 - RNA, 17 nt, Yersinia pestis KIM
ggcgauuucagcugcuu

SEQ ID NO: 2318789 - RNA, 23 nt, Yersinia pestis KIM
ggcgcaagaguuagggcuggaug

SEQ ID NO: 2318790 - RNA, 17 nt, Yersinia pestis KIM
ggcgcacguucccaggc

SEQ ID NO: 2318791 - RNA, 17 nt, Yersinia pestis KIM
ggcgcacugauucucuu

SEQ ID NO: 2318792 - RNA, 19 nt, Yersinia pestis KIM
ggcgcauauccugauagga

SEQ ID NO: 2318793 - RNA, 20 nt, Yersinia pestis KIM
ggcgcaguuagugccuaucu

SEQ ID NO: 2318794 - RNA, 17 nt, Yersinia pestis KIM
ggcgacugugcuuugcc

SEQ ID NO: 2318795 - RNA, 14 nt, Yersinia pestis KIM
ggcgagauggucau

SEQ ID NO: 2318796 - RNA, 15 nt, Yersinia pestis KIM
ggcgaaugcccugcu

SEQ ID NO: 2318797 - RNA, 20 nt, Yersinia pestis KIM
ggcgacaauauuccaaaaaa

SEQ ID NO: 2318798 - RNA, 12 nt, Yersinia pestis KIM
ggcgaacagaaa

SEQ ID NO: 2318799 - RNA, 14 nt, Yersinia pestis KIM
ggccucuucuuuua

SEQ ID NO: 2318800 - RNA, 14 nt, Yersinia pestis KIM
ggccgugaccaccg

SEQ ID NO: 2318801 - RNA, 19 nt, Yersinia pestis KIM
ggccgugaccaccgcagca

SEQ ID NO: 2318802 - RNA, 21 nt, Yersinia pestis KIM
ggccuacggaggucaaaugag

SEQ ID NO: 2318803 - RNA, 23 nt, Yersinia pestis KIM
ggccugcugugucgcuauuuccg

SEQ ID NO: 2318804 - RNA, 20 nt, Yersinia pestis KIM
ggccuggguagacauggcaa

SEQ ID NO: 2318805 - RNA, 22 nt, Yersinia pestis KIM
ggccuguuugcagcgaauugac

SEQ ID NO: 2318806 - RNA, 16 nt, Yersinia pestis KIM
gucaggaacccauuug

SEQ ID NO: 2318807 - RNA, 18 nt, Yersinia pestis KIM
gucagggagucagggagu

SEQ ID NO: 2318808 - RNA, 19 nt, Yersinia pestis KIM
gucagcagucugacaccgg

SEQ ID NO: 2318809 - RNA, 15 nt, Yersinia pestis KIM
gucagccccugccag

SEQ ID NO: 2318810 - RNA, 15 nt, Yersinia pestis KIM
gucagcaugaauggc

SEQ ID NO: 2318811 - RNA, 19 nt, Yersinia pestis KIM
gucagcgguaucccacugg

SEQ ID NO: 2318812 - RNA, 15 nt, Yersinia pestis KIM
gucagucagggugaa

SEQ ID NO: 2318813 - RNA, 13 nt, Yersinia pestis KIM
gucaguccaaaau

SEQ ID NO: 2318814 - RNA, 16 nt, Yersinia pestis KIM
gucagugguuuuauca

SEQ ID NO: 2318815 - RNA, 15 nt, Yersinia pestis KIM
gucagugcuccaucu

SEQ ID NO: 2318816 - RNA, 13 nt, Yersinia pestis KIM
gucaguuauaaaa

SEQ ID NO: 2318817 - RNA, 14 nt, Yersinia pestis KIM
gucaguucacgaau

SEQ ID NO: 2318818 - RNA, 16 nt, Yersinia pestis KIM
gucaguuguucaccua

SEQ ID NO: 2318819 - RNA, 16 nt, Yersinia pestis KIM
gucaguaauucacccu

SEQ ID NO: 2318820 - RNA, 21 nt, Yersinia pestis KIM
gucaguaacuggauauuuuua

SEQ ID NO: 2318821 - RNA, 19 nt, Yersinia pestis KIM
gucauaaauaaagauaccc

SEQ ID NO: 2318822 - RNA, 20 nt, Yersinia pestis KIM
gucauacaaaaugagccugu

SEQ ID NO: 2318823 - RNA, 14 nt, Yersinia pestis KIM
gucauaaucaggga

SEQ ID NO: 2318824 - RNA, 19 nt, Yersinia pestis KIM
gucaugauagacagcaaac

SEQ ID NO: 2318825 - RNA, 16 nt, Yersinia pestis KIM
gucaugcaauuacugc

SEQ ID NO: 2318826 - RNA, 19 nt, Yersinia pestis KIM
gucaugaugaauacgauaa

SEQ ID NO: 2318827 - RNA, 22 nt, Yersinia pestis KIM
gucauuaacguuguuauuucug

SEQ ID NO: 2318828 - RNA, 17 nt, Yersinia pestis KIM
gucauuaacuguuaaaa

SEQ ID NO: 2318829 - RNA, 13 nt, Yersinia pestis KIM
gucauuaacacau

SEQ ID NO: 2318830 - RNA, 14 nt, Yersinia pestis KIM
gucauuaauuucac

SEQ ID NO: 2318831 - RNA, 20 nt, Yersinia pestis KIM
gucauguugaccaaacagaa

SEQ ID NO: 2318832 - RNA, 15 nt, Yersinia pestis KIM
gucagauaucugcuc

SEQ ID NO: 2318833 - RNA, 21 nt, Yersinia pestis KIM
gucagaugcugacgggcgcgg

SEQ ID NO: 2318834 - RNA, 20 nt, Yersinia pestis KIM
gucagauuagucuuagacgu

SEQ ID NO: 2318835 - RNA, 19 nt, Yersinia pestis KIM
gucagauuaguuuuagaug

SEQ ID NO: 2318836 - RNA, 14 nt, Yersinia pestis KIM
gucagcaaaucaaa

SEQ ID NO: 2318837 - RNA, 13 nt, Yersinia pestis KIM
gucagaaauaaau

SEQ ID NO: 2318838 - RNA, 13 nt, Yersinia pestis KIM
gucagaaccugca

SEQ ID NO: 2318839 - RNA, 18 nt, Yersinia pestis KIM
gucacugccugcacaaau

SEQ ID NO: 2318840 - RNA, 17 nt, Yersinia pestis KIM
gucacuguucuugaugg

SEQ ID NO: 2318841 - RNA, 20 nt, Yersinia pestis KIM
gucacuuaaauaacucagug

SEQ ID NO: 2318842 - RNA, 16 nt, Yersinia pestis KIM
gucacuaaaacugaag

SEQ ID NO: 2318843 - RNA, 17 nt, Yersinia pestis KIM
gucacuaaaacugaagc

SEQ ID NO: 2318844 - RNA, 14 nt, Yersinia pestis KIM
gucacucagaaaac

SEQ ID NO: 2318845 - RNA, 17 nt, Yersinia pestis KIM
gucacggaaagcagguc

SEQ ID NO: 2318846 - RNA, 22 nt, Yersinia pestis KIM
gucacgcggcggcgucaaauua

SEQ ID NO: 2318847 - RNA, 17 nt, Yersinia pestis KIM
gucaccgccaaaugaaa

SEQ ID NO: 2318848 - RNA, 16 nt, Yersinia pestis KIM
gucaauuaaaauugcu

SEQ ID NO: 2318849 - RNA, 16 nt, Yersinia pestis KIM
gucaauguucucuggg

SEQ ID NO: 2318850 - RNA, 17 nt, Yersinia pestis KIM
gucaaggugauuucaaa

SEQ ID NO: 2318851 - RNA, 14 nt, Yersinia pestis KIM
gucaacuaaacaga

SEQ ID NO: 2318852 - RNA, 15 nt, Yersinia pestis KIM
gucaagccaaccccc

SEQ ID NO: 2318853 - RNA, 18 nt, Yersinia pestis KIM
gucaaccugcguaaacaa

SEQ ID NO: 2318854 - RNA, 11 nt, Yersinia pestis KIM
guauauuuaug

SEQ ID NO: 2318855 - RNA, 23 nt, Yersinia pestis KIM
guauauuaucauucaagaaaaug

SEQ ID NO: 2318856 - RNA, 16 nt, Yersinia pestis KIM
guauuuuucgcaguaa

SEQ ID NO: 2318857 - RNA, 19 nt, Yersinia pestis KIM
gucaaaacuauuuauuuua

SEQ ID NO: 2318858 - RNA, 13 nt, Yersinia pestis KIM
gucaaaagaaacu

SEQ ID NO: 2318859 - RNA, 18 nt, Yersinia pestis KIM
guauacaauugccugauu

SEQ ID NO: 2318860 - RNA, 17 nt, Yersinia pestis KIM
guauaucacuauuucag

SEQ ID NO: 2318861 - RNA, 17 nt, Yersinia pestis KIM
guauauacccuaaauaa

SEQ ID NO: 2318862 - RNA, 20 nt, Yersinia pestis KIM
guauauacccuaaauaauuc

SEQ ID NO: 2318863 - RNA, 20 nt, Yersinia pestis KIM
gucauucccgagauaaccac

SEQ ID NO: 2318864 - RNA, 13 nt, Yersinia pestis KIM
gucauucacugug

SEQ ID NO: 2318865 - RNA, 14 nt, Yersinia pestis KIM
gucauuuacugaug

SEQ ID NO: 2318866 - RNA, 21 nt, Yersinia pestis KIM
gucauuuccguuaacccaaag

SEQ ID NO: 2318867 - RNA, 17 nt, Yersinia pestis KIM
gucauuguagauggcca

SEQ ID NO: 2318868 - RNA, 16 nt, Yersinia pestis KIM
guccauaauucugugu

SEQ ID NO: 2318869 - RNA, 21 nt, Yersinia pestis KIM
guccccgagaggcuauuuauc

SEQ ID NO: 2318870 - RNA, 23 nt, Yersinia pestis KIM
guccugauucgcgaccagcagaa

SEQ ID NO: 2318871 - RNA, 14 nt, Yersinia pestis KIM
gucgccucuggggc

SEQ ID NO: 2318872 - RNA, 20 nt, Yersinia pestis KIM
gucgcgggcacuuugucaau

SEQ ID NO: 2318873 - RNA, 20 nt, Yersinia pestis KIM
gucgccaacauuuauuuauc

SEQ ID NO: 2318874 - RNA, 13 nt, Yersinia pestis KIM
gucgccaccccau

SEQ ID NO: 2318875 - RNA, 17 nt, Yersinia pestis KIM
gucgccauaauuaaggu

SEQ ID NO: 2318876 - RNA, 15 nt, Yersinia pestis KIM
gucgaggaucaccac

SEQ ID NO: 2318877 - RNA, 20 nt, Yersinia pestis KIM
gucgaucccaauauuaaaau

SEQ ID NO: 2318878 - RNA, 14 nt, Yersinia pestis KIM
guacccauuauucu

SEQ ID NO: 2318879 - RNA, 19 nt, Yersinia pestis KIM
guaccaaucuccaaugacc

SEQ ID NO: 2318880 - RNA, 14 nt, Yersinia pestis KIM
guaccaaugucuca

SEQ ID NO: 2318881 - RNA, 15 nt, Yersinia pestis KIM
guaccaucgacuggc

SEQ ID NO: 2318882 - RNA, 16 nt, Yersinia pestis KIM
guaccaucgacuggcc

SEQ ID NO: 2318883 - RNA, 21 nt, Yersinia pestis KIM
guacccguaggcccacaauca

SEQ ID NO: 2318884 - RNA, 13 nt, Yersinia pestis KIM
guaccgcagguca

SEQ ID NO: 2318885 - RNA, 16 nt, Yersinia pestis KIM
guaccggauacaccgu

SEQ ID NO: 2318886 - RNA, 16 nt, Yersinia pestis KIM
guaaucguauucucaa

SEQ ID NO: 2318887 - RNA, 22 nt, Yersinia pestis KIM
guaaugcuguuguagcgccagg

SEQ ID NO: 2318888 - RNA, 17 nt, Yersinia pestis KIM
guaauggcgauaauauu

SEQ ID NO: 2318889 - RNA, 17 nt, Yersinia pestis KIM
guaauggcgcacauuac

SEQ ID NO: 2318890 - RNA, 12 nt, Yersinia pestis KIM
guaccaaauaac

SEQ ID NO: 2318891 - RNA, 15 nt, Yersinia pestis KIM
guacauuaaaugaau

SEQ ID NO: 2318892 - RNA, 18 nt, Yersinia pestis KIM
guaaugguuuauuuaacu

SEQ ID NO: 2318893 - RNA, 21 nt, Yersinia pestis KIM
guaaugguuuauuuaacuguu

SEQ ID NO: 2318894 - RNA, 19 nt, Yersinia pestis KIM
guagacgucauaaaaagca

SEQ ID NO: 2318895 - RNA, 19 nt, Yersinia pestis KIM
guagacgacacaaaugcug

SEQ ID NO: 2318896 - RNA, 17 nt, Yersinia pestis KIM
guacuccccggcccaga

SEQ ID NO: 2318897 - RNA, 18 nt, Yersinia pestis KIM
guacugggaugaagaaau

SEQ ID NO: 2318898 - RNA, 20 nt, Yersinia pestis KIM
guacuggcgcgcuuuggauc

SEQ ID NO: 2318899 - RNA, 22 nt, Yersinia pestis KIM
guacuuccaauaagugauucga

SEQ ID NO: 2318900 - RNA, 16 nt, Yersinia pestis KIM
guacuugacgcugcag

SEQ ID NO: 2318901 - RNA, 20 nt, Yersinia pestis KIM
guacuguugaugcagaugac

SEQ ID NO: 2318902 - RNA, 12 nt, Yersinia pestis KIM
guacuguugaug

SEQ ID NO: 2318903 - RNA, 18 nt, Yersinia pestis KIM
guacuguuaguucagacg

SEQ ID NO: 2318904 - RNA, 14 nt, Yersinia pestis KIM
guaccguugagaac

SEQ ID NO: 2318905 - RNA, 13 nt, Yersinia pestis KIM
guacgcuggccag

SEQ ID NO: 2318906 - RNA, 15 nt, Yersinia pestis KIM
guacuaccaaaacgu

SEQ ID NO: 2318907 - RNA, 23 nt, Yersinia pestis KIM
guacucauauuguccaaaggaag

SEQ ID NO: 2318908 - RNA, 20 nt, Yersinia pestis KIM
guacguagcgauaacagaua

SEQ ID NO: 2318909 - RNA, 15 nt, Yersinia pestis KIM
guacggugccagcag

SEQ ID NO: 2318910 - RNA, 17 nt, Yersinia pestis KIM
guacggugccagcagca

SEQ ID NO: 2318911 - RNA, 21 nt, Yersinia pestis KIM
guagggauaaaucgcccaacc

SEQ ID NO: 2318912 - RNA, 13 nt, Yersinia pestis KIM
guagggauaaauc

SEQ ID NO: 2318913 - RNA, 23 nt, Yersinia pestis KIM
guaggggccaccaaauaaaacaa

SEQ ID NO: 2318914 - RNA, 13 nt, Yersinia pestis KIM
guaggcaucugcc

SEQ ID NO: 2318915 - RNA, 21 nt, Yersinia pestis KIM
guaggcaauacaccgccagua

SEQ ID NO: 2318916 - RNA, 15 nt, Yersinia pestis KIM
guaggcaacuaagcu

SEQ ID NO: 2318917 - RNA, 21 nt, Yersinia pestis KIM
guaggcaacuaagcugccuca

SEQ ID NO: 2318918 - RNA, 20 nt, Yersinia pestis KIM
guaggccacccccauaacca

SEQ ID NO: 2318919 - RNA, 14 nt, Yersinia pestis KIM
guauaaaaauagcc

SEQ ID NO: 2318920 - RNA, 16 nt, Yersinia pestis KIM
guauaaaaauagccuu

SEQ ID NO: 2318921 - RNA, 23 nt, Yersinia pestis KIM
guauaaaaauagccuuccuuggc

SEQ ID NO: 2318922 - RNA, 12 nt, Yersinia pestis KIM
guauaaaaauag

SEQ ID NO: 2318923 - RNA, 12 nt, Yersinia pestis KIM
guaguuuugcau

SEQ ID NO: 2318924 - RNA, 16 nt, Yersinia pestis KIM
guauaaauagccugua

SEQ ID NO: 2318925 - RNA, 12 nt, Yersinia pestis KIM
guauaacucauc

SEQ ID NO: 2318926 - RNA, 19 nt, Yersinia pestis KIM
guaguguguuuucuuguau

SEQ ID NO: 2318927 - RNA, 11 nt, Yersinia pestis KIM
guaguggggcu

SEQ ID NO: 2318928 - RNA, 19 nt, Yersinia pestis KIM
guagugaagauaauaacgg

SEQ ID NO: 2318929 - RNA, 14 nt, Yersinia pestis KIM
guagguuucugggc

SEQ ID NO: 2318930 - RNA, 13 nt, Yersinia pestis KIM
guaguaaccacac

SEQ ID NO: 2318931 - RNA, 20 nt, Yersinia pestis KIM
guaaacaacacauucccauu

SEQ ID NO: 2318932 - RNA, 13 nt, Yersinia pestis KIM
guaaaaugccuuu

SEQ ID NO: 2318933 - RNA, 12 nt, Yersinia pestis KIM
guaaaauaccaa

SEQ ID NO: 2318934 - RNA, 10 nt, Yersinia pestis KIM
guaaaauauu

SEQ ID NO: 2318935 - RNA, 22 nt, Yersinia pestis KIM
gguuaacggucucuuucgggca

SEQ ID NO: 2318936 - RNA, 13 nt, Yersinia pestis KIM
gguuaaacugacc

SEQ ID NO: 2318937 - RNA, 12 nt, Yersinia pestis KIM
gguuaaaacaga

SEQ ID NO: 2318938 - RNA, 22 nt, Yersinia pestis KIM
gguuaaaacagauaaaaaauaa

SEQ ID NO: 2318939 - RNA, 14 nt, Yersinia pestis KIM
gguguuuggugaag

SEQ ID NO: 2318940 - RNA, 18 nt, Yersinia pestis KIM
guaaaccgguuaaaacag

SEQ ID NO: 2318941 - RNA, 21 nt, Yersinia pestis KIM
guaaaccuaacacguuaaauu

SEQ ID NO: 2318942 - RNA, 19 nt, Yersinia pestis KIM
guaaacagacacagcaaca

SEQ ID NO: 2318943 - RNA, 21 nt, Yersinia pestis KIM
guaaacuuggccgauaugaag

SEQ ID NO: 2318944 - RNA, 16 nt, Yersinia pestis KIM
guaaagcaggccuucu

SEQ ID NO: 2318945 - RNA, 23 nt, Yersinia pestis KIM
guaaagcaaauucccaccauaau

SEQ ID NO: 2318946 - RNA, 17 nt, Yersinia pestis KIM
guaacacacagcagaca

SEQ ID NO: 2318947 - RNA, 20 nt, Yersinia pestis KIM
guaacacacagcagacagcg

SEQ ID NO: 2318948 - RNA, 16 nt, Yersinia pestis KIM
guaacauauccugugc

SEQ ID NO: 2318949 - RNA, 22 nt, Yersinia pestis KIM
guaacagagcagaaagcagcag

SEQ ID NO: 2318950 - RNA, 21 nt, Yersinia pestis KIM
guaacacuucagacugaaagu

SEQ ID NO: 2318951 - RNA, 19 nt, Yersinia pestis KIM
guaacacuugaccaaccug

SEQ ID NO: 2318952 - RNA, 21 nt, Yersinia pestis KIM
guaaauguacagucauuuacu

SEQ ID NO: 2318953 - RNA, 23 nt, Yersinia pestis KIM
guaaauuauuuuccagaugaaua

SEQ ID NO: 2318954 - RNA, 14 nt, Yersinia pestis KIM
guaaauuagccacu

SEQ ID NO: 2318955 - RNA, 22 nt, Yersinia pestis KIM
guaaauucgggcuuuaauacaa

SEQ ID NO: 2318956 - RNA, 12 nt, Yersinia pestis KIM
guaaauuccuau

SEQ ID NO: 2318957 - RNA, 18 nt, Yersinia pestis KIM
guaaauugcgagucucau

SEQ ID NO: 2318958 - RNA, 13 nt, Yersinia pestis KIM
guaaauuuauuua

SEQ ID NO: 2318959 - RNA, 18 nt, Yersinia pestis KIM
guaaauagucauauauuu

SEQ ID NO: 2318960 - RNA, 13 nt, Yersinia pestis KIM
guaaauauaaaau

SEQ ID NO: 2318961 - RNA, 13 nt, Yersinia pestis KIM
guaaauaucauau

SEQ ID NO: 2318962 - RNA, 15 nt, Yersinia pestis KIM
guaaaucaggccggu

SEQ ID NO: 2318963 - RNA, 16 nt, Yersinia pestis KIM
guaaagguuucugccu

SEQ ID NO: 2318964 - RNA, 17 nt, Yersinia pestis KIM
guaacuuacaggcugcc

SEQ ID NO: 2318965 - RNA, 18 nt, Yersinia pestis KIM
guaacuuaaucuguucac

SEQ ID NO: 2318966 - RNA, 20 nt, Yersinia pestis KIM
guaacguccaacugacgcca

SEQ ID NO: 2318967 - RNA, 17 nt, Yersinia pestis KIM
guaacguccaacugacg

SEQ ID NO: 2318968 - RNA, 13 nt, Yersinia pestis KIM
guaacuaaagccg

SEQ ID NO: 2318969 - RNA, 19 nt, Yersinia pestis KIM
guaacuaccugcuuuacca

SEQ ID NO: 2318970 - RNA, 20 nt, Yersinia pestis KIM
guaagaaagagaugacccaa

SEQ ID NO: 2318971 - RNA, 13 nt, Yersinia pestis KIM
guaacuuuucggg

SEQ ID NO: 2318972 - RNA, 17 nt, Yersinia pestis KIM
guaagaccaauugguaa

SEQ ID NO: 2318973 - RNA, 16 nt, Yersinia pestis KIM
guaagaauaaauaaua

SEQ ID NO: 2318974 - RNA, 18 nt, Yersinia pestis KIM
guaacgccgcuaaaucau

SEQ ID NO: 2318975 - RNA, 20 nt, Yersinia pestis KIM
guaacgggucucaaugcagu

SEQ ID NO: 2318976 - RNA, 17 nt, Yersinia pestis KIM
guaacauuacuuugaau

SEQ ID NO: 2318977 - RNA, 22 nt, Yersinia pestis KIM
guaaccggcuaggcucagcaug

SEQ ID NO: 2318978 - RNA, 14 nt, Yersinia pestis KIM
guaagugauucggg

SEQ ID NO: 2318979 - RNA, 21 nt, Yersinia pestis KIM
guaagugauucgggugaguga

SEQ ID NO: 2318980 - RNA, 17 nt, Yersinia pestis KIM
guaaguuggcaucagcu

SEQ ID NO: 2318981 - RNA, 12 nt, Yersinia pestis KIM
guaagugauucg

SEQ ID NO: 2318982 - RNA, 18 nt, Yersinia pestis KIM
guaauaaaucaugucccu

SEQ ID NO: 2318983 - RNA, 22 nt, Yersinia pestis KIM
guaaucaacacauaaaaucagc

SEQ ID NO: 2318984 - RNA, 20 nt, Yersinia pestis KIM
guaaucaacacauaaaauca

SEQ ID NO: 2318985 - RNA, 14 nt, Yersinia pestis KIM
guaaucaaacauaa

SEQ ID NO: 2318986 - RNA, 16 nt, Yersinia pestis KIM
guaauauuuuguugcu

SEQ ID NO: 2318987 - RNA, 23 nt, Yersinia pestis KIM
guaauaguuaaucgcagcagaga

SEQ ID NO: 2318988 - RNA, 13 nt, Yersinia pestis KIM
guaauaucaccau

SEQ ID NO: 2318989 - RNA, 20 nt, Yersinia pestis KIM
guaauaucgguaaaaaauca

SEQ ID NO: 2318990 - RNA, 14 nt, Yersinia pestis KIM
guaauaguaaaaca

SEQ ID NO: 2318991 - RNA, 19 nt, Yersinia pestis KIM
guaauagcuuaaucaucau

SEQ ID NO: 2318992 - RNA, 18 nt, Yersinia pestis KIM
guaauagcaaaaaaaaag

SEQ ID NO: 2318993 - RNA, 21 nt, Yersinia pestis KIM
guaagcgcuggcuuaauuggc

SEQ ID NO: 2318994 - RNA, 19 nt, Yersinia pestis KIM
guaagcgguuuguuaaaaa

SEQ ID NO: 2318995 - RNA, 21 nt, Yersinia pestis KIM
guaagccgugccugcuggcaa

SEQ ID NO: 2318996 - RNA, 20 nt, Yersinia pestis KIM
guaagccuucaaccugaauc

SEQ ID NO: 2318997 - RNA, 18 nt, Yersinia pestis KIM
guaagccgugccugcugg

SEQ ID NO: 2318998 - RNA, 15 nt, Yersinia pestis KIM
guaaggucaguucac

SEQ ID NO: 2318999 - RNA, 18 nt, Yersinia pestis KIM
guaagcucuacuaauauu

SEQ ID NO: 2319000 - RNA, 23 nt, Yersinia pestis KIM
guaagcuuugugcaaaauacaaa

SEQ ID NO: 2319001 - RNA, 15 nt, Yersinia pestis KIM
guaaggcaauaccaa

SEQ ID NO: 2319002 - RNA, 15 nt, Yersinia pestis KIM
guaaggccaaacccg

SEQ ID NO: 2319003 - RNA, 22 nt, Yersinia pestis KIM
ggucgacaaaaugugaaaagca

SEQ ID NO: 2319004 - RNA, 18 nt, Yersinia pestis KIM
ggucgcacugugagcggc

SEQ ID NO: 2319005 - RNA, 16 nt, Yersinia pestis KIM
ggucgauuacauacuu

SEQ ID NO: 2319006 - RNA, 18 nt, Yersinia pestis KIM
ggucgccgugcugcucgg

SEQ ID NO: 2319007 - RNA, 21 nt, Yersinia pestis KIM
ggucgcuugagguuauugaca

SEQ ID NO: 2319008 - RNA, 19 nt, Yersinia pestis KIM
ggucgucucuugcaaugaa

SEQ ID NO: 2319009 - RNA, 13 nt, Yersinia pestis KIM
ggugaaaaaauau

SEQ ID NO: 2319010 - RNA, 15 nt, Yersinia pestis KIM
ggugaagaaaccuaa

SEQ ID NO: 2319011 - RNA, 15 nt, Yersinia pestis KIM
ggugagugagcgcgg

SEQ ID NO: 2319012 - RNA, 14 nt, Yersinia pestis KIM
ggugauacaucucg

SEQ ID NO: 2319013 - RNA, 18 nt, Yersinia pestis KIM
ggugauauucgcccgcug

SEQ ID NO: 2319014 - RNA, 14 nt, Yersinia pestis KIM
ggugacuauuuaaa

SEQ ID NO: 2319015 - RNA, 20 nt, Yersinia pestis KIM
ggugacggcuuuauaguccu

SEQ ID NO: 2319016 - RNA, 22 nt, Yersinia pestis KIM
ggugcgccacuguucuuaucac

SEQ ID NO: 2319017 - RNA, 22 nt, Yersinia pestis KIM
ggugaucaucauccgccugcgu

SEQ ID NO: 2319018 - RNA, 13 nt, Yersinia pestis KIM
ggugcuauuucug

SEQ ID NO: 2319019 - RNA, 19 nt, Yersinia pestis KIM
ggugcuaccucguaguaau

SEQ ID NO: 2319020 - RNA, 15 nt, Yersinia pestis KIM
ggugcgggccagaau

SEQ ID NO: 2319021 - RNA, 14 nt, Yersinia pestis KIM
gguggcucaaucca

SEQ ID NO: 2319022 - RNA, 20 nt, Yersinia pestis KIM
ggguuaaccagaagaacagc

SEQ ID NO: 2319023 - RNA, 14 nt, Yersinia pestis KIM
ggguucaaggaaac

SEQ ID NO: 2319024 - RNA, 20 nt, Yersinia pestis KIM
ggguuauaggccuaaacccc

SEQ ID NO: 2319025 - RNA, 15 nt, Yersinia pestis KIM
ggguuccaacugaua

SEQ ID NO: 2319026 - RNA, 23 nt, Yersinia pestis KIM
ggguucaguaaagcuuucagcuu

SEQ ID NO: 2319027 - RNA, 20 nt, Yersinia pestis KIM
ggguuucauccccaccaggu

SEQ ID NO: 2319028 - RNA, 21 nt, Yersinia pestis KIM
ggguuucauccccaccaggua

SEQ ID NO: 2319029 - RNA, 18 nt, Yersinia pestis KIM
ggguuuaauucaggccaa

SEQ ID NO: 2319030 - RNA, 18 nt, Yersinia pestis KIM
gguaacuuacaggcugcc

SEQ ID NO: 2319031 - RNA, 14 nt, Yersinia pestis KIM
gguaacggaagggg

SEQ ID NO: 2319032 - RNA, 18 nt, Yersinia pestis KIM
gguaacgcagaaauauuc

SEQ ID NO: 2319033 - RNA, 15 nt, Yersinia pestis KIM
gguaagguaaagaaa

SEQ ID NO: 2319034 - RNA, 13 nt, Yersinia pestis KIM
gguaagccuuucu

SEQ ID NO: 2319035 - RNA, 16 nt, Yersinia pestis KIM
gguaagccuuucucca

SEQ ID NO: 2319036 - RNA, 20 nt, Yersinia pestis KIM
gguaaauuccguaccaguug

SEQ ID NO: 2319037 - RNA, 17 nt, Yersinia pestis KIM
gguaacaaggcaaauag

SEQ ID NO: 2319038 - RNA, 11 nt, Yersinia pestis KIM
gguaaaacugc

SEQ ID NO: 2319039 - RNA, 21 nt, Yersinia pestis KIM
gguaaaaucacguuuccaaaa

SEQ ID NO: 2319040 - RNA, 23 nt, Yersinia pestis KIM
gguaaaaucacguuuccaaaacu

SEQ ID NO: 2319041 - RNA, 16 nt, Yersinia pestis KIM
ggguaucagcgaccaa

SEQ ID NO: 2319042 - RNA, 16 nt, Yersinia pestis KIM
ggguauuccacccgca

SEQ ID NO: 2319043 - RNA, 17 nt, Yersinia pestis KIM
ggguauugaagauaccc

SEQ ID NO: 2319044 - RNA, 11 nt, Yersinia pestis KIM
ggguaucuguu

SEQ ID NO: 2319045 - RNA, 15 nt, Yersinia pestis KIM
gggucagggcggcgg

SEQ ID NO: 2319046 - RNA, 14 nt, Yersinia pestis KIM
gggucgguaaccug

SEQ ID NO: 2319047 - RNA, 21 nt, Yersinia pestis KIM
gggugacgcuggcacuggaug

SEQ ID NO: 2319048 - RNA, 22 nt, Yersinia pestis KIM
gggugagucucagggaugaagc

SEQ ID NO: 2319049 - RNA, 13 nt, Yersinia pestis KIM
gggugagugaaca

SEQ ID NO: 2319050 - RNA, 22 nt, Yersinia pestis KIM
gggugagugaacauagcuaaca

SEQ ID NO: 2319051 - RNA, 19 nt, Yersinia pestis KIM
gguauggcgcuuaacugca

SEQ ID NO: 2319052 - RNA, 20 nt, Yersinia pestis KIM
gguaucucccgcaaagccug

SEQ ID NO: 2319053 - RNA, 15 nt, Yersinia pestis KIM
gguaucuggagccau

SEQ ID NO: 2319054 - RNA, 18 nt, Yersinia pestis KIM
ggucacccucaagagcga

SEQ ID NO: 2319055 - RNA, 18 nt, Yersinia pestis KIM
gguauucagccaaaucau

SEQ ID NO: 2319056 - RNA, 19 nt, Yersinia pestis KIM
ggucagccaacgacaggua

SEQ ID NO: 2319057 - RNA, 17 nt, Yersinia pestis KIM
gguagugacucaucaaa

SEQ ID NO: 2319058 - RNA, 13 nt, Yersinia pestis KIM
gguagugacucau

SEQ ID NO: 2319059 - RNA, 15 nt, Yersinia pestis KIM
gguagugacucauca

SEQ ID NO: 2319060 - RNA, 15 nt, Yersinia pestis KIM
gguagucauauucag

SEQ ID NO: 2319061 - RNA, 16 nt, Yersinia pestis KIM
gguagguauaauuauu

SEQ ID NO: 2319062 - RNA, 17 nt, Yersinia pestis KIM
gguaccugaucagcauu

SEQ ID NO: 2319063 - RNA, 16 nt, Yersinia pestis KIM
gguaccugcaucauca

SEQ ID NO: 2319064 - RNA, 20 nt, Yersinia pestis KIM
gguaccgggccauagcccau

SEQ ID NO: 2319065 - RNA, 15 nt, Yersinia pestis KIM
gguaccgcaggucag

SEQ ID NO: 2319066 - RNA, 16 nt, Yersinia pestis KIM
gguaccgcaggucaga

SEQ ID NO: 2319067 - RNA, 15 nt, Yersinia pestis KIM
gguacuugacgcugc

SEQ ID NO: 2319068 - RNA, 15 nt, Yersinia pestis KIM
gguaaucagacugcu

SEQ ID NO: 2319069 - RNA, 21 nt, Yersinia pestis KIM
gguaauaucgguaaaaaauca

SEQ ID NO: 2319070 - RNA, 14 nt, Yersinia pestis KIM
gguaagucagcggg

SEQ ID NO: 2319071 - RNA, 17 nt, Yersinia pestis KIM
gguaauaaacagacaaa

SEQ ID NO: 2319072 - RNA, 15 nt, Yersinia pestis KIM
gguaauaccaaugcu

SEQ ID NO: 2319073 - RNA, 16 nt, Yersinia pestis KIM
gguaauaagugaucag

SEQ ID NO: 2319074 - RNA, 13 nt, Yersinia pestis KIM
gguaauaaaucau

SEQ ID NO: 2319075 - RNA, 17 nt, Yersinia pestis KIM
gguaaugacauauucaa

SEQ ID NO: 2319076 - RNA, 15 nt, Yersinia pestis KIM
gguaauggccugcgg

SEQ ID NO: 2319077 - RNA, 19 nt, Yersinia pestis KIM
gguaaugcgcgcagcaagc

SEQ ID NO: 2319078 - RNA, 21 nt, Yersinia pestis KIM
gguaaugucacguuaaguuca

SEQ ID NO: 2319079 - RNA, 13 nt, Yersinia pestis KIM
gguaaucaugggg

SEQ ID NO: 2319080 - RNA, 16 nt, Yersinia pestis KIM
gguaaugaaugccccu

SEQ ID NO: 2319081 - RNA, 21 nt, Yersinia pestis KIM
ggcuggaaugggcggcgagua

SEQ ID NO: 2319082 - RNA, 16 nt, Yersinia pestis KIM
ggcuggaucagcagac

SEQ ID NO: 2319083 - RNA, 18 nt, Yersinia pestis KIM
ggcuggcauuuuuuaugu

SEQ ID NO: 2319084 - RNA, 16 nt, Yersinia pestis KIM
ggcuggcaccaagcag

SEQ ID NO: 2319085 - RNA, 16 nt, Yersinia pestis KIM
ggcugcugcagccggg

SEQ ID NO: 2319086 - RNA, 20 nt, Yersinia pestis KIM
ggcugcguucuuugauuuga

SEQ ID NO: 2319087 - RNA, 20 nt, Yersinia pestis KIM
ggcugccuggaauaagugug

SEQ ID NO: 2319088 - RNA, 16 nt, Yersinia pestis KIM
ggcuguauucacguau

SEQ ID NO: 2319089 - RNA, 21 nt, Yersinia pestis KIM
ggcuguuguaguuagaugaca

SEQ ID NO: 2319090 - RNA, 19 nt, Yersinia pestis KIM
ggcuuaacucgccacucac

SEQ ID NO: 2319091 - RNA, 15 nt, Yersinia pestis KIM
ggcuugggagucaga

SEQ ID NO: 2319092 - RNA, 16 nt, Yersinia pestis KIM
ggcuuggcaugacauc

SEQ ID NO: 2319093 - RNA, 15 nt, Yersinia pestis KIM
ggcuucuaacaauaa

SEQ ID NO: 2319094 - RNA, 21 nt, Yersinia pestis KIM
ggcuuuuucacacgcccaggc

SEQ ID NO: 2319095 - RNA, 12 nt, Yersinia pestis KIM
ggcuuuaauauc

SEQ ID NO: 2319096 - RNA, 20 nt, Yersinia pestis KIM
gggaaaaguggcuaucugaa

SEQ ID NO: 2319097 - RNA, 23 nt, Yersinia pestis KIM
gggaaaaguggcuaucugaaacu

SEQ ID NO: 2319098 - RNA, 19 nt, Yersinia pestis KIM
ggcuuuuuuacgcgccugc

SEQ ID NO: 2319099 - RNA, 14 nt, Yersinia pestis KIM
ggcucagcauggaa

SEQ ID NO: 2319100 - RNA, 19 nt, Yersinia pestis KIM
ggcucagcacaaacauggc

SEQ ID NO: 2319101 - RNA, 21 nt, Yersinia pestis KIM
ggcucaauccaaaugacacuu

SEQ ID NO: 2319102 - RNA, 17 nt, Yersinia pestis KIM
ggcucaauccaaaugac

SEQ ID NO: 2319103 - RNA, 19 nt, Yersinia pestis KIM
ggcucaauccaaaugacac

SEQ ID NO: 2319104 - RNA, 14 nt, Yersinia pestis KIM
ggcucaugcagcau

SEQ ID NO: 2319105 - RNA, 20 nt, Yersinia pestis KIM
ggcucaucgcuaaccgccag

SEQ ID NO: 2319106 - RNA, 18 nt, Yersinia pestis KIM
ggcucccccuugauucac

SEQ ID NO: 2319107 - RNA, 16 nt, Yersinia pestis KIM
ggcuccuauagcucag

SEQ ID NO: 2319108 - RNA, 20 nt, Yersinia pestis KIM
ggcucgagccuacauggaug

SEQ ID NO: 2319109 - RNA, 14 nt, Yersinia pestis KIM
ggcucgagccgcgc

SEQ ID NO: 2319110 - RNA, 13 nt, Yersinia pestis KIM
ggcucgugaucag

SEQ ID NO: 2319111 - RNA, 20 nt, Yersinia pestis KIM
ggcucuucucgaauaaacgg

SEQ ID NO: 2319112 - RNA, 14 nt, Yersinia pestis KIM
ggcucugaaacgcu

SEQ ID NO: 2319113 - RNA, 18 nt, Yersinia pestis KIM
ggcucucuuuuuucucuu

SEQ ID NO: 2319114 - RNA, 20 nt, Yersinia pestis KIM
ggcucuggcaauggcuagcu

SEQ ID NO: 2319115 - RNA, 14 nt, Yersinia pestis KIM
ggcucuguuuuacu

SEQ ID NO: 2319116 - RNA, 14 nt, Yersinia pestis KIM
ggcugauuaauauc

SEQ ID NO: 2319117 - RNA, 17 nt, Yersinia pestis KIM
ggcugauuaccugcauc

SEQ ID NO: 2319118 - RNA, 15 nt, Yersinia pestis KIM
ggcugauucacuggc

SEQ ID NO: 2319119 - RNA, 20 nt, Yersinia pestis KIM
ggcugcaccuuacagcaggu

SEQ ID NO: 2319120 - RNA, 12 nt, Yersinia pestis KIM
ggcugaugguca

SEQ ID NO: 2319121 - RNA, 12 nt, Yersinia pestis KIM
ggcugauacagc

SEQ ID NO: 2319122 - RNA, 22 nt, Yersinia pestis KIM
ggcugauacuacacuuuaggca

SEQ ID NO: 2319123 - RNA, 14 nt, Yersinia pestis KIM
ggcugaagacccaa

SEQ ID NO: 2319124 - RNA, 19 nt, Yersinia pestis KIM
gggcgcggguaauggcggu

SEQ ID NO: 2319125 - RNA, 13 nt, Yersinia pestis KIM
gggcguucuguca

SEQ ID NO: 2319126 - RNA, 16 nt, Yersinia pestis KIM
gggcuuuuggggcgcu

SEQ ID NO: 2319127 - RNA, 15 nt, Yersinia pestis KIM
gggcuuuaauacaau

SEQ ID NO: 2319128 - RNA, 15 nt, Yersinia pestis KIM
gggcugccaguaaaa

SEQ ID NO: 2319129 - RNA, 14 nt, Yersinia pestis KIM
gggcuggcaagcag

SEQ ID NO: 2319130 - RNA, 10 nt, Yersinia pestis KIM
gggcgccccg

SEQ ID NO: 2319131 - RNA, 15 nt, Yersinia pestis KIM
gggcgauggcaacau

SEQ ID NO: 2319132 - RNA, 18 nt, Yersinia pestis KIM
gggccuuuauucauucag

SEQ ID NO: 2319133 - RNA, 17 nt, Yersinia pestis KIM
gggccuguuugcagcga

SEQ ID NO: 2319134 - RNA, 14 nt, Yersinia pestis KIM
gggccaaggucagg

SEQ ID NO: 2319135 - RNA, 13 nt, Yersinia pestis KIM
gggcaguauaauu

SEQ ID NO: 2319136 - RNA, 11 nt, Yersinia pestis KIM
gggcaguaacg

SEQ ID NO: 2319137 - RNA, 14 nt, Yersinia pestis KIM
gggaguuacucagc

SEQ ID NO: 2319138 - RNA, 21 nt, Yersinia pestis KIM
gggaguuacucagcauccucc

SEQ ID NO: 2319139 - RNA, 14 nt, Yersinia pestis KIM
gggaguucaucaaa

SEQ ID NO: 2319140 - RNA, 12 nt, Yersinia pestis KIM
gggagggcgcgc

SEQ ID NO: 2319141 - RNA, 22 nt, Yersinia pestis KIM
gggaaauagcaacuaaacacga

SEQ ID NO: 2319142 - RNA, 17 nt, Yersinia pestis KIM
gggauggccgugggauc

SEQ ID NO: 2319143 - RNA, 18 nt, Yersinia pestis KIM
gggaugaaaaauacaaau

SEQ ID NO: 2319144 - RNA, 15 nt, Yersinia pestis KIM
gggauauuaauucca

SEQ ID NO: 2319145 - RNA, 16 nt, Yersinia pestis KIM
gggauauuaauuccac

SEQ ID NO: 2319146 - RNA, 22 nt, Yersinia pestis KIM
gggaucuccggacaggcuugau

SEQ ID NO: 2319147 - RNA, 18 nt, Yersinia pestis KIM
gggauagcauaaauacgg

SEQ ID NO: 2319148 - RNA, 15 nt, Yersinia pestis KIM
uaauuggcaauaaug

SEQ ID NO: 2319149 - RNA, 20 nt, Yersinia pestis KIM
uaauuggcaauaaugucacc

SEQ ID NO: 2319150 - RNA, 20 nt, Yersinia pestis KIM
uaauuggcccauaacaauua

SEQ ID NO: 2319151 - RNA, 15 nt, Yersinia pestis KIM
uaauugguuuauaac

SEQ ID NO: 2319152 - RNA, 18 nt, Yersinia pestis KIM
uaauugauauuauuuaua

SEQ ID NO: 2319153 - RNA, 20 nt, Yersinia pestis KIM
uaauugaagauuuaaauaac

SEQ ID NO: 2319154 - RNA, 21 nt, Yersinia pestis KIM
uaauugaagauuuaaauaaca

SEQ ID NO: 2319155 - RNA, 17 nt, Yersinia pestis KIM
uaauuauaccuacccuu

SEQ ID NO: 2319156 - RNA, 19 nt, Yersinia pestis KIM
uaauucaugugagauaaca

SEQ ID NO: 2319157 - RNA, 14 nt, Yersinia pestis KIM
uaauucaucagauu

SEQ ID NO: 2319158 - RNA, 17 nt, Yersinia pestis KIM
uaauuccaugcaaaaua

SEQ ID NO: 2319159 - RNA, 20 nt, Yersinia pestis KIM
uaauuaggcuucuaacaaua

SEQ ID NO: 2319160 - RNA, 16 nt, Yersinia pestis KIM
uaauuaguuuuaauaa

SEQ ID NO: 2319161 - RNA, 23 nt, Yersinia pestis KIM
uaaugcuguuguagcgccaggua

SEQ ID NO: 2319162 - RNA, 16 nt, Yersinia pestis KIM
uaaugcugaugcaaua

SEQ ID NO: 2319163 - RNA, 15 nt, Yersinia pestis KIM
uaaucuuguaguaca

SEQ ID NO: 2319164 - RNA, 15 nt, Yersinia pestis KIM
uaaucuuuacugcau

SEQ ID NO: 2319165 - RNA, 20 nt, Yersinia pestis KIM
uaauggcaccaucggcucua

SEQ ID NO: 2319166 - RNA, 15 nt, Yersinia pestis KIM
uaaugguuuauuuaa

SEQ ID NO: 2319167 - RNA, 15 nt, Yersinia pestis KIM
uaauggcacgccagu

SEQ ID NO: 2319168 - RNA, 14 nt, Yersinia pestis KIM
uaauggauaaugcu

SEQ ID NO: 2319169 - RNA, 13 nt, Yersinia pestis KIM
uaauguauuuauu

SEQ ID NO: 2319170 - RNA, 15 nt, Yersinia pestis KIM
uaauguccuauuuaa

SEQ ID NO: 2319171 - RNA, 20 nt, Yersinia pestis KIM
uaauuaacacccaauaauaa

SEQ ID NO: 2319172 - RNA, 19 nt, Yersinia pestis KIM
uaauuaacacccaauaaua

SEQ ID NO: 2319173 - RNA, 18 nt, Yersinia pestis KIM
uaauuaacagcaucacug

SEQ ID NO: 2319174 - RNA, 15 nt, Yersinia pestis KIM
uaauuacuuauaaac

SEQ ID NO: 2319175 - RNA, 14 nt, Yersinia pestis KIM
uaaugucuuuacua

SEQ ID NO: 2319176 - RNA, 22 nt, Yersinia pestis KIM
uaauguugcaaacggauaaugu

SEQ ID NO: 2319177 - RNA, 13 nt, Yersinia pestis KIM
uaauguucauuca

SEQ ID NO: 2319178 - RNA, 14 nt, Yersinia pestis KIM
uaauguuaauauuu

SEQ ID NO: 2319179 - RNA, 14 nt, Yersinia pestis KIM
uaauccauacagaa

SEQ ID NO: 2319180 - RNA, 15 nt, Yersinia pestis KIM
uaauccauacagaac

SEQ ID NO: 2319181 - RNA, 15 nt, Yersinia pestis KIM
uaaucgcagcagaga

SEQ ID NO: 2319182 - RNA, 20 nt, Yersinia pestis KIM
uaauccccggucacuuaaau

SEQ ID NO: 2319183 - RNA, 21 nt, Yersinia pestis KIM
uaaucgccugaugcuuuucuu

SEQ ID NO: 2319184 - RNA, 21 nt, Yersinia pestis KIM
uaaucgccagcaaaucacauu

SEQ ID NO: 2319185 - RNA, 21 nt, Yersinia pestis KIM
uaaucgccaggcgcuacgcaa

SEQ ID NO: 2319186 - RNA, 17 nt, Yersinia pestis KIM
uaaucgccaauaaccgc

SEQ ID NO: 2319187 - RNA, 23 nt, Yersinia pestis KIM
uaaucgccugcugagccaaauaa

SEQ ID NO: 2319188 - RNA, 21 nt, Yersinia pestis KIM
uaaucgccugcugagccaaau

SEQ ID NO: 2319189 - RNA, 23 nt, Yersinia pestis KIM
uaaucgucuuguuggucaccacu

SEQ ID NO: 2319190 - RNA, 15 nt, Yersinia pestis KIM
uaaucuuaaguaaau

SEQ ID NO: 2319191 - RNA, 18 nt, Yersinia pestis KIM
uaaucuggaugaguauua

SEQ ID NO: 2319192 - RNA, 13 nt, Yersinia pestis KIM
uaaucuccaucau

SEQ ID NO: 2319193 - RNA, 15 nt, Yersinia pestis KIM
uaaucuccaucaugg

SEQ ID NO: 2319194 - RNA, 16 nt, Yersinia pestis KIM
uaaucaagccuucauu

SEQ ID NO: 2319195 - RNA, 14 nt, Yersinia pestis KIM
uaaucaguggcuga

SEQ ID NO: 2319196 - RNA, 13 nt, Yersinia pestis KIM
uaauccacccggc

SEQ ID NO: 2319197 - RNA, 17 nt, Yersinia pestis KIM
uaaucauaucaaaauaa

SEQ ID NO: 2319198 - RNA, 15 nt, Yersinia pestis KIM
uaaucauaucaaaau

SEQ ID NO: 2319199 - RNA, 12 nt, Yersinia pestis KIM
uaauauuauuca

SEQ ID NO: 2319200 - RNA, 19 nt, Yersinia pestis KIM
uaauaugcacgucauuuuu

SEQ ID NO: 2319201 - RNA, 14 nt, Yersinia pestis KIM
uaauagauaguacu

SEQ ID NO: 2319202 - RNA, 13 nt, Yersinia pestis KIM
uaauagcaaaaaa

SEQ ID NO: 2319203 - RNA, 15 nt, Yersinia pestis KIM
uaauagccucugucu

SEQ ID NO: 2319204 - RNA, 14 nt, Yersinia pestis KIM
uaauagauaguacg

SEQ ID NO: 2319205 - RNA, 22 nt, Yersinia pestis KIM
uaagugauucgggugagugaac

SEQ ID NO: 2319206 - RNA, 22 nt, Yersinia pestis KIM
uaaguguauucgcaucuuccaa

SEQ ID NO: 2319207 - RNA, 19 nt, Yersinia pestis KIM
uaaguguguguauuuaaaa

SEQ ID NO: 2319208 - RNA, 18 nt, Yersinia pestis KIM
uaagugaaacaaauacac

SEQ ID NO: 2319209 - RNA, 15 nt, Yersinia pestis KIM
uaaguauuucaaaua

SEQ ID NO: 2319210 - RNA, 14 nt, Yersinia pestis KIM
uaagucaauuucag

SEQ ID NO: 2319211 - RNA, 15 nt, Yersinia pestis KIM
uaagucaauuucagc

SEQ ID NO: 2319212 - RNA, 15 nt, Yersinia pestis KIM
uaaguccaagacaga

SEQ ID NO: 2319213 - RNA, 19 nt, Yersinia pestis KIM
uaagucgucugauauuaaa

SEQ ID NO: 2319214 - RNA, 13 nt, Yersinia pestis KIM
uaaguuaguggug

SEQ ID NO: 2319215 - RNA, 16 nt, Yersinia pestis KIM
uaaguuaacaccauca

SEQ ID NO: 2319216 - RNA, 23 nt, Yersinia pestis KIM
uaaguucagguugaaauaaauaa

SEQ ID NO: 2319217 - RNA, 20 nt, Yersinia pestis KIM
uaauaaaaaaaaauaaaauu

SEQ ID NO: 2319218 - RNA, 14 nt, Yersinia pestis KIM
uaauaaaaaaaaau

SEQ ID NO: 2319219 - RNA, 15 nt, Yersinia pestis KIM
uaauaaaaaaaaaua

SEQ ID NO: 2319220 - RNA, 20 nt, Yersinia pestis KIM
uaaggucacuguuucgccuu

SEQ ID NO: 2319221 - RNA, 19 nt, Yersinia pestis KIM
uaaggucaguucacgaauu

SEQ ID NO: 2319222 - RNA, 13 nt, Yersinia pestis KIM
uaagguaaagaaa

SEQ ID NO: 2319223 - RNA, 14 nt, Yersinia pestis KIM
uaaggugccacaca

SEQ ID NO: 2319224 - RNA, 16 nt, Yersinia pestis KIM
uaaggguaaaaucccc

SEQ ID NO: 2319225 - RNA, 13 nt, Yersinia pestis KIM
uaagggggacccc

SEQ ID NO: 2319226 - RNA, 20 nt, Yersinia pestis KIM
uaaggcguuacccacauuaa

SEQ ID NO: 2319227 - RNA, 14 nt, Yersinia pestis KIM
uaaggagugccauc

SEQ ID NO: 2319228 - RNA, 14 nt, Yersinia pestis KIM
uaaggaucugaaga

SEQ ID NO: 2319229 - RNA, 14 nt, Yersinia pestis KIM
uaaggcaucaacca

SEQ ID NO: 2319230 - RNA, 20 nt, Yersinia pestis KIM
uaauaaaaccuuuacaauua

SEQ ID NO: 2319231 - RNA, 13 nt, Yersinia pestis KIM
uaauaaaaucaaa

SEQ ID NO: 2319232 - RNA, 13 nt, Yersinia pestis KIM
uaauaaauuaaua

SEQ ID NO: 2319233 - RNA, 17 nt, Yersinia pestis KIM
uaauaaauuuucuaagc

SEQ ID NO: 2319234 - RNA, 14 nt, Yersinia pestis KIM
uaauaaaggcugua

SEQ ID NO: 2319235 - RNA, 20 nt, Yersinia pestis KIM
uaauaacgccgaguaaguca

SEQ ID NO: 2319236 - RNA, 17 nt, Yersinia pestis KIM
uaauaaccguuucagga

SEQ ID NO: 2319237 - RNA, 12 nt, Yersinia pestis KIM
uaauaaccauua

SEQ ID NO: 2319238 - RNA, 12 nt, Yersinia pestis KIM
uaauaaccauug

SEQ ID NO: 2319239 - RNA, 17 nt, Yersinia pestis KIM
uaauaaccauugguuac

SEQ ID NO: 2319240 - RNA, 23 nt, Yersinia pestis KIM
uaauaagccgcaggcaaacaaug

SEQ ID NO: 2319241 - RNA, 14 nt, Yersinia pestis KIM
uaauaauagauagu

SEQ ID NO: 2319242 - RNA, 16 nt, Yersinia pestis KIM
uaauaaguuaauaaug

SEQ ID NO: 2319243 - RNA, 14 nt, Yersinia pestis KIM
uaauaagggcgcau

SEQ ID NO: 2319244 - RNA, 22 nt, Yersinia pestis KIM
uaauaagugaucagcuaacaaa

SEQ ID NO: 2319245 - RNA, 13 nt, Yersinia pestis KIM
uaauacaucauca

SEQ ID NO: 2319246 - RNA, 16 nt, Yersinia pestis KIM
uaauacaucaucaaaa

SEQ ID NO: 2319247 - RNA, 12 nt, Yersinia pestis KIM
uaauacauaaaa

SEQ ID NO: 2319248 - RNA, 13 nt, Yersinia pestis KIM
uaauacauaaaau

SEQ ID NO: 2319249 - RNA, 24 nt, Yersinia pestis KIM
uaauacauaaaaucaauaucgcua

SEQ ID NO: 2319250 - RNA, 22 nt, Yersinia pestis KIM
uaauacacuaggagaaacauua

SEQ ID NO: 2319251 - RNA, 16 nt, Yersinia pestis KIM
uaauaaucuuaaguaa

SEQ ID NO: 2319252 - RNA, 19 nt, Yersinia pestis KIM
uaauaaucuuaaguaaauu

SEQ ID NO: 2319253 - RNA, 19 nt, Yersinia pestis KIM
uaauaaugaugaacuacag

SEQ ID NO: 2319254 - RNA, 12 nt, Yersinia pestis KIM
uaauaauuauuu

SEQ ID NO: 2319255 - RNA, 20 nt, Yersinia pestis KIM
uaauaauucagguugagcau

SEQ ID NO: 2319256 - RNA, 22 nt, Yersinia pestis KIM
uaauaauuuauacauaucagaa

SEQ ID NO: 2319257 - RNA, 15 nt, Yersinia pestis KIM
uaauaccacaccuua

SEQ ID NO: 2319258 - RNA, 20 nt, Yersinia pestis KIM
uaauacccucgacaccaaaa

SEQ ID NO: 2319259 - RNA, 22 nt, Yersinia pestis KIM
uaauacugcgguccuacccuuu

SEQ ID NO: 2319260 - RNA, 16 nt, Yersinia pestis KIM
uaauacugucaaaauc

SEQ ID NO: 2319261 - RNA, 20 nt, Yersinia pestis KIM
uaauacuuucccauagcugg

SEQ ID NO: 2319262 - RNA, 15 nt, Yersinia pestis KIM
uacgccauccacuca

SEQ ID NO: 2319263 - RNA, 14 nt, Yersinia pestis KIM
uacgccauuaaaag

SEQ ID NO: 2319264 - RNA, 13 nt, Yersinia pestis KIM
uacgccaagaggg

SEQ ID NO: 2319265 - RNA, 20 nt, Yersinia pestis KIM
uacgagagaucguaggcuug

SEQ ID NO: 2319266 - RNA, 12 nt, Yersinia pestis KIM
uaccuguucaau

SEQ ID NO: 2319267 - RNA, 14 nt, Yersinia pestis KIM
uaccuuacuguauc

SEQ ID NO: 2319268 - RNA, 21 nt, Yersinia pestis KIM
uaccuuaauuaacucuucugu

SEQ ID NO: 2319269 - RNA, 22 nt, Yersinia pestis KIM
uacgacaauccuaucguuuauu

SEQ ID NO: 2319270 - RNA, 13 nt, Yersinia pestis KIM
uacguuguaccag

SEQ ID NO: 2319271 - RNA, 17 nt, Yersinia pestis KIM
uacuaaauuagaaaaca

SEQ ID NO: 2319272 - RNA, 20 nt, Yersinia pestis KIM
uacuaaauuuagugccaaca

SEQ ID NO: 2319273 - RNA, 17 nt, Yersinia pestis KIM
uacuaacgucaacagaa

SEQ ID NO: 2319274 - RNA, 15 nt, Yersinia pestis KIM
uacguaaauuuauuu

SEQ ID NO: 2319275 - RNA, 18 nt, Yersinia pestis KIM
uacguaaauuuauuuagu

SEQ ID NO: 2319276 - RNA, 20 nt, Yersinia pestis KIM
uacguaaacgaguuuccagu

SEQ ID NO: 2319277 - RNA, 19 nt, Yersinia pestis KIM
uacgguucacuagccugag

SEQ ID NO: 2319278 - RNA, 15 nt, Yersinia pestis KIM
uacgguguuugguga

SEQ ID NO: 2319279 - RNA, 17 nt, Yersinia pestis KIM
uacggugccagcagcaa

SEQ ID NO: 2319280 - RNA, 16 nt, Yersinia pestis KIM
uacggugccagcagca

SEQ ID NO: 2319281 - RNA, 23 nt, Yersinia pestis KIM
uacgcucgguuguucagcaccag

SEQ ID NO: 2319282 - RNA, 19 nt, Yersinia pestis KIM
uacgcucuccucuccccua

SEQ ID NO: 2319283 - RNA, 18 nt, Yersinia pestis KIM
uacgggugugcugggugu

SEQ ID NO: 2319284 - RNA, 17 nt, Yersinia pestis KIM
uacgguaccgcagguca

SEQ ID NO: 2319285 - RNA, 23 nt, Yersinia pestis KIM
uacgcuguaugccgcucaaggag

SEQ ID NO: 2319286 - RNA, 21 nt, Yersinia pestis KIM
uaccgcuuaaggcaucaacca

SEQ ID NO: 2319287 - RNA, 13 nt, Yersinia pestis KIM
uaccgcuuuuacc

SEQ ID NO: 2319288 - RNA, 16 nt, Yersinia pestis KIM
uaccgacaccaauacc

SEQ ID NO: 2319289 - RNA, 17 nt, Yersinia pestis KIM
uaccgaacgaacacagu

SEQ ID NO: 2319290 - RNA, 17 nt, Yersinia pestis KIM
uaccgugagcagcaaua

SEQ ID NO: 2319291 - RNA, 15 nt, Yersinia pestis KIM
uaccugcaucaucac

SEQ ID NO: 2319292 - RNA, 13 nt, Yersinia pestis KIM
uaccugccccaca

SEQ ID NO: 2319293 - RNA, 20 nt, Yersinia pestis KIM
uaccugcaccaaugacuaau

SEQ ID NO: 2319294 - RNA, 15 nt, Yersinia pestis KIM
uaccugcauauccuc

SEQ ID NO: 2319295 - RNA, 20 nt, Yersinia pestis KIM
uaccugcaucaagccgcuua

SEQ ID NO: 2319296 - RNA, 18 nt, Yersinia pestis KIM
uaccugcgacaccguuga

SEQ ID NO: 2319297 - RNA, 13 nt, Yersinia pestis KIM
uaccugcucaacu

SEQ ID NO: 2319298 - RNA, 22 nt, Yersinia pestis KIM
uaccuggacgcuggcagccuuu

SEQ ID NO: 2319299 - RNA, 17 nt, Yersinia pestis KIM
uaccugauuccuaagca

SEQ ID NO: 2319300 - RNA, 20 nt, Yersinia pestis KIM
uaccugauuccuaagcaaau

SEQ ID NO: 2319301 - RNA, 16 nt, Yersinia pestis KIM
uaccugagagagguug

SEQ ID NO: 2319302 - RNA, 17 nt, Yersinia pestis KIM
uaccugacacugcaucu

SEQ ID NO: 2319303 - RNA, 20 nt, Yersinia pestis KIM
uaccucacuggcuuuauuau

SEQ ID NO: 2319304 - RNA, 19 nt, Yersinia pestis KIM
uaccguuuuauuucccccu

SEQ ID NO: 2319305 - RNA, 16 nt, Yersinia pestis KIM
uaccuccauauccugg

SEQ ID NO: 2319306 - RNA, 16 nt, Yersinia pestis KIM
uaccaccaccacaccg

SEQ ID NO: 2319307 - RNA, 18 nt, Yersinia pestis KIM
uaccaccaccaacagcau

SEQ ID NO: 2319308 - RNA, 12 nt, Yersinia pestis KIM
uaccaauugaug

SEQ ID NO: 2319309 - RNA, 15 nt, Yersinia pestis KIM
uaccaccaccaacag

SEQ ID NO: 2319310 - RNA, 18 nt, Yersinia pestis KIM
uaccauaguuuuucuccu

SEQ ID NO: 2319311 - RNA, 19 nt, Yersinia pestis KIM
uaccauauggaugaugcac

SEQ ID NO: 2319312 - RNA, 13 nt, Yersinia pestis KIM
uaccaucaaccac

SEQ ID NO: 2319313 - RNA, 16 nt, Yersinia pestis KIM
uaccauaacaauggcc

SEQ ID NO: 2319314 - RNA, 18 nt, Yersinia pestis KIM
uaccauccagugccaacc

SEQ ID NO: 2319315 - RNA, 15 nt, Yersinia pestis KIM
uaccaugcucauguu

SEQ ID NO: 2319316 - RNA, 16 nt, Yersinia pestis KIM
uaccaugcucauguuc

SEQ ID NO: 2319317 - RNA, 22 nt, Yersinia pestis KIM
uacccagcuucuuuuaaagaag

SEQ ID NO: 2319318 - RNA, 14 nt, Yersinia pestis KIM
uacccauuauaaau

SEQ ID NO: 2319319 - RNA, 17 nt, Yersinia pestis KIM
uacccauuauaaauaau

SEQ ID NO: 2319320 - RNA, 22 nt, Yersinia pestis KIM
uacccauuauaaauaauuaaug

SEQ ID NO: 2319321 - RNA, 23 nt, Yersinia pestis KIM
uacccacuuuauuuuuuuccagg

SEQ ID NO: 2319322 - RNA, 21 nt, Yersinia pestis KIM
uaccauuucacgguucacccc

SEQ ID NO: 2319323 - RNA, 14 nt, Yersinia pestis KIM
uacccggaauggag

SEQ ID NO: 2319324 - RNA, 20 nt, Yersinia pestis KIM
uacccggaauggagccgcua

SEQ ID NO: 2319325 - RNA, 13 nt, Yersinia pestis KIM
uacagggcauauc

SEQ ID NO: 2319326 - RNA, 23 nt, Yersinia pestis KIM
uacaggcucuaucucuucagggc

SEQ ID NO: 2319327 - RNA, 18 nt, Yersinia pestis KIM
uacaggggcguuauucuc

SEQ ID NO: 2319328 - RNA, 14 nt, Yersinia pestis KIM
uacaggccccuucu

SEQ ID NO: 2319329 - RNA, 18 nt, Yersinia pestis KIM
uacaggauuaaauaaaga

SEQ ID NO: 2319330 - RNA, 18 nt, Yersinia pestis KIM
uacauauaggaaaugucg

SEQ ID NO: 2319331 - RNA, 22 nt, Yersinia pestis KIM
uacauaucuuuauuaucaaugg

SEQ ID NO: 2319332 - RNA, 18 nt, Yersinia pestis KIM
uacauaggucuuuacgca

SEQ ID NO: 2319333 - RNA, 13 nt, Yersinia pestis KIM
uacaucacaccca

SEQ ID NO: 2319334 - RNA, 16 nt, Yersinia pestis KIM
uacaucaaaucagagg

SEQ ID NO: 2319335 - RNA, 13 nt, Yersinia pestis KIM
uacaucaggguga

SEQ ID NO: 2319336 - RNA, 14 nt, Yersinia pestis KIM
uacaucaucuucua

SEQ ID NO: 2319337 - RNA, 13 nt, Yersinia pestis KIM
uacauccaacuuc

SEQ ID NO: 2319338 - RNA, 20 nt, Yersinia pestis KIM
uacaucuuacugauaucuuu

SEQ ID NO: 2319339 - RNA, 17 nt, Yersinia pestis KIM
uacaugauugaaaaaca

SEQ ID NO: 2319340 - RNA, 16 nt, Yersinia pestis KIM
uaccaauggugcccau

SEQ ID NO: 2319341 - RNA, 14 nt, Yersinia pestis KIM
uaccaauuaauaag

SEQ ID NO: 2319342 - RNA, 13 nt, Yersinia pestis KIM
uaccaauaagcug

SEQ ID NO: 2319343 - RNA, 19 nt, Yersinia pestis KIM
uaccaagacuucaugacua

SEQ ID NO: 2319344 - RNA, 12 nt, Yersinia pestis KIM
uaccaaacauuu

SEQ ID NO: 2319345 - RNA, 15 nt, Yersinia pestis KIM
uaccaaauaacaaca

SEQ ID NO: 2319346 - RNA, 19 nt, Yersinia pestis KIM
uaccaacucugaaguaaau

SEQ ID NO: 2319347 - RNA, 22 nt, Yersinia pestis KIM
uacauucgagcaacuuuuacug

SEQ ID NO: 2319348 - RNA, 22 nt, Yersinia pestis KIM
uacauuuaaacacucaauaagu

SEQ ID NO: 2319349 - RNA, 18 nt, Yersinia pestis KIM
uacauuuaaacacucaau

SEQ ID NO: 2319350 - RNA, 13 nt, Yersinia pestis KIM
uacauuuaaacac

SEQ ID NO: 2319351 - RNA, 13 nt, Yersinia pestis KIM
uacauuuuuaaca

SEQ ID NO: 2319352 - RNA, 11 nt, Yersinia pestis KIM
uacaaauauua

SEQ ID NO: 2319353 - RNA, 16 nt, Yersinia pestis KIM
uacaacaagaucccaa

SEQ ID NO: 2319354 - RNA, 14 nt, Yersinia pestis KIM
uacaacaauaauaa

SEQ ID NO: 2319355 - RNA, 13 nt, Yersinia pestis KIM
uacaaauaaaaua

SEQ ID NO: 2319356 - RNA, 18 nt, Yersinia pestis KIM
uacaauccaaccuauaua

SEQ ID NO: 2319357 - RNA, 19 nt, Yersinia pestis KIM
uacaacgguuuaugcccag

SEQ ID NO: 2319358 - RNA, 21 nt, Yersinia pestis KIM
uacagagcaaaaagccagcga

SEQ ID NO: 2319359 - RNA, 23 nt, Yersinia pestis KIM
uacagcaaacaucgguaaaucgc

SEQ ID NO: 2319360 - RNA, 22 nt, Yersinia pestis KIM
uacagccggauaggcuuaauau

SEQ ID NO: 2319361 - RNA, 15 nt, Yersinia pestis KIM
uacagcccaagagaa

SEQ ID NO: 2319362 - RNA, 19 nt, Yersinia pestis KIM
uacagcccgguaucaccuu

SEQ ID NO: 2319363 - RNA, 14 nt, Yersinia pestis KIM
uacagcaaauaggu

SEQ ID NO: 2319364 - RNA, 13 nt, Yersinia pestis KIM
uacagcaaggcag

SEQ ID NO: 2319365 - RNA, 15 nt, Yersinia pestis KIM
uacagcaaggcagca

SEQ ID NO: 2319366 - RNA, 17 nt, Yersinia pestis KIM
uacacaaucaguaaaua

SEQ ID NO: 2319367 - RNA, 21 nt, Yersinia pestis KIM
uagaacuauuggucaaucuag

SEQ ID NO: 2319368 - RNA, 13 nt, Yersinia pestis KIM
uagaacuuaagca

SEQ ID NO: 2319369 - RNA, 15 nt, Yersinia pestis KIM
uagaacuuaagcaau

SEQ ID NO: 2319370 - RNA, 24 nt, Yersinia pestis KIM
uagaacuuaagcaauauuuuagca

SEQ ID NO: 2319371 - RNA, 13 nt, Yersinia pestis KIM
uagaagagauaga

SEQ ID NO: 2319372 - RNA, 14 nt, Yersinia pestis KIM
uagaagcucauaug

SEQ ID NO: 2319373 - RNA, 19 nt, Yersinia pestis KIM
uagaauuuaagauaccagc

SEQ ID NO: 2319374 - RNA, 19 nt, Yersinia pestis KIM
uagaauuugaucagccaga

SEQ ID NO: 2319375 - RNA, 22 nt, Yersinia pestis KIM
uagaauuuucucauuaauaaug

SEQ ID NO: 2319376 - RNA, 16 nt, Yersinia pestis KIM
uagaauuuaagauacc

SEQ ID NO: 2319377 - RNA, 18 nt, Yersinia pestis KIM
uacuaucuuuauugcucc

SEQ ID NO: 2319378 - RNA, 12 nt, Yersinia pestis KIM
uagaaacguuca

SEQ ID NO: 2319379 - RNA, 15 nt, Yersinia pestis KIM
uagaguugauaaaca

SEQ ID NO: 2319380 - RNA, 16 nt, Yersinia pestis KIM
uagaguugauaaacaa

SEQ ID NO: 2319381 - RNA, 14 nt, Yersinia pestis KIM
uagaguugauaaac

SEQ ID NO: 2319382 - RNA, 21 nt, Yersinia pestis KIM
uagauaaaaacauuuaaauau

SEQ ID NO: 2319383 - RNA, 16 nt, Yersinia pestis KIM
uagauagcaaucaaua

SEQ ID NO: 2319384 - RNA, 17 nt, Yersinia pestis KIM
uagauagccauaauaau

SEQ ID NO: 2319385 - RNA, 14 nt, Yersinia pestis KIM
uagauacaauucac

SEQ ID NO: 2319386 - RNA, 17 nt, Yersinia pestis KIM
uagauacaauucaccca

SEQ ID NO: 2319387 - RNA, 16 nt, Yersinia pestis KIM
uagauaccgcaaccau

SEQ ID NO: 2319388 - RNA, 18 nt, Yersinia pestis KIM
uagauaccgcaaccauug

SEQ ID NO: 2319389 - RNA, 17 nt, Yersinia pestis KIM
uagauaacugaaagauc

SEQ ID NO: 2319390 - RNA, 19 nt, Yersinia pestis KIM
uagagcuuccagugcauua

SEQ ID NO: 2319391 - RNA, 17 nt, Yersinia pestis KIM
uagagccuuuacgggcu

SEQ ID NO: 2319392 - RNA, 22 nt, Yersinia pestis KIM
uagagcauaacugguggcaggc

SEQ ID NO: 2319393 - RNA, 14 nt, Yersinia pestis KIM
uagagcacagcacu

SEQ ID NO: 2319394 - RNA, 16 nt, Yersinia pestis KIM
uagagcaccaaaucuu

SEQ ID NO: 2319395 - RNA, 20 nt, Yersinia pestis KIM
uagagcaccaaaucuuccag

SEQ ID NO: 2319396 - RNA, 19 nt, Yersinia pestis KIM
uagagauuaacggcgugcg

SEQ ID NO: 2319397 - RNA, 20 nt, Yersinia pestis KIM
uagacagcuuaaaaucugua

SEQ ID NO: 2319398 - RNA, 13 nt, Yersinia pestis KIM
uagaccaccaacu

SEQ ID NO: 2319399 - RNA, 17 nt, Yersinia pestis KIM
uagacgacacaaaugcu

SEQ ID NO: 2319400 - RNA, 12 nt, Yersinia pestis KIM
uagacgaaggca

SEQ ID NO: 2319401 - RNA, 21 nt, Yersinia pestis KIM
uagaccaguuaauaucaauga

SEQ ID NO: 2319402 - RNA, 20 nt, Yersinia pestis KIM
uagacgucagauuaguuuua

SEQ ID NO: 2319403 - RNA, 20 nt, Yersinia pestis KIM
uagacgucagauuagcuuua

SEQ ID NO: 2319404 - RNA, 16 nt, Yersinia pestis KIM
uagacuguuuuauuau

SEQ ID NO: 2319405 - RNA, 23 nt, Yersinia pestis KIM
uaggaggguguuuuuuugucuuu

SEQ ID NO: 2319406 - RNA, 17 nt, Yersinia pestis KIM
uaggccggggagccaag

SEQ ID NO: 2319407 - RNA, 15 nt, Yersinia pestis KIM
uaggccuaaacccca

SEQ ID NO: 2319408 - RNA, 18 nt, Yersinia pestis KIM
uaggccuaaaccccacag

SEQ ID NO: 2319409 - RNA, 20 nt, Yersinia pestis KIM
uagggauuuaugcaaauaau

SEQ ID NO: 2319410 - RNA, 13 nt, Yersinia pestis KIM
uagggauauuucu

SEQ ID NO: 2319411 - RNA, 15 nt, Yersinia pestis KIM
uaggcgcagcagggc

SEQ ID NO: 2319412 - RNA, 15 nt, Yersinia pestis KIM
uagggagauuucaaa

SEQ ID NO: 2319413 - RNA, 20 nt, Yersinia pestis KIM
uagggagccaauagaggcuc

SEQ ID NO: 2319414 - RNA, 22 nt, Yersinia pestis KIM
uagggagccaauagaggcuccc

SEQ ID NO: 2319415 - RNA, 13 nt, Yersinia pestis KIM
uaggguugugugg

SEQ ID NO: 2319416 - RNA, 16 nt, Yersinia pestis KIM
uagggucauacccaaa

SEQ ID NO: 2319417 - RNA, 22 nt, Yersinia pestis KIM
uaggggccaccaaauaaaacaa

SEQ ID NO: 2319418 - RNA, 17 nt, Yersinia pestis KIM
uaggguaaguccaucag

SEQ ID NO: 2319419 - RNA, 21 nt, Yersinia pestis KIM
uaggggccaccaaauaaaaca

SEQ ID NO: 2319420 - RNA, 18 nt, Yersinia pestis KIM
uagggcuggcaagcagac

SEQ ID NO: 2319421 - RNA, 19 nt, Yersinia pestis KIM
uagcgaugacugaguauga

SEQ ID NO: 2319422 - RNA, 15 nt, Yersinia pestis KIM
uagcgaugacugagu

SEQ ID NO: 2319423 - RNA, 14 nt, Yersinia pestis KIM
uagcgauagaguug

SEQ ID NO: 2319424 - RNA, 23 nt, Yersinia pestis KIM
uagcgauaaacguucaacaccac

SEQ ID NO: 2319425 - RNA, 14 nt, Yersinia pestis KIM
uagcgauauccuua

SEQ ID NO: 2319426 - RNA, 22 nt, Yersinia pestis KIM
uagcguugccgccgggcagcaa

SEQ ID NO: 2319427 - RNA, 22 nt, Yersinia pestis KIM
uagcguucaucgcccuguaacu

SEQ ID NO: 2319428 - RNA, 17 nt, Yersinia pestis KIM
uagcgugauuuuuauau

SEQ ID NO: 2319429 - RNA, 13 nt, Yersinia pestis KIM
uagcgugccgcag

SEQ ID NO: 2319430 - RNA, 20 nt, Yersinia pestis KIM
uagcguuuuuucguuuacuu

SEQ ID NO: 2319431 - RNA, 14 nt, Yersinia pestis KIM
uagcuaaaugacau

SEQ ID NO: 2319432 - RNA, 22 nt, Yersinia pestis KIM
uagcuaaaugacauauugugcu

SEQ ID NO: 2319433 - RNA, 13 nt, Yersinia pestis KIM
uagcucaagggca

SEQ ID NO: 2319434 - RNA, 13 nt, Yersinia pestis KIM
uagcuaaauuuaa

SEQ ID NO: 2319435 - RNA, 16 nt, Yersinia pestis KIM
uagcucgcuguggcua

SEQ ID NO: 2319436 - RNA, 15 nt, Yersinia pestis KIM
uagcucgcucaacau

SEQ ID NO: 2319437 - RNA, 21 nt, Yersinia pestis KIM
uagcucgcucaacaugccaga

SEQ ID NO: 2319438 - RNA, 17 nt, Yersinia pestis KIM
uagcucgccuucauuau

SEQ ID NO: 2319439 - RNA, 17 nt, Yersinia pestis KIM
uagcuuucuccuuugau

SEQ ID NO: 2319440 - RNA, 14 nt, Yersinia pestis KIM
uagcuuuuuaaaua

SEQ ID NO: 2319441 - RNA, 12 nt, Yersinia pestis KIM
uagcucuucacg

SEQ ID NO: 2319442 - RNA, 22 nt, Yersinia pestis KIM
uagauauuguuuugacuaaaau

SEQ ID NO: 2319443 - RNA, 14 nt, Yersinia pestis KIM
uagaucaaacauaa

SEQ ID NO: 2319444 - RNA, 16 nt, Yersinia pestis KIM
uagaucggccaaugcu

SEQ ID NO: 2319445 - RNA, 21 nt, Yersinia pestis KIM
uagcaauaccagccgauaauc

SEQ ID NO: 2319446 - RNA, 18 nt, Yersinia pestis KIM
uagcaauccaguuaucau

SEQ ID NO: 2319447 - RNA, 21 nt, Yersinia pestis KIM
uagccaaauacccuaauucag

SEQ ID NO: 2319448 - RNA, 23 nt, Yersinia pestis KIM
uagccaacacgaccugugcacca

SEQ ID NO: 2319449 - RNA, 20 nt, Yersinia pestis KIM
uagccaaauacauauaacca

SEQ ID NO: 2319450 - RNA, 13 nt, Yersinia pestis KIM
uagcauaaaaauc

SEQ ID NO: 2319451 - RNA, 15 nt, Yersinia pestis KIM
uagcagugauuucag

SEQ ID NO: 2319452 - RNA, 21 nt, Yersinia pestis KIM
uagccuucguuugucaaugga

SEQ ID NO: 2319453 - RNA, 20 nt, Yersinia pestis KIM
uagccgcaggcgaugcaagg

SEQ ID NO: 2319454 - RNA, 19 nt, Yersinia pestis KIM
uagccagccaccgcacacu

SEQ ID NO: 2319455 - RNA, 21 nt, Yersinia pestis KIM
uagccagccaccgcacacuga

SEQ ID NO: 2319456 - RNA, 19 nt, Yersinia pestis KIM
uagccagcggcguaacaua

SEQ ID NO: 2319457 - RNA, 22 nt, Yersinia pestis KIM
uagccaccaguuuauuuucccu

SEQ ID NO: 2319458 - RNA, 23 nt, Yersinia pestis KIM
uagccaccaguuuauuuucccuu

SEQ ID NO: 2319459 - RNA, 15 nt, Yersinia pestis KIM
uagccaccucacuca

SEQ ID NO: 2319460 - RNA, 17 nt, Yersinia pestis KIM
uagccacagucauuuga

SEQ ID NO: 2319461 - RNA, 16 nt, Yersinia pestis KIM
uagccacuuaauaaug

SEQ ID NO: 2319462 - RNA, 19 nt, Yersinia pestis KIM
uagccagaaauagcaccau

SEQ ID NO: 2319463 - RNA, 16 nt, Yersinia pestis KIM
uagccacgucugcgga

SEQ ID NO: 2319464 - RNA, 14 nt, Yersinia pestis KIM
uagccacuaacuaa

SEQ ID NO: 2319465 - RNA, 16 nt, Yersinia pestis KIM
uaucgaugguuggcua

SEQ ID NO: 2319466 - RNA, 13 nt, Yersinia pestis KIM
uaucgauaagaaa

SEQ ID NO: 2319467 - RNA, 13 nt, Yersinia pestis KIM
uaucgauuucuac

SEQ ID NO: 2319468 - RNA, 16 nt, Yersinia pestis KIM
uaucuaggugcaguaa

SEQ ID NO: 2319469 - RNA, 18 nt, Yersinia pestis KIM
uaucuagcaacacaucgg

SEQ ID NO: 2319470 - RNA, 22 nt, Yersinia pestis KIM
uaucuaauguauuuauucaaaa

SEQ ID NO: 2319471 - RNA, 16 nt, Yersinia pestis KIM
uaucuuauccacagca

SEQ ID NO: 2319472 - RNA, 12 nt, Yersinia pestis KIM
uaucuuauucau

SEQ ID NO: 2319473 - RNA, 16 nt, Yersinia pestis KIM
uaucuguuguauacug

SEQ ID NO: 2319474 - RNA, 13 nt, Yersinia pestis KIM
uaucuaucuguuc

SEQ ID NO: 2319475 - RNA, 22 nt, Yersinia pestis KIM
uauccuugauggaaauacgcuu

SEQ ID NO: 2319476 - RNA, 16 nt, Yersinia pestis KIM
uauccuuuuuauuuaa

SEQ ID NO: 2319477 - RNA, 15 nt, Yersinia pestis KIM
uaucgaccaugaaua

SEQ ID NO: 2319478 - RNA, 13 nt, Yersinia pestis KIM
uaucgaauugauc

SEQ ID NO: 2319479 - RNA, 20 nt, Yersinia pestis KIM
uaucgaauugaucugauauu

SEQ ID NO: 2319480 - RNA, 17 nt, Yersinia pestis KIM
uaucgaaacacauacaa

SEQ ID NO: 2319481 - RNA, 13 nt, Yersinia pestis KIM
uaucgaaacacau

SEQ ID NO: 2319482 - RNA, 14 nt, Yersinia pestis KIM
uaucccuuacgauc

SEQ ID NO: 2319483 - RNA, 22 nt, Yersinia pestis KIM
uaucccuauuuuuuccgaaaaa

SEQ ID NO: 2319484 - RNA, 12 nt, Yersinia pestis KIM
uauccaggcacu

SEQ ID NO: 2319485 - RNA, 14 nt, Yersinia pestis KIM
uauccaggcacugc

SEQ ID NO: 2319486 - RNA, 11 nt, Yersinia pestis KIM
uauccagcccu

SEQ ID NO: 2319487 - RNA, 15 nt, Yersinia pestis KIM
uauccagccaccuua

SEQ ID NO: 2319488 - RNA, 13 nt, Yersinia pestis KIM
uaucaucagcaga

SEQ ID NO: 2319489 - RNA, 21 nt, Yersinia pestis KIM
uaucaucaccaagcuuaauau

SEQ ID NO: 2319490 - RNA, 12 nt, Yersinia pestis KIM
uaucaucaccac

SEQ ID NO: 2319491 - RNA, 16 nt, Yersinia pestis KIM
uaucauccccuauaua

SEQ ID NO: 2319492 - RNA, 17 nt, Yersinia pestis KIM
uaucauccccggcaaca

SEQ ID NO: 2319493 - RNA, 20 nt, Yersinia pestis KIM
uauaucgaucugauaucucu

SEQ ID NO: 2319494 - RNA, 13 nt, Yersinia pestis KIM
uauaucucuucuu

SEQ ID NO: 2319495 - RNA, 18 nt, Yersinia pestis KIM
uauauagcccagcguucu

SEQ ID NO: 2319496 - RNA, 18 nt, Yersinia pestis KIM
uauauagagaaaucuaca

SEQ ID NO: 2319497 - RNA, 12 nt, Yersinia pestis KIM
uauagcguucau

SEQ ID NO: 2319498 - RNA, 23 nt, Yersinia pestis KIM
uauauucuacaaugucacgcuuu

SEQ ID NO: 2319499 - RNA, 17 nt, Yersinia pestis KIM
uauauucuacaauguca

SEQ ID NO: 2319500 - RNA, 14 nt, Yersinia pestis KIM
uauauugauaaaag

SEQ ID NO: 2319501 - RNA, 18 nt, Yersinia pestis KIM
uauauucaauaucacuga

SEQ ID NO: 2319502 - RNA, 19 nt, Yersinia pestis KIM
uaucaauuguuugcuauca

SEQ ID NO: 2319503 - RNA, 19 nt, Yersinia pestis KIM
uaucaaucaaaaaauaaau

SEQ ID NO: 2319504 - RNA, 15 nt, Yersinia pestis KIM
uaucaaucaaaaaau

SEQ ID NO: 2319505 - RNA, 21 nt, Yersinia pestis KIM
uaucaaucagcugauaugaaa

SEQ ID NO: 2319506 - RNA, 24 nt, Yersinia pestis KIM
uaucaaucagcugauaugaaaaau

SEQ ID NO: 2319507 - RNA, 20 nt, Yersinia pestis KIM
uaucaauaggauuuucauga

SEQ ID NO: 2319508 - RNA, 12 nt, Yersinia pestis KIM
uaucaauagguc

SEQ ID NO: 2319509 - RNA, 15 nt, Yersinia pestis KIM
uaucaauaggucagu

SEQ ID NO: 2319510 - RNA, 17 nt, Yersinia pestis KIM
uauauugcauuuaugau

SEQ ID NO: 2319511 - RNA, 13 nt, Yersinia pestis KIM
uauauuuaauuga

SEQ ID NO: 2319512 - RNA, 16 nt, Yersinia pestis KIM
uaucaaguuaaauacu

SEQ ID NO: 2319513 - RNA, 18 nt, Yersinia pestis KIM
uaucaaggcggcagagcc

SEQ ID NO: 2319514 - RNA, 14 nt, Yersinia pestis KIM
uaucaguugguuua

SEQ ID NO: 2319515 - RNA, 19 nt, Yersinia pestis KIM
uaucaguguauuuaucaaa

SEQ ID NO: 2319516 - RNA, 15 nt, Yersinia pestis KIM
uaucagucuuuucaa

SEQ ID NO: 2319517 - RNA, 12 nt, Yersinia pestis KIM
uaucagucuuuu

SEQ ID NO: 2319518 - RNA, 20 nt, Yersinia pestis KIM
uaucaguagcuagaauaagu

SEQ ID NO: 2319519 - RNA, 23 nt, Yersinia pestis KIM
uaucauaucgaccaugaauaauu

SEQ ID NO: 2319520 - RNA, 20 nt, Yersinia pestis KIM
uaucaggcuaauacaugcug

SEQ ID NO: 2319521 - RNA, 12 nt, Yersinia pestis KIM
uaucaccagguu

SEQ ID NO: 2319522 - RNA, 22 nt, Yersinia pestis KIM
uaucagccccuaaauccugcaa

SEQ ID NO: 2319523 - RNA, 20 nt, Yersinia pestis KIM
uaucagcgaccaaauggacg

SEQ ID NO: 2319524 - RNA, 19 nt, Yersinia pestis KIM
uaucagcgauuuuaaaaaa

SEQ ID NO: 2319525 - RNA, 20 nt, Yersinia pestis KIM
uaucagcgauuuuaaaaaau

SEQ ID NO: 2319526 - RNA, 17 nt, Yersinia pestis KIM
uauaaacauuuacuuau

SEQ ID NO: 2319527 - RNA, 21 nt, Yersinia pestis KIM
uauaaacauuuacuuauaaac

SEQ ID NO: 2319528 - RNA, 18 nt, Yersinia pestis KIM
uauaaaugauugcuauau

SEQ ID NO: 2319529 - RNA, 12 nt, Yersinia pestis KIM
uauaaauuaaaa

SEQ ID NO: 2319530 - RNA, 21 nt, Yersinia pestis KIM
uauaaauggcuguuauauaaa

SEQ ID NO: 2319531 - RNA, 14 nt, Yersinia pestis KIM
uaguucaaugguca

SEQ ID NO: 2319532 - RNA, 20 nt, Yersinia pestis KIM
uaguuaucucccauuaauua

SEQ ID NO: 2319533 - RNA, 21 nt, Yersinia pestis KIM
uaguuaucucccauuaauuaa

SEQ ID NO: 2319534 - RNA, 23 nt, Yersinia pestis KIM
uaguuaucugggcggauaaggau

SEQ ID NO: 2319535 - RNA, 13 nt, Yersinia pestis KIM
uaguuuuucuccu

SEQ ID NO: 2319536 - RNA, 20 nt, Yersinia pestis KIM
uauaaaaaagcaugcagaau

SEQ ID NO: 2319537 - RNA, 18 nt, Yersinia pestis KIM
uauaaaaaagcugucaua

SEQ ID NO: 2319538 - RNA, 20 nt, Yersinia pestis KIM
uauaaaaaagcugucauaaa

SEQ ID NO: 2319539 - RNA, 17 nt, Yersinia pestis KIM
uaguuuuaauaaccauu

SEQ ID NO: 2319540 - RNA, 17 nt, Yersinia pestis KIM
uagucuccaaauucauu

SEQ ID NO: 2319541 - RNA, 15 nt, Yersinia pestis KIM
uagucuucaucaucc

SEQ ID NO: 2319542 - RNA, 22 nt, Yersinia pestis KIM
uagugaaaacguuaacugcagu

SEQ ID NO: 2319543 - RNA, 18 nt, Yersinia pestis KIM
uagugaaguaauaaaaau

SEQ ID NO: 2319544 - RNA, 19 nt, Yersinia pestis KIM
uagugaaccguacagauau

SEQ ID NO: 2319545 - RNA, 14 nt, Yersinia pestis KIM
uagguaacuaagcu

SEQ ID NO: 2319546 - RNA, 17 nt, Yersinia pestis KIM
uaggucagugguuuuau

SEQ ID NO: 2319547 - RNA, 21 nt, Yersinia pestis KIM
uaguuaacacgaaaagcagca

SEQ ID NO: 2319548 - RNA, 15 nt, Yersinia pestis KIM
uaguuaacccuauuu

SEQ ID NO: 2319549 - RNA, 12 nt, Yersinia pestis KIM
uaguuaaauaau

SEQ ID NO: 2319550 - RNA, 17 nt, Yersinia pestis KIM
uaguuaaucgcagcaga

SEQ ID NO: 2319551 - RNA, 11 nt, Yersinia pestis KIM
uagugcuucca

SEQ ID NO: 2319552 - RNA, 17 nt, Yersinia pestis KIM
uaguggcacaaauaaaa

SEQ ID NO: 2319553 - RNA, 23 nt, Yersinia pestis KIM
uaguggugagcgccaugcgcuuu

SEQ ID NO: 2319554 - RNA, 13 nt, Yersinia pestis KIM
uauaauucauuuu

SEQ ID NO: 2319555 - RNA, 14 nt, Yersinia pestis KIM
uauaauaacucuau

SEQ ID NO: 2319556 - RNA, 17 nt, Yersinia pestis KIM
uauaaauuaaaaagagu

SEQ ID NO: 2319557 - RNA, 22 nt, Yersinia pestis KIM
uauaaauuacucguauaaaaaa

SEQ ID NO: 2319558 - RNA, 22 nt, Yersinia pestis KIM
uauaauagcuggcggauaaaaa

SEQ ID NO: 2319559 - RNA, 11 nt, Yersinia pestis KIM
uauaauaaugg

SEQ ID NO: 2319560 - RNA, 18 nt, Yersinia pestis KIM
uauacagcauauaaaaaa

SEQ ID NO: 2319561 - RNA, 21 nt, Yersinia pestis KIM
uauacagucaauugagaauaa

SEQ ID NO: 2319562 - RNA, 22 nt, Yersinia pestis KIM
uauacaauugccugauuuuuau

SEQ ID NO: 2319563 - RNA, 19 nt, Yersinia pestis KIM
uauacaaggcacaucucca

SEQ ID NO: 2319564 - RNA, 18 nt, Yersinia pestis KIM
uauaauuucuugucaccu

SEQ ID NO: 2319565 - RNA, 14 nt, Yersinia pestis KIM
uauaauuucucuca

SEQ ID NO: 2319566 - RNA, 23 nt, Yersinia pestis KIM
uauagacaccuucccuauucaaa

SEQ ID NO: 2319567 - RNA, 17 nt, Yersinia pestis KIM
uauagaauucauucaga

SEQ ID NO: 2319568 - RNA, 23 nt, Yersinia pestis KIM
uauacccaccagagaccacagau

SEQ ID NO: 2319569 - RNA, 21 nt, Yersinia pestis KIM
uauacccagcaucauaagacu

SEQ ID NO: 2319570 - RNA, 15 nt, Yersinia pestis KIM
uauacccgucauaaa

SEQ ID NO: 2319571 - RNA, 14 nt, Yersinia pestis KIM
uauacggcuauuuu

SEQ ID NO: 2319572 - RNA, 15 nt, Yersinia pestis KIM
uauacuaaagaaaua

SEQ ID NO: 2319573 - RNA, 17 nt, Yersinia pestis KIM
uauacuaaaacagcuca

SEQ ID NO: 2319574 - RNA, 19 nt, Yersinia pestis KIM
uauacuaugggauaaacuu

SEQ ID NO: 2319575 - RNA, 14 nt, Yersinia pestis KIM
uaagauaccagcga

SEQ ID NO: 2319576 - RNA, 17 nt, Yersinia pestis KIM
uaagauccaccacauca

SEQ ID NO: 2319577 - RNA, 14 nt, Yersinia pestis KIM
uaagauccaccaca

SEQ ID NO: 2319578 - RNA, 16 nt, Yersinia pestis KIM
uaagaucaauauguuu

SEQ ID NO: 2319579 - RNA, 15 nt, Yersinia pestis KIM
uaagagucacagcau

SEQ ID NO: 2319580 - RNA, 19 nt, Yersinia pestis KIM
uaagagcgacucaauaaua

SEQ ID NO: 2319581 - RNA, 22 nt, Yersinia pestis KIM
uaagaauaaggguagguucaau

SEQ ID NO: 2319582 - RNA, 16 nt, Yersinia pestis KIM
uaagaagccucaugaa

SEQ ID NO: 2319583 - RNA, 19 nt, Yersinia pestis KIM
uaagaacgcuugcgccaaa

SEQ ID NO: 2319584 - RNA, 16 nt, Yersinia pestis KIM
uaagaacaacgcugca

SEQ ID NO: 2319585 - RNA, 15 nt, Yersinia pestis KIM
uaacuuuuggcagca

SEQ ID NO: 2319586 - RNA, 15 nt, Yersinia pestis KIM
uaacuuuucuucauu

SEQ ID NO: 2319587 - RNA, 17 nt, Yersinia pestis KIM
uaacuuuccauccagaa

SEQ ID NO: 2319588 - RNA, 21 nt, Yersinia pestis KIM
uaacuuaucgaccaacuggca

SEQ ID NO: 2319589 - RNA, 19 nt, Yersinia pestis KIM
uaacuuauugauuauaugc

SEQ ID NO: 2319590 - RNA, 23 nt, Yersinia pestis KIM
uaacuuauuacaccuuaaaacag

SEQ ID NO: 2319591 - RNA, 17 nt, Yersinia pestis KIM
uaacuuaaauaauuuuc

SEQ ID NO: 2319592 - RNA, 20 nt, Yersinia pestis KIM
uaacuuagauugcaaaucac

SEQ ID NO: 2319593 - RNA, 21 nt, Yersinia pestis KIM
uaacuuaaaauauggcaggua

SEQ ID NO: 2319594 - RNA, 15 nt, Yersinia pestis KIM
uaacuguuaaaacag

SEQ ID NO: 2319595 - RNA, 15 nt, Yersinia pestis KIM
uaacuucuauuuuuc

SEQ ID NO: 2319596 - RNA, 18 nt, Yersinia pestis KIM
uaagcggcguauuaucag

SEQ ID NO: 2319597 - RNA, 18 nt, Yersinia pestis KIM
uaagcgggcuuuaauagc

SEQ ID NO: 2319598 - RNA, 16 nt, Yersinia pestis KIM
uaagcgguuuguuaaa

SEQ ID NO: 2319599 - RNA, 21 nt, Yersinia pestis KIM
uaagcguauuuugucaugaaa

SEQ ID NO: 2319600 - RNA, 17 nt, Yersinia pestis KIM
uaagcgacgacauuaau

SEQ ID NO: 2319601 - RNA, 22 nt, Yersinia pestis KIM
uaagccgcaggcaaacaaugug

SEQ ID NO: 2319602 - RNA, 19 nt, Yersinia pestis KIM
uaagccucggucacugccu

SEQ ID NO: 2319603 - RNA, 18 nt, Yersinia pestis KIM
uaagcucaucuaacucau

SEQ ID NO: 2319604 - RNA, 15 nt, Yersinia pestis KIM
uaagcugccugugcg

SEQ ID NO: 2319605 - RNA, 18 nt, Yersinia pestis KIM
uaagcugccugugcggca

SEQ ID NO: 2319606 - RNA, 22 nt, Yersinia pestis KIM
uaagcugaaauuuuuuaauuug

SEQ ID NO: 2319607 - RNA, 20 nt, Yersinia pestis KIM
uaagcuggcgcacucauccu

SEQ ID NO: 2319608 - RNA, 20 nt, Yersinia pestis KIM
uaagcuguuggcuuuaucuc

SEQ ID NO: 2319609 - RNA, 13 nt, Yersinia pestis KIM
uaaggaaacucau

SEQ ID NO: 2319610 - RNA, 14 nt, Yersinia pestis KIM
uaaggaaaauaccc

SEQ ID NO: 2319611 - RNA, 19 nt, Yersinia pestis KIM
uaagcuucgagcaggcuuu

SEQ ID NO: 2319612 - RNA, 19 nt, Yersinia pestis KIM
uaagauucgccgcaaggca

SEQ ID NO: 2319613 - RNA, 21 nt, Yersinia pestis KIM
uaagauucgccgcaaggcaaa

SEQ ID NO: 2319614 - RNA, 20 nt, Yersinia pestis KIM
uaagauccaguucaguccag

SEQ ID NO: 2319615 - RNA, 20 nt, Yersinia pestis KIM
uaagauccagaacaccaaca

SEQ ID NO: 2319616 - RNA, 17 nt, Yersinia pestis KIM
uaagauccauguauauu

SEQ ID NO: 2319617 - RNA, 13 nt, Yersinia pestis KIM
uaagaucucagca

SEQ ID NO: 2319618 - RNA, 24 nt, Yersinia pestis KIM
uaagaugcaucccacgcagauacu

SEQ ID NO: 2319619 - RNA, 18 nt, Yersinia pestis KIM
uaagccgcaauaaauggc

SEQ ID NO: 2319620 - RNA, 18 nt, Yersinia pestis KIM
uaagccaugggucauuaa

SEQ ID NO: 2319621 - RNA, 20 nt, Yersinia pestis KIM
uaagccaugggucauuaauu

SEQ ID NO: 2319622 - RNA, 19 nt, Yersinia pestis KIM
uaagccauuuuuuauaaac

SEQ ID NO: 2319623 - RNA, 18 nt, Yersinia pestis KIM
uaagcauuggcaaaucau

SEQ ID NO: 2319624 - RNA, 17 nt, Yersinia pestis KIM
uaagccaauaauauaau

SEQ ID NO: 2319625 - RNA, 19 nt, Yersinia pestis KIM
uaagcaauuuagacagcuu

SEQ ID NO: 2319626 - RNA, 20 nt, Yersinia pestis KIM
uaagcaggcaguaaaauauu

SEQ ID NO: 2319627 - RNA, 16 nt, Yersinia pestis KIM
uaacucuucuggcaaa

SEQ ID NO: 2319628 - RNA, 12 nt, Yersinia pestis KIM
uaacugaaagcc

SEQ ID NO: 2319629 - RNA, 18 nt, Yersinia pestis KIM
uaacugaccgcagccuuc

SEQ ID NO: 2319630 - RNA, 21 nt, Yersinia pestis KIM
uaacugaguuggaaaugacaa

SEQ ID NO: 2319631 - RNA, 17 nt, Yersinia pestis KIM
uaacugcagugaaaagg

SEQ ID NO: 2319632 - RNA, 23 nt, Yersinia pestis KIM
uaacugccgauaucuuuaucauu

SEQ ID NO: 2319633 - RNA, 16 nt, Yersinia pestis KIM
uaacugguggcaggcc

SEQ ID NO: 2319634 - RNA, 10 nt, Yersinia pestis KIM
uaacuggucu

SEQ ID NO: 2319635 - RNA, 15 nt, Yersinia pestis KIM
uaacugguggcaggc

SEQ ID NO: 2319636 - RNA, 16 nt, Yersinia pestis KIM
uaacugugcaguaucu

SEQ ID NO: 2319637 - RNA, 15 nt, Yersinia pestis KIM
uaacuguaaggccaa

SEQ ID NO: 2319638 - RNA, 15 nt, Yersinia pestis KIM
uaacugggaagacau

SEQ ID NO: 2319639 - RNA, 15 nt, Yersinia pestis KIM
uaacucaagcguuau

SEQ ID NO: 2319640 - RNA, 13 nt, Yersinia pestis KIM
uaacucagccaca

SEQ ID NO: 2319641 - RNA, 18 nt, Yersinia pestis KIM
uaacucaggauccucguc

SEQ ID NO: 2319642 - RNA, 13 nt, Yersinia pestis KIM
uaacucaugugua

SEQ ID NO: 2319643 - RNA, 13 nt, Yersinia pestis KIM
uaacucaguaccg

SEQ ID NO: 2319644 - RNA, 16 nt, Yersinia pestis KIM
uaacuccaucaggcua

SEQ ID NO: 2319645 - RNA, 16 nt, Yersinia pestis KIM
uaacucgccacucaca

SEQ ID NO: 2319646 - RNA, 18 nt, Yersinia pestis KIM
uaacucaaccccagccgg

SEQ ID NO: 2319647 - RNA, 14 nt, Yersinia pestis KIM
uaacuaauaauaau

SEQ ID NO: 2319648 - RNA, 18 nt, Yersinia pestis KIM
uaacuaagagucacagca

SEQ ID NO: 2319649 - RNA, 13 nt, Yersinia pestis KIM
uaacuaagcugcc

SEQ ID NO: 2319650 - RNA, 20 nt, Yersinia pestis KIM
uaacgccgaguaagucaaua

SEQ ID NO: 2319651 - RNA, 19 nt, Yersinia pestis KIM
uaacgccggauaaauuaau

SEQ ID NO: 2319652 - RNA, 15 nt, Yersinia pestis KIM
uaacggcucugccaa

SEQ ID NO: 2319653 - RNA, 23 nt, Yersinia pestis KIM
uaacggccggaacggucagggaa

SEQ ID NO: 2319654 - RNA, 13 nt, Yersinia pestis KIM
uaacggccagcgu

SEQ ID NO: 2319655 - RNA, 13 nt, Yersinia pestis KIM
uaacgggcggcug

SEQ ID NO: 2319656 - RNA, 21 nt, Yersinia pestis KIM
uaacguuuuaacgcuuugacu

SEQ ID NO: 2319657 - RNA, 18 nt, Yersinia pestis KIM
uaacggucauaaucaggg

SEQ ID NO: 2319658 - RNA, 14 nt, Yersinia pestis KIM
uaaccuuaacugca

SEQ ID NO: 2319659 - RNA, 22 nt, Yersinia pestis KIM
uaaccugcuggcgcaacuguag

SEQ ID NO: 2319660 - RNA, 15 nt, Yersinia pestis KIM
uaaccccguagcaca

SEQ ID NO: 2319661 - RNA, 22 nt, Yersinia pestis KIM
uaacccccaaauagcuggcauc

SEQ ID NO: 2319662 - RNA, 21 nt, Yersinia pestis KIM
uaacccauugguuuuuagcuu

SEQ ID NO: 2319663 - RNA, 18 nt, Yersinia pestis KIM
uaaccucuaauaaaccug

SEQ ID NO: 2319664 - RNA, 12 nt, Yersinia pestis KIM
uaacccaaagug

SEQ ID NO: 2319665 - RNA, 13 nt, Yersinia pestis KIM
uaaccauuuuaau

SEQ ID NO: 2319666 - RNA, 21 nt, Yersinia pestis KIM
uaaccauuuuaauauuauggu

SEQ ID NO: 2319667 - RNA, 13 nt, Yersinia pestis KIM
uaacccaaagcca

SEQ ID NO: 2319668 - RNA, 12 nt, Yersinia pestis KIM
uaaccauugguu

SEQ ID NO: 2319669 - RNA, 24 nt, Yersinia pestis KIM
uaaccaaagaacggccugccagaa

SEQ ID NO: 2319670 - RNA, 21 nt, Yersinia pestis KIM
uaaccaacaguuauuuuaauu

SEQ ID NO: 2319671 - RNA, 22 nt, Yersinia pestis KIM
uaaccaacaguuauuuuaauug

SEQ ID NO: 2319672 - RNA, 21 nt, Yersinia pestis KIM
uaaccagcaguugcugcucug

SEQ ID NO: 2319673 - RNA, 11 nt, Yersinia pestis KIM
uaaccacagca

SEQ ID NO: 2319674 - RNA, 15 nt, Yersinia pestis KIM
uaaccaauucuuagg

SEQ ID NO: 2319675 - RNA, 20 nt, Yersinia pestis KIM
uaaccaccgucaccaaauau

SEQ ID NO: 2319676 - RNA, 19 nt, Yersinia pestis KIM
uaacauauaaaccagccag

SEQ ID NO: 2319677 - RNA, 15 nt, Yersinia pestis KIM
uaacauaaggcuaga

SEQ ID NO: 2319678 - RNA, 19 nt, Yersinia pestis KIM
uaacagcgugcgcuccauu

SEQ ID NO: 2319679 - RNA, 17 nt, Yersinia pestis KIM
uaaaugucgcuaauagg

SEQ ID NO: 2319680 - RNA, 19 nt, Yersinia pestis KIM
uaaaugucacuugcccuga

SEQ ID NO: 2319681 - RNA, 19 nt, Yersinia pestis KIM
uaaauuuuguacaacuucu

SEQ ID NO: 2319682 - RNA, 22 nt, Yersinia pestis KIM
uaaauuuuguacaacuucuuca

SEQ ID NO: 2319683 - RNA, 13 nt, Yersinia pestis KIM
uaaauguucaccg

SEQ ID NO: 2319684 - RNA, 12 nt, Yersinia pestis KIM
uaacaaaaccgg

SEQ ID NO: 2319685 - RNA, 17 nt, Yersinia pestis KIM
uaaauuuuuauauaauu

SEQ ID NO: 2319686 - RNA, 16 nt, Yersinia pestis KIM
uaacaacccuaacacc

SEQ ID NO: 2319687 - RNA, 21 nt, Yersinia pestis KIM
uaacaacccuaacaccgagua

SEQ ID NO: 2319688 - RNA, 15 nt, Yersinia pestis KIM
uaacaaguuacauuu

SEQ ID NO: 2319689 - RNA, 11 nt, Yersinia pestis KIM
uaacaacugcc

SEQ ID NO: 2319690 - RNA, 21 nt, Yersinia pestis KIM
uaacaacugguuaucacuguc

SEQ ID NO: 2319691 - RNA, 17 nt, Yersinia pestis KIM
uaacaauccgaacaaaa

SEQ ID NO: 2319692 - RNA, 17 nt, Yersinia pestis KIM
uaacaccgcuguagcgu

SEQ ID NO: 2319693 - RNA, 18 nt, Yersinia pestis KIM
uaacacgaaaagcagcag

SEQ ID NO: 2319694 - RNA, 19 nt, Yersinia pestis KIM
uaacacgaaaagcagcagu

SEQ ID NO: 2319695 - RNA, 15 nt, Yersinia pestis KIM
uaacaauccgaacaa

SEQ ID NO: 2319696 - RNA, 16 nt, Yersinia pestis KIM
uaacaauccgaacaaa

SEQ ID NO: 2319697 - RNA, 14 nt, Yersinia pestis KIM
uaacaaucagugca

SEQ ID NO: 2319698 - RNA, 20 nt, Yersinia pestis KIM
uaacacgaaaagcagcaguu

SEQ ID NO: 2319699 - RNA, 20 nt, Yersinia pestis KIM
uaacacggccuauugaauaa

SEQ ID NO: 2319700 - RNA, 23 nt, Yersinia pestis KIM
uaacacggccuauugaauaacag

SEQ ID NO: 2319701 - RNA, 21 nt, Yersinia pestis KIM
uaacacguuaaauuucuucaa

SEQ ID NO: 2319702 - RNA, 21 nt, Yersinia pestis KIM
uaacacuugaccaaccuguuu

SEQ ID NO: 2319703 - RNA, 17 nt, Yersinia pestis KIM
uaacacuucaugacagg

SEQ ID NO: 2319704 - RNA, 20 nt, Yersinia pestis KIM
uaaagaaauaaucauaucaa

SEQ ID NO: 2319705 - RNA, 14 nt, Yersinia pestis KIM
uaaagaaaaacccg

SEQ ID NO: 2319706 - RNA, 12 nt, Yersinia pestis KIM
uaaagaaaaaac

SEQ ID NO: 2319707 - RNA, 18 nt, Yersinia pestis KIM
uaaacugugcccuugagc

SEQ ID NO: 2319708 - RNA, 17 nt, Yersinia pestis KIM
uaaagauagccacuaac

SEQ ID NO: 2319709 - RNA, 16 nt, Yersinia pestis KIM
uaaagauaauuaauuc

SEQ ID NO: 2319710 - RNA, 19 nt, Yersinia pestis KIM
uaaagauaauuaauucaau

SEQ ID NO: 2319711 - RNA, 15 nt, Yersinia pestis KIM
uaaagagugaaauau

SEQ ID NO: 2319712 - RNA, 22 nt, Yersinia pestis KIM
uaaaggcaacgaaggcaacaac

SEQ ID NO: 2319713 - RNA, 19 nt, Yersinia pestis KIM
uaaaggcaagauuucucuu

SEQ ID NO: 2319714 - RNA, 16 nt, Yersinia pestis KIM
uaaagcugucagucca

SEQ ID NO: 2319715 - RNA, 16 nt, Yersinia pestis KIM
uaaagauuucaucauu

SEQ ID NO: 2319716 - RNA, 21 nt, Yersinia pestis KIM
uaaagauuucaucauucaaua

SEQ ID NO: 2319717 - RNA, 20 nt, Yersinia pestis KIM
uaaagcaaagaucucucgaa

SEQ ID NO: 2319718 - RNA, 22 nt, Yersinia pestis KIM
uaaacgccgaucauaaaucaca

SEQ ID NO: 2319719 - RNA, 14 nt, Yersinia pestis KIM
uaaacgcccagcua

SEQ ID NO: 2319720 - RNA, 20 nt, Yersinia pestis KIM
uaaacgcccagcuaauugau

SEQ ID NO: 2319721 - RNA, 20 nt, Yersinia pestis KIM
uaaacgccugggauccauag

SEQ ID NO: 2319722 - RNA, 23 nt, Yersinia pestis KIM
uaaacuaccgaucaucaggcagg

SEQ ID NO: 2319723 - RNA, 18 nt, Yersinia pestis KIM
uaaacugaauaucccccu

SEQ ID NO: 2319724 - RNA, 15 nt, Yersinia pestis KIM
uaaacucuuuaaguu

SEQ ID NO: 2319725 - RNA, 15 nt, Yersinia pestis KIM
uaaacugaucaucaa

SEQ ID NO: 2319726 - RNA, 17 nt, Yersinia pestis KIM
uaaacugccguaaacaa

SEQ ID NO: 2319727 - RNA, 17 nt, Yersinia pestis KIM
uaaacgccaaucaccuu

SEQ ID NO: 2319728 - RNA, 15 nt, Yersinia pestis KIM
uaaacccaaccccau

SEQ ID NO: 2319729 - RNA, 20 nt, Yersinia pestis KIM
uaaacccaaccccaucagca

SEQ ID NO: 2319730 - RNA, 17 nt, Yersinia pestis KIM
uaaacccacagacauuu

SEQ ID NO: 2319731 - RNA, 21 nt, Yersinia pestis KIM
uaaacccccuguaaccgcaag

SEQ ID NO: 2319732 - RNA, 13 nt, Yersinia pestis KIM
uaaaccaucagag

SEQ ID NO: 2319733 - RNA, 15 nt, Yersinia pestis KIM
uaaaccaucagaguc

SEQ ID NO: 2319734 - RNA, 22 nt, Yersinia pestis KIM
uaaacagccguauaucuuaccu

SEQ ID NO: 2319735 - RNA, 17 nt, Yersinia pestis KIM
uaaacagggcagaaaau

SEQ ID NO: 2319736 - RNA, 18 nt, Yersinia pestis KIM
uaaacagucuuauuacuc

SEQ ID NO: 2319737 - RNA, 20 nt, Yersinia pestis KIM
uaaacaguaggaauuauagu

SEQ ID NO: 2319738 - RNA, 20 nt, Yersinia pestis KIM
uaaauaaguaggcaucugcc

SEQ ID NO: 2319739 - RNA, 19 nt, Yersinia pestis KIM
uaaauaacgcaaaaaucac

SEQ ID NO: 2319740 - RNA, 20 nt, Yersinia pestis KIM
uaaauaacgcaaaaaucacu

SEQ ID NO: 2319741 - RNA, 16 nt, Yersinia pestis KIM
uaaauacagcaccauu

SEQ ID NO: 2319742 - RNA, 17 nt, Yersinia pestis KIM
uaaauaccaauuucaua

SEQ ID NO: 2319743 - RNA, 13 nt, Yersinia pestis KIM
uaaauacagauca

SEQ ID NO: 2319744 - RNA, 16 nt, Yersinia pestis KIM
uaaauaauaucaauga

SEQ ID NO: 2319745 - RNA, 20 nt, Yersinia pestis KIM
uaaauaguuacuauauaaau

SEQ ID NO: 2319746 - RNA, 22 nt, Yersinia pestis KIM
uaaauaguuacuauauaaauga

SEQ ID NO: 2319747 - RNA, 20 nt, Yersinia pestis KIM
uaaauagucguuauauaaau

SEQ ID NO: 2319748 - RNA, 18 nt, Yersinia pestis KIM
uaaauacccgguuuccag

SEQ ID NO: 2319749 - RNA, 19 nt, Yersinia pestis KIM
uaaauaccgccaaauacaa

SEQ ID NO: 2319750 - RNA, 15 nt, Yersinia pestis KIM
uaaagugcguaggca

SEQ ID NO: 2319751 - RNA, 22 nt, Yersinia pestis KIM
uaaaggcuaaaccggcacaggc

SEQ ID NO: 2319752 - RNA, 22 nt, Yersinia pestis KIM
uaaaggggggaaacgguuuuaa

SEQ ID NO: 2319753 - RNA, 11 nt, Yersinia pestis KIM
uaaaucaucaa

SEQ ID NO: 2319754 - RNA, 13 nt, Yersinia pestis KIM
uaaaucaucaaau

SEQ ID NO: 2319755 - RNA, 16 nt, Yersinia pestis KIM
uaaaucaucaaauuca

SEQ ID NO: 2319756 - RNA, 19 nt, Yersinia pestis KIM
uaaaucagaccauggccuu

SEQ ID NO: 2319757 - RNA, 12 nt, Yersinia pestis KIM
uaaauccaaaug

SEQ ID NO: 2319758 - RNA, 15 nt, Yersinia pestis KIM
uaaauccaaaugccc

SEQ ID NO: 2319759 - RNA, 16 nt, Yersinia pestis KIM
uaaauccaaaugccca

SEQ ID NO: 2319760 - RNA, 20 nt, Yersinia pestis KIM
uaaaucaugucccuauuaga

SEQ ID NO: 2319761 - RNA, 13 nt, Yersinia pestis KIM
uaaauauucauua

SEQ ID NO: 2319762 - RNA, 13 nt, Yersinia pestis KIM
uaaauauaaaaua

SEQ ID NO: 2319763 - RNA, 14 nt, Yersinia pestis KIM
uaaauauaaaauaa

SEQ ID NO: 2319764 - RNA, 17 nt, Yersinia pestis KIM
uaaaucccgcuugucgc

SEQ ID NO: 2319765 - RNA, 20 nt, Yersinia pestis KIM
uaaauccgcuaguuaacccu

SEQ ID NO: 2319766 - RNA, 21 nt, Yersinia pestis KIM
uaaauccguggcccccuuucc

SEQ ID NO: 2319767 - RNA, 14 nt, Yersinia pestis KIM
uaaauccaaggcgg

SEQ ID NO: 2319768 - RNA, 18 nt, Yersinia pestis KIM
uaaaucgucgaacauuuu

SEQ ID NO: 2319769 - RNA, 21 nt, Yersinia pestis KIM
uaaaugcaauuuuugcagugc

SEQ ID NO: 2319770 - RNA, 23 nt, Yersinia pestis KIM
uaaaugcaauauugcuugccagc

SEQ ID NO: 2319771 - RNA, 15 nt, Yersinia pestis KIM
uaaaauaauaauggu

SEQ ID NO: 2319772 - RNA, 11 nt, Yersinia pestis KIM
uaaaauaauga

SEQ ID NO: 2319773 - RNA, 18 nt, Yersinia pestis KIM
uaaaaggauggcccaagc

SEQ ID NO: 2319774 - RNA, 19 nt, Yersinia pestis KIM
uaaaaggauagggagccaa

SEQ ID NO: 2319775 - RNA, 23 nt, Yersinia pestis KIM
uaaaaggauagggagccaauaga

SEQ ID NO: 2319776 - RNA, 21 nt, Yersinia pestis KIM
uaaaauaaugaguuaaugaga

SEQ ID NO: 2319777 - RNA, 13 nt, Yersinia pestis KIM
uaaaauaaugagu

SEQ ID NO: 2319778 - RNA, 18 nt, Yersinia pestis KIM
uaaaauuacccagcaucu

SEQ ID NO: 2319779 - RNA, 16 nt, Yersinia pestis KIM
uaaaauuaauaaauua

SEQ ID NO: 2319780 - RNA, 17 nt, Yersinia pestis KIM
uaaaauuaauaaauuau

SEQ ID NO: 2319781 - RNA, 18 nt, Yersinia pestis KIM
uaaacaacgcugaaaaau

SEQ ID NO: 2319782 - RNA, 18 nt, Yersinia pestis KIM
uaaacaaccaaaaaucuu

SEQ ID NO: 2319783 - RNA, 14 nt, Yersinia pestis KIM
uaaacaaauaugac

SEQ ID NO: 2319784 - RNA, 13 nt, Yersinia pestis KIM
uaaacaaaauagg

SEQ ID NO: 2319785 - RNA, 17 nt, Yersinia pestis KIM
uaaacaauguuaaacuu

SEQ ID NO: 2319786 - RNA, 14 nt, Yersinia pestis KIM
uaaacaacacauuc

SEQ ID NO: 2319787 - RNA, 18 nt, Yersinia pestis KIM
uaaacaagcuuauauuau

SEQ ID NO: 2319788 - RNA, 18 nt, Yersinia pestis KIM
uaaacagacuaaaaaccg

SEQ ID NO: 2319789 - RNA, 16 nt, Yersinia pestis KIM
uaaacagacacagcaa

SEQ ID NO: 2319790 - RNA, 19 nt, Yersinia pestis KIM
uaaacagacacagcaacaa

SEQ ID NO: 2319791 - RNA, 18 nt, Yersinia pestis KIM
uaaacacucaauaaguag

SEQ ID NO: 2319792 - RNA, 22 nt, Yersinia pestis KIM
uaaacagacaaaaaauaguugu

SEQ ID NO: 2319793 - RNA, 14 nt, Yersinia pestis KIM
uaaacaaugaaauu

SEQ ID NO: 2319794 - RNA, 12 nt, Yersinia pestis KIM
uaaaauuuuaag

SEQ ID NO: 2319795 - RNA, 15 nt, Yersinia pestis KIM
uaaaaauucacaaca

SEQ ID NO: 2319796 - RNA, 12 nt, Yersinia pestis KIM
uaaaacauuuca

SEQ ID NO: 2319797 - RNA, 10 nt, Yersinia pestis KIM
uaaaaccaau

SEQ ID NO: 2319798 - RNA, 16 nt, Yersinia pestis KIM
uaaaaccacugaccua

SEQ ID NO: 2319799 - RNA, 21 nt, Yersinia pestis KIM
uaaaaccacugaccuauugau

SEQ ID NO: 2319800 - RNA, 23 nt, Yersinia pestis KIM
uaaaaccacugaccuauugauaa

SEQ ID NO: 2319801 - RNA, 12 nt, Yersinia pestis KIM
uaaaaccacuga

SEQ ID NO: 2319802 - RNA, 19 nt, Yersinia pestis KIM
uaaaagauucauaaaaaaa

SEQ ID NO: 2319803 - RNA, 17 nt, Yersinia pestis KIM
uaaaagauucauaaaaa

SEQ ID NO: 2319804 - RNA, 15 nt, Yersinia pestis KIM
uaaaacugaagcauc

SEQ ID NO: 2319805 - RNA, 14 nt, Yersinia pestis KIM
uaaaacucaaacug

SEQ ID NO: 2319806 - RNA, 22 nt, Yersinia pestis KIM
uaaaaagucauuaacuguuaaa

SEQ ID NO: 2319807 - RNA, 15 nt, Yersinia pestis KIM
uaaaaagccagucag

SEQ ID NO: 2319808 - RNA, 19 nt, Yersinia pestis KIM
uaaaaagccugaauucugu

SEQ ID NO: 2319809 - RNA, 19 nt, Yersinia pestis KIM
uaaaaagcgacacuuauug

SEQ ID NO: 2319810 - RNA, 14 nt, Yersinia pestis KIM
uaaaaauacaacca

SEQ ID NO: 2319811 - RNA, 16 nt, Yersinia pestis KIM
uaaaaauacauaucaa

SEQ ID NO: 2319812 - RNA, 21 nt, Yersinia pestis KIM
uaaaaauacauaucaacacug

SEQ ID NO: 2319813 - RNA, 14 nt, Yersinia pestis KIM
uaaaaauaaucaau

SEQ ID NO: 2319814 - RNA, 16 nt, Yersinia pestis KIM
uaaaaauaaucaauga

SEQ ID NO: 2319815 - RNA, 11 nt, Yersinia pestis KIM
uaaaaaccccu

SEQ ID NO: 2319816 - RNA, 21 nt, Yersinia pestis KIM
uaaaaacuuaucuaaaaaacc

SEQ ID NO: 2319817 - RNA, 12 nt, Yersinia pestis KIM
uaaaaacugugc

SEQ ID NO: 2319818 - RNA, 20 nt, Yersinia pestis KIM
uaaaaacuaccguauaauca

SEQ ID NO: 2319819 - RNA, 18 nt, Yersinia pestis KIM
uaaaaacuaaggggccaa

SEQ ID NO: 2319820 - RNA, 18 nt, Yersinia pestis KIM
guugcccccaccauggca

SEQ ID NO: 2319821 - RNA, 19 nt, Yersinia pestis KIM
guugccauguugaguuuac

SEQ ID NO: 2319822 - RNA, 12 nt, Yersinia pestis KIM
guugccagcagg

SEQ ID NO: 2319823 - RNA, 17 nt, Yersinia pestis KIM
guugccauaaccugagc

SEQ ID NO: 2319824 - RNA, 13 nt, Yersinia pestis KIM
guugccacagagg

SEQ ID NO: 2319825 - RNA, 21 nt, Yersinia pestis KIM
guugcauugccucccauugcu

SEQ ID NO: 2319826 - RNA, 18 nt, Yersinia pestis KIM
guugcccguuaauauuaa

SEQ ID NO: 2319827 - RNA, 14 nt, Yersinia pestis KIM
guugcgaaauaaau

SEQ ID NO: 2319828 - RNA, 22 nt, Yersinia pestis KIM
guugcuaggcgcagcagggcuu

SEQ ID NO: 2319829 - RNA, 21 nt, Yersinia pestis KIM
guugggaaaaguggcuaucug

SEQ ID NO: 2319830 - RNA, 16 nt, Yersinia pestis KIM
guuggcuuuaucucac

SEQ ID NO: 2319831 - RNA, 12 nt, Yersinia pestis KIM
guuggggaugcc

SEQ ID NO: 2319832 - RNA, 14 nt, Yersinia pestis KIM
guugggcaguaacg

SEQ ID NO: 2319833 - RNA, 14 nt, Yersinia pestis KIM
guuggucaccacuu

SEQ ID NO: 2319834 - RNA, 17 nt, Yersinia pestis KIM
guuggucaccacuugca

SEQ ID NO: 2319835 - RNA, 13 nt, Yersinia pestis KIM
guuggucagcacu

SEQ ID NO: 2319836 - RNA, 17 nt, Yersinia pestis KIM
guuggucagcacuucca

SEQ ID NO: 2319837 - RNA, 22 nt, Yersinia pestis KIM
guuggugaucuggcuuucucaa

SEQ ID NO: 2319838 - RNA, 15 nt, Yersinia pestis KIM
guugcugucucgcuu

SEQ ID NO: 2319839 - RNA, 22 nt, Yersinia pestis KIM
guugcuucacggacagcaacca

SEQ ID NO: 2319840 - RNA, 15 nt, Yersinia pestis KIM
guugcuuuuaacucc

SEQ ID NO: 2319841 - RNA, 13 nt, Yersinia pestis KIM
guuggcaaauaau

SEQ ID NO: 2319842 - RNA, 20 nt, Yersinia pestis KIM
guuucucugccgccagauuu

SEQ ID NO: 2319843 - RNA, 20 nt, Yersinia pestis KIM
guuucgcaucaggcuuauau

SEQ ID NO: 2319844 - RNA, 18 nt, Yersinia pestis KIM
guuucgccuucccacaaa

SEQ ID NO: 2319845 - RNA, 17 nt, Yersinia pestis KIM
guuugagaaacugaugc

SEQ ID NO: 2319846 - RNA, 14 nt, Yersinia pestis KIM
guuuccuucaccaa

SEQ ID NO: 2319847 - RNA, 21 nt, Yersinia pestis KIM
guuuauccuuuuuauuuaagc

SEQ ID NO: 2319848 - RNA, 22 nt, Yersinia pestis KIM
guuuauccuuuuuauuuaagca

SEQ ID NO: 2319849 - RNA, 13 nt, Yersinia pestis KIM
guuuaccuauugc

SEQ ID NO: 2319850 - RNA, 19 nt, Yersinia pestis KIM
guuuacaugauugaaaaac

SEQ ID NO: 2319851 - RNA, 17 nt, Yersinia pestis KIM
guuuagcuuccaacuga

SEQ ID NO: 2319852 - RNA, 15 nt, Yersinia pestis KIM
guuuaucaaacagca

SEQ ID NO: 2319853 - RNA, 15 nt, Yersinia pestis KIM
guuuauaaauuaaaa

SEQ ID NO: 2319854 - RNA, 16 nt, Yersinia pestis KIM
guuuauacuauuuaug

SEQ ID NO: 2319855 - RNA, 15 nt, Yersinia pestis KIM
guuguuucaauaaau

SEQ ID NO: 2319856 - RNA, 21 nt, Yersinia pestis KIM
guuuaaaaaggcguuauccuu

SEQ ID NO: 2319857 - RNA, 13 nt, Yersinia pestis KIM
guuuaaaaaauau

SEQ ID NO: 2319858 - RNA, 12 nt, Yersinia pestis KIM
guuuaaauaaaa

SEQ ID NO: 2319859 - RNA, 19 nt, Yersinia pestis KIM
guuuaaaguaaaucagacc

SEQ ID NO: 2319860 - RNA, 18 nt, Yersinia pestis KIM
guuguauacuguuuauua

SEQ ID NO: 2319861 - RNA, 16 nt, Yersinia pestis KIM
guuguucgugaaagca

SEQ ID NO: 2319862 - RNA, 17 nt, Yersinia pestis KIM
guuguucugauagagac

SEQ ID NO: 2319863 - RNA, 20 nt, Yersinia pestis KIM
guugucagauaucugcucau

SEQ ID NO: 2319864 - RNA, 18 nt, Yersinia pestis KIM
guucuucugauaaaacag

SEQ ID NO: 2319865 - RNA, 13 nt, Yersinia pestis KIM
guucuugaugguc

SEQ ID NO: 2319866 - RNA, 21 nt, Yersinia pestis KIM
guucuucuuguggcaguucac

SEQ ID NO: 2319867 - RNA, 13 nt, Yersinia pestis KIM
guucgugaaagca

SEQ ID NO: 2319868 - RNA, 22 nt, Yersinia pestis KIM
guucgucgcgaauagccaagcc

SEQ ID NO: 2319869 - RNA, 15 nt, Yersinia pestis KIM
guucuucgcaaugau

SEQ ID NO: 2319870 - RNA, 17 nt, Yersinia pestis KIM
guucuacagggaaaaac

SEQ ID NO: 2319871 - RNA, 17 nt, Yersinia pestis KIM
guugaaaccucaucauc

SEQ ID NO: 2319872 - RNA, 19 nt, Yersinia pestis KIM
guugaaauaaauaaguuca

SEQ ID NO: 2319873 - RNA, 17 nt, Yersinia pestis KIM
guugaaucaauugcugu

SEQ ID NO: 2319874 - RNA, 15 nt, Yersinia pestis KIM
guugaccaaacagaa

SEQ ID NO: 2319875 - RNA, 16 nt, Yersinia pestis KIM
guugaauuuuuauaau

SEQ ID NO: 2319876 - RNA, 18 nt, Yersinia pestis KIM
guugaauuuuuauaauua

SEQ ID NO: 2319877 - RNA, 19 nt, Yersinia pestis KIM
guugaccugaagaaagguc

SEQ ID NO: 2319878 - RNA, 21 nt, Yersinia pestis KIM
guugagaauuaaggaaacuca

SEQ ID NO: 2319879 - RNA, 12 nt, Yersinia pestis KIM
guugacguucag

SEQ ID NO: 2319880 - RNA, 19 nt, Yersinia pestis KIM
guugaggagaucgauaaag

SEQ ID NO: 2319881 - RNA, 20 nt, Yersinia pestis KIM
guugaguaauuuucgcccua

SEQ ID NO: 2319882 - RNA, 22 nt, Yersinia pestis KIM
guugauacuccauuugaacugu

SEQ ID NO: 2319883 - RNA, 13 nt, Yersinia pestis KIM
guugcacccugcu

SEQ ID NO: 2319884 - RNA, 19 nt, Yersinia pestis KIM
guugcacugacggcagaca

SEQ ID NO: 2319885 - RNA, 23 nt, Yersinia pestis KIM
guugcacgugaggauucaagaac

SEQ ID NO: 2319886 - RNA, 19 nt, Yersinia pestis KIM
guugaugcucauuuaaaau

SEQ ID NO: 2319887 - RNA, 18 nt, Yersinia pestis KIM
guugauggcgcaguaacu

SEQ ID NO: 2319888 - RNA, 14 nt, Yersinia pestis KIM
guugaugcaaaacc

SEQ ID NO: 2319889 - RNA, 13 nt, Yersinia pestis KIM
guugaugcaguga

SEQ ID NO: 2319890 - RNA, 15 nt, Yersinia pestis KIM
guugaugaguaaaca

SEQ ID NO: 2319891 - RNA, 15 nt, Yersinia pestis KIM
guugcaaauuuccag

SEQ ID NO: 2319892 - RNA, 14 nt, Yersinia pestis KIM
guucgagcggcaua

SEQ ID NO: 2319893 - RNA, 22 nt, Yersinia pestis KIM
guucggcagcggagaaucgcug

SEQ ID NO: 2319894 - RNA, 15 nt, Yersinia pestis KIM
guucccaucccuuug

SEQ ID NO: 2319895 - RNA, 18 nt, Yersinia pestis KIM
guuccaacgcacaccccc

SEQ ID NO: 2319896 - RNA, 17 nt, Yersinia pestis KIM
guucagcauaaauauuc

SEQ ID NO: 2319897 - RNA, 14 nt, Yersinia pestis KIM
guuacuuuccugcu

SEQ ID NO: 2319898 - RNA, 15 nt, Yersinia pestis KIM
guucauaaauuaaaa

SEQ ID NO: 2319899 - RNA, 21 nt, Yersinia pestis KIM
guucagugcucccugaacgcc

SEQ ID NO: 2319900 - RNA, 20 nt, Yersinia pestis KIM
guucaggcagauaaauccac

SEQ ID NO: 2319901 - RNA, 14 nt, Yersinia pestis KIM
guucauauuggcca

SEQ ID NO: 2319902 - RNA, 22 nt, Yersinia pestis KIM
guucauauaguugcuuaucguc

SEQ ID NO: 2319903 - RNA, 23 nt, Yersinia pestis KIM
guucauggugaugaucaugcuca

SEQ ID NO: 2319904 - RNA, 17 nt, Yersinia pestis KIM
guucauuuuguauuuug

SEQ ID NO: 2319905 - RNA, 20 nt, Yersinia pestis KIM
guucauuuugaccagcauac

SEQ ID NO: 2319906 - RNA, 14 nt, Yersinia pestis KIM
guggcuaucugaaa

SEQ ID NO: 2319907 - RNA, 15 nt, Yersinia pestis KIM
guggccacucaccuc

SEQ ID NO: 2319908 - RNA, 14 nt, Yersinia pestis KIM
guggauugccaaau

SEQ ID NO: 2319909 - RNA, 23 nt, Yersinia pestis KIM
guggaugacaguauuugcagugg

SEQ ID NO: 2319910 - RNA, 15 nt, Yersinia pestis KIM
gugcuucucugccgc

SEQ ID NO: 2319911 - RNA, 16 nt, Yersinia pestis KIM
gugcuucaucacuguu

SEQ ID NO: 2319912 - RNA, 12 nt, Yersinia pestis KIM
gugcuguauuua

SEQ ID NO: 2319913 - RNA, 14 nt, Yersinia pestis KIM
guggugaugaugac

SEQ ID NO: 2319914 - RNA, 14 nt, Yersinia pestis KIM
gugguggcagagaa

SEQ ID NO: 2319915 - RNA, 14 nt, Yersinia pestis KIM
gugguuuggugguu

SEQ ID NO: 2319916 - RNA, 19 nt, Yersinia pestis KIM
guguaaaaacuuaucuaaa

SEQ ID NO: 2319917 - RNA, 18 nt, Yersinia pestis KIM
gugguucaccacuuucca

SEQ ID NO: 2319918 - RNA, 22 nt, Yersinia pestis KIM
guggcucaauccaaaugacacu

SEQ ID NO: 2319919 - RNA, 23 nt, Yersinia pestis KIM
guggcucgacggccaauuucagu

SEQ ID NO: 2319920 - RNA, 20 nt, Yersinia pestis KIM
guggcugaaucguacuucuu

SEQ ID NO: 2319921 - RNA, 15 nt, Yersinia pestis KIM
guggcugagacuucu

SEQ ID NO: 2319922 - RNA, 19 nt, Yersinia pestis KIM
guggcuguaaauaaauaau

SEQ ID NO: 2319923 - RNA, 15 nt, Yersinia pestis KIM
gugggugagcagaga

SEQ ID NO: 2319924 - RNA, 13 nt, Yersinia pestis KIM
guuacuauauaaa

SEQ ID NO: 2319925 - RNA, 14 nt, Yersinia pestis KIM
guuacucagcaucc

SEQ ID NO: 2319926 - RNA, 19 nt, Yersinia pestis KIM
guuacugccgacaggguuu

SEQ ID NO: 2319927 - RNA, 20 nt, Yersinia pestis KIM
guuacugcgcaaauccugaa

SEQ ID NO: 2319928 - RNA, 18 nt, Yersinia pestis KIM
guuaccuaaccaaacauu

SEQ ID NO: 2319929 - RNA, 16 nt, Yersinia pestis KIM
guuaccuaaccaaaca

SEQ ID NO: 2319930 - RNA, 15 nt, Yersinia pestis KIM
guuacacaucaggcu

SEQ ID NO: 2319931 - RNA, 17 nt, Yersinia pestis KIM
guuacagcaaggcggca

SEQ ID NO: 2319932 - RNA, 21 nt, Yersinia pestis KIM
guuacgauacguugcagguca

SEQ ID NO: 2319933 - RNA, 17 nt, Yersinia pestis KIM
guuaccuugugucacca

SEQ ID NO: 2319934 - RNA, 17 nt, Yersinia pestis KIM
guuaaaguuaucaccaa

SEQ ID NO: 2319935 - RNA, 19 nt, Yersinia pestis KIM
guuaaauagugggcuaaaa

SEQ ID NO: 2319936 - RNA, 16 nt, Yersinia pestis KIM
guuaaauacagcacca

SEQ ID NO: 2319937 - RNA, 12 nt, Yersinia pestis KIM
guuaaguuucau

SEQ ID NO: 2319938 - RNA, 15 nt, Yersinia pestis KIM
guuaauugaauugcc

SEQ ID NO: 2319939 - RNA, 14 nt, Yersinia pestis KIM
guuaauuuaaacag

SEQ ID NO: 2319940 - RNA, 23 nt, Yersinia pestis KIM
guuaauucaugugagauaacaca

SEQ ID NO: 2319941 - RNA, 23 nt, Yersinia pestis KIM
guuaauaccagaugcauauacug

SEQ ID NO: 2319942 - RNA, 16 nt, Yersinia pestis KIM
guuaauaccugcacca

SEQ ID NO: 2319943 - RNA, 15 nt, Yersinia pestis KIM
gugugauuuccaucu

SEQ ID NO: 2319944 - RNA, 15 nt, Yersinia pestis KIM
gugugcguacaggua

SEQ ID NO: 2319945 - RNA, 17 nt, Yersinia pestis KIM
guguaaaccgcaccaca

SEQ ID NO: 2319946 - RNA, 15 nt, Yersinia pestis KIM
guguacucauauugu

SEQ ID NO: 2319947 - RNA, 19 nt, Yersinia pestis KIM
guguuggauaaaccggcug

SEQ ID NO: 2319948 - RNA, 15 nt, Yersinia pestis KIM
guguucgguaaauaa

SEQ ID NO: 2319949 - RNA, 20 nt, Yersinia pestis KIM
guguguuuucuuguauauaa

SEQ ID NO: 2319950 - RNA, 13 nt, Yersinia pestis KIM
guguugaaugacg

SEQ ID NO: 2319951 - RNA, 14 nt, Yersinia pestis KIM
guguuucaaauaag

SEQ ID NO: 2319952 - RNA, 13 nt, Yersinia pestis KIM
gugccccaagaag

SEQ ID NO: 2319953 - RNA, 14 nt, Yersinia pestis KIM
gugcccgcgggggc

SEQ ID NO: 2319954 - RNA, 23 nt, Yersinia pestis KIM
gugcccgcuuguuguaucacagc

SEQ ID NO: 2319955 - RNA, 11 nt, Yersinia pestis KIM
gugccaacauc

SEQ ID NO: 2319956 - RNA, 12 nt, Yersinia pestis KIM
gugccagcagca

SEQ ID NO: 2319957 - RNA, 13 nt, Yersinia pestis KIM
gugccagcagcaa

SEQ ID NO: 2319958 - RNA, 17 nt, Yersinia pestis KIM
gugccaaaauaucuucc

SEQ ID NO: 2319959 - RNA, 20 nt, Yersinia pestis KIM
gugcauuaucuuuaauuuuu

SEQ ID NO: 2319960 - RNA, 12 nt, Yersinia pestis KIM
gucgcuguuacu

SEQ ID NO: 2319961 - RNA, 19 nt, Yersinia pestis KIM
gucgcuguagcgccaggua

SEQ ID NO: 2319962 - RNA, 14 nt, Yersinia pestis KIM
gugaugcaguaaau

SEQ ID NO: 2319963 - RNA, 21 nt, Yersinia pestis KIM
gugaugaauuugauacaguga

SEQ ID NO: 2319964 - RNA, 15 nt, Yersinia pestis KIM
gugauuagcaguaau

SEQ ID NO: 2319965 - RNA, 22 nt, Yersinia pestis KIM
gugauuaccugagagagguuga

SEQ ID NO: 2319966 - RNA, 18 nt, Yersinia pestis KIM
gugauucgggugagugaa

SEQ ID NO: 2319967 - RNA, 20 nt, Yersinia pestis KIM
gugauguguaccaaauaaac

SEQ ID NO: 2319968 - RNA, 23 nt, Yersinia pestis KIM
gugccuuacuuuuuugccugcuc

SEQ ID NO: 2319969 - RNA, 14 nt, Yersinia pestis KIM
gugccuuauugacc

SEQ ID NO: 2319970 - RNA, 14 nt, Yersinia pestis KIM
gugcgccggccugc

SEQ ID NO: 2319971 - RNA, 18 nt, Yersinia pestis KIM
gugcgaaauaccccucac

SEQ ID NO: 2319972 - RNA, 14 nt, Yersinia pestis KIM
gugcgaacaaaaau

SEQ ID NO: 2319973 - RNA, 16 nt, Yersinia pestis KIM
gugcgaauggaaaaac

SEQ ID NO: 2319974 - RNA, 14 nt, Yersinia pestis KIM
gugcgcuccauuuc

SEQ ID NO: 2319975 - RNA, 22 nt, Yersinia pestis KIM
gugcgcuacgcaugaugcugcc

SEQ ID NO: 2319976 - RNA, 17 nt, Yersinia pestis KIM
gugcgcggcuagccacc

SEQ ID NO: 2319977 - RNA, 15 nt, Yersinia pestis KIM
gugcggcagugaacc

SEQ ID NO: 2319978 - RNA, 15 nt, Yersinia pestis KIM
gugcggcagugaacu

SEQ ID NO: 2319979 - RNA, 21 nt, Yersinia pestis KIM
gugcucgggugccucacguau

SEQ ID NO: 2319980 - RNA, 20 nt, Yersinia pestis KIM
gugcucgggugccucacgua

SEQ ID NO: 2319981 - RNA, 12 nt, Yersinia pestis KIM
gugcguaggcaa

SEQ ID NO: 2319982 - RNA, 16 nt, Yersinia pestis KIM
gugcucauuaucgcag

SEQ ID NO: 2319983 - RNA, 13 nt, Yersinia pestis KIM
gugcuccagcacu

SEQ ID NO: 2319984 - RNA, 13 nt, Yersinia pestis KIM
gugcuacuccugc

SEQ ID NO: 2319985 - RNA, 14 nt, Yersinia pestis KIM
gugcuacuccugcu

SEQ ID NO: 2319986 - RNA, 17 nt, Yersinia pestis KIM
gcgccgaaauaaaacca

SEQ ID NO: 2319987 - RNA, 15 nt, Yersinia pestis KIM
gcgccgugcccgguu

SEQ ID NO: 2319988 - RNA, 17 nt, Yersinia pestis KIM
gcgccgcggcccugagg

SEQ ID NO: 2319989 - RNA, 12 nt, Yersinia pestis KIM
gcgcccucccug

SEQ ID NO: 2319990 - RNA, 16 nt, Yersinia pestis KIM
gcgcccauccgcagga

SEQ ID NO: 2319991 - RNA, 18 nt, Yersinia pestis KIM
gcgcccaguggagccaug

SEQ ID NO: 2319992 - RNA, 22 nt, Yersinia pestis KIM
gcgccagguaagaaagagauga

SEQ ID NO: 2319993 - RNA, 17 nt, Yersinia pestis KIM
gcgccagggagggcgcg

SEQ ID NO: 2319994 - RNA, 20 nt, Yersinia pestis KIM
gcgccacuucuuucacuaau

SEQ ID NO: 2319995 - RNA, 14 nt, Yersinia pestis KIM
gcgcaggauuucaa

SEQ ID NO: 2319996 - RNA, 21 nt, Yersinia pestis KIM
gcgcugcaucagcagugacgu

SEQ ID NO: 2319997 - RNA, 13 nt, Yersinia pestis KIM
gcgcugcaaagcc

SEQ ID NO: 2319998 - RNA, 21 nt, Yersinia pestis KIM
gcgcuacgcaugaugcugccu

SEQ ID NO: 2319999 - RNA, 15 nt, Yersinia pestis KIM
gcgcucacuuuuauu

SEQ ID NO: 2320000 - RNA, 22 nt, Yersinia pestis KIM
gcgcuauuuauccacuaauuca

SEQ ID NO: 2320001 - RNA, 20 nt, Yersinia pestis KIM
gcgcuauguuggcaaauaau

SEQ ID NO: 2320002 - RNA, 16 nt, Yersinia pestis KIM
gcgcguuaaucugcug

SEQ ID NO: 2320003 - RNA, 16 nt, Yersinia pestis KIM
gcgcgcuucgagcccc

SEQ ID NO: 2320004 - RNA, 19 nt, Yersinia pestis KIM
gcgacaccaagaggcugcg

SEQ ID NO: 2320005 - RNA, 13 nt, Yersinia pestis KIM
gcgacaaccugua

SEQ ID NO: 2320006 - RNA, 20 nt, Yersinia pestis KIM
gcgacacccacuuguucaga

SEQ ID NO: 2320007 - RNA, 22 nt, Yersinia pestis KIM
gcgacacccacuuguucagaga

SEQ ID NO: 2320008 - RNA, 17 nt, Yersinia pestis KIM
gcgaaaaaccaugagaa

SEQ ID NO: 2320009 - RNA, 18 nt, Yersinia pestis KIM
gccuuuuugcaucaccau

SEQ ID NO: 2320010 - RNA, 16 nt, Yersinia pestis KIM
gccuuuuaauuuucag

SEQ ID NO: 2320011 - RNA, 17 nt, Yersinia pestis KIM
gccuuucguuucugucu

SEQ ID NO: 2320012 - RNA, 14 nt, Yersinia pestis KIM
gccuuucucggugu

SEQ ID NO: 2320013 - RNA, 13 nt, Yersinia pestis KIM
gccuuuauucauu

SEQ ID NO: 2320014 - RNA, 16 nt, Yersinia pestis KIM
gccuuuaaccacgagc

SEQ ID NO: 2320015 - RNA, 23 nt, Yersinia pestis KIM
gccuguucucuccgucgcgggca

SEQ ID NO: 2320016 - RNA, 22 nt, Yersinia pestis KIM
gccuuaucagcgaaaaauuuca

SEQ ID NO: 2320017 - RNA, 23 nt, Yersinia pestis KIM
gccuuaucagcgaaaaauuucac

SEQ ID NO: 2320018 - RNA, 22 nt, Yersinia pestis KIM
gccuuaaaugcguagagucagu

SEQ ID NO: 2320019 - RNA, 21 nt, Yersinia pestis KIM
gccuucagcgauacaaccggc

SEQ ID NO: 2320020 - RNA, 18 nt, Yersinia pestis KIM
gccuugugggcaucuguc

SEQ ID NO: 2320021 - RNA, 15 nt, Yersinia pestis KIM
gccuuggucucagaa

SEQ ID NO: 2320022 - RNA, 15 nt, Yersinia pestis KIM
gccuuggcauguuca

SEQ ID NO: 2320023 - RNA, 13 nt, Yersinia pestis KIM
gccuugaaucaaa

SEQ ID NO: 2320024 - RNA, 14 nt, Yersinia pestis KIM
gccuugaaucaaaa

SEQ ID NO: 2320025 - RNA, 17 nt, Yersinia pestis KIM
gccuucguuugucaaug

SEQ ID NO: 2320026 - RNA, 16 nt, Yersinia pestis KIM
gcgauuaggacaaaua

SEQ ID NO: 2320027 - RNA, 19 nt, Yersinia pestis KIM
gcgcaaaugcguagcgggg

SEQ ID NO: 2320028 - RNA, 22 nt, Yersinia pestis KIM
gcgauuuaugcaugaaaacccu

SEQ ID NO: 2320029 - RNA, 14 nt, Yersinia pestis KIM
gcgagcaaggcauc

SEQ ID NO: 2320030 - RNA, 18 nt, Yersinia pestis KIM
gcgagcaauaccaaaaau

SEQ ID NO: 2320031 - RNA, 20 nt, Yersinia pestis KIM
gcgagauauaaacuaauauc

SEQ ID NO: 2320032 - RNA, 22 nt, Yersinia pestis KIM
gcgagcgaccuugauucucaaa

SEQ ID NO: 2320033 - RNA, 16 nt, Yersinia pestis KIM
gcgaggccgcugcaag

SEQ ID NO: 2320034 - RNA, 20 nt, Yersinia pestis KIM
gcgacugauugaccaucaac

SEQ ID NO: 2320035 - RNA, 22 nt, Yersinia pestis KIM
gcgagggccuuucugaacaaaa

SEQ ID NO: 2320036 - RNA, 21 nt, Yersinia pestis KIM
gcgauacaccauuuccaggcu

SEQ ID NO: 2320037 - RNA, 21 nt, Yersinia pestis KIM
gcgauagaguugauaaacaau

SEQ ID NO: 2320038 - RNA, 16 nt, Yersinia pestis KIM
gcgaucaggaagcccg

SEQ ID NO: 2320039 - RNA, 23 nt, Yersinia pestis KIM
gcggccuggguagacauggcaac

SEQ ID NO: 2320040 - RNA, 18 nt, Yersinia pestis KIM
gcggccagcggcaccgcc

SEQ ID NO: 2320041 - RNA, 16 nt, Yersinia pestis KIM
gcggccagccuugagc

SEQ ID NO: 2320042 - RNA, 17 nt, Yersinia pestis KIM
gcggcccgcagauaauc

SEQ ID NO: 2320043 - RNA, 11 nt, Yersinia pestis KIM
gcggccaauag

SEQ ID NO: 2320044 - RNA, 12 nt, Yersinia pestis KIM
gcggcauccagu

SEQ ID NO: 2320045 - RNA, 16 nt, Yersinia pestis KIM
gcggcauaauccucaa

SEQ ID NO: 2320046 - RNA, 19 nt, Yersinia pestis KIM
gcggcagagccaaucccca

SEQ ID NO: 2320047 - RNA, 21 nt, Yersinia pestis KIM
gcggcuguucauggucaccac

SEQ ID NO: 2320048 - RNA, 18 nt, Yersinia pestis KIM
gcgggaucuccagaagca

SEQ ID NO: 2320049 - RNA, 13 nt, Yersinia pestis KIM
gcggcuucagcac

SEQ ID NO: 2320050 - RNA, 22 nt, Yersinia pestis KIM
gcgggcaaaacgacgggcugcu

SEQ ID NO: 2320051 - RNA, 15 nt, Yersinia pestis KIM
gcgggcaacagagaa

SEQ ID NO: 2320052 - RNA, 15 nt, Yersinia pestis KIM
gcgggcaucagccca

SEQ ID NO: 2320053 - RNA, 22 nt, Yersinia pestis KIM
gcgggccuuugcuuuucugccu

SEQ ID NO: 2320054 - RNA, 15 nt, Yersinia pestis KIM
gcgggccagcaacca

SEQ ID NO: 2320055 - RNA, 17 nt, Yersinia pestis KIM
gcgggugguccccagag

SEQ ID NO: 2320056 - RNA, 19 nt, Yersinia pestis KIM
gcgggggaacguggguggu

SEQ ID NO: 2320057 - RNA, 22 nt, Yersinia pestis KIM
gcgguggccagagcauagacga

SEQ ID NO: 2320058 - RNA, 17 nt, Yersinia pestis KIM
gcgguugggaaaagugg

SEQ ID NO: 2320059 - RNA, 18 nt, Yersinia pestis KIM
gcgguuccaaagcaccaa

SEQ ID NO: 2320060 - RNA, 22 nt, Yersinia pestis KIM
gcgguuuuuccgccgucuggug

SEQ ID NO: 2320061 - RNA, 18 nt, Yersinia pestis KIM
gcguaaaauuagagcaaa

SEQ ID NO: 2320062 - RNA, 22 nt, Yersinia pestis KIM
gcguaaacaacgcuaucuggcg

SEQ ID NO: 2320063 - RNA, 13 nt, Yersinia pestis KIM
gcguaaagcaccc

SEQ ID NO: 2320064 - RNA, 17 nt, Yersinia pestis KIM
gcguaagccuucaaccu

SEQ ID NO: 2320065 - RNA, 16 nt, Yersinia pestis KIM
gcguaaucagccgcgg

SEQ ID NO: 2320066 - RNA, 22 nt, Yersinia pestis KIM
gcguaccauauggaugaugcac

SEQ ID NO: 2320067 - RNA, 22 nt, Yersinia pestis KIM
gcguaccauaguuuuucuccua

SEQ ID NO: 2320068 - RNA, 16 nt, Yersinia pestis KIM
gcguacaucaggguga

SEQ ID NO: 2320069 - RNA, 13 nt, Yersinia pestis KIM
gcguacuguuagu

SEQ ID NO: 2320070 - RNA, 18 nt, Yersinia pestis KIM
gcguagagccuuuacggg

SEQ ID NO: 2320071 - RNA, 16 nt, Yersinia pestis KIM
gcguagguuucagccu

SEQ ID NO: 2320072 - RNA, 19 nt, Yersinia pestis KIM
gcguagguuucagccucug

SEQ ID NO: 2320073 - RNA, 22 nt, Yersinia pestis KIM
gcgugauuuuuauauuuugaga

SEQ ID NO: 2320074 - RNA, 14 nt, Yersinia pestis KIM
gcguggaauuaaua

SEQ ID NO: 2320075 - RNA, 16 nt, Yersinia pestis KIM
gcgugcugcuuccugc

SEQ ID NO: 2320076 - RNA, 18 nt, Yersinia pestis KIM
gcgucuuuaucgccagcu

SEQ ID NO: 2320077 - RNA, 20 nt, Yersinia pestis KIM
gcgucuuucgggcugaugaa

SEQ ID NO: 2320078 - RNA, 20 nt, Yersinia pestis KIM
gcgucuuuacgaucugccug

SEQ ID NO: 2320079 - RNA, 18 nt, Yersinia pestis KIM
gcgucuuuagauuucacc

SEQ ID NO: 2320080 - RNA, 16 nt, Yersinia pestis KIM
gcgucugagguggcac

SEQ ID NO: 2320081 - RNA, 11 nt, Yersinia pestis KIM
gcgucucuacg

SEQ ID NO: 2320082 - RNA, 16 nt, Yersinia pestis KIM
gcgucucuacgacgcc

SEQ ID NO: 2320083 - RNA, 14 nt, Yersinia pestis KIM
gcguauaaacagag

SEQ ID NO: 2320084 - RNA, 15 nt, Yersinia pestis KIM
gcguucaaaaucaaa

SEQ ID NO: 2320085 - RNA, 21 nt, Yersinia pestis KIM
gcguucccgguuucagugcca

SEQ ID NO: 2320086 - RNA, 21 nt, Yersinia pestis KIM
gcguuauugcgacauaaagca

SEQ ID NO: 2320087 - RNA, 14 nt, Yersinia pestis KIM
gcguuauugagaag

SEQ ID NO: 2320088 - RNA, 23 nt, Yersinia pestis KIM
gcguuaucucgucuuccgcccgu

SEQ ID NO: 2320089 - RNA, 16 nt, Yersinia pestis KIM
gcguuaaugccacccc

SEQ ID NO: 2320090 - RNA, 15 nt, Yersinia pestis KIM
gcguuaaugccaccc

SEQ ID NO: 2320091 - RNA, 16 nt, Yersinia pestis KIM
gcguuacccacauuaa

SEQ ID NO: 2320092 - RNA, 22 nt, Yersinia pestis KIM
gcguuacacaucaggcuguuga

SEQ ID NO: 2320093 - RNA, 20 nt, Yersinia pestis KIM
gcguuacagcaaggcagcaa

SEQ ID NO: 2320094 - RNA, 18 nt, Yersinia pestis KIM
gcgugggugaugugacgu

SEQ ID NO: 2320095 - RNA, 20 nt, Yersinia pestis KIM
gcguucuucugauucaauuu

SEQ ID NO: 2320096 - RNA, 23 nt, Yersinia pestis KIM
gcguucuacugcguccuuugccc

SEQ ID NO: 2320097 - RNA, 19 nt, Yersinia pestis KIM
gcguuuugcaucaacgaca

SEQ ID NO: 2320098 - RNA, 19 nt, Yersinia pestis KIM
gcguuuuuauugggcagcg

SEQ ID NO: 2320099 - RNA, 13 nt, Yersinia pestis KIM
gcuaaaucaucaa

SEQ ID NO: 2320100 - RNA, 14 nt, Yersinia pestis KIM
gcuaacaccgcugu

SEQ ID NO: 2320101 - RNA, 22 nt, Yersinia pestis KIM
gcuaacacgaccuucaucucug

SEQ ID NO: 2320102 - RNA, 13 nt, Yersinia pestis KIM
gcuaaaugacaua

SEQ ID NO: 2320103 - RNA, 20 nt, Yersinia pestis KIM
gcuaaaugacauauugugcu

SEQ ID NO: 2320104 - RNA, 12 nt, Yersinia pestis KIM
gcuaaccgccuu

SEQ ID NO: 2320105 - RNA, 21 nt, Yersinia pestis KIM
gcuaaccaccgucaccaaaua

SEQ ID NO: 2320106 - RNA, 17 nt, Yersinia pestis KIM
gcuaaccaccgucacca

SEQ ID NO: 2320107 - RNA, 16 nt, Yersinia pestis KIM
gcuaaccaccgucacc

SEQ ID NO: 2320108 - RNA, 13 nt, Yersinia pestis KIM
gcuaacagugacc

SEQ ID NO: 2320109 - RNA, 14 nt, Yersinia pestis KIM
gcuaaaaugaucuu

SEQ ID NO: 2320110 - RNA, 18 nt, Yersinia pestis KIM
gcuaaacaggguugagcc

SEQ ID NO: 2320111 - RNA, 17 nt, Yersinia pestis KIM
gcuaauacuggcuaaau

SEQ ID NO: 2320112 - RNA, 16 nt, Yersinia pestis KIM
gcuaauauuuauaaaa

SEQ ID NO: 2320113 - RNA, 15 nt, Yersinia pestis KIM
gcuaauauuuauaaa

SEQ ID NO: 2320114 - RNA, 16 nt, Yersinia pestis KIM
gcuaauauuuucagcc

SEQ ID NO: 2320115 - RNA, 19 nt, Yersinia pestis KIM
gcuaagugucaauaacagu

SEQ ID NO: 2320116 - RNA, 20 nt, Yersinia pestis KIM
gcuaagugucaauaacaguu

SEQ ID NO: 2320117 - RNA, 23 nt, Yersinia pestis KIM
gcuacguuuaucgugcaguaaug

SEQ ID NO: 2320118 - RNA, 16 nt, Yersinia pestis KIM
gcuacgcaaaaucagu

SEQ ID NO: 2320119 - RNA, 21 nt, Yersinia pestis KIM
gcuacaggcgcaacugccaug

SEQ ID NO: 2320120 - RNA, 21 nt, Yersinia pestis KIM
gcuaccaggaagcggccaggu

SEQ ID NO: 2320121 - RNA, 14 nt, Yersinia pestis KIM
gcuaccaugaguga

SEQ ID NO: 2320122 - RNA, 19 nt, Yersinia pestis KIM
gcuaccagagaaccgacag

SEQ ID NO: 2320123 - RNA, 17 nt, Yersinia pestis KIM
gcuaccaauuauucggg

SEQ ID NO: 2320124 - RNA, 18 nt, Yersinia pestis KIM
gcuaaugcucgcucauca

SEQ ID NO: 2320125 - RNA, 24 nt, Yersinia pestis KIM
gcuaauuaaaccugacugguucac

SEQ ID NO: 2320126 - RNA, 18 nt, Yersinia pestis KIM
gcuaauuaauuuaaacaa

SEQ ID NO: 2320127 - RNA, 18 nt, Yersinia pestis KIM
gcuaauuagaugaguggu

SEQ ID NO: 2320128 - RNA, 23 nt, Yersinia pestis KIM
gcuaauucugcgccuauaccugc

SEQ ID NO: 2320129 - RNA, 14 nt, Yersinia pestis KIM
gcuaauugucacag

SEQ ID NO: 2320130 - RNA, 21 nt, Yersinia pestis KIM
gcuaauuugggugccauagca

SEQ ID NO: 2320131 - RNA, 20 nt, Yersinia pestis KIM
gcucgaaccugaacgcagga

SEQ ID NO: 2320132 - RNA, 13 nt, Yersinia pestis KIM
gcucgaaccugaa

SEQ ID NO: 2320133 - RNA, 22 nt, Yersinia pestis KIM
gcuccucacuuugcauuuucug

SEQ ID NO: 2320134 - RNA, 14 nt, Yersinia pestis KIM
gcuccuauagcuca

SEQ ID NO: 2320135 - RNA, 22 nt, Yersinia pestis KIM
gcuccuauagcucagaaaauaa

SEQ ID NO: 2320136 - RNA, 16 nt, Yersinia pestis KIM
gcuccgcacuuggccc

SEQ ID NO: 2320137 - RNA, 15 nt, Yersinia pestis KIM
gcuccaguucgacua

SEQ ID NO: 2320138 - RNA, 15 nt, Yersinia pestis KIM
gcuccaucagguuua

SEQ ID NO: 2320139 - RNA, 14 nt, Yersinia pestis KIM
gcucccuccugcgg

SEQ ID NO: 2320140 - RNA, 14 nt, Yersinia pestis KIM
gcuccaauaaaaaa

SEQ ID NO: 2320141 - RNA, 11 nt, Yersinia pestis KIM
gcuccagauug

SEQ ID NO: 2320142 - RNA, 19 nt, Yersinia pestis KIM
gcuccagugcaucgcugag

SEQ ID NO: 2320143 - RNA, 20 nt, Yersinia pestis KIM
gcucaggcucaucaccuucc

SEQ ID NO: 2320144 - RNA, 15 nt, Yersinia pestis KIM
gcucaucauaaaaau

SEQ ID NO: 2320145 - RNA, 16 nt, Yersinia pestis KIM
gcucaucauaaaaaua

SEQ ID NO: 2320146 - RNA, 17 nt, Yersinia pestis KIM
gcucaucauaaaaauac

SEQ ID NO: 2320147 - RNA, 21 nt, Yersinia pestis KIM
gcucauaccaugccaucaaug

SEQ ID NO: 2320148 - RNA, 16 nt, Yersinia pestis KIM
gcucauaaagcaucag

SEQ ID NO: 2320149 - RNA, 18 nt, Yersinia pestis KIM
gcucaucaaccucagccu

SEQ ID NO: 2320150 - RNA, 23 nt, Yersinia pestis KIM
gcucauaugcagcauccagcuca

SEQ ID NO: 2320151 - RNA, 20 nt, Yersinia pestis KIM
gcucacucgguacaaucucu

SEQ ID NO: 2320152 - RNA, 23 nt, Yersinia pestis KIM
gcucacucaccgccagcaauaag

SEQ ID NO: 2320153 - RNA, 21 nt, Yersinia pestis KIM
gcucacccauuuuauccucuu

SEQ ID NO: 2320154 - RNA, 18 nt, Yersinia pestis KIM
gcucacuuuuauauccgc

SEQ ID NO: 2320155 - RNA, 20 nt, Yersinia pestis KIM
gcucacuuuuauauccgcca

SEQ ID NO: 2320156 - RNA, 22 nt, Yersinia pestis KIM
gcucacuggaguuaaaucccug

SEQ ID NO: 2320157 - RNA, 17 nt, Yersinia pestis KIM
gcucacuuuuauccagc

SEQ ID NO: 2320158 - RNA, 23 nt, Yersinia pestis KIM
gcucagaaaauaaagggggcacc

SEQ ID NO: 2320159 - RNA, 14 nt, Yersinia pestis KIM
gcucaggccuugcg

SEQ ID NO: 2320160 - RNA, 14 nt, Yersinia pestis KIM
gcuacugggcuacc

SEQ ID NO: 2320161 - RNA, 14 nt, Yersinia pestis KIM
gcuacugguaauaa

SEQ ID NO: 2320162 - RNA, 16 nt, Yersinia pestis KIM
gcuacugguagcagcc

SEQ ID NO: 2320163 - RNA, 22 nt, Yersinia pestis KIM
gcuacugcgcguugccauguug

SEQ ID NO: 2320164 - RNA, 21 nt, Yersinia pestis KIM
gcuacuuaacgauaaaaucaa

SEQ ID NO: 2320165 - RNA, 14 nt, Yersinia pestis KIM
gcuagcuuauccag

SEQ ID NO: 2320166 - RNA, 18 nt, Yersinia pestis KIM
gcuaggaggccaggacuu

SEQ ID NO: 2320167 - RNA, 17 nt, Yersinia pestis KIM
gcuaggaggccaggacu

SEQ ID NO: 2320168 - RNA, 17 nt, Yersinia pestis KIM
gcuaggcgcagcagggc

SEQ ID NO: 2320169 - RNA, 20 nt, Yersinia pestis KIM
gcuagucuguuaugcccaac

SEQ ID NO: 2320170 - RNA, 17 nt, Yersinia pestis KIM
gcucaauggcgggggcg

SEQ ID NO: 2320171 - RNA, 22 nt, Yersinia pestis KIM
gccgccagucauucaccugccc

SEQ ID NO: 2320172 - RNA, 13 nt, Yersinia pestis KIM
gccgcccagcgac

SEQ ID NO: 2320173 - RNA, 15 nt, Yersinia pestis KIM
gccgcgaauaacaga

SEQ ID NO: 2320174 - RNA, 14 nt, Yersinia pestis KIM
gccgccucugcucc

SEQ ID NO: 2320175 - RNA, 13 nt, Yersinia pestis KIM
gccgccgccagcc

SEQ ID NO: 2320176 - RNA, 14 nt, Yersinia pestis KIM
gccgccgccagccc

SEQ ID NO: 2320177 - RNA, 21 nt, Yersinia pestis KIM
gccgccagauuauccagcccu

SEQ ID NO: 2320178 - RNA, 17 nt, Yersinia pestis KIM
gccgcauucaccaccau

SEQ ID NO: 2320179 - RNA, 19 nt, Yersinia pestis KIM
gccgcaugcaacagauaau

SEQ ID NO: 2320180 - RNA, 18 nt, Yersinia pestis KIM
gccgcauugauccucguu

SEQ ID NO: 2320181 - RNA, 19 nt, Yersinia pestis KIM
gccgcaggcgaugcaagga

SEQ ID NO: 2320182 - RNA, 22 nt, Yersinia pestis KIM
gccgaugagcuucuucaaaagc

SEQ ID NO: 2320183 - RNA, 18 nt, Yersinia pestis KIM
gccgaucaacaggccacc

SEQ ID NO: 2320184 - RNA, 17 nt, Yersinia pestis KIM
gccgaucaacaggccac

SEQ ID NO: 2320185 - RNA, 16 nt, Yersinia pestis KIM
gccgauacuuuugcua

SEQ ID NO: 2320186 - RNA, 16 nt, Yersinia pestis KIM
gccgauauacacccca

SEQ ID NO: 2320187 - RNA, 15 nt, Yersinia pestis KIM
gccgaugcgacaauu

SEQ ID NO: 2320188 - RNA, 14 nt, Yersinia pestis KIM
gccgauggaaccac

SEQ ID NO: 2320189 - RNA, 13 nt, Yersinia pestis KIM
gccgcagauaaac

SEQ ID NO: 2320190 - RNA, 14 nt, Yersinia pestis KIM
gccggcuucccugu

SEQ ID NO: 2320191 - RNA, 13 nt, Yersinia pestis KIM
gccggccaacauc

SEQ ID NO: 2320192 - RNA, 17 nt, Yersinia pestis KIM
gccgcggugaagaacag

SEQ ID NO: 2320193 - RNA, 18 nt, Yersinia pestis KIM
gccgcuaauuuucccugu

SEQ ID NO: 2320194 - RNA, 22 nt, Yersinia pestis KIM
gccgcuuugguugccagauaau

SEQ ID NO: 2320195 - RNA, 13 nt, Yersinia pestis KIM
gccggcaacagcg

SEQ ID NO: 2320196 - RNA, 20 nt, Yersinia pestis KIM
gccugugacgcuugaauaua

SEQ ID NO: 2320197 - RNA, 23 nt, Yersinia pestis KIM
gccuguaccaccaccaacagcau

SEQ ID NO: 2320198 - RNA, 14 nt, Yersinia pestis KIM
gccuggugcaaccg

SEQ ID NO: 2320199 - RNA, 13 nt, Yersinia pestis KIM
gccuguaaaauau

SEQ ID NO: 2320200 - RNA, 15 nt, Yersinia pestis KIM
gccuggcaggaagcc

SEQ ID NO: 2320201 - RNA, 23 nt, Yersinia pestis KIM
gccugcgcuaauacggcuugcaa

SEQ ID NO: 2320202 - RNA, 14 nt, Yersinia pestis KIM
gccugcggcggcua

SEQ ID NO: 2320203 - RNA, 16 nt, Yersinia pestis KIM
gccugcucaccgccga

SEQ ID NO: 2320204 - RNA, 22 nt, Yersinia pestis KIM
gccugcguuguuuuucaaucua

SEQ ID NO: 2320205 - RNA, 17 nt, Yersinia pestis KIM
gccugcucaacacaggu

SEQ ID NO: 2320206 - RNA, 14 nt, Yersinia pestis KIM
gccugcugagccaa

SEQ ID NO: 2320207 - RNA, 21 nt, Yersinia pestis KIM
gccugcgaauuaucauccaga

SEQ ID NO: 2320208 - RNA, 16 nt, Yersinia pestis KIM
gccugcaccagugcca

SEQ ID NO: 2320209 - RNA, 23 nt, Yersinia pestis KIM
gccugcaccagugccaaucccca

SEQ ID NO: 2320210 - RNA, 13 nt, Yersinia pestis KIM
gccugccauguca

SEQ ID NO: 2320211 - RNA, 13 nt, Yersinia pestis KIM
gccucuucugucg

SEQ ID NO: 2320212 - RNA, 21 nt, Yersinia pestis KIM
gccucuucugucggagccuga

SEQ ID NO: 2320213 - RNA, 17 nt, Yersinia pestis KIM
gccucugcugcugcccg

SEQ ID NO: 2320214 - RNA, 12 nt, Yersinia pestis KIM
gccucugcuccg

SEQ ID NO: 2320215 - RNA, 12 nt, Yersinia pestis KIM
gccucucucacu

SEQ ID NO: 2320216 - RNA, 20 nt, Yersinia pestis KIM
gccugaaucugaauggcccg

SEQ ID NO: 2320217 - RNA, 22 nt, Yersinia pestis KIM
gccguucuccaguugccagcag

SEQ ID NO: 2320218 - RNA, 21 nt, Yersinia pestis KIM
gccgugcaaucuguuauaaaa

SEQ ID NO: 2320219 - RNA, 23 nt, Yersinia pestis KIM
gccgugcaaucuguuauaaaaaa

SEQ ID NO: 2320220 - RNA, 14 nt, Yersinia pestis KIM
gccgggucaggaag

SEQ ID NO: 2320221 - RNA, 13 nt, Yersinia pestis KIM
gccgggucaggaa

SEQ ID NO: 2320222 - RNA, 20 nt, Yersinia pestis KIM
gccggguuauaaaucagggc

SEQ ID NO: 2320223 - RNA, 24 nt, Yersinia pestis KIM
gccggguggcccaauaaaagguag

SEQ ID NO: 2320224 - RNA, 23 nt, Yersinia pestis KIM
gccuauaaggcucuguuaccagc

SEQ ID NO: 2320225 - RNA, 20 nt, Yersinia pestis KIM
gccuaggaucgaaugaucag

SEQ ID NO: 2320226 - RNA, 13 nt, Yersinia pestis KIM
gccuauccucacc

SEQ ID NO: 2320227 - RNA, 14 nt, Yersinia pestis KIM
gccuauccucaccg

SEQ ID NO: 2320228 - RNA, 16 nt, Yersinia pestis KIM
gccuacguucaggccc

SEQ ID NO: 2320229 - RNA, 21 nt, Yersinia pestis KIM
gccucacaacuuucccaguca

SEQ ID NO: 2320230 - RNA, 17 nt, Yersinia pestis KIM
gccucaacgcaccccac

SEQ ID NO: 2320231 - RNA, 22 nt, Yersinia pestis KIM
gccuauuguuuaugaguucugc

SEQ ID NO: 2320232 - RNA, 19 nt, Yersinia pestis KIM
gccuauugaauaacagcua

SEQ ID NO: 2320233 - RNA, 17 nt, Yersinia pestis KIM
gccuauuugcagaaagu

SEQ ID NO: 2320234 - RNA, 19 nt, Yersinia pestis KIM
gccuauggcggccauguug

SEQ ID NO: 2320235 - RNA, 23 nt, Yersinia pestis KIM
gccuauuaagauaauuauccauu

SEQ ID NO: 2320236 - RNA, 13 nt, Yersinia pestis KIM
gccuccagugaua

SEQ ID NO: 2320237 - RNA, 16 nt, Yersinia pestis KIM
gccuccaguugaguau

SEQ ID NO: 2320238 - RNA, 21 nt, Yersinia pestis KIM
gccuccaacuuaucacuggag

SEQ ID NO: 2320239 - RNA, 20 nt, Yersinia pestis KIM
gccuccaacuuaucacugga

SEQ ID NO: 2320240 - RNA, 23 nt, Yersinia pestis KIM
gccucaucagaggcucauccugc

SEQ ID NO: 2320241 - RNA, 14 nt, Yersinia pestis KIM
gccucacugucuuu

SEQ ID NO: 2320242 - RNA, 15 nt, Yersinia pestis KIM
gccucagacuaauga

SEQ ID NO: 2320243 - RNA, 20 nt, Yersinia pestis KIM
gccucgcggaaaucagcuuc

SEQ ID NO: 2320244 - RNA, 16 nt, Yersinia pestis KIM
gccucgcuuacuggua

SEQ ID NO: 2320245 - RNA, 23 nt, Yersinia pestis KIM
gccucgcuucugcgaggccgcug

SEQ ID NO: 2320246 - RNA, 13 nt, Yersinia pestis KIM
gcccgcagacugc

SEQ ID NO: 2320247 - RNA, 22 nt, Yersinia pestis KIM
gcccgcgacggagagaacaggc

SEQ ID NO: 2320248 - RNA, 17 nt, Yersinia pestis KIM
gcccgcgacgagagaac

SEQ ID NO: 2320249 - RNA, 14 nt, Yersinia pestis KIM
gcccgcgcauauag

SEQ ID NO: 2320250 - RNA, 17 nt, Yersinia pestis KIM
gccccggauugcugccc

SEQ ID NO: 2320251 - RNA, 22 nt, Yersinia pestis KIM
gccccggcaaguugaucacccg

SEQ ID NO: 2320252 - RNA, 24 nt, Yersinia pestis KIM
gccccgcuaauugcugcucggaug

SEQ ID NO: 2320253 - RNA, 15 nt, Yersinia pestis KIM
gccccuguaaauaaa

SEQ ID NO: 2320254 - RNA, 17 nt, Yersinia pestis KIM
gccccuguuugcgcagc

SEQ ID NO: 2320255 - RNA, 16 nt, Yersinia pestis KIM
gcccugaauuucaaua

SEQ ID NO: 2320256 - RNA, 19 nt, Yersinia pestis KIM
gcccugaauagccugagca

SEQ ID NO: 2320257 - RNA, 14 nt, Yersinia pestis KIM
gcccuaacauugag

SEQ ID NO: 2320258 - RNA, 22 nt, Yersinia pestis KIM
gcccuccagccgguuuuuucca

SEQ ID NO: 2320259 - RNA, 17 nt, Yersinia pestis KIM
gcccguugcccaccgag

SEQ ID NO: 2320260 - RNA, 22 nt, Yersinia pestis KIM
gcccgcuagugauagcgggccu

SEQ ID NO: 2320261 - RNA, 21 nt, Yersinia pestis KIM
gcccgcuagugauagcgggcc

SEQ ID NO: 2320262 - RNA, 15 nt, Yersinia pestis KIM
gcccgcuaucacuag

SEQ ID NO: 2320263 - RNA, 14 nt, Yersinia pestis KIM
gcccgcuucccuac

SEQ ID NO: 2320264 - RNA, 18 nt, Yersinia pestis KIM
gcccggcucauccgccaa

SEQ ID NO: 2320265 - RNA, 16 nt, Yersinia pestis KIM
gcccagaaaggcaaaa

SEQ ID NO: 2320266 - RNA, 12 nt, Yersinia pestis KIM
gcccagaaaacc

SEQ ID NO: 2320267 - RNA, 19 nt, Yersinia pestis KIM
gcccacuggccugagaacc

SEQ ID NO: 2320268 - RNA, 15 nt, Yersinia pestis KIM
gccaugcuggaugaa

SEQ ID NO: 2320269 - RNA, 14 nt, Yersinia pestis KIM
gcccagccucugga

SEQ ID NO: 2320270 - RNA, 18 nt, Yersinia pestis KIM
gcccagccugguuuuuua

SEQ ID NO: 2320271 - RNA, 16 nt, Yersinia pestis KIM
gcccagcguucucugg

SEQ ID NO: 2320272 - RNA, 21 nt, Yersinia pestis KIM
gcccagcguuggcagaaagug

SEQ ID NO: 2320273 - RNA, 22 nt, Yersinia pestis KIM
gcccagcgguaaauugcucacu

SEQ ID NO: 2320274 - RNA, 19 nt, Yersinia pestis KIM
gcccauccuguucaaaagg

SEQ ID NO: 2320275 - RNA, 14 nt, Yersinia pestis KIM
gcccauccgcagga

SEQ ID NO: 2320276 - RNA, 19 nt, Yersinia pestis KIM
gcccauaucuuuaaaaacc

SEQ ID NO: 2320277 - RNA, 16 nt, Yersinia pestis KIM
gcccauagaugggcca

SEQ ID NO: 2320278 - RNA, 17 nt, Yersinia pestis KIM
gccccagcccagcaggc

SEQ ID NO: 2320279 - RNA, 15 nt, Yersinia pestis KIM
gccccaagcauagaa

SEQ ID NO: 2320280 - RNA, 15 nt, Yersinia pestis KIM
gccccacaaugaauu

SEQ ID NO: 2320281 - RNA, 17 nt, Yersinia pestis KIM
gccccaauagauagaga

SEQ ID NO: 2320282 - RNA, 15 nt, Yersinia pestis KIM
gccccaaucaccggc

SEQ ID NO: 2320283 - RNA, 22 nt, Yersinia pestis KIM
gcccaucuuucggccuccccug

SEQ ID NO: 2320284 - RNA, 14 nt, Yersinia pestis KIM
gcccaugaccacuu

SEQ ID NO: 2320285 - RNA, 20 nt, Yersinia pestis KIM
gcccauggcugaaauaacuu

SEQ ID NO: 2320286 - RNA, 15 nt, Yersinia pestis KIM
gccccaaccaucucc

SEQ ID NO: 2320287 - RNA, 22 nt, Yersinia pestis KIM
gccccaaauaaucagcucauua

SEQ ID NO: 2320288 - RNA, 12 nt, Yersinia pestis KIM
gcccauugcgcu

SEQ ID NO: 2320289 - RNA, 22 nt, Yersinia pestis KIM
gccccauccugacgaaugacuc

SEQ ID NO: 2320290 - RNA, 14 nt, Yersinia pestis KIM
gccccgauaaacca

SEQ ID NO: 2320291 - RNA, 16 nt, Yersinia pestis KIM
gcccccuuucuuaucg

SEQ ID NO: 2320292 - RNA, 17 nt, Yersinia pestis KIM
gccaucgccccaaagau

SEQ ID NO: 2320293 - RNA, 18 nt, Yersinia pestis KIM
gccaugcauuaaggcgcg

SEQ ID NO: 2320294 - RNA, 15 nt, Yersinia pestis KIM
gccaugauguggcug

SEQ ID NO: 2320295 - RNA, 20 nt, Yersinia pestis KIM
gccauaagcgacgacauuaa

SEQ ID NO: 2320296 - RNA, 17 nt, Yersinia pestis KIM
gccauaagugcacugaa

SEQ ID NO: 2320297 - RNA, 14 nt, Yersinia pestis KIM
gccauaaccagagc

SEQ ID NO: 2320298 - RNA, 22 nt, Yersinia pestis KIM
gccauaagugcacugaacccca

SEQ ID NO: 2320299 - RNA, 17 nt, Yersinia pestis KIM
gccauacccugguagca

SEQ ID NO: 2320300 - RNA, 13 nt, Yersinia pestis KIM
gccauagcaaucc

SEQ ID NO: 2320301 - RNA, 20 nt, Yersinia pestis KIM
gccaucccccuuuggccgcu

SEQ ID NO: 2320302 - RNA, 12 nt, Yersinia pestis KIM
gccauaugcaug

SEQ ID NO: 2320303 - RNA, 21 nt, Yersinia pestis KIM
gccauauguugccaccagcgu

SEQ ID NO: 2320304 - RNA, 17 nt, Yersinia pestis KIM
gccaguaauuaaugcca

SEQ ID NO: 2320305 - RNA, 15 nt, Yersinia pestis KIM
gccaguaaucaaaca

SEQ ID NO: 2320306 - RNA, 20 nt, Yersinia pestis KIM
gccagugaugcugcacauca

SEQ ID NO: 2320307 - RNA, 14 nt, Yersinia pestis KIM
gccagugaacccgc

SEQ ID NO: 2320308 - RNA, 18 nt, Yersinia pestis KIM
gccagugccgcggcggcc

SEQ ID NO: 2320309 - RNA, 13 nt, Yersinia pestis KIM
gccaguugcucac

SEQ ID NO: 2320310 - RNA, 19 nt, Yersinia pestis KIM
gccaguuuagugcucauga

SEQ ID NO: 2320311 - RNA, 20 nt, Yersinia pestis KIM
gccaguuuagugcucaugag

SEQ ID NO: 2320312 - RNA, 16 nt, Yersinia pestis KIM
gccaguuucgguacca

SEQ ID NO: 2320313 - RNA, 12 nt, Yersinia pestis KIM
gccauaaauaaa

SEQ ID NO: 2320314 - RNA, 16 nt, Yersinia pestis KIM
gccauaaauaccaauu

SEQ ID NO: 2320315 - RNA, 16 nt, Yersinia pestis KIM
gccagggagggcgcgc

SEQ ID NO: 2320316 - RNA, 13 nt, Yersinia pestis KIM
gccaggucaggaa

SEQ ID NO: 2320317 - RNA, 23 nt, Yersinia pestis KIM
gccaguaacgcuucaucauggau

SEQ ID NO: 2320318 - RNA, 21 nt, Yersinia pestis KIM
gccaguaaaaacucacuguuc

SEQ ID NO: 2320319 - RNA, 17 nt, Yersinia pestis KIM
gccagguaagaaagaga

SEQ ID NO: 2320320 - RNA, 15 nt, Yersinia pestis KIM
gccagguaagaaaga

SEQ ID NO: 2320321 - RNA, 22 nt, Yersinia pestis KIM
gccaggaaauuugcacugcagg

SEQ ID NO: 2320322 - RNA, 13 nt, Yersinia pestis KIM
gccagcuccugcc

SEQ ID NO: 2320323 - RNA, 14 nt, Yersinia pestis KIM
gccagcuccugcca

SEQ ID NO: 2320324 - RNA, 17 nt, Yersinia pestis KIM
gccagcggguacacugu

SEQ ID NO: 2320325 - RNA, 14 nt, Yersinia pestis KIM
gccagccucugcgc

SEQ ID NO: 2320326 - RNA, 20 nt, Yersinia pestis KIM
gccagccggugauuggggcu

SEQ ID NO: 2320327 - RNA, 18 nt, Yersinia pestis KIM
gccagcagaguaaagcag

SEQ ID NO: 2320328 - RNA, 19 nt, Yersinia pestis KIM
gccagauaugaucaaaaau

SEQ ID NO: 2320329 - RNA, 19 nt, Yersinia pestis KIM
gccagauccguaccaccac

SEQ ID NO: 2320330 - RNA, 17 nt, Yersinia pestis KIM
gccagauagagguggcc

SEQ ID NO: 2320331 - RNA, 17 nt, Yersinia pestis KIM
gccagauagaccccuuc

SEQ ID NO: 2320332 - RNA, 22 nt, Yersinia pestis KIM
gccagcacguuuuaaugccaau

SEQ ID NO: 2320333 - RNA, 19 nt, Yersinia pestis KIM
gccagauugugcuccagca

SEQ ID NO: 2320334 - RNA, 21 nt, Yersinia pestis KIM
gccagauugugcuccagcacu

SEQ ID NO: 2320335 - RNA, 13 nt, Yersinia pestis KIM
gccagacacaaug

SEQ ID NO: 2320336 - RNA, 20 nt, Yersinia pestis KIM
gccagacacugacaucauca

SEQ ID NO: 2320337 - RNA, 19 nt, Yersinia pestis KIM
gccagacccggcaaauaaa

SEQ ID NO: 2320338 - RNA, 15 nt, Yersinia pestis KIM
gccagaaucagcccc

SEQ ID NO: 2320339 - RNA, 15 nt, Yersinia pestis KIM
gccagaacagcaggc

SEQ ID NO: 2320340 - RNA, 16 nt, Yersinia pestis KIM
gccacugauaccgaua

SEQ ID NO: 2320341 - RNA, 20 nt, Yersinia pestis KIM
gccacggccgccuucaacug

SEQ ID NO: 2320342 - RNA, 16 nt, Yersinia pestis KIM
gccacggcauuagaag

SEQ ID NO: 2320343 - RNA, 21 nt, Yersinia pestis KIM
gccacggcgagaccuacucgc

SEQ ID NO: 2320344 - RNA, 19 nt, Yersinia pestis KIM
gccacgggcaccugacgca

SEQ ID NO: 2320345 - RNA, 16 nt, Yersinia pestis KIM
gccacgcuauucacuc

SEQ ID NO: 2320346 - RNA, 14 nt, Yersinia pestis KIM
gccacugacugcuu

SEQ ID NO: 2320347 - RNA, 19 nt, Yersinia pestis KIM
gccacugagcaaacagugc

SEQ ID NO: 2320348 - RNA, 14 nt, Yersinia pestis KIM
gccacucuagcugu

SEQ ID NO: 2320349 - RNA, 23 nt, Yersinia pestis KIM
gccacucuagcuguguuuuaucu

SEQ ID NO: 2320350 - RNA, 20 nt, Yersinia pestis KIM
gccacgucugcggaucagag

SEQ ID NO: 2320351 - RNA, 14 nt, Yersinia pestis KIM
gccaccuuaaguaa

SEQ ID NO: 2320352 - RNA, 17 nt, Yersinia pestis KIM
gccacgaugugaagcaa

SEQ ID NO: 2320353 - RNA, 20 nt, Yersinia pestis KIM
gccacgaccauucgcaggcc

SEQ ID NO: 2320354 - RNA, 22 nt, Yersinia pestis KIM
gccacgccaguaaacagccagc

SEQ ID NO: 2320355 - RNA, 16 nt, Yersinia pestis KIM
gcauagcuaaccuuaa

SEQ ID NO: 2320356 - RNA, 17 nt, Yersinia pestis KIM
gcauagcuaaccuuaac

SEQ ID NO: 2320357 - RNA, 14 nt, Yersinia pestis KIM
gcauaggccaauag

SEQ ID NO: 2320358 - RNA, 16 nt, Yersinia pestis KIM
gcauacaccuucuuaa

SEQ ID NO: 2320359 - RNA, 20 nt, Yersinia pestis KIM
gcaaaacugggcuugagagu

SEQ ID NO: 2320360 - RNA, 18 nt, Yersinia pestis KIM
gcaaaacguauaaaagca

SEQ ID NO: 2320361 - RNA, 15 nt, Yersinia pestis KIM
gcaacaaccccauga

SEQ ID NO: 2320362 - RNA, 21 nt, Yersinia pestis KIM
gcaaccaguuauagcgguggc

SEQ ID NO: 2320363 - RNA, 16 nt, Yersinia pestis KIM
gcaacauuaaaaauac

SEQ ID NO: 2320364 - RNA, 21 nt, Yersinia pestis KIM
gcaacauuauccguuugcaac

SEQ ID NO: 2320365 - RNA, 23 nt, Yersinia pestis KIM
gcaacauuauccguuugcaacau

SEQ ID NO: 2320366 - RNA, 23 nt, Yersinia pestis KIM
gcaacgcacgauccgcccauugc

SEQ ID NO: 2320367 - RNA, 15 nt, Yersinia pestis KIM
gcaaccgagaagucg

SEQ ID NO: 2320368 - RNA, 15 nt, Yersinia pestis KIM
gcaacgacagcaaca

SEQ ID NO: 2320369 - RNA, 14 nt, Yersinia pestis KIM
gcaaccuuguuuua

SEQ ID NO: 2320370 - RNA, 23 nt, Yersinia pestis KIM
gcaaccuggaauggcgcaauagc

SEQ ID NO: 2320371 - RNA, 21 nt, Yersinia pestis KIM
gcaaccuggccaauaaacgcu

SEQ ID NO: 2320372 - RNA, 23 nt, Yersinia pestis KIM
gcaacuguaaugccccacuucac

SEQ ID NO: 2320373 - RNA, 19 nt, Yersinia pestis KIM
gcaacuguaaugccccacu

SEQ ID NO: 2320374 - RNA, 14 nt, Yersinia pestis KIM
gcaagaauaacugg

SEQ ID NO: 2320375 - RNA, 21 nt, Yersinia pestis KIM
gcaagcugagauaagccucgg

SEQ ID NO: 2320376 - RNA, 15 nt, Yersinia pestis KIM
gcaagaguuagggcu

SEQ ID NO: 2320377 - RNA, 13 nt, Yersinia pestis KIM
gcaaggaagucca

SEQ ID NO: 2320378 - RNA, 20 nt, Yersinia pestis KIM
gcaaggauuccccccaguca

SEQ ID NO: 2320379 - RNA, 16 nt, Yersinia pestis KIM
gcaacucuagcgccag

SEQ ID NO: 2320380 - RNA, 21 nt, Yersinia pestis KIM
gcaacucuagcgccagcaauu

SEQ ID NO: 2320381 - RNA, 21 nt, Yersinia pestis KIM
gcaacucgguuuuaaucgcag

SEQ ID NO: 2320382 - RNA, 16 nt, Yersinia pestis KIM
gcaacguuuuaccugc

SEQ ID NO: 2320383 - RNA, 19 nt, Yersinia pestis KIM
gcaauccgcugacauugcc

SEQ ID NO: 2320384 - RNA, 20 nt, Yersinia pestis KIM
gcaaucaggauaaugagugu

SEQ ID NO: 2320385 - RNA, 16 nt, Yersinia pestis KIM
gcaaggcggcaagcaa

SEQ ID NO: 2320386 - RNA, 11 nt, Yersinia pestis KIM
gcaaggccagg

SEQ ID NO: 2320387 - RNA, 18 nt, Yersinia pestis KIM
gcaauaaccagaauaauc

SEQ ID NO: 2320388 - RNA, 17 nt, Yersinia pestis KIM
gcaauaauugcacccca

SEQ ID NO: 2320389 - RNA, 23 nt, Yersinia pestis KIM
gcaauaaaggcaagauuucucuu

SEQ ID NO: 2320390 - RNA, 20 nt, Yersinia pestis KIM
gcaauaaagcgucagaugcu

SEQ ID NO: 2320391 - RNA, 15 nt, Yersinia pestis KIM
gcaauaacaccagca

SEQ ID NO: 2320392 - RNA, 17 nt, Yersinia pestis KIM
gcaauaacaccagcagg

SEQ ID NO: 2320393 - RNA, 14 nt, Yersinia pestis KIM
gcaauaaauucaaa

SEQ ID NO: 2320394 - RNA, 20 nt, Yersinia pestis KIM
gcaauaacaaacacauccag

SEQ ID NO: 2320395 - RNA, 22 nt, Yersinia pestis KIM
gcaauaacaaacacauccagga

SEQ ID NO: 2320396 - RNA, 21 nt, Yersinia pestis KIM
gcacaggcaaaaagagucagu

SEQ ID NO: 2320397 - RNA, 13 nt, Yersinia pestis KIM
gcacaucccaaua

SEQ ID NO: 2320398 - RNA, 21 nt, Yersinia pestis KIM
gcacaucauuuauuuccaagc

SEQ ID NO: 2320399 - RNA, 22 nt, Yersinia pestis KIM
gcacaguagaagcuaccagcac

SEQ ID NO: 2320400 - RNA, 17 nt, Yersinia pestis KIM
gcacagcgagauaaacu

SEQ ID NO: 2320401 - RNA, 13 nt, Yersinia pestis KIM
gcacagccugccg

SEQ ID NO: 2320402 - RNA, 19 nt, Yersinia pestis KIM
gcacagcacucguggacau

SEQ ID NO: 2320403 - RNA, 19 nt, Yersinia pestis KIM
gcacaccgcuacaggcgca

SEQ ID NO: 2320404 - RNA, 12 nt, Yersinia pestis KIM
gcacacccccau

SEQ ID NO: 2320405 - RNA, 18 nt, Yersinia pestis KIM
gcacaaagcuuacuguuc

SEQ ID NO: 2320406 - RNA, 19 nt, Yersinia pestis KIM
gcacaaagcuuacuguuca

SEQ ID NO: 2320407 - RNA, 14 nt, Yersinia pestis KIM
gcaaugaaggcuca

SEQ ID NO: 2320408 - RNA, 22 nt, Yersinia pestis KIM
gcaccaguugaccauuuuuauc

SEQ ID NO: 2320409 - RNA, 21 nt, Yersinia pestis KIM
gcaccauaaccaauccaugcc

SEQ ID NO: 2320410 - RNA, 18 nt, Yersinia pestis KIM
gcaccauccagcaaauca

SEQ ID NO: 2320411 - RNA, 13 nt, Yersinia pestis KIM
gcaccauccagca

SEQ ID NO: 2320412 - RNA, 18 nt, Yersinia pestis KIM
gcaccauagauuaagaaa

SEQ ID NO: 2320413 - RNA, 18 nt, Yersinia pestis KIM
gcaccauauucccagcca

SEQ ID NO: 2320414 - RNA, 15 nt, Yersinia pestis KIM
gcaccauggaaaaua

SEQ ID NO: 2320415 - RNA, 21 nt, Yersinia pestis KIM
gcaccaaucauuacaucaucu

SEQ ID NO: 2320416 - RNA, 14 nt, Yersinia pestis KIM
gcacauuaacacau

SEQ ID NO: 2320417 - RNA, 16 nt, Yersinia pestis KIM
gcaccacaauggcaga

SEQ ID NO: 2320418 - RNA, 13 nt, Yersinia pestis KIM
gcaccacacagcg

SEQ ID NO: 2320419 - RNA, 16 nt, Yersinia pestis KIM
gcacgacaacaaagcc

SEQ ID NO: 2320420 - RNA, 21 nt, Yersinia pestis KIM
gcacgacaacaaagccgcugc

SEQ ID NO: 2320421 - RNA, 15 nt, Yersinia pestis KIM
gcaccggacaaacca

SEQ ID NO: 2320422 - RNA, 18 nt, Yersinia pestis KIM
gcaccguggauaaacaaa

SEQ ID NO: 2320423 - RNA, 13 nt, Yersinia pestis KIM
gcaccucaggguu

SEQ ID NO: 2320424 - RNA, 12 nt, Yersinia pestis KIM
gcacccacaccg

SEQ ID NO: 2320425 - RNA, 13 nt, Yersinia pestis KIM
gcacccagugacc

SEQ ID NO: 2320426 - RNA, 23 nt, Yersinia pestis KIM
gcaccgcuggucgggugcaggcc

SEQ ID NO: 2320427 - RNA, 15 nt, Yersinia pestis KIM
gcaguaauagcaaaa

SEQ ID NO: 2320428 - RNA, 23 nt, Yersinia pestis KIM
gcagucugacagauacuuucggg

SEQ ID NO: 2320429 - RNA, 16 nt, Yersinia pestis KIM
gcagucugagccucau

SEQ ID NO: 2320430 - RNA, 17 nt, Yersinia pestis KIM
gcagucugaggagccau

SEQ ID NO: 2320431 - RNA, 18 nt, Yersinia pestis KIM
gcagucugaggcccgcua

SEQ ID NO: 2320432 - RNA, 21 nt, Yersinia pestis KIM
gcagucugaaacgccagccuc

SEQ ID NO: 2320433 - RNA, 21 nt, Yersinia pestis KIM
gcagugaucaguccuuagcau

SEQ ID NO: 2320434 - RNA, 19 nt, Yersinia pestis KIM
gcaguguaaaaccugacug

SEQ ID NO: 2320435 - RNA, 22 nt, Yersinia pestis KIM
gcaguuaagguuagcuaugcag

SEQ ID NO: 2320436 - RNA, 21 nt, Yersinia pestis KIM
gcauaaauacgguucaaauca

SEQ ID NO: 2320437 - RNA, 12 nt, Yersinia pestis KIM
gcauaaacugaa

SEQ ID NO: 2320438 - RNA, 20 nt, Yersinia pestis KIM
gcauaacaacgacuccauca

SEQ ID NO: 2320439 - RNA, 20 nt, Yersinia pestis KIM
gcauaaauauucauuaaaaa

SEQ ID NO: 2320440 - RNA, 21 nt, Yersinia pestis KIM
gcauaaauauucauuaaaaaa

SEQ ID NO: 2320441 - RNA, 21 nt, Yersinia pestis KIM
gcauaacuggcgguuucaccu

SEQ ID NO: 2320442 - RNA, 20 nt, Yersinia pestis KIM
gcaguucaaaggggcugauc

SEQ ID NO: 2320443 - RNA, 23 nt, Yersinia pestis KIM
gcaguuggaucugcacaccacac

SEQ ID NO: 2320444 - RNA, 21 nt, Yersinia pestis KIM
gcagguggguuuauugauugg

SEQ ID NO: 2320445 - RNA, 14 nt, Yersinia pestis KIM
gcagguuaaacagc

SEQ ID NO: 2320446 - RNA, 12 nt, Yersinia pestis KIM
gcagguggaucc

SEQ ID NO: 2320447 - RNA, 15 nt, Yersinia pestis KIM
gcaguaacgccauaa

SEQ ID NO: 2320448 - RNA, 20 nt, Yersinia pestis KIM
gcaguaacggaauucagaac

SEQ ID NO: 2320449 - RNA, 16 nt, Yersinia pestis KIM
gcaguaacguccaacu

SEQ ID NO: 2320450 - RNA, 14 nt, Yersinia pestis KIM
gcaggucagaauga

SEQ ID NO: 2320451 - RNA, 23 nt, Yersinia pestis KIM
gcagguaucaauacagacgccga

SEQ ID NO: 2320452 - RNA, 20 nt, Yersinia pestis KIM
gcaggguggagagaaaggcu

SEQ ID NO: 2320453 - RNA, 15 nt, Yersinia pestis KIM
gcaggguauuuucuc

SEQ ID NO: 2320454 - RNA, 15 nt, Yersinia pestis KIM
gcagguaaugcauuc

SEQ ID NO: 2320455 - RNA, 19 nt, Yersinia pestis KIM
gcaggggguuagcugcaag

SEQ ID NO: 2320456 - RNA, 14 nt, Yersinia pestis KIM
gcagggcgaucagg

SEQ ID NO: 2320457 - RNA, 22 nt, Yersinia pestis KIM
gcaggagucugaaaccccuugu

SEQ ID NO: 2320458 - RNA, 14 nt, Yersinia pestis KIM
gcaggcggccaaug

SEQ ID NO: 2320459 - RNA, 19 nt, Yersinia pestis KIM
gcagggccgguuaauugaa

SEQ ID NO: 2320460 - RNA, 22 nt, Yersinia pestis KIM
gcaggaaauugccgcaucagcc

SEQ ID NO: 2320461 - RNA, 14 nt, Yersinia pestis KIM
gcaggaauccaagu

SEQ ID NO: 2320462 - RNA, 17 nt, Yersinia pestis KIM
gcaggaauccaaguuca

SEQ ID NO: 2320463 - RNA, 16 nt, Yersinia pestis KIM
gcaggaagcaaugaaa

SEQ ID NO: 2320464 - RNA, 15 nt, Yersinia pestis KIM
gcagcgagcacugcc

SEQ ID NO: 2320465 - RNA, 16 nt, Yersinia pestis KIM
gcagcgagcacugccc

SEQ ID NO: 2320466 - RNA, 15 nt, Yersinia pestis KIM
gcagcuaaagcaaag

SEQ ID NO: 2320467 - RNA, 13 nt, Yersinia pestis KIM
gcagacagcgagc

SEQ ID NO: 2320468 - RNA, 16 nt, Yersinia pestis KIM
gcagaccgacauucca

SEQ ID NO: 2320469 - RNA, 20 nt, Yersinia pestis KIM
gcagacggggaggacuuccg

SEQ ID NO: 2320470 - RNA, 21 nt, Yersinia pestis KIM
gcagacgcacccggcuggcac

SEQ ID NO: 2320471 - RNA, 20 nt, Yersinia pestis KIM
gcagacgcguaacuguugca

SEQ ID NO: 2320472 - RNA, 22 nt, Yersinia pestis KIM
gcagacgcguaacuguugcaaa

SEQ ID NO: 2320473 - RNA, 23 nt, Yersinia pestis KIM
gcagagaugcagagaugcagaga

SEQ ID NO: 2320474 - RNA, 21 nt, Yersinia pestis KIM
gcagagaucauguaguacuua

SEQ ID NO: 2320475 - RNA, 16 nt, Yersinia pestis KIM
gcagacucuuauauaa

SEQ ID NO: 2320476 - RNA, 19 nt, Yersinia pestis KIM
gcagacugcugacaaaccc

SEQ ID NO: 2320477 - RNA, 18 nt, Yersinia pestis KIM
gcagagccugacucacag

SEQ ID NO: 2320478 - RNA, 19 nt, Yersinia pestis KIM
gcagagucgcaaaaaauau

SEQ ID NO: 2320479 - RNA, 19 nt, Yersinia pestis KIM
gcacuuuucgucauuauua

SEQ ID NO: 2320480 - RNA, 16 nt, Yersinia pestis KIM
gcacuuguuuugccag

SEQ ID NO: 2320481 - RNA, 20 nt, Yersinia pestis KIM
gcacuuggccccaucaucuc

SEQ ID NO: 2320482 - RNA, 14 nt, Yersinia pestis KIM
gcacuucauuggcu

SEQ ID NO: 2320483 - RNA, 16 nt, Yersinia pestis KIM
gcagaaauaauaucaa

SEQ ID NO: 2320484 - RNA, 18 nt, Yersinia pestis KIM
gcagaacaaaacaagccc

SEQ ID NO: 2320485 - RNA, 18 nt, Yersinia pestis KIM
gcagaaaaugcggcggcu

SEQ ID NO: 2320486 - RNA, 16 nt, Yersinia pestis KIM
gcagaagaauaucugc

SEQ ID NO: 2320487 - RNA, 12 nt, Yersinia pestis KIM
gcagaacuaaca

SEQ ID NO: 2320488 - RNA, 10 nt, Yersinia pestis KIM
gcagccgccg

SEQ ID NO: 2320489 - RNA, 18 nt, Yersinia pestis KIM
gcagccuuuauccagcca

SEQ ID NO: 2320490 - RNA, 18 nt, Yersinia pestis KIM
gcagcagggcuuucacau

SEQ ID NO: 2320491 - RNA, 14 nt, Yersinia pestis KIM
gcagcaagaacaau

SEQ ID NO: 2320492 - RNA, 21 nt, Yersinia pestis KIM
gcagcacaccggccaaaauca

SEQ ID NO: 2320493 - RNA, 17 nt, Yersinia pestis KIM
gcagcagacaacugaca

SEQ ID NO: 2320494 - RNA, 21 nt, Yersinia pestis KIM
gcagauacuggaagccgacga

SEQ ID NO: 2320495 - RNA, 15 nt, Yersinia pestis KIM
gcagauaccacauca

SEQ ID NO: 2320496 - RNA, 19 nt, Yersinia pestis KIM
gcagauauccuuuuucgug

SEQ ID NO: 2320497 - RNA, 15 nt, Yersinia pestis KIM
gcagaucguaaagac

SEQ ID NO: 2320498 - RNA, 14 nt, Yersinia pestis KIM
gaguaggaaauaca

SEQ ID NO: 2320499 - RNA, 20 nt, Yersinia pestis KIM
gagucccguccgcaccgcca

SEQ ID NO: 2320500 - RNA, 15 nt, Yersinia pestis KIM
gagucgcaaaacuuc

SEQ ID NO: 2320501 - RNA, 16 nt, Yersinia pestis KIM
gagugaauuucuuccc

SEQ ID NO: 2320502 - RNA, 18 nt, Yersinia pestis KIM
gagugacggcuucuguaa

SEQ ID NO: 2320503 - RNA, 19 nt, Yersinia pestis KIM
gagugaaggguugaccgca

SEQ ID NO: 2320504 - RNA, 14 nt, Yersinia pestis KIM
gagugaaggguuga

SEQ ID NO: 2320505 - RNA, 23 nt, Yersinia pestis KIM
gagugaaaucuccuguggcacau

SEQ ID NO: 2320506 - RNA, 13 nt, Yersinia pestis KIM
gaguuucaggaag

SEQ ID NO: 2320507 - RNA, 18 nt, Yersinia pestis KIM
gaguuucccuuuuccauc

SEQ ID NO: 2320508 - RNA, 15 nt, Yersinia pestis KIM
gaguuguugccacag

SEQ ID NO: 2320509 - RNA, 19 nt, Yersinia pestis KIM
gaguguucauaaauuaaaa

SEQ ID NO: 2320510 - RNA, 13 nt, Yersinia pestis KIM
gagugguuuauaa

SEQ ID NO: 2320511 - RNA, 18 nt, Yersinia pestis KIM
gaguguaaaaagcagugc

SEQ ID NO: 2320512 - RNA, 14 nt, Yersinia pestis KIM
gagugagcgcgggu

SEQ ID NO: 2320513 - RNA, 17 nt, Yersinia pestis KIM
gagugagucaucggggu

SEQ ID NO: 2320514 - RNA, 14 nt, Yersinia pestis KIM
gaguuuguggggag

SEQ ID NO: 2320515 - RNA, 14 nt, Yersinia pestis KIM
gaguuuuagcccaa

SEQ ID NO: 2320516 - RNA, 18 nt, Yersinia pestis KIM
gaguuuuuugcgccacaa

SEQ ID NO: 2320517 - RNA, 19 nt, Yersinia pestis KIM
gauaaaccgcuauaucauc

SEQ ID NO: 2320518 - RNA, 14 nt, Yersinia pestis KIM
gauaaaccaaucac

SEQ ID NO: 2320519 - RNA, 13 nt, Yersinia pestis KIM
gauaaaucgccca

SEQ ID NO: 2320520 - RNA, 18 nt, Yersinia pestis KIM
gauaaauucgauaaaagg

SEQ ID NO: 2320521 - RNA, 14 nt, Yersinia pestis KIM
gauaaauucaaaua

SEQ ID NO: 2320522 - RNA, 21 nt, Yersinia pestis KIM
gauaaauagucguuauauaaa

SEQ ID NO: 2320523 - RNA, 20 nt, Yersinia pestis KIM
gauaaauaccgccaaauaca

SEQ ID NO: 2320524 - RNA, 16 nt, Yersinia pestis KIM
gauaacacauauauua

SEQ ID NO: 2320525 - RNA, 22 nt, Yersinia pestis KIM
gauaacccuaucgucagugcgg

SEQ ID NO: 2320526 - RNA, 13 nt, Yersinia pestis KIM
gauaaccagcagc

SEQ ID NO: 2320527 - RNA, 14 nt, Yersinia pestis KIM
gauaaccacuucaa

SEQ ID NO: 2320528 - RNA, 20 nt, Yersinia pestis KIM
gauaagagcgacucaauaau

SEQ ID NO: 2320529 - RNA, 15 nt, Yersinia pestis KIM
gauaagaucucagca

SEQ ID NO: 2320530 - RNA, 18 nt, Yersinia pestis KIM
gauaacucgcgcuauuua

SEQ ID NO: 2320531 - RNA, 18 nt, Yersinia pestis KIM
gauaacugaccugcgcuu

SEQ ID NO: 2320532 - RNA, 18 nt, Yersinia pestis KIM
gauaacuuuuuauuucuu

SEQ ID NO: 2320533 - RNA, 16 nt, Yersinia pestis KIM
gauaagaaugaauauu

SEQ ID NO: 2320534 - RNA, 15 nt, Yersinia pestis KIM
gaggcucuucugggc

SEQ ID NO: 2320535 - RNA, 16 nt, Yersinia pestis KIM
gaggcucuucugggcu

SEQ ID NO: 2320536 - RNA, 22 nt, Yersinia pestis KIM
gaggcugcguguucuucucacc

SEQ ID NO: 2320537 - RNA, 14 nt, Yersinia pestis KIM
gaggcguggcacac

SEQ ID NO: 2320538 - RNA, 19 nt, Yersinia pestis KIM
gagggacgcgaaucccccc

SEQ ID NO: 2320539 - RNA, 12 nt, Yersinia pestis KIM
gagggacagaga

SEQ ID NO: 2320540 - RNA, 16 nt, Yersinia pestis KIM
gagggagucagggagu

SEQ ID NO: 2320541 - RNA, 19 nt, Yersinia pestis KIM
gaggguugucagcagucug

SEQ ID NO: 2320542 - RNA, 17 nt, Yersinia pestis KIM
gagggcgguuaaauaca

SEQ ID NO: 2320543 - RNA, 22 nt, Yersinia pestis KIM
gagggcgguuaaauacagcacc

SEQ ID NO: 2320544 - RNA, 17 nt, Yersinia pestis KIM
gagggcucaaucucugc

SEQ ID NO: 2320545 - RNA, 18 nt, Yersinia pestis KIM
gagggcguucucaggaac

SEQ ID NO: 2320546 - RNA, 15 nt, Yersinia pestis KIM
gagguggcacccagu

SEQ ID NO: 2320547 - RNA, 16 nt, Yersinia pestis KIM
gaggucauucagguuu

SEQ ID NO: 2320548 - RNA, 23 nt, Yersinia pestis KIM
gagguuuugggcuaaaagggagu

SEQ ID NO: 2320549 - RNA, 13 nt, Yersinia pestis KIM
gaguaaaacugau

SEQ ID NO: 2320550 - RNA, 21 nt, Yersinia pestis KIM
gaguaaagcaggccuucuaac

SEQ ID NO: 2320551 - RNA, 12 nt, Yersinia pestis KIM
gaguaaacagag

SEQ ID NO: 2320552 - RNA, 13 nt, Yersinia pestis KIM
gaguaaaccguac

SEQ ID NO: 2320553 - RNA, 20 nt, Yersinia pestis KIM
gaguaaauucgggcuuuaau

SEQ ID NO: 2320554 - RNA, 15 nt, Yersinia pestis KIM
gaguaaagcguccgc

SEQ ID NO: 2320555 - RNA, 23 nt, Yersinia pestis KIM
gaguaaucgccugcugagccaaa

SEQ ID NO: 2320556 - RNA, 19 nt, Yersinia pestis KIM
gaguaagugauucggguga

SEQ ID NO: 2320557 - RNA, 22 nt, Yersinia pestis KIM
gaguaacacuucagacugaaag

SEQ ID NO: 2320558 - RNA, 21 nt, Yersinia pestis KIM
gaucauccgcucagcaaaaau

SEQ ID NO: 2320559 - RNA, 17 nt, Yersinia pestis KIM
gaucaucgcaccauaac

SEQ ID NO: 2320560 - RNA, 22 nt, Yersinia pestis KIM
gaucaucgggcauucacugcua

SEQ ID NO: 2320561 - RNA, 20 nt, Yersinia pestis KIM
gauccaguuucaguggcuuc

SEQ ID NO: 2320562 - RNA, 14 nt, Yersinia pestis KIM
gauccauaggaucc

SEQ ID NO: 2320563 - RNA, 14 nt, Yersinia pestis KIM
gaucaucagcagca

SEQ ID NO: 2320564 - RNA, 15 nt, Yersinia pestis KIM
gaucaucagcagcag

SEQ ID NO: 2320565 - RNA, 22 nt, Yersinia pestis KIM
gaucaguggcuuaauugaagca

SEQ ID NO: 2320566 - RNA, 16 nt, Yersinia pestis KIM
gaucacggauaucaau

SEQ ID NO: 2320567 - RNA, 19 nt, Yersinia pestis KIM
gaucaccaccgcauuuuca

SEQ ID NO: 2320568 - RNA, 18 nt, Yersinia pestis KIM
gaucaccagcaaaggcca

SEQ ID NO: 2320569 - RNA, 18 nt, Yersinia pestis KIM
gaucaaacauaaccugca

SEQ ID NO: 2320570 - RNA, 21 nt, Yersinia pestis KIM
gaucaauaucccgagaaacaa

SEQ ID NO: 2320571 - RNA, 15 nt, Yersinia pestis KIM
gaucaaucucaucaa

SEQ ID NO: 2320572 - RNA, 23 nt, Yersinia pestis KIM
gaucaccaaucggaucgagcugu

SEQ ID NO: 2320573 - RNA, 20 nt, Yersinia pestis KIM
gaucacaauacagcaaauag

SEQ ID NO: 2320574 - RNA, 17 nt, Yersinia pestis KIM
gauauuauuagccaaau

SEQ ID NO: 2320575 - RNA, 15 nt, Yersinia pestis KIM
gauauaugccauauu

SEQ ID NO: 2320576 - RNA, 19 nt, Yersinia pestis KIM
gauauucacguuuuuccau

SEQ ID NO: 2320577 - RNA, 16 nt, Yersinia pestis KIM
gauauucgcgcccaaa

SEQ ID NO: 2320578 - RNA, 16 nt, Yersinia pestis KIM
gauauuccugcaaagu

SEQ ID NO: 2320579 - RNA, 20 nt, Yersinia pestis KIM
gauauucgcccgcugauucu

SEQ ID NO: 2320580 - RNA, 18 nt, Yersinia pestis KIM
gauauucucaccugcuua

SEQ ID NO: 2320581 - RNA, 20 nt, Yersinia pestis KIM
gauauuucacguucaucaau

SEQ ID NO: 2320582 - RNA, 23 nt, Yersinia pestis KIM
gauauuugggucgguaaccugaa

SEQ ID NO: 2320583 - RNA, 12 nt, Yersinia pestis KIM
gauauuuucggg

SEQ ID NO: 2320584 - RNA, 15 nt, Yersinia pestis KIM
gaucaaaagcagaga

SEQ ID NO: 2320585 - RNA, 21 nt, Yersinia pestis KIM
gaucaaaaacguccaggcuuu

SEQ ID NO: 2320586 - RNA, 19 nt, Yersinia pestis KIM
gauauuuuuuugucugacg

SEQ ID NO: 2320587 - RNA, 18 nt, Yersinia pestis KIM
gauaaggugcgggaugca

SEQ ID NO: 2320588 - RNA, 23 nt, Yersinia pestis KIM
gauaagccauuuuuuauaaacac

SEQ ID NO: 2320589 - RNA, 20 nt, Yersinia pestis KIM
gauaagcgguuuuaucaaua

SEQ ID NO: 2320590 - RNA, 16 nt, Yersinia pestis KIM
gauaccggaaaaugcg

SEQ ID NO: 2320591 - RNA, 19 nt, Yersinia pestis KIM
gauaaguugagaucaacuc

SEQ ID NO: 2320592 - RNA, 17 nt, Yersinia pestis KIM
gauagccauaauaaugc

SEQ ID NO: 2320593 - RNA, 18 nt, Yersinia pestis KIM
gauacuacaaucaucggc

SEQ ID NO: 2320594 - RNA, 14 nt, Yersinia pestis KIM
gauacuaauuucua

SEQ ID NO: 2320595 - RNA, 22 nt, Yersinia pestis KIM
gauacguuuggugccgcuggca

SEQ ID NO: 2320596 - RNA, 15 nt, Yersinia pestis KIM
gauagcuucagcauu

SEQ ID NO: 2320597 - RNA, 20 nt, Yersinia pestis KIM
gauagcggcuaaagggcuga

SEQ ID NO: 2320598 - RNA, 21 nt, Yersinia pestis KIM
gauagcggcuaaagggcugag

SEQ ID NO: 2320599 - RNA, 20 nt, Yersinia pestis KIM
gauagcgggccuuugcuuuu

SEQ ID NO: 2320600 - RNA, 14 nt, Yersinia pestis KIM
gauaggcagaggag

SEQ ID NO: 2320601 - RNA, 16 nt, Yersinia pestis KIM
gauagggagccaauag

SEQ ID NO: 2320602 - RNA, 21 nt, Yersinia pestis KIM
gauagggagccaauagaggcu

SEQ ID NO: 2320603 - RNA, 14 nt, Yersinia pestis KIM
gauaguuaucuccc

SEQ ID NO: 2320604 - RNA, 23 nt, Yersinia pestis KIM
gauaguuuuuuuuauggcugcgu

SEQ ID NO: 2320605 - RNA, 21 nt, Yersinia pestis KIM
gauagucauuuuauuuaggcu

SEQ ID NO: 2320606 - RNA, 16 nt, Yersinia pestis KIM
gauagugaguauguau

SEQ ID NO: 2320607 - RNA, 22 nt, Yersinia pestis KIM
gauagugacuucgcugcuaaac

SEQ ID NO: 2320608 - RNA, 15 nt, Yersinia pestis KIM
gauauaaauaaaaua

SEQ ID NO: 2320609 - RNA, 12 nt, Yersinia pestis KIM
gauauaacgaau

SEQ ID NO: 2320610 - RNA, 12 nt, Yersinia pestis KIM
gauauaaauaaa

SEQ ID NO: 2320611 - RNA, 22 nt, Yersinia pestis KIM
gauauaaacuaauaucuuucau

SEQ ID NO: 2320612 - RNA, 17 nt, Yersinia pestis KIM
gauauacccaccagaga

SEQ ID NO: 2320613 - RNA, 19 nt, Yersinia pestis KIM
gaucuugaacggugaggau

SEQ ID NO: 2320614 - RNA, 16 nt, Yersinia pestis KIM
gaucuucauugccuuc

SEQ ID NO: 2320615 - RNA, 13 nt, Yersinia pestis KIM
gaugaaacccaga

SEQ ID NO: 2320616 - RNA, 17 nt, Yersinia pestis KIM
gaugaaaauugcaggug

SEQ ID NO: 2320617 - RNA, 15 nt, Yersinia pestis KIM
gaugaaauuaaaaug

SEQ ID NO: 2320618 - RNA, 15 nt, Yersinia pestis KIM
gaucucuccagccug

SEQ ID NO: 2320619 - RNA, 19 nt, Yersinia pestis KIM
gaucucucgaacccgcaga

SEQ ID NO: 2320620 - RNA, 16 nt, Yersinia pestis KIM
gaucucuuuauauuca

SEQ ID NO: 2320621 - RNA, 18 nt, Yersinia pestis KIM
gaucugccuguucucucc

SEQ ID NO: 2320622 - RNA, 16 nt, Yersinia pestis KIM
gaucugccuguucucu

SEQ ID NO: 2320623 - RNA, 20 nt, Yersinia pestis KIM
gaucugccccuggcucagua

SEQ ID NO: 2320624 - RNA, 22 nt, Yersinia pestis KIM
gaucugauaucucuuuaucauu

SEQ ID NO: 2320625 - RNA, 14 nt, Yersinia pestis KIM
gaucucauuuagca

SEQ ID NO: 2320626 - RNA, 20 nt, Yersinia pestis KIM
gaucucaucauugacgugca

SEQ ID NO: 2320627 - RNA, 21 nt, Yersinia pestis KIM
gauggccuugaaucaaaauac

SEQ ID NO: 2320628 - RNA, 13 nt, Yersinia pestis KIM
gauggccgggcug

SEQ ID NO: 2320629 - RNA, 22 nt, Yersinia pestis KIM
gauggcggcuggaaaaccaauu

SEQ ID NO: 2320630 - RNA, 14 nt, Yersinia pestis KIM
gaugccuaauaauu

SEQ ID NO: 2320631 - RNA, 14 nt, Yersinia pestis KIM
gaugcgcuccgcca

SEQ ID NO: 2320632 - RNA, 13 nt, Yersinia pestis KIM
gaugccauuuacc

SEQ ID NO: 2320633 - RNA, 13 nt, Yersinia pestis KIM
gaugccacuguuc

SEQ ID NO: 2320634 - RNA, 14 nt, Yersinia pestis KIM
gaugauauacccac

SEQ ID NO: 2320635 - RNA, 20 nt, Yersinia pestis KIM
gaugauauacccaccagaga

SEQ ID NO: 2320636 - RNA, 19 nt, Yersinia pestis KIM
gaugaagcauuaaacagau

SEQ ID NO: 2320637 - RNA, 17 nt, Yersinia pestis KIM
gaugaacugacacacac

SEQ ID NO: 2320638 - RNA, 14 nt, Yersinia pestis KIM
gaugaacggcuggu

SEQ ID NO: 2320639 - RNA, 20 nt, Yersinia pestis KIM
gaugaccgugacauuuucac

SEQ ID NO: 2320640 - RNA, 16 nt, Yersinia pestis KIM
gaugagucgcugguau

SEQ ID NO: 2320641 - RNA, 21 nt, Yersinia pestis KIM
gaugaguauuaccucaucauu

SEQ ID NO: 2320642 - RNA, 13 nt, Yersinia pestis KIM
gaugagcugguga

SEQ ID NO: 2320643 - RNA, 17 nt, Yersinia pestis KIM
gaugacgcgaucugaaa

SEQ ID NO: 2320644 - RNA, 22 nt, Yersinia pestis KIM
gauguggauaauuucagcagca

SEQ ID NO: 2320645 - RNA, 20 nt, Yersinia pestis KIM
gaugugauccacacagcauu

SEQ ID NO: 2320646 - RNA, 17 nt, Yersinia pestis KIM
gaugucuucaacuugug

SEQ ID NO: 2320647 - RNA, 18 nt, Yersinia pestis KIM
gauguuauuugaauaaaa

SEQ ID NO: 2320648 - RNA, 12 nt, Yersinia pestis KIM
gauguuaugagg

SEQ ID NO: 2320649 - RNA, 17 nt, Yersinia pestis KIM
gauguguggcagucacu

SEQ ID NO: 2320650 - RNA, 16 nt, Yersinia pestis KIM
gauguuuaacccaaug

SEQ ID NO: 2320651 - RNA, 23 nt, Yersinia pestis KIM
gauuaauuaacacccaauaauaa

SEQ ID NO: 2320652 - RNA, 15 nt, Yersinia pestis KIM
gauuacaaaauauac

SEQ ID NO: 2320653 - RNA, 15 nt, Yersinia pestis KIM
gauuaccaauaauua

SEQ ID NO: 2320654 - RNA, 19 nt, Yersinia pestis KIM
gauucagaaagguaugugc

SEQ ID NO: 2320655 - RNA, 18 nt, Yersinia pestis KIM
gauucaccgauagcccau

SEQ ID NO: 2320656 - RNA, 13 nt, Yersinia pestis KIM
gauucacaggcga

SEQ ID NO: 2320657 - RNA, 14 nt, Yersinia pestis KIM
gauucacaggcgag

SEQ ID NO: 2320658 - RNA, 20 nt, Yersinia pestis KIM
gauucacaggcgaguuggcu

SEQ ID NO: 2320659 - RNA, 19 nt, Yersinia pestis KIM
gauuagcuggcuguuggua

SEQ ID NO: 2320660 - RNA, 16 nt, Yersinia pestis KIM
gauuagccauaagaua

SEQ ID NO: 2320661 - RNA, 23 nt, Yersinia pestis KIM
gauucaaacaaggccaccacggg

SEQ ID NO: 2320662 - RNA, 18 nt, Yersinia pestis KIM
gauuauuuuguuuguaaa

SEQ ID NO: 2320663 - RNA, 21 nt, Yersinia pestis KIM
gauuauuuuguuuguaaauuu

SEQ ID NO: 2320664 - RNA, 18 nt, Yersinia pestis KIM
gauuccgguacugugcug

SEQ ID NO: 2320665 - RNA, 20 nt, Yersinia pestis KIM
gauuccaucagcgcacugca

SEQ ID NO: 2320666 - RNA, 14 nt, Yersinia pestis KIM
gauucguagaaaca

SEQ ID NO: 2320667 - RNA, 19 nt, Yersinia pestis KIM
gauucguagaaacaucgcc

SEQ ID NO: 2320668 - RNA, 16 nt, Yersinia pestis KIM
gauucgggugagugag

SEQ ID NO: 2320669 - RNA, 16 nt, Yersinia pestis KIM
gauucgggugagugaa

SEQ ID NO: 2320670 - RNA, 14 nt, Yersinia pestis KIM
gauucgucugccau

SEQ ID NO: 2320671 - RNA, 19 nt, Yersinia pestis KIM
gauucgcaaagcgggccag

SEQ ID NO: 2320672 - RNA, 13 nt, Yersinia pestis KIM
gauucuccacuga

SEQ ID NO: 2320673 - RNA, 15 nt, Yersinia pestis KIM
gauugcaaauccguc

SEQ ID NO: 2320674 - RNA, 20 nt, Yersinia pestis KIM
gauugcaacaacgccagaua

SEQ ID NO: 2320675 - RNA, 18 nt, Yersinia pestis KIM
gauuucaucauucaauac

SEQ ID NO: 2320676 - RNA, 23 nt, Yersinia pestis KIM
gauuuaucggcgguguaauaaga

SEQ ID NO: 2320677 - RNA, 14 nt, Yersinia pestis KIM
gauuucaucauuca

SEQ ID NO: 2320678 - RNA, 17 nt, Yersinia pestis KIM
gauuuauaaauaauuau

SEQ ID NO: 2320679 - RNA, 19 nt, Yersinia pestis KIM
gauuuacguuuuuuuaaau

SEQ ID NO: 2320680 - RNA, 17 nt, Yersinia pestis KIM
gauuuaauguucauuca

SEQ ID NO: 2320681 - RNA, 19 nt, Yersinia pestis KIM
gauugguacgggugugcug

SEQ ID NO: 2320682 - RNA, 22 nt, Yersinia pestis KIM
gauugccgcaaggccauagaau

SEQ ID NO: 2320683 - RNA, 20 nt, Yersinia pestis KIM
gcaaaaaaauccccggacca

SEQ ID NO: 2320684 - RNA, 21 nt, Yersinia pestis KIM
gcaaaacagauauuugcugcc

SEQ ID NO: 2320685 - RNA, 17 nt, Yersinia pestis KIM
gcaaaacacucagauca

SEQ ID NO: 2320686 - RNA, 19 nt, Yersinia pestis KIM
gauuugcgggcuaaaacug

SEQ ID NO: 2320687 - RNA, 14 nt, Yersinia pestis KIM
gauuuguggauaac

SEQ ID NO: 2320688 - RNA, 15 nt, Yersinia pestis KIM
gauuuguuaaaacag

SEQ ID NO: 2320689 - RNA, 16 nt, Yersinia pestis KIM
gauuuguuaaaacagu

SEQ ID NO: 2320690 - RNA, 19 nt, Yersinia pestis KIM
gauuucaucggcaaaaaca

SEQ ID NO: 2320691 - RNA, 17 nt, Yersinia pestis KIM
gagauccuccauauccu

SEQ ID NO: 2320692 - RNA, 17 nt, Yersinia pestis KIM
gagaucaguucaguauu

SEQ ID NO: 2320693 - RNA, 24 nt, Yersinia pestis KIM
gagaucaucgggcauucacugcua

SEQ ID NO: 2320694 - RNA, 20 nt, Yersinia pestis KIM
gagauauuugucgcauuuau

SEQ ID NO: 2320695 - RNA, 16 nt, Yersinia pestis KIM
gagauauaaacuaaua

SEQ ID NO: 2320696 - RNA, 19 nt, Yersinia pestis KIM
gagauaacgcugauguagg

SEQ ID NO: 2320697 - RNA, 21 nt, Yersinia pestis KIM
gagauaaaaaggggcuacuga

SEQ ID NO: 2320698 - RNA, 17 nt, Yersinia pestis KIM
gagagugauuauucugc

SEQ ID NO: 2320699 - RNA, 20 nt, Yersinia pestis KIM
gagagucuauuauauucaau

SEQ ID NO: 2320700 - RNA, 12 nt, Yersinia pestis KIM
gagauucugggg

SEQ ID NO: 2320701 - RNA, 13 nt, Yersinia pestis KIM
gagauugcuacug

SEQ ID NO: 2320702 - RNA, 14 nt, Yersinia pestis KIM
gagauguauccaag

SEQ ID NO: 2320703 - RNA, 20 nt, Yersinia pestis KIM
gagauuauugggcugccugu

SEQ ID NO: 2320704 - RNA, 15 nt, Yersinia pestis KIM
gagaucguaggcuuu

SEQ ID NO: 2320705 - RNA, 13 nt, Yersinia pestis KIM
gagcaaucaaaag

SEQ ID NO: 2320706 - RNA, 15 nt, Yersinia pestis KIM
gagcaccaaaucuuc

SEQ ID NO: 2320707 - RNA, 18 nt, Yersinia pestis KIM
gagcaccaaaucuuccag

SEQ ID NO: 2320708 - RNA, 18 nt, Yersinia pestis KIM
gagcaaaacugggcuuga

SEQ ID NO: 2320709 - RNA, 17 nt, Yersinia pestis KIM
gagauuucagacugcug

SEQ ID NO: 2320710 - RNA, 15 nt, Yersinia pestis KIM
gagcaaaaagccagc

SEQ ID NO: 2320711 - RNA, 16 nt, Yersinia pestis KIM
gagcacgauuaccauu

SEQ ID NO: 2320712 - RNA, 22 nt, Yersinia pestis KIM
gagcagaaagcagcagcuuuug

SEQ ID NO: 2320713 - RNA, 12 nt, Yersinia pestis KIM
gagcacugcccc

SEQ ID NO: 2320714 - RNA, 21 nt, Yersinia pestis KIM
gagcacugccccgaagcucaa

SEQ ID NO: 2320715 - RNA, 12 nt, Yersinia pestis KIM
gagcagaccgac

SEQ ID NO: 2320716 - RNA, 18 nt, Yersinia pestis KIM
gagcauuuuguuacccac

SEQ ID NO: 2320717 - RNA, 19 nt, Yersinia pestis KIM
gagcauuuuagugaugaua

SEQ ID NO: 2320718 - RNA, 19 nt, Yersinia pestis KIM
gagccacaacgcacugaag

SEQ ID NO: 2320719 - RNA, 12 nt, Yersinia pestis KIM
gagccacacauu

SEQ ID NO: 2320720 - RNA, 21 nt, Yersinia pestis KIM
gagcauaacugguggcaggcc

SEQ ID NO: 2320721 - RNA, 19 nt, Yersinia pestis KIM
gagcagccaacacaccugc

SEQ ID NO: 2320722 - RNA, 19 nt, Yersinia pestis KIM
gagccauugauuggcuccu

SEQ ID NO: 2320723 - RNA, 14 nt, Yersinia pestis KIM
gagcccccagggaa

SEQ ID NO: 2320724 - RNA, 15 nt, Yersinia pestis KIM
gagccauccaggcaa

SEQ ID NO: 2320725 - RNA, 16 nt, Yersinia pestis KIM
gagccauccaggcaag

SEQ ID NO: 2320726 - RNA, 21 nt, Yersinia pestis KIM
gaggaaggcgguuaucuggaa

SEQ ID NO: 2320727 - RNA, 19 nt, Yersinia pestis KIM
gaggaaaacgccagcagac

SEQ ID NO: 2320728 - RNA, 13 nt, Yersinia pestis KIM
gaggaaacugccg

SEQ ID NO: 2320729 - RNA, 12 nt, Yersinia pestis KIM
gaggaaauaaau

SEQ ID NO: 2320730 - RNA, 21 nt, Yersinia pestis KIM
gaggacuuccugcccagcggc

SEQ ID NO: 2320731 - RNA, 15 nt, Yersinia pestis KIM
gaggacagguggguu

SEQ ID NO: 2320732 - RNA, 14 nt, Yersinia pestis KIM
gaggacuauucaau

SEQ ID NO: 2320733 - RNA, 14 nt, Yersinia pestis KIM
gagcuuauaucaau

SEQ ID NO: 2320734 - RNA, 16 nt, Yersinia pestis KIM
gagcuugcuggcggcg

SEQ ID NO: 2320735 - RNA, 17 nt, Yersinia pestis KIM
gagcuucuucaaaagca

SEQ ID NO: 2320736 - RNA, 17 nt, Yersinia pestis KIM
gagcuuugcuagugaac

SEQ ID NO: 2320737 - RNA, 19 nt, Yersinia pestis KIM
gaggcgcuacugcuuuuua

SEQ ID NO: 2320738 - RNA, 13 nt, Yersinia pestis KIM
gaggccaaaugaa

SEQ ID NO: 2320739 - RNA, 22 nt, Yersinia pestis KIM
gaggcaucaagggcggggucaa

SEQ ID NO: 2320740 - RNA, 13 nt, Yersinia pestis KIM
gaggccaggacuu

SEQ ID NO: 2320741 - RNA, 14 nt, Yersinia pestis KIM
gaggccagcggcau

SEQ ID NO: 2320742 - RNA, 14 nt, Yersinia pestis KIM
gaggcacccgagca

SEQ ID NO: 2320743 - RNA, 23 nt, Yersinia pestis KIM
gaggcacuuguuuugccaguuuc

SEQ ID NO: 2320744 - RNA, 19 nt, Yersinia pestis KIM
gaggauauuagggcugaca

SEQ ID NO: 2320745 - RNA, 14 nt, Yersinia pestis KIM
gaggauaggcagag

SEQ ID NO: 2320746 - RNA, 12 nt, Yersinia pestis KIM
gaggaucaccac

SEQ ID NO: 2320747 - RNA, 13 nt, Yersinia pestis KIM
gagcgucaagcca

SEQ ID NO: 2320748 - RNA, 17 nt, Yersinia pestis KIM
gagcugaacugagguga

SEQ ID NO: 2320749 - RNA, 21 nt, Yersinia pestis KIM
gagcucucacugcuccagcca

SEQ ID NO: 2320750 - RNA, 21 nt, Yersinia pestis KIM
gagccuacauggauguauuua

SEQ ID NO: 2320751 - RNA, 21 nt, Yersinia pestis KIM
gagccguuagauuuaaaggca

SEQ ID NO: 2320752 - RNA, 16 nt, Yersinia pestis KIM
gagccuguccauaauu

SEQ ID NO: 2320753 - RNA, 20 nt, Yersinia pestis KIM
gagcgauaacauuuuuucuu

SEQ ID NO: 2320754 - RNA, 21 nt, Yersinia pestis KIM
gagcgacuuaauggucuucuu

SEQ ID NO: 2320755 - RNA, 19 nt, Yersinia pestis KIM
gagcgacucaauaauaugg

SEQ ID NO: 2320756 - RNA, 17 nt, Yersinia pestis KIM
gacgugaugccaguaau

SEQ ID NO: 2320757 - RNA, 20 nt, Yersinia pestis KIM
gacgugugcuguaagaaaaa

SEQ ID NO: 2320758 - RNA, 13 nt, Yersinia pestis KIM
gacgucauagaau

SEQ ID NO: 2320759 - RNA, 13 nt, Yersinia pestis KIM
gacguugcagggg

SEQ ID NO: 2320760 - RNA, 21 nt, Yersinia pestis KIM
gacguugcaggggguuagcug

SEQ ID NO: 2320761 - RNA, 16 nt, Yersinia pestis KIM
gacguuaucaauacug

SEQ ID NO: 2320762 - RNA, 19 nt, Yersinia pestis KIM
gacguuaucaauacugcaa

SEQ ID NO: 2320763 - RNA, 21 nt, Yersinia pestis KIM
gacgugugcuguaagaaaaag

SEQ ID NO: 2320764 - RNA, 18 nt, Yersinia pestis KIM
gacuaaaaaccgccacag

SEQ ID NO: 2320765 - RNA, 17 nt, Yersinia pestis KIM
gacuaaacugaucauca

SEQ ID NO: 2320766 - RNA, 16 nt, Yersinia pestis KIM
gacuaaacgcccagcu

SEQ ID NO: 2320767 - RNA, 10 nt, Yersinia pestis KIM
gacuaacucu

SEQ ID NO: 2320768 - RNA, 19 nt, Yersinia pestis KIM
gacggcggcgagcacugcc

SEQ ID NO: 2320769 - RNA, 20 nt, Yersinia pestis KIM
gacgggacaaucuguuccug

SEQ ID NO: 2320770 - RNA, 23 nt, Yersinia pestis KIM
gacggcuucuguaauaaaggcug

SEQ ID NO: 2320771 - RNA, 19 nt, Yersinia pestis KIM
gacguaauuuuaagccgca

SEQ ID NO: 2320772 - RNA, 15 nt, Yersinia pestis KIM
gacgguauuuaggcg

SEQ ID NO: 2320773 - RNA, 21 nt, Yersinia pestis KIM
gacucgaugacaggggauagc

SEQ ID NO: 2320774 - RNA, 14 nt, Yersinia pestis KIM
gacucacgucagua

SEQ ID NO: 2320775 - RNA, 15 nt, Yersinia pestis KIM
gacucauuaaaucca

SEQ ID NO: 2320776 - RNA, 22 nt, Yersinia pestis KIM
gacucauuaaauccaauauucc

SEQ ID NO: 2320777 - RNA, 23 nt, Yersinia pestis KIM
gacucauuaaauccaauauuccc

SEQ ID NO: 2320778 - RNA, 21 nt, Yersinia pestis KIM
gacuaauugugcagcaucacc

SEQ ID NO: 2320779 - RNA, 20 nt, Yersinia pestis KIM
gacuauagauacccacuuua

SEQ ID NO: 2320780 - RNA, 23 nt, Yersinia pestis KIM
gacuauucugccuauccucaccg

SEQ ID NO: 2320781 - RNA, 22 nt, Yersinia pestis KIM
gacuaucucuuccugggccagu

SEQ ID NO: 2320782 - RNA, 14 nt, Yersinia pestis KIM
gacucaagccucua

SEQ ID NO: 2320783 - RNA, 12 nt, Yersinia pestis KIM
gacucaagccuc

SEQ ID NO: 2320784 - RNA, 16 nt, Yersinia pestis KIM
gacucaauaauauggg

SEQ ID NO: 2320785 - RNA, 14 nt, Yersinia pestis KIM
gacugcucuuuccc

SEQ ID NO: 2320786 - RNA, 19 nt, Yersinia pestis KIM
gacugcauuaccuuuaaaa

SEQ ID NO: 2320787 - RNA, 21 nt, Yersinia pestis KIM
gacugcauuaccuuuaaaacu

SEQ ID NO: 2320788 - RNA, 18 nt, Yersinia pestis KIM
gacugcauucacauagcc

SEQ ID NO: 2320789 - RNA, 18 nt, Yersinia pestis KIM
gacugauagcaaacaaac

SEQ ID NO: 2320790 - RNA, 15 nt, Yersinia pestis KIM
gacugagauuauuau

SEQ ID NO: 2320791 - RNA, 16 nt, Yersinia pestis KIM
gacugaccauaaaagg

SEQ ID NO: 2320792 - RNA, 19 nt, Yersinia pestis KIM
gacucugcuaccaggaagc

SEQ ID NO: 2320793 - RNA, 21 nt, Yersinia pestis KIM
gacucugcgcucauacucagu

SEQ ID NO: 2320794 - RNA, 17 nt, Yersinia pestis KIM
gacucuccgggcauaaa

SEQ ID NO: 2320795 - RNA, 17 nt, Yersinia pestis KIM
gagaauauagagccguu

SEQ ID NO: 2320796 - RNA, 20 nt, Yersinia pestis KIM
gagaaucucuccagugcaaa

SEQ ID NO: 2320797 - RNA, 14 nt, Yersinia pestis KIM
gagaaucaaucaau

SEQ ID NO: 2320798 - RNA, 16 nt, Yersinia pestis KIM
gagaccacagauaaau

SEQ ID NO: 2320799 - RNA, 15 nt, Yersinia pestis KIM
gagacaggauaagca

SEQ ID NO: 2320800 - RNA, 16 nt, Yersinia pestis KIM
gagagaggccagacac

SEQ ID NO: 2320801 - RNA, 22 nt, Yersinia pestis KIM
gagagaggccagacacaaugcu

SEQ ID NO: 2320802 - RNA, 22 nt, Yersinia pestis KIM
gagaggcugaaggcgcuccccu

SEQ ID NO: 2320803 - RNA, 14 nt, Yersinia pestis KIM
gagaggagauuaga

SEQ ID NO: 2320804 - RNA, 20 nt, Yersinia pestis KIM
gagacggaaagagccagcac

SEQ ID NO: 2320805 - RNA, 17 nt, Yersinia pestis KIM
gagacuucgguauggcg

SEQ ID NO: 2320806 - RNA, 13 nt, Yersinia pestis KIM
gagagaacaggca

SEQ ID NO: 2320807 - RNA, 16 nt, Yersinia pestis KIM
gagacuccucuucuuc

SEQ ID NO: 2320808 - RNA, 17 nt, Yersinia pestis KIM
gagacgugcguuuuuga

SEQ ID NO: 2320809 - RNA, 13 nt, Yersinia pestis KIM
gagaacaggcaga

SEQ ID NO: 2320810 - RNA, 19 nt, Yersinia pestis KIM
gagaaaggcgcgggcgauc

SEQ ID NO: 2320811 - RNA, 15 nt, Yersinia pestis KIM
gagaaacaaaaccaa

SEQ ID NO: 2320812 - RNA, 16 nt, Yersinia pestis KIM
gagaaacccauagcaa

SEQ ID NO: 2320813 - RNA, 18 nt, Yersinia pestis KIM
gacuuuauguacauccaa

SEQ ID NO: 2320814 - RNA, 14 nt, Yersinia pestis KIM
gacuugggcuucca

SEQ ID NO: 2320815 - RNA, 21 nt, Yersinia pestis KIM
gacuugaacuucgaaagaaau

SEQ ID NO: 2320816 - RNA, 23 nt, Yersinia pestis KIM
gacuucacucgcgacuacagaaa

SEQ ID NO: 2320817 - RNA, 18 nt, Yersinia pestis KIM
gacuuccugcccagcggc

SEQ ID NO: 2320818 - RNA, 19 nt, Yersinia pestis KIM
gacuggucacucgaugacg

SEQ ID NO: 2320819 - RNA, 19 nt, Yersinia pestis KIM
gacuguaaauauucugacg

SEQ ID NO: 2320820 - RNA, 13 nt, Yersinia pestis KIM
gacugguugcugg

SEQ ID NO: 2320821 - RNA, 14 nt, Yersinia pestis KIM
gacugguugcuggu

SEQ ID NO: 2320822 - RNA, 22 nt, Yersinia pestis KIM
gacuguuuugcuaacugugcca

SEQ ID NO: 2320823 - RNA, 13 nt, Yersinia pestis KIM
gacuguuuugcua

SEQ ID NO: 2320824 - RNA, 15 nt, Yersinia pestis KIM
gacuguugaaguaca

SEQ ID NO: 2320825 - RNA, 16 nt, Yersinia pestis KIM
gacuuacccuacccau

SEQ ID NO: 2320826 - RNA, 15 nt, Yersinia pestis KIM
gacugucuucaacuu

SEQ ID NO: 2320827 - RNA, 13 nt, Yersinia pestis KIM
gaccagugagcca

SEQ ID NO: 2320828 - RNA, 14 nt, Yersinia pestis KIM
gaccagugcaccca

SEQ ID NO: 2320829 - RNA, 17 nt, Yersinia pestis KIM
gaccaguggugcucccg

SEQ ID NO: 2320830 - RNA, 19 nt, Yersinia pestis KIM
gaccaguggugcucccgca

SEQ ID NO: 2320831 - RNA, 13 nt, Yersinia pestis KIM
gaccaguaaguga

SEQ ID NO: 2320832 - RNA, 15 nt, Yersinia pestis KIM
gaccaguaagugauu

SEQ ID NO: 2320833 - RNA, 17 nt, Yersinia pestis KIM
gaccagauaaucgccaa

SEQ ID NO: 2320834 - RNA, 18 nt, Yersinia pestis KIM
gaccagcgccgauauaca

SEQ ID NO: 2320835 - RNA, 21 nt, Yersinia pestis KIM
gaccaaauggacgaacagccc

SEQ ID NO: 2320836 - RNA, 13 nt, Yersinia pestis KIM
gaccaaauucccc

SEQ ID NO: 2320837 - RNA, 17 nt, Yersinia pestis KIM
gaccaaaggcuauuuaa

SEQ ID NO: 2320838 - RNA, 16 nt, Yersinia pestis KIM
gaccaaauagcaagcc

SEQ ID NO: 2320839 - RNA, 12 nt, Yersinia pestis KIM
gacauuuuucua

SEQ ID NO: 2320840 - RNA, 22 nt, Yersinia pestis KIM
gacauuuuuuagcccuaacugc

SEQ ID NO: 2320841 - RNA, 18 nt, Yersinia pestis KIM
gaccaaaacccaucagac

SEQ ID NO: 2320842 - RNA, 13 nt, Yersinia pestis KIM
gaccaaacagaau

SEQ ID NO: 2320843 - RNA, 14 nt, Yersinia pestis KIM
gaccaaacauuguc

SEQ ID NO: 2320844 - RNA, 15 nt, Yersinia pestis KIM
gaccaaccuguuuca

SEQ ID NO: 2320845 - RNA, 16 nt, Yersinia pestis KIM
gaccaauuucaauaau

SEQ ID NO: 2320846 - RNA, 21 nt, Yersinia pestis KIM
gaccaauacuacggcagaaac

SEQ ID NO: 2320847 - RNA, 11 nt, Yersinia pestis KIM
gaccaccaacu

SEQ ID NO: 2320848 - RNA, 21 nt, Yersinia pestis KIM
gaccacagauaaauaaaauaa

SEQ ID NO: 2320849 - RNA, 14 nt, Yersinia pestis KIM
gaccaccacugcau

SEQ ID NO: 2320850 - RNA, 17 nt, Yersinia pestis KIM
gaccacgcaucaauaau

SEQ ID NO: 2320851 - RNA, 21 nt, Yersinia pestis KIM
gaccagacaacagucacacca

SEQ ID NO: 2320852 - RNA, 21 nt, Yersinia pestis KIM
gaccacuuuuuguguuuuggc

SEQ ID NO: 2320853 - RNA, 16 nt, Yersinia pestis KIM
gaccacugacaaaaac

SEQ ID NO: 2320854 - RNA, 20 nt, Yersinia pestis KIM
gaccacuugcugaugcccau

SEQ ID NO: 2320855 - RNA, 16 nt, Yersinia pestis KIM
gacaguauuugcagug

SEQ ID NO: 2320856 - RNA, 17 nt, Yersinia pestis KIM
gacaguaaguugaugac

SEQ ID NO: 2320857 - RNA, 22 nt, Yersinia pestis KIM
gacaguagugaguuaacgagug

SEQ ID NO: 2320858 - RNA, 14 nt, Yersinia pestis KIM
gacaguaacuaaag

SEQ ID NO: 2320859 - RNA, 18 nt, Yersinia pestis KIM
gacaggcaauuauccauc

SEQ ID NO: 2320860 - RNA, 14 nt, Yersinia pestis KIM
gacaggcuccuccu

SEQ ID NO: 2320861 - RNA, 16 nt, Yersinia pestis KIM
gacaggcucagcacaa

SEQ ID NO: 2320862 - RNA, 20 nt, Yersinia pestis KIM
gacauagccggagguuuuuc

SEQ ID NO: 2320863 - RNA, 16 nt, Yersinia pestis KIM
gacauauucaaccgcc

SEQ ID NO: 2320864 - RNA, 20 nt, Yersinia pestis KIM
gacauaucuugaaccaauuu

SEQ ID NO: 2320865 - RNA, 22 nt, Yersinia pestis KIM
gacauaagaugaccaccaauuu

SEQ ID NO: 2320866 - RNA, 18 nt, Yersinia pestis KIM
gacauaagaugaccacca

SEQ ID NO: 2320867 - RNA, 21 nt, Yersinia pestis KIM
gacaugcaccguaacuucuuc

SEQ ID NO: 2320868 - RNA, 12 nt, Yersinia pestis KIM
gacauccaauuc

SEQ ID NO: 2320869 - RNA, 19 nt, Yersinia pestis KIM
gacaucagguuguauuuug

SEQ ID NO: 2320870 - RNA, 21 nt, Yersinia pestis KIM
gacauccaccauuuggggugu

SEQ ID NO: 2320871 - RNA, 14 nt, Yersinia pestis KIM
gacaucgccagauu

SEQ ID NO: 2320872 - RNA, 15 nt, Yersinia pestis KIM
gacaucgccagauuc

SEQ ID NO: 2320873 - RNA, 19 nt, Yersinia pestis KIM
gacaucgacggcagugacg

SEQ ID NO: 2320874 - RNA, 16 nt, Yersinia pestis KIM
gacauuuuacucccug

SEQ ID NO: 2320875 - RNA, 14 nt, Yersinia pestis KIM
gacauuucggccac

SEQ ID NO: 2320876 - RNA, 17 nt, Yersinia pestis KIM
gacauuuagcacuguuc

SEQ ID NO: 2320877 - RNA, 21 nt, Yersinia pestis KIM
gacauucaaauacggcaccaa

SEQ ID NO: 2320878 - RNA, 19 nt, Yersinia pestis KIM
gacaugggcagugcacagu

SEQ ID NO: 2320879 - RNA, 23 nt, Yersinia pestis KIM
gacauguuccagugcuuuaucca

SEQ ID NO: 2320880 - RNA, 18 nt, Yersinia pestis KIM
gacauguugcccuuaguu

SEQ ID NO: 2320881 - RNA, 20 nt, Yersinia pestis KIM
gacaugugagugguguaaga

SEQ ID NO: 2320882 - RNA, 17 nt, Yersinia pestis KIM
gacaugugaguggugua

SEQ ID NO: 2320883 - RNA, 13 nt, Yersinia pestis KIM
gacauuauguucu

SEQ ID NO: 2320884 - RNA, 15 nt, Yersinia pestis KIM
gacacgaucauuaua

SEQ ID NO: 2320885 - RNA, 14 nt, Yersinia pestis KIM
gacacuaaccagac

SEQ ID NO: 2320886 - RNA, 14 nt, Yersinia pestis KIM
gacacgcucaucca

SEQ ID NO: 2320887 - RNA, 17 nt, Yersinia pestis KIM
gacaccaagacugaagu

SEQ ID NO: 2320888 - RNA, 18 nt, Yersinia pestis KIM
gacacccguuccuucagc

SEQ ID NO: 2320889 - RNA, 22 nt, Yersinia pestis KIM
gacacccguuccuucagccacc

SEQ ID NO: 2320890 - RNA, 16 nt, Yersinia pestis KIM
gacacccucagaggcc

SEQ ID NO: 2320891 - RNA, 22 nt, Yersinia pestis KIM
gacacaauucccguuagguuca

SEQ ID NO: 2320892 - RNA, 18 nt, Yersinia pestis KIM
gacacaaaugcugugcca

SEQ ID NO: 2320893 - RNA, 18 nt, Yersinia pestis KIM
gacaauuuccccugcuuc

SEQ ID NO: 2320894 - RNA, 15 nt, Yersinia pestis KIM
gacacauaaguguau

SEQ ID NO: 2320895 - RNA, 17 nt, Yersinia pestis KIM
gacaggauaagcagggc

SEQ ID NO: 2320896 - RNA, 23 nt, Yersinia pestis KIM
gacagcuaucuugaaacaaccca

SEQ ID NO: 2320897 - RNA, 12 nt, Yersinia pestis KIM
gacagcgcgcag

SEQ ID NO: 2320898 - RNA, 22 nt, Yersinia pestis KIM
gacagcauacauccuaaauaau

SEQ ID NO: 2320899 - RNA, 22 nt, Yersinia pestis KIM
gacagcaucugcaauggcuggc

SEQ ID NO: 2320900 - RNA, 20 nt, Yersinia pestis KIM
gacacuuugguuugcagcga

SEQ ID NO: 2320901 - RNA, 15 nt, Yersinia pestis KIM
gacacuuuugucgcu

SEQ ID NO: 2320902 - RNA, 16 nt, Yersinia pestis KIM
gacagaacugauuuca

SEQ ID NO: 2320903 - RNA, 19 nt, Yersinia pestis KIM
gacagcaaccacuucaacg

SEQ ID NO: 2320904 - RNA, 20 nt, Yersinia pestis KIM
gacagauuauuucagcuuca

SEQ ID NO: 2320905 - RNA, 20 nt, Yersinia pestis KIM
gacaagcgcaguagcggcuc

SEQ ID NO: 2320906 - RNA, 17 nt, Yersinia pestis KIM
gacaacgucacuuccau

SEQ ID NO: 2320907 - RNA, 16 nt, Yersinia pestis KIM
gacaacucuucuaucu

SEQ ID NO: 2320908 - RNA, 16 nt, Yersinia pestis KIM
gacaacgucacuucca

SEQ ID NO: 2320909 - RNA, 21 nt, Yersinia pestis KIM
gacaacccgcuacugaauaag

SEQ ID NO: 2320910 - RNA, 23 nt, Yersinia pestis KIM
gacaauaacggaaaaucaucgcu

SEQ ID NO: 2320911 - RNA, 22 nt, Yersinia pestis KIM
gacaagucaugguacaacugcg

SEQ ID NO: 2320912 - RNA, 15 nt, Yersinia pestis KIM
gacaauauaauaaug

SEQ ID NO: 2320913 - RNA, 11 nt, Yersinia pestis KIM
gacaauauccg

SEQ ID NO: 2320914 - RNA, 18 nt, Yersinia pestis KIM
gacaaugccaucccccuu

SEQ ID NO: 2320915 - RNA, 21 nt, Yersinia pestis KIM
gacaauuauagccaaaucugg

SEQ ID NO: 2320916 - RNA, 15 nt, Yersinia pestis KIM
gacaauuuacaccca

SEQ ID NO: 2320917 - RNA, 18 nt, Yersinia pestis KIM
gacaauugagucgcucuu

SEQ ID NO: 2320918 - RNA, 12 nt, Yersinia pestis KIM
gaauuuuuauaa

SEQ ID NO: 2320919 - RNA, 15 nt, Yersinia pestis KIM
cuuuggugaucauga

SEQ ID NO: 2320920 - RNA, 18 nt, Yersinia pestis KIM
cuuugguugccagauaau

SEQ ID NO: 2320921 - RNA, 18 nt, Yersinia pestis KIM
cuuuggguauaugacugu

SEQ ID NO: 2320922 - RNA, 19 nt, Yersinia pestis KIM
cuuugggucaguuauaaaa

SEQ ID NO: 2320923 - RNA, 13 nt, Yersinia pestis KIM
gaauuuuagucaa

SEQ ID NO: 2320924 - RNA, 16 nt, Yersinia pestis KIM
gaauuuuauucagcaa

SEQ ID NO: 2320925 - RNA, 13 nt, Yersinia pestis KIM
gacaaacagauac

SEQ ID NO: 2320926 - RNA, 23 nt, Yersinia pestis KIM
gacaaacaaccuaaaaaaaacaa

SEQ ID NO: 2320927 - RNA, 14 nt, Yersinia pestis KIM
gacaaaaucaguac

SEQ ID NO: 2320928 - RNA, 14 nt, Yersinia pestis KIM
gacaaagagcccgc

SEQ ID NO: 2320929 - RNA, 10 nt, Yersinia pestis KIM
gacaaauaag

SEQ ID NO: 2320930 - RNA, 18 nt, Yersinia pestis KIM
gacaaauaaaacagaacc

SEQ ID NO: 2320931 - RNA, 18 nt, Yersinia pestis KIM
gacgccguaaauacaucc

SEQ ID NO: 2320932 - RNA, 16 nt, Yersinia pestis KIM
gacgccguacaaauau

SEQ ID NO: 2320933 - RNA, 14 nt, Yersinia pestis KIM
gacgccggccgguu

SEQ ID NO: 2320934 - RNA, 14 nt, Yersinia pestis KIM
gacgcccgcagacu

SEQ ID NO: 2320935 - RNA, 21 nt, Yersinia pestis KIM
gacgcaguaaguuaguggugu

SEQ ID NO: 2320936 - RNA, 15 nt, Yersinia pestis KIM
gacgccaacuucaag

SEQ ID NO: 2320937 - RNA, 22 nt, Yersinia pestis KIM
gacgcuuuacuccucugccuau

SEQ ID NO: 2320938 - RNA, 16 nt, Yersinia pestis KIM
gacgcuugaauauagc

SEQ ID NO: 2320939 - RNA, 20 nt, Yersinia pestis KIM
gacgcuguauacggacaaug

SEQ ID NO: 2320940 - RNA, 13 nt, Yersinia pestis KIM
gacgcucucccca

SEQ ID NO: 2320941 - RNA, 22 nt, Yersinia pestis KIM
gacgcuaaccaccgucaccaaa

SEQ ID NO: 2320942 - RNA, 19 nt, Yersinia pestis KIM
gacgaugucggcaggcaac

SEQ ID NO: 2320943 - RNA, 21 nt, Yersinia pestis KIM
gacgcagcaggcguagcgugu

SEQ ID NO: 2320944 - RNA, 22 nt, Yersinia pestis KIM
gacgagucuauugaaaaaauaa

SEQ ID NO: 2320945 - RNA, 20 nt, Yersinia pestis KIM
gacgagaucauuggcuauca

SEQ ID NO: 2320946 - RNA, 22 nt, Yersinia pestis KIM
gacgacauuaauuugcaacgca

SEQ ID NO: 2320947 - RNA, 16 nt, Yersinia pestis KIM
gacgacacaaaugcug

SEQ ID NO: 2320948 - RNA, 15 nt, Yersinia pestis KIM
gacgaaagauaauuu

SEQ ID NO: 2320949 - RNA, 18 nt, Yersinia pestis KIM
gacgaaaaccuaauacuu

SEQ ID NO: 2320950 - RNA, 15 nt, Yersinia pestis KIM
gaccuuccauaacuc

SEQ ID NO: 2320951 - RNA, 20 nt, Yersinia pestis KIM
gaccauaaaaggauggccca

SEQ ID NO: 2320952 - RNA, 14 nt, Yersinia pestis KIM
gaccauaaaaggau

SEQ ID NO: 2320953 - RNA, 17 nt, Yersinia pestis KIM
gaccauaaaaggauggc

SEQ ID NO: 2320954 - RNA, 12 nt, Yersinia pestis KIM
gaccaucugcuu

SEQ ID NO: 2320955 - RNA, 16 nt, Yersinia pestis KIM
gaccauggcgaugcgu

SEQ ID NO: 2320956 - RNA, 14 nt, Yersinia pestis KIM
gacccacaucggcc

SEQ ID NO: 2320957 - RNA, 14 nt, Yersinia pestis KIM
gacccauuauauag

SEQ ID NO: 2320958 - RNA, 23 nt, Yersinia pestis KIM
gaccgccaaauccaagccaccac

SEQ ID NO: 2320959 - RNA, 12 nt, Yersinia pestis KIM
gaccgagaagcu

SEQ ID NO: 2320960 - RNA, 24 nt, Yersinia pestis KIM
gaccgagaagcuucaacuuaauuu

SEQ ID NO: 2320961 - RNA, 16 nt, Yersinia pestis KIM
gacccggcaaauaaau

SEQ ID NO: 2320962 - RNA, 19 nt, Yersinia pestis KIM
gacccggcaaauaaauacc

SEQ ID NO: 2320963 - RNA, 14 nt, Yersinia pestis KIM
gacccguuuauaaa

SEQ ID NO: 2320964 - RNA, 23 nt, Yersinia pestis KIM
gaccgcuaacaugguaugccacu

SEQ ID NO: 2320965 - RNA, 20 nt, Yersinia pestis KIM
gaccgcuguuugauuaaaac

SEQ ID NO: 2320966 - RNA, 13 nt, Yersinia pestis KIM
gaccguaccuauc

SEQ ID NO: 2320967 - RNA, 13 nt, Yersinia pestis KIM
gaccgucaccaaa

SEQ ID NO: 2320968 - RNA, 12 nt, Yersinia pestis KIM
gaccggccgcuu

SEQ ID NO: 2320969 - RNA, 20 nt, Yersinia pestis KIM
gaccuaaaccgcucucaccu

SEQ ID NO: 2320970 - RNA, 21 nt, Yersinia pestis KIM
gaccuuaucaucacugaaagu

SEQ ID NO: 2320971 - RNA, 14 nt, Yersinia pestis KIM
gaccuuagauaaau

SEQ ID NO: 2320972 - RNA, 22 nt, Yersinia pestis KIM
gaccugacguucuuguaaccac

SEQ ID NO: 2320973 - RNA, 14 nt, Yersinia pestis KIM
gaccugcugcaccu

SEQ ID NO: 2320974 - RNA, 20 nt, Yersinia pestis KIM
cguucuaucaaugccuuggc

SEQ ID NO: 2320975 - RNA, 16 nt, Yersinia pestis KIM
cguucguuuacugccu

SEQ ID NO: 2320976 - RNA, 18 nt, Yersinia pestis KIM
cguucguuuacugccuug

SEQ ID NO: 2320977 - RNA, 15 nt, Yersinia pestis KIM
cguugcacccugcuu

SEQ ID NO: 2320978 - RNA, 21 nt, Yersinia pestis KIM
cguugcaggggguuagcugca

SEQ ID NO: 2320979 - RNA, 13 nt, Yersinia pestis KIM
cguugcaggucaa

SEQ ID NO: 2320980 - RNA, 15 nt, Yersinia pestis KIM
cguuccuuggcugcc

SEQ ID NO: 2320981 - RNA, 22 nt, Yersinia pestis KIM
cgucauuaugcauuucguucca

SEQ ID NO: 2320982 - RNA, 15 nt, Yersinia pestis KIM
cgucauucuuugcca

SEQ ID NO: 2320983 - RNA, 16 nt, Yersinia pestis KIM
cguuauacuucaagcu

SEQ ID NO: 2320984 - RNA, 22 nt, Yersinia pestis KIM
cuaaagcggaauuugccucugc

SEQ ID NO: 2320985 - RNA, 22 nt, Yersinia pestis KIM
cuaaagcgccuuccuuuuauuu

SEQ ID NO: 2320986 - RNA, 14 nt, Yersinia pestis KIM
cuaaagcugucagu

SEQ ID NO: 2320987 - RNA, 16 nt, Yersinia pestis KIM
cuaaacugaucaucaa

SEQ ID NO: 2320988 - RNA, 16 nt, Yersinia pestis KIM
cuaaacagggcagaaa

SEQ ID NO: 2320989 - RNA, 12 nt, Yersinia pestis KIM
cuaaacacggcg

SEQ ID NO: 2320990 - RNA, 22 nt, Yersinia pestis KIM
cuaaacggcccugugaaucuuu

SEQ ID NO: 2320991 - RNA, 19 nt, Yersinia pestis KIM
cuaaacgccgcgucaauaa

SEQ ID NO: 2320992 - RNA, 18 nt, Yersinia pestis KIM
cuaaaauucaaacaaaua

SEQ ID NO: 2320993 - RNA, 14 nt, Yersinia pestis KIM
cuaaaauuaagccg

SEQ ID NO: 2320994 - RNA, 18 nt, Yersinia pestis KIM
cguuuugcagaucaaucg

SEQ ID NO: 2320995 - RNA, 13 nt, Yersinia pestis KIM
cguuuugcaucaa

SEQ ID NO: 2320996 - RNA, 18 nt, Yersinia pestis KIM
cguuuuuaccugauuccu

SEQ ID NO: 2320997 - RNA, 14 nt, Yersinia pestis KIM
cguuguucaagcac

SEQ ID NO: 2320998 - RNA, 19 nt, Yersinia pestis KIM
cguuguauuagccgccagu

SEQ ID NO: 2320999 - RNA, 16 nt, Yersinia pestis KIM
cguuucaguaaaacca

SEQ ID NO: 2321000 - RNA, 20 nt, Yersinia pestis KIM
cguuucaguaaaaccagcag

SEQ ID NO: 2321001 - RNA, 19 nt, Yersinia pestis KIM
cguuuauacggcuauuuuu

SEQ ID NO: 2321002 - RNA, 16 nt, Yersinia pestis KIM
cuaaggccaucaauaa

SEQ ID NO: 2321003 - RNA, 15 nt, Yersinia pestis KIM
cuaaggggccaauag

SEQ ID NO: 2321004 - RNA, 18 nt, Yersinia pestis KIM
cuaaggguaaaaucccca

SEQ ID NO: 2321005 - RNA, 15 nt, Yersinia pestis KIM
cuaauaauuguucau

SEQ ID NO: 2321006 - RNA, 15 nt, Yersinia pestis KIM
cuaauaauuuauaca

SEQ ID NO: 2321007 - RNA, 22 nt, Yersinia pestis KIM
cuaauaauaauuaaucuuaaug

SEQ ID NO: 2321008 - RNA, 14 nt, Yersinia pestis KIM
cuaaguaaaacaaa

SEQ ID NO: 2321009 - RNA, 13 nt, Yersinia pestis KIM
cuaauaaaccugc

SEQ ID NO: 2321010 - RNA, 12 nt, Yersinia pestis KIM
cuaacguccccu

SEQ ID NO: 2321011 - RNA, 15 nt, Yersinia pestis KIM
cuaacgucaacagaa

SEQ ID NO: 2321012 - RNA, 21 nt, Yersinia pestis KIM
cuaacguuaaaaggcaccuca

SEQ ID NO: 2321013 - RNA, 18 nt, Yersinia pestis KIM
cuaaauccugcaaauuaa

SEQ ID NO: 2321014 - RNA, 12 nt, Yersinia pestis KIM
cuaaauacugcu

SEQ ID NO: 2321015 - RNA, 16 nt, Yersinia pestis KIM
cuaacugaugcugaca

SEQ ID NO: 2321016 - RNA, 12 nt, Yersinia pestis KIM
cuaacucuucug

SEQ ID NO: 2321017 - RNA, 17 nt, Yersinia pestis KIM
cuaagagucacagcauu

SEQ ID NO: 2321018 - RNA, 14 nt, Yersinia pestis KIM
cuaagacuguuuua

SEQ ID NO: 2321019 - RNA, 19 nt, Yersinia pestis KIM
cuaauucuccuuucuuuuc

SEQ ID NO: 2321020 - RNA, 12 nt, Yersinia pestis KIM
cuaauucuccuu

SEQ ID NO: 2321021 - RNA, 21 nt, Yersinia pestis KIM
cuaauucgugggcauuuuuug

SEQ ID NO: 2321022 - RNA, 20 nt, Yersinia pestis KIM
cuaauucuccuuucuuuucg

SEQ ID NO: 2321023 - RNA, 21 nt, Yersinia pestis KIM
cuaauucuggguacaacacaa

SEQ ID NO: 2321024 - RNA, 15 nt, Yersinia pestis KIM
cuaauucuuaggaua

SEQ ID NO: 2321025 - RNA, 13 nt, Yersinia pestis KIM
cuaauuaauuuaa

SEQ ID NO: 2321026 - RNA, 20 nt, Yersinia pestis KIM
cuaauuagugacaguagaau

SEQ ID NO: 2321027 - RNA, 16 nt, Yersinia pestis KIM
cuaaugucucuauuca

SEQ ID NO: 2321028 - RNA, 18 nt, Yersinia pestis KIM
cuaauguuuguuucucug

SEQ ID NO: 2321029 - RNA, 18 nt, Yersinia pestis KIM
cuaauggugcuauuucug

SEQ ID NO: 2321030 - RNA, 21 nt, Yersinia pestis KIM
cuaauguauuuauucaaaaaa

SEQ ID NO: 2321031 - RNA, 18 nt, Yersinia pestis KIM
cuaaugccagacacaaga

SEQ ID NO: 2321032 - RNA, 22 nt, Yersinia pestis KIM
cuaaugccgcgcccccagccau

SEQ ID NO: 2321033 - RNA, 14 nt, Yersinia pestis KIM
cuaaugaacgagua

SEQ ID NO: 2321034 - RNA, 16 nt, Yersinia pestis KIM
cuaaucuccucuccgg

SEQ ID NO: 2321035 - RNA, 12 nt, Yersinia pestis KIM
cuaauccaaggc

SEQ ID NO: 2321036 - RNA, 15 nt, Yersinia pestis KIM
cuaauaucaacagaa

SEQ ID NO: 2321037 - RNA, 16 nt, Yersinia pestis KIM
cuaauaucaacagaac

SEQ ID NO: 2321038 - RNA, 14 nt, Yersinia pestis KIM
cuaauauuuucagc

SEQ ID NO: 2321039 - RNA, 11 nt, Yersinia pestis KIM
cuacaaccugg

SEQ ID NO: 2321040 - RNA, 14 nt, Yersinia pestis KIM
cuacacacagcaau

SEQ ID NO: 2321041 - RNA, 16 nt, Yersinia pestis KIM
cuacacagucuuuuuc

SEQ ID NO: 2321042 - RNA, 15 nt, Yersinia pestis KIM
cuacaccgcuaaccu

SEQ ID NO: 2321043 - RNA, 19 nt, Yersinia pestis KIM
cuaauuuauaaccuuuuuc

SEQ ID NO: 2321044 - RNA, 19 nt, Yersinia pestis KIM
cuaccaugagugaaaauau

SEQ ID NO: 2321045 - RNA, 15 nt, Yersinia pestis KIM
cuaccaucaaaauau

SEQ ID NO: 2321046 - RNA, 22 nt, Yersinia pestis KIM
cuaccacguuuaucugacacaa

SEQ ID NO: 2321047 - RNA, 18 nt, Yersinia pestis KIM
cuacauuuugggcaauuu

SEQ ID NO: 2321048 - RNA, 16 nt, Yersinia pestis KIM
cuacauagaaaauaau

SEQ ID NO: 2321049 - RNA, 14 nt, Yersinia pestis KIM
cuacagaaaaauaa

SEQ ID NO: 2321050 - RNA, 22 nt, Yersinia pestis KIM
cuacagaaaaauaacauccaug

SEQ ID NO: 2321051 - RNA, 17 nt, Yersinia pestis KIM
cucauccagcaacucaa

SEQ ID NO: 2321052 - RNA, 19 nt, Yersinia pestis KIM
cucauccaacguaaacauu

SEQ ID NO: 2321053 - RNA, 15 nt, Yersinia pestis KIM
cucaucauaaaaaua

SEQ ID NO: 2321054 - RNA, 18 nt, Yersinia pestis KIM
cucaucaguuggucuuua

SEQ ID NO: 2321055 - RNA, 22 nt, Yersinia pestis KIM
cucaucaguaacgccugauuca

SEQ ID NO: 2321056 - RNA, 15 nt, Yersinia pestis KIM
cucaucaguaacgcc

SEQ ID NO: 2321057 - RNA, 20 nt, Yersinia pestis KIM
cucauauucaaaaucugaua

SEQ ID NO: 2321058 - RNA, 13 nt, Yersinia pestis KIM
cucaugccccaau

SEQ ID NO: 2321059 - RNA, 13 nt, Yersinia pestis KIM
cucaugaaugagg

SEQ ID NO: 2321060 - RNA, 12 nt, Yersinia pestis KIM
cucaugacaaaa

SEQ ID NO: 2321061 - RNA, 14 nt, Yersinia pestis KIM
cucaugaaugaggc

SEQ ID NO: 2321062 - RNA, 13 nt, Yersinia pestis KIM
cucauucaugagg

SEQ ID NO: 2321063 - RNA, 17 nt, Yersinia pestis KIM
cucauuauuaaacugau

SEQ ID NO: 2321064 - RNA, 14 nt, Yersinia pestis KIM
cucauucaugaggc

SEQ ID NO: 2321065 - RNA, 19 nt, Yersinia pestis KIM
cucauugccuggcccaucu

SEQ ID NO: 2321066 - RNA, 17 nt, Yersinia pestis KIM
cucauugcgucagguaa

SEQ ID NO: 2321067 - RNA, 22 nt, Yersinia pestis KIM
cuccaaagcuuccaauauugag

SEQ ID NO: 2321068 - RNA, 20 nt, Yersinia pestis KIM
cucauuuaaaauacucauuu

SEQ ID NO: 2321069 - RNA, 15 nt, Yersinia pestis KIM
cucauuuaucuaaaa

SEQ ID NO: 2321070 - RNA, 20 nt, Yersinia pestis KIM
cuccaagcacacugguugaa

SEQ ID NO: 2321071 - RNA, 13 nt, Yersinia pestis KIM
cuccaacaaccau

SEQ ID NO: 2321072 - RNA, 19 nt, Yersinia pestis KIM
cucagggcgcuuaugcccu

SEQ ID NO: 2321073 - RNA, 14 nt, Yersinia pestis KIM
cucagggagccaau

SEQ ID NO: 2321074 - RNA, 21 nt, Yersinia pestis KIM
cucagggagccaauagaggcu

SEQ ID NO: 2321075 - RNA, 13 nt, Yersinia pestis KIM
cucagggccacuu

SEQ ID NO: 2321076 - RNA, 20 nt, Yersinia pestis KIM
cucagcgggcuaaaugcucg

SEQ ID NO: 2321077 - RNA, 22 nt, Yersinia pestis KIM
cucagcgucacggaaagcaggu

SEQ ID NO: 2321078 - RNA, 18 nt, Yersinia pestis KIM
cucagcgggcuaaaugcu

SEQ ID NO: 2321079 - RNA, 19 nt, Yersinia pestis KIM
cucagcgccauauccaacu

SEQ ID NO: 2321080 - RNA, 17 nt, Yersinia pestis KIM
cucagcgacuccuggca

SEQ ID NO: 2321081 - RNA, 13 nt, Yersinia pestis KIM
cucacugucuuug

SEQ ID NO: 2321082 - RNA, 17 nt, Yersinia pestis KIM
cucacugcuccagccaa

SEQ ID NO: 2321083 - RNA, 19 nt, Yersinia pestis KIM
cucacugcuccagccaacu

SEQ ID NO: 2321084 - RNA, 13 nt, Yersinia pestis KIM
cucauauaaucau

SEQ ID NO: 2321085 - RNA, 17 nt, Yersinia pestis KIM
cucauagcccugcugcu

SEQ ID NO: 2321086 - RNA, 17 nt, Yersinia pestis KIM
cucaguuaucagggccu

SEQ ID NO: 2321087 - RNA, 21 nt, Yersinia pestis KIM
cucagugacugggggugagca

SEQ ID NO: 2321088 - RNA, 15 nt, Yersinia pestis KIM
cucaguugaugcaaa

SEQ ID NO: 2321089 - RNA, 15 nt, Yersinia pestis KIM
cucaguucagccccc

SEQ ID NO: 2321090 - RNA, 18 nt, Yersinia pestis KIM
cucacccgcuugucuuga

SEQ ID NO: 2321091 - RNA, 20 nt, Yersinia pestis KIM
cucaccgagcauauuuuuua

SEQ ID NO: 2321092 - RNA, 14 nt, Yersinia pestis KIM
cucacguauuuuca

SEQ ID NO: 2321093 - RNA, 18 nt, Yersinia pestis KIM
cucacggaagguugcccc

SEQ ID NO: 2321094 - RNA, 19 nt, Yersinia pestis KIM
cucacguuuagcccacugu

SEQ ID NO: 2321095 - RNA, 12 nt, Yersinia pestis KIM
cucacccauuuu

SEQ ID NO: 2321096 - RNA, 21 nt, Yersinia pestis KIM
cucacccauuuuauccucuuc

SEQ ID NO: 2321097 - RNA, 22 nt, Yersinia pestis KIM
cucacaacuuuuauuggcauua

SEQ ID NO: 2321098 - RNA, 17 nt, Yersinia pestis KIM
cucacacacuaauaaua

SEQ ID NO: 2321099 - RNA, 20 nt, Yersinia pestis KIM
cucaagcguacaucagggug

SEQ ID NO: 2321100 - RNA, 17 nt, Yersinia pestis KIM
cucaauagcuaauaauu

SEQ ID NO: 2321101 - RNA, 13 nt, Yersinia pestis KIM
cucaauauauucu

SEQ ID NO: 2321102 - RNA, 23 nt, Yersinia pestis KIM
cucaauaugcaguuuuccucccu

SEQ ID NO: 2321103 - RNA, 12 nt, Yersinia pestis KIM
cucaauauuaau

SEQ ID NO: 2321104 - RNA, 15 nt, Yersinia pestis KIM
cucaagccucuagga

SEQ ID NO: 2321105 - RNA, 15 nt, Yersinia pestis KIM
cucaacucaaaacaa

SEQ ID NO: 2321106 - RNA, 22 nt, Yersinia pestis KIM
cucaacguauucccgcuaccga

SEQ ID NO: 2321107 - RNA, 15 nt, Yersinia pestis KIM
cucaacugcucaacu

SEQ ID NO: 2321108 - RNA, 17 nt, Yersinia pestis KIM
cucaacugcucaacugc

SEQ ID NO: 2321109 - RNA, 18 nt, Yersinia pestis KIM
cucaacugcucaacugcu

SEQ ID NO: 2321110 - RNA, 15 nt, Yersinia pestis KIM
cuauugugucaauac

SEQ ID NO: 2321111 - RNA, 20 nt, Yersinia pestis KIM
cuauugguggcucaaagaaa

SEQ ID NO: 2321112 - RNA, 22 nt, Yersinia pestis KIM
cuauugauaaaaccacugaccu

SEQ ID NO: 2321113 - RNA, 14 nt, Yersinia pestis KIM
cuauugaucacagu

SEQ ID NO: 2321114 - RNA, 15 nt, Yersinia pestis KIM
cuauugauaaaacca

SEQ ID NO: 2321115 - RNA, 17 nt, Yersinia pestis KIM
cuauugauaaaaccacu

SEQ ID NO: 2321116 - RNA, 23 nt, Yersinia pestis KIM
cucaaaacaauuucgaaaacuca

SEQ ID NO: 2321117 - RNA, 16 nt, Yersinia pestis KIM
cucaaaaggauggccc

SEQ ID NO: 2321118 - RNA, 15 nt, Yersinia pestis KIM
cucaaaauuaucuaa

SEQ ID NO: 2321119 - RNA, 20 nt, Yersinia pestis KIM
cuaucaauugcuggcuauca

SEQ ID NO: 2321120 - RNA, 16 nt, Yersinia pestis KIM
cuaucacuagcgggcc

SEQ ID NO: 2321121 - RNA, 15 nt, Yersinia pestis KIM
cuaucaauaaaccca

SEQ ID NO: 2321122 - RNA, 19 nt, Yersinia pestis KIM
cuauccgaaaaauauucuc

SEQ ID NO: 2321123 - RNA, 16 nt, Yersinia pestis KIM
cuaucccuccccacug

SEQ ID NO: 2321124 - RNA, 14 nt, Yersinia pestis KIM
cuaucauuaaaugg

SEQ ID NO: 2321125 - RNA, 18 nt, Yersinia pestis KIM
cuaucauuguccucaaga

SEQ ID NO: 2321126 - RNA, 17 nt, Yersinia pestis KIM
cuaucaggucaaucuua

SEQ ID NO: 2321127 - RNA, 17 nt, Yersinia pestis KIM
cuauauucucauugccc

SEQ ID NO: 2321128 - RNA, 23 nt, Yersinia pestis KIM
cuauauucucauugcccccuuca

SEQ ID NO: 2321129 - RNA, 11 nt, Yersinia pestis KIM
cuauauuuggc

SEQ ID NO: 2321130 - RNA, 21 nt, Yersinia pestis KIM
cuaguuuuaaacgucagauua

SEQ ID NO: 2321131 - RNA, 19 nt, Yersinia pestis KIM
cuaugcaguuaaggcuggc

SEQ ID NO: 2321132 - RNA, 18 nt, Yersinia pestis KIM
cuaugcacccauagcuca

SEQ ID NO: 2321133 - RNA, 22 nt, Yersinia pestis KIM
cuaugugaaugcagucagcacu

SEQ ID NO: 2321134 - RNA, 22 nt, Yersinia pestis KIM
cuaugcccaguuuaccauccac

SEQ ID NO: 2321135 - RNA, 21 nt, Yersinia pestis KIM
cuaucuauuuuuauuucuccu

SEQ ID NO: 2321136 - RNA, 16 nt, Yersinia pestis KIM
cuaucucaucuuaauc

SEQ ID NO: 2321137 - RNA, 18 nt, Yersinia pestis KIM
cuaucguuuguaccuguu

SEQ ID NO: 2321138 - RNA, 18 nt, Yersinia pestis KIM
cuaucgguaucucccgca

SEQ ID NO: 2321139 - RNA, 16 nt, Yersinia pestis KIM
cuaucggugcagugca

SEQ ID NO: 2321140 - RNA, 16 nt, Yersinia pestis KIM
cuauucucuguaaugg

SEQ ID NO: 2321141 - RNA, 13 nt, Yersinia pestis KIM
cuauugaaaaaau

SEQ ID NO: 2321142 - RNA, 15 nt, Yersinia pestis KIM
cuauugaaaaaauaa

SEQ ID NO: 2321143 - RNA, 15 nt, Yersinia pestis KIM
cuauucccuuguuug

SEQ ID NO: 2321144 - RNA, 17 nt, Yersinia pestis KIM
cuauguuggcaaauaau

SEQ ID NO: 2321145 - RNA, 18 nt, Yersinia pestis KIM
cuauguucacguaaauga

SEQ ID NO: 2321146 - RNA, 16 nt, Yersinia pestis KIM
cuauuaucuuuuaaaa

SEQ ID NO: 2321147 - RNA, 21 nt, Yersinia pestis KIM
cuagauuaaccuuaucaccaa

SEQ ID NO: 2321148 - RNA, 12 nt, Yersinia pestis KIM
cuagaugcggca

SEQ ID NO: 2321149 - RNA, 18 nt, Yersinia pestis KIM
cuagaugcggcaacuuuu

SEQ ID NO: 2321150 - RNA, 22 nt, Yersinia pestis KIM
cuagaucacagacguuuaaaua

SEQ ID NO: 2321151 - RNA, 14 nt, Yersinia pestis KIM
cuagauuuucuuuc

SEQ ID NO: 2321152 - RNA, 15 nt, Yersinia pestis KIM
cuagauuuucuuuca

SEQ ID NO: 2321153 - RNA, 16 nt, Yersinia pestis KIM
cuaggcuauugacaaa

SEQ ID NO: 2321154 - RNA, 18 nt, Yersinia pestis KIM
cuagcucaagggcacagu

SEQ ID NO: 2321155 - RNA, 23 nt, Yersinia pestis KIM
cuagcucacggaagguugccccc

SEQ ID NO: 2321156 - RNA, 14 nt, Yersinia pestis KIM
cuagcguuuacuuu

SEQ ID NO: 2321157 - RNA, 22 nt, Yersinia pestis KIM
cuagcaacaugguuaagagauc

SEQ ID NO: 2321158 - RNA, 12 nt, Yersinia pestis KIM
cuagcuguguuu

SEQ ID NO: 2321159 - RNA, 21 nt, Yersinia pestis KIM
cuagcuguguuuuaucuguga

SEQ ID NO: 2321160 - RNA, 20 nt, Yersinia pestis KIM
cuagugcgcugugcccuacu

SEQ ID NO: 2321161 - RNA, 18 nt, Yersinia pestis KIM
cuagucucacuaaaucaa

SEQ ID NO: 2321162 - RNA, 22 nt, Yersinia pestis KIM
cuagggauuuuaagcagccgcc

SEQ ID NO: 2321163 - RNA, 19 nt, Yersinia pestis KIM
cuagggauuuuaagcagcc

SEQ ID NO: 2321164 - RNA, 17 nt, Yersinia pestis KIM
cuagggcuacugaccug

SEQ ID NO: 2321165 - RNA, 14 nt, Yersinia pestis KIM
cuaguagauaauca

SEQ ID NO: 2321166 - RNA, 21 nt, Yersinia pestis KIM
cuacucguaacgacgaaauag

SEQ ID NO: 2321167 - RNA, 15 nt, Yersinia pestis KIM
cuacuggcugaaguu

SEQ ID NO: 2321168 - RNA, 15 nt, Yersinia pestis KIM
cuacuguuuugguuu

SEQ ID NO: 2321169 - RNA, 14 nt, Yersinia pestis KIM
cuacuggcugaagu

SEQ ID NO: 2321170 - RNA, 19 nt, Yersinia pestis KIM
cuacugaugugcaugugga

SEQ ID NO: 2321171 - RNA, 13 nt, Yersinia pestis KIM
cuacuccaacaac

SEQ ID NO: 2321172 - RNA, 17 nt, Yersinia pestis KIM
cuaccccaacauugguu

SEQ ID NO: 2321173 - RNA, 12 nt, Yersinia pestis KIM
cuacuuauuucc

SEQ ID NO: 2321174 - RNA, 20 nt, Yersinia pestis KIM
cuagaauuugaucagccaga

SEQ ID NO: 2321175 - RNA, 16 nt, Yersinia pestis KIM
cucuuccaauagcagu

SEQ ID NO: 2321176 - RNA, 17 nt, Yersinia pestis KIM
cucuucagccuauccuc

SEQ ID NO: 2321177 - RNA, 18 nt, Yersinia pestis KIM
cucuucagccuauccuca

SEQ ID NO: 2321178 - RNA, 20 nt, Yersinia pestis KIM
cucuucagccuauccucacc

SEQ ID NO: 2321179 - RNA, 22 nt, Yersinia pestis KIM
cucuucagggcggcguuagccg

SEQ ID NO: 2321180 - RNA, 22 nt, Yersinia pestis KIM
cucuuccgacaggcuaacaacu

SEQ ID NO: 2321181 - RNA, 20 nt, Yersinia pestis KIM
cucuguauuguaauaaugga

SEQ ID NO: 2321182 - RNA, 22 nt, Yersinia pestis KIM
cucuguauuuucaaucgcuuuc

SEQ ID NO: 2321183 - RNA, 12 nt, Yersinia pestis KIM
cucuguucuuuu

SEQ ID NO: 2321184 - RNA, 18 nt, Yersinia pestis KIM
cucuuacauaaagaccca

SEQ ID NO: 2321185 - RNA, 17 nt, Yersinia pestis KIM
cucuuaaugucuuuacu

SEQ ID NO: 2321186 - RNA, 20 nt, Yersinia pestis KIM
cucuuauauaaauccagccc

SEQ ID NO: 2321187 - RNA, 15 nt, Yersinia pestis KIM
cucuuauuaaaugga

SEQ ID NO: 2321188 - RNA, 21 nt, Yersinia pestis KIM
cucuuuauacauauguugagu

SEQ ID NO: 2321189 - RNA, 21 nt, Yersinia pestis KIM
cucuuuauaaccgucaccaaa

SEQ ID NO: 2321190 - RNA, 19 nt, Yersinia pestis KIM
cucuuuagccgcuacgugu

SEQ ID NO: 2321191 - RNA, 18 nt, Yersinia pestis KIM
cucuuuccccauuuuuuu

SEQ ID NO: 2321192 - RNA, 17 nt, Yersinia pestis KIM
cucuuuccccauuuuuu

SEQ ID NO: 2321193 - RNA, 16 nt, Yersinia pestis KIM
cucuuucccuucaggu

SEQ ID NO: 2321194 - RNA, 21 nt, Yersinia pestis KIM
cucuuuccaacaguagcuuga

SEQ ID NO: 2321195 - RNA, 12 nt, Yersinia pestis KIM
cucuuucaacuu

SEQ ID NO: 2321196 - RNA, 18 nt, Yersinia pestis KIM
cucuuuaacaccccuuca

SEQ ID NO: 2321197 - RNA, 15 nt, Yersinia pestis KIM
cucuuuaaguucacu

SEQ ID NO: 2321198 - RNA, 15 nt, Yersinia pestis KIM
cucuuggcugacucc

SEQ ID NO: 2321199 - RNA, 17 nt, Yersinia pestis KIM
cucuugaacggugagga

SEQ ID NO: 2321200 - RNA, 15 nt, Yersinia pestis KIM
cucuugaacggugag

SEQ ID NO: 2321201 - RNA, 22 nt, Yersinia pestis KIM
cucuugacgccgacaaacccac

SEQ ID NO: 2321202 - RNA, 19 nt, Yersinia pestis KIM
cucuucugggcugaacgug

SEQ ID NO: 2321203 - RNA, 23 nt, Yersinia pestis KIM
cucuucuucgauuuuagcuuuga

SEQ ID NO: 2321204 - RNA, 19 nt, Yersinia pestis KIM
cucuugcgcuccacgcccc

SEQ ID NO: 2321205 - RNA, 21 nt, Yersinia pestis KIM
cucuugauuaccaauaauuaa

SEQ ID NO: 2321206 - RNA, 20 nt, Yersinia pestis KIM
cucuucuaaaaucgcacuga

SEQ ID NO: 2321207 - RNA, 13 nt, Yersinia pestis KIM
cucuucguugcuc

SEQ ID NO: 2321208 - RNA, 18 nt, Yersinia pestis KIM
cucuucugccuauccuca

SEQ ID NO: 2321209 - RNA, 22 nt, Yersinia pestis KIM
cucuucuggcgcuaaugagauu

SEQ ID NO: 2321210 - RNA, 14 nt, Yersinia pestis KIM
cugaaauuuuuuaa

SEQ ID NO: 2321211 - RNA, 23 nt, Yersinia pestis KIM
cugaaauuuuuuaauuugcuccu

SEQ ID NO: 2321212 - RNA, 22 nt, Yersinia pestis KIM
cugaaauuuauuucgauucauu

SEQ ID NO: 2321213 - RNA, 17 nt, Yersinia pestis KIM
cugaacaccauacuuuu

SEQ ID NO: 2321214 - RNA, 20 nt, Yersinia pestis KIM
cugaacgaggacuuccugcc

SEQ ID NO: 2321215 - RNA, 15 nt, Yersinia pestis KIM
cugaacgaccagaau

SEQ ID NO: 2321216 - RNA, 19 nt, Yersinia pestis KIM
cugaaccuuggcauugucu

SEQ ID NO: 2321217 - RNA, 18 nt, Yersinia pestis KIM
cugaacccugacggccag

SEQ ID NO: 2321218 - RNA, 19 nt, Yersinia pestis KIM
cugaacccugacggccagc

SEQ ID NO: 2321219 - RNA, 14 nt, Yersinia pestis KIM
cugaaccauggcuu

SEQ ID NO: 2321220 - RNA, 15 nt, Yersinia pestis KIM
cugaagaugccaauc

SEQ ID NO: 2321221 - RNA, 21 nt, Yersinia pestis KIM
cugaagaugccaaucaaaaaa

SEQ ID NO: 2321222 - RNA, 17 nt, Yersinia pestis KIM
cugaagccuacgagaga

SEQ ID NO: 2321223 - RNA, 14 nt, Yersinia pestis KIM
cugaagcaucaaua

SEQ ID NO: 2321224 - RNA, 23 nt, Yersinia pestis KIM
cugaacguaaaacaaucaccacc

SEQ ID NO: 2321225 - RNA, 15 nt, Yersinia pestis KIM
cugaacguauauugg

SEQ ID NO: 2321226 - RNA, 14 nt, Yersinia pestis KIM
cugaagacccaagg

SEQ ID NO: 2321227 - RNA, 20 nt, Yersinia pestis KIM
cugaagagaaauaacccaua

SEQ ID NO: 2321228 - RNA, 13 nt, Yersinia pestis KIM
cugaaagcaaaca

SEQ ID NO: 2321229 - RNA, 16 nt, Yersinia pestis KIM
cugaaagugcccccug

SEQ ID NO: 2321230 - RNA, 17 nt, Yersinia pestis KIM
cugaaaguguauuucuc

SEQ ID NO: 2321231 - RNA, 16 nt, Yersinia pestis KIM
cugaaacguucuucca

SEQ ID NO: 2321232 - RNA, 20 nt, Yersinia pestis KIM
cugaaacguucuuccaugcu

SEQ ID NO: 2321233 - RNA, 19 nt, Yersinia pestis KIM
cugaaaacaauauaauaac

SEQ ID NO: 2321234 - RNA, 16 nt, Yersinia pestis KIM
cucuuuuuccacaccc

SEQ ID NO: 2321235 - RNA, 23 nt, Yersinia pestis KIM
cugaaaaaugagucauuaucuga

SEQ ID NO: 2321236 - RNA, 17 nt, Yersinia pestis KIM
cugaaaaaggcaccagc

SEQ ID NO: 2321237 - RNA, 13 nt, Yersinia pestis KIM
cugacggcagaca

SEQ ID NO: 2321238 - RNA, 17 nt, Yersinia pestis KIM
cugacggccagcaaccu

SEQ ID NO: 2321239 - RNA, 18 nt, Yersinia pestis KIM
cugacucccugacucccu

SEQ ID NO: 2321240 - RNA, 20 nt, Yersinia pestis KIM
cugacucccugacucccuga

SEQ ID NO: 2321241 - RNA, 14 nt, Yersinia pestis KIM
cugacucccugacu

SEQ ID NO: 2321242 - RNA, 17 nt, Yersinia pestis KIM
cugacguaguguauuca

SEQ ID NO: 2321243 - RNA, 22 nt, Yersinia pestis KIM
cugaccuauugauaaaaccacu

SEQ ID NO: 2321244 - RNA, 14 nt, Yersinia pestis KIM
cugaccguuaucau

SEQ ID NO: 2321245 - RNA, 18 nt, Yersinia pestis KIM
cugacgaauagcaucagg

SEQ ID NO: 2321246 - RNA, 21 nt, Yersinia pestis KIM
cugacgaaauuuaagaaaucu

SEQ ID NO: 2321247 - RNA, 14 nt, Yersinia pestis KIM
cugacgaaaugccg

SEQ ID NO: 2321248 - RNA, 13 nt, Yersinia pestis KIM
cugacgcagcagg

SEQ ID NO: 2321249 - RNA, 13 nt, Yersinia pestis KIM
cugacgaugacuc

SEQ ID NO: 2321250 - RNA, 15 nt, Yersinia pestis KIM
cugacgauaacuuuu

SEQ ID NO: 2321251 - RNA, 14 nt, Yersinia pestis KIM
cugacgaaugacuc

SEQ ID NO: 2321252 - RNA, 16 nt, Yersinia pestis KIM
cugacgccaugcucag

SEQ ID NO: 2321253 - RNA, 12 nt, Yersinia pestis KIM
cugacuugcagg

SEQ ID NO: 2321254 - RNA, 15 nt, Yersinia pestis KIM
cugacuguuuugcua

SEQ ID NO: 2321255 - RNA, 22 nt, Yersinia pestis KIM
cugacuuacaauaaucuggaug

SEQ ID NO: 2321256 - RNA, 15 nt, Yersinia pestis KIM
cugacuguggcugcu

SEQ ID NO: 2321257 - RNA, 15 nt, Yersinia pestis KIM
cugacugcuuuuaau

SEQ ID NO: 2321258 - RNA, 19 nt, Yersinia pestis KIM
cugacugguucacaccaaa

SEQ ID NO: 2321259 - RNA, 19 nt, Yersinia pestis KIM
cugagaagcggaauuugcu

SEQ ID NO: 2321260 - RNA, 12 nt, Yersinia pestis KIM
cugagaacccau

SEQ ID NO: 2321261 - RNA, 14 nt, Yersinia pestis KIM
cugagaaucaaaaa

SEQ ID NO: 2321262 - RNA, 21 nt, Yersinia pestis KIM
cugagccgccaguugggaauc

SEQ ID NO: 2321263 - RNA, 23 nt, Yersinia pestis KIM
cugagccucaugaaugaggcuga

SEQ ID NO: 2321264 - RNA, 19 nt, Yersinia pestis KIM
cugagcauucgaguuaacu

SEQ ID NO: 2321265 - RNA, 15 nt, Yersinia pestis KIM
cugagcgaacugaau

SEQ ID NO: 2321266 - RNA, 16 nt, Yersinia pestis KIM
cugagcagcaacuguu

SEQ ID NO: 2321267 - RNA, 15 nt, Yersinia pestis KIM
cugagauaagccucg

SEQ ID NO: 2321268 - RNA, 19 nt, Yersinia pestis KIM
cugaauuggaagagccuga

SEQ ID NO: 2321269 - RNA, 15 nt, Yersinia pestis KIM
cugaauuucaauaac

SEQ ID NO: 2321270 - RNA, 18 nt, Yersinia pestis KIM
cugaauugaugcacagua

SEQ ID NO: 2321271 - RNA, 18 nt, Yersinia pestis KIM
cugaauugauuuauuccu

SEQ ID NO: 2321272 - RNA, 15 nt, Yersinia pestis KIM
cugaauggaaaaauu

SEQ ID NO: 2321273 - RNA, 18 nt, Yersinia pestis KIM
cugaauggcuauuuacuc

SEQ ID NO: 2321274 - RNA, 22 nt, Yersinia pestis KIM
cugaauggcuauuuacucucuu

SEQ ID NO: 2321275 - RNA, 15 nt, Yersinia pestis KIM
cugaaugucucuggc

SEQ ID NO: 2321276 - RNA, 15 nt, Yersinia pestis KIM
cugaaugccauucaa

SEQ ID NO: 2321277 - RNA, 16 nt, Yersinia pestis KIM
cugaauccccucaaaa

SEQ ID NO: 2321278 - RNA, 23 nt, Yersinia pestis KIM
cugaaucccagaaccucaacauu

SEQ ID NO: 2321279 - RNA, 17 nt, Yersinia pestis KIM
cugaaucguacuucuua

SEQ ID NO: 2321280 - RNA, 19 nt, Yersinia pestis KIM
cugaaucccagaaccucaa

SEQ ID NO: 2321281 - RNA, 11 nt, Yersinia pestis KIM
cugaauaccau

SEQ ID NO: 2321282 - RNA, 14 nt, Yersinia pestis KIM
cugaauaccauaac

SEQ ID NO: 2321283 - RNA, 15 nt, Yersinia pestis KIM
cugaauaauacuguc

SEQ ID NO: 2321284 - RNA, 22 nt, Yersinia pestis KIM
cugaauaaaaaauuauuaaaua

SEQ ID NO: 2321285 - RNA, 23 nt, Yersinia pestis KIM
cugaauaaaaaauuauuaaauaa

SEQ ID NO: 2321286 - RNA, 12 nt, Yersinia pestis KIM
cugaauaaacac

SEQ ID NO: 2321287 - RNA, 17 nt, Yersinia pestis KIM
cugaauaaacaccauag

SEQ ID NO: 2321288 - RNA, 16 nt, Yersinia pestis KIM
cugaauaaacggcaag

SEQ ID NO: 2321289 - RNA, 21 nt, Yersinia pestis KIM
cugaauaacguggaaaaaacg

SEQ ID NO: 2321290 - RNA, 20 nt, Yersinia pestis KIM
cugaauaucaucuuuuucug

SEQ ID NO: 2321291 - RNA, 19 nt, Yersinia pestis KIM
cugaauaucaucuuuuucu

SEQ ID NO: 2321292 - RNA, 18 nt, Yersinia pestis KIM
cugaauaucaucuuuuuc

SEQ ID NO: 2321293 - RNA, 16 nt, Yersinia pestis KIM
cugaaggcugauuaau

SEQ ID NO: 2321294 - RNA, 15 nt, Yersinia pestis KIM
cugaaggccugcugu

SEQ ID NO: 2321295 - RNA, 13 nt, Yersinia pestis KIM
cugaaguuaaaaa

SEQ ID NO: 2321296 - RNA, 20 nt, Yersinia pestis KIM
cugaaguuuaccgcaugaau

SEQ ID NO: 2321297 - RNA, 22 nt, Yersinia pestis KIM
cugaagggcaaauugccgcuuu

SEQ ID NO: 2321298 - RNA, 21 nt, Yersinia pestis KIM
cugaccagcggugccuugcca

SEQ ID NO: 2321299 - RNA, 18 nt, Yersinia pestis KIM
cugacccccgccgcuucu

SEQ ID NO: 2321300 - RNA, 20 nt, Yersinia pestis KIM
cugaccgauugaaucaaggc

SEQ ID NO: 2321301 - RNA, 12 nt, Yersinia pestis KIM
cugacaucauca

SEQ ID NO: 2321302 - RNA, 17 nt, Yersinia pestis KIM
cugacauuuucuaucuc

SEQ ID NO: 2321303 - RNA, 13 nt, Yersinia pestis KIM
cugaccaaacauu

SEQ ID NO: 2321304 - RNA, 14 nt, Yersinia pestis KIM
cugacagccugugc

SEQ ID NO: 2321305 - RNA, 18 nt, Yersinia pestis KIM
cugacagcggucgguauu

SEQ ID NO: 2321306 - RNA, 16 nt, Yersinia pestis KIM
cugacagagcggguuu

SEQ ID NO: 2321307 - RNA, 20 nt, Yersinia pestis KIM
cugacacuggcguuuucugc

SEQ ID NO: 2321308 - RNA, 17 nt, Yersinia pestis KIM
cugacacugcaucucug

SEQ ID NO: 2321309 - RNA, 20 nt, Yersinia pestis KIM
cugacacugcaucucugcau

SEQ ID NO: 2321310 - RNA, 16 nt, Yersinia pestis KIM
cugacacacaccagug

SEQ ID NO: 2321311 - RNA, 17 nt, Yersinia pestis KIM
cugacaccggauaugcc

SEQ ID NO: 2321312 - RNA, 16 nt, Yersinia pestis KIM
cugacaaaaugccaga

SEQ ID NO: 2321313 - RNA, 21 nt, Yersinia pestis KIM
cugaauuugugcuacggcaaa

SEQ ID NO: 2321314 - RNA, 21 nt, Yersinia pestis KIM
cugaauuuuugugcuagcuca

SEQ ID NO: 2321315 - RNA, 15 nt, Yersinia pestis KIM
cucugccaacgugau

SEQ ID NO: 2321316 - RNA, 17 nt, Yersinia pestis KIM
cucugauuguaacaauc

SEQ ID NO: 2321317 - RNA, 22 nt, Yersinia pestis KIM
cucugacaaaaugccagaaugc

SEQ ID NO: 2321318 - RNA, 14 nt, Yersinia pestis KIM
cucugacacugaca

SEQ ID NO: 2321319 - RNA, 17 nt, Yersinia pestis KIM
cucugaauaaaaaauua

SEQ ID NO: 2321320 - RNA, 17 nt, Yersinia pestis KIM
cucugaagccuucaugu

SEQ ID NO: 2321321 - RNA, 14 nt, Yersinia pestis KIM
cucucuuuuuucuc

SEQ ID NO: 2321322 - RNA, 15 nt, Yersinia pestis KIM
cucugccuauccuca

SEQ ID NO: 2321323 - RNA, 17 nt, Yersinia pestis KIM
cucugccguaccaaugu

SEQ ID NO: 2321324 - RNA, 18 nt, Yersinia pestis KIM
cucugcguacaacacauc

SEQ ID NO: 2321325 - RNA, 19 nt, Yersinia pestis KIM
cucuggacguuugcugcuu

SEQ ID NO: 2321326 - RNA, 16 nt, Yersinia pestis KIM
cucuggcagugaggca

SEQ ID NO: 2321327 - RNA, 22 nt, Yersinia pestis KIM
cucuggcaacggcacaucccaa

SEQ ID NO: 2321328 - RNA, 19 nt, Yersinia pestis KIM
cucuccgucgcgggcacuu

SEQ ID NO: 2321329 - RNA, 16 nt, Yersinia pestis KIM
cucuccgucgcgggca

SEQ ID NO: 2321330 - RNA, 14 nt, Yersinia pestis KIM
cucucuuuccagca

SEQ ID NO: 2321331 - RNA, 22 nt, Yersinia pestis KIM
cucucuuuccagcaaaagccuc

SEQ ID NO: 2321332 - RNA, 23 nt, Yersinia pestis KIM
cucucuuuccagcaaaagccucu

SEQ ID NO: 2321333 - RNA, 16 nt, Yersinia pestis KIM
cucucuggggagggcc

SEQ ID NO: 2321334 - RNA, 13 nt, Yersinia pestis KIM
cucucuauugauc

SEQ ID NO: 2321335 - RNA, 12 nt, Yersinia pestis KIM
cucucucaauuc

SEQ ID NO: 2321336 - RNA, 23 nt, Yersinia pestis KIM
cucucucaauucaauacgcaggc

SEQ ID NO: 2321337 - RNA, 13 nt, Yersinia pestis KIM
cucucacccugcg

SEQ ID NO: 2321338 - RNA, 23 nt, Yersinia pestis KIM
cucucacugcuccagccaacugg

SEQ ID NO: 2321339 - RNA, 13 nt, Yersinia pestis KIM
cucuccaugauau

SEQ ID NO: 2321340 - RNA, 12 nt, Yersinia pestis KIM
cucucauauccc

SEQ ID NO: 2321341 - RNA, 23 nt, Yersinia pestis KIM
cucuccagccugcgauagcccca

SEQ ID NO: 2321342 - RNA, 16 nt, Yersinia pestis KIM
cucgguaacuuaucga

SEQ ID NO: 2321343 - RNA, 16 nt, Yersinia pestis KIM
cucgguaaugagccgc

SEQ ID NO: 2321344 - RNA, 21 nt, Yersinia pestis KIM
cucggcgguuugagccaccgc

SEQ ID NO: 2321345 - RNA, 13 nt, Yersinia pestis KIM
cucguauuacccu

SEQ ID NO: 2321346 - RNA, 13 nt, Yersinia pestis KIM
cucuagcuguguu

SEQ ID NO: 2321347 - RNA, 15 nt, Yersinia pestis KIM
cucuaauaaaccugc

SEQ ID NO: 2321348 - RNA, 22 nt, Yersinia pestis KIM
cucguuggaucaucgggaacag

SEQ ID NO: 2321349 - RNA, 21 nt, Yersinia pestis KIM
cuccaccaacggcccaauauu

SEQ ID NO: 2321350 - RNA, 15 nt, Yersinia pestis KIM
cuccaccaacggccc

SEQ ID NO: 2321351 - RNA, 14 nt, Yersinia pestis KIM
cuccacauauugug

SEQ ID NO: 2321352 - RNA, 18 nt, Yersinia pestis KIM
cuccacaccuccgcccuc

SEQ ID NO: 2321353 - RNA, 12 nt, Yersinia pestis KIM
cuccccuguaac

SEQ ID NO: 2321354 - RNA, 19 nt, Yersinia pestis KIM
cuccguguaguuauugauu

SEQ ID NO: 2321355 - RNA, 13 nt, Yersinia pestis KIM
cuccguugaaacc

SEQ ID NO: 2321356 - RNA, 15 nt, Yersinia pestis KIM
cuccgucgcgggcac

SEQ ID NO: 2321357 - RNA, 12 nt, Yersinia pestis KIM
cuccggaaucag

SEQ ID NO: 2321358 - RNA, 20 nt, Yersinia pestis KIM
cuccugaaauaaagaacuga

SEQ ID NO: 2321359 - RNA, 13 nt, Yersinia pestis KIM
cuccucugccuau

SEQ ID NO: 2321360 - RNA, 15 nt, Yersinia pestis KIM
cuccucuuucuuaau

SEQ ID NO: 2321361 - RNA, 19 nt, Yersinia pestis KIM
cucgccguggcauaaucaa

SEQ ID NO: 2321362 - RNA, 17 nt, Yersinia pestis KIM
cucgccguggcgacagc

SEQ ID NO: 2321363 - RNA, 16 nt, Yersinia pestis KIM
cucgccgacaacuuca

SEQ ID NO: 2321364 - RNA, 16 nt, Yersinia pestis KIM
cucgccccgugcuacu

SEQ ID NO: 2321365 - RNA, 22 nt, Yersinia pestis KIM
cucgcaaugaaaguggccacuc

SEQ ID NO: 2321366 - RNA, 18 nt, Yersinia pestis KIM
cucgagccgcgcccuccc

SEQ ID NO: 2321367 - RNA, 18 nt, Yersinia pestis KIM
cucgaagcgcgcccuccc

SEQ ID NO: 2321368 - RNA, 21 nt, Yersinia pestis KIM
cucgaacgcuuguggaaauag

SEQ ID NO: 2321369 - RNA, 14 nt, Yersinia pestis KIM
cucgaaccgccacu

SEQ ID NO: 2321370 - RNA, 21 nt, Yersinia pestis KIM
cucgaaaucauccgcggcaaa

SEQ ID NO: 2321371 - RNA, 21 nt, Yersinia pestis KIM
cuccuuaccacugcucacuuu

SEQ ID NO: 2321372 - RNA, 18 nt, Yersinia pestis KIM
cuccuuauacuaaagaaa

SEQ ID NO: 2321373 - RNA, 18 nt, Yersinia pestis KIM
cuccuguggagguggugg

SEQ ID NO: 2321374 - RNA, 20 nt, Yersinia pestis KIM
cuccuuuaccuacaaccugg

SEQ ID NO: 2321375 - RNA, 13 nt, Yersinia pestis KIM
cuccuuugauuug

SEQ ID NO: 2321376 - RNA, 23 nt, Yersinia pestis KIM
cuccuuucuuuucgcuauuucuc

SEQ ID NO: 2321377 - RNA, 18 nt, Yersinia pestis KIM
cugugguuggcagcucag

SEQ ID NO: 2321378 - RNA, 15 nt, Yersinia pestis KIM
cugugugauguguac

SEQ ID NO: 2321379 - RNA, 17 nt, Yersinia pestis KIM
cugugucgcuauuuccg

SEQ ID NO: 2321380 - RNA, 14 nt, Yersinia pestis KIM
cugugcuuugccau

SEQ ID NO: 2321381 - RNA, 23 nt, Yersinia pestis KIM
cuguggcggcaagaacaccguca

SEQ ID NO: 2321382 - RNA, 17 nt, Yersinia pestis KIM
cuguguuuauaccaaag

SEQ ID NO: 2321383 - RNA, 21 nt, Yersinia pestis KIM
cuguguuuugcuaaccgccuu

SEQ ID NO: 2321384 - RNA, 22 nt, Yersinia pestis KIM
cuguuaaaagaccgcuuuugcg

SEQ ID NO: 2321385 - RNA, 19 nt, Yersinia pestis KIM
cuguuaauccguaugucac

SEQ ID NO: 2321386 - RNA, 13 nt, Yersinia pestis KIM
cuguuaacucaug

SEQ ID NO: 2321387 - RNA, 19 nt, Yersinia pestis KIM
cuguuacaucagagcucaa

SEQ ID NO: 2321388 - RNA, 16 nt, Yersinia pestis KIM
cuguuaccaaacauuu

SEQ ID NO: 2321389 - RNA, 15 nt, Yersinia pestis KIM
cuguuaccagaaaac

SEQ ID NO: 2321390 - RNA, 11 nt, Yersinia pestis KIM
cuguucaucag

SEQ ID NO: 2321391 - RNA, 13 nt, Yersinia pestis KIM
cuguuccaaccaa

SEQ ID NO: 2321392 - RNA, 15 nt, Yersinia pestis KIM
cuguucagauuuacc

SEQ ID NO: 2321393 - RNA, 22 nt, Yersinia pestis KIM
cuguucagauuuaccaugucca

SEQ ID NO: 2321394 - RNA, 19 nt, Yersinia pestis KIM
cuguuauuggggacaggcu

SEQ ID NO: 2321395 - RNA, 15 nt, Yersinia pestis KIM
cuguuaguucagacg

SEQ ID NO: 2321396 - RNA, 14 nt, Yersinia pestis KIM
cuguuauauaaaug

SEQ ID NO: 2321397 - RNA, 22 nt, Yersinia pestis KIM
cuguuaguaacuguaaggccaa

SEQ ID NO: 2321398 - RNA, 15 nt, Yersinia pestis KIM
cugugcuaaauccca

SEQ ID NO: 2321399 - RNA, 19 nt, Yersinia pestis KIM
cugugcuaaaucccaggcg

SEQ ID NO: 2321400 - RNA, 19 nt, Yersinia pestis KIM
cugugcgcggcuagccacc

SEQ ID NO: 2321401 - RNA, 22 nt, Yersinia pestis KIM
cugugcggaucccguuucagcu

SEQ ID NO: 2321402 - RNA, 15 nt, Yersinia pestis KIM
cugugcggcagugaa

SEQ ID NO: 2321403 - RNA, 21 nt, Yersinia pestis KIM
cugugcggcagugaaccugaa

SEQ ID NO: 2321404 - RNA, 18 nt, Yersinia pestis KIM
cugugcggcagugaacuu

SEQ ID NO: 2321405 - RNA, 20 nt, Yersinia pestis KIM
cugugcggcagugaacuuaa

SEQ ID NO: 2321406 - RNA, 23 nt, Yersinia pestis KIM
cugugccugcagguaagaaggca

SEQ ID NO: 2321407 - RNA, 18 nt, Yersinia pestis KIM
cugugcgaauggaaaaac

SEQ ID NO: 2321408 - RNA, 17 nt, Yersinia pestis KIM
cugugauuucagccagg

SEQ ID NO: 2321409 - RNA, 19 nt, Yersinia pestis KIM
cugucgauaauaaauugcg

SEQ ID NO: 2321410 - RNA, 15 nt, Yersinia pestis KIM
cugucuuauuuuuug

SEQ ID NO: 2321411 - RNA, 20 nt, Yersinia pestis KIM
cugugaucgcugccgcaaga

SEQ ID NO: 2321412 - RNA, 23 nt, Yersinia pestis KIM
cugugauaaccaacaguuauuuu

SEQ ID NO: 2321413 - RNA, 15 nt, Yersinia pestis KIM
cugugauaaacccca

SEQ ID NO: 2321414 - RNA, 21 nt, Yersinia pestis KIM
cugugauaaccaacaguuauu

SEQ ID NO: 2321415 - RNA, 18 nt, Yersinia pestis KIM
cugugagcggcauccagu

SEQ ID NO: 2321416 - RNA, 22 nt, Yersinia pestis KIM
cugugaauuuaucaggcuaaua

SEQ ID NO: 2321417 - RNA, 19 nt, Yersinia pestis KIM
cugguucacaccaaaccgg

SEQ ID NO: 2321418 - RNA, 16 nt, Yersinia pestis KIM
cuggugugagcgagga

SEQ ID NO: 2321419 - RNA, 13 nt, Yersinia pestis KIM
cugguugaaaccu

SEQ ID NO: 2321420 - RNA, 12 nt, Yersinia pestis KIM
cugguugcuuca

SEQ ID NO: 2321421 - RNA, 15 nt, Yersinia pestis KIM
cugguugcuucauca

SEQ ID NO: 2321422 - RNA, 14 nt, Yersinia pestis KIM
cugguuggauuggu

SEQ ID NO: 2321423 - RNA, 15 nt, Yersinia pestis KIM
cugguugugcuucag

SEQ ID NO: 2321424 - RNA, 18 nt, Yersinia pestis KIM
cugguuuuaccaucacca

SEQ ID NO: 2321425 - RNA, 18 nt, Yersinia pestis KIM
cuggugcuggugaauggu

SEQ ID NO: 2321426 - RNA, 19 nt, Yersinia pestis KIM
cuguaauaucgaaggggau

SEQ ID NO: 2321427 - RNA, 19 nt, Yersinia pestis KIM
cuguaacucaaauuauuuu

SEQ ID NO: 2321428 - RNA, 23 nt, Yersinia pestis KIM
cuguaacugccaguucaucagcc

SEQ ID NO: 2321429 - RNA, 17 nt, Yersinia pestis KIM
cuguaacuaccugcuuu

SEQ ID NO: 2321430 - RNA, 15 nt, Yersinia pestis KIM
cuguaacuuuauuga

SEQ ID NO: 2321431 - RNA, 14 nt, Yersinia pestis KIM
cuguaaggccaaac

SEQ ID NO: 2321432 - RNA, 16 nt, Yersinia pestis KIM
cuguaaggcccgcagu

SEQ ID NO: 2321433 - RNA, 14 nt, Yersinia pestis KIM
cuguaauaaaggcu

SEQ ID NO: 2321434 - RNA, 23 nt, Yersinia pestis KIM
cuguagccgcaggcgaugcaagg

SEQ ID NO: 2321435 - RNA, 20 nt, Yersinia pestis KIM
cuguagcgccagguaagaaa

SEQ ID NO: 2321436 - RNA, 19 nt, Yersinia pestis KIM
cuguagaacuuguucauau

SEQ ID NO: 2321437 - RNA, 19 nt, Yersinia pestis KIM
cuguacugcugcaacucau

SEQ ID NO: 2321438 - RNA, 14 nt, Yersinia pestis KIM
cuguagcuuuuuaa

SEQ ID NO: 2321439 - RNA, 20 nt, Yersinia pestis KIM
cugucauuacacuuucuuug

SEQ ID NO: 2321440 - RNA, 13 nt, Yersinia pestis KIM
cugucauugcugu

SEQ ID NO: 2321441 - RNA, 15 nt, Yersinia pestis KIM
cuguccaagaagcca

SEQ ID NO: 2321442 - RNA, 18 nt, Yersinia pestis KIM
cuguccaagaagccaaga

SEQ ID NO: 2321443 - RNA, 20 nt, Yersinia pestis KIM
cuggaucggcauacuccauu

SEQ ID NO: 2321444 - RNA, 14 nt, Yersinia pestis KIM
cuggauggccaucu

SEQ ID NO: 2321445 - RNA, 23 nt, Yersinia pestis KIM
cuggcaaacgcugcacaucauuu

SEQ ID NO: 2321446 - RNA, 18 nt, Yersinia pestis KIM
cuggcaaaacucagguga

SEQ ID NO: 2321447 - RNA, 21 nt, Yersinia pestis KIM
cuggcaaauaagggauaugaa

SEQ ID NO: 2321448 - RNA, 22 nt, Yersinia pestis KIM
cuggauguguggcagucacugc

SEQ ID NO: 2321449 - RNA, 13 nt, Yersinia pestis KIM
cuggauauuuucc

SEQ ID NO: 2321450 - RNA, 15 nt, Yersinia pestis KIM
cugcuguucuggcag

SEQ ID NO: 2321451 - RNA, 16 nt, Yersinia pestis KIM
cugcuguucuggcagg

SEQ ID NO: 2321452 - RNA, 23 nt, Yersinia pestis KIM
cugcuuaccuuguuuguuacugc

SEQ ID NO: 2321453 - RNA, 13 nt, Yersinia pestis KIM
cugcuuaccuugu

SEQ ID NO: 2321454 - RNA, 13 nt, Yersinia pestis KIM
cuggccgcaggcg

SEQ ID NO: 2321455 - RNA, 14 nt, Yersinia pestis KIM
cuggcgaccgcuga

SEQ ID NO: 2321456 - RNA, 13 nt, Yersinia pestis KIM
cuggcgcacgccg

SEQ ID NO: 2321457 - RNA, 21 nt, Yersinia pestis KIM
cuggccagaagguaagccagu

SEQ ID NO: 2321458 - RNA, 20 nt, Yersinia pestis KIM
cuggccgauaucauggccau

SEQ ID NO: 2321459 - RNA, 22 nt, Yersinia pestis KIM
cuggcccuggaacaccagcaca

SEQ ID NO: 2321460 - RNA, 18 nt, Yersinia pestis KIM
cuggcgugcgggcaaaac

SEQ ID NO: 2321461 - RNA, 15 nt, Yersinia pestis KIM
cuggcucaaauuugg

SEQ ID NO: 2321462 - RNA, 16 nt, Yersinia pestis KIM
cuggcuaauuuuauua

SEQ ID NO: 2321463 - RNA, 18 nt, Yersinia pestis KIM
cuggcuaacguggccuua

SEQ ID NO: 2321464 - RNA, 23 nt, Yersinia pestis KIM
cuggcguuuugcaucaacgacag

SEQ ID NO: 2321465 - RNA, 22 nt, Yersinia pestis KIM
cuggcuggcuuuggaacgcuca

SEQ ID NO: 2321466 - RNA, 20 nt, Yersinia pestis KIM
cuggcucugcgaccaaggcu

SEQ ID NO: 2321467 - RNA, 14 nt, Yersinia pestis KIM
cuggcucuauuuuc

SEQ ID NO: 2321468 - RNA, 19 nt, Yersinia pestis KIM
cugggcugaacgugccugu

SEQ ID NO: 2321469 - RNA, 15 nt, Yersinia pestis KIM
cugggcugcauagcg

SEQ ID NO: 2321470 - RNA, 18 nt, Yersinia pestis KIM
cuggggucaucaacgcac

SEQ ID NO: 2321471 - RNA, 16 nt, Yersinia pestis KIM
cuggguacaacacaaa

SEQ ID NO: 2321472 - RNA, 22 nt, Yersinia pestis KIM
cugggccgcuggcgauccccuu

SEQ ID NO: 2321473 - RNA, 17 nt, Yersinia pestis KIM
cugggauccauaggauc

SEQ ID NO: 2321474 - RNA, 24 nt, Yersinia pestis KIM
cuggcuuuuucacacgcccaggcc

SEQ ID NO: 2321475 - RNA, 23 nt, Yersinia pestis KIM
cuggcuuuuuuguuuuuauauca

SEQ ID NO: 2321476 - RNA, 23 nt, Yersinia pestis KIM
cugggcaaaacguauaaaagcau

SEQ ID NO: 2321477 - RNA, 15 nt, Yersinia pestis KIM
cugcauuaccuuuaa

SEQ ID NO: 2321478 - RNA, 17 nt, Yersinia pestis KIM
cugcauugauuaaauca

SEQ ID NO: 2321479 - RNA, 14 nt, Yersinia pestis KIM
cugcauugauuaaa

SEQ ID NO: 2321480 - RNA, 14 nt, Yersinia pestis KIM
cugcaucucugcau

SEQ ID NO: 2321481 - RNA, 20 nt, Yersinia pestis KIM
cugcaucuggucaucaugua

SEQ ID NO: 2321482 - RNA, 20 nt, Yersinia pestis KIM
cugccaauauccauauuaaa

SEQ ID NO: 2321483 - RNA, 22 nt, Yersinia pestis KIM
cugccaaauauugcacaauagc

SEQ ID NO: 2321484 - RNA, 19 nt, Yersinia pestis KIM
cugccaacaacuuaauucc

SEQ ID NO: 2321485 - RNA, 21 nt, Yersinia pestis KIM
cugccaaccaccaaagauaca

SEQ ID NO: 2321486 - RNA, 23 nt, Yersinia pestis KIM
cugccaaaaaauaagggccacca

SEQ ID NO: 2321487 - RNA, 17 nt, Yersinia pestis KIM
cugcagcgauauacauc

SEQ ID NO: 2321488 - RNA, 11 nt, Yersinia pestis KIM
cugcaucaucg

SEQ ID NO: 2321489 - RNA, 15 nt, Yersinia pestis KIM
cugcaucaagccgcu

SEQ ID NO: 2321490 - RNA, 15 nt, Yersinia pestis KIM
cugcauagcuaaccu

SEQ ID NO: 2321491 - RNA, 14 nt, Yersinia pestis KIM
cugcccgccccggc

SEQ ID NO: 2321492 - RNA, 16 nt, Yersinia pestis KIM
cugccccucuuuucuu

SEQ ID NO: 2321493 - RNA, 13 nt, Yersinia pestis KIM
cugccauugcuca

SEQ ID NO: 2321494 - RNA, 12 nt, Yersinia pestis KIM
cugcccaauucg

SEQ ID NO: 2321495 - RNA, 23 nt, Yersinia pestis KIM
cugcccacagggugagucucagg

SEQ ID NO: 2321496 - RNA, 17 nt, Yersinia pestis KIM
cugccaauucaaggcca

SEQ ID NO: 2321497 - RNA, 16 nt, Yersinia pestis KIM
cugccagcccacgagg

SEQ ID NO: 2321498 - RNA, 13 nt, Yersinia pestis KIM
cugcaccagugcc

SEQ ID NO: 2321499 - RNA, 17 nt, Yersinia pestis KIM
cugcacaucauuuauuu

SEQ ID NO: 2321500 - RNA, 16 nt, Yersinia pestis KIM
cugcacaguagaagcu

SEQ ID NO: 2321501 - RNA, 18 nt, Yersinia pestis KIM
cugcacaccacacuggau

SEQ ID NO: 2321502 - RNA, 19 nt, Yersinia pestis KIM
cugcaaauuaaccugcugg

SEQ ID NO: 2321503 - RNA, 18 nt, Yersinia pestis KIM
cugcaccucaucaacgac

SEQ ID NO: 2321504 - RNA, 15 nt, Yersinia pestis KIM
cugauugaccaucaa

SEQ ID NO: 2321505 - RNA, 15 nt, Yersinia pestis KIM
cugauucuucagaau

SEQ ID NO: 2321506 - RNA, 19 nt, Yersinia pestis KIM
cugauuuuuuacuuuuucc

SEQ ID NO: 2321507 - RNA, 13 nt, Yersinia pestis KIM
cugauuuuuauca

SEQ ID NO: 2321508 - RNA, 14 nt, Yersinia pestis KIM
cugauucacuggca

SEQ ID NO: 2321509 - RNA, 22 nt, Yersinia pestis KIM
cugagcguccgucauccaauga

SEQ ID NO: 2321510 - RNA, 15 nt, Yersinia pestis KIM
cugaugaucauugca

SEQ ID NO: 2321511 - RNA, 15 nt, Yersinia pestis KIM
cugaugcaauaacuc

SEQ ID NO: 2321512 - RNA, 13 nt, Yersinia pestis KIM
cugaugcaccuca

SEQ ID NO: 2321513 - RNA, 14 nt, Yersinia pestis KIM
cugaugacucaucu

SEQ ID NO: 2321514 - RNA, 23 nt, Yersinia pestis KIM
cugaugacgccguacaaauauaa

SEQ ID NO: 2321515 - RNA, 14 nt, Yersinia pestis KIM
cugaugcuuuucuu

SEQ ID NO: 2321516 - RNA, 13 nt, Yersinia pestis KIM
cugcggcaauaag

SEQ ID NO: 2321517 - RNA, 22 nt, Yersinia pestis KIM
cugcgcugaccuaaaccgcucu

SEQ ID NO: 2321518 - RNA, 18 nt, Yersinia pestis KIM
cugcgccauaugccauga

SEQ ID NO: 2321519 - RNA, 20 nt, Yersinia pestis KIM
cugcgauuuaugaaccguca

SEQ ID NO: 2321520 - RNA, 22 nt, Yersinia pestis KIM
cugcgaccaaggcucuggcaau

SEQ ID NO: 2321521 - RNA, 17 nt, Yersinia pestis KIM
cugccgccccuuccaau

SEQ ID NO: 2321522 - RNA, 21 nt, Yersinia pestis KIM
cugccgccaccauaucagaac

SEQ ID NO: 2321523 - RNA, 15 nt, Yersinia pestis KIM
cugcucuuucccuuc

SEQ ID NO: 2321524 - RNA, 12 nt, Yersinia pestis KIM
cugcucugcccc

SEQ ID NO: 2321525 - RNA, 21 nt, Yersinia pestis KIM
cugcuccgcccuaaagcuguc

SEQ ID NO: 2321526 - RNA, 13 nt, Yersinia pestis KIM
cugcucgcccaag

SEQ ID NO: 2321527 - RNA, 14 nt, Yersinia pestis KIM
cugcucgagccaau

SEQ ID NO: 2321528 - RNA, 18 nt, Yersinia pestis KIM
cugcuguggguucaucaa

SEQ ID NO: 2321529 - RNA, 14 nt, Yersinia pestis KIM
cugcugugugggcg

SEQ ID NO: 2321530 - RNA, 20 nt, Yersinia pestis KIM
cugcugugucgcuauuuccg

SEQ ID NO: 2321531 - RNA, 23 nt, Yersinia pestis KIM
cugcuggugccacuguuuuucca

SEQ ID NO: 2321532 - RNA, 15 nt, Yersinia pestis KIM
cugcugguuuuacug

SEQ ID NO: 2321533 - RNA, 19 nt, Yersinia pestis KIM
cugcugcuuggguggucag

SEQ ID NO: 2321534 - RNA, 13 nt, Yersinia pestis KIM
cugcugcuuuaau

SEQ ID NO: 2321535 - RNA, 17 nt, Yersinia pestis KIM
cugcuggaaguuggcuu

SEQ ID NO: 2321536 - RNA, 15 nt, Yersinia pestis KIM
cugcuggaaugcagu

SEQ ID NO: 2321537 - RNA, 13 nt, Yersinia pestis KIM
cuucaagaugcag

SEQ ID NO: 2321538 - RNA, 14 nt, Yersinia pestis KIM
cuucaacuuuuuuc

SEQ ID NO: 2321539 - RNA, 22 nt, Yersinia pestis KIM
cuucaacuuuuuucuuaaggac

SEQ ID NO: 2321540 - RNA, 12 nt, Yersinia pestis KIM
cuucaagcccga

SEQ ID NO: 2321541 - RNA, 20 nt, Yersinia pestis KIM
cuucaagcccgaaauucagu

SEQ ID NO: 2321542 - RNA, 18 nt, Yersinia pestis KIM
cuucaacguggaaguuca

SEQ ID NO: 2321543 - RNA, 22 nt, Yersinia pestis KIM
cuucaauacguucguagccacg

SEQ ID NO: 2321544 - RNA, 17 nt, Yersinia pestis KIM
cuuauuugaaauacuua

SEQ ID NO: 2321545 - RNA, 13 nt, Yersinia pestis KIM
cuuauuucuuacu

SEQ ID NO: 2321546 - RNA, 23 nt, Yersinia pestis KIM
cuuauuucacgcuaauuauuuua

SEQ ID NO: 2321547 - RNA, 22 nt, Yersinia pestis KIM
cuuauugggcgcgauaaaagau

SEQ ID NO: 2321548 - RNA, 14 nt, Yersinia pestis KIM
cuuauuggucgcuu

SEQ ID NO: 2321549 - RNA, 12 nt, Yersinia pestis KIM
cuuauuuuagcu

SEQ ID NO: 2321550 - RNA, 14 nt, Yersinia pestis KIM
cuuauuuuuaccaa

SEQ ID NO: 2321551 - RNA, 18 nt, Yersinia pestis KIM
cuucaaaaucaccuggcc

SEQ ID NO: 2321552 - RNA, 21 nt, Yersinia pestis KIM
cuuaugaucuugaauaauauu

SEQ ID NO: 2321553 - RNA, 19 nt, Yersinia pestis KIM
cuuaugagcagcccagucu

SEQ ID NO: 2321554 - RNA, 14 nt, Yersinia pestis KIM
cuuaguuucuacgg

SEQ ID NO: 2321555 - RNA, 13 nt, Yersinia pestis KIM
cuuauaaacacug

SEQ ID NO: 2321556 - RNA, 12 nt, Yersinia pestis KIM
cuuauaaaccuc

SEQ ID NO: 2321557 - RNA, 23 nt, Yersinia pestis KIM
cuuauucgaguagggauuuaugc

SEQ ID NO: 2321558 - RNA, 18 nt, Yersinia pestis KIM
cuuauuggaaguacuuau

SEQ ID NO: 2321559 - RNA, 24 nt, Yersinia pestis KIM
cuuauggggacucuuuauuuaugg

SEQ ID NO: 2321560 - RNA, 15 nt, Yersinia pestis KIM
cuuauggcguuugau

SEQ ID NO: 2321561 - RNA, 19 nt, Yersinia pestis KIM
cuuauggucgguuuccgcc

SEQ ID NO: 2321562 - RNA, 21 nt, Yersinia pestis KIM
cuuaacacgaaccuucucugc

SEQ ID NO: 2321563 - RNA, 16 nt, Yersinia pestis KIM
cuuaacaaucagugca

SEQ ID NO: 2321564 - RNA, 16 nt, Yersinia pestis KIM
cuuaagagagaugcaa

SEQ ID NO: 2321565 - RNA, 14 nt, Yersinia pestis KIM
cuuaagcaauauuu

SEQ ID NO: 2321566 - RNA, 17 nt, Yersinia pestis KIM
cuuaagcaauauuuuag

SEQ ID NO: 2321567 - RNA, 17 nt, Yersinia pestis KIM
cuuaagcccaucuuauu

SEQ ID NO: 2321568 - RNA, 16 nt, Yersinia pestis KIM
cuuaacuacaccgcua

SEQ ID NO: 2321569 - RNA, 18 nt, Yersinia pestis KIM
cuuaacgguaugacgggu

SEQ ID NO: 2321570 - RNA, 23 nt, Yersinia pestis KIM
cuuaaguugaguugaauuuuuau

SEQ ID NO: 2321571 - RNA, 19 nt, Yersinia pestis KIM
cuuaccggccucuuucccc

SEQ ID NO: 2321572 - RNA, 16 nt, Yersinia pestis KIM
cuuacuguaucaauac

SEQ ID NO: 2321573 - RNA, 23 nt, Yersinia pestis KIM
cuuacuuuuuacggcuuaucaau

SEQ ID NO: 2321574 - RNA, 15 nt, Yersinia pestis KIM
cuuacauaaguaagu

SEQ ID NO: 2321575 - RNA, 19 nt, Yersinia pestis KIM
cuuacaugaguaagugauu

SEQ ID NO: 2321576 - RNA, 16 nt, Yersinia pestis KIM
cuuaaucuuuaauuca

SEQ ID NO: 2321577 - RNA, 16 nt, Yersinia pestis KIM
cuuagucauuaagaau

SEQ ID NO: 2321578 - RNA, 23 nt, Yersinia pestis KIM
cuuaguuacaauaaaucaauucu

SEQ ID NO: 2321579 - RNA, 15 nt, Yersinia pestis KIM
cuuaguuggugcuuu

SEQ ID NO: 2321580 - RNA, 18 nt, Yersinia pestis KIM
cuuagcgcacggggaaac

SEQ ID NO: 2321581 - RNA, 18 nt, Yersinia pestis KIM
cuuagcucaguugguuag

SEQ ID NO: 2321582 - RNA, 20 nt, Yersinia pestis KIM
cuuagcuguaaaggcaaaga

SEQ ID NO: 2321583 - RNA, 14 nt, Yersinia pestis KIM
cuuccaauagcagu

SEQ ID NO: 2321584 - RNA, 12 nt, Yersinia pestis KIM
cuuccaauauug

SEQ ID NO: 2321585 - RNA, 16 nt, Yersinia pestis KIM
cuuccaauaagugauu

SEQ ID NO: 2321586 - RNA, 19 nt, Yersinia pestis KIM
cuuccaacgcuucaccauu

SEQ ID NO: 2321587 - RNA, 14 nt, Yersinia pestis KIM
cuuccaaaggaagg

SEQ ID NO: 2321588 - RNA, 13 nt, Yersinia pestis KIM
cuucacuucuggg

SEQ ID NO: 2321589 - RNA, 14 nt, Yersinia pestis KIM
cuucacuucugggg

SEQ ID NO: 2321590 - RNA, 22 nt, Yersinia pestis KIM
cuucacuucagaaccgacaggu

SEQ ID NO: 2321591 - RNA, 15 nt, Yersinia pestis KIM
cuuccagcgcccggc

SEQ ID NO: 2321592 - RNA, 23 nt, Yersinia pestis KIM
cuuccagcgcccggcugaccugu

SEQ ID NO: 2321593 - RNA, 14 nt, Yersinia pestis KIM
cuuccaauucauaa

SEQ ID NO: 2321594 - RNA, 12 nt, Yersinia pestis KIM
cuucccauccua

SEQ ID NO: 2321595 - RNA, 20 nt, Yersinia pestis KIM
cuucccccaaguaaaaaaaa

SEQ ID NO: 2321596 - RNA, 22 nt, Yersinia pestis KIM
cuucccccaaguaaaaaaaacc

SEQ ID NO: 2321597 - RNA, 19 nt, Yersinia pestis KIM
cuucccggcgauucuccac

SEQ ID NO: 2321598 - RNA, 13 nt, Yersinia pestis KIM
cuuccgucccaag

SEQ ID NO: 2321599 - RNA, 13 nt, Yersinia pestis KIM
cuuccugcccagc

SEQ ID NO: 2321600 - RNA, 12 nt, Yersinia pestis KIM
cuuccuugcucu

SEQ ID NO: 2321601 - RNA, 20 nt, Yersinia pestis KIM
cuuccuugauuuucauuuca

SEQ ID NO: 2321602 - RNA, 14 nt, Yersinia pestis KIM
cuucgcucacaacc

SEQ ID NO: 2321603 - RNA, 22 nt, Yersinia pestis KIM
cuucgagcaggcuuugugccaa

SEQ ID NO: 2321604 - RNA, 17 nt, Yersinia pestis KIM
cuucgacaggcaauuau

SEQ ID NO: 2321605 - RNA, 14 nt, Yersinia pestis KIM
cuuccuuuuauuua

SEQ ID NO: 2321606 - RNA, 19 nt, Yersinia pestis KIM
cuuccuuugcccuuacuau

SEQ ID NO: 2321607 - RNA, 20 nt, Yersinia pestis KIM
cuuccuuuuuaugccauaaa

SEQ ID NO: 2321608 - RNA, 21 nt, Yersinia pestis KIM
cuucgaaagaaauaaaagaaa

SEQ ID NO: 2321609 - RNA, 21 nt, Yersinia pestis KIM
cuucgggauagggaaaaguua

SEQ ID NO: 2321610 - RNA, 22 nt, Yersinia pestis KIM
cuucgguauauuucccguugau

SEQ ID NO: 2321611 - RNA, 16 nt, Yersinia pestis KIM
cuucgguaaauuuaua

SEQ ID NO: 2321612 - RNA, 15 nt, Yersinia pestis KIM
cuucggacgcuccuc

SEQ ID NO: 2321613 - RNA, 19 nt, Yersinia pestis KIM
cuucgcuuucaucuucuuc

SEQ ID NO: 2321614 - RNA, 21 nt, Yersinia pestis KIM
cuucgguuugagcuugcugcu

SEQ ID NO: 2321615 - RNA, 13 nt, Yersinia pestis KIM
cuucuaacaauaa

SEQ ID NO: 2321616 - RNA, 18 nt, Yersinia pestis KIM
cuucuaaaaucgcacuga

SEQ ID NO: 2321617 - RNA, 19 nt, Yersinia pestis KIM
cuucuaggugcucugccuu

SEQ ID NO: 2321618 - RNA, 21 nt, Yersinia pestis KIM
cuucuaggugcucugccuuau

SEQ ID NO: 2321619 - RNA, 14 nt, Yersinia pestis KIM
cuucuauuacccuu

SEQ ID NO: 2321620 - RNA, 16 nt, Yersinia pestis KIM
cuuucuguucaucaau

SEQ ID NO: 2321621 - RNA, 18 nt, Yersinia pestis KIM
cuuucugggguauguaau

SEQ ID NO: 2321622 - RNA, 15 nt, Yersinia pestis KIM
cuuucguuucugucu

SEQ ID NO: 2321623 - RNA, 14 nt, Yersinia pestis KIM
cuuucguucacuua

SEQ ID NO: 2321624 - RNA, 15 nt, Yersinia pestis KIM
cuuucuaagcugccu

SEQ ID NO: 2321625 - RNA, 18 nt, Yersinia pestis KIM
cuuucuaagcugccugug

SEQ ID NO: 2321626 - RNA, 20 nt, Yersinia pestis KIM
cuuuccacgcccaacucuuu

SEQ ID NO: 2321627 - RNA, 18 nt, Yersinia pestis KIM
cuuuccacgcccaacucu

SEQ ID NO: 2321628 - RNA, 20 nt, Yersinia pestis KIM
cuuuccagcgguuuuuucuu

SEQ ID NO: 2321629 - RNA, 17 nt, Yersinia pestis KIM
cuuucgggcaaaaaaau

SEQ ID NO: 2321630 - RNA, 12 nt, Yersinia pestis KIM
cuuuccagccaa

SEQ ID NO: 2321631 - RNA, 19 nt, Yersinia pestis KIM
cuuucuuaauaauaucaaa

SEQ ID NO: 2321632 - RNA, 17 nt, Yersinia pestis KIM
cuuugaccgaaccaccg

SEQ ID NO: 2321633 - RNA, 13 nt, Yersinia pestis KIM
cuuugacagcauc

SEQ ID NO: 2321634 - RNA, 15 nt, Yersinia pestis KIM
cuuugacagcaucug

SEQ ID NO: 2321635 - RNA, 19 nt, Yersinia pestis KIM
cuuugacaugucccucugu

SEQ ID NO: 2321636 - RNA, 17 nt, Yersinia pestis KIM
cuuugcgcugauaacuu

SEQ ID NO: 2321637 - RNA, 17 nt, Yersinia pestis KIM
cuuugcgugacauacuu

SEQ ID NO: 2321638 - RNA, 12 nt, Yersinia pestis KIM
cuuugcuaguga

SEQ ID NO: 2321639 - RNA, 16 nt, Yersinia pestis KIM
cuuugcuuuucugccu

SEQ ID NO: 2321640 - RNA, 17 nt, Yersinia pestis KIM
cuuugcuuuucugccua

SEQ ID NO: 2321641 - RNA, 14 nt, Yersinia pestis KIM
cuuugcuuugacua

SEQ ID NO: 2321642 - RNA, 17 nt, Yersinia pestis KIM
cuuuggcaaucacaacc

SEQ ID NO: 2321643 - RNA, 13 nt, Yersinia pestis KIM
cuuugauagaaau

SEQ ID NO: 2321644 - RNA, 18 nt, Yersinia pestis KIM
cuuugauagaaauagcca

SEQ ID NO: 2321645 - RNA, 23 nt, Yersinia pestis KIM
cuuugauuugaacgacaugugag

SEQ ID NO: 2321646 - RNA, 14 nt, Yersinia pestis KIM
cuuugcauuuucug

SEQ ID NO: 2321647 - RNA, 15 nt, Yersinia pestis KIM
cuuugcauuuucugg

SEQ ID NO: 2321648 - RNA, 21 nt, Yersinia pestis KIM
cuuugcauuuucuggugagca

SEQ ID NO: 2321649 - RNA, 23 nt, Yersinia pestis KIM
cuuuaagauccaguucaguccag

SEQ ID NO: 2321650 - RNA, 24 nt, Yersinia pestis KIM
cuuuaagauccaguucaguccagc

SEQ ID NO: 2321651 - RNA, 23 nt, Yersinia pestis KIM
cuuuacggccgcuaguuugacgc

SEQ ID NO: 2321652 - RNA, 20 nt, Yersinia pestis KIM
cuuuacgcagcuuguugaua

SEQ ID NO: 2321653 - RNA, 23 nt, Yersinia pestis KIM
cuuuacgcagcuuguugauauca

SEQ ID NO: 2321654 - RNA, 15 nt, Yersinia pestis KIM
cuuuacuccucugcc

SEQ ID NO: 2321655 - RNA, 16 nt, Yersinia pestis KIM
cuuuacuccucugccu

SEQ ID NO: 2321656 - RNA, 17 nt, Yersinia pestis KIM
cuuuacuccucugccua

SEQ ID NO: 2321657 - RNA, 22 nt, Yersinia pestis KIM
cuuuacuccucugccuauccuc

SEQ ID NO: 2321658 - RNA, 12 nt, Yersinia pestis KIM
cuuuacugucag

SEQ ID NO: 2321659 - RNA, 16 nt, Yersinia pestis KIM
cuuuacugcauugaga

SEQ ID NO: 2321660 - RNA, 13 nt, Yersinia pestis KIM
cuuuaggaaagcc

SEQ ID NO: 2321661 - RNA, 21 nt, Yersinia pestis KIM
cuuuauacauauguugaguca

SEQ ID NO: 2321662 - RNA, 21 nt, Yersinia pestis KIM
cuuuaucgccagcugcaauug

SEQ ID NO: 2321663 - RNA, 14 nt, Yersinia pestis KIM
cuuuaggcaagagu

SEQ ID NO: 2321664 - RNA, 18 nt, Yersinia pestis KIM
cuuuagggcggccuuaau

SEQ ID NO: 2321665 - RNA, 19 nt, Yersinia pestis KIM
cuuucagaauugugccccu

SEQ ID NO: 2321666 - RNA, 21 nt, Yersinia pestis KIM
cuuucagacaagccagugacu

SEQ ID NO: 2321667 - RNA, 23 nt, Yersinia pestis KIM
cuuucaacuauugcaucuuuaau

SEQ ID NO: 2321668 - RNA, 15 nt, Yersinia pestis KIM
cuuuauuuuuuucca

SEQ ID NO: 2321669 - RNA, 16 nt, Yersinia pestis KIM
cuuggcaaagagacug

SEQ ID NO: 2321670 - RNA, 18 nt, Yersinia pestis KIM
cuuggcaccuaauaagcu

SEQ ID NO: 2321671 - RNA, 21 nt, Yersinia pestis KIM
cuugcuucugaacgaccagaa

SEQ ID NO: 2321672 - RNA, 18 nt, Yersinia pestis KIM
cuuggccggucguauuca

SEQ ID NO: 2321673 - RNA, 17 nt, Yersinia pestis KIM
cuuggcauguucagggu

SEQ ID NO: 2321674 - RNA, 14 nt, Yersinia pestis KIM
cuugggcagcgaca

SEQ ID NO: 2321675 - RNA, 18 nt, Yersinia pestis KIM
cuugggccgacucugcau

SEQ ID NO: 2321676 - RNA, 16 nt, Yersinia pestis KIM
cuuggggccucacucu

SEQ ID NO: 2321677 - RNA, 16 nt, Yersinia pestis KIM
cuuggguggucagcau

SEQ ID NO: 2321678 - RNA, 23 nt, Yersinia pestis KIM
cuugggucaguuuuauuaccaua

SEQ ID NO: 2321679 - RNA, 15 nt, Yersinia pestis KIM
cuuggcguaacugca

SEQ ID NO: 2321680 - RNA, 18 nt, Yersinia pestis KIM
cuuggcucuggagcucuc

SEQ ID NO: 2321681 - RNA, 23 nt, Yersinia pestis KIM
cuugggaucagccaucagcgccc

SEQ ID NO: 2321682 - RNA, 20 nt, Yersinia pestis KIM
cuugggagucagaugccgcu

SEQ ID NO: 2321683 - RNA, 19 nt, Yersinia pestis KIM
cuugguccgggauggaaau

SEQ ID NO: 2321684 - RNA, 18 nt, Yersinia pestis KIM
cuugguggagccuguaca

SEQ ID NO: 2321685 - RNA, 16 nt, Yersinia pestis KIM
cuuguauauaaaaaau

SEQ ID NO: 2321686 - RNA, 17 nt, Yersinia pestis KIM
cuuguauauaaaaaaug

SEQ ID NO: 2321687 - RNA, 14 nt, Yersinia pestis KIM
cuuguauccuggcc

SEQ ID NO: 2321688 - RNA, 12 nt, Yersinia pestis KIM
cuugguuguuuc

SEQ ID NO: 2321689 - RNA, 13 nt, Yersinia pestis KIM
cuugguuaguucu

SEQ ID NO: 2321690 - RNA, 18 nt, Yersinia pestis KIM
cuugccauaagugaacau

SEQ ID NO: 2321691 - RNA, 21 nt, Yersinia pestis KIM
cuugccacgccaguaaacagc

SEQ ID NO: 2321692 - RNA, 19 nt, Yersinia pestis KIM
cuugccacgccaguaaaca

SEQ ID NO: 2321693 - RNA, 12 nt, Yersinia pestis KIM
cuugcaucccca

SEQ ID NO: 2321694 - RNA, 18 nt, Yersinia pestis KIM
cuugcaacaaaauggccu

SEQ ID NO: 2321695 - RNA, 22 nt, Yersinia pestis KIM
cuugcaacaacucgaacaaccg

SEQ ID NO: 2321696 - RNA, 15 nt, Yersinia pestis KIM
cuugcauaucagcaa

SEQ ID NO: 2321697 - RNA, 21 nt, Yersinia pestis KIM
cuugaucggauaguuaucugg

SEQ ID NO: 2321698 - RNA, 19 nt, Yersinia pestis KIM
cuugaucgccaaauaaaca

SEQ ID NO: 2321699 - RNA, 20 nt, Yersinia pestis KIM
cuugagauccuccauauccu

SEQ ID NO: 2321700 - RNA, 14 nt, Yersinia pestis KIM
cuugacugaccaua

SEQ ID NO: 2321701 - RNA, 16 nt, Yersinia pestis KIM
cuugacugcguucugc

SEQ ID NO: 2321702 - RNA, 13 nt, Yersinia pestis KIM
cuucuuuuaaaga

SEQ ID NO: 2321703 - RNA, 17 nt, Yersinia pestis KIM
cuucuuugacauguccc

SEQ ID NO: 2321704 - RNA, 18 nt, Yersinia pestis KIM
cuugaccuugccuugcau

SEQ ID NO: 2321705 - RNA, 15 nt, Yersinia pestis KIM
cuugaaucaaaauac

SEQ ID NO: 2321706 - RNA, 21 nt, Yersinia pestis KIM
cuugaauaauaggcugaucaa

SEQ ID NO: 2321707 - RNA, 13 nt, Yersinia pestis KIM
cgcccguugccca

SEQ ID NO: 2321708 - RNA, 16 nt, Yersinia pestis KIM
cgcccguuggccggcc

SEQ ID NO: 2321709 - RNA, 17 nt, Yersinia pestis KIM
cgcccguuggccggcca

SEQ ID NO: 2321710 - RNA, 18 nt, Yersinia pestis KIM
cgcccucuugcugaguga

SEQ ID NO: 2321711 - RNA, 13 nt, Yersinia pestis KIM
cgccgccgccagc

SEQ ID NO: 2321712 - RNA, 13 nt, Yersinia pestis KIM
cgccgcucaauua

SEQ ID NO: 2321713 - RNA, 17 nt, Yersinia pestis KIM
cgccgcuaaaucaucaa

SEQ ID NO: 2321714 - RNA, 22 nt, Yersinia pestis KIM
cgccgcgugacuauucugccua

SEQ ID NO: 2321715 - RNA, 21 nt, Yersinia pestis KIM
cgccgccucuucugucggagc

SEQ ID NO: 2321716 - RNA, 13 nt, Yersinia pestis KIM
cgccggguuuugc

SEQ ID NO: 2321717 - RNA, 23 nt, Yersinia pestis KIM
cgcgcauauaggcgaaaggcgca

SEQ ID NO: 2321718 - RNA, 16 nt, Yersinia pestis KIM
cgcgccauccuugccu

SEQ ID NO: 2321719 - RNA, 15 nt, Yersinia pestis KIM
cgcgccauccuugcc

SEQ ID NO: 2321720 - RNA, 14 nt, Yersinia pestis KIM
cgcgccagggaggg

SEQ ID NO: 2321721 - RNA, 15 nt, Yersinia pestis KIM
cgcgcccucccuggc

SEQ ID NO: 2321722 - RNA, 18 nt, Yersinia pestis KIM
cgcgaugacacaauuccc

SEQ ID NO: 2321723 - RNA, 17 nt, Yersinia pestis KIM
cgcgacucaagccucua

SEQ ID NO: 2321724 - RNA, 17 nt, Yersinia pestis KIM
cgcgaccagcagaauaa

SEQ ID NO: 2321725 - RNA, 20 nt, Yersinia pestis KIM
cgccuuuuuuauaauaaugg

SEQ ID NO: 2321726 - RNA, 16 nt, Yersinia pestis KIM
cgccuuucccgcuagc

SEQ ID NO: 2321727 - RNA, 12 nt, Yersinia pestis KIM
cgccugggaucc

SEQ ID NO: 2321728 - RNA, 22 nt, Yersinia pestis KIM
cgccuguuucggcaggcagaaa

SEQ ID NO: 2321729 - RNA, 16 nt, Yersinia pestis KIM
cgccuuaucagcgaaa

SEQ ID NO: 2321730 - RNA, 16 nt, Yersinia pestis KIM
cgccuucauguugcaa

SEQ ID NO: 2321731 - RNA, 20 nt, Yersinia pestis KIM
cgccucaguaucuuuccagc

SEQ ID NO: 2321732 - RNA, 15 nt, Yersinia pestis KIM
cgccucugcuccggu

SEQ ID NO: 2321733 - RNA, 22 nt, Yersinia pestis KIM
cgccugacugcccgccugcuug

SEQ ID NO: 2321734 - RNA, 20 nt, Yersinia pestis KIM
cgccugacugcccgccugcu

SEQ ID NO: 2321735 - RNA, 21 nt, Yersinia pestis KIM
cgccugauagcgcacugucug

SEQ ID NO: 2321736 - RNA, 15 nt, Yersinia pestis KIM
cgccugaucgauaac

SEQ ID NO: 2321737 - RNA, 19 nt, Yersinia pestis KIM
cgccucgcuuacugguacc

SEQ ID NO: 2321738 - RNA, 19 nt, Yersinia pestis KIM
cgccuaaaaaugauuucag

SEQ ID NO: 2321739 - RNA, 23 nt, Yersinia pestis KIM
cgccguggcgacagcuauuuauu

SEQ ID NO: 2321740 - RNA, 15 nt, Yersinia pestis KIM
cgauccgcuuuuuag

SEQ ID NO: 2321741 - RNA, 21 nt, Yersinia pestis KIM
cgauccgggaaaaaauacgcu

SEQ ID NO: 2321742 - RNA, 17 nt, Yersinia pestis KIM
cgaucagaacuaacacu

SEQ ID NO: 2321743 - RNA, 16 nt, Yersinia pestis KIM
cgaucagcaauaugcu

SEQ ID NO: 2321744 - RNA, 13 nt, Yersinia pestis KIM
cgauaucaauaaa

SEQ ID NO: 2321745 - RNA, 18 nt, Yersinia pestis KIM
cgaucagcguauaaaacu

SEQ ID NO: 2321746 - RNA, 21 nt, Yersinia pestis KIM
cgauccaaaacaucggccagc

SEQ ID NO: 2321747 - RNA, 17 nt, Yersinia pestis KIM
cgauacguugcagguca

SEQ ID NO: 2321748 - RNA, 18 nt, Yersinia pestis KIM
cgauacucgauaccagcg

SEQ ID NO: 2321749 - RNA, 22 nt, Yersinia pestis KIM
cgauagugcuuccaacucaccu

SEQ ID NO: 2321750 - RNA, 16 nt, Yersinia pestis KIM
cgauacgacuucuuau

SEQ ID NO: 2321751 - RNA, 19 nt, Yersinia pestis KIM
ccuucaucgacaauggcug

SEQ ID NO: 2321752 - RNA, 18 nt, Yersinia pestis KIM
ccuucaucgacaauggcu

SEQ ID NO: 2321753 - RNA, 21 nt, Yersinia pestis KIM
cgauaaaccaacugaaacugg

SEQ ID NO: 2321754 - RNA, 17 nt, Yersinia pestis KIM
cgauaaaauucagccac

SEQ ID NO: 2321755 - RNA, 19 nt, Yersinia pestis KIM
cgauaaaagauuuccuuuc

SEQ ID NO: 2321756 - RNA, 18 nt, Yersinia pestis KIM
ccuucauuugacuuuguc

SEQ ID NO: 2321757 - RNA, 11 nt, Yersinia pestis KIM
cgauaaauaau

SEQ ID NO: 2321758 - RNA, 13 nt, Yersinia pestis KIM
cgauaaauaauua

SEQ ID NO: 2321759 - RNA, 20 nt, Yersinia pestis KIM
cgauaaauaauuacuuauaa

SEQ ID NO: 2321760 - RNA, 23 nt, Yersinia pestis KIM
cgauaaauagucguuauauaaau

SEQ ID NO: 2321761 - RNA, 14 nt, Yersinia pestis KIM
cgauaaacuucaca

SEQ ID NO: 2321762 - RNA, 20 nt, Yersinia pestis KIM
cgaucugccuguucucuccc

SEQ ID NO: 2321763 - RNA, 17 nt, Yersinia pestis KIM
cgaucugaagaugcuga

SEQ ID NO: 2321764 - RNA, 18 nt, Yersinia pestis KIM
cgaucugauaucucuuua

SEQ ID NO: 2321765 - RNA, 14 nt, Yersinia pestis KIM
cgaugaaaaacaga

SEQ ID NO: 2321766 - RNA, 16 nt, Yersinia pestis KIM
cgaucuugaacgguga

SEQ ID NO: 2321767 - RNA, 16 nt, Yersinia pestis KIM
cgaugacgcgaucuug

SEQ ID NO: 2321768 - RNA, 14 nt, Yersinia pestis KIM
cgaugaccuggaag

SEQ ID NO: 2321769 - RNA, 20 nt, Yersinia pestis KIM
cgaugaccgugacauuuuca

SEQ ID NO: 2321770 - RNA, 19 nt, Yersinia pestis KIM
cgaugaccauuuauuucca

SEQ ID NO: 2321771 - RNA, 20 nt, Yersinia pestis KIM
cgaugauauacccaccagag

SEQ ID NO: 2321772 - RNA, 15 nt, Yersinia pestis KIM
cgaugaugauuauuu

SEQ ID NO: 2321773 - RNA, 22 nt, Yersinia pestis KIM
cgaugcccccuacauagcgcau

SEQ ID NO: 2321774 - RNA, 13 nt, Yersinia pestis KIM
cgaugucaauaaa

SEQ ID NO: 2321775 - RNA, 24 nt, Yersinia pestis KIM
cgcaguacgugacggcggcgagca

SEQ ID NO: 2321776 - RNA, 20 nt, Yersinia pestis KIM
cgcaguacgugacggcagcg

SEQ ID NO: 2321777 - RNA, 15 nt, Yersinia pestis KIM
cgcagguuggcggca

SEQ ID NO: 2321778 - RNA, 23 nt, Yersinia pestis KIM
cgcaggaacgaaguuagacccaa

SEQ ID NO: 2321779 - RNA, 16 nt, Yersinia pestis KIM
cgcaggauaaagcuga

SEQ ID NO: 2321780 - RNA, 15 nt, Yersinia pestis KIM
cgcagcggcuagcag

SEQ ID NO: 2321781 - RNA, 23 nt, Yersinia pestis KIM
cgcacugagggugauaucgucag

SEQ ID NO: 2321782 - RNA, 13 nt, Yersinia pestis KIM
cgcacugcaugcc

SEQ ID NO: 2321783 - RNA, 22 nt, Yersinia pestis KIM
cgcacuuaaugccgcugaucag

SEQ ID NO: 2321784 - RNA, 22 nt, Yersinia pestis KIM
cgcacugggucaucacccagca

SEQ ID NO: 2321785 - RNA, 12 nt, Yersinia pestis KIM
cgcagcagggcu

SEQ ID NO: 2321786 - RNA, 20 nt, Yersinia pestis KIM
cgcaccauccagcaaaucau

SEQ ID NO: 2321787 - RNA, 14 nt, Yersinia pestis KIM
cgcaccauaaccaa

SEQ ID NO: 2321788 - RNA, 16 nt, Yersinia pestis KIM
cgcacccuccaauaau

SEQ ID NO: 2321789 - RNA, 15 nt, Yersinia pestis KIM
cgcaccugcccagac

SEQ ID NO: 2321790 - RNA, 14 nt, Yersinia pestis KIM
cgcaaaucaccuug

SEQ ID NO: 2321791 - RNA, 17 nt, Yersinia pestis KIM
cgcaaagggcaacaaua

SEQ ID NO: 2321792 - RNA, 18 nt, Yersinia pestis KIM
cgauuaauuaguuuuaau

SEQ ID NO: 2321793 - RNA, 18 nt, Yersinia pestis KIM
cgauuauccgcaccauag

SEQ ID NO: 2321794 - RNA, 22 nt, Yersinia pestis KIM
cgauuaaacgucucuuuuucau

SEQ ID NO: 2321795 - RNA, 19 nt, Yersinia pestis KIM
cgccccacaaugucccguc

SEQ ID NO: 2321796 - RNA, 14 nt, Yersinia pestis KIM
cgccccccgccugc

SEQ ID NO: 2321797 - RNA, 13 nt, Yersinia pestis KIM
cgcccccgccagg

SEQ ID NO: 2321798 - RNA, 20 nt, Yersinia pestis KIM
cgccccuuagcgcacgggga

SEQ ID NO: 2321799 - RNA, 13 nt, Yersinia pestis KIM
cgcccgcgccaga

SEQ ID NO: 2321800 - RNA, 17 nt, Yersinia pestis KIM
cgcccgcgccagauguu

SEQ ID NO: 2321801 - RNA, 17 nt, Yersinia pestis KIM
cgcccgcggccaauagc

SEQ ID NO: 2321802 - RNA, 13 nt, Yersinia pestis KIM
cgcccgcggccaa

SEQ ID NO: 2321803 - RNA, 13 nt, Yersinia pestis KIM
cgcccggcugacc

SEQ ID NO: 2321804 - RNA, 16 nt, Yersinia pestis KIM
cgcccgguaauaauga

SEQ ID NO: 2321805 - RNA, 14 nt, Yersinia pestis KIM
cgccauccgcaccu

SEQ ID NO: 2321806 - RNA, 13 nt, Yersinia pestis KIM
cgccauccuuggc

SEQ ID NO: 2321807 - RNA, 21 nt, Yersinia pestis KIM
cgccaugagaaccaguucugg

SEQ ID NO: 2321808 - RNA, 16 nt, Yersinia pestis KIM
cgcccaacucuuuagc

SEQ ID NO: 2321809 - RNA, 20 nt, Yersinia pestis KIM
cgccaugcucagaaaccugu

SEQ ID NO: 2321810 - RNA, 17 nt, Yersinia pestis KIM
cgccauugcauauugcu

SEQ ID NO: 2321811 - RNA, 19 nt, Yersinia pestis KIM
cgccauugagucguuauaa

SEQ ID NO: 2321812 - RNA, 23 nt, Yersinia pestis KIM
cgccacagcaacaggguaauaac

SEQ ID NO: 2321813 - RNA, 19 nt, Yersinia pestis KIM
cgccacaauauuccggcau

SEQ ID NO: 2321814 - RNA, 13 nt, Yersinia pestis KIM
cgcauaagacacc

SEQ ID NO: 2321815 - RNA, 17 nt, Yersinia pestis KIM
cgccaguggcaucaaua

SEQ ID NO: 2321816 - RNA, 12 nt, Yersinia pestis KIM
cgccaucaauaa

SEQ ID NO: 2321817 - RNA, 14 nt, Yersinia pestis KIM
cgccauauccaacu

SEQ ID NO: 2321818 - RNA, 20 nt, Yersinia pestis KIM
cgccauaaugcggcucucuu

SEQ ID NO: 2321819 - RNA, 23 nt, Yersinia pestis KIM
cgccagguaagaaagagaugacc

SEQ ID NO: 2321820 - RNA, 18 nt, Yersinia pestis KIM
cgccagugccgcggcggc

SEQ ID NO: 2321821 - RNA, 19 nt, Yersinia pestis KIM
cgccagugccgcggcggcc

SEQ ID NO: 2321822 - RNA, 17 nt, Yersinia pestis KIM
cgccagcuauugcuuuu

SEQ ID NO: 2321823 - RNA, 12 nt, Yersinia pestis KIM
cgccagcugacc

SEQ ID NO: 2321824 - RNA, 17 nt, Yersinia pestis KIM
cggccauuugcucuggc

SEQ ID NO: 2321825 - RNA, 18 nt, Yersinia pestis KIM
cggcccaauauugaucca

SEQ ID NO: 2321826 - RNA, 17 nt, Yersinia pestis KIM
cggccagucaaaagaaa

SEQ ID NO: 2321827 - RNA, 15 nt, Yersinia pestis KIM
cggcaucggccccug

SEQ ID NO: 2321828 - RNA, 16 nt, Yersinia pestis KIM
cggcccggccaggcuc

SEQ ID NO: 2321829 - RNA, 14 nt, Yersinia pestis KIM
cggcccggccaggc

SEQ ID NO: 2321830 - RNA, 23 nt, Yersinia pestis KIM
cggcccgcagauaauccccuugu

SEQ ID NO: 2321831 - RNA, 22 nt, Yersinia pestis KIM
cggcccugagguugcucagcgg

SEQ ID NO: 2321832 - RNA, 18 nt, Yersinia pestis KIM
cggcccguaaacgggcua

SEQ ID NO: 2321833 - RNA, 17 nt, Yersinia pestis KIM
cggccuaucaucaccau

SEQ ID NO: 2321834 - RNA, 12 nt, Yersinia pestis KIM
cggccugccaga

SEQ ID NO: 2321835 - RNA, 23 nt, Yersinia pestis KIM
cggcaaauuaaugucgccauaac

SEQ ID NO: 2321836 - RNA, 17 nt, Yersinia pestis KIM
cggcaaauagagcacca

SEQ ID NO: 2321837 - RNA, 18 nt, Yersinia pestis KIM
cggcaaauagagcaccaa

SEQ ID NO: 2321838 - RNA, 16 nt, Yersinia pestis KIM
cggcaccaaccauuga

SEQ ID NO: 2321839 - RNA, 16 nt, Yersinia pestis KIM
cggcacugcaucugac

SEQ ID NO: 2321840 - RNA, 16 nt, Yersinia pestis KIM
cggcaccugcccgccc

SEQ ID NO: 2321841 - RNA, 20 nt, Yersinia pestis KIM
cggcagggcgguaacgcaga

SEQ ID NO: 2321842 - RNA, 18 nt, Yersinia pestis KIM
cggcaguaaucuccccgc

SEQ ID NO: 2321843 - RNA, 20 nt, Yersinia pestis KIM
cggcagugaucgcacuucaa

SEQ ID NO: 2321844 - RNA, 18 nt, Yersinia pestis KIM
cggcauaauuucaggucg

SEQ ID NO: 2321845 - RNA, 17 nt, Yersinia pestis KIM
cggcauaacaggugcag

SEQ ID NO: 2321846 - RNA, 23 nt, Yersinia pestis KIM
cggcaguuugaguguggugagcc

SEQ ID NO: 2321847 - RNA, 17 nt, Yersinia pestis KIM
cggcagcgagcacugcc

SEQ ID NO: 2321848 - RNA, 20 nt, Yersinia pestis KIM
cggcagcgagcacugccccg

SEQ ID NO: 2321849 - RNA, 20 nt, Yersinia pestis KIM
cggauggcgcgguucuagua

SEQ ID NO: 2321850 - RNA, 17 nt, Yersinia pestis KIM
cggaugcaucgggcaua

SEQ ID NO: 2321851 - RNA, 17 nt, Yersinia pestis KIM
cggaugccgcuccagca

SEQ ID NO: 2321852 - RNA, 23 nt, Yersinia pestis KIM
cggaucugcaacuucagccacca

SEQ ID NO: 2321853 - RNA, 13 nt, Yersinia pestis KIM
cggauucacccau

SEQ ID NO: 2321854 - RNA, 23 nt, Yersinia pestis KIM
cggauucacccauuaauagacga

SEQ ID NO: 2321855 - RNA, 13 nt, Yersinia pestis KIM
cggagcaagggcg

SEQ ID NO: 2321856 - RNA, 15 nt, Yersinia pestis KIM
cggaaauuaaaaauu

SEQ ID NO: 2321857 - RNA, 19 nt, Yersinia pestis KIM
cggaaccuuucgaguugaa

SEQ ID NO: 2321858 - RNA, 18 nt, Yersinia pestis KIM
cggauaacggcggcaaua

SEQ ID NO: 2321859 - RNA, 20 nt, Yersinia pestis KIM
cggauaaccgcauucccugc

SEQ ID NO: 2321860 - RNA, 17 nt, Yersinia pestis KIM
cgcgguucgcagcuucc

SEQ ID NO: 2321861 - RNA, 22 nt, Yersinia pestis KIM
cgcgguuggguucaauucccaa

SEQ ID NO: 2321862 - RNA, 16 nt, Yersinia pestis KIM
cgcuaaccaccgucac

SEQ ID NO: 2321863 - RNA, 14 nt, Yersinia pestis KIM
cgcuaacaugccac

SEQ ID NO: 2321864 - RNA, 14 nt, Yersinia pestis KIM
cgcuauuucucucu

SEQ ID NO: 2321865 - RNA, 15 nt, Yersinia pestis KIM
cgcucacuuuuauau

SEQ ID NO: 2321866 - RNA, 22 nt, Yersinia pestis KIM
cgcucacuuuuauauccgccau

SEQ ID NO: 2321867 - RNA, 23 nt, Yersinia pestis KIM
cgcuaucugcugaccauuacgua

SEQ ID NO: 2321868 - RNA, 12 nt, Yersinia pestis KIM
cgcuaugcuaaa

SEQ ID NO: 2321869 - RNA, 14 nt, Yersinia pestis KIM
cgcuagauuuucuu

SEQ ID NO: 2321870 - RNA, 22 nt, Yersinia pestis KIM
cgcggguuaucacauaaauaag

SEQ ID NO: 2321871 - RNA, 15 nt, Yersinia pestis KIM
cgcggcaaagucugg

SEQ ID NO: 2321872 - RNA, 19 nt, Yersinia pestis KIM
cgcuuuacuccucugccua

SEQ ID NO: 2321873 - RNA, 22 nt, Yersinia pestis KIM
cgcuuuaucuccgccauugagu

SEQ ID NO: 2321874 - RNA, 20 nt, Yersinia pestis KIM
cgcuuucagcacgcuuucca

SEQ ID NO: 2321875 - RNA, 13 nt, Yersinia pestis KIM
cgcuuuuuacuga

SEQ ID NO: 2321876 - RNA, 21 nt, Yersinia pestis KIM
cgcuguacaacaagaucccaa

SEQ ID NO: 2321877 - RNA, 18 nt, Yersinia pestis KIM
cgcuguaggugucaccaa

SEQ ID NO: 2321878 - RNA, 16 nt, Yersinia pestis KIM
cgcugucugaauagug

SEQ ID NO: 2321879 - RNA, 22 nt, Yersinia pestis KIM
cgcuguguuuugcuaaccgccu

SEQ ID NO: 2321880 - RNA, 13 nt, Yersinia pestis KIM
cgcugcugaauuc

SEQ ID NO: 2321881 - RNA, 17 nt, Yersinia pestis KIM
cgcugcuaaacaggguu

SEQ ID NO: 2321882 - RNA, 14 nt, Yersinia pestis KIM
cgcuggcauacuga

SEQ ID NO: 2321883 - RNA, 16 nt, Yersinia pestis KIM
cgcugaucaucaucaa

SEQ ID NO: 2321884 - RNA, 16 nt, Yersinia pestis KIM
cgcugauaacuuccuu

SEQ ID NO: 2321885 - RNA, 23 nt, Yersinia pestis KIM
cgcugagguucuccaacaaccgu

SEQ ID NO: 2321886 - RNA, 20 nt, Yersinia pestis KIM
cgcugagguucuccaacaac

SEQ ID NO: 2321887 - RNA, 21 nt, Yersinia pestis KIM
cgcucuaacgucagauaaaaa

SEQ ID NO: 2321888 - RNA, 16 nt, Yersinia pestis KIM
cgcucuacaacgucca

SEQ ID NO: 2321889 - RNA, 12 nt, Yersinia pestis KIM
cgcucuccccau

SEQ ID NO: 2321890 - RNA, 16 nt, Yersinia pestis KIM
cggggguugucagcag

SEQ ID NO: 2321891 - RNA, 22 nt, Yersinia pestis KIM
cggggguugucagcagucugau

SEQ ID NO: 2321892 - RNA, 22 nt, Yersinia pestis KIM
cgggcuuuuuuucggcaucuua

SEQ ID NO: 2321893 - RNA, 21 nt, Yersinia pestis KIM
cgggcuucuaggugcucugcc

SEQ ID NO: 2321894 - RNA, 21 nt, Yersinia pestis KIM
cgggcugucggcgaugaaaaa

SEQ ID NO: 2321895 - RNA, 17 nt, Yersinia pestis KIM
cgggcuuccaucaggaa

SEQ ID NO: 2321896 - RNA, 17 nt, Yersinia pestis KIM
cggguauuacgggcgau

SEQ ID NO: 2321897 - RNA, 16 nt, Yersinia pestis KIM
cggguauuugucgucc

SEQ ID NO: 2321898 - RNA, 19 nt, Yersinia pestis KIM
cggggucuuuucgguaaua

SEQ ID NO: 2321899 - RNA, 21 nt, Yersinia pestis KIM
cgggcuaucaucaaaggcaau

SEQ ID NO: 2321900 - RNA, 15 nt, Yersinia pestis KIM
cgggcggauccccug

SEQ ID NO: 2321901 - RNA, 19 nt, Yersinia pestis KIM
cgggcgcuuaaauaaaaca

SEQ ID NO: 2321902 - RNA, 12 nt, Yersinia pestis KIM
cgggcgcaggcg

SEQ ID NO: 2321903 - RNA, 16 nt, Yersinia pestis KIM
cgggcgcaauggaaga

SEQ ID NO: 2321904 - RNA, 17 nt, Yersinia pestis KIM
cgggcgaacagaaauca

SEQ ID NO: 2321905 - RNA, 17 nt, Yersinia pestis KIM
cgggccgcauucaccac

SEQ ID NO: 2321906 - RNA, 22 nt, Yersinia pestis KIM
cgggccgagucacgaaggcaac

SEQ ID NO: 2321907 - RNA, 21 nt, Yersinia pestis KIM
cgggaaucaauuugaacaaca

SEQ ID NO: 2321908 - RNA, 14 nt, Yersinia pestis KIM
cgggaaucuugauu

SEQ ID NO: 2321909 - RNA, 22 nt, Yersinia pestis KIM
cggcuuuuuaaacuuguaucaa

SEQ ID NO: 2321910 - RNA, 21 nt, Yersinia pestis KIM
cggcguuaaugccacccccag

SEQ ID NO: 2321911 - RNA, 18 nt, Yersinia pestis KIM
cggcguuacuggcgaccg

SEQ ID NO: 2321912 - RNA, 20 nt, Yersinia pestis KIM
cggcuaaugagcucacuuga

SEQ ID NO: 2321913 - RNA, 16 nt, Yersinia pestis KIM
cggcuaaccacagcaa

SEQ ID NO: 2321914 - RNA, 20 nt, Yersinia pestis KIM
cggcucacacacuaauaaua

SEQ ID NO: 2321915 - RNA, 11 nt, Yersinia pestis KIM
cggcuauuuuu

SEQ ID NO: 2321916 - RNA, 18 nt, Yersinia pestis KIM
cggcucgcccacggcaca

SEQ ID NO: 2321917 - RNA, 14 nt, Yersinia pestis KIM
cggcucauccgcca

SEQ ID NO: 2321918 - RNA, 17 nt, Yersinia pestis KIM
cggcugggaacccauca

SEQ ID NO: 2321919 - RNA, 22 nt, Yersinia pestis KIM
cggcuuuaauccauucacgccc

SEQ ID NO: 2321920 - RNA, 14 nt, Yersinia pestis KIM
cggcuuucaauaaa

SEQ ID NO: 2321921 - RNA, 18 nt, Yersinia pestis KIM
cggcuuucaggugacuga

SEQ ID NO: 2321922 - RNA, 22 nt, Yersinia pestis KIM
cggcuuaaccaacaacuccacu

SEQ ID NO: 2321923 - RNA, 14 nt, Yersinia pestis KIM
cggcguaaauaaaa

SEQ ID NO: 2321924 - RNA, 15 nt, Yersinia pestis KIM
cggcggcgcuggcgu

SEQ ID NO: 2321925 - RNA, 22 nt, Yersinia pestis KIM
cggcggcgcuggcguaaaauau

SEQ ID NO: 2321926 - RNA, 13 nt, Yersinia pestis KIM
cggcggcuuuauu

SEQ ID NO: 2321927 - RNA, 20 nt, Yersinia pestis KIM
cggucgaacccauucaucaa

SEQ ID NO: 2321928 - RNA, 18 nt, Yersinia pestis KIM
cggucacaccagacagaa

SEQ ID NO: 2321929 - RNA, 15 nt, Yersinia pestis KIM
cggucacacuggcac

SEQ ID NO: 2321930 - RNA, 21 nt, Yersinia pestis KIM
cggucaauaccauauccacgg

SEQ ID NO: 2321931 - RNA, 21 nt, Yersinia pestis KIM
cggucagguggugcccgacca

SEQ ID NO: 2321932 - RNA, 16 nt, Yersinia pestis KIM
cggucuaaugcaauuu

SEQ ID NO: 2321933 - RNA, 15 nt, Yersinia pestis KIM
cggugauuccaauga

SEQ ID NO: 2321934 - RNA, 17 nt, Yersinia pestis KIM
cgguggcuuacgccacu

SEQ ID NO: 2321935 - RNA, 19 nt, Yersinia pestis KIM
cgguuauaaaacagccacg

SEQ ID NO: 2321936 - RNA, 16 nt, Yersinia pestis KIM
cgguuacuuccauaaa

SEQ ID NO: 2321937 - RNA, 19 nt, Yersinia pestis KIM
cgguuacccucuauuaucu

SEQ ID NO: 2321938 - RNA, 20 nt, Yersinia pestis KIM
cgguugcuguaaugccuggu

SEQ ID NO: 2321939 - RNA, 21 nt, Yersinia pestis KIM
cgguugucaugcuguagcagc

SEQ ID NO: 2321940 - RNA, 22 nt, Yersinia pestis KIM
cgguuggucagcacuuccaacu

SEQ ID NO: 2321941 - RNA, 12 nt, Yersinia pestis KIM
cgguuauuuucu

SEQ ID NO: 2321942 - RNA, 16 nt, Yersinia pestis KIM
cgguuuaugcccagaa

SEQ ID NO: 2321943 - RNA, 13 nt, Yersinia pestis KIM
cgguuguggcugc

SEQ ID NO: 2321944 - RNA, 15 nt, Yersinia pestis KIM
cgguuguggcugcca

SEQ ID NO: 2321945 - RNA, 18 nt, Yersinia pestis KIM
cgguuucagugccaauaa

SEQ ID NO: 2321946 - RNA, 16 nt, Yersinia pestis KIM
cgguuuccggcucuua

SEQ ID NO: 2321947 - RNA, 19 nt, Yersinia pestis KIM
cgguuucgcaucaggcuua

SEQ ID NO: 2321948 - RNA, 19 nt, Yersinia pestis KIM
cgguuugagcuugcugcug

SEQ ID NO: 2321949 - RNA, 15 nt, Yersinia pestis KIM
cgguuugagcuugcu

SEQ ID NO: 2321950 - RNA, 13 nt, Yersinia pestis KIM
cgguuuguugcua

SEQ ID NO: 2321951 - RNA, 12 nt, Yersinia pestis KIM
cgguuuuaaaua

SEQ ID NO: 2321952 - RNA, 14 nt, Yersinia pestis KIM
cgguuuuaaauaca

SEQ ID NO: 2321953 - RNA, 12 nt, Yersinia pestis KIM
cguaaacacaaa

SEQ ID NO: 2321954 - RNA, 13 nt, Yersinia pestis KIM
cguaaacacaaaa

SEQ ID NO: 2321955 - RNA, 15 nt, Yersinia pestis KIM
cguaaacaucuuuug

SEQ ID NO: 2321956 - RNA, 17 nt, Yersinia pestis KIM
cguaacccuaaugauua

SEQ ID NO: 2321957 - RNA, 20 nt, Yersinia pestis KIM
cguaacccaucacccgcagu

SEQ ID NO: 2321958 - RNA, 14 nt, Yersinia pestis KIM
cguaaagacgccgg

SEQ ID NO: 2321959 - RNA, 18 nt, Yersinia pestis KIM
cguaaacguucugccaau

SEQ ID NO: 2321960 - RNA, 15 nt, Yersinia pestis KIM
cguaaagaaaaaaug

SEQ ID NO: 2321961 - RNA, 11 nt, Yersinia pestis KIM
cguaaagcacc

SEQ ID NO: 2321962 - RNA, 20 nt, Yersinia pestis KIM
cguaacccagauuaggggcu

SEQ ID NO: 2321963 - RNA, 15 nt, Yersinia pestis KIM
cguauaacauaauaa

SEQ ID NO: 2321964 - RNA, 16 nt, Yersinia pestis KIM
cguauaacgcagcccc

SEQ ID NO: 2321965 - RNA, 19 nt, Yersinia pestis KIM
cguagguuucagccucuga

SEQ ID NO: 2321966 - RNA, 21 nt, Yersinia pestis KIM
cguaucagccccuaaauccug

SEQ ID NO: 2321967 - RNA, 23 nt, Yersinia pestis KIM
cguaucacccgccucuaaaucug

SEQ ID NO: 2321968 - RNA, 15 nt, Yersinia pestis KIM
cguauagauuauuuu

SEQ ID NO: 2321969 - RNA, 20 nt, Yersinia pestis KIM
cguaucuuguaguaaccaca

SEQ ID NO: 2321970 - RNA, 18 nt, Yersinia pestis KIM
cguauuuucauuuuaaca

SEQ ID NO: 2321971 - RNA, 20 nt, Yersinia pestis KIM
cguagguaauuaaacgcuca

SEQ ID NO: 2321972 - RNA, 17 nt, Yersinia pestis KIM
cguagguaacuaagcug

SEQ ID NO: 2321973 - RNA, 19 nt, Yersinia pestis KIM
cguagguaacuaagcugcc

SEQ ID NO: 2321974 - RNA, 15 nt, Yersinia pestis KIM
cguaggcaaacaugg

SEQ ID NO: 2321975 - RNA, 21 nt, Yersinia pestis KIM
cguaggccacccccauaacca

SEQ ID NO: 2321976 - RNA, 17 nt, Yersinia pestis KIM
cguaggcaacuaagcug

SEQ ID NO: 2321977 - RNA, 19 nt, Yersinia pestis KIM
cguaggcaacuaagcugcc

SEQ ID NO: 2321978 - RNA, 12 nt, Yersinia pestis KIM
cguaggccaacc

SEQ ID NO: 2321979 - RNA, 16 nt, Yersinia pestis KIM
cguagccguuaaauau

SEQ ID NO: 2321980 - RNA, 22 nt, Yersinia pestis KIM
cguagccauuggguauggucag

SEQ ID NO: 2321981 - RNA, 18 nt, Yersinia pestis KIM
cguagaacgucaccgcca

SEQ ID NO: 2321982 - RNA, 16 nt, Yersinia pestis KIM
cguaacucaccgucug

SEQ ID NO: 2321983 - RNA, 18 nt, Yersinia pestis KIM
cgucagaucgcgcccauc

SEQ ID NO: 2321984 - RNA, 13 nt, Yersinia pestis KIM
cgucagaugcuga

SEQ ID NO: 2321985 - RNA, 14 nt, Yersinia pestis KIM
cgucauccagcacu

SEQ ID NO: 2321986 - RNA, 19 nt, Yersinia pestis KIM
cgucagugcgguaaccagc

SEQ ID NO: 2321987 - RNA, 21 nt, Yersinia pestis KIM
cgucauaccauucucugucuu

SEQ ID NO: 2321988 - RNA, 13 nt, Yersinia pestis KIM
cgucaucaucuuc

SEQ ID NO: 2321989 - RNA, 23 nt, Yersinia pestis KIM
cgucaccaucaauauaagagaaa

SEQ ID NO: 2321990 - RNA, 19 nt, Yersinia pestis KIM
cgucaccgccaaaauaaac

SEQ ID NO: 2321991 - RNA, 21 nt, Yersinia pestis KIM
cgucacgguauuggagcugaa

SEQ ID NO: 2321992 - RNA, 14 nt, Yersinia pestis KIM
cgucaaguucauau

SEQ ID NO: 2321993 - RNA, 20 nt, Yersinia pestis KIM
cgucaagguacccauuauuc

SEQ ID NO: 2321994 - RNA, 19 nt, Yersinia pestis KIM
cgucaagacaacaaacagu

SEQ ID NO: 2321995 - RNA, 17 nt, Yersinia pestis KIM
cgucaagccaaccccca

SEQ ID NO: 2321996 - RNA, 12 nt, Yersinia pestis KIM
cgucacacuggu

SEQ ID NO: 2321997 - RNA, 18 nt, Yersinia pestis KIM
cgucaccacaaaggucag

SEQ ID NO: 2321998 - RNA, 18 nt, Yersinia pestis KIM
cgucaauucacugcuagu

SEQ ID NO: 2321999 - RNA, 11 nt, Yersinia pestis KIM
cccgcaggcgg

SEQ ID NO: 2322000 - RNA, 18 nt, Yersinia pestis KIM
cccgcagcggcuagcagc

SEQ ID NO: 2322001 - RNA, 22 nt, Yersinia pestis KIM
cccgcagauaauccccuugugg

SEQ ID NO: 2322002 - RNA, 18 nt, Yersinia pestis KIM
cccgccauggcaugccau

SEQ ID NO: 2322003 - RNA, 18 nt, Yersinia pestis KIM
cccgccaggaaaacgccc

SEQ ID NO: 2322004 - RNA, 22 nt, Yersinia pestis KIM
cccgccaggaaauuugcacugc

SEQ ID NO: 2322005 - RNA, 16 nt, Yersinia pestis KIM
cccgccaguaaaccug

SEQ ID NO: 2322006 - RNA, 20 nt, Yersinia pestis KIM
cccgccaguaaaccuggcgg

SEQ ID NO: 2322007 - RNA, 13 nt, Yersinia pestis KIM
cccgccugcuugc

SEQ ID NO: 2322008 - RNA, 16 nt, Yersinia pestis KIM
cccgccguugccgugc

SEQ ID NO: 2322009 - RNA, 14 nt, Yersinia pestis KIM
cccgcuaucacuag

SEQ ID NO: 2322010 - RNA, 13 nt, Yersinia pestis KIM
cccgcuaucacua

SEQ ID NO: 2322011 - RNA, 12 nt, Yersinia pestis KIM
cccgcucuguca

SEQ ID NO: 2322012 - RNA, 21 nt, Yersinia pestis KIM
cccgcuggucgauaagcacuc

SEQ ID NO: 2322013 - RNA, 15 nt, Yersinia pestis KIM
cccgcguugucagcc

SEQ ID NO: 2322014 - RNA, 14 nt, Yersinia pestis KIM
cccggcaaguugau

SEQ ID NO: 2322015 - RNA, 17 nt, Yersinia pestis KIM
cccggauugcugcccgg

SEQ ID NO: 2322016 - RNA, 23 nt, Yersinia pestis KIM
cccggcauggacgagcacauggc

SEQ ID NO: 2322017 - RNA, 16 nt, Yersinia pestis KIM
cccgcuugucuugaaa

SEQ ID NO: 2322018 - RNA, 21 nt, Yersinia pestis KIM
cccgcuuguuguaucacagca

SEQ ID NO: 2322019 - RNA, 14 nt, Yersinia pestis KIM
cccgcuucucguau

SEQ ID NO: 2322020 - RNA, 19 nt, Yersinia pestis KIM
cccggcuaggaggccagga

SEQ ID NO: 2322021 - RNA, 20 nt, Yersinia pestis KIM
cccgguaccgaggucauuca

SEQ ID NO: 2322022 - RNA, 15 nt, Yersinia pestis KIM
cccggugacccgugc

SEQ ID NO: 2322023 - RNA, 12 nt, Yersinia pestis KIM
cccucagccaaa

SEQ ID NO: 2322024 - RNA, 14 nt, Yersinia pestis KIM
cccucagccaaagc

SEQ ID NO: 2322025 - RNA, 22 nt, Yersinia pestis KIM
cccucacugccagccauaaugc

SEQ ID NO: 2322026 - RNA, 16 nt, Yersinia pestis KIM
cccucauuuuacccga

SEQ ID NO: 2322027 - RNA, 22 nt, Yersinia pestis KIM
cccucauuuucgaacuuaacua

SEQ ID NO: 2322028 - RNA, 11 nt, Yersinia pestis KIM
cccuccaaacu

SEQ ID NO: 2322029 - RNA, 17 nt, Yersinia pestis KIM
cccuccggcgcccuucc

SEQ ID NO: 2322030 - RNA, 14 nt, Yersinia pestis KIM
cccucgacaccaaa

SEQ ID NO: 2322031 - RNA, 24 nt, Yersinia pestis KIM
cccuacuggcugaaguuaaugaca

SEQ ID NO: 2322032 - RNA, 13 nt, Yersinia pestis KIM
cccuacuggcuga

SEQ ID NO: 2322033 - RNA, 15 nt, Yersinia pestis KIM
cccuagccagccacc

SEQ ID NO: 2322034 - RNA, 14 nt, Yersinia pestis KIM
cccuauaauuuguu

SEQ ID NO: 2322035 - RNA, 19 nt, Yersinia pestis KIM
cccucaauagcuaauaauu

SEQ ID NO: 2322036 - RNA, 14 nt, Yersinia pestis KIM
cccucaaugacgcg

SEQ ID NO: 2322037 - RNA, 18 nt, Yersinia pestis KIM
cccuaacucuuuggaugg

SEQ ID NO: 2322038 - RNA, 13 nt, Yersinia pestis KIM
cccuaacugcuca

SEQ ID NO: 2322039 - RNA, 20 nt, Yersinia pestis KIM
cccuaacugcucagccgacu

SEQ ID NO: 2322040 - RNA, 18 nt, Yersinia pestis KIM
cccuaaacagcaacacaa

SEQ ID NO: 2322041 - RNA, 13 nt, Yersinia pestis KIM
cccuacugagaau

SEQ ID NO: 2322042 - RNA, 15 nt, Yersinia pestis KIM
cccguaggccuuaac

SEQ ID NO: 2322043 - RNA, 20 nt, Yersinia pestis KIM
cccguuugcagcucaaagac

SEQ ID NO: 2322044 - RNA, 16 nt, Yersinia pestis KIM
cccguuugcagcucaa

SEQ ID NO: 2322045 - RNA, 19 nt, Yersinia pestis KIM
cccguugagugaaagccug

SEQ ID NO: 2322046 - RNA, 15 nt, Yersinia pestis KIM
cccguucaucaccca

SEQ ID NO: 2322047 - RNA, 15 nt, Yersinia pestis KIM
cccguuacugcaucu

SEQ ID NO: 2322048 - RNA, 13 nt, Yersinia pestis KIM
cccgugucacuua

SEQ ID NO: 2322049 - RNA, 22 nt, Yersinia pestis KIM
cccaggcaaucucuccccaagc

SEQ ID NO: 2322050 - RNA, 14 nt, Yersinia pestis KIM
cccaggcaaucucu

SEQ ID NO: 2322051 - RNA, 15 nt, Yersinia pestis KIM
cccagcgguugaggc

SEQ ID NO: 2322052 - RNA, 12 nt, Yersinia pestis KIM
cccagccucugg

SEQ ID NO: 2322053 - RNA, 21 nt, Yersinia pestis KIM
cccagccgggguaucauagaa

SEQ ID NO: 2322054 - RNA, 23 nt, Yersinia pestis KIM
cccagcaggcugugaucugccag

SEQ ID NO: 2322055 - RNA, 14 nt, Yersinia pestis KIM
cccagcagugcugc

SEQ ID NO: 2322056 - RNA, 21 nt, Yersinia pestis KIM
cccacguuuugacgcguagag

SEQ ID NO: 2322057 - RNA, 16 nt, Yersinia pestis KIM
cccacguucccccgcc

SEQ ID NO: 2322058 - RNA, 12 nt, Yersinia pestis KIM
cccacuaauauu

SEQ ID NO: 2322059 - RNA, 15 nt, Yersinia pestis KIM
cccacuaauauuccu

SEQ ID NO: 2322060 - RNA, 16 nt, Yersinia pestis KIM
cccacuaauauuccug

SEQ ID NO: 2322061 - RNA, 18 nt, Yersinia pestis KIM
cccacggcgacguucagc

SEQ ID NO: 2322062 - RNA, 21 nt, Yersinia pestis KIM
cccaaauagcuggcauccuca

SEQ ID NO: 2322063 - RNA, 17 nt, Yersinia pestis KIM
cccaaaugagcagcaau

SEQ ID NO: 2322064 - RNA, 21 nt, Yersinia pestis KIM
cccaaagcgcagugcucauua

SEQ ID NO: 2322065 - RNA, 18 nt, Yersinia pestis KIM
cccaaagccuacgagaga

SEQ ID NO: 2322066 - RNA, 21 nt, Yersinia pestis KIM
cccaacaacgcuccagguuca

SEQ ID NO: 2322067 - RNA, 14 nt, Yersinia pestis KIM
cccaccaaaccauu

SEQ ID NO: 2322068 - RNA, 18 nt, Yersinia pestis KIM
ccauugaguaaguucguc

SEQ ID NO: 2322069 - RNA, 16 nt, Yersinia pestis KIM
ccauugcauauugcuc

SEQ ID NO: 2322070 - RNA, 16 nt, Yersinia pestis KIM
ccauugcaccaauaac

SEQ ID NO: 2322071 - RNA, 13 nt, Yersinia pestis KIM
ccauuuauuucca

SEQ ID NO: 2322072 - RNA, 21 nt, Yersinia pestis KIM
ccauuuaucgccaagccagua

SEQ ID NO: 2322073 - RNA, 12 nt, Yersinia pestis KIM
ccauuuuauccu

SEQ ID NO: 2322074 - RNA, 17 nt, Yersinia pestis KIM
ccauuuuauccucuucc

SEQ ID NO: 2322075 - RNA, 19 nt, Yersinia pestis KIM
ccauuuuauuuaacguguu

SEQ ID NO: 2322076 - RNA, 23 nt, Yersinia pestis KIM
ccauuuggugauaagcugcguga

SEQ ID NO: 2322077 - RNA, 14 nt, Yersinia pestis KIM
ccauuugcucuggc

SEQ ID NO: 2322078 - RNA, 21 nt, Yersinia pestis KIM
ccauuucugguugugcuucag

SEQ ID NO: 2322079 - RNA, 12 nt, Yersinia pestis KIM
ccauuucucuga

SEQ ID NO: 2322080 - RNA, 11 nt, Yersinia pestis KIM
ccauuuugcug

SEQ ID NO: 2322081 - RNA, 18 nt, Yersinia pestis KIM
ccauuuuuauaucagauu

SEQ ID NO: 2322082 - RNA, 15 nt, Yersinia pestis KIM
cccaaaccaacaaua

SEQ ID NO: 2322083 - RNA, 21 nt, Yersinia pestis KIM
cccaaaaccaccaccccagca

SEQ ID NO: 2322084 - RNA, 22 nt, Yersinia pestis KIM
cccgaucugagccauuaucguu

SEQ ID NO: 2322085 - RNA, 22 nt, Yersinia pestis KIM
cccgaugaacugacacacacca

SEQ ID NO: 2322086 - RNA, 13 nt, Yersinia pestis KIM
cccgaugagucua

SEQ ID NO: 2322087 - RNA, 15 nt, Yersinia pestis KIM
cccgaguaagcgcug

SEQ ID NO: 2322088 - RNA, 12 nt, Yersinia pestis KIM
cccgcaauuuua

SEQ ID NO: 2322089 - RNA, 13 nt, Yersinia pestis KIM
cccgcaaagccug

SEQ ID NO: 2322090 - RNA, 19 nt, Yersinia pestis KIM
cccgcacacugagccgccc

SEQ ID NO: 2322091 - RNA, 20 nt, Yersinia pestis KIM
cccgauuauugugccgccuu

SEQ ID NO: 2322092 - RNA, 21 nt, Yersinia pestis KIM
cccgauguggauaauuucagc

SEQ ID NO: 2322093 - RNA, 20 nt, Yersinia pestis KIM
cccgauuucaacgcaccauc

SEQ ID NO: 2322094 - RNA, 18 nt, Yersinia pestis KIM
cccgcaaccugacugcug

SEQ ID NO: 2322095 - RNA, 18 nt, Yersinia pestis KIM
cccgaagcucaagcuggu

SEQ ID NO: 2322096 - RNA, 18 nt, Yersinia pestis KIM
cccgaauuaauaaaaccu

SEQ ID NO: 2322097 - RNA, 14 nt, Yersinia pestis KIM
ccccuuuuuucuau

SEQ ID NO: 2322098 - RNA, 22 nt, Yersinia pestis KIM
ccccgcuucucguauccccuga

SEQ ID NO: 2322099 - RNA, 16 nt, Yersinia pestis KIM
ccccgcuaauugcugc

SEQ ID NO: 2322100 - RNA, 18 nt, Yersinia pestis KIM
ccccgcuaccaagcccag

SEQ ID NO: 2322101 - RNA, 17 nt, Yersinia pestis KIM
ccccgccucaaugcaac

SEQ ID NO: 2322102 - RNA, 13 nt, Yersinia pestis KIM
ccccuucuucacc

SEQ ID NO: 2322103 - RNA, 19 nt, Yersinia pestis KIM
cccccaguagcacaaugcc

SEQ ID NO: 2322104 - RNA, 11 nt, Yersinia pestis KIM
cccccagugcu

SEQ ID NO: 2322105 - RNA, 14 nt, Yersinia pestis KIM
ccccccaagagaaa

SEQ ID NO: 2322106 - RNA, 11 nt, Yersinia pestis KIM
cccccaccaug

SEQ ID NO: 2322107 - RNA, 15 nt, Yersinia pestis KIM
cccccacucgcccca

SEQ ID NO: 2322108 - RNA, 14 nt, Yersinia pestis KIM
ccccagaugaaugg

SEQ ID NO: 2322109 - RNA, 14 nt, Yersinia pestis KIM
ccccacuucacgca

SEQ ID NO: 2322110 - RNA, 18 nt, Yersinia pestis KIM
cccauuccguuuaaacuc

SEQ ID NO: 2322111 - RNA, 18 nt, Yersinia pestis KIM
cccauuugucgcgccuga

SEQ ID NO: 2322112 - RNA, 21 nt, Yersinia pestis KIM
cccauuagcaguaacguccaa

SEQ ID NO: 2322113 - RNA, 17 nt, Yersinia pestis KIM
cccauuauaaauaauua

SEQ ID NO: 2322114 - RNA, 12 nt, Yersinia pestis KIM
cccauuauuaua

SEQ ID NO: 2322115 - RNA, 18 nt, Yersinia pestis KIM
cccaugcucccuccugcc

SEQ ID NO: 2322116 - RNA, 20 nt, Yersinia pestis KIM
ccccaauucacgcaaggcca

SEQ ID NO: 2322117 - RNA, 18 nt, Yersinia pestis KIM
ccccaauaagggccaccc

SEQ ID NO: 2322118 - RNA, 13 nt, Yersinia pestis KIM
ccccaagcuuuug

SEQ ID NO: 2322119 - RNA, 20 nt, Yersinia pestis KIM
ccccaacucuuucaacuucc

SEQ ID NO: 2322120 - RNA, 15 nt, Yersinia pestis KIM
ccccacccugugagc

SEQ ID NO: 2322121 - RNA, 21 nt, Yersinia pestis KIM
ccccacaaccugcgccaccca

SEQ ID NO: 2322122 - RNA, 22 nt, Yersinia pestis KIM
ccccaauucacgcaaggccagg

SEQ ID NO: 2322123 - RNA, 17 nt, Yersinia pestis KIM
ccagcgccgauauacac

SEQ ID NO: 2322124 - RNA, 21 nt, Yersinia pestis KIM
ccagcgccgauauacacccca

SEQ ID NO: 2322125 - RNA, 15 nt, Yersinia pestis KIM
ccagcggcuuauucc

SEQ ID NO: 2322126 - RNA, 15 nt, Yersinia pestis KIM
ccagcgggaaucaaa

SEQ ID NO: 2322127 - RNA, 14 nt, Yersinia pestis KIM
ccagcggcaccgcc

SEQ ID NO: 2322128 - RNA, 23 nt, Yersinia pestis KIM
ccagcggcaaauagagcaccaaa

SEQ ID NO: 2322129 - RNA, 16 nt, Yersinia pestis KIM
ccagcgcuuuaggcaa

SEQ ID NO: 2322130 - RNA, 20 nt, Yersinia pestis KIM
ccagcgucgccguaaauugc

SEQ ID NO: 2322131 - RNA, 23 nt, Yersinia pestis KIM
ccagcguccugugcaaagugcug

SEQ ID NO: 2322132 - RNA, 18 nt, Yersinia pestis KIM
ccagcuauugcuuuuauu

SEQ ID NO: 2322133 - RNA, 18 nt, Yersinia pestis KIM
ccaggcauuaaaaucacc

SEQ ID NO: 2322134 - RNA, 16 nt, Yersinia pestis KIM
ccaggccacggccgcc

SEQ ID NO: 2322135 - RNA, 18 nt, Yersinia pestis KIM
ccaggaauuaacaauucu

SEQ ID NO: 2322136 - RNA, 15 nt, Yersinia pestis KIM
ccaggaagcggccag

SEQ ID NO: 2322137 - RNA, 13 nt, Yersinia pestis KIM
ccagcugcaauug

SEQ ID NO: 2322138 - RNA, 17 nt, Yersinia pestis KIM
ccaggucaguuuuaccc

SEQ ID NO: 2322139 - RNA, 18 nt, Yersinia pestis KIM
ccaggcuggccacuucca

SEQ ID NO: 2322140 - RNA, 16 nt, Yersinia pestis KIM
ccaggcgcuguugcau

SEQ ID NO: 2322141 - RNA, 15 nt, Yersinia pestis KIM
ccaucagccaacaaa

SEQ ID NO: 2322142 - RNA, 18 nt, Yersinia pestis KIM
ccaucagcauauuaccca

SEQ ID NO: 2322143 - RNA, 13 nt, Yersinia pestis KIM
ccaucagagucca

SEQ ID NO: 2322144 - RNA, 20 nt, Yersinia pestis KIM
ccaucagaguccaauagcug

SEQ ID NO: 2322145 - RNA, 21 nt, Yersinia pestis KIM
ccaucagacaggauaaucauc

SEQ ID NO: 2322146 - RNA, 13 nt, Yersinia pestis KIM
ccaucaauaccaa

SEQ ID NO: 2322147 - RNA, 13 nt, Yersinia pestis KIM
ccaucaauaaacu

SEQ ID NO: 2322148 - RNA, 15 nt, Yersinia pestis KIM
ccaucacaaaaccuu

SEQ ID NO: 2322149 - RNA, 13 nt, Yersinia pestis KIM
ccauacagaacug

SEQ ID NO: 2322150 - RNA, 14 nt, Yersinia pestis KIM
ccauacagaacugg

SEQ ID NO: 2322151 - RNA, 22 nt, Yersinia pestis KIM
ccauaauucugccgacuaauau

SEQ ID NO: 2322152 - RNA, 22 nt, Yersinia pestis KIM
ccauaucagcgccuucuuguaa

SEQ ID NO: 2322153 - RNA, 16 nt, Yersinia pestis KIM
ccauauccucaagacc

SEQ ID NO: 2322154 - RNA, 17 nt, Yersinia pestis KIM
ccauauccucaagaccg

SEQ ID NO: 2322155 - RNA, 13 nt, Yersinia pestis KIM
ccauauccucgag

SEQ ID NO: 2322156 - RNA, 18 nt, Yersinia pestis KIM
ccauaucuuuaaaaaccc

SEQ ID NO: 2322157 - RNA, 13 nt, Yersinia pestis KIM
ccaucgccccaaa

SEQ ID NO: 2322158 - RNA, 13 nt, Yersinia pestis KIM
ccaucgcaccaaa

SEQ ID NO: 2322159 - RNA, 16 nt, Yersinia pestis KIM
ccaucgccacuucuaa

SEQ ID NO: 2322160 - RNA, 15 nt, Yersinia pestis KIM
ccaucgucagccccu

SEQ ID NO: 2322161 - RNA, 15 nt, Yersinia pestis KIM
ccaucguauauccac

SEQ ID NO: 2322162 - RNA, 16 nt, Yersinia pestis KIM
ccauccgcaccugcac

SEQ ID NO: 2322163 - RNA, 24 nt, Yersinia pestis KIM
ccaucauuacccucauguaagcca

SEQ ID NO: 2322164 - RNA, 15 nt, Yersinia pestis KIM
ccaucaguucacuga

SEQ ID NO: 2322165 - RNA, 14 nt, Yersinia pestis KIM
ccaguagcccagcc

SEQ ID NO: 2322166 - RNA, 15 nt, Yersinia pestis KIM
ccaguagcccagccg

SEQ ID NO: 2322167 - RNA, 18 nt, Yersinia pestis KIM
ccaguauugcagagcaaa

SEQ ID NO: 2322168 - RNA, 22 nt, Yersinia pestis KIM
ccaguaggggccaccaaauaaa

SEQ ID NO: 2322169 - RNA, 18 nt, Yersinia pestis KIM
ccagucgucuucagcuuc

SEQ ID NO: 2322170 - RNA, 15 nt, Yersinia pestis KIM
ccagugcgcaaaaau

SEQ ID NO: 2322171 - RNA, 15 nt, Yersinia pestis KIM
ccagugccaauugag

SEQ ID NO: 2322172 - RNA, 12 nt, Yersinia pestis KIM
ccagugccaauc

SEQ ID NO: 2322173 - RNA, 19 nt, Yersinia pestis KIM
ccagugccaauccccacca

SEQ ID NO: 2322174 - RNA, 19 nt, Yersinia pestis KIM
ccagugcaaaaugcucuuc

SEQ ID NO: 2322175 - RNA, 14 nt, Yersinia pestis KIM
ccagugcaaauuua

SEQ ID NO: 2322176 - RNA, 15 nt, Yersinia pestis KIM
ccagugaguccuuua

SEQ ID NO: 2322177 - RNA, 18 nt, Yersinia pestis KIM
ccagugagccauguguuu

SEQ ID NO: 2322178 - RNA, 20 nt, Yersinia pestis KIM
ccauaaccugagcaccagaa

SEQ ID NO: 2322179 - RNA, 16 nt, Yersinia pestis KIM
ccauaacgcugcucaa

SEQ ID NO: 2322180 - RNA, 18 nt, Yersinia pestis KIM
ccauaaacggaacucauc

SEQ ID NO: 2322181 - RNA, 16 nt, Yersinia pestis KIM
ccauaaaguuuuuccu

SEQ ID NO: 2322182 - RNA, 20 nt, Yersinia pestis KIM
ccagccuguuaauaauucag

SEQ ID NO: 2322183 - RNA, 20 nt, Yersinia pestis KIM
ccagccugguuuuuuaaaaa

SEQ ID NO: 2322184 - RNA, 21 nt, Yersinia pestis KIM
ccagccuguuaauaauucagg

SEQ ID NO: 2322185 - RNA, 20 nt, Yersinia pestis KIM
ccagccgauaauccaccuga

SEQ ID NO: 2322186 - RNA, 18 nt, Yersinia pestis KIM
ccagccccaaacacuuag

SEQ ID NO: 2322187 - RNA, 15 nt, Yersinia pestis KIM
ccagcauaguaagcu

SEQ ID NO: 2322188 - RNA, 13 nt, Yersinia pestis KIM
ccagcagugcugc

SEQ ID NO: 2322189 - RNA, 12 nt, Yersinia pestis KIM
ccagcaaaucau

SEQ ID NO: 2322190 - RNA, 15 nt, Yersinia pestis KIM
ccagcaaaggccacc

SEQ ID NO: 2322191 - RNA, 19 nt, Yersinia pestis KIM
ccagaaucacugucaaaaa

SEQ ID NO: 2322192 - RNA, 15 nt, Yersinia pestis KIM
ccagaauaauaagcc

SEQ ID NO: 2322193 - RNA, 15 nt, Yersinia pestis KIM
ccagauaacaacaaa

SEQ ID NO: 2322194 - RNA, 18 nt, Yersinia pestis KIM
ccagauaugaucaaaaau

SEQ ID NO: 2322195 - RNA, 17 nt, Yersinia pestis KIM
ccagcaaaauagcacag

SEQ ID NO: 2322196 - RNA, 20 nt, Yersinia pestis KIM
ccagauggccagauucacca

SEQ ID NO: 2322197 - RNA, 16 nt, Yersinia pestis KIM
ccacuaguuaaaacca

SEQ ID NO: 2322198 - RNA, 14 nt, Yersinia pestis KIM
ccacuagaaauacu

SEQ ID NO: 2322199 - RNA, 22 nt, Yersinia pestis KIM
ccacuaugcccaguuuaccauc

SEQ ID NO: 2322200 - RNA, 15 nt, Yersinia pestis KIM
ccacucaguguggaa

SEQ ID NO: 2322201 - RNA, 17 nt, Yersinia pestis KIM
ccacugagcaaacagug

SEQ ID NO: 2322202 - RNA, 20 nt, Yersinia pestis KIM
ccacugagcaaacagugcac

SEQ ID NO: 2322203 - RNA, 14 nt, Yersinia pestis KIM
ccacugauacccag

SEQ ID NO: 2322204 - RNA, 23 nt, Yersinia pestis KIM
ccacugaccgggaacaacgaaac

SEQ ID NO: 2322205 - RNA, 15 nt, Yersinia pestis KIM
ccacugaccuauuga

SEQ ID NO: 2322206 - RNA, 21 nt, Yersinia pestis KIM
ccacugaccuauugauaaaac

SEQ ID NO: 2322207 - RNA, 21 nt, Yersinia pestis KIM
ccacucuggggcaaucaaugu

SEQ ID NO: 2322208 - RNA, 21 nt, Yersinia pestis KIM
ccacucggccagagcuugcug

SEQ ID NO: 2322209 - RNA, 16 nt, Yersinia pestis KIM
ccacucgccccacaau

SEQ ID NO: 2322210 - RNA, 14 nt, Yersinia pestis KIM
ccacucucccucag

SEQ ID NO: 2322211 - RNA, 13 nt, Yersinia pestis KIM
ccacucucccuca

SEQ ID NO: 2322212 - RNA, 23 nt, Yersinia pestis KIM
ccacucggguucuaaauccugca

SEQ ID NO: 2322213 - RNA, 16 nt, Yersinia pestis KIM
ccacuaaggucaucaa

SEQ ID NO: 2322214 - RNA, 12 nt, Yersinia pestis KIM
ccacuaauauuc

SEQ ID NO: 2322215 - RNA, 16 nt, Yersinia pestis KIM
ccacgcuccacacaaa

SEQ ID NO: 2322216 - RNA, 21 nt, Yersinia pestis KIM
ccagaacaauaccgccaauau

SEQ ID NO: 2322217 - RNA, 17 nt, Yersinia pestis KIM
ccacuuggcccacuguu

SEQ ID NO: 2322218 - RNA, 17 nt, Yersinia pestis KIM
ccacuuguaccugugcc

SEQ ID NO: 2322219 - RNA, 15 nt, Yersinia pestis KIM
ccagaaaggcaaaaa

SEQ ID NO: 2322220 - RNA, 10 nt, Yersinia pestis KIM
ccacuucuuc

SEQ ID NO: 2322221 - RNA, 14 nt, Yersinia pestis KIM
ccacuguuuuucca

SEQ ID NO: 2322222 - RNA, 19 nt, Yersinia pestis KIM
ccacuggccugagaaccca

SEQ ID NO: 2322223 - RNA, 14 nt, Yersinia pestis KIM
ccacuggccugaga

SEQ ID NO: 2322224 - RNA, 21 nt, Yersinia pestis KIM
ccacugcuuuaggauuuauuu

SEQ ID NO: 2322225 - RNA, 14 nt, Yersinia pestis KIM
ccacugcaucaucg

SEQ ID NO: 2322226 - RNA, 17 nt, Yersinia pestis KIM
ccacgauuagcccguuc

SEQ ID NO: 2322227 - RNA, 13 nt, Yersinia pestis KIM
ccacgcauuccau

SEQ ID NO: 2322228 - RNA, 16 nt, Yersinia pestis KIM
ccacgcauuccaucag

SEQ ID NO: 2322229 - RNA, 21 nt, Yersinia pestis KIM
ccaccugacuguggcugcucu

SEQ ID NO: 2322230 - RNA, 21 nt, Yersinia pestis KIM
ccaccgagguuaucagccucu

SEQ ID NO: 2322231 - RNA, 12 nt, Yersinia pestis KIM
ccaccgcacacu

SEQ ID NO: 2322232 - RNA, 17 nt, Yersinia pestis KIM
ccaccgcagcaaccguc

SEQ ID NO: 2322233 - RNA, 13 nt, Yersinia pestis KIM
cauuuuuugggau

SEQ ID NO: 2322234 - RNA, 11 nt, Yersinia pestis KIM
cauuuuuucuu

SEQ ID NO: 2322235 - RNA, 14 nt, Yersinia pestis KIM
cauuuuuuguagug

SEQ ID NO: 2322236 - RNA, 15 nt, Yersinia pestis KIM
cauuuuuuguaguga

SEQ ID NO: 2322237 - RNA, 16 nt, Yersinia pestis KIM
ccaccggcaguucauu

SEQ ID NO: 2322238 - RNA, 19 nt, Yersinia pestis KIM
ccaccggcaguucauuccc

SEQ ID NO: 2322239 - RNA, 20 nt, Yersinia pestis KIM
ccggcgaagggcgcagcccc

SEQ ID NO: 2322240 - RNA, 17 nt, Yersinia pestis KIM
ccggcaucccaccuuca

SEQ ID NO: 2322241 - RNA, 15 nt, Yersinia pestis KIM
ccggagguuuuucau

SEQ ID NO: 2322242 - RNA, 16 nt, Yersinia pestis KIM
ccggagcaagggcgca

SEQ ID NO: 2322243 - RNA, 17 nt, Yersinia pestis KIM
ccgcuugcauacgcuua

SEQ ID NO: 2322244 - RNA, 20 nt, Yersinia pestis KIM
ccgcuucguccagaugccaa

SEQ ID NO: 2322245 - RNA, 18 nt, Yersinia pestis KIM
ccggcaaaaacgccauca

SEQ ID NO: 2322246 - RNA, 14 nt, Yersinia pestis KIM
ccggauuccaccug

SEQ ID NO: 2322247 - RNA, 16 nt, Yersinia pestis KIM
ccggaugcaucgggca

SEQ ID NO: 2322248 - RNA, 20 nt, Yersinia pestis KIM
ccggaucgcgacgaaaaccu

SEQ ID NO: 2322249 - RNA, 14 nt, Yersinia pestis KIM
ccgcgucgccgcuu

SEQ ID NO: 2322250 - RNA, 14 nt, Yersinia pestis KIM
ccgcgucuguuauc

SEQ ID NO: 2322251 - RNA, 17 nt, Yersinia pestis KIM
ccgcuaccaagcccagu

SEQ ID NO: 2322252 - RNA, 16 nt, Yersinia pestis KIM
ccgcuaccacuccuua

SEQ ID NO: 2322253 - RNA, 20 nt, Yersinia pestis KIM
ccgcuagugauagcgggccu

SEQ ID NO: 2322254 - RNA, 18 nt, Yersinia pestis KIM
ccgcuaucacuagcgggc

SEQ ID NO: 2322255 - RNA, 15 nt, Yersinia pestis KIM
ccgcuauauuuuuac

SEQ ID NO: 2322256 - RNA, 13 nt, Yersinia pestis KIM
ccgcuaguuugac

SEQ ID NO: 2322257 - RNA, 19 nt, Yersinia pestis KIM
ccgcuauaucaucagcaga

SEQ ID NO: 2322258 - RNA, 14 nt, Yersinia pestis KIM
ccgcugcaacuccu

SEQ ID NO: 2322259 - RNA, 17 nt, Yersinia pestis KIM
ccgcuggugcugcgggc

SEQ ID NO: 2322260 - RNA, 18 nt, Yersinia pestis KIM
ccgcuguaggugucacca

SEQ ID NO: 2322261 - RNA, 20 nt, Yersinia pestis KIM
ccgcuguagcgccaaugaca

SEQ ID NO: 2322262 - RNA, 14 nt, Yersinia pestis KIM
ccgcugcuccgccc

SEQ ID NO: 2322263 - RNA, 13 nt, Yersinia pestis KIM
ccgcgccagggag

SEQ ID NO: 2322264 - RNA, 16 nt, Yersinia pestis KIM
ccgcgccauaaaagau

SEQ ID NO: 2322265 - RNA, 21 nt, Yersinia pestis KIM
ccgcgccaaggauggcgcggc

SEQ ID NO: 2322266 - RNA, 13 nt, Yersinia pestis KIM
ccgcgaaaaacca

SEQ ID NO: 2322267 - RNA, 17 nt, Yersinia pestis KIM
ccgccugcucaacacag

SEQ ID NO: 2322268 - RNA, 17 nt, Yersinia pestis KIM
ccgcgaucaacaagaau

SEQ ID NO: 2322269 - RNA, 23 nt, Yersinia pestis KIM
ccgcgauaaaaaauaaaguccag

SEQ ID NO: 2322270 - RNA, 14 nt, Yersinia pestis KIM
ccgcgaauaacaga

SEQ ID NO: 2322271 - RNA, 15 nt, Yersinia pestis KIM
ccgacacccagccag

SEQ ID NO: 2322272 - RNA, 14 nt, Yersinia pestis KIM
ccgacacccagcca

SEQ ID NO: 2322273 - RNA, 14 nt, Yersinia pestis KIM
ccgacccacgcccc

SEQ ID NO: 2322274 - RNA, 14 nt, Yersinia pestis KIM
ccgaccaaaggcca

SEQ ID NO: 2322275 - RNA, 14 nt, Yersinia pestis KIM
ccgaccaccacugc

SEQ ID NO: 2322276 - RNA, 19 nt, Yersinia pestis KIM
ccgaaauaaauauccuccg

SEQ ID NO: 2322277 - RNA, 19 nt, Yersinia pestis KIM
cccuuuuccgucagcccaa

SEQ ID NO: 2322278 - RNA, 11 nt, Yersinia pestis KIM
ccgaagcccca

SEQ ID NO: 2322279 - RNA, 14 nt, Yersinia pestis KIM
ccgaacgaacccga

SEQ ID NO: 2322280 - RNA, 17 nt, Yersinia pestis KIM
cccuuucagcgcuuuuu

SEQ ID NO: 2322281 - RNA, 21 nt, Yersinia pestis KIM
cccuuuaaaucuagcccuuca

SEQ ID NO: 2322282 - RNA, 22 nt, Yersinia pestis KIM
cccuuguuuaucggucacuuua

SEQ ID NO: 2322283 - RNA, 20 nt, Yersinia pestis KIM
cccuuggcucucgacaaccu

SEQ ID NO: 2322284 - RNA, 19 nt, Yersinia pestis KIM
ccgacugagauuauuauua

SEQ ID NO: 2322285 - RNA, 12 nt, Yersinia pestis KIM
ccgauaagcccu

SEQ ID NO: 2322286 - RNA, 18 nt, Yersinia pestis KIM
ccgagguuaucagccucu

SEQ ID NO: 2322287 - RNA, 16 nt, Yersinia pestis KIM
ccgagcgucaagccaa

SEQ ID NO: 2322288 - RNA, 20 nt, Yersinia pestis KIM
ccgauaaucccugccagaau

SEQ ID NO: 2322289 - RNA, 16 nt, Yersinia pestis KIM
ccgauaaucaauuugu

SEQ ID NO: 2322290 - RNA, 14 nt, Yersinia pestis KIM
ccgauaaucaauuu

SEQ ID NO: 2322291 - RNA, 11 nt, Yersinia pestis KIM
ccgauauaaau

SEQ ID NO: 2322292 - RNA, 21 nt, Yersinia pestis KIM
ccgccagguuuacuggcgggc

SEQ ID NO: 2322293 - RNA, 15 nt, Yersinia pestis KIM
ccgccaguaaaccug

SEQ ID NO: 2322294 - RNA, 19 nt, Yersinia pestis KIM
ccgccagguuuacuggcgg

SEQ ID NO: 2322295 - RNA, 20 nt, Yersinia pestis KIM
ccgccagcugacccccgccg

SEQ ID NO: 2322296 - RNA, 15 nt, Yersinia pestis KIM
ccgccagcagaacca

SEQ ID NO: 2322297 - RNA, 16 nt, Yersinia pestis KIM
ccgccagaauaaacga

SEQ ID NO: 2322298 - RNA, 14 nt, Yersinia pestis KIM
ccgccacugauacc

SEQ ID NO: 2322299 - RNA, 14 nt, Yersinia pestis KIM
ccgccauccuucaa

SEQ ID NO: 2322300 - RNA, 19 nt, Yersinia pestis KIM
ccgcccuuuagccagcggc

SEQ ID NO: 2322301 - RNA, 15 nt, Yersinia pestis KIM
ccgcaccacaaaggc

SEQ ID NO: 2322302 - RNA, 18 nt, Yersinia pestis KIM
ccgcacgaaccguggcgc

SEQ ID NO: 2322303 - RNA, 18 nt, Yersinia pestis KIM
ccgcauucaccaccauau

SEQ ID NO: 2322304 - RNA, 19 nt, Yersinia pestis KIM
ccgcagcggcuagcagcag

SEQ ID NO: 2322305 - RNA, 22 nt, Yersinia pestis KIM
ccgcagcggcuagcagcagguu

SEQ ID NO: 2322306 - RNA, 13 nt, Yersinia pestis KIM
ccgcauccggcgg

SEQ ID NO: 2322307 - RNA, 17 nt, Yersinia pestis KIM
ccgccaaauccaagcca

SEQ ID NO: 2322308 - RNA, 14 nt, Yersinia pestis KIM
ccucgcagauccag

SEQ ID NO: 2322309 - RNA, 14 nt, Yersinia pestis KIM
ccucgcucaggcgg

SEQ ID NO: 2322310 - RNA, 22 nt, Yersinia pestis KIM
ccucaggugcauccacauauau

SEQ ID NO: 2322311 - RNA, 21 nt, Yersinia pestis KIM
ccucaggcccgcuaucacuag

SEQ ID NO: 2322312 - RNA, 20 nt, Yersinia pestis KIM
ccucagccucauucaugagg

SEQ ID NO: 2322313 - RNA, 16 nt, Yersinia pestis KIM
ccucugccuauccuca

SEQ ID NO: 2322314 - RNA, 19 nt, Yersinia pestis KIM
ccucugccuauccucaccg

SEQ ID NO: 2322315 - RNA, 17 nt, Yersinia pestis KIM
ccucugccgauuuaaac

SEQ ID NO: 2322316 - RNA, 23 nt, Yersinia pestis KIM
ccucuagcuguauugcccgauca

SEQ ID NO: 2322317 - RNA, 12 nt, Yersinia pestis KIM
ccucuaccacga

SEQ ID NO: 2322318 - RNA, 15 nt, Yersinia pestis KIM
ccucuaaucuccucu

SEQ ID NO: 2322319 - RNA, 17 nt, Yersinia pestis KIM
ccucuaaggggcgagaa

SEQ ID NO: 2322320 - RNA, 13 nt, Yersinia pestis KIM
ccucuucauaauc

SEQ ID NO: 2322321 - RNA, 20 nt, Yersinia pestis KIM
ccucugcgcuggcguuuuug

SEQ ID NO: 2322322 - RNA, 21 nt, Yersinia pestis KIM
ccucugcgcuggcguuuuugu

SEQ ID NO: 2322323 - RNA, 20 nt, Yersinia pestis KIM
ccucuggauaaacaauaauc

SEQ ID NO: 2322324 - RNA, 11 nt, Yersinia pestis KIM
ccucugcugcu

SEQ ID NO: 2322325 - RNA, 21 nt, Yersinia pestis KIM
ccugacgcggugacaaugaau

SEQ ID NO: 2322326 - RNA, 23 nt, Yersinia pestis KIM
ccugacgaaauuuaagaaaucua

SEQ ID NO: 2322327 - RNA, 18 nt, Yersinia pestis KIM
ccugacuguggcugcucu

SEQ ID NO: 2322328 - RNA, 20 nt, Yersinia pestis KIM
ccugacugguucacaccaaa

SEQ ID NO: 2322329 - RNA, 14 nt, Yersinia pestis KIM
ccugacggccagca

SEQ ID NO: 2322330 - RNA, 15 nt, Yersinia pestis KIM
ccugacacugcaucu

SEQ ID NO: 2322331 - RNA, 21 nt, Yersinia pestis KIM
ccugacacugcaucucugcau

SEQ ID NO: 2322332 - RNA, 17 nt, Yersinia pestis KIM
ccugacagccugugccc

SEQ ID NO: 2322333 - RNA, 18 nt, Yersinia pestis KIM
ccugagguucccaacggc

SEQ ID NO: 2322334 - RNA, 23 nt, Yersinia pestis KIM
ccugagggugaugacaaugcguu

SEQ ID NO: 2322335 - RNA, 18 nt, Yersinia pestis KIM
ccugagggugaugacaau

SEQ ID NO: 2322336 - RNA, 16 nt, Yersinia pestis KIM
ccugagccgccaguug

SEQ ID NO: 2322337 - RNA, 22 nt, Yersinia pestis KIM
ccugagcgaucaauacaccaga

SEQ ID NO: 2322338 - RNA, 13 nt, Yersinia pestis KIM
ccugagugggggc

SEQ ID NO: 2322339 - RNA, 21 nt, Yersinia pestis KIM
ccugaguuaccuugugucacc

SEQ ID NO: 2322340 - RNA, 17 nt, Yersinia pestis KIM
ccugagucaguaauuca

SEQ ID NO: 2322341 - RNA, 14 nt, Yersinia pestis KIM
ccugauacaccauu

SEQ ID NO: 2322342 - RNA, 14 nt, Yersinia pestis KIM
ccugccaauaucca

SEQ ID NO: 2322343 - RNA, 13 nt, Yersinia pestis KIM
ccugccagaacag

SEQ ID NO: 2322344 - RNA, 14 nt, Yersinia pestis KIM
ccugauuguuuuua

SEQ ID NO: 2322345 - RNA, 19 nt, Yersinia pestis KIM
ccugauuugccagcaccgc

SEQ ID NO: 2322346 - RNA, 18 nt, Yersinia pestis KIM
ccugauuuugauugcuga

SEQ ID NO: 2322347 - RNA, 15 nt, Yersinia pestis KIM
ccugaugaugaagca

SEQ ID NO: 2322348 - RNA, 19 nt, Yersinia pestis KIM
ccugauucgcgaccagcag

SEQ ID NO: 2322349 - RNA, 15 nt, Yersinia pestis KIM
ccugauccaguuuca

SEQ ID NO: 2322350 - RNA, 19 nt, Yersinia pestis KIM
ccugaucgauaacccccaa

SEQ ID NO: 2322351 - RNA, 15 nt, Yersinia pestis KIM
ccuggcccgccagca

SEQ ID NO: 2322352 - RNA, 20 nt, Yersinia pestis KIM
ccuggcccuggaacaccagc

SEQ ID NO: 2322353 - RNA, 13 nt, Yersinia pestis KIM
ccugguggaccaa

SEQ ID NO: 2322354 - RNA, 14 nt, Yersinia pestis KIM
ccuggcucaaauuu

SEQ ID NO: 2322355 - RNA, 18 nt, Yersinia pestis KIM
ccugccagaaucagcccc

SEQ ID NO: 2322356 - RNA, 17 nt, Yersinia pestis KIM
ccugccccacaaugaau

SEQ ID NO: 2322357 - RNA, 12 nt, Yersinia pestis KIM
ccugcuggcgca

SEQ ID NO: 2322358 - RNA, 13 nt, Yersinia pestis KIM
ccugcuguuagua

SEQ ID NO: 2322359 - RNA, 16 nt, Yersinia pestis KIM
ccuucacauuuucucc

SEQ ID NO: 2322360 - RNA, 14 nt, Yersinia pestis KIM
ccuucaauugacuu

SEQ ID NO: 2322361 - RNA, 16 nt, Yersinia pestis KIM
ccuucaaagccgcuuu

SEQ ID NO: 2322362 - RNA, 19 nt, Yersinia pestis KIM
ccuucaaagccgcuuuaau

SEQ ID NO: 2322363 - RNA, 21 nt, Yersinia pestis KIM
ccuucaaacgggugauguuua

SEQ ID NO: 2322364 - RNA, 23 nt, Yersinia pestis KIM
ccuucacgcaucacaucuugcaa

SEQ ID NO: 2322365 - RNA, 22 nt, Yersinia pestis KIM
ccuucagaugaauccagccaug

SEQ ID NO: 2322366 - RNA, 17 nt, Yersinia pestis KIM
ccuucaggaauaaacag

SEQ ID NO: 2322367 - RNA, 16 nt, Yersinia pestis KIM
ccuucagccaccagau

SEQ ID NO: 2322368 - RNA, 14 nt, Yersinia pestis KIM
ccuuaucagcgaaa

SEQ ID NO: 2322369 - RNA, 23 nt, Yersinia pestis KIM
ccuuauccaauagaaaagcgccu

SEQ ID NO: 2322370 - RNA, 14 nt, Yersinia pestis KIM
ccuuauucuuauuu

SEQ ID NO: 2322371 - RNA, 13 nt, Yersinia pestis KIM
ccuuaucuacugg

SEQ ID NO: 2322372 - RNA, 15 nt, Yersinia pestis KIM
ccuuaucuggccccu

SEQ ID NO: 2322373 - RNA, 20 nt, Yersinia pestis KIM
ccuuacuaucuuuauugcuc

SEQ ID NO: 2322374 - RNA, 14 nt, Yersinia pestis KIM
ccuuacuauuuuca

SEQ ID NO: 2322375 - RNA, 14 nt, Yersinia pestis KIM
ccuuacuaucuuua

SEQ ID NO: 2322376 - RNA, 22 nt, Yersinia pestis KIM
ccuuagcacguuuuucagcuuc

SEQ ID NO: 2322377 - RNA, 17 nt, Yersinia pestis KIM
ccugugauuucagccag

SEQ ID NO: 2322378 - RNA, 22 nt, Yersinia pestis KIM
ccuguugagguacggcucuauu

SEQ ID NO: 2322379 - RNA, 20 nt, Yersinia pestis KIM
ccuguucgacauucucuacu

SEQ ID NO: 2322380 - RNA, 13 nt, Yersinia pestis KIM
ccuguaaaacaag

SEQ ID NO: 2322381 - RNA, 19 nt, Yersinia pestis KIM
ccugugagcgguaagcuga

SEQ ID NO: 2322382 - RNA, 13 nt, Yersinia pestis KIM
ccuguuuaguaaa

SEQ ID NO: 2322383 - RNA, 17 nt, Yersinia pestis KIM
ccuguuuaguaaauaua

SEQ ID NO: 2322384 - RNA, 18 nt, Yersinia pestis KIM
ccuguuguaacacuugac

SEQ ID NO: 2322385 - RNA, 18 nt, Yersinia pestis KIM
ccuguuuuuguuguucuu

SEQ ID NO: 2322386 - RNA, 21 nt, Yersinia pestis KIM
ccuuaauuaacucuucuguug

SEQ ID NO: 2322387 - RNA, 22 nt, Yersinia pestis KIM
ccuuaacggucagauccacauu

SEQ ID NO: 2322388 - RNA, 19 nt, Yersinia pestis KIM
ccgggcaaacgccagugca

SEQ ID NO: 2322389 - RNA, 19 nt, Yersinia pestis KIM
ccgggaucuaucagaccuu

SEQ ID NO: 2322390 - RNA, 18 nt, Yersinia pestis KIM
ccgggcauaaaugcaaua

SEQ ID NO: 2322391 - RNA, 16 nt, Yersinia pestis KIM
ccgguacaggcaaagu

SEQ ID NO: 2322392 - RNA, 21 nt, Yersinia pestis KIM
ccggucguauucagcacugcc

SEQ ID NO: 2322393 - RNA, 13 nt, Yersinia pestis KIM
ccguaccuccggu

SEQ ID NO: 2322394 - RNA, 14 nt, Yersinia pestis KIM
ccguacaaauauaa

SEQ ID NO: 2322395 - RNA, 12 nt, Yersinia pestis KIM
ccguacaacaau

SEQ ID NO: 2322396 - RNA, 19 nt, Yersinia pestis KIM
ccguaucuuguaguaacca

SEQ ID NO: 2322397 - RNA, 20 nt, Yersinia pestis KIM
ccguaucauggaagaccaga

SEQ ID NO: 2322398 - RNA, 16 nt, Yersinia pestis KIM
ccgguucuugcgcgcu

SEQ ID NO: 2322399 - RNA, 20 nt, Yersinia pestis KIM
ccgguucauuuagcagcgca

SEQ ID NO: 2322400 - RNA, 22 nt, Yersinia pestis KIM
ccgguguauuuggguuaaauag

SEQ ID NO: 2322401 - RNA, 18 nt, Yersinia pestis KIM
ccggugguuucgccgcca

SEQ ID NO: 2322402 - RNA, 16 nt, Yersinia pestis KIM
ccgguggucccugugg

SEQ ID NO: 2322403 - RNA, 17 nt, Yersinia pestis KIM
ccuagcaucauaaauac

SEQ ID NO: 2322404 - RNA, 15 nt, Yersinia pestis KIM
ccuagccagccaccg

SEQ ID NO: 2322405 - RNA, 14 nt, Yersinia pestis KIM
ccuagcggauacca

SEQ ID NO: 2322406 - RNA, 16 nt, Yersinia pestis KIM
ccuacuggcugaaguu

SEQ ID NO: 2322407 - RNA, 15 nt, Yersinia pestis KIM
ccuauccucaccguu

SEQ ID NO: 2322408 - RNA, 13 nt, Yersinia pestis KIM
ccuaucgccgccg

SEQ ID NO: 2322409 - RNA, 16 nt, Yersinia pestis KIM
ccuaucugaaugcugu

SEQ ID NO: 2322410 - RNA, 18 nt, Yersinia pestis KIM
ccuaggcuauugacaaag

SEQ ID NO: 2322411 - RNA, 23 nt, Yersinia pestis KIM
ccuagucucacuaaaucaaaagg

SEQ ID NO: 2322412 - RNA, 23 nt, Yersinia pestis KIM
ccuauaauuaacagcaucacugu

SEQ ID NO: 2322413 - RNA, 13 nt, Yersinia pestis KIM
ccuauaaauuuua

SEQ ID NO: 2322414 - RNA, 14 nt, Yersinia pestis KIM
ccuauacgcucuau

SEQ ID NO: 2322415 - RNA, 15 nt, Yersinia pestis KIM
ccucaccguauacgc

SEQ ID NO: 2322416 - RNA, 12 nt, Yersinia pestis KIM
ccucaccauuua

SEQ ID NO: 2322417 - RNA, 12 nt, Yersinia pestis KIM
ccucaauugugc

SEQ ID NO: 2322418 - RNA, 17 nt, Yersinia pestis KIM
ccucaaggaugaggcuc

SEQ ID NO: 2322419 - RNA, 14 nt, Yersinia pestis KIM
ccucacugucuuug

SEQ ID NO: 2322420 - RNA, 16 nt, Yersinia pestis KIM
ccucagagacaucuuu

SEQ ID NO: 2322421 - RNA, 21 nt, Yersinia pestis KIM
ccucagagacaucuuuaccag

SEQ ID NO: 2322422 - RNA, 14 nt, Yersinia pestis KIM
ccucacucagcgac

SEQ ID NO: 2322423 - RNA, 13 nt, Yersinia pestis KIM
ccucacgcagcgu

SEQ ID NO: 2322424 - RNA, 23 nt, Yersinia pestis KIM
ccucacgcagcguagguaacuaa

SEQ ID NO: 2322425 - RNA, 23 nt, Yersinia pestis KIM
ccucaccguucaagagugaguca

SEQ ID NO: 2322426 - RNA, 16 nt, Yersinia pestis KIM
ccuauugaauaacagc

SEQ ID NO: 2322427 - RNA, 23 nt, Yersinia pestis KIM
ccuauuucagggcguauaaacag

SEQ ID NO: 2322428 - RNA, 23 nt, Yersinia pestis KIM
ccuauuagauguguuuaaaucuu

SEQ ID NO: 2322429 - RNA, 18 nt, Yersinia pestis KIM
ccuauucagcagcauuuc

SEQ ID NO: 2322430 - RNA, 18 nt, Yersinia pestis KIM
ccuauggcgguuccaaag

SEQ ID NO: 2322431 - RNA, 16 nt, Yersinia pestis KIM
ccucaacgcaccccac

SEQ ID NO: 2322432 - RNA, 17 nt, Yersinia pestis KIM
ccucaacucaaaacaau

SEQ ID NO: 2322433 - RNA, 12 nt, Yersinia pestis KIM
ccucaaaaggau

SEQ ID NO: 2322434 - RNA, 23 nt, Yersinia pestis KIM
ccuauuuucgcccuuaucuacug

SEQ ID NO: 2322435 - RNA, 23 nt, Yersinia pestis KIM
ccucaaaaggauggcccaagcca

SEQ ID NO: 2322436 - RNA, 19 nt, Yersinia pestis KIM
ccguggcauaaucaacgcu

SEQ ID NO: 2322437 - RNA, 22 nt, Yersinia pestis KIM
ccgugcauagcgugauuuuuau

SEQ ID NO: 2322438 - RNA, 17 nt, Yersinia pestis KIM
ccgugcauagcgugauu

SEQ ID NO: 2322439 - RNA, 14 nt, Yersinia pestis KIM
ccgugcagggcgau

SEQ ID NO: 2322440 - RNA, 15 nt, Yersinia pestis KIM
ccguccguacgcagc

SEQ ID NO: 2322441 - RNA, 22 nt, Yersinia pestis KIM
ccguggcauaaucaacgcucaa

SEQ ID NO: 2322442 - RNA, 22 nt, Yersinia pestis KIM
ccguggcgcggaugcuuuauuc

SEQ ID NO: 2322443 - RNA, 18 nt, Yersinia pestis KIM
ccguucuaguagugggca

SEQ ID NO: 2322444 - RNA, 21 nt, Yersinia pestis KIM
ccguuauagaucuccugcaac

SEQ ID NO: 2322445 - RNA, 22 nt, Yersinia pestis KIM
ccguuagcaccggauggucacc

SEQ ID NO: 2322446 - RNA, 14 nt, Yersinia pestis KIM
ccguuacugcaucu

SEQ ID NO: 2322447 - RNA, 17 nt, Yersinia pestis KIM
ccguuaauggcaccauc

SEQ ID NO: 2322448 - RNA, 17 nt, Yersinia pestis KIM
ccguuaacccaaagcca

SEQ ID NO: 2322449 - RNA, 21 nt, Yersinia pestis KIM
ccuaaagauaauuaauucaau

SEQ ID NO: 2322450 - RNA, 15 nt, Yersinia pestis KIM
ccuaaauaauuccag

SEQ ID NO: 2322451 - RNA, 22 nt, Yersinia pestis KIM
ccuaaauccugcaaugcauaag

SEQ ID NO: 2322452 - RNA, 21 nt, Yersinia pestis KIM
ccguucuugccacucugcucc

SEQ ID NO: 2322453 - RNA, 11 nt, Yersinia pestis KIM
ccuaaaaaaaa

SEQ ID NO: 2322454 - RNA, 22 nt, Yersinia pestis KIM
ccuaaacagcaacacaaaagcg

SEQ ID NO: 2322455 - RNA, 16 nt, Yersinia pestis KIM
ccuaaaccccacagcg

SEQ ID NO: 2322456 - RNA, 23 nt, Yersinia pestis KIM
ccuaaaaucauugacguuacaga

SEQ ID NO: 2322457 - RNA, 14 nt, Yersinia pestis KIM
caucgggaacagga

SEQ ID NO: 2322458 - RNA, 23 nt, Yersinia pestis KIM
caucgggaacaggaucugcuccu

SEQ ID NO: 2322459 - RNA, 22 nt, Yersinia pestis KIM
caucggucauuuuacgccuggc

SEQ ID NO: 2322460 - RNA, 21 nt, Yersinia pestis KIM
caucuagcucaagggcacagu

SEQ ID NO: 2322461 - RNA, 21 nt, Yersinia pestis KIM
caucuaugcuauccagaucgc

SEQ ID NO: 2322462 - RNA, 21 nt, Yersinia pestis KIM
caucugcuuuacugcuuuucu

SEQ ID NO: 2322463 - RNA, 22 nt, Yersinia pestis KIM
caucugcuccaggcgcucaggu

SEQ ID NO: 2322464 - RNA, 19 nt, Yersinia pestis KIM
caucuccgccaacccuuuu

SEQ ID NO: 2322465 - RNA, 14 nt, Yersinia pestis KIM
caucugucuaagug

SEQ ID NO: 2322466 - RNA, 16 nt, Yersinia pestis KIM
caucuuccaaaggaag

SEQ ID NO: 2322467 - RNA, 13 nt, Yersinia pestis KIM
caucuuauuauua

SEQ ID NO: 2322468 - RNA, 19 nt, Yersinia pestis KIM
caucuuucggccuccccug

SEQ ID NO: 2322469 - RNA, 19 nt, Yersinia pestis KIM
caucuugggccgacucugc

SEQ ID NO: 2322470 - RNA, 12 nt, Yersinia pestis KIM
caucuuuaacaa

SEQ ID NO: 2322471 - RNA, 16 nt, Yersinia pestis KIM
caucuuuaccccauug

SEQ ID NO: 2322472 - RNA, 15 nt, Yersinia pestis KIM
caucuuccgucaguu

SEQ ID NO: 2322473 - RNA, 18 nt, Yersinia pestis KIM
caucuucgcuuucaucuu

SEQ ID NO: 2322474 - RNA, 20 nt, Yersinia pestis KIM
caucuugcgccgaaauaaaa

SEQ ID NO: 2322475 - RNA, 23 nt, Yersinia pestis KIM
caucuugcgccgaaauaaaacca

SEQ ID NO: 2322476 - RNA, 15 nt, Yersinia pestis KIM
caucuucuucuuuaa

SEQ ID NO: 2322477 - RNA, 13 nt, Yersinia pestis KIM
cauccgcuugcag

SEQ ID NO: 2322478 - RNA, 16 nt, Yersinia pestis KIM
cauccuaaagauaauu

SEQ ID NO: 2322479 - RNA, 22 nt, Yersinia pestis KIM
cauccuaaagauaauuaauuca

SEQ ID NO: 2322480 - RNA, 16 nt, Yersinia pestis KIM
cauccguucccacuuc

SEQ ID NO: 2322481 - RNA, 21 nt, Yersinia pestis KIM
caucgacaccaagacugaagu

SEQ ID NO: 2322482 - RNA, 15 nt, Yersinia pestis KIM
cauccugauuacguu

SEQ ID NO: 2322483 - RNA, 23 nt, Yersinia pestis KIM
cauccuccugaucuucauugccu

SEQ ID NO: 2322484 - RNA, 15 nt, Yersinia pestis KIM
cauccucaggaugga

SEQ ID NO: 2322485 - RNA, 15 nt, Yersinia pestis KIM
caucgcucaucgcca

SEQ ID NO: 2322486 - RNA, 19 nt, Yersinia pestis KIM
caucggcguuacaguaagg

SEQ ID NO: 2322487 - RNA, 22 nt, Yersinia pestis KIM
caucggcgaggcguuggcuucu

SEQ ID NO: 2322488 - RNA, 22 nt, Yersinia pestis KIM
caucgcggaugcgcgcgucacu

SEQ ID NO: 2322489 - RNA, 20 nt, Yersinia pestis KIM
caucgcggaugcgcgcguca

SEQ ID NO: 2322490 - RNA, 17 nt, Yersinia pestis KIM
caucgccuucuggcaaa

SEQ ID NO: 2322491 - RNA, 13 nt, Yersinia pestis KIM
caucgccagcggg

SEQ ID NO: 2322492 - RNA, 19 nt, Yersinia pestis KIM
caucgccaguaaaaacuca

SEQ ID NO: 2322493 - RNA, 16 nt, Yersinia pestis KIM
caucgccccaaagaua

SEQ ID NO: 2322494 - RNA, 19 nt, Yersinia pestis KIM
caucgacuugaugaaguua

SEQ ID NO: 2322495 - RNA, 20 nt, Yersinia pestis KIM
caucgaguccguuaaaaaau

SEQ ID NO: 2322496 - RNA, 21 nt, Yersinia pestis KIM
caucgaguccguuaaaaaauu

SEQ ID NO: 2322497 - RNA, 16 nt, Yersinia pestis KIM
caucagccagccacug

SEQ ID NO: 2322498 - RNA, 18 nt, Yersinia pestis KIM
caucacggcgaguucgau

SEQ ID NO: 2322499 - RNA, 15 nt, Yersinia pestis KIM
caucagccucuaaca

SEQ ID NO: 2322500 - RNA, 16 nt, Yersinia pestis KIM
caucagcgcacugcau

SEQ ID NO: 2322501 - RNA, 18 nt, Yersinia pestis KIM
caucaccgcuaucacuga

SEQ ID NO: 2322502 - RNA, 13 nt, Yersinia pestis KIM
caucacgcagcag

SEQ ID NO: 2322503 - RNA, 16 nt, Yersinia pestis KIM
caucacgcucaucggu

SEQ ID NO: 2322504 - RNA, 19 nt, Yersinia pestis KIM
caucaguaauuuuuuguag

SEQ ID NO: 2322505 - RNA, 14 nt, Yersinia pestis KIM
caucaguaaaauac

SEQ ID NO: 2322506 - RNA, 12 nt, Yersinia pestis KIM
caucaguucacu

SEQ ID NO: 2322507 - RNA, 16 nt, Yersinia pestis KIM
caucaguuuauuguua

SEQ ID NO: 2322508 - RNA, 16 nt, Yersinia pestis KIM
caucauaaaaauacau

SEQ ID NO: 2322509 - RNA, 19 nt, Yersinia pestis KIM
caucauaaaaauacauauc

SEQ ID NO: 2322510 - RNA, 18 nt, Yersinia pestis KIM
caucaggcgcuuuucuau

SEQ ID NO: 2322511 - RNA, 18 nt, Yersinia pestis KIM
caucagguuguauuuugc

SEQ ID NO: 2322512 - RNA, 21 nt, Yersinia pestis KIM
caucagggugaccgcacugcc

SEQ ID NO: 2322513 - RNA, 16 nt, Yersinia pestis KIM
caucaggcuuauauuu

SEQ ID NO: 2322514 - RNA, 13 nt, Yersinia pestis KIM
caucaugacaaaa

SEQ ID NO: 2322515 - RNA, 19 nt, Yersinia pestis KIM
caucaugagauaaauauuu

SEQ ID NO: 2322516 - RNA, 13 nt, Yersinia pestis KIM
caucaucuucuuc

SEQ ID NO: 2322517 - RNA, 17 nt, Yersinia pestis KIM
caucaugaguaaaagau

SEQ ID NO: 2322518 - RNA, 16 nt, Yersinia pestis KIM
caucauuguuuacuau

SEQ ID NO: 2322519 - RNA, 14 nt, Yersinia pestis KIM
caucauuugagcug

SEQ ID NO: 2322520 - RNA, 19 nt, Yersinia pestis KIM
cauccacaucuugcgccga

SEQ ID NO: 2322521 - RNA, 12 nt, Yersinia pestis KIM
caucauccauaa

SEQ ID NO: 2322522 - RNA, 14 nt, Yersinia pestis KIM
caucauccaucaca

SEQ ID NO: 2322523 - RNA, 16 nt, Yersinia pestis KIM
caucaucacaaauaac

SEQ ID NO: 2322524 - RNA, 15 nt, Yersinia pestis KIM
caucaucacaaauaa

SEQ ID NO: 2322525 - RNA, 22 nt, Yersinia pestis KIM
caucaucaaaaccgaugaguga

SEQ ID NO: 2322526 - RNA, 12 nt, Yersinia pestis KIM
caucaucaaaac

SEQ ID NO: 2322527 - RNA, 18 nt, Yersinia pestis KIM
caucaucacauucaaaca

SEQ ID NO: 2322528 - RNA, 12 nt, Yersinia pestis KIM
caucauacugac

SEQ ID NO: 2322529 - RNA, 17 nt, Yersinia pestis KIM
cauacuuuucauuuccu

SEQ ID NO: 2322530 - RNA, 14 nt, Yersinia pestis KIM
cauauaaucauacu

SEQ ID NO: 2322531 - RNA, 19 nt, Yersinia pestis KIM
cauauaaccaugcgauacg

SEQ ID NO: 2322532 - RNA, 19 nt, Yersinia pestis KIM
cauauaucacuauuucagg

SEQ ID NO: 2322533 - RNA, 15 nt, Yersinia pestis KIM
cauauauugcauuua

SEQ ID NO: 2322534 - RNA, 15 nt, Yersinia pestis KIM
cauauaucacuauuu

SEQ ID NO: 2322535 - RNA, 14 nt, Yersinia pestis KIM
cauaucaaacagcu

SEQ ID NO: 2322536 - RNA, 11 nt, Yersinia pestis KIM
cauauauuuca

SEQ ID NO: 2322537 - RNA, 16 nt, Yersinia pestis KIM
cauaucaacacugccu

SEQ ID NO: 2322538 - RNA, 14 nt, Yersinia pestis KIM
cauaucaaccguuu

SEQ ID NO: 2322539 - RNA, 23 nt, Yersinia pestis KIM
cauaugggcaucucaauauguug

SEQ ID NO: 2322540 - RNA, 21 nt, Yersinia pestis KIM
cauauuaacauaucaauaagu

SEQ ID NO: 2322541 - RNA, 17 nt, Yersinia pestis KIM
cauauuaccgcugaaaa

SEQ ID NO: 2322542 - RNA, 15 nt, Yersinia pestis KIM
cauauuacucucuau

SEQ ID NO: 2322543 - RNA, 13 nt, Yersinia pestis KIM
cauaucguccaaa

SEQ ID NO: 2322544 - RNA, 11 nt, Yersinia pestis KIM
cauaugacaaa

SEQ ID NO: 2322545 - RNA, 15 nt, Yersinia pestis KIM
cauaugaaugagcag

SEQ ID NO: 2322546 - RNA, 15 nt, Yersinia pestis KIM
cauaucuugaaccaa

SEQ ID NO: 2322547 - RNA, 20 nt, Yersinia pestis KIM
cauaucuugaaccaauuuuu

SEQ ID NO: 2322548 - RNA, 22 nt, Yersinia pestis KIM
cauaucuugaaccaauuuuucu

SEQ ID NO: 2322549 - RNA, 16 nt, Yersinia pestis KIM
cauaugaguuucaaau

SEQ ID NO: 2322550 - RNA, 23 nt, Yersinia pestis KIM
cauaugcauggcauauucaccag

SEQ ID NO: 2322551 - RNA, 14 nt, Yersinia pestis KIM
cauauucaaccgcc

SEQ ID NO: 2322552 - RNA, 23 nt, Yersinia pestis KIM
cauauucaaugcggcuuuacugg

SEQ ID NO: 2322553 - RNA, 12 nt, Yersinia pestis KIM
cauauucaccag

SEQ ID NO: 2322554 - RNA, 13 nt, Yersinia pestis KIM
cauauuuuaaaua

SEQ ID NO: 2322555 - RNA, 14 nt, Yersinia pestis KIM
cauauuuuucaaua

SEQ ID NO: 2322556 - RNA, 16 nt, Yersinia pestis KIM
caucaacauuguccug

SEQ ID NO: 2322557 - RNA, 12 nt, Yersinia pestis KIM
caucaaaacaau

SEQ ID NO: 2322558 - RNA, 14 nt, Yersinia pestis KIM
caucaaaauauguu

SEQ ID NO: 2322559 - RNA, 22 nt, Yersinia pestis KIM
caucaauaauaacgaauuucau

SEQ ID NO: 2322560 - RNA, 13 nt, Yersinia pestis KIM
caucaauaacggu

SEQ ID NO: 2322561 - RNA, 14 nt, Yersinia pestis KIM
caucaauaaaauua

SEQ ID NO: 2322562 - RNA, 19 nt, Yersinia pestis KIM
caucaauaaaauuacccag

SEQ ID NO: 2322563 - RNA, 20 nt, Yersinia pestis KIM
caucacccgcagugccuuau

SEQ ID NO: 2322564 - RNA, 15 nt, Yersinia pestis KIM
caucaacgacagcag

SEQ ID NO: 2322565 - RNA, 22 nt, Yersinia pestis KIM
caucaaccgggauaucaaauuc

SEQ ID NO: 2322566 - RNA, 22 nt, Yersinia pestis KIM
caucaaccucagccucauucau

SEQ ID NO: 2322567 - RNA, 15 nt, Yersinia pestis KIM
caucaacuuugguuu

SEQ ID NO: 2322568 - RNA, 23 nt, Yersinia pestis KIM
caucaacuuugguuuuugaggaa

SEQ ID NO: 2322569 - RNA, 15 nt, Yersinia pestis KIM
caucaaggugccaua

SEQ ID NO: 2322570 - RNA, 16 nt, Yersinia pestis KIM
caucaagccaccgcug

SEQ ID NO: 2322571 - RNA, 23 nt, Yersinia pestis KIM
cauugaguucugaucauuauuau

SEQ ID NO: 2322572 - RNA, 14 nt, Yersinia pestis KIM
cauugauaauaaua

SEQ ID NO: 2322573 - RNA, 19 nt, Yersinia pestis KIM
cauugauaagccauuuuuu

SEQ ID NO: 2322574 - RNA, 19 nt, Yersinia pestis KIM
cauugaggguugucagcag

SEQ ID NO: 2322575 - RNA, 22 nt, Yersinia pestis KIM
cauugagcgccacaucggcguu

SEQ ID NO: 2322576 - RNA, 22 nt, Yersinia pestis KIM
cauugacgauaucaauaaagaa

SEQ ID NO: 2322577 - RNA, 13 nt, Yersinia pestis KIM
cauugacguuaca

SEQ ID NO: 2322578 - RNA, 13 nt, Yersinia pestis KIM
cauugaccgccaa

SEQ ID NO: 2322579 - RNA, 11 nt, Yersinia pestis KIM
cauucuuaucg

SEQ ID NO: 2322580 - RNA, 13 nt, Yersinia pestis KIM
cauugaccagauu

SEQ ID NO: 2322581 - RNA, 20 nt, Yersinia pestis KIM
cauucuaguuugugcugcua

SEQ ID NO: 2322582 - RNA, 16 nt, Yersinia pestis KIM
cauucuaucauccuug

SEQ ID NO: 2322583 - RNA, 19 nt, Yersinia pestis KIM
cauucugauagugauuuuu

SEQ ID NO: 2322584 - RNA, 15 nt, Yersinia pestis KIM
cauucugaaugguuu

SEQ ID NO: 2322585 - RNA, 22 nt, Yersinia pestis KIM
cauucucuacucgcucaccacu

SEQ ID NO: 2322586 - RNA, 14 nt, Yersinia pestis KIM
cauuaucuuuaauu

SEQ ID NO: 2322587 - RNA, 23 nt, Yersinia pestis KIM
cauuaucuuccauagauacacuc

SEQ ID NO: 2322588 - RNA, 21 nt, Yersinia pestis KIM
cauuaucuaaacaauugccuu

SEQ ID NO: 2322589 - RNA, 15 nt, Yersinia pestis KIM
cauuaucugaaagca

SEQ ID NO: 2322590 - RNA, 14 nt, Yersinia pestis KIM
cauugugcuuuuug

SEQ ID NO: 2322591 - RNA, 12 nt, Yersinia pestis KIM
cauuguggagga

SEQ ID NO: 2322592 - RNA, 17 nt, Yersinia pestis KIM
cauuguggcuaaaccca

SEQ ID NO: 2322593 - RNA, 17 nt, Yersinia pestis KIM
cauuggaaaaaaucuuc

SEQ ID NO: 2322594 - RNA, 20 nt, Yersinia pestis KIM
cauuggauaauuugccuggc

SEQ ID NO: 2322595 - RNA, 14 nt, Yersinia pestis KIM
cauuuaaaauacuc

SEQ ID NO: 2322596 - RNA, 16 nt, Yersinia pestis KIM
cauugcgcuaacagcg

SEQ ID NO: 2322597 - RNA, 16 nt, Yersinia pestis KIM
cauugcugcuguuauu

SEQ ID NO: 2322598 - RNA, 20 nt, Yersinia pestis KIM
cauugcugcuguuauuacug

SEQ ID NO: 2322599 - RNA, 16 nt, Yersinia pestis KIM
cauugcaaacaucaca

SEQ ID NO: 2322600 - RNA, 14 nt, Yersinia pestis KIM
cauugauccucguu

SEQ ID NO: 2322601 - RNA, 15 nt, Yersinia pestis KIM
cauuugagcuguuau

SEQ ID NO: 2322602 - RNA, 23 nt, Yersinia pestis KIM
cauuugaccuccguaggccaacc

SEQ ID NO: 2322603 - RNA, 23 nt, Yersinia pestis KIM
cauuucugguugugcuucagaca

SEQ ID NO: 2322604 - RNA, 13 nt, Yersinia pestis KIM
cauuuaauucagu

SEQ ID NO: 2322605 - RNA, 15 nt, Yersinia pestis KIM
cauuuaauucaguua

SEQ ID NO: 2322606 - RNA, 19 nt, Yersinia pestis KIM
cauuuaagccaauaauaua

SEQ ID NO: 2322607 - RNA, 21 nt, Yersinia pestis KIM
cauuuaauaacuuaaauaauu

SEQ ID NO: 2322608 - RNA, 13 nt, Yersinia pestis KIM
cauuugcaucuau

SEQ ID NO: 2322609 - RNA, 18 nt, Yersinia pestis KIM
cauuugcaucuauggauu

SEQ ID NO: 2322610 - RNA, 18 nt, Yersinia pestis KIM
cauuugcucgauuucacu

SEQ ID NO: 2322611 - RNA, 14 nt, Yersinia pestis KIM
cauuugggguguua

SEQ ID NO: 2322612 - RNA, 13 nt, Yersinia pestis KIM
cauuuguuucuga

SEQ ID NO: 2322613 - RNA, 19 nt, Yersinia pestis KIM
cauuugucguuauaaacca

SEQ ID NO: 2322614 - RNA, 18 nt, Yersinia pestis KIM
cauuuuaaucucuccaug

SEQ ID NO: 2322615 - RNA, 12 nt, Yersinia pestis KIM
cauuuuacgccu

SEQ ID NO: 2322616 - RNA, 19 nt, Yersinia pestis KIM
cauuuuacaggauuaaaua

SEQ ID NO: 2322617 - RNA, 20 nt, Yersinia pestis KIM
cauuuuacaggauuaaauaa

SEQ ID NO: 2322618 - RNA, 21 nt, Yersinia pestis KIM
cauuuuccugcauauuauuuu

SEQ ID NO: 2322619 - RNA, 14 nt, Yersinia pestis KIM
cauuuucuaagcug

SEQ ID NO: 2322620 - RNA, 17 nt, Yersinia pestis KIM
cauuuucuaagcugccu

SEQ ID NO: 2322621 - RNA, 20 nt, Yersinia pestis KIM
cauuuucuaagcugccugug

SEQ ID NO: 2322622 - RNA, 22 nt, Yersinia pestis KIM
cauuuucuaagcugccugugcg

SEQ ID NO: 2322623 - RNA, 19 nt, Yersinia pestis KIM
cauuuucuggugagcauca

SEQ ID NO: 2322624 - RNA, 14 nt, Yersinia pestis KIM
cauuuucaauacca

SEQ ID NO: 2322625 - RNA, 21 nt, Yersinia pestis KIM
cauuuuguauuuuguuuuuuu

SEQ ID NO: 2322626 - RNA, 13 nt, Yersinia pestis KIM
cauuuuuaacauc

SEQ ID NO: 2322627 - RNA, 12 nt, Yersinia pestis KIM
cauuuugaccag

SEQ ID NO: 2322628 - RNA, 21 nt, Yersinia pestis KIM
cauuuuuuagcccuaacugcu

SEQ ID NO: 2322629 - RNA, 15 nt, Yersinia pestis KIM
cauuuuuuauaaaca

SEQ ID NO: 2322630 - RNA, 19 nt, Yersinia pestis KIM
cauuuuuuaucuuguaaau

SEQ ID NO: 2322631 - RNA, 23 nt, Yersinia pestis KIM
cauuuuuuaucuuguaaauaguc

SEQ ID NO: 2322632 - RNA, 18 nt, Yersinia pestis KIM
cauuaccaaggaaaccac

SEQ ID NO: 2322633 - RNA, 20 nt, Yersinia pestis KIM
cauuacaagugccaaaugga

SEQ ID NO: 2322634 - RNA, 11 nt, Yersinia pestis KIM
cauuacaccau

SEQ ID NO: 2322635 - RNA, 18 nt, Yersinia pestis KIM
cauuaauuuaucugcuaa

SEQ ID NO: 2322636 - RNA, 19 nt, Yersinia pestis KIM
cauuaauuuaucugcuaau

SEQ ID NO: 2322637 - RNA, 15 nt, Yersinia pestis KIM
cauuaauuucaccac

SEQ ID NO: 2322638 - RNA, 17 nt, Yersinia pestis KIM
cauuaauuaaucagaca

SEQ ID NO: 2322639 - RNA, 18 nt, Yersinia pestis KIM
cauuaauuaaucagacac

SEQ ID NO: 2322640 - RNA, 17 nt, Yersinia pestis KIM
cauuacugucuuuuaau

SEQ ID NO: 2322641 - RNA, 19 nt, Yersinia pestis KIM
cauuagccccaaaugccag

SEQ ID NO: 2322642 - RNA, 18 nt, Yersinia pestis KIM
cauuaaucagcgaaugcc

SEQ ID NO: 2322643 - RNA, 22 nt, Yersinia pestis KIM
cauuaaugcagguucauuacac

SEQ ID NO: 2322644 - RNA, 17 nt, Yersinia pestis KIM
cauuaauaccguuuucu

SEQ ID NO: 2322645 - RNA, 22 nt, Yersinia pestis KIM
cauuaauaccguuuucuuucaa

SEQ ID NO: 2322646 - RNA, 16 nt, Yersinia pestis KIM
cauuaauaauaugcac

SEQ ID NO: 2322647 - RNA, 16 nt, Yersinia pestis KIM
cauuaacaauuacuuu

SEQ ID NO: 2322648 - RNA, 16 nt, Yersinia pestis KIM
cauuaacacauuaauu

SEQ ID NO: 2322649 - RNA, 16 nt, Yersinia pestis KIM
cauuaaccuaaaaacg

SEQ ID NO: 2322650 - RNA, 14 nt, Yersinia pestis KIM
cauuaaggagugcc

SEQ ID NO: 2322651 - RNA, 19 nt, Yersinia pestis KIM
cauggucaucgcuucacac

SEQ ID NO: 2322652 - RNA, 14 nt, Yersinia pestis KIM
cauuaaaagcaugc

SEQ ID NO: 2322653 - RNA, 12 nt, Yersinia pestis KIM
cauuaaaaacaa

SEQ ID NO: 2322654 - RNA, 13 nt, Yersinia pestis KIM
cauuaaaaacaaa

SEQ ID NO: 2322655 - RNA, 18 nt, Yersinia pestis KIM
cauuaaagguacguaauu

SEQ ID NO: 2322656 - RNA, 19 nt, Yersinia pestis KIM
cauuaaagguacguaauuu

SEQ ID NO: 2322657 - RNA, 16 nt, Yersinia pestis KIM
cauguugaguuuacgc

SEQ ID NO: 2322658 - RNA, 15 nt, Yersinia pestis KIM
cauguuuaucaaaca

SEQ ID NO: 2322659 - RNA, 23 nt, Yersinia pestis KIM
caugccucguuggaucaucggga

SEQ ID NO: 2322660 - RNA, 17 nt, Yersinia pestis KIM
caugccuaauuugguac

SEQ ID NO: 2322661 - RNA, 17 nt, Yersinia pestis KIM
caugcccauacacaguc

SEQ ID NO: 2322662 - RNA, 15 nt, Yersinia pestis KIM
caugcgaauacuuug

SEQ ID NO: 2322663 - RNA, 12 nt, Yersinia pestis KIM
caucuuuuucug

SEQ ID NO: 2322664 - RNA, 19 nt, Yersinia pestis KIM
caucuuuuucugccugagu

SEQ ID NO: 2322665 - RNA, 11 nt, Yersinia pestis KIM
caugcaacaga

SEQ ID NO: 2322666 - RNA, 15 nt, Yersinia pestis KIM
caugaaaucagagag

SEQ ID NO: 2322667 - RNA, 17 nt, Yersinia pestis KIM
caugaaaucagagaguu

SEQ ID NO: 2322668 - RNA, 16 nt, Yersinia pestis KIM
caugauuucucgcuuu

SEQ ID NO: 2322669 - RNA, 12 nt, Yersinia pestis KIM
caugcacaguug

SEQ ID NO: 2322670 - RNA, 22 nt, Yersinia pestis KIM
caugggcuugcauaucagcaau

SEQ ID NO: 2322671 - RNA, 20 nt, Yersinia pestis KIM
caugggugccccauauuuuc

SEQ ID NO: 2322672 - RNA, 16 nt, Yersinia pestis KIM
caugguaagaauaaau

SEQ ID NO: 2322673 - RNA, 19 nt, Yersinia pestis KIM
caugguagccugcacggcu

SEQ ID NO: 2322674 - RNA, 14 nt, Yersinia pestis KIM
caugggaaacaagg

SEQ ID NO: 2322675 - RNA, 16 nt, Yersinia pestis KIM
cauggcuugugcagca

SEQ ID NO: 2322676 - RNA, 13 nt, Yersinia pestis KIM
caugggaaaucaa

SEQ ID NO: 2322677 - RNA, 14 nt, Yersinia pestis KIM
cauggcugggaagg

SEQ ID NO: 2322678 - RNA, 15 nt, Yersinia pestis KIM
cauggcugaaauaac

SEQ ID NO: 2322679 - RNA, 16 nt, Yersinia pestis KIM
cauggcugaaauaacu

SEQ ID NO: 2322680 - RNA, 20 nt, Yersinia pestis KIM
cauggauggucauaaaaucg

SEQ ID NO: 2322681 - RNA, 20 nt, Yersinia pestis KIM
cauggaucacccguugcaag

SEQ ID NO: 2322682 - RNA, 19 nt, Yersinia pestis KIM
cauggcaaccccuaaucca

SEQ ID NO: 2322683 - RNA, 23 nt, Yersinia pestis KIM
caugcguugaugcucuucuucac

SEQ ID NO: 2322684 - RNA, 16 nt, Yersinia pestis KIM
caugcguaaaugaaau

SEQ ID NO: 2322685 - RNA, 23 nt, Yersinia pestis KIM
cauggaaaauauucuaaguaaaa

SEQ ID NO: 2322686 - RNA, 16 nt, Yersinia pestis KIM
cauggaagaccagaua

SEQ ID NO: 2322687 - RNA, 17 nt, Yersinia pestis KIM
cauggagagcagggccc

SEQ ID NO: 2322688 - RNA, 20 nt, Yersinia pestis KIM
cauacgcuuaaccagcacuu

SEQ ID NO: 2322689 - RNA, 17 nt, Yersinia pestis KIM
cauacggcgauauuuau

SEQ ID NO: 2322690 - RNA, 12 nt, Yersinia pestis KIM
cauaccuuaauu

SEQ ID NO: 2322691 - RNA, 20 nt, Yersinia pestis KIM
cauaccggguucaaggaaac

SEQ ID NO: 2322692 - RNA, 19 nt, Yersinia pestis KIM
cauacucuuccaacgcuuc

SEQ ID NO: 2322693 - RNA, 23 nt, Yersinia pestis KIM
cauacuccauuuuuuugaugcau

SEQ ID NO: 2322694 - RNA, 13 nt, Yersinia pestis KIM
cauacucccccau

SEQ ID NO: 2322695 - RNA, 21 nt, Yersinia pestis KIM
cauacuccuuaaucguccggu

SEQ ID NO: 2322696 - RNA, 24 nt, Yersinia pestis KIM
cauacaucgcuggacgcaucagau

SEQ ID NO: 2322697 - RNA, 17 nt, Yersinia pestis KIM
cauacccgcuguacugc

SEQ ID NO: 2322698 - RNA, 21 nt, Yersinia pestis KIM
cauacccgcugcuggaaugca

SEQ ID NO: 2322699 - RNA, 22 nt, Yersinia pestis KIM
cauacccaaauuacggcucagu

SEQ ID NO: 2322700 - RNA, 16 nt, Yersinia pestis KIM
cauaccauaaggccag

SEQ ID NO: 2322701 - RNA, 20 nt, Yersinia pestis KIM
cauaccauaaggccaggcaa

SEQ ID NO: 2322702 - RNA, 19 nt, Yersinia pestis KIM
cauaauccucaaccugauc

SEQ ID NO: 2322703 - RNA, 20 nt, Yersinia pestis KIM
cauaaucugggguuccaggc

SEQ ID NO: 2322704 - RNA, 16 nt, Yersinia pestis KIM
cauaaucuuuacugca

SEQ ID NO: 2322705 - RNA, 16 nt, Yersinia pestis KIM
cauaacgcuuuuucau

SEQ ID NO: 2322706 - RNA, 17 nt, Yersinia pestis KIM
caguugguagagcacga

SEQ ID NO: 2322707 - RNA, 24 nt, Yersinia pestis KIM
caguuggcgcacguucccaggcca

SEQ ID NO: 2322708 - RNA, 15 nt, Yersinia pestis KIM
caguuggccaccauu

SEQ ID NO: 2322709 - RNA, 14 nt, Yersinia pestis KIM
caguugucuauuuu

SEQ ID NO: 2322710 - RNA, 14 nt, Yersinia pestis KIM
caguugucugaggc

SEQ ID NO: 2322711 - RNA, 16 nt, Yersinia pestis KIM
caguugguuagagcac

SEQ ID NO: 2322712 - RNA, 14 nt, Yersinia pestis KIM
caguugaugcaaaa

SEQ ID NO: 2322713 - RNA, 17 nt, Yersinia pestis KIM
caguugauugcaaaaca

SEQ ID NO: 2322714 - RNA, 15 nt, Yersinia pestis KIM
caguugcacaccauc

SEQ ID NO: 2322715 - RNA, 14 nt, Yersinia pestis KIM
caguugcugauucu

SEQ ID NO: 2322716 - RNA, 22 nt, Yersinia pestis KIM
caguugcugauucugacguugg

SEQ ID NO: 2322717 - RNA, 17 nt, Yersinia pestis KIM
caguugcugcucuguca

SEQ ID NO: 2322718 - RNA, 15 nt, Yersinia pestis KIM
caguugaccauuuuu

SEQ ID NO: 2322719 - RNA, 18 nt, Yersinia pestis KIM
caguucugguagcugcuc

SEQ ID NO: 2322720 - RNA, 15 nt, Yersinia pestis KIM
caguguuuucuccac

SEQ ID NO: 2322721 - RNA, 18 nt, Yersinia pestis KIM
cauaaacacgcaaucaga

SEQ ID NO: 2322722 - RNA, 18 nt, Yersinia pestis KIM
cauaaacaaguugaacca

SEQ ID NO: 2322723 - RNA, 19 nt, Yersinia pestis KIM
cauaaagauagccacuaac

SEQ ID NO: 2322724 - RNA, 16 nt, Yersinia pestis KIM
cauaaagauagccacu

SEQ ID NO: 2322725 - RNA, 15 nt, Yersinia pestis KIM
cauaaacugaaguua

SEQ ID NO: 2322726 - RNA, 12 nt, Yersinia pestis KIM
cauaaagaaaag

SEQ ID NO: 2322727 - RNA, 21 nt, Yersinia pestis KIM
cauaaagacccaauacaccac

SEQ ID NO: 2322728 - RNA, 22 nt, Yersinia pestis KIM
cauaaaaacuaaggggccaaua

SEQ ID NO: 2322729 - RNA, 13 nt, Yersinia pestis KIM
cauaaaaagaaaa

SEQ ID NO: 2322730 - RNA, 13 nt, Yersinia pestis KIM
cauaaaaauacau

SEQ ID NO: 2322731 - RNA, 22 nt, Yersinia pestis KIM
cauaaaaagcgacacuuauugg

SEQ ID NO: 2322732 - RNA, 15 nt, Yersinia pestis KIM
cauaaaaauacauau

SEQ ID NO: 2322733 - RNA, 17 nt, Yersinia pestis KIM
cauaaaaagaaaaaaac

SEQ ID NO: 2322734 - RNA, 19 nt, Yersinia pestis KIM
cauaaaaauacauaucaac

SEQ ID NO: 2322735 - RNA, 16 nt, Yersinia pestis KIM
cauaaaaaaagaaggg

SEQ ID NO: 2322736 - RNA, 23 nt, Yersinia pestis KIM
cauaaaaaaagaaggguuagcau

SEQ ID NO: 2322737 - RNA, 22 nt, Yersinia pestis KIM
caguuuacggugauuccuggcc

SEQ ID NO: 2322738 - RNA, 17 nt, Yersinia pestis KIM
caguuuaccauccacua

SEQ ID NO: 2322739 - RNA, 17 nt, Yersinia pestis KIM
cauaaauauugguacau

SEQ ID NO: 2322740 - RNA, 21 nt, Yersinia pestis KIM
cauaaaucacaauuucacccc

SEQ ID NO: 2322741 - RNA, 18 nt, Yersinia pestis KIM
cauaaauucuagcaacau

SEQ ID NO: 2322742 - RNA, 18 nt, Yersinia pestis KIM
cauaaccgcuaaggccaa

SEQ ID NO: 2322743 - RNA, 16 nt, Yersinia pestis KIM
cauaaccgcuaaggcc

SEQ ID NO: 2322744 - RNA, 13 nt, Yersinia pestis KIM
cauaaccauugaa

SEQ ID NO: 2322745 - RNA, 17 nt, Yersinia pestis KIM
cauaaccaucaaacaua

SEQ ID NO: 2322746 - RNA, 17 nt, Yersinia pestis KIM
cauaacaacgacuccau

SEQ ID NO: 2322747 - RNA, 14 nt, Yersinia pestis KIM
cagguaaaacauuu

SEQ ID NO: 2322748 - RNA, 17 nt, Yersinia pestis KIM
caggugcguuaucuuca

SEQ ID NO: 2322749 - RNA, 18 nt, Yersinia pestis KIM
caggugcguuaucuucac

SEQ ID NO: 2322750 - RNA, 18 nt, Yersinia pestis KIM
caggugcgauuaaccuua

SEQ ID NO: 2322751 - RNA, 15 nt, Yersinia pestis KIM
caguaaacagccagc

SEQ ID NO: 2322752 - RNA, 19 nt, Yersinia pestis KIM
caguaaacagccagcauca

SEQ ID NO: 2322753 - RNA, 16 nt, Yersinia pestis KIM
caguaaacauuuugac

SEQ ID NO: 2322754 - RNA, 18 nt, Yersinia pestis KIM
caguaaacauuuugacuu

SEQ ID NO: 2322755 - RNA, 22 nt, Yersinia pestis KIM
caguaaaaucaucagccucuaa

SEQ ID NO: 2322756 - RNA, 16 nt, Yersinia pestis KIM
caguaaaauauugaua

SEQ ID NO: 2322757 - RNA, 13 nt, Yersinia pestis KIM
caguaaaaaaaua

SEQ ID NO: 2322758 - RNA, 14 nt, Yersinia pestis KIM
caguaaaaaaauag

SEQ ID NO: 2322759 - RNA, 14 nt, Yersinia pestis KIM
caguaaaaacucac

SEQ ID NO: 2322760 - RNA, 12 nt, Yersinia pestis KIM
caguaaaaacug

SEQ ID NO: 2322761 - RNA, 22 nt, Yersinia pestis KIM
caguaaaaaaaccccguacaug

SEQ ID NO: 2322762 - RNA, 19 nt, Yersinia pestis KIM
caguaaacugcgcuuccag

SEQ ID NO: 2322763 - RNA, 13 nt, Yersinia pestis KIM
caguaagaucuuc

SEQ ID NO: 2322764 - RNA, 11 nt, Yersinia pestis KIM
caguaagcucu

SEQ ID NO: 2322765 - RNA, 12 nt, Yersinia pestis KIM
caguaaggcagc

SEQ ID NO: 2322766 - RNA, 19 nt, Yersinia pestis KIM
caguaaguuaaaaagaaaa

SEQ ID NO: 2322767 - RNA, 20 nt, Yersinia pestis KIM
caguaaguuaaaaagaaaaa

SEQ ID NO: 2322768 - RNA, 17 nt, Yersinia pestis KIM
caguagcagggccgccc

SEQ ID NO: 2322769 - RNA, 21 nt, Yersinia pestis KIM
caguagacgacacaaaugcug

SEQ ID NO: 2322770 - RNA, 19 nt, Yersinia pestis KIM
caguagaagcuaccagcac

SEQ ID NO: 2322771 - RNA, 20 nt, Yersinia pestis KIM
caguagaagcuaccagcacc

SEQ ID NO: 2322772 - RNA, 14 nt, Yersinia pestis KIM
cagucaauaaacau

SEQ ID NO: 2322773 - RNA, 22 nt, Yersinia pestis KIM
cagucaaaagaaacugucaguc

SEQ ID NO: 2322774 - RNA, 22 nt, Yersinia pestis KIM
caguauuuuaagaaaacugugc

SEQ ID NO: 2322775 - RNA, 13 nt, Yersinia pestis KIM
caguaucaaccac

SEQ ID NO: 2322776 - RNA, 14 nt, Yersinia pestis KIM
cagugcacagucac

SEQ ID NO: 2322777 - RNA, 13 nt, Yersinia pestis KIM
cagugaacugcuc

SEQ ID NO: 2322778 - RNA, 21 nt, Yersinia pestis KIM
cagugaaggaugaauaaauga

SEQ ID NO: 2322779 - RNA, 15 nt, Yersinia pestis KIM
caguguaaaaagcga

SEQ ID NO: 2322780 - RNA, 22 nt, Yersinia pestis KIM
cagugguuuuauaaauaaauag

SEQ ID NO: 2322781 - RNA, 18 nt, Yersinia pestis KIM
caguggccauugaacaua

SEQ ID NO: 2322782 - RNA, 14 nt, Yersinia pestis KIM
cagugucaguucga

SEQ ID NO: 2322783 - RNA, 16 nt, Yersinia pestis KIM
cagugucaguaugaaa

SEQ ID NO: 2322784 - RNA, 17 nt, Yersinia pestis KIM
caguguaucaauaggau

SEQ ID NO: 2322785 - RNA, 18 nt, Yersinia pestis KIM
caguguauuaccugcgac

SEQ ID NO: 2322786 - RNA, 19 nt, Yersinia pestis KIM
caguguacgaauauguucu

SEQ ID NO: 2322787 - RNA, 21 nt, Yersinia pestis KIM
cagugcauccccacugacauc

SEQ ID NO: 2322788 - RNA, 19 nt, Yersinia pestis KIM
cagugccaauugaguaacu

SEQ ID NO: 2322789 - RNA, 17 nt, Yersinia pestis KIM
cagugccaagguucgaa

SEQ ID NO: 2322790 - RNA, 20 nt, Yersinia pestis KIM
cagucgacaguguaaaaagc

SEQ ID NO: 2322791 - RNA, 13 nt, Yersinia pestis KIM
cagucgauaaaca

SEQ ID NO: 2322792 - RNA, 11 nt, Yersinia pestis KIM
cagucacugcu

SEQ ID NO: 2322793 - RNA, 17 nt, Yersinia pestis KIM
cagucacugcugcacug

SEQ ID NO: 2322794 - RNA, 19 nt, Yersinia pestis KIM
cagucacugcugcacuggc

SEQ ID NO: 2322795 - RNA, 20 nt, Yersinia pestis KIM
cagucacugcugcacuggcg

SEQ ID NO: 2322796 - RNA, 21 nt, Yersinia pestis KIM
cagucagcacuccguuaccaa

SEQ ID NO: 2322797 - RNA, 13 nt, Yersinia pestis KIM
cagucaguaggcu

SEQ ID NO: 2322798 - RNA, 18 nt, Yersinia pestis KIM
cagucagccuuaauguuu

SEQ ID NO: 2322799 - RNA, 23 nt, Yersinia pestis KIM
cagucugagccucaugaaugagg

SEQ ID NO: 2322800 - RNA, 17 nt, Yersinia pestis KIM
cagucugagggccacuu

SEQ ID NO: 2322801 - RNA, 17 nt, Yersinia pestis KIM
cagucugaaaucuccuc

SEQ ID NO: 2322802 - RNA, 23 nt, Yersinia pestis KIM
cagucugaaggguauugaagaua

SEQ ID NO: 2322803 - RNA, 17 nt, Yersinia pestis KIM
cagucuagugcgcugug

SEQ ID NO: 2322804 - RNA, 19 nt, Yersinia pestis KIM
cagucugucguacuuuccu

SEQ ID NO: 2322805 - RNA, 13 nt, Yersinia pestis KIM
cagucuuccauga

SEQ ID NO: 2322806 - RNA, 19 nt, Yersinia pestis KIM
caggccgcgaauauggcau

SEQ ID NO: 2322807 - RNA, 24 nt, Yersinia pestis KIM
caggcgugggcuaauugaauacaa

SEQ ID NO: 2322808 - RNA, 17 nt, Yersinia pestis KIM
caggcuacggcugaucu

SEQ ID NO: 2322809 - RNA, 17 nt, Yersinia pestis KIM
caggcguucuguagcug

SEQ ID NO: 2322810 - RNA, 15 nt, Yersinia pestis KIM
cagggagccgcccug

SEQ ID NO: 2322811 - RNA, 12 nt, Yersinia pestis KIM
cagggagccgcc

SEQ ID NO: 2322812 - RNA, 13 nt, Yersinia pestis KIM
cagggcagccaau

SEQ ID NO: 2322813 - RNA, 21 nt, Yersinia pestis KIM
cagggcaaucaggaaaggccg

SEQ ID NO: 2322814 - RNA, 13 nt, Yersinia pestis KIM
cagggccacuucg

SEQ ID NO: 2322815 - RNA, 15 nt, Yersinia pestis KIM
caggcucccaagggu

SEQ ID NO: 2322816 - RNA, 15 nt, Yersinia pestis KIM
cagggcgaucaggaa

SEQ ID NO: 2322817 - RNA, 24 nt, Yersinia pestis KIM
cagggcgauagcccuacuggcuga

SEQ ID NO: 2322818 - RNA, 19 nt, Yersinia pestis KIM
cagggccgauaaaaaaccc

SEQ ID NO: 2322819 - RNA, 21 nt, Yersinia pestis KIM
cagggccaguuaccgaugauu

SEQ ID NO: 2322820 - RNA, 15 nt, Yersinia pestis KIM
caggguaauaaccga

SEQ ID NO: 2322821 - RNA, 23 nt, Yersinia pestis KIM
cagggugguguagagcucuucug

SEQ ID NO: 2322822 - RNA, 17 nt, Yersinia pestis KIM
cagggugcgggccagaa

SEQ ID NO: 2322823 - RNA, 14 nt, Yersinia pestis KIM
cagggcuuucacau

SEQ ID NO: 2322824 - RNA, 17 nt, Yersinia pestis KIM
caggggaguaaaggaug

SEQ ID NO: 2322825 - RNA, 19 nt, Yersinia pestis KIM
cagggcguauaaacagagc

SEQ ID NO: 2322826 - RNA, 16 nt, Yersinia pestis KIM
cagggcguauaaacag

SEQ ID NO: 2322827 - RNA, 16 nt, Yersinia pestis KIM
cagggcggcguuagcc

SEQ ID NO: 2322828 - RNA, 18 nt, Yersinia pestis KIM
cagcucaaagaccacauc

SEQ ID NO: 2322829 - RNA, 22 nt, Yersinia pestis KIM
cagcuauguacgcaaguaucuu

SEQ ID NO: 2322830 - RNA, 16 nt, Yersinia pestis KIM
cagcuaucuugaaaca

SEQ ID NO: 2322831 - RNA, 15 nt, Yersinia pestis KIM
cagcuagccugcccc

SEQ ID NO: 2322832 - RNA, 15 nt, Yersinia pestis KIM
cagcggcggcgcuga

SEQ ID NO: 2322833 - RNA, 23 nt, Yersinia pestis KIM
cagcucaucgucgugugucuuaa

SEQ ID NO: 2322834 - RNA, 15 nt, Yersinia pestis KIM
cagcuucuuuuaaag

SEQ ID NO: 2322835 - RNA, 17 nt, Yersinia pestis KIM
cagcuucuuuuaaagaa

SEQ ID NO: 2322836 - RNA, 16 nt, Yersinia pestis KIM
cagcugcuuuaucgua

SEQ ID NO: 2322837 - RNA, 23 nt, Yersinia pestis KIM
cagcuggaugugagucugcggau

SEQ ID NO: 2322838 - RNA, 20 nt, Yersinia pestis KIM
cagcuugauagggcugaaga

SEQ ID NO: 2322839 - RNA, 23 nt, Yersinia pestis KIM
caggaagcccgucagacugcuga

SEQ ID NO: 2322840 - RNA, 21 nt, Yersinia pestis KIM
caggaagcggccagguucaau

SEQ ID NO: 2322841 - RNA, 16 nt, Yersinia pestis KIM
caggaagcggccaggu

SEQ ID NO: 2322842 - RNA, 13 nt, Yersinia pestis KIM
caggaagcggcca

SEQ ID NO: 2322843 - RNA, 19 nt, Yersinia pestis KIM
caggauaaaccuacagcca

SEQ ID NO: 2322844 - RNA, 15 nt, Yersinia pestis KIM
caggagugaauuucu

SEQ ID NO: 2322845 - RNA, 15 nt, Yersinia pestis KIM
caggaucugcuccuc

SEQ ID NO: 2322846 - RNA, 16 nt, Yersinia pestis KIM
caggcagagcaagggu

SEQ ID NO: 2322847 - RNA, 14 nt, Yersinia pestis KIM
caggcagaaauaau

SEQ ID NO: 2322848 - RNA, 14 nt, Yersinia pestis KIM
caggauuaaauaaa

SEQ ID NO: 2322849 - RNA, 16 nt, Yersinia pestis KIM
cacuugcucuaccacg

SEQ ID NO: 2322850 - RNA, 20 nt, Yersinia pestis KIM
cacuugugguaaccccgucg

SEQ ID NO: 2322851 - RNA, 16 nt, Yersinia pestis KIM
cacuugguauguuugu

SEQ ID NO: 2322852 - RNA, 22 nt, Yersinia pestis KIM
cacuuggguagcagcccaacac

SEQ ID NO: 2322853 - RNA, 15 nt, Yersinia pestis KIM
cacuugcaacauuau

SEQ ID NO: 2322854 - RNA, 19 nt, Yersinia pestis KIM
cacuuuaaauacccagcuu

SEQ ID NO: 2322855 - RNA, 12 nt, Yersinia pestis KIM
cacuuuaaauac

SEQ ID NO: 2322856 - RNA, 18 nt, Yersinia pestis KIM
cacuuucaacuauugcau

SEQ ID NO: 2322857 - RNA, 17 nt, Yersinia pestis KIM
cacuuuaccgauuucag

SEQ ID NO: 2322858 - RNA, 20 nt, Yersinia pestis KIM
cacuuuugcuggugucacaa

SEQ ID NO: 2322859 - RNA, 14 nt, Yersinia pestis KIM
cacuuuuauuuuuu

SEQ ID NO: 2322860 - RNA, 19 nt, Yersinia pestis KIM
cacuuugggcugaucaucg

SEQ ID NO: 2322861 - RNA, 20 nt, Yersinia pestis KIM
cacuuugucaauaaccucag

SEQ ID NO: 2322862 - RNA, 16 nt, Yersinia pestis KIM
cagaaaagcaaaggcc

SEQ ID NO: 2322863 - RNA, 14 nt, Yersinia pestis KIM
cagaaaaccuucag

SEQ ID NO: 2322864 - RNA, 20 nt, Yersinia pestis KIM
cagaaaaccuucagcaaaga

SEQ ID NO: 2322865 - RNA, 16 nt, Yersinia pestis KIM
cacuuccgccgccaac

SEQ ID NO: 2322866 - RNA, 16 nt, Yersinia pestis KIM
cacuucgguggcccuu

SEQ ID NO: 2322867 - RNA, 17 nt, Yersinia pestis KIM
cacuucguaaucuggcu

SEQ ID NO: 2322868 - RNA, 16 nt, Yersinia pestis KIM
cacuucgguggcccug

SEQ ID NO: 2322869 - RNA, 20 nt, Yersinia pestis KIM
cacuucgauacuacaaucau

SEQ ID NO: 2322870 - RNA, 20 nt, Yersinia pestis KIM
cacuucguagggcacuuuca

SEQ ID NO: 2322871 - RNA, 22 nt, Yersinia pestis KIM
cacuucguagggcacuuucauc

SEQ ID NO: 2322872 - RNA, 16 nt, Yersinia pestis KIM
cacuucuacagggcau

SEQ ID NO: 2322873 - RNA, 15 nt, Yersinia pestis KIM
cacuuauuauaaagc

SEQ ID NO: 2322874 - RNA, 15 nt, Yersinia pestis KIM
cacuuagugcuggcc

SEQ ID NO: 2322875 - RNA, 12 nt, Yersinia pestis KIM
cacuuauuugaa

SEQ ID NO: 2322876 - RNA, 21 nt, Yersinia pestis KIM
cacuuauuugaaauacuuauu

SEQ ID NO: 2322877 - RNA, 23 nt, Yersinia pestis KIM
cacuuauuggaaguacuuauuug

SEQ ID NO: 2322878 - RNA, 12 nt, Yersinia pestis KIM
cacuuauuggaa

SEQ ID NO: 2322879 - RNA, 21 nt, Yersinia pestis KIM
cacuuauuggaaguacuuauu

SEQ ID NO: 2322880 - RNA, 22 nt, Yersinia pestis KIM
cacuuauuggaaguacuuauuu

SEQ ID NO: 2322881 - RNA, 14 nt, Yersinia pestis KIM
cacuucaucaucaa

SEQ ID NO: 2322882 - RNA, 21 nt, Yersinia pestis KIM
cacuucaucauucauuuuaaa

SEQ ID NO: 2322883 - RNA, 16 nt, Yersinia pestis KIM
cacuggccuauuaaga

SEQ ID NO: 2322884 - RNA, 16 nt, Yersinia pestis KIM
cacuggccgcaggcgc

SEQ ID NO: 2322885 - RNA, 16 nt, Yersinia pestis KIM
cacugggaucugauca

SEQ ID NO: 2322886 - RNA, 18 nt, Yersinia pestis KIM
cacugggucaucacccag

SEQ ID NO: 2322887 - RNA, 15 nt, Yersinia pestis KIM
cacuggcaccgcuuc

SEQ ID NO: 2322888 - RNA, 21 nt, Yersinia pestis KIM
cacuggaguuaaaucccugug

SEQ ID NO: 2322889 - RNA, 17 nt, Yersinia pestis KIM
cacuggcaccgcuucug

SEQ ID NO: 2322890 - RNA, 15 nt, Yersinia pestis KIM
cacuggaggaacuga

SEQ ID NO: 2322891 - RNA, 13 nt, Yersinia pestis KIM
cacugcucugccc

SEQ ID NO: 2322892 - RNA, 20 nt, Yersinia pestis KIM
cacugcuccagccaacuggc

SEQ ID NO: 2322893 - RNA, 13 nt, Yersinia pestis KIM
cacuggaaacaaa

SEQ ID NO: 2322894 - RNA, 14 nt, Yersinia pestis KIM
cacuggaaaaagug

SEQ ID NO: 2322895 - RNA, 16 nt, Yersinia pestis KIM
cacuguagaccucuuu

SEQ ID NO: 2322896 - RNA, 15 nt, Yersinia pestis KIM
cacuguacugggaug

SEQ ID NO: 2322897 - RNA, 20 nt, Yersinia pestis KIM
cacugugagcggcauccagu

SEQ ID NO: 2322898 - RNA, 12 nt, Yersinia pestis KIM
cacuuaauaaug

SEQ ID NO: 2322899 - RNA, 13 nt, Yersinia pestis KIM
cacuuacugccaa

SEQ ID NO: 2322900 - RNA, 17 nt, Yersinia pestis KIM
cacuuaccuauaaacau

SEQ ID NO: 2322901 - RNA, 20 nt, Yersinia pestis KIM
cacuguugcgggcaucagcc

SEQ ID NO: 2322902 - RNA, 22 nt, Yersinia pestis KIM
cacuuaacacgaaccuucucug

SEQ ID NO: 2322903 - RNA, 23 nt, Yersinia pestis KIM
cacugcgcgaucccagaauggca

SEQ ID NO: 2322904 - RNA, 12 nt, Yersinia pestis KIM
cacugccugcuc

SEQ ID NO: 2322905 - RNA, 14 nt, Yersinia pestis KIM
cacugcauuugaua

SEQ ID NO: 2322906 - RNA, 16 nt, Yersinia pestis KIM
cacugcaucucugcau

SEQ ID NO: 2322907 - RNA, 19 nt, Yersinia pestis KIM
caaugucaugcaauuacug

SEQ ID NO: 2322908 - RNA, 15 nt, Yersinia pestis KIM
caauguucucugggu

SEQ ID NO: 2322909 - RNA, 16 nt, Yersinia pestis KIM
caauguuggcccaaga

SEQ ID NO: 2322910 - RNA, 22 nt, Yersinia pestis KIM
cacugauuuuuuaccugagaaa

SEQ ID NO: 2322911 - RNA, 19 nt, Yersinia pestis KIM
cacugauuuauaaauaauu

SEQ ID NO: 2322912 - RNA, 23 nt, Yersinia pestis KIM
cacugaugagcuggcaaaacuca

SEQ ID NO: 2322913 - RNA, 21 nt, Yersinia pestis KIM
cagaccgacauuccagauauc

SEQ ID NO: 2322914 - RNA, 19 nt, Yersinia pestis KIM
cagacccauuucugcuucu

SEQ ID NO: 2322915 - RNA, 20 nt, Yersinia pestis KIM
cagaccaaauagcaagccaa

SEQ ID NO: 2322916 - RNA, 14 nt, Yersinia pestis KIM
cagaccaaauuccc

SEQ ID NO: 2322917 - RNA, 16 nt, Yersinia pestis KIM
cagaccaaauucccca

SEQ ID NO: 2322918 - RNA, 12 nt, Yersinia pestis KIM
cagaccaaucaa

SEQ ID NO: 2322919 - RNA, 23 nt, Yersinia pestis KIM
cagacauauuggucauuuuuccc

SEQ ID NO: 2322920 - RNA, 20 nt, Yersinia pestis KIM
cagacaguaaauccugauga

SEQ ID NO: 2322921 - RNA, 21 nt, Yersinia pestis KIM
cagacauauuggucauuuuuc

SEQ ID NO: 2322922 - RNA, 11 nt, Yersinia pestis KIM
cagacagccau

SEQ ID NO: 2322923 - RNA, 16 nt, Yersinia pestis KIM
cagacacugacaucau

SEQ ID NO: 2322924 - RNA, 21 nt, Yersinia pestis KIM
cagacacagcaacaaccccau

SEQ ID NO: 2322925 - RNA, 18 nt, Yersinia pestis KIM
cagaaucgccguagauuu

SEQ ID NO: 2322926 - RNA, 21 nt, Yersinia pestis KIM
cagaaugaaaggcggugaaca

SEQ ID NO: 2322927 - RNA, 14 nt, Yersinia pestis KIM
cagaaucaccaaca

SEQ ID NO: 2322928 - RNA, 21 nt, Yersinia pestis KIM
cagaaucacugucaaaaagca

SEQ ID NO: 2322929 - RNA, 14 nt, Yersinia pestis KIM
cagaaucagcccca

SEQ ID NO: 2322930 - RNA, 17 nt, Yersinia pestis KIM
cagaaucagccccaagc

SEQ ID NO: 2322931 - RNA, 15 nt, Yersinia pestis KIM
cagaauaauccaagc

SEQ ID NO: 2322932 - RNA, 19 nt, Yersinia pestis KIM
cagaauaauccaagccaug

SEQ ID NO: 2322933 - RNA, 18 nt, Yersinia pestis KIM
cagaauggugccauacag

SEQ ID NO: 2322934 - RNA, 20 nt, Yersinia pestis KIM
cagaauuucauuguggagga

SEQ ID NO: 2322935 - RNA, 14 nt, Yersinia pestis KIM
cagacacaaugcug

SEQ ID NO: 2322936 - RNA, 23 nt, Yersinia pestis KIM
cagaauuuuuuuagauaucagaa

SEQ ID NO: 2322937 - RNA, 21 nt, Yersinia pestis KIM
cagacaacagucacaccaaca

SEQ ID NO: 2322938 - RNA, 15 nt, Yersinia pestis KIM
cagacaacagucaca

SEQ ID NO: 2322939 - RNA, 14 nt, Yersinia pestis KIM
cagacaaacaaccu

SEQ ID NO: 2322940 - RNA, 11 nt, Yersinia pestis KIM
cagacaaacaa

SEQ ID NO: 2322941 - RNA, 19 nt, Yersinia pestis KIM
cagaagggcggccagcaag

SEQ ID NO: 2322942 - RNA, 22 nt, Yersinia pestis KIM
cagaaguaugcguggguucuuc

SEQ ID NO: 2322943 - RNA, 17 nt, Yersinia pestis KIM
cagaagcauauggaugu

SEQ ID NO: 2322944 - RNA, 16 nt, Yersinia pestis KIM
cagaagcguaaagcac

SEQ ID NO: 2322945 - RNA, 18 nt, Yersinia pestis KIM
cagaagcguaaagcaccc

SEQ ID NO: 2322946 - RNA, 21 nt, Yersinia pestis KIM
cagaacccccgcgaacagcag

SEQ ID NO: 2322947 - RNA, 19 nt, Yersinia pestis KIM
cagaacccccgcgaacagc

SEQ ID NO: 2322948 - RNA, 19 nt, Yersinia pestis KIM
cagaaccuguuacaucaga

SEQ ID NO: 2322949 - RNA, 16 nt, Yersinia pestis KIM
cagaacguuaauuuag

SEQ ID NO: 2322950 - RNA, 16 nt, Yersinia pestis KIM
cagaacuaauaucaac

SEQ ID NO: 2322951 - RNA, 16 nt, Yersinia pestis KIM
cagaacugauuucagg

SEQ ID NO: 2322952 - RNA, 16 nt, Yersinia pestis KIM
cagaaacgauuaccca

SEQ ID NO: 2322953 - RNA, 22 nt, Yersinia pestis KIM
cagaaagguaugugccaaaaaa

SEQ ID NO: 2322954 - RNA, 23 nt, Yersinia pestis KIM
cagaacaccaacaccacacugag

SEQ ID NO: 2322955 - RNA, 24 nt, Yersinia pestis KIM
cagaacaccaacaccacacugagc

SEQ ID NO: 2322956 - RNA, 13 nt, Yersinia pestis KIM
cagaacagcaggc

SEQ ID NO: 2322957 - RNA, 16 nt, Yersinia pestis KIM
cagaacagguuuuuuc

SEQ ID NO: 2322958 - RNA, 16 nt, Yersinia pestis KIM
cagaaauagcaccauu

SEQ ID NO: 2322959 - RNA, 21 nt, Yersinia pestis KIM
cagaaauagcaccauuaggcu

SEQ ID NO: 2322960 - RNA, 14 nt, Yersinia pestis KIM
cagaaauaaauuca

SEQ ID NO: 2322961 - RNA, 18 nt, Yersinia pestis KIM
cagaaauaaauucaucuc

SEQ ID NO: 2322962 - RNA, 17 nt, Yersinia pestis KIM
cagaaauaauaucaagu

SEQ ID NO: 2322963 - RNA, 13 nt, Yersinia pestis KIM
cagcaccacuaag

SEQ ID NO: 2322964 - RNA, 14 nt, Yersinia pestis KIM
cagcaccaccgaug

SEQ ID NO: 2322965 - RNA, 16 nt, Yersinia pestis KIM
cagcacauaaagcgca

SEQ ID NO: 2322966 - RNA, 17 nt, Yersinia pestis KIM
cagcacagagcacaacg

SEQ ID NO: 2322967 - RNA, 18 nt, Yersinia pestis KIM
cagcaccacaauggcaga

SEQ ID NO: 2322968 - RNA, 15 nt, Yersinia pestis KIM
cagcacacaggcagc

SEQ ID NO: 2322969 - RNA, 22 nt, Yersinia pestis KIM
cagcaauauccgugauuaaccu

SEQ ID NO: 2322970 - RNA, 18 nt, Yersinia pestis KIM
cagcaauaugaauacgaa

SEQ ID NO: 2322971 - RNA, 13 nt, Yersinia pestis KIM
cagcaauauuguc

SEQ ID NO: 2322972 - RNA, 17 nt, Yersinia pestis KIM
cagcaacgaauaaaaaa

SEQ ID NO: 2322973 - RNA, 14 nt, Yersinia pestis KIM
cagcaacgaauaaa

SEQ ID NO: 2322974 - RNA, 19 nt, Yersinia pestis KIM
cagcaaccacgguaucaau

SEQ ID NO: 2322975 - RNA, 20 nt, Yersinia pestis KIM
cagcaaauugcugaaaaaaa

SEQ ID NO: 2322976 - RNA, 15 nt, Yersinia pestis KIM
cagcaaaggccacca

SEQ ID NO: 2322977 - RNA, 14 nt, Yersinia pestis KIM
cagcaaaguauuua

SEQ ID NO: 2322978 - RNA, 22 nt, Yersinia pestis KIM
cagcaaauaccgggacuaccaa

SEQ ID NO: 2322979 - RNA, 13 nt, Yersinia pestis KIM
cagcaacuguuuu

SEQ ID NO: 2322980 - RNA, 15 nt, Yersinia pestis KIM
cagcaacgguuucaa

SEQ ID NO: 2322981 - RNA, 21 nt, Yersinia pestis KIM
cagcaaguuagcgauaucugc

SEQ ID NO: 2322982 - RNA, 16 nt, Yersinia pestis KIM
cagcaagugaauaaca

SEQ ID NO: 2322983 - RNA, 17 nt, Yersinia pestis KIM
cagcaagugaauaacag

SEQ ID NO: 2322984 - RNA, 18 nt, Yersinia pestis KIM
cagcaaggcggcaagcaa

SEQ ID NO: 2322985 - RNA, 21 nt, Yersinia pestis KIM
cagcaaggcggcaagcaagca

SEQ ID NO: 2322986 - RNA, 12 nt, Yersinia pestis KIM
cagcaaggcagc

SEQ ID NO: 2322987 - RNA, 14 nt, Yersinia pestis KIM
cagcaaggcagcaa

SEQ ID NO: 2322988 - RNA, 22 nt, Yersinia pestis KIM
cagaugaauccagccaugcgac

SEQ ID NO: 2322989 - RNA, 21 nt, Yersinia pestis KIM
cagaugaauauguuccaucag

SEQ ID NO: 2322990 - RNA, 21 nt, Yersinia pestis KIM
cagaugacgggcgacccgcug

SEQ ID NO: 2322991 - RNA, 17 nt, Yersinia pestis KIM
cagaugacggugcccac

SEQ ID NO: 2322992 - RNA, 18 nt, Yersinia pestis KIM
cagaugaaugagggagga

SEQ ID NO: 2322993 - RNA, 17 nt, Yersinia pestis KIM
cagaugcuggcuuuuuu

SEQ ID NO: 2322994 - RNA, 17 nt, Yersinia pestis KIM
cagauggccccaauugu

SEQ ID NO: 2322995 - RNA, 19 nt, Yersinia pestis KIM
cagaugccgcuuuaguuuc

SEQ ID NO: 2322996 - RNA, 23 nt, Yersinia pestis KIM
cagauccugccgccucugcuccg

SEQ ID NO: 2322997 - RNA, 21 nt, Yersinia pestis KIM
cagaucgcccugaauagccug

SEQ ID NO: 2322998 - RNA, 23 nt, Yersinia pestis KIM
cagaucguuaaaguuaucaccaa

SEQ ID NO: 2322999 - RNA, 16 nt, Yersinia pestis KIM
cagaugaaaaacugug

SEQ ID NO: 2323000 - RNA, 21 nt, Yersinia pestis KIM
cagaugaaaaacugugcaaau

SEQ ID NO: 2323001 - RNA, 22 nt, Yersinia pestis KIM
cagcaaaagccucuugcgcucc

SEQ ID NO: 2323002 - RNA, 14 nt, Yersinia pestis KIM
cagcaaaagccucu

SEQ ID NO: 2323003 - RNA, 18 nt, Yersinia pestis KIM
cagauuuuugcuuuccac

SEQ ID NO: 2323004 - RNA, 21 nt, Yersinia pestis KIM
cagauuuggccacgcugccug

SEQ ID NO: 2323005 - RNA, 13 nt, Yersinia pestis KIM
cagauuuacuccc

SEQ ID NO: 2323006 - RNA, 14 nt, Yersinia pestis KIM
cagauuuaaaucau

SEQ ID NO: 2323007 - RNA, 19 nt, Yersinia pestis KIM
cagauuguuuauaaauuaa

SEQ ID NO: 2323008 - RNA, 18 nt, Yersinia pestis KIM
cagauuguuuauaaauua

SEQ ID NO: 2323009 - RNA, 17 nt, Yersinia pestis KIM
cagauugugcuccagca

SEQ ID NO: 2323010 - RNA, 20 nt, Yersinia pestis KIM
cagauugugcuccagcacuu

SEQ ID NO: 2323011 - RNA, 15 nt, Yersinia pestis KIM
cagauuggcuugcuu

SEQ ID NO: 2323012 - RNA, 14 nt, Yersinia pestis KIM
cagaugggaagaca

SEQ ID NO: 2323013 - RNA, 18 nt, Yersinia pestis KIM
cagauuauuguuauccac

SEQ ID NO: 2323014 - RNA, 17 nt, Yersinia pestis KIM
cagauucaccaguagcc

SEQ ID NO: 2323015 - RNA, 20 nt, Yersinia pestis KIM
cagauucgcaaagcgggcca

SEQ ID NO: 2323016 - RNA, 18 nt, Yersinia pestis KIM
cagacgacgugcagcgcg

SEQ ID NO: 2323017 - RNA, 16 nt, Yersinia pestis KIM
cagacgaaagauaauu

SEQ ID NO: 2323018 - RNA, 19 nt, Yersinia pestis KIM
cagacgaguauuccccacu

SEQ ID NO: 2323019 - RNA, 23 nt, Yersinia pestis KIM
cagacgauuauccgcaccauaga

SEQ ID NO: 2323020 - RNA, 23 nt, Yersinia pestis KIM
cagacgcgguuaacgacgcauua

SEQ ID NO: 2323021 - RNA, 19 nt, Yersinia pestis KIM
cagacguacauauaucacu

SEQ ID NO: 2323022 - RNA, 20 nt, Yersinia pestis KIM
cagacguacauauaucacua

SEQ ID NO: 2323023 - RNA, 21 nt, Yersinia pestis KIM
cagacggcagauccugaacga

SEQ ID NO: 2323024 - RNA, 17 nt, Yersinia pestis KIM
cagacggcagcaacgaa

SEQ ID NO: 2323025 - RNA, 17 nt, Yersinia pestis KIM
cagacuaaaaaccgcca

SEQ ID NO: 2323026 - RNA, 21 nt, Yersinia pestis KIM
cagacuaaaaaccgccacagc

SEQ ID NO: 2323027 - RNA, 15 nt, Yersinia pestis KIM
cagacguuuaaauaa

SEQ ID NO: 2323028 - RNA, 16 nt, Yersinia pestis KIM
cagacguuuaaauaag

SEQ ID NO: 2323029 - RNA, 15 nt, Yersinia pestis KIM
cagacucaaaauagc

SEQ ID NO: 2323030 - RNA, 22 nt, Yersinia pestis KIM
cagacugaaaguagaaauaaaa

SEQ ID NO: 2323031 - RNA, 18 nt, Yersinia pestis KIM
cagacucugcuaccagga

SEQ ID NO: 2323032 - RNA, 13 nt, Yersinia pestis KIM
cagacugcugaca

SEQ ID NO: 2323033 - RNA, 12 nt, Yersinia pestis KIM
cagacugcugac

SEQ ID NO: 2323034 - RNA, 20 nt, Yersinia pestis KIM
cagacugaaaugacauugcg

SEQ ID NO: 2323035 - RNA, 14 nt, Yersinia pestis KIM
cagacugacgcaga

SEQ ID NO: 2323036 - RNA, 21 nt, Yersinia pestis KIM
cagacuuggguaaccaaucac

SEQ ID NO: 2323037 - RNA, 21 nt, Yersinia pestis KIM
cagagaugcagagaugcagug

SEQ ID NO: 2323038 - RNA, 20 nt, Yersinia pestis KIM
cagagauaauagauaacaaa

SEQ ID NO: 2323039 - RNA, 20 nt, Yersinia pestis KIM
cagagcaagggucuccacac

SEQ ID NO: 2323040 - RNA, 16 nt, Yersinia pestis KIM
cagagcaaaaagccag

SEQ ID NO: 2323041 - RNA, 22 nt, Yersinia pestis KIM
cagagcacugugcgccauuucc

SEQ ID NO: 2323042 - RNA, 17 nt, Yersinia pestis KIM
cagagcagaaagcagca

SEQ ID NO: 2323043 - RNA, 15 nt, Yersinia pestis KIM
cagagcagaaagcag

SEQ ID NO: 2323044 - RNA, 22 nt, Yersinia pestis KIM
cagagccagaauaucguggaga

SEQ ID NO: 2323045 - RNA, 22 nt, Yersinia pestis KIM
cagauaaauaaaauaauaaugg

SEQ ID NO: 2323046 - RNA, 19 nt, Yersinia pestis KIM
cagauaaaucaguggguca

SEQ ID NO: 2323047 - RNA, 13 nt, Yersinia pestis KIM
cagauaacaacaa

SEQ ID NO: 2323048 - RNA, 16 nt, Yersinia pestis KIM
cagauaacucaguacc

SEQ ID NO: 2323049 - RNA, 15 nt, Yersinia pestis KIM
cagauacggcuccag

SEQ ID NO: 2323050 - RNA, 17 nt, Yersinia pestis KIM
cagauauuacgcagcca

SEQ ID NO: 2323051 - RNA, 23 nt, Yersinia pestis KIM
cagauauuacgcagccauaccca

SEQ ID NO: 2323052 - RNA, 20 nt, Yersinia pestis KIM
cagauauggcauuccugguu

SEQ ID NO: 2323053 - RNA, 21 nt, Yersinia pestis KIM
cagauaugccaggcaucaucu

SEQ ID NO: 2323054 - RNA, 18 nt, Yersinia pestis KIM
cagauaugccaggcauca

SEQ ID NO: 2323055 - RNA, 14 nt, Yersinia pestis KIM
cagauaugcauuau

SEQ ID NO: 2323056 - RNA, 22 nt, Yersinia pestis KIM
cagauaucugcucauuaccaau

SEQ ID NO: 2323057 - RNA, 17 nt, Yersinia pestis KIM
cagauauccuuuuucgu

SEQ ID NO: 2323058 - RNA, 13 nt, Yersinia pestis KIM
cagauagucaucu

SEQ ID NO: 2323059 - RNA, 15 nt, Yersinia pestis KIM
cagauagucaucuuu

SEQ ID NO: 2323060 - RNA, 21 nt, Yersinia pestis KIM
cagaucagcgugacguuaucu

SEQ ID NO: 2323061 - RNA, 22 nt, Yersinia pestis KIM
cagauccgcacugggaucugau

SEQ ID NO: 2323062 - RNA, 14 nt, Yersinia pestis KIM
cagagugugaaauc

SEQ ID NO: 2323063 - RNA, 14 nt, Yersinia pestis KIM
cagaguucggucau

SEQ ID NO: 2323064 - RNA, 21 nt, Yersinia pestis KIM
cagagugacaacaaaaaauaa

SEQ ID NO: 2323065 - RNA, 20 nt, Yersinia pestis KIM
cagauaaagaaaaacccguu

SEQ ID NO: 2323066 - RNA, 18 nt, Yersinia pestis KIM
cagauaaagaaaaacccg

SEQ ID NO: 2323067 - RNA, 14 nt, Yersinia pestis KIM
cagauaaauaaaau

SEQ ID NO: 2323068 - RNA, 13 nt, Yersinia pestis KIM
cagauaaaaagcc

SEQ ID NO: 2323069 - RNA, 14 nt, Yersinia pestis KIM
cagauaaaaagcca

SEQ ID NO: 2323070 - RNA, 16 nt, Yersinia pestis KIM
cagauaaaaaauaauu

SEQ ID NO: 2323071 - RNA, 16 nt, Yersinia pestis KIM
cagauaaacaucauga

SEQ ID NO: 2323072 - RNA, 18 nt, Yersinia pestis KIM
cagagucgcaaaaaauau

SEQ ID NO: 2323073 - RNA, 15 nt, Yersinia pestis KIM
cagaguccucucacc

SEQ ID NO: 2323074 - RNA, 16 nt, Yersinia pestis KIM
cagaguccucucacca

SEQ ID NO: 2323075 - RNA, 17 nt, Yersinia pestis KIM
cagaguauccagcguca

SEQ ID NO: 2323076 - RNA, 15 nt, Yersinia pestis KIM
cagaguccaauagcu

SEQ ID NO: 2323077 - RNA, 16 nt, Yersinia pestis KIM
cagaguccaauagcug

SEQ ID NO: 2323078 - RNA, 22 nt, Yersinia pestis KIM
cagaggcucauccugcgggcca

SEQ ID NO: 2323079 - RNA, 14 nt, Yersinia pestis KIM
cagagcgggaacgc

SEQ ID NO: 2323080 - RNA, 15 nt, Yersinia pestis KIM
cagaggaguaaagcg

SEQ ID NO: 2323081 - RNA, 13 nt, Yersinia pestis KIM
cagaggaguaaag

SEQ ID NO: 2323082 - RNA, 13 nt, Yersinia pestis KIM
cagcggcaaauag

SEQ ID NO: 2323083 - RNA, 22 nt, Yersinia pestis KIM
cagcgcgucgccugggaaugca

SEQ ID NO: 2323084 - RNA, 20 nt, Yersinia pestis KIM
cagcgccgauauacacccca

SEQ ID NO: 2323085 - RNA, 20 nt, Yersinia pestis KIM
cagcgcagguggauccguca

SEQ ID NO: 2323086 - RNA, 12 nt, Yersinia pestis KIM
cagcgccacagu

SEQ ID NO: 2323087 - RNA, 17 nt, Yersinia pestis KIM
cagcgauacaaccggcu

SEQ ID NO: 2323088 - RNA, 18 nt, Yersinia pestis KIM
cagcgauauacaucacgu

SEQ ID NO: 2323089 - RNA, 17 nt, Yersinia pestis KIM
cagcgaucuauucucug

SEQ ID NO: 2323090 - RNA, 15 nt, Yersinia pestis KIM
cagcgauuaaaauaa

SEQ ID NO: 2323091 - RNA, 17 nt, Yersinia pestis KIM
cagcgauuaaaauaaag

SEQ ID NO: 2323092 - RNA, 16 nt, Yersinia pestis KIM
cagcgcaaaaggcauc

SEQ ID NO: 2323093 - RNA, 17 nt, Yersinia pestis KIM
cagcgagacgauuaucu

SEQ ID NO: 2323094 - RNA, 14 nt, Yersinia pestis KIM
cagcgagcacugcc

SEQ ID NO: 2323095 - RNA, 15 nt, Yersinia pestis KIM
cagcgagcacugccc

SEQ ID NO: 2323096 - RNA, 16 nt, Yersinia pestis KIM
cagcgagcacugcccc

SEQ ID NO: 2323097 - RNA, 15 nt, Yersinia pestis KIM
cagcgacgauaauuu

SEQ ID NO: 2323098 - RNA, 15 nt, Yersinia pestis KIM
cagcgacaaccugua

SEQ ID NO: 2323099 - RNA, 14 nt, Yersinia pestis KIM
cagcgaauaaauaa

SEQ ID NO: 2323100 - RNA, 23 nt, Yersinia pestis KIM
cagcgaaauguaagcuacuaaug

SEQ ID NO: 2323101 - RNA, 16 nt, Yersinia pestis KIM
cagccgguuuuuucca

SEQ ID NO: 2323102 - RNA, 18 nt, Yersinia pestis KIM
cagccuaaaaugaauaac

SEQ ID NO: 2323103 - RNA, 12 nt, Yersinia pestis KIM
cagccuaaauuc

SEQ ID NO: 2323104 - RNA, 14 nt, Yersinia pestis KIM
cagccuaaccgcug

SEQ ID NO: 2323105 - RNA, 21 nt, Yersinia pestis KIM
cagccuauggcgguuccaaag

SEQ ID NO: 2323106 - RNA, 21 nt, Yersinia pestis KIM
cagccuaaggccaucaauaaa

SEQ ID NO: 2323107 - RNA, 17 nt, Yersinia pestis KIM
cagccuauccucaccgu

SEQ ID NO: 2323108 - RNA, 18 nt, Yersinia pestis KIM
cagccucuaacacucuuu

SEQ ID NO: 2323109 - RNA, 17 nt, Yersinia pestis KIM
cagccucuaacauacuc

SEQ ID NO: 2323110 - RNA, 20 nt, Yersinia pestis KIM
cagccugguuuuuuaaaaaa

SEQ ID NO: 2323111 - RNA, 23 nt, Yersinia pestis KIM
cagccuuuuuugcuuaaaacagg

SEQ ID NO: 2323112 - RNA, 13 nt, Yersinia pestis KIM
cagccuuuaucca

SEQ ID NO: 2323113 - RNA, 20 nt, Yersinia pestis KIM
cagccuuuauccagccaccu

SEQ ID NO: 2323114 - RNA, 23 nt, Yersinia pestis KIM
cagccuuaauguuuuacgaucaa

SEQ ID NO: 2323115 - RNA, 19 nt, Yersinia pestis KIM
cagccgcgaaaaaccauga

SEQ ID NO: 2323116 - RNA, 22 nt, Yersinia pestis KIM
cagcccugccuggcaggaagcc

SEQ ID NO: 2323117 - RNA, 13 nt, Yersinia pestis KIM
cagcccuucuuua

SEQ ID NO: 2323118 - RNA, 23 nt, Yersinia pestis KIM
cagcccuacuggcccgcccauaa

SEQ ID NO: 2323119 - RNA, 13 nt, Yersinia pestis KIM
cagcauucugcuu

SEQ ID NO: 2323120 - RNA, 16 nt, Yersinia pestis KIM
cagcauucugcuucca

SEQ ID NO: 2323121 - RNA, 16 nt, Yersinia pestis KIM
cagcauuaacccauau

SEQ ID NO: 2323122 - RNA, 21 nt, Yersinia pestis KIM
cagcauuaacccauauuacuc

SEQ ID NO: 2323123 - RNA, 18 nt, Yersinia pestis KIM
cagcauggcgcugggcaa

SEQ ID NO: 2323124 - RNA, 13 nt, Yersinia pestis KIM
cagcaugguagcc

SEQ ID NO: 2323125 - RNA, 14 nt, Yersinia pestis KIM
cagccaccaaaaaa

SEQ ID NO: 2323126 - RNA, 20 nt, Yersinia pestis KIM
cagccaauggccaccauuaa

SEQ ID NO: 2323127 - RNA, 15 nt, Yersinia pestis KIM
cagccaagaucccaa

SEQ ID NO: 2323128 - RNA, 16 nt, Yersinia pestis KIM
cagcaucuuuaauaaa

SEQ ID NO: 2323129 - RNA, 14 nt, Yersinia pestis KIM
cagcaucacugucu

SEQ ID NO: 2323130 - RNA, 18 nt, Yersinia pestis KIM
cagcaucacccguuuucc

SEQ ID NO: 2323131 - RNA, 13 nt, Yersinia pestis KIM
cagcauaaggcgu

SEQ ID NO: 2323132 - RNA, 21 nt, Yersinia pestis KIM
cagcauaucccuguuuucuag

SEQ ID NO: 2323133 - RNA, 20 nt, Yersinia pestis KIM
cagcauauuacccaguacug

SEQ ID NO: 2323134 - RNA, 15 nt, Yersinia pestis KIM
cagcaucaacaugga

SEQ ID NO: 2323135 - RNA, 22 nt, Yersinia pestis KIM
cagcauauugagcauacuguug

SEQ ID NO: 2323136 - RNA, 20 nt, Yersinia pestis KIM
cagcauauuguaaacuucca

SEQ ID NO: 2323137 - RNA, 18 nt, Yersinia pestis KIM
cagccaguugaucggcca

SEQ ID NO: 2323138 - RNA, 15 nt, Yersinia pestis KIM
cagccagagaauuau

SEQ ID NO: 2323139 - RNA, 18 nt, Yersinia pestis KIM
cagccacgauuaucucuu

SEQ ID NO: 2323140 - RNA, 16 nt, Yersinia pestis KIM
cagccccuagcaccgc

SEQ ID NO: 2323141 - RNA, 20 nt, Yersinia pestis KIM
cagcccagucucuuugccaa

SEQ ID NO: 2323142 - RNA, 13 nt, Yersinia pestis KIM
cagcccauccugu

SEQ ID NO: 2323143 - RNA, 20 nt, Yersinia pestis KIM
cagccccaaucaccggcugg

SEQ ID NO: 2323144 - RNA, 15 nt, Yersinia pestis KIM
cagccaugccugcga

SEQ ID NO: 2323145 - RNA, 19 nt, Yersinia pestis KIM
cagccaucggucauuuuac

SEQ ID NO: 2323146 - RNA, 22 nt, Yersinia pestis KIM
cagccauauguugccaccagcg

SEQ ID NO: 2323147 - RNA, 19 nt, Yersinia pestis KIM
cagcacgggcuaucgggua

SEQ ID NO: 2323148 - RNA, 16 nt, Yersinia pestis KIM
cagcacgguaaccuuu

SEQ ID NO: 2323149 - RNA, 15 nt, Yersinia pestis KIM
cagcacguaccgcug

SEQ ID NO: 2323150 - RNA, 12 nt, Yersinia pestis KIM
cagcacucagua

SEQ ID NO: 2323151 - RNA, 15 nt, Yersinia pestis KIM
cagcacguucaccaa

SEQ ID NO: 2323152 - RNA, 22 nt, Yersinia pestis KIM
cagcacguucaccaaagcaaug

SEQ ID NO: 2323153 - RNA, 17 nt, Yersinia pestis KIM
cagcagaguaaagcagg

SEQ ID NO: 2323154 - RNA, 22 nt, Yersinia pestis KIM
cagcagauugauaacaccggcu

SEQ ID NO: 2323155 - RNA, 15 nt, Yersinia pestis KIM
cagcagaacaaaaca

SEQ ID NO: 2323156 - RNA, 12 nt, Yersinia pestis KIM
cagcacgccagu

SEQ ID NO: 2323157 - RNA, 15 nt, Yersinia pestis KIM
cagcacgccaguguu

SEQ ID NO: 2323158 - RNA, 18 nt, Yersinia pestis KIM
cagcacgaaccugagcga

SEQ ID NO: 2323159 - RNA, 14 nt, Yersinia pestis KIM
cagcaccauacagc

SEQ ID NO: 2323160 - RNA, 23 nt, Yersinia pestis KIM
cagcaccagggaugggcgccgcu

SEQ ID NO: 2323161 - RNA, 11 nt, Yersinia pestis KIM
cagcagcagga

SEQ ID NO: 2323162 - RNA, 14 nt, Yersinia pestis KIM
cagcagcaggaaua

SEQ ID NO: 2323163 - RNA, 22 nt, Yersinia pestis KIM
cagcaggggcaaccucuucuuc

SEQ ID NO: 2323164 - RNA, 20 nt, Yersinia pestis KIM
cagcagggcuuucacaucug

SEQ ID NO: 2323165 - RNA, 12 nt, Yersinia pestis KIM
cagcagucugaa

SEQ ID NO: 2323166 - RNA, 20 nt, Yersinia pestis KIM
cagcagugcugcgcccagug

SEQ ID NO: 2323167 - RNA, 20 nt, Yersinia pestis KIM
cagcaguuacaguagugaag

SEQ ID NO: 2323168 - RNA, 12 nt, Yersinia pestis KIM
cagcagucugau

SEQ ID NO: 2323169 - RNA, 15 nt, Yersinia pestis KIM
cagcagucugaagcc

SEQ ID NO: 2323170 - RNA, 15 nt, Yersinia pestis KIM
cagcagucugacaga

SEQ ID NO: 2323171 - RNA, 17 nt, Yersinia pestis KIM
cagcaguugucagcccu

SEQ ID NO: 2323172 - RNA, 20 nt, Yersinia pestis KIM
cagcauaaauauucauuaaa

SEQ ID NO: 2323173 - RNA, 14 nt, Yersinia pestis KIM
caaccaggccgcca

SEQ ID NO: 2323174 - RNA, 21 nt, Yersinia pestis KIM
caaccacgguaauagcuuaau

SEQ ID NO: 2323175 - RNA, 18 nt, Yersinia pestis KIM
caaccacgguaauagcuu

SEQ ID NO: 2323176 - RNA, 18 nt, Yersinia pestis KIM
caaccaaucguugcuggu

SEQ ID NO: 2323177 - RNA, 17 nt, Yersinia pestis KIM
caaccaacacuccucuu

SEQ ID NO: 2323178 - RNA, 14 nt, Yersinia pestis KIM
caaccaaccaugcu

SEQ ID NO: 2323179 - RNA, 13 nt, Yersinia pestis KIM
caaccaacaaaca

SEQ ID NO: 2323180 - RNA, 18 nt, Yersinia pestis KIM
caaccaacaaacaauccu

SEQ ID NO: 2323181 - RNA, 15 nt, Yersinia pestis KIM
caacauuauccguuu

SEQ ID NO: 2323182 - RNA, 17 nt, Yersinia pestis KIM
caacauuaaaaauacaa

SEQ ID NO: 2323183 - RNA, 14 nt, Yersinia pestis KIM
caacauuaaaaaua

SEQ ID NO: 2323184 - RNA, 13 nt, Yersinia pestis KIM
caacauuaaaaau

SEQ ID NO: 2323185 - RNA, 23 nt, Yersinia pestis KIM
caacauuaaaaauacaaccaaca

SEQ ID NO: 2323186 - RNA, 15 nt, Yersinia pestis KIM
caacauuuguugcaa

SEQ ID NO: 2323187 - RNA, 14 nt, Yersinia pestis KIM
caacauuuuuagcu

SEQ ID NO: 2323188 - RNA, 18 nt, Yersinia pestis KIM
caacauuuauuuaucgcc

SEQ ID NO: 2323189 - RNA, 22 nt, Yersinia pestis KIM
caacauuguccugcaauccucc

SEQ ID NO: 2323190 - RNA, 15 nt, Yersinia pestis KIM
caacaugguccacag

SEQ ID NO: 2323191 - RNA, 15 nt, Yersinia pestis KIM
caaccauaucgccau

SEQ ID NO: 2323192 - RNA, 15 nt, Yersinia pestis KIM
caaccagugcucgcu

SEQ ID NO: 2323193 - RNA, 17 nt, Yersinia pestis KIM
caaccauuguggcuaaa

SEQ ID NO: 2323194 - RNA, 22 nt, Yersinia pestis KIM
caaccauuguggcuaaacccaa

SEQ ID NO: 2323195 - RNA, 22 nt, Yersinia pestis KIM
caacccagacaagaaugccugc

SEQ ID NO: 2323196 - RNA, 17 nt, Yersinia pestis KIM
caacccccgaacacucg

SEQ ID NO: 2323197 - RNA, 18 nt, Yersinia pestis KIM
caaccccuucaagcaccc

SEQ ID NO: 2323198 - RNA, 19 nt, Yersinia pestis KIM
caaccccuucaagcaccca

SEQ ID NO: 2323199 - RNA, 14 nt, Yersinia pestis KIM
caacccgcugaugc

SEQ ID NO: 2323200 - RNA, 19 nt, Yersinia pestis KIM
caaccgcuugcauacgcuu

SEQ ID NO: 2323201 - RNA, 15 nt, Yersinia pestis KIM
caaccggauuacaua

SEQ ID NO: 2323202 - RNA, 17 nt, Yersinia pestis KIM
caaccguagucgcacca

SEQ ID NO: 2323203 - RNA, 19 nt, Yersinia pestis KIM
caacgcuccgguuuucacc

SEQ ID NO: 2323204 - RNA, 23 nt, Yersinia pestis KIM
caacgcuccgguuuucaccccca

SEQ ID NO: 2323205 - RNA, 20 nt, Yersinia pestis KIM
caacgcucaauggcgggggc

SEQ ID NO: 2323206 - RNA, 22 nt, Yersinia pestis KIM
caacgcuguuggguugugguau

SEQ ID NO: 2323207 - RNA, 18 nt, Yersinia pestis KIM
caacgcucuaacgucaga

SEQ ID NO: 2323208 - RNA, 17 nt, Yersinia pestis KIM
caacggcccaauauuga

SEQ ID NO: 2323209 - RNA, 21 nt, Yersinia pestis KIM
caacggcccaauauugaucca

SEQ ID NO: 2323210 - RNA, 14 nt, Yersinia pestis KIM
caacggacacauaa

SEQ ID NO: 2323211 - RNA, 18 nt, Yersinia pestis KIM
caacggagagaacaggca

SEQ ID NO: 2323212 - RNA, 20 nt, Yersinia pestis KIM
caacggagagaacaggcaga

SEQ ID NO: 2323213 - RNA, 20 nt, Yersinia pestis KIM
caacgucaucgccacacgca

SEQ ID NO: 2323214 - RNA, 24 nt, Yersinia pestis KIM
caacguaauaucugccaccgcaca

SEQ ID NO: 2323215 - RNA, 23 nt, Yersinia pestis KIM
caaccguuguguaucagcaacuu

SEQ ID NO: 2323216 - RNA, 15 nt, Yersinia pestis KIM
caaccguuaacgggc

SEQ ID NO: 2323217 - RNA, 13 nt, Yersinia pestis KIM
caaccuaaaaaaa

SEQ ID NO: 2323218 - RNA, 18 nt, Yersinia pestis KIM
caaccuaaaaaaaacaac

SEQ ID NO: 2323219 - RNA, 15 nt, Yersinia pestis KIM
caaccuauauagccc

SEQ ID NO: 2323220 - RNA, 18 nt, Yersinia pestis KIM
caaccucagccucauuca

SEQ ID NO: 2323221 - RNA, 20 nt, Yersinia pestis KIM
caaccucggucugaauaaga

SEQ ID NO: 2323222 - RNA, 12 nt, Yersinia pestis KIM
caaccucagccu

SEQ ID NO: 2323223 - RNA, 18 nt, Yersinia pestis KIM
caacgcauuguuuaaagc

SEQ ID NO: 2323224 - RNA, 22 nt, Yersinia pestis KIM
caacgcccagcuuuuuacgcaa

SEQ ID NO: 2323225 - RNA, 22 nt, Yersinia pestis KIM
caacgccaaaauaaccaacacc

SEQ ID NO: 2323226 - RNA, 20 nt, Yersinia pestis KIM
caacugccgccaugcuggau

SEQ ID NO: 2323227 - RNA, 17 nt, Yersinia pestis KIM
caacugccccucuuuuc

SEQ ID NO: 2323228 - RNA, 16 nt, Yersinia pestis KIM
caacuguuagcguggc

SEQ ID NO: 2323229 - RNA, 21 nt, Yersinia pestis KIM
caacuguuagcguggcugaaa

SEQ ID NO: 2323230 - RNA, 14 nt, Yersinia pestis KIM
caacuguaaaaucu

SEQ ID NO: 2323231 - RNA, 20 nt, Yersinia pestis KIM
caacuggguggccaguaacg

SEQ ID NO: 2323232 - RNA, 16 nt, Yersinia pestis KIM
caacuaagcugccuca

SEQ ID NO: 2323233 - RNA, 18 nt, Yersinia pestis KIM
caacucuucguugcucag

SEQ ID NO: 2323234 - RNA, 16 nt, Yersinia pestis KIM
caacugacugaaguua

SEQ ID NO: 2323235 - RNA, 20 nt, Yersinia pestis KIM
caacugacaacaucaaauga

SEQ ID NO: 2323236 - RNA, 15 nt, Yersinia pestis KIM
caacugacugaaguu

SEQ ID NO: 2323237 - RNA, 20 nt, Yersinia pestis KIM
caacugaggcaacauuuguu

SEQ ID NO: 2323238 - RNA, 11 nt, Yersinia pestis KIM
caacugauaaa

SEQ ID NO: 2323239 - RNA, 19 nt, Yersinia pestis KIM
caacugccaaauuuggccu

SEQ ID NO: 2323240 - RNA, 13 nt, Yersinia pestis KIM
caacacugccuga

SEQ ID NO: 2323241 - RNA, 18 nt, Yersinia pestis KIM
caacagaacuaaacgcca

SEQ ID NO: 2323242 - RNA, 22 nt, Yersinia pestis KIM
caacagaacuaauaucaacaga

SEQ ID NO: 2323243 - RNA, 15 nt, Yersinia pestis KIM
caacacauaaaauca

SEQ ID NO: 2323244 - RNA, 13 nt, Yersinia pestis KIM
caacaccacacug

SEQ ID NO: 2323245 - RNA, 20 nt, Yersinia pestis KIM
caacaccacacugagcaccg

SEQ ID NO: 2323246 - RNA, 19 nt, Yersinia pestis KIM
caacacggugaauaaaccc

SEQ ID NO: 2323247 - RNA, 19 nt, Yersinia pestis KIM
caacacacuuagcuaagcu

SEQ ID NO: 2323248 - RNA, 23 nt, Yersinia pestis KIM
caacaauuuacgguccauaaaau

SEQ ID NO: 2323249 - RNA, 13 nt, Yersinia pestis KIM
caacacaaaaacc

SEQ ID NO: 2323250 - RNA, 22 nt, Yersinia pestis KIM
caacaauauucgcagccaaaau

SEQ ID NO: 2323251 - RNA, 17 nt, Yersinia pestis KIM
caaauuugacauuuccu

SEQ ID NO: 2323252 - RNA, 22 nt, Yersinia pestis KIM
caacaauaccgaugagcugaau

SEQ ID NO: 2323253 - RNA, 19 nt, Yersinia pestis KIM
caaauugcugaaaaaaaac

SEQ ID NO: 2323254 - RNA, 21 nt, Yersinia pestis KIM
caaauuguugcaagcugagau

SEQ ID NO: 2323255 - RNA, 19 nt, Yersinia pestis KIM
caaauuuagccgcaacuac

SEQ ID NO: 2323256 - RNA, 19 nt, Yersinia pestis KIM
caaaucgccaaacugcuca

SEQ ID NO: 2323257 - RNA, 15 nt, Yersinia pestis KIM
caaaucgauacuuuu

SEQ ID NO: 2323258 - RNA, 14 nt, Yersinia pestis KIM
caaaugacacuuuu

SEQ ID NO: 2323259 - RNA, 20 nt, Yersinia pestis KIM
caaaucaccugacaccaaga

SEQ ID NO: 2323260 - RNA, 13 nt, Yersinia pestis KIM
caaaucaccuugg

SEQ ID NO: 2323261 - RNA, 15 nt, Yersinia pestis KIM
caaauuaaucuugua

SEQ ID NO: 2323262 - RNA, 13 nt, Yersinia pestis KIM
caaauuagcaggg

SEQ ID NO: 2323263 - RNA, 22 nt, Yersinia pestis KIM
caaauuacggcucaguugaugc

SEQ ID NO: 2323264 - RNA, 19 nt, Yersinia pestis KIM
caaauuauauaagagauga

SEQ ID NO: 2323265 - RNA, 23 nt, Yersinia pestis KIM
caaagauuucaucggcaaaaaca

SEQ ID NO: 2323266 - RNA, 23 nt, Yersinia pestis KIM
caaagaauugagguaaaccaagu

SEQ ID NO: 2323267 - RNA, 16 nt, Yersinia pestis KIM
caaagccuacgagaga

SEQ ID NO: 2323268 - RNA, 14 nt, Yersinia pestis KIM
caaagccgucaguu

SEQ ID NO: 2323269 - RNA, 21 nt, Yersinia pestis KIM
caaagccugccauacccgcug

SEQ ID NO: 2323270 - RNA, 20 nt, Yersinia pestis KIM
caaagcccggaaacguccag

SEQ ID NO: 2323271 - RNA, 22 nt, Yersinia pestis KIM
caaagccgcugcucacauagcg

SEQ ID NO: 2323272 - RNA, 21 nt, Yersinia pestis KIM
caaagcaucgguauauuaguu

SEQ ID NO: 2323273 - RNA, 14 nt, Yersinia pestis KIM
caaaaggauggccc

SEQ ID NO: 2323274 - RNA, 20 nt, Yersinia pestis KIM
caaaagccucuugcgcucca

SEQ ID NO: 2323275 - RNA, 22 nt, Yersinia pestis KIM
caaaagccccagugcgcaaaaa

SEQ ID NO: 2323276 - RNA, 22 nt, Yersinia pestis KIM
caaaagcgaucagcaauaugcu

SEQ ID NO: 2323277 - RNA, 22 nt, Yersinia pestis KIM
caaagugcccgcgacggagaga

SEQ ID NO: 2323278 - RNA, 20 nt, Yersinia pestis KIM
caaagugccugcggcggaga

SEQ ID NO: 2323279 - RNA, 13 nt, Yersinia pestis KIM
caaaguaguacga

SEQ ID NO: 2323280 - RNA, 22 nt, Yersinia pestis KIM
caaaguaccuauggcgaagaga

SEQ ID NO: 2323281 - RNA, 14 nt, Yersinia pestis KIM
caaauaauuacgua

SEQ ID NO: 2323282 - RNA, 21 nt, Yersinia pestis KIM
caaauaaucagcucauuaaac

SEQ ID NO: 2323283 - RNA, 18 nt, Yersinia pestis KIM
caaauaaguguuucaaau

SEQ ID NO: 2323284 - RNA, 15 nt, Yersinia pestis KIM
caaauagguuuuacu

SEQ ID NO: 2323285 - RNA, 23 nt, Yersinia pestis KIM
caaauacauauaaccaucaaaua

SEQ ID NO: 2323286 - RNA, 13 nt, Yersinia pestis KIM
caaauacacauaa

SEQ ID NO: 2323287 - RNA, 22 nt, Yersinia pestis KIM
caaauacaaaccguuugccguu

SEQ ID NO: 2323288 - RNA, 17 nt, Yersinia pestis KIM
caacuucaccacuguga

SEQ ID NO: 2323289 - RNA, 19 nt, Yersinia pestis KIM
caacuucaauaccaaauuu

SEQ ID NO: 2323290 - RNA, 20 nt, Yersinia pestis KIM
caacuucaauaccaaauuua

SEQ ID NO: 2323291 - RNA, 19 nt, Yersinia pestis KIM
caacuuccuugauuuucau

SEQ ID NO: 2323292 - RNA, 14 nt, Yersinia pestis KIM
caacuucuccugua

SEQ ID NO: 2323293 - RNA, 19 nt, Yersinia pestis KIM
caagcagugucagggcaau

SEQ ID NO: 2323294 - RNA, 21 nt, Yersinia pestis KIM
caagcagacgcacccggcugg

SEQ ID NO: 2323295 - RNA, 18 nt, Yersinia pestis KIM
caagccgcguuccaaucu

SEQ ID NO: 2323296 - RNA, 19 nt, Yersinia pestis KIM
caagccgauaaucaauuug

SEQ ID NO: 2323297 - RNA, 22 nt, Yersinia pestis KIM
caagccgcuuaucucggggcca

SEQ ID NO: 2323298 - RNA, 14 nt, Yersinia pestis KIM
caagccaccaccac

SEQ ID NO: 2323299 - RNA, 17 nt, Yersinia pestis KIM
caagccaccgcuggugg

SEQ ID NO: 2323300 - RNA, 16 nt, Yersinia pestis KIM
caagccaacccccauu

SEQ ID NO: 2323301 - RNA, 18 nt, Yersinia pestis KIM
caagcaucggaauccauu

SEQ ID NO: 2323302 - RNA, 13 nt, Yersinia pestis KIM
caagcauagaaga

SEQ ID NO: 2323303 - RNA, 12 nt, Yersinia pestis KIM
caagcauagaag

SEQ ID NO: 2323304 - RNA, 21 nt, Yersinia pestis KIM
caaggccgaucaacaggccac

SEQ ID NO: 2323305 - RNA, 20 nt, Yersinia pestis KIM
caaggcgacuuugaugccaa

SEQ ID NO: 2323306 - RNA, 21 nt, Yersinia pestis KIM
caaggugccauaaauaccaau

SEQ ID NO: 2323307 - RNA, 15 nt, Yersinia pestis KIM
caaggucgcaaccag

SEQ ID NO: 2323308 - RNA, 20 nt, Yersinia pestis KIM
caaggugacuauuuaaauac

SEQ ID NO: 2323309 - RNA, 15 nt, Yersinia pestis KIM
caaggccgaucaaca

SEQ ID NO: 2323310 - RNA, 20 nt, Yersinia pestis KIM
caaggccgaucaacaggcca

SEQ ID NO: 2323311 - RNA, 21 nt, Yersinia pestis KIM
caaggauaagcaguucuggcu

SEQ ID NO: 2323312 - RNA, 21 nt, Yersinia pestis KIM
caaggagaucgcucucacccu

SEQ ID NO: 2323313 - RNA, 17 nt, Yersinia pestis KIM
caaggacgaaggguaaa

SEQ ID NO: 2323314 - RNA, 16 nt, Yersinia pestis KIM
caaggaaggcuauuuu

SEQ ID NO: 2323315 - RNA, 17 nt, Yersinia pestis KIM
caagcggcccaucauag

SEQ ID NO: 2323316 - RNA, 11 nt, Yersinia pestis KIM
caagccucuag

SEQ ID NO: 2323317 - RNA, 23 nt, Yersinia pestis KIM
caagccucuagcuaacagugacc

SEQ ID NO: 2323318 - RNA, 24 nt, Yersinia pestis KIM
caagcguucgaggauaucacucug

SEQ ID NO: 2323319 - RNA, 15 nt, Yersinia pestis KIM
caagcguuaacagcg

SEQ ID NO: 2323320 - RNA, 16 nt, Yersinia pestis KIM
caauaucgauuuuuaa

SEQ ID NO: 2323321 - RNA, 13 nt, Yersinia pestis KIM
caauauccauauu

SEQ ID NO: 2323322 - RNA, 23 nt, Yersinia pestis KIM
caauaguguugcuaaggugugau

SEQ ID NO: 2323323 - RNA, 21 nt, Yersinia pestis KIM
caauauaaagccauuggucaa

SEQ ID NO: 2323324 - RNA, 20 nt, Yersinia pestis KIM
caauagucuggccuucuggu

SEQ ID NO: 2323325 - RNA, 22 nt, Yersinia pestis KIM
caauagcuaauaauuguucaua

SEQ ID NO: 2323326 - RNA, 14 nt, Yersinia pestis KIM
caauacggcacuca

SEQ ID NO: 2323327 - RNA, 20 nt, Yersinia pestis KIM
caauagccaagaucacauga

SEQ ID NO: 2323328 - RNA, 17 nt, Yersinia pestis KIM
caauagccauggcuuua

SEQ ID NO: 2323329 - RNA, 21 nt, Yersinia pestis KIM
caauagccaugucauggggga

SEQ ID NO: 2323330 - RNA, 18 nt, Yersinia pestis KIM
caauaauucagaugagaa

SEQ ID NO: 2323331 - RNA, 16 nt, Yersinia pestis KIM
caauaauugcacccca

SEQ ID NO: 2323332 - RNA, 19 nt, Yersinia pestis KIM
caauacaccagacucugcu

SEQ ID NO: 2323333 - RNA, 20 nt, Yersinia pestis KIM
caauaaacagacuaaaaacc

SEQ ID NO: 2323334 - RNA, 21 nt, Yersinia pestis KIM
caauaaacagacuaaaaaccg

SEQ ID NO: 2323335 - RNA, 15 nt, Yersinia pestis KIM
caauaaaauuaccca

SEQ ID NO: 2323336 - RNA, 19 nt, Yersinia pestis KIM
caauaaaaccuuuauguaa

SEQ ID NO: 2323337 - RNA, 15 nt, Yersinia pestis KIM
caagucaugguacaa

SEQ ID NO: 2323338 - RNA, 15 nt, Yersinia pestis KIM
caaguauguuuacuu

SEQ ID NO: 2323339 - RNA, 22 nt, Yersinia pestis KIM
caaguauuggcguucagauaag

SEQ ID NO: 2323340 - RNA, 15 nt, Yersinia pestis KIM
caauaacaauauuca

SEQ ID NO: 2323341 - RNA, 16 nt, Yersinia pestis KIM
caauaaauauccuccg

SEQ ID NO: 2323342 - RNA, 15 nt, Yersinia pestis KIM
caauaaauaaaaacg

SEQ ID NO: 2323343 - RNA, 16 nt, Yersinia pestis KIM
caauaagcuguaaugc

SEQ ID NO: 2323344 - RNA, 17 nt, Yersinia pestis KIM
caauaaccagaauaauc

SEQ ID NO: 2323345 - RNA, 20 nt, Yersinia pestis KIM
caauaauaaaaaaaaauaaa

SEQ ID NO: 2323346 - RNA, 15 nt, Yersinia pestis KIM
caauaauaagccgca

SEQ ID NO: 2323347 - RNA, 24 nt, Yersinia pestis KIM
caauaagugcaaacuuaaaaauca

SEQ ID NO: 2323348 - RNA, 19 nt, Yersinia pestis KIM
caauaagugaaacaaauac

SEQ ID NO: 2323349 - RNA, 22 nt, Yersinia pestis KIM
caauaagugcaaacuuaaaaau

SEQ ID NO: 2323350 - RNA, 19 nt, Yersinia pestis KIM
caauaauaacgaauuucau

SEQ ID NO: 2323351 - RNA, 14 nt, Yersinia pestis KIM
caaugcgcccaagc

SEQ ID NO: 2323352 - RNA, 21 nt, Yersinia pestis KIM
caaugcgauagagauagccaa

SEQ ID NO: 2323353 - RNA, 22 nt, Yersinia pestis KIM
caaugccgcgaaggugugcuca

SEQ ID NO: 2323354 - RNA, 19 nt, Yersinia pestis KIM
caaugcgcggguaacaacu

SEQ ID NO: 2323355 - RNA, 18 nt, Yersinia pestis KIM
caauggcuggcaaggcac

SEQ ID NO: 2323356 - RNA, 13 nt, Yersinia pestis KIM
caauggcucaggc

SEQ ID NO: 2323357 - RNA, 14 nt, Yersinia pestis KIM
caauggcuccaccg

SEQ ID NO: 2323358 - RNA, 19 nt, Yersinia pestis KIM
caauggcuaaaucaucauu

SEQ ID NO: 2323359 - RNA, 18 nt, Yersinia pestis KIM
caauggauucuugcugca

SEQ ID NO: 2323360 - RNA, 15 nt, Yersinia pestis KIM
caaugucaugcaauu

SEQ ID NO: 2323361 - RNA, 21 nt, Yersinia pestis KIM
caaugggucauugcgugcaau

SEQ ID NO: 2323362 - RNA, 17 nt, Yersinia pestis KIM
caaugguucaucauuuu

SEQ ID NO: 2323363 - RNA, 19 nt, Yersinia pestis KIM
caaugguguuaucuucacu

SEQ ID NO: 2323364 - RNA, 13 nt, Yersinia pestis KIM
caaugauuuuuuu

SEQ ID NO: 2323365 - RNA, 21 nt, Yersinia pestis KIM
caaugcaccgacaaagauacu

SEQ ID NO: 2323366 - RNA, 21 nt, Yersinia pestis KIM
caaugagggaugaaaagagcu

SEQ ID NO: 2323367 - RNA, 16 nt, Yersinia pestis KIM
caaugaucaaacggau

SEQ ID NO: 2323368 - RNA, 18 nt, Yersinia pestis KIM
caaugauggcggcuaaau

SEQ ID NO: 2323369 - RNA, 19 nt, Yersinia pestis KIM
caaugauuacaucacuuuu

SEQ ID NO: 2323370 - RNA, 15 nt, Yersinia pestis KIM
caaugacuuaacuga

SEQ ID NO: 2323371 - RNA, 16 nt, Yersinia pestis KIM
caaugacuuaacugaa

SEQ ID NO: 2323372 - RNA, 20 nt, Yersinia pestis KIM
caaugacuccugaaauaaag

SEQ ID NO: 2323373 - RNA, 19 nt, Yersinia pestis KIM
caaugacuccugaaauaaa

SEQ ID NO: 2323374 - RNA, 20 nt, Yersinia pestis KIM
caaugaccacuaaauuaaau

SEQ ID NO: 2323375 - RNA, 18 nt, Yersinia pestis KIM
caaugaauccggauccag

SEQ ID NO: 2323376 - RNA, 21 nt, Yersinia pestis KIM
caaucuguuccugauuccaaa

SEQ ID NO: 2323377 - RNA, 15 nt, Yersinia pestis KIM
caaucuucuucaguc

SEQ ID NO: 2323378 - RNA, 19 nt, Yersinia pestis KIM
caaucuuauugaaaacaag

SEQ ID NO: 2323379 - RNA, 24 nt, Yersinia pestis KIM
caaugaaaauauccgagguuauug

SEQ ID NO: 2323380 - RNA, 19 nt, Yersinia pestis KIM
caaucaugggccaauccaa

SEQ ID NO: 2323381 - RNA, 19 nt, Yersinia pestis KIM
caaucauugagaucaguuc

SEQ ID NO: 2323382 - RNA, 20 nt, Yersinia pestis KIM
caaucauugagaucaguuca

SEQ ID NO: 2323383 - RNA, 13 nt, Yersinia pestis KIM
caauccaaaugac

SEQ ID NO: 2323384 - RNA, 20 nt, Yersinia pestis KIM
caauccaaccuauauagccc

SEQ ID NO: 2323385 - RNA, 13 nt, Yersinia pestis KIM
caauccaugccag

SEQ ID NO: 2323386 - RNA, 21 nt, Yersinia pestis KIM
caaucccggccauuugcucug

SEQ ID NO: 2323387 - RNA, 19 nt, Yersinia pestis KIM
caaucccgauaaaaaccau

SEQ ID NO: 2323388 - RNA, 23 nt, Yersinia pestis KIM
caaucccuucgcccuguaaagcc

SEQ ID NO: 2323389 - RNA, 18 nt, Yersinia pestis KIM
caauauuggauaauaacc

SEQ ID NO: 2323390 - RNA, 19 nt, Yersinia pestis KIM
caauauugcuugccagcgc

SEQ ID NO: 2323391 - RNA, 22 nt, Yersinia pestis KIM
caauauugccuucacccaggcu

SEQ ID NO: 2323392 - RNA, 22 nt, Yersinia pestis KIM
caauauugacaggaucaggcca

SEQ ID NO: 2323393 - RNA, 22 nt, Yersinia pestis KIM
caauauucgcagccaaaauaau

SEQ ID NO: 2323394 - RNA, 16 nt, Yersinia pestis KIM
caauauucgccagauu

SEQ ID NO: 2323395 - RNA, 18 nt, Yersinia pestis KIM
caauauucagcguugaca

SEQ ID NO: 2323396 - RNA, 14 nt, Yersinia pestis KIM
caauauucgcagcc

SEQ ID NO: 2323397 - RNA, 12 nt, Yersinia pestis KIM
caauauuccaaa

SEQ ID NO: 2323398 - RNA, 16 nt, Yersinia pestis KIM
caauauuccaaaaaau

SEQ ID NO: 2323399 - RNA, 20 nt, Yersinia pestis KIM
caauauuccaaaaaauagcc

SEQ ID NO: 2323400 - RNA, 18 nt, Yersinia pestis KIM
caaucaaaagggaucacc

SEQ ID NO: 2323401 - RNA, 17 nt, Yersinia pestis KIM
caaucaaaaauugcccc

SEQ ID NO: 2323402 - RNA, 16 nt, Yersinia pestis KIM
caaucaaaaaauaaau

SEQ ID NO: 2323403 - RNA, 18 nt, Yersinia pestis KIM
caaucaaaaaauaaauua

SEQ ID NO: 2323404 - RNA, 15 nt, Yersinia pestis KIM
caaucaaaaaauaaa

SEQ ID NO: 2323405 - RNA, 21 nt, Yersinia pestis KIM
caaucuccaguaaaucuacuu

SEQ ID NO: 2323406 - RNA, 13 nt, Yersinia pestis KIM
caaucucaucaau

SEQ ID NO: 2323407 - RNA, 15 nt, Yersinia pestis KIM
caaucuagaacuauu

SEQ ID NO: 2323408 - RNA, 12 nt, Yersinia pestis KIM
caaucucaaagc

SEQ ID NO: 2323409 - RNA, 18 nt, Yersinia pestis KIM
caaucgucuucggucaua

SEQ ID NO: 2323410 - RNA, 22 nt, Yersinia pestis KIM
caaucuaaugacuacuaaucaa

SEQ ID NO: 2323411 - RNA, 21 nt, Yersinia pestis KIM
caaucucugggugcugcuccc

SEQ ID NO: 2323412 - RNA, 22 nt, Yersinia pestis KIM
caaucucugggugcugcucccg

SEQ ID NO: 2323413 - RNA, 22 nt, Yersinia pestis KIM
caaucgcucugcguuuuucccu

SEQ ID NO: 2323414 - RNA, 18 nt, Yersinia pestis KIM
auuuuugcauauaaaaca

SEQ ID NO: 2323415 - RNA, 12 nt, Yersinia pestis KIM
auuuuuguugaa

SEQ ID NO: 2323416 - RNA, 17 nt, Yersinia pestis KIM
auuuuuuacuuuuuccu

SEQ ID NO: 2323417 - RNA, 15 nt, Yersinia pestis KIM
auuuuucauucuauu

SEQ ID NO: 2323418 - RNA, 21 nt, Yersinia pestis KIM
auuuuucuguaucgaauugau

SEQ ID NO: 2323419 - RNA, 20 nt, Yersinia pestis KIM
auuuuucuguaucgaauuga

SEQ ID NO: 2323420 - RNA, 15 nt, Yersinia pestis KIM
auuuuucguccacua

SEQ ID NO: 2323421 - RNA, 21 nt, Yersinia pestis KIM
auuuuucggugaaccaucaac

SEQ ID NO: 2323422 - RNA, 22 nt, Yersinia pestis KIM
auuuuuuuuccuauaaaccaac

SEQ ID NO: 2323423 - RNA, 15 nt, Yersinia pestis KIM
caaaaaaaaagccug

SEQ ID NO: 2323424 - RNA, 18 nt, Yersinia pestis KIM
auuuuuuugaugcauccu

SEQ ID NO: 2323425 - RNA, 12 nt, Yersinia pestis KIM
caaaaaagggca

SEQ ID NO: 2323426 - RNA, 12 nt, Yersinia pestis KIM
caaaaaacaaac

SEQ ID NO: 2323427 - RNA, 17 nt, Yersinia pestis KIM
auuuuuuucaugguaaa

SEQ ID NO: 2323428 - RNA, 14 nt, Yersinia pestis KIM
auuuuuuguagguu

SEQ ID NO: 2323429 - RNA, 18 nt, Yersinia pestis KIM
caaaaauacaaaaagcga

SEQ ID NO: 2323430 - RNA, 20 nt, Yersinia pestis KIM
caaaaauaaacgggcuucca

SEQ ID NO: 2323431 - RNA, 21 nt, Yersinia pestis KIM
caaaaauaaacgggcuuccau

SEQ ID NO: 2323432 - RNA, 19 nt, Yersinia pestis KIM
caaaaacacagguucucca

SEQ ID NO: 2323433 - RNA, 20 nt, Yersinia pestis KIM
caaaaacacagguucuccag

SEQ ID NO: 2323434 - RNA, 20 nt, Yersinia pestis KIM
caaaaaauauuaauccauag

SEQ ID NO: 2323435 - RNA, 11 nt, Yersinia pestis KIM
caaaaaauaaa

SEQ ID NO: 2323436 - RNA, 20 nt, Yersinia pestis KIM
caaaaaauagccguaggcca

SEQ ID NO: 2323437 - RNA, 19 nt, Yersinia pestis KIM
caaaaacccauuaaaaaca

SEQ ID NO: 2323438 - RNA, 18 nt, Yersinia pestis KIM
caaaaacccauuaaaaac

SEQ ID NO: 2323439 - RNA, 23 nt, Yersinia pestis KIM
caaaaacgcuggccagcauggcg

SEQ ID NO: 2323440 - RNA, 16 nt, Yersinia pestis KIM
caaaagcaucaccaaa

SEQ ID NO: 2323441 - RNA, 20 nt, Yersinia pestis KIM
caaaagaaacugucagucaa

SEQ ID NO: 2323442 - RNA, 13 nt, Yersinia pestis KIM
caaaagaaucagu

SEQ ID NO: 2323443 - RNA, 19 nt, Yersinia pestis KIM
caaaacguauaaaagcauc

SEQ ID NO: 2323444 - RNA, 14 nt, Yersinia pestis KIM
caaaacuauuuauu

SEQ ID NO: 2323445 - RNA, 19 nt, Yersinia pestis KIM
caaaacucaggugaguaaa

SEQ ID NO: 2323446 - RNA, 14 nt, Yersinia pestis KIM
caaaacucagguga

SEQ ID NO: 2323447 - RNA, 13 nt, Yersinia pestis KIM
caaaacugaagca

SEQ ID NO: 2323448 - RNA, 16 nt, Yersinia pestis KIM
caaaagaaaaucagga

SEQ ID NO: 2323449 - RNA, 14 nt, Yersinia pestis KIM
caaaacgcgcgcca

SEQ ID NO: 2323450 - RNA, 14 nt, Yersinia pestis KIM
caaaacgaacaaaa

SEQ ID NO: 2323451 - RNA, 18 nt, Yersinia pestis KIM
caaaacgacgggcugcug

SEQ ID NO: 2323452 - RNA, 22 nt, Yersinia pestis KIM
caaaaccgaugagugaaaucuc

SEQ ID NO: 2323453 - RNA, 18 nt, Yersinia pestis KIM
caaaacagccuaaggcca

SEQ ID NO: 2323454 - RNA, 21 nt, Yersinia pestis KIM
auuugcucagauacaucaaug

SEQ ID NO: 2323455 - RNA, 14 nt, Yersinia pestis KIM
auuugggcuucagc

SEQ ID NO: 2323456 - RNA, 19 nt, Yersinia pestis KIM
auuugguauuggcuagaaa

SEQ ID NO: 2323457 - RNA, 20 nt, Yersinia pestis KIM
auuugguauuggcuagaaau

SEQ ID NO: 2323458 - RNA, 18 nt, Yersinia pestis KIM
auuugcccucgaacgaag

SEQ ID NO: 2323459 - RNA, 14 nt, Yersinia pestis KIM
auuugcgcccgcgc

SEQ ID NO: 2323460 - RNA, 19 nt, Yersinia pestis KIM
auuugccucugcuagcaaa

SEQ ID NO: 2323461 - RNA, 19 nt, Yersinia pestis KIM
auuugucauguugaccaaa

SEQ ID NO: 2323462 - RNA, 14 nt, Yersinia pestis KIM
auuugugucgggau

SEQ ID NO: 2323463 - RNA, 21 nt, Yersinia pestis KIM
auuugugucguacacuauuuu

SEQ ID NO: 2323464 - RNA, 14 nt, Yersinia pestis KIM
auuuguucaagcgu

SEQ ID NO: 2323465 - RNA, 18 nt, Yersinia pestis KIM
auuucuuuuuauguuaaa

SEQ ID NO: 2323466 - RNA, 21 nt, Yersinia pestis KIM
auuugaacaacauugaugcua

SEQ ID NO: 2323467 - RNA, 11 nt, Yersinia pestis KIM
auuugaaacag

SEQ ID NO: 2323468 - RNA, 21 nt, Yersinia pestis KIM
auuugaacgugccccaaugau

SEQ ID NO: 2323469 - RNA, 20 nt, Yersinia pestis KIM
auuugaagacaacucuucua

SEQ ID NO: 2323470 - RNA, 14 nt, Yersinia pestis KIM
auuugaacuucaaa

SEQ ID NO: 2323471 - RNA, 14 nt, Yersinia pestis KIM
auuucuuuuuaugu

SEQ ID NO: 2323472 - RNA, 24 nt, Yersinia pestis KIM
auuucaucggcaaaaacagucauu

SEQ ID NO: 2323473 - RNA, 18 nt, Yersinia pestis KIM
auuucaucggcaaaaaca

SEQ ID NO: 2323474 - RNA, 20 nt, Yersinia pestis KIM
auuucaugauucucuauucu

SEQ ID NO: 2323475 - RNA, 14 nt, Yersinia pestis KIM
auuucaucuugauu

SEQ ID NO: 2323476 - RNA, 17 nt, Yersinia pestis KIM
auuucaugcgaauacuu

SEQ ID NO: 2323477 - RNA, 20 nt, Yersinia pestis KIM
auuucuccccacuucaucau

SEQ ID NO: 2323478 - RNA, 22 nt, Yersinia pestis KIM
auuuugagaugcgagauauaaa

SEQ ID NO: 2323479 - RNA, 16 nt, Yersinia pestis KIM
auuuugagucugggca

SEQ ID NO: 2323480 - RNA, 16 nt, Yersinia pestis KIM
auuuuguagcccacug

SEQ ID NO: 2323481 - RNA, 22 nt, Yersinia pestis KIM
auuuugcacacgauuaccugca

SEQ ID NO: 2323482 - RNA, 20 nt, Yersinia pestis KIM
auuuugugggaaugcccuuu

SEQ ID NO: 2323483 - RNA, 12 nt, Yersinia pestis KIM
auuuugugggaa

SEQ ID NO: 2323484 - RNA, 20 nt, Yersinia pestis KIM
auuuuguuuguaaauuuuaa

SEQ ID NO: 2323485 - RNA, 22 nt, Yersinia pestis KIM
auuuuguuuguaaauuuuaaac

SEQ ID NO: 2323486 - RNA, 19 nt, Yersinia pestis KIM
auuuucuggugagcaucaa

SEQ ID NO: 2323487 - RNA, 21 nt, Yersinia pestis KIM
auuuucuggugagcaucaaca

SEQ ID NO: 2323488 - RNA, 20 nt, Yersinia pestis KIM
auuuucgcccuaacauugag

SEQ ID NO: 2323489 - RNA, 23 nt, Yersinia pestis KIM
auuuuccugcauauuauuuugca

SEQ ID NO: 2323490 - RNA, 22 nt, Yersinia pestis KIM
auuuucgaacuuaacuacugca

SEQ ID NO: 2323491 - RNA, 15 nt, Yersinia pestis KIM
auuuucgaacuuaac

SEQ ID NO: 2323492 - RNA, 14 nt, Yersinia pestis KIM
auuuucauuauuuu

SEQ ID NO: 2323493 - RNA, 19 nt, Yersinia pestis KIM
auuuucauugauacaaaua

SEQ ID NO: 2323494 - RNA, 16 nt, Yersinia pestis KIM
auuuucaucugaccaa

SEQ ID NO: 2323495 - RNA, 18 nt, Yersinia pestis KIM
auuuuaagccgcaaggau

SEQ ID NO: 2323496 - RNA, 22 nt, Yersinia pestis KIM
auuuuaagcugucuaaauugcu

SEQ ID NO: 2323497 - RNA, 14 nt, Yersinia pestis KIM
auuuuaagaaaacu

SEQ ID NO: 2323498 - RNA, 14 nt, Yersinia pestis KIM
auuuuacugaugaa

SEQ ID NO: 2323499 - RNA, 18 nt, Yersinia pestis KIM
auuuuacugccacugacu

SEQ ID NO: 2323500 - RNA, 15 nt, Yersinia pestis KIM
auuuuacuuugaaau

SEQ ID NO: 2323501 - RNA, 19 nt, Yersinia pestis KIM
auuuuaaucagaaaauuca

SEQ ID NO: 2323502 - RNA, 14 nt, Yersinia pestis KIM
auugugcagcauca

SEQ ID NO: 2323503 - RNA, 15 nt, Yersinia pestis KIM
auugugagcuauucc

SEQ ID NO: 2323504 - RNA, 15 nt, Yersinia pestis KIM
auugucuuuaauaaa

SEQ ID NO: 2323505 - RNA, 17 nt, Yersinia pestis KIM
auuguggcuaaacccaa

SEQ ID NO: 2323506 - RNA, 14 nt, Yersinia pestis KIM
auugugcuccagca

SEQ ID NO: 2323507 - RNA, 16 nt, Yersinia pestis KIM
auuguccaaaggaagg

SEQ ID NO: 2323508 - RNA, 15 nt, Yersinia pestis KIM
auuguccaaaggaag

SEQ ID NO: 2323509 - RNA, 15 nt, Yersinia pestis KIM
auuguauugcucagg

SEQ ID NO: 2323510 - RNA, 13 nt, Yersinia pestis KIM
auugucacagacg

SEQ ID NO: 2323511 - RNA, 13 nt, Yersinia pestis KIM
auugucaaucacu

SEQ ID NO: 2323512 - RNA, 21 nt, Yersinia pestis KIM
auuguuaccuaaccaaacauu

SEQ ID NO: 2323513 - RNA, 13 nt, Yersinia pestis KIM
auuguuuaaagcu

SEQ ID NO: 2323514 - RNA, 16 nt, Yersinia pestis KIM
auuguucuuacuguuu

SEQ ID NO: 2323515 - RNA, 12 nt, Yersinia pestis KIM
auuguugccaaa

SEQ ID NO: 2323516 - RNA, 13 nt, Yersinia pestis KIM
auuguugcaagcu

SEQ ID NO: 2323517 - RNA, 16 nt, Yersinia pestis KIM
auuuaaauacaaaaau

SEQ ID NO: 2323518 - RNA, 17 nt, Yersinia pestis KIM
auuuaaauagucaccuu

SEQ ID NO: 2323519 - RNA, 18 nt, Yersinia pestis KIM
auuguuugcuaucaauug

SEQ ID NO: 2323520 - RNA, 21 nt, Yersinia pestis KIM
auuuaacgccaccaaugcauc

SEQ ID NO: 2323521 - RNA, 17 nt, Yersinia pestis KIM
auuuagacagcuuaaaa

SEQ ID NO: 2323522 - RNA, 17 nt, Yersinia pestis KIM
auuuaguaucauuguga

SEQ ID NO: 2323523 - RNA, 19 nt, Yersinia pestis KIM
auuuauagguauacaccuc

SEQ ID NO: 2323524 - RNA, 17 nt, Yersinia pestis KIM
auuuauccauuuaauaa

SEQ ID NO: 2323525 - RNA, 19 nt, Yersinia pestis KIM
auuuauccacuaauucauc

SEQ ID NO: 2323526 - RNA, 22 nt, Yersinia pestis KIM
auuuauccacuaauucaucucc

SEQ ID NO: 2323527 - RNA, 20 nt, Yersinia pestis KIM
auuuaucgccaagccaguaa

SEQ ID NO: 2323528 - RNA, 17 nt, Yersinia pestis KIM
auuuaucgccaacauaa

SEQ ID NO: 2323529 - RNA, 19 nt, Yersinia pestis KIM
auuuaucgcuguuuacuga

SEQ ID NO: 2323530 - RNA, 12 nt, Yersinia pestis KIM
auuuauccuauu

SEQ ID NO: 2323531 - RNA, 15 nt, Yersinia pestis KIM
auuuauccuauuuuu

SEQ ID NO: 2323532 - RNA, 19 nt, Yersinia pestis KIM
auuuaucuaauguauuuau

SEQ ID NO: 2323533 - RNA, 16 nt, Yersinia pestis KIM
auuuauaaaaccacug

SEQ ID NO: 2323534 - RNA, 13 nt, Yersinia pestis KIM
auuuauaaaacca

SEQ ID NO: 2323535 - RNA, 14 nt, Yersinia pestis KIM
auuuauaaaaccac

SEQ ID NO: 2323536 - RNA, 20 nt, Yersinia pestis KIM
auuuauuuguagugacguaa

SEQ ID NO: 2323537 - RNA, 19 nt, Yersinia pestis KIM
auuuauuggucaauaaaau

SEQ ID NO: 2323538 - RNA, 20 nt, Yersinia pestis KIM
auuuauuggucaauaaaauu

SEQ ID NO: 2323539 - RNA, 17 nt, Yersinia pestis KIM
auuuauuuauccuauuu

SEQ ID NO: 2323540 - RNA, 18 nt, Yersinia pestis KIM
auuuauuggucaauaaaa

SEQ ID NO: 2323541 - RNA, 13 nt, Yersinia pestis KIM
auuuauuccucuc

SEQ ID NO: 2323542 - RNA, 17 nt, Yersinia pestis KIM
auuucagcagcacguuc

SEQ ID NO: 2323543 - RNA, 22 nt, Yersinia pestis KIM
auuucagauaaaaauaaucaau

SEQ ID NO: 2323544 - RNA, 14 nt, Yersinia pestis KIM
auuucagccaggcg

SEQ ID NO: 2323545 - RNA, 18 nt, Yersinia pestis KIM
auuucagacugcugacaa

SEQ ID NO: 2323546 - RNA, 13 nt, Yersinia pestis KIM
auuucagacugcu

SEQ ID NO: 2323547 - RNA, 14 nt, Yersinia pestis KIM
auuucagacauaca

SEQ ID NO: 2323548 - RNA, 15 nt, Yersinia pestis KIM
auuucagcuuuuagg

SEQ ID NO: 2323549 - RNA, 12 nt, Yersinia pestis KIM
auuucagcugcu

SEQ ID NO: 2323550 - RNA, 14 nt, Yersinia pestis KIM
auuucagcguagca

SEQ ID NO: 2323551 - RNA, 21 nt, Yersinia pestis KIM
auuucaaacguguacuuuccc

SEQ ID NO: 2323552 - RNA, 21 nt, Yersinia pestis KIM
auuucaacgcaccauccagca

SEQ ID NO: 2323553 - RNA, 10 nt, Yersinia pestis KIM
auuucaagcu

SEQ ID NO: 2323554 - RNA, 12 nt, Yersinia pestis KIM
auuucaaucacu

SEQ ID NO: 2323555 - RNA, 16 nt, Yersinia pestis KIM
auuucaauauaugaau

SEQ ID NO: 2323556 - RNA, 21 nt, Yersinia pestis KIM
auuucaauauaugaaugaguu

SEQ ID NO: 2323557 - RNA, 16 nt, Yersinia pestis KIM
auugccuggcccaucu

SEQ ID NO: 2323558 - RNA, 21 nt, Yersinia pestis KIM
auugcgacgaggguaauaaug

SEQ ID NO: 2323559 - RNA, 19 nt, Yersinia pestis KIM
auugcuccuuacuauuuuc

SEQ ID NO: 2323560 - RNA, 20 nt, Yersinia pestis KIM
auugcuccuuacuauuuuca

SEQ ID NO: 2323561 - RNA, 14 nt, Yersinia pestis KIM
auugcugugguuga

SEQ ID NO: 2323562 - RNA, 18 nt, Yersinia pestis KIM
auugcuguuguuauuacu

SEQ ID NO: 2323563 - RNA, 22 nt, Yersinia pestis KIM
auugcuguuguuauuacuguca

SEQ ID NO: 2323564 - RNA, 22 nt, Yersinia pestis KIM
auugcucaaacucagcaucacc

SEQ ID NO: 2323565 - RNA, 17 nt, Yersinia pestis KIM
auugcuaaauuuuguac

SEQ ID NO: 2323566 - RNA, 15 nt, Yersinia pestis KIM
auugcucagggccac

SEQ ID NO: 2323567 - RNA, 16 nt, Yersinia pestis KIM
auuggcaaaggccagc

SEQ ID NO: 2323568 - RNA, 14 nt, Yersinia pestis KIM
auuggcuucaacuu

SEQ ID NO: 2323569 - RNA, 17 nt, Yersinia pestis KIM
auuggcuccuauagcuc

SEQ ID NO: 2323570 - RNA, 23 nt, Yersinia pestis KIM
auuggcagcggcaaauagagcac

SEQ ID NO: 2323571 - RNA, 23 nt, Yersinia pestis KIM
auugggcucuucgccaguucauu

SEQ ID NO: 2323572 - RNA, 17 nt, Yersinia pestis KIM
auugggcugccugugcg

SEQ ID NO: 2323573 - RNA, 16 nt, Yersinia pestis KIM
auuggguaaucucuuu

SEQ ID NO: 2323574 - RNA, 23 nt, Yersinia pestis KIM
auuggauaauuugccuggcgaau

SEQ ID NO: 2323575 - RNA, 19 nt, Yersinia pestis KIM
auugcuuugcgauacacca

SEQ ID NO: 2323576 - RNA, 23 nt, Yersinia pestis KIM
auugccccccaauauuggauaau

SEQ ID NO: 2323577 - RNA, 21 nt, Yersinia pestis KIM
auugcccuacggguaaagcgu

SEQ ID NO: 2323578 - RNA, 20 nt, Yersinia pestis KIM
auugccgcagauaaaucugu

SEQ ID NO: 2323579 - RNA, 23 nt, Yersinia pestis KIM
auugccgcauacaccuucuuaau

SEQ ID NO: 2323580 - RNA, 20 nt, Yersinia pestis KIM
auugccggauuccaccugac

SEQ ID NO: 2323581 - RNA, 17 nt, Yersinia pestis KIM
auugaguaacugauuaa

SEQ ID NO: 2323582 - RNA, 17 nt, Yersinia pestis KIM
auugagucguuauaaca

SEQ ID NO: 2323583 - RNA, 15 nt, Yersinia pestis KIM
auugagucucuggcc

SEQ ID NO: 2323584 - RNA, 13 nt, Yersinia pestis KIM
auugcaacugggc

SEQ ID NO: 2323585 - RNA, 21 nt, Yersinia pestis KIM
auugcacaugcagcauuucag

SEQ ID NO: 2323586 - RNA, 22 nt, Yersinia pestis KIM
auugauuuguaauaacgauuaa

SEQ ID NO: 2323587 - RNA, 21 nt, Yersinia pestis KIM
auugaauaacuucgcgaacac

SEQ ID NO: 2323588 - RNA, 16 nt, Yersinia pestis KIM
auugagcauauucagu

SEQ ID NO: 2323589 - RNA, 16 nt, Yersinia pestis KIM
auugacuuuaaaaaaa

SEQ ID NO: 2323590 - RNA, 17 nt, Yersinia pestis KIM
auucuuaggucaucguc

SEQ ID NO: 2323591 - RNA, 19 nt, Yersinia pestis KIM
auucuuaucaaucaaaaaa

SEQ ID NO: 2323592 - RNA, 15 nt, Yersinia pestis KIM
auugaagugauauag

SEQ ID NO: 2323593 - RNA, 20 nt, Yersinia pestis KIM
auugaagugauauagaaagc

SEQ ID NO: 2323594 - RNA, 19 nt, Yersinia pestis KIM
auugaagauuuaaauaaca

SEQ ID NO: 2323595 - RNA, 22 nt, Yersinia pestis KIM
auugaaaaucaguuuacaugau

SEQ ID NO: 2323596 - RNA, 18 nt, Yersinia pestis KIM
auucuuuuuguuaaaaua

SEQ ID NO: 2323597 - RNA, 15 nt, Yersinia pestis KIM
auucuuuuuguuaaa

SEQ ID NO: 2323598 - RNA, 15 nt, Yersinia pestis KIM
auucucccauuuauu

SEQ ID NO: 2323599 - RNA, 13 nt, Yersinia pestis KIM
auucucccauuua

SEQ ID NO: 2323600 - RNA, 14 nt, Yersinia pestis KIM
auucucccauuuau

SEQ ID NO: 2323601 - RNA, 19 nt, Yersinia pestis KIM
auucuaggcaugaauaaua

SEQ ID NO: 2323602 - RNA, 12 nt, Yersinia pestis KIM
auucagcuucag

SEQ ID NO: 2323603 - RNA, 19 nt, Yersinia pestis KIM
auucagcuucagcucuucu

SEQ ID NO: 2323604 - RNA, 20 nt, Yersinia pestis KIM
auucucuacucgcucaccac

SEQ ID NO: 2323605 - RNA, 17 nt, Yersinia pestis KIM
auucugcuuuuugcuuu

SEQ ID NO: 2323606 - RNA, 16 nt, Yersinia pestis KIM
auucugcuuuuugcuu

SEQ ID NO: 2323607 - RNA, 21 nt, Yersinia pestis KIM
auucuguagaguaaaacugau

SEQ ID NO: 2323608 - RNA, 18 nt, Yersinia pestis KIM
auucuguagaguaaaacu

SEQ ID NO: 2323609 - RNA, 20 nt, Yersinia pestis KIM
auucugucagagcuauguuc

SEQ ID NO: 2323610 - RNA, 20 nt, Yersinia pestis KIM
auucuggguacaacacaaaa

SEQ ID NO: 2323611 - RNA, 16 nt, Yersinia pestis KIM
augccgcuccagcacu

SEQ ID NO: 2323612 - RNA, 15 nt, Yersinia pestis KIM
augccgcuccagcac

SEQ ID NO: 2323613 - RNA, 17 nt, Yersinia pestis KIM
augccgcugaucaggaa

SEQ ID NO: 2323614 - RNA, 17 nt, Yersinia pestis KIM
augccggaaucagccag

SEQ ID NO: 2323615 - RNA, 17 nt, Yersinia pestis KIM
augccggucaauugagu

SEQ ID NO: 2323616 - RNA, 15 nt, Yersinia pestis KIM
augccggugagcacg

SEQ ID NO: 2323617 - RNA, 16 nt, Yersinia pestis KIM
augccuuguuucuggc

SEQ ID NO: 2323618 - RNA, 21 nt, Yersinia pestis KIM
augccuuuuaaaugaagcagu

SEQ ID NO: 2323619 - RNA, 20 nt, Yersinia pestis KIM
augccuaauaauuuauacau

SEQ ID NO: 2323620 - RNA, 19 nt, Yersinia pestis KIM
augccugagcuauugcaac

SEQ ID NO: 2323621 - RNA, 16 nt, Yersinia pestis KIM
augcccugagauuauu

SEQ ID NO: 2323622 - RNA, 19 nt, Yersinia pestis KIM
augccgcaggucccucuug

SEQ ID NO: 2323623 - RNA, 16 nt, Yersinia pestis KIM
augccauauuacucuc

SEQ ID NO: 2323624 - RNA, 23 nt, Yersinia pestis KIM
augccauaacaucguuaauccau

SEQ ID NO: 2323625 - RNA, 15 nt, Yersinia pestis KIM
augccaguuauuauu

SEQ ID NO: 2323626 - RNA, 19 nt, Yersinia pestis KIM
augccaucccccuuuggcc

SEQ ID NO: 2323627 - RNA, 15 nt, Yersinia pestis KIM
augccauuuacccug

SEQ ID NO: 2323628 - RNA, 13 nt, Yersinia pestis KIM
augcccauuagua

SEQ ID NO: 2323629 - RNA, 20 nt, Yersinia pestis KIM
augauggcaucuuauuauua

SEQ ID NO: 2323630 - RNA, 11 nt, Yersinia pestis KIM
augaugacaau

SEQ ID NO: 2323631 - RNA, 20 nt, Yersinia pestis KIM
augaugaaaauugcaggugg

SEQ ID NO: 2323632 - RNA, 14 nt, Yersinia pestis KIM
augauaaauaaccg

SEQ ID NO: 2323633 - RNA, 13 nt, Yersinia pestis KIM
augauaaaauccu

SEQ ID NO: 2323634 - RNA, 15 nt, Yersinia pestis KIM
augaucuuuauuauu

SEQ ID NO: 2323635 - RNA, 20 nt, Yersinia pestis KIM
augaguguuggccucagacu

SEQ ID NO: 2323636 - RNA, 21 nt, Yersinia pestis KIM
augaguuugaucacagcucuc

SEQ ID NO: 2323637 - RNA, 20 nt, Yersinia pestis KIM
augauguugauuaacccuuu

SEQ ID NO: 2323638 - RNA, 20 nt, Yersinia pestis KIM
augcaaauaauaacgccugc

SEQ ID NO: 2323639 - RNA, 15 nt, Yersinia pestis KIM
augcagcauuucagg

SEQ ID NO: 2323640 - RNA, 15 nt, Yersinia pestis KIM
augcacaguugucug

SEQ ID NO: 2323641 - RNA, 16 nt, Yersinia pestis KIM
augcacaguaggcuga

SEQ ID NO: 2323642 - RNA, 19 nt, Yersinia pestis KIM
augcaauuuuugcagugca

SEQ ID NO: 2323643 - RNA, 21 nt, Yersinia pestis KIM
augcaaucuaacuaauaauaa

SEQ ID NO: 2323644 - RNA, 15 nt, Yersinia pestis KIM
augcagcuaaaagau

SEQ ID NO: 2323645 - RNA, 16 nt, Yersinia pestis KIM
augcagggaagcuggc

SEQ ID NO: 2323646 - RNA, 20 nt, Yersinia pestis KIM
augcaggggaaauggugucu

SEQ ID NO: 2323647 - RNA, 12 nt, Yersinia pestis KIM
augccagcccca

SEQ ID NO: 2323648 - RNA, 20 nt, Yersinia pestis KIM
augccagcguggcccaggca

SEQ ID NO: 2323649 - RNA, 13 nt, Yersinia pestis KIM
augccacccccag

SEQ ID NO: 2323650 - RNA, 12 nt, Yersinia pestis KIM
augccacacuca

SEQ ID NO: 2323651 - RNA, 19 nt, Yersinia pestis KIM
augcaguuuuccucccugc

SEQ ID NO: 2323652 - RNA, 16 nt, Yersinia pestis KIM
augccaacaacugggu

SEQ ID NO: 2323653 - RNA, 14 nt, Yersinia pestis KIM
augcagucagcacu

SEQ ID NO: 2323654 - RNA, 14 nt, Yersinia pestis KIM
augccaagaauaau

SEQ ID NO: 2323655 - RNA, 15 nt, Yersinia pestis KIM
augccaagaauaauu

SEQ ID NO: 2323656 - RNA, 20 nt, Yersinia pestis KIM
augaccaacuguaaaaucuu

SEQ ID NO: 2323657 - RNA, 17 nt, Yersinia pestis KIM
augaauuccuacaagau

SEQ ID NO: 2323658 - RNA, 12 nt, Yersinia pestis KIM
augaauuaucaa

SEQ ID NO: 2323659 - RNA, 16 nt, Yersinia pestis KIM
augaaugcgaacuacg

SEQ ID NO: 2323660 - RNA, 13 nt, Yersinia pestis KIM
augaaugaggcug

SEQ ID NO: 2323661 - RNA, 14 nt, Yersinia pestis KIM
augaaugaggcuga

SEQ ID NO: 2323662 - RNA, 17 nt, Yersinia pestis KIM
augaaugaguuucaagu

SEQ ID NO: 2323663 - RNA, 22 nt, Yersinia pestis KIM
augaaguuauccuccauucugc

SEQ ID NO: 2323664 - RNA, 22 nt, Yersinia pestis KIM
augaagggggcuuauucuaauu

SEQ ID NO: 2323665 - RNA, 12 nt, Yersinia pestis KIM
augaaguuauuu

SEQ ID NO: 2323666 - RNA, 15 nt, Yersinia pestis KIM
augaauaaagggggu

SEQ ID NO: 2323667 - RNA, 23 nt, Yersinia pestis KIM
augaauaaaggggguuuuccccu

SEQ ID NO: 2323668 - RNA, 16 nt, Yersinia pestis KIM
augaauauucaccacc

SEQ ID NO: 2323669 - RNA, 14 nt, Yersinia pestis KIM
augaauauuauuca

SEQ ID NO: 2323670 - RNA, 23 nt, Yersinia pestis KIM
augaauaggauagacaguaacua

SEQ ID NO: 2323671 - RNA, 13 nt, Yersinia pestis KIM
augaauauaugau

SEQ ID NO: 2323672 - RNA, 15 nt, Yersinia pestis KIM
augaauauaugauac

SEQ ID NO: 2323673 - RNA, 17 nt, Yersinia pestis KIM
augaaucgaguaauauu

SEQ ID NO: 2323674 - RNA, 24 nt, Yersinia pestis KIM
augaaucgaguaauauuuuguugc

SEQ ID NO: 2323675 - RNA, 14 nt, Yersinia pestis KIM
augagaaugugacu

SEQ ID NO: 2323676 - RNA, 22 nt, Yersinia pestis KIM
augagaauaucuauauagggaa

SEQ ID NO: 2323677 - RNA, 23 nt, Yersinia pestis KIM
augagaauaucuauauagggaaa

SEQ ID NO: 2323678 - RNA, 18 nt, Yersinia pestis KIM
augagagcgcagcaguga

SEQ ID NO: 2323679 - RNA, 16 nt, Yersinia pestis KIM
augagaugaacacaga

SEQ ID NO: 2323680 - RNA, 16 nt, Yersinia pestis KIM
augagauccugaaaau

SEQ ID NO: 2323681 - RNA, 14 nt, Yersinia pestis KIM
augaguaaacagag

SEQ ID NO: 2323682 - RNA, 13 nt, Yersinia pestis KIM
augaguaaacaga

SEQ ID NO: 2323683 - RNA, 22 nt, Yersinia pestis KIM
augaguaaaccguacauuaaau

SEQ ID NO: 2323684 - RNA, 13 nt, Yersinia pestis KIM
augaguacuauuu

SEQ ID NO: 2323685 - RNA, 18 nt, Yersinia pestis KIM
augaguagagcgcaaagu

SEQ ID NO: 2323686 - RNA, 14 nt, Yersinia pestis KIM
augaguaagugauu

SEQ ID NO: 2323687 - RNA, 13 nt, Yersinia pestis KIM
augaguaucggcc

SEQ ID NO: 2323688 - RNA, 21 nt, Yersinia pestis KIM
augagugaaaauauguaguug

SEQ ID NO: 2323689 - RNA, 15 nt, Yersinia pestis KIM
augagucuauuuauu

SEQ ID NO: 2323690 - RNA, 22 nt, Yersinia pestis KIM
augagucuauuuauugcaaggu

SEQ ID NO: 2323691 - RNA, 13 nt, Yersinia pestis KIM
augagauuaauuc

SEQ ID NO: 2323692 - RNA, 16 nt, Yersinia pestis KIM
augagauuaauucaaa

SEQ ID NO: 2323693 - RNA, 22 nt, Yersinia pestis KIM
augagguaauacucauccagau

SEQ ID NO: 2323694 - RNA, 19 nt, Yersinia pestis KIM
augacgcccgcagcggcua

SEQ ID NO: 2323695 - RNA, 14 nt, Yersinia pestis KIM
augacuggcuauua

SEQ ID NO: 2323696 - RNA, 11 nt, Yersinia pestis KIM
augacuucuua

SEQ ID NO: 2323697 - RNA, 15 nt, Yersinia pestis KIM
aucuuuaacaacaac

SEQ ID NO: 2323698 - RNA, 13 nt, Yersinia pestis KIM
aucuuuaaaaacc

SEQ ID NO: 2323699 - RNA, 18 nt, Yersinia pestis KIM
aucuugaacggugaggau

SEQ ID NO: 2323700 - RNA, 18 nt, Yersinia pestis KIM
aucuugaauaauauucaa

SEQ ID NO: 2323701 - RNA, 14 nt, Yersinia pestis KIM
aucuuuaccagccc

SEQ ID NO: 2323702 - RNA, 16 nt, Yersinia pestis KIM
aucuuuaauuuuuccc

SEQ ID NO: 2323703 - RNA, 17 nt, Yersinia pestis KIM
aucuuuaauauugcauu

SEQ ID NO: 2323704 - RNA, 15 nt, Yersinia pestis KIM
aucuuuaauuuuucc

SEQ ID NO: 2323705 - RNA, 18 nt, Yersinia pestis KIM
aucuuuaauaaauuuucu

SEQ ID NO: 2323706 - RNA, 19 nt, Yersinia pestis KIM
aucuuucauaucaaaagga

SEQ ID NO: 2323707 - RNA, 16 nt, Yersinia pestis KIM
aucuugaaacaaccca

SEQ ID NO: 2323708 - RNA, 18 nt, Yersinia pestis KIM
augaagcauuaaacagau

SEQ ID NO: 2323709 - RNA, 17 nt, Yersinia pestis KIM
augaagcauuaaacaga

SEQ ID NO: 2323710 - RNA, 12 nt, Yersinia pestis KIM
augaagaaauac

SEQ ID NO: 2323711 - RNA, 18 nt, Yersinia pestis KIM
augaaauaguaauuaauu

SEQ ID NO: 2323712 - RNA, 15 nt, Yersinia pestis KIM
augaaaucaguguau

SEQ ID NO: 2323713 - RNA, 21 nt, Yersinia pestis KIM
augaaaguaagagucuggauu

SEQ ID NO: 2323714 - RNA, 15 nt, Yersinia pestis KIM
aucuuuuauuuauga

SEQ ID NO: 2323715 - RNA, 23 nt, Yersinia pestis KIM
aucuuuuaguaacaaaaugcggu

SEQ ID NO: 2323716 - RNA, 21 nt, Yersinia pestis KIM
aucuuucugacuaacucuucu

SEQ ID NO: 2323717 - RNA, 16 nt, Yersinia pestis KIM
aucuuucggccucccc

SEQ ID NO: 2323718 - RNA, 17 nt, Yersinia pestis KIM
augaaaggcuccacaua

SEQ ID NO: 2323719 - RNA, 20 nt, Yersinia pestis KIM
augaaaggcggugaacagua

SEQ ID NO: 2323720 - RNA, 21 nt, Yersinia pestis KIM
aucgcgcccauccgcaggaag

SEQ ID NO: 2323721 - RNA, 18 nt, Yersinia pestis KIM
aucgcgcauuucuucucu

SEQ ID NO: 2323722 - RNA, 17 nt, Yersinia pestis KIM
aucgcgcauuucuucuc

SEQ ID NO: 2323723 - RNA, 15 nt, Yersinia pestis KIM
aucgcggcugauuaa

SEQ ID NO: 2323724 - RNA, 17 nt, Yersinia pestis KIM
aucgcgacgaaaaccua

SEQ ID NO: 2323725 - RNA, 22 nt, Yersinia pestis KIM
aucgccguagauuuaaccccaa

SEQ ID NO: 2323726 - RNA, 17 nt, Yersinia pestis KIM
aucgcauugucacccac

SEQ ID NO: 2323727 - RNA, 23 nt, Yersinia pestis KIM
aucgcauccgggaaccccuucag

SEQ ID NO: 2323728 - RNA, 22 nt, Yersinia pestis KIM
aucgcacugaguucugcugcca

SEQ ID NO: 2323729 - RNA, 18 nt, Yersinia pestis KIM
aucgcacguugcagaugg

SEQ ID NO: 2323730 - RNA, 21 nt, Yersinia pestis KIM
aucgcaguggcgcuacuuccc

SEQ ID NO: 2323731 - RNA, 17 nt, Yersinia pestis KIM
aucagcguagauuuucu

SEQ ID NO: 2323732 - RNA, 16 nt, Yersinia pestis KIM
aucagcguuuuauucg

SEQ ID NO: 2323733 - RNA, 15 nt, Yersinia pestis KIM
aucagcugauaugaa

SEQ ID NO: 2323734 - RNA, 17 nt, Yersinia pestis KIM
aucagcuucauuaagga

SEQ ID NO: 2323735 - RNA, 14 nt, Yersinia pestis KIM
aucgaacaucuccu

SEQ ID NO: 2323736 - RNA, 23 nt, Yersinia pestis KIM
aucgagaguugcucacccauuuu

SEQ ID NO: 2323737 - RNA, 20 nt, Yersinia pestis KIM
aucggcaaaccgaauaccau

SEQ ID NO: 2323738 - RNA, 15 nt, Yersinia pestis KIM
aucggccaauaugau

SEQ ID NO: 2323739 - RNA, 23 nt, Yersinia pestis KIM
aucggauggucauccacaaccag

SEQ ID NO: 2323740 - RNA, 23 nt, Yersinia pestis KIM
aucgcgguaaucccgauauaaau

SEQ ID NO: 2323741 - RNA, 17 nt, Yersinia pestis KIM
aucgcggguuuuuaacu

SEQ ID NO: 2323742 - RNA, 13 nt, Yersinia pestis KIM
aucgcuaaaaagc

SEQ ID NO: 2323743 - RNA, 12 nt, Yersinia pestis KIM
aucgcuaaaaag

SEQ ID NO: 2323744 - RNA, 19 nt, Yersinia pestis KIM
aucgcuaacccucaguaaa

SEQ ID NO: 2323745 - RNA, 15 nt, Yersinia pestis KIM
aucgcuaaauacugc

SEQ ID NO: 2323746 - RNA, 15 nt, Yersinia pestis KIM
aucggccccugacau

SEQ ID NO: 2323747 - RNA, 14 nt, Yersinia pestis KIM
aucggccugcgcug

SEQ ID NO: 2323748 - RNA, 20 nt, Yersinia pestis KIM
aucggccugcgcugcuuuuu

SEQ ID NO: 2323749 - RNA, 15 nt, Yersinia pestis KIM
aucgggcuaucauca

SEQ ID NO: 2323750 - RNA, 23 nt, Yersinia pestis KIM
aucgggguuugucagcagucuga

SEQ ID NO: 2323751 - RNA, 13 nt, Yersinia pestis KIM
aucgguaaaucgc

SEQ ID NO: 2323752 - RNA, 15 nt, Yersinia pestis KIM
aucguccggucugaa

SEQ ID NO: 2323753 - RNA, 18 nt, Yersinia pestis KIM
aucguccggucugaagag

SEQ ID NO: 2323754 - RNA, 23 nt, Yersinia pestis KIM
aucguccuguaaggcccgcagua

SEQ ID NO: 2323755 - RNA, 21 nt, Yersinia pestis KIM
aucguggcuguaaauaaauaa

SEQ ID NO: 2323756 - RNA, 14 nt, Yersinia pestis KIM
aucguuacucgauu

SEQ ID NO: 2323757 - RNA, 20 nt, Yersinia pestis KIM
aucguuaaaguuaucaccaa

SEQ ID NO: 2323758 - RNA, 21 nt, Yersinia pestis KIM
aucguuaaacccggcaucaac

SEQ ID NO: 2323759 - RNA, 15 nt, Yersinia pestis KIM
aucuaaaaggauagg

SEQ ID NO: 2323760 - RNA, 11 nt, Yersinia pestis KIM
aucuaaauauu

SEQ ID NO: 2323761 - RNA, 17 nt, Yersinia pestis KIM
aucucaagacacuauuc

SEQ ID NO: 2323762 - RNA, 16 nt, Yersinia pestis KIM
aucuauucucuguaau

SEQ ID NO: 2323763 - RNA, 17 nt, Yersinia pestis KIM
aucuauuugaguuuuag

SEQ ID NO: 2323764 - RNA, 21 nt, Yersinia pestis KIM
aucuauuuuuauuucuccuua

SEQ ID NO: 2323765 - RNA, 19 nt, Yersinia pestis KIM
aucuauuagaugugaaaua

SEQ ID NO: 2323766 - RNA, 19 nt, Yersinia pestis KIM
aucuaucggugcagugcaa

SEQ ID NO: 2323767 - RNA, 20 nt, Yersinia pestis KIM
aucuauauagggaaauaaca

SEQ ID NO: 2323768 - RNA, 19 nt, Yersinia pestis KIM
aucuaccgcagaaccuugu

SEQ ID NO: 2323769 - RNA, 18 nt, Yersinia pestis KIM
aucucgacaaauccuuuu

SEQ ID NO: 2323770 - RNA, 19 nt, Yersinia pestis KIM
aucucgacaaauccuuuua

SEQ ID NO: 2323771 - RNA, 22 nt, Yersinia pestis KIM
aucucgacaaauccuuuuaaaa

SEQ ID NO: 2323772 - RNA, 18 nt, Yersinia pestis KIM
aucucgagguguuuuccc

SEQ ID NO: 2323773 - RNA, 15 nt, Yersinia pestis KIM
aucuccgcggguucu

SEQ ID NO: 2323774 - RNA, 16 nt, Yersinia pestis KIM
aucuccaguaaaucua

SEQ ID NO: 2323775 - RNA, 17 nt, Yersinia pestis KIM
aucucccgcaaagccug

SEQ ID NO: 2323776 - RNA, 20 nt, Yersinia pestis KIM
aucucaucuuaaucacgaua

SEQ ID NO: 2323777 - RNA, 11 nt, Yersinia pestis KIM
aucucaucaaa

SEQ ID NO: 2323778 - RNA, 19 nt, Yersinia pestis KIM
aucucaucggcauacuccu

SEQ ID NO: 2323779 - RNA, 16 nt, Yersinia pestis KIM
aucuccagaauauaaa

SEQ ID NO: 2323780 - RNA, 13 nt, Yersinia pestis KIM
aucuccagaagca

SEQ ID NO: 2323781 - RNA, 16 nt, Yersinia pestis KIM
aucucacgcugaauaa

SEQ ID NO: 2323782 - RNA, 18 nt, Yersinia pestis KIM
aucucacgcugaauaaca

SEQ ID NO: 2323783 - RNA, 15 nt, Yersinia pestis KIM
aucucacgcugaaua

SEQ ID NO: 2323784 - RNA, 22 nt, Yersinia pestis KIM
aucucacgguagugacucauca

SEQ ID NO: 2323785 - RNA, 15 nt, Yersinia pestis KIM
aucucacgguaguga

SEQ ID NO: 2323786 - RNA, 23 nt, Yersinia pestis KIM
aucucagugagguuuuugauggu

SEQ ID NO: 2323787 - RNA, 20 nt, Yersinia pestis KIM
aucucagcagugaguuuauu

SEQ ID NO: 2323788 - RNA, 13 nt, Yersinia pestis KIM
aucucuuccuggg

SEQ ID NO: 2323789 - RNA, 21 nt, Yersinia pestis KIM
aucucuugauuaccaauaauu

SEQ ID NO: 2323790 - RNA, 20 nt, Yersinia pestis KIM
aucucuuuauauucaauauc

SEQ ID NO: 2323791 - RNA, 23 nt, Yersinia pestis KIM
aucucuggcaacggcacauccca

SEQ ID NO: 2323792 - RNA, 16 nt, Yersinia pestis KIM
aucucuuaccccuuuc

SEQ ID NO: 2323793 - RNA, 16 nt, Yersinia pestis KIM
aucucugggugcugcu

SEQ ID NO: 2323794 - RNA, 19 nt, Yersinia pestis KIM
aucucuaucgcgguuuuaa

SEQ ID NO: 2323795 - RNA, 20 nt, Yersinia pestis KIM
aucucuaucguuuggcaauu

SEQ ID NO: 2323796 - RNA, 20 nt, Yersinia pestis KIM
aucucuacgcacuuaaugcc

SEQ ID NO: 2323797 - RNA, 14 nt, Yersinia pestis KIM
aucucuccagccug

SEQ ID NO: 2323798 - RNA, 14 nt, Yersinia pestis KIM
aucucuaacaggga

SEQ ID NO: 2323799 - RNA, 20 nt, Yersinia pestis KIM
aucucuaacagggaugaaua

SEQ ID NO: 2323800 - RNA, 23 nt, Yersinia pestis KIM
aucucggggccacgguuggccgu

SEQ ID NO: 2323801 - RNA, 21 nt, Yersinia pestis KIM
aucugcaauggcuggcaaggc

SEQ ID NO: 2323802 - RNA, 22 nt, Yersinia pestis KIM
aucugcacaccacacuggaugc

SEQ ID NO: 2323803 - RNA, 15 nt, Yersinia pestis KIM
aucugauaucucuuu

SEQ ID NO: 2323804 - RNA, 19 nt, Yersinia pestis KIM
aucugauaucucuuuauca

SEQ ID NO: 2323805 - RNA, 14 nt, Yersinia pestis KIM
aucugauauuauug

SEQ ID NO: 2323806 - RNA, 13 nt, Yersinia pestis KIM
aucugaugagugu

SEQ ID NO: 2323807 - RNA, 13 nt, Yersinia pestis KIM
aucugaccaaaca

SEQ ID NO: 2323808 - RNA, 17 nt, Yersinia pestis KIM
aucugagcgaacugaau

SEQ ID NO: 2323809 - RNA, 15 nt, Yersinia pestis KIM
aucugaagaugcuga

SEQ ID NO: 2323810 - RNA, 19 nt, Yersinia pestis KIM
aucugaauagcgcugcauc

SEQ ID NO: 2323811 - RNA, 15 nt, Yersinia pestis KIM
aucugaauggcccgc

SEQ ID NO: 2323812 - RNA, 22 nt, Yersinia pestis KIM
aucugcggauuuacucgccuuu

SEQ ID NO: 2323813 - RNA, 20 nt, Yersinia pestis KIM
aucugcgguaaccaauaaca

SEQ ID NO: 2323814 - RNA, 12 nt, Yersinia pestis KIM
aucugcccagcc

SEQ ID NO: 2323815 - RNA, 12 nt, Yersinia pestis KIM
aucugcaguaga

SEQ ID NO: 2323816 - RNA, 16 nt, Yersinia pestis KIM
aucugcauugauuaaa

SEQ ID NO: 2323817 - RNA, 20 nt, Yersinia pestis KIM
auggcggcuggaaaaccaau

SEQ ID NO: 2323818 - RNA, 20 nt, Yersinia pestis KIM
auggcuaagcacaauuguua

SEQ ID NO: 2323819 - RNA, 16 nt, Yersinia pestis KIM
auggcuaauuaauuua

SEQ ID NO: 2323820 - RNA, 18 nt, Yersinia pestis KIM
auggcuccaccguucagg

SEQ ID NO: 2323821 - RNA, 13 nt, Yersinia pestis KIM
auggcgcugggca

SEQ ID NO: 2323822 - RNA, 21 nt, Yersinia pestis KIM
auggccaucucacauagcugu

SEQ ID NO: 2323823 - RNA, 17 nt, Yersinia pestis KIM
auggcagguaucaauac

SEQ ID NO: 2323824 - RNA, 14 nt, Yersinia pestis KIM
auggccaauaccca

SEQ ID NO: 2323825 - RNA, 15 nt, Yersinia pestis KIM
auggccaauacccau

SEQ ID NO: 2323826 - RNA, 16 nt, Yersinia pestis KIM
auggcaucuuauuauu

SEQ ID NO: 2323827 - RNA, 14 nt, Yersinia pestis KIM
auggcauuaaaaau

SEQ ID NO: 2323828 - RNA, 15 nt, Yersinia pestis KIM
auggcauuaaaaauc

SEQ ID NO: 2323829 - RNA, 18 nt, Yersinia pestis KIM
auggcauauucaccagac

SEQ ID NO: 2323830 - RNA, 12 nt, Yersinia pestis KIM
augccuuuucuu

SEQ ID NO: 2323831 - RNA, 13 nt, Yersinia pestis KIM
augccuuuucuuc

SEQ ID NO: 2323832 - RNA, 16 nt, Yersinia pestis KIM
augcgaaaaaagaugg

SEQ ID NO: 2323833 - RNA, 13 nt, Yersinia pestis KIM
augcgauuuuuga

SEQ ID NO: 2323834 - RNA, 20 nt, Yersinia pestis KIM
auggcuuuuuuacgcgccug

SEQ ID NO: 2323835 - RNA, 13 nt, Yersinia pestis KIM
augggcagaagag

SEQ ID NO: 2323836 - RNA, 12 nt, Yersinia pestis KIM
augggauaaacu

SEQ ID NO: 2323837 - RNA, 21 nt, Yersinia pestis KIM
augggcgccgcuuuaccuguu

SEQ ID NO: 2323838 - RNA, 22 nt, Yersinia pestis KIM
auggguuguucuuuacuugguu

SEQ ID NO: 2323839 - RNA, 20 nt, Yersinia pestis KIM
augguguguagucuucauca

SEQ ID NO: 2323840 - RNA, 17 nt, Yersinia pestis KIM
augguguuaucuucacu

SEQ ID NO: 2323841 - RNA, 15 nt, Yersinia pestis KIM
augguuaaaacucaa

SEQ ID NO: 2323842 - RNA, 21 nt, Yersinia pestis KIM
augguuaagagaucccgugcc

SEQ ID NO: 2323843 - RNA, 21 nt, Yersinia pestis KIM
auggucgaucccaauauuaaa

SEQ ID NO: 2323844 - RNA, 21 nt, Yersinia pestis KIM
augguagccauauaauaugcc

SEQ ID NO: 2323845 - RNA, 22 nt, Yersinia pestis KIM
augguacggaucagugugggcu

SEQ ID NO: 2323846 - RNA, 16 nt, Yersinia pestis KIM
auguggcauguucagc

SEQ ID NO: 2323847 - RNA, 18 nt, Yersinia pestis KIM
auguggcugcuguugcca

SEQ ID NO: 2323848 - RNA, 17 nt, Yersinia pestis KIM
auguuaaaccaaagaua

SEQ ID NO: 2323849 - RNA, 19 nt, Yersinia pestis KIM
auguuaaaccaaagauaau

SEQ ID NO: 2323850 - RNA, 13 nt, Yersinia pestis KIM
auguuaaaucagu

SEQ ID NO: 2323851 - RNA, 18 nt, Yersinia pestis KIM
auguuaaaucagugaagg

SEQ ID NO: 2323852 - RNA, 17 nt, Yersinia pestis KIM
auguucaacaagaaauc

SEQ ID NO: 2323853 - RNA, 17 nt, Yersinia pestis KIM
auguucaacaaguguca

SEQ ID NO: 2323854 - RNA, 18 nt, Yersinia pestis KIM
augugaaaagcagucgac

SEQ ID NO: 2323855 - RNA, 14 nt, Yersinia pestis KIM
augugaaaagcagu

SEQ ID NO: 2323856 - RNA, 22 nt, Yersinia pestis KIM
augucuuuuucuuuuuaacuua

SEQ ID NO: 2323857 - RNA, 16 nt, Yersinia pestis KIM
auguccucaccauuua

SEQ ID NO: 2323858 - RNA, 22 nt, Yersinia pestis KIM
auguccucaccauuuauugcca

SEQ ID NO: 2323859 - RNA, 16 nt, Yersinia pestis KIM
auguaggcaauacacc

SEQ ID NO: 2323860 - RNA, 15 nt, Yersinia pestis KIM
auguaaugccacacu

SEQ ID NO: 2323861 - RNA, 17 nt, Yersinia pestis KIM
auguaaugccacacuca

SEQ ID NO: 2323862 - RNA, 13 nt, Yersinia pestis KIM
auguaguguguuu

SEQ ID NO: 2323863 - RNA, 23 nt, Yersinia pestis KIM
auguaguguguuuucuuguauau

SEQ ID NO: 2323864 - RNA, 17 nt, Yersinia pestis KIM
auguaaggcaauaccaa

SEQ ID NO: 2323865 - RNA, 23 nt, Yersinia pestis KIM
augguuuccuucaccaaaaaaac

SEQ ID NO: 2323866 - RNA, 20 nt, Yersinia pestis KIM
auguaaaacacgcaacacuu

SEQ ID NO: 2323867 - RNA, 17 nt, Yersinia pestis KIM
auguccaguuaucaucg

SEQ ID NO: 2323868 - RNA, 15 nt, Yersinia pestis KIM
auguauucaagcgau

SEQ ID NO: 2323869 - RNA, 16 nt, Yersinia pestis KIM
augucaugguuaaacu

SEQ ID NO: 2323870 - RNA, 13 nt, Yersinia pestis KIM
augucaugauaaa

SEQ ID NO: 2323871 - RNA, 15 nt, Yersinia pestis KIM
auguccucaccauuu

SEQ ID NO: 2323872 - RNA, 22 nt, Yersinia pestis KIM
auguauuagcgcugcucaauca

SEQ ID NO: 2323873 - RNA, 12 nt, Yersinia pestis KIM
auguauccaucu

SEQ ID NO: 2323874 - RNA, 20 nt, Yersinia pestis KIM
auuaaauuuuaugacacaua

SEQ ID NO: 2323875 - RNA, 16 nt, Yersinia pestis KIM
auuaaauuuuauauua

SEQ ID NO: 2323876 - RNA, 13 nt, Yersinia pestis KIM
auuaacauccauu

SEQ ID NO: 2323877 - RNA, 13 nt, Yersinia pestis KIM
auuaacauucucu

SEQ ID NO: 2323878 - RNA, 22 nt, Yersinia pestis KIM
auuaacacccaauaauaaaaaa

SEQ ID NO: 2323879 - RNA, 12 nt, Yersinia pestis KIM
auuaacacaucu

SEQ ID NO: 2323880 - RNA, 14 nt, Yersinia pestis KIM
auuaagaaaccagc

SEQ ID NO: 2323881 - RNA, 16 nt, Yersinia pestis KIM
auuaagccguaacuga

SEQ ID NO: 2323882 - RNA, 20 nt, Yersinia pestis KIM
auuaagccaugggucauuaa

SEQ ID NO: 2323883 - RNA, 18 nt, Yersinia pestis KIM
auuaacuauuugaugcua

SEQ ID NO: 2323884 - RNA, 18 nt, Yersinia pestis KIM
auuaacuguuaaaacagg

SEQ ID NO: 2323885 - RNA, 16 nt, Yersinia pestis KIM
auuaaccuuaucacca

SEQ ID NO: 2323886 - RNA, 12 nt, Yersinia pestis KIM
auuaaugauaac

SEQ ID NO: 2323887 - RNA, 22 nt, Yersinia pestis KIM
auuaaucuauuaauaucgaggu

SEQ ID NO: 2323888 - RNA, 14 nt, Yersinia pestis KIM
auuaaugcaccuac

SEQ ID NO: 2323889 - RNA, 17 nt, Yersinia pestis KIM
auuaauggauagcugua

SEQ ID NO: 2323890 - RNA, 22 nt, Yersinia pestis KIM
auuaauggauugaucauucucu

SEQ ID NO: 2323891 - RNA, 23 nt, Yersinia pestis KIM
auuaaucaagauauuacuucuuu

SEQ ID NO: 2323892 - RNA, 23 nt, Yersinia pestis KIM
auuaauccccggucacuuaaaua

SEQ ID NO: 2323893 - RNA, 15 nt, Yersinia pestis KIM
auuaauacaucauca

SEQ ID NO: 2323894 - RNA, 16 nt, Yersinia pestis KIM
auuaauacaucaucaa

SEQ ID NO: 2323895 - RNA, 17 nt, Yersinia pestis KIM
auuaauaauaaauugca

SEQ ID NO: 2323896 - RNA, 15 nt, Yersinia pestis KIM
auuaauaaaaccuuu

SEQ ID NO: 2323897 - RNA, 16 nt, Yersinia pestis KIM
auuaauaaauuauaau

SEQ ID NO: 2323898 - RNA, 19 nt, Yersinia pestis KIM
auuaauaaccauaaaauaa

SEQ ID NO: 2323899 - RNA, 22 nt, Yersinia pestis KIM
auuaaggcgauauuauuaguag

SEQ ID NO: 2323900 - RNA, 23 nt, Yersinia pestis KIM
auuaaggguuaaccagaagaaca

SEQ ID NO: 2323901 - RNA, 12 nt, Yersinia pestis KIM
auuaaggagugc

SEQ ID NO: 2323902 - RNA, 22 nt, Yersinia pestis KIM
auuaaacagucuuauuacucau

SEQ ID NO: 2323903 - RNA, 11 nt, Yersinia pestis KIM
auuaaacagau

SEQ ID NO: 2323904 - RNA, 13 nt, Yersinia pestis KIM
auuaaacgcucau

SEQ ID NO: 2323905 - RNA, 14 nt, Yersinia pestis KIM
auuaaacuugcucu

SEQ ID NO: 2323906 - RNA, 19 nt, Yersinia pestis KIM
auuaaacgucucuuuuuca

SEQ ID NO: 2323907 - RNA, 14 nt, Yersinia pestis KIM
auuaaagauuucau

SEQ ID NO: 2323908 - RNA, 22 nt, Yersinia pestis KIM
auuaaagauuucaucauucaau

SEQ ID NO: 2323909 - RNA, 12 nt, Yersinia pestis KIM
auuaaauaagaa

SEQ ID NO: 2323910 - RNA, 12 nt, Yersinia pestis KIM
auuaaaaauaca

SEQ ID NO: 2323911 - RNA, 13 nt, Yersinia pestis KIM
auuaaaaauacaa

SEQ ID NO: 2323912 - RNA, 14 nt, Yersinia pestis KIM
auuaaaaauacaac

SEQ ID NO: 2323913 - RNA, 21 nt, Yersinia pestis KIM
auuaaaaaucugcaauaucau

SEQ ID NO: 2323914 - RNA, 13 nt, Yersinia pestis KIM
auuaaaaauuaau

SEQ ID NO: 2323915 - RNA, 16 nt, Yersinia pestis KIM
auuaaaaccacgcauu

SEQ ID NO: 2323916 - RNA, 20 nt, Yersinia pestis KIM
auguugcccuuaguuggcaa

SEQ ID NO: 2323917 - RNA, 16 nt, Yersinia pestis KIM
auguucacaucgguca

SEQ ID NO: 2323918 - RNA, 17 nt, Yersinia pestis KIM
auguucagcucaagaau

SEQ ID NO: 2323919 - RNA, 18 nt, Yersinia pestis KIM
auguuugccgguaugcca

SEQ ID NO: 2323920 - RNA, 18 nt, Yersinia pestis KIM
auguuugaugguuaugug

SEQ ID NO: 2323921 - RNA, 22 nt, Yersinia pestis KIM
auguuuuacgaucaacccccug

SEQ ID NO: 2323922 - RNA, 22 nt, Yersinia pestis KIM
auguuucuauccgaaaaauauu

SEQ ID NO: 2323923 - RNA, 15 nt, Yersinia pestis KIM
auuagaaaacaaguu

SEQ ID NO: 2323924 - RNA, 17 nt, Yersinia pestis KIM
auuagaaguucuaaaua

SEQ ID NO: 2323925 - RNA, 19 nt, Yersinia pestis KIM
auuagaugguuaacucauu

SEQ ID NO: 2323926 - RNA, 21 nt, Yersinia pestis KIM
auuagcuugugugcuuacauu

SEQ ID NO: 2323927 - RNA, 12 nt, Yersinia pestis KIM
auuauaaugaaa

SEQ ID NO: 2323928 - RNA, 13 nt, Yersinia pestis KIM
auuauaaugaaau

SEQ ID NO: 2323929 - RNA, 16 nt, Yersinia pestis KIM
auuauaacuauuaucu

SEQ ID NO: 2323930 - RNA, 19 nt, Yersinia pestis KIM
auuauaaggagagauuaga

SEQ ID NO: 2323931 - RNA, 18 nt, Yersinia pestis KIM
auuauauagauuuauuca

SEQ ID NO: 2323932 - RNA, 15 nt, Yersinia pestis KIM
auuaggcaugauaag

SEQ ID NO: 2323933 - RNA, 18 nt, Yersinia pestis KIM
auuagggcugacagagcg

SEQ ID NO: 2323934 - RNA, 19 nt, Yersinia pestis KIM
auuaguuuuaauaaccauu

SEQ ID NO: 2323935 - RNA, 21 nt, Yersinia pestis KIM
auuagucgcuuuuuguauuuu

SEQ ID NO: 2323936 - RNA, 23 nt, Yersinia pestis KIM
auuaccaccgucaagacaacaaa

SEQ ID NO: 2323937 - RNA, 21 nt, Yersinia pestis KIM
auuaccaauaagcuguaaugc

SEQ ID NO: 2323938 - RNA, 20 nt, Yersinia pestis KIM
auuacccacuugcaacauua

SEQ ID NO: 2323939 - RNA, 20 nt, Yersinia pestis KIM
auuacccucauuuuacccga

SEQ ID NO: 2323940 - RNA, 21 nt, Yersinia pestis KIM
auuaccuuuaaaacuggucag

SEQ ID NO: 2323941 - RNA, 13 nt, Yersinia pestis KIM
auuaccuuuuuac

SEQ ID NO: 2323942 - RNA, 14 nt, Yersinia pestis KIM
auuaccguuaucaa

SEQ ID NO: 2323943 - RNA, 16 nt, Yersinia pestis KIM
auuaccggcacuggcu

SEQ ID NO: 2323944 - RNA, 23 nt, Yersinia pestis KIM
auuaccugagagagguugaggau

SEQ ID NO: 2323945 - RNA, 20 nt, Yersinia pestis KIM
auuacucagcacauuuuuau

SEQ ID NO: 2323946 - RNA, 17 nt, Yersinia pestis KIM
auuacgugcccaaaaac

SEQ ID NO: 2323947 - RNA, 17 nt, Yersinia pestis KIM
auuacguuccacugcuu

SEQ ID NO: 2323948 - RNA, 18 nt, Yersinia pestis KIM
auuacgggucagcucacc

SEQ ID NO: 2323949 - RNA, 14 nt, Yersinia pestis KIM
auuacggucaccaa

SEQ ID NO: 2323950 - RNA, 23 nt, Yersinia pestis KIM
auuacgguuuaccaccuuaaaau

SEQ ID NO: 2323951 - RNA, 14 nt, Yersinia pestis KIM
auuacgcgucauca

SEQ ID NO: 2323952 - RNA, 22 nt, Yersinia pestis KIM
auuaaugucgccauaacgcaca

SEQ ID NO: 2323953 - RNA, 13 nt, Yersinia pestis KIM
auuaauuaagcua

SEQ ID NO: 2323954 - RNA, 15 nt, Yersinia pestis KIM
auuaauuaagcuauu

SEQ ID NO: 2323955 - RNA, 11 nt, Yersinia pestis KIM
auuaauuacuu

SEQ ID NO: 2323956 - RNA, 13 nt, Yersinia pestis KIM
auuaauuaaugaa

SEQ ID NO: 2323957 - RNA, 18 nt, Yersinia pestis KIM
auuaauuaguuuuaauaa

SEQ ID NO: 2323958 - RNA, 21 nt, Yersinia pestis KIM
auuaauuaguuuuaauaacca

SEQ ID NO: 2323959 - RNA, 14 nt, Yersinia pestis KIM
auuaauuauuuuau

SEQ ID NO: 2323960 - RNA, 11 nt, Yersinia pestis KIM
auuaauuauuc

SEQ ID NO: 2323961 - RNA, 22 nt, Yersinia pestis KIM
auuaauuccacgcugaaacuuu

SEQ ID NO: 2323962 - RNA, 16 nt, Yersinia pestis KIM
auuaauuucaccacau

SEQ ID NO: 2323963 - RNA, 15 nt, Yersinia pestis KIM
auuaauugguauuuu

SEQ ID NO: 2323964 - RNA, 16 nt, Yersinia pestis KIM
auuaauugguauuuua

SEQ ID NO: 2323965 - RNA, 18 nt, Yersinia pestis KIM
auuaauugguuuuaauaa

SEQ ID NO: 2323966 - RNA, 21 nt, Yersinia pestis KIM
auuaauugguuuuaauaacca

SEQ ID NO: 2323967 - RNA, 15 nt, Yersinia pestis KIM
auuaauuuaaacaac

SEQ ID NO: 2323968 - RNA, 12 nt, Yersinia pestis KIM
auuaauuuuuca

SEQ ID NO: 2323969 - RNA, 17 nt, Yersinia pestis KIM
auuacaggccccaaucc

SEQ ID NO: 2323970 - RNA, 15 nt, Yersinia pestis KIM
auuacaagugccaaa

SEQ ID NO: 2323971 - RNA, 13 nt, Yersinia pestis KIM
auuacaaaauaua

SEQ ID NO: 2323972 - RNA, 15 nt, Yersinia pestis KIM
auucaccagcaauaa

SEQ ID NO: 2323973 - RNA, 16 nt, Yersinia pestis KIM
auucaccagcaauaaa

SEQ ID NO: 2323974 - RNA, 20 nt, Yersinia pestis KIM
auucaccaucugccugcaaa

SEQ ID NO: 2323975 - RNA, 15 nt, Yersinia pestis KIM
auucacccuuuaaau

SEQ ID NO: 2323976 - RNA, 17 nt, Yersinia pestis KIM
auucaccaccauuaaca

SEQ ID NO: 2323977 - RNA, 23 nt, Yersinia pestis KIM
auucaaugacuccugaaauaaag

SEQ ID NO: 2323978 - RNA, 16 nt, Yersinia pestis KIM
auucaauugaaauaag

SEQ ID NO: 2323979 - RNA, 17 nt, Yersinia pestis KIM
auucaauugaaauaaga

SEQ ID NO: 2323980 - RNA, 13 nt, Yersinia pestis KIM
auucaauugaucu

SEQ ID NO: 2323981 - RNA, 20 nt, Yersinia pestis KIM
auucacaacagugcaacauu

SEQ ID NO: 2323982 - RNA, 21 nt, Yersinia pestis KIM
auucaauugugcaaaaucagc

SEQ ID NO: 2323983 - RNA, 23 nt, Yersinia pestis KIM
auucaauugugcaaaaucagcau

SEQ ID NO: 2323984 - RNA, 12 nt, Yersinia pestis KIM
auucacugcuaa

SEQ ID NO: 2323985 - RNA, 12 nt, Yersinia pestis KIM
auucagcaauau

SEQ ID NO: 2323986 - RNA, 13 nt, Yersinia pestis KIM
auucaccuucaau

SEQ ID NO: 2323987 - RNA, 14 nt, Yersinia pestis KIM
auucacgccuaucu

SEQ ID NO: 2323988 - RNA, 19 nt, Yersinia pestis KIM
auucacguccucuuauuaa

SEQ ID NO: 2323989 - RNA, 18 nt, Yersinia pestis KIM
auucacguaugguuuuua

SEQ ID NO: 2323990 - RNA, 22 nt, Yersinia pestis KIM
auucacuauuuauuaaucuauu

SEQ ID NO: 2323991 - RNA, 21 nt, Yersinia pestis KIM
auucaaaauagaggaaauaaa

SEQ ID NO: 2323992 - RNA, 16 nt, Yersinia pestis KIM
auucaaaauagggaag

SEQ ID NO: 2323993 - RNA, 16 nt, Yersinia pestis KIM
auuauuuuuauacaga

SEQ ID NO: 2323994 - RNA, 15 nt, Yersinia pestis KIM
auucaaaauagaaaa

SEQ ID NO: 2323995 - RNA, 22 nt, Yersinia pestis KIM
auucaaacggugugcaaugcag

SEQ ID NO: 2323996 - RNA, 21 nt, Yersinia pestis KIM
auuauuuuguacgaauaacuc

SEQ ID NO: 2323997 - RNA, 21 nt, Yersinia pestis KIM
auuauuuugugcguaaagaaa

SEQ ID NO: 2323998 - RNA, 20 nt, Yersinia pestis KIM
auucaaggccagcacguuuu

SEQ ID NO: 2323999 - RNA, 16 nt, Yersinia pestis KIM
auucaagaaaaugauu

SEQ ID NO: 2324000 - RNA, 20 nt, Yersinia pestis KIM
auucaagaaaaugauuuaau

SEQ ID NO: 2324001 - RNA, 22 nt, Yersinia pestis KIM
auucaagaaaaugauuuaauuu

SEQ ID NO: 2324002 - RNA, 22 nt, Yersinia pestis KIM
auucaaugacuccugaaauaaa

SEQ ID NO: 2324003 - RNA, 15 nt, Yersinia pestis KIM
auucaauauuuaucc

SEQ ID NO: 2324004 - RNA, 23 nt, Yersinia pestis KIM
auucaauccauugaucucauucc

SEQ ID NO: 2324005 - RNA, 21 nt, Yersinia pestis KIM
auucaacccacuguuggaggc

SEQ ID NO: 2324006 - RNA, 19 nt, Yersinia pestis KIM
auucaaccaauuauccauc

SEQ ID NO: 2324007 - RNA, 20 nt, Yersinia pestis KIM
auucaaauagcguuuggcug

SEQ ID NO: 2324008 - RNA, 22 nt, Yersinia pestis KIM
auuaugggugguuagcagauaa

SEQ ID NO: 2324009 - RNA, 16 nt, Yersinia pestis KIM
auuauggcuauacuua

SEQ ID NO: 2324010 - RNA, 15 nt, Yersinia pestis KIM
auuauguaaauaguu

SEQ ID NO: 2324011 - RNA, 22 nt, Yersinia pestis KIM
auuauuacucagcacauuuuua

SEQ ID NO: 2324012 - RNA, 22 nt, Yersinia pestis KIM
auuauuaucgggaacguagcca

SEQ ID NO: 2324013 - RNA, 21 nt, Yersinia pestis KIM
auuauuauaaauuuucaguuc

SEQ ID NO: 2324014 - RNA, 22 nt, Yersinia pestis KIM
auuauuaaacagauucaauauu

SEQ ID NO: 2324015 - RNA, 18 nt, Yersinia pestis KIM
auuauugauguuauuaau

SEQ ID NO: 2324016 - RNA, 15 nt, Yersinia pestis KIM
auuauugaccagaua

SEQ ID NO: 2324017 - RNA, 12 nt, Yersinia pestis KIM
auuauucugcuc

SEQ ID NO: 2324018 - RNA, 18 nt, Yersinia pestis KIM
auuauucuucaccacgau

SEQ ID NO: 2324019 - RNA, 19 nt, Yersinia pestis KIM
auuauucuucaccacgauu

SEQ ID NO: 2324020 - RNA, 13 nt, Yersinia pestis KIM
auuauuauuuaua

SEQ ID NO: 2324021 - RNA, 16 nt, Yersinia pestis KIM
auuauuuaaacaauga

SEQ ID NO: 2324022 - RNA, 19 nt, Yersinia pestis KIM
auuauuuaaacaaugaaau

SEQ ID NO: 2324023 - RNA, 14 nt, Yersinia pestis KIM
auuauuuaucaauc

SEQ ID NO: 2324024 - RNA, 17 nt, Yersinia pestis KIM
auuauuggcgauuuaau

SEQ ID NO: 2324025 - RNA, 11 nt, Yersinia pestis KIM
auuauugcugu

SEQ ID NO: 2324026 - RNA, 15 nt, Yersinia pestis KIM
auuauuguacuuuau

SEQ ID NO: 2324027 - RNA, 22 nt, Yersinia pestis KIM
auuaucugaaagcaaacaauua

SEQ ID NO: 2324028 - RNA, 17 nt, Yersinia pestis KIM
auuaucgccuggcuuga

SEQ ID NO: 2324029 - RNA, 16 nt, Yersinia pestis KIM
auuaucgcuuuuaugg

SEQ ID NO: 2324030 - RNA, 22 nt, Yersinia pestis KIM
auuaucgccuaccaucaaaaua

SEQ ID NO: 2324031 - RNA, 16 nt, Yersinia pestis KIM
auuaucgauaaauaau

SEQ ID NO: 2324032 - RNA, 19 nt, Yersinia pestis KIM
auuaucgauaaauaauuac

SEQ ID NO: 2324033 - RNA, 21 nt, Yersinia pestis KIM
auuaucgaucacaugcucagu

SEQ ID NO: 2324034 - RNA, 21 nt, Yersinia pestis KIM
auuaucccguucaauaauagu

SEQ ID NO: 2324035 - RNA, 21 nt, Yersinia pestis KIM
auuauccgcaccauagauuaa

SEQ ID NO: 2324036 - RNA, 16 nt, Yersinia pestis KIM
auuauccguuugcaac

SEQ ID NO: 2324037 - RNA, 19 nt, Yersinia pestis KIM
auuauccguuugcaacagu

SEQ ID NO: 2324038 - RNA, 15 nt, Yersinia pestis KIM
auuaucccaguuuuu

SEQ ID NO: 2324039 - RNA, 23 nt, Yersinia pestis KIM
auuauccacgggcgcaauggaag

SEQ ID NO: 2324040 - RNA, 12 nt, Yersinia pestis KIM
auuaucaucacc

SEQ ID NO: 2324041 - RNA, 14 nt, Yersinia pestis KIM
auuaucaucaccau

SEQ ID NO: 2324042 - RNA, 15 nt, Yersinia pestis KIM
auuaucaucaauagc

SEQ ID NO: 2324043 - RNA, 18 nt, Yersinia pestis KIM
auuaucauucaagaaaau

SEQ ID NO: 2324044 - RNA, 13 nt, Yersinia pestis KIM
auauaaaagccag

SEQ ID NO: 2324045 - RNA, 11 nt, Yersinia pestis KIM
auauaaaaaau

SEQ ID NO: 2324046 - RNA, 13 nt, Yersinia pestis KIM
auauaaauggcug

SEQ ID NO: 2324047 - RNA, 22 nt, Yersinia pestis KIM
auauaaaugguuauuauguaaa

SEQ ID NO: 2324048 - RNA, 20 nt, Yersinia pestis KIM
auauaauugaagauuuaaau

SEQ ID NO: 2324049 - RNA, 14 nt, Yersinia pestis KIM
auauaauucaauau

SEQ ID NO: 2324050 - RNA, 13 nt, Yersinia pestis KIM
auauaauucaaua

SEQ ID NO: 2324051 - RNA, 16 nt, Yersinia pestis KIM
auauaauuucaagaau

SEQ ID NO: 2324052 - RNA, 20 nt, Yersinia pestis KIM
auauaagagaugaaauuuua

SEQ ID NO: 2324053 - RNA, 22 nt, Yersinia pestis KIM
auauaagauuccuuaccugaug

SEQ ID NO: 2324054 - RNA, 14 nt, Yersinia pestis KIM
auaguggguaaacc

SEQ ID NO: 2324055 - RNA, 14 nt, Yersinia pestis KIM
auagugggcuaaaa

SEQ ID NO: 2324056 - RNA, 16 nt, Yersinia pestis KIM
auaguggcacaaauaa

SEQ ID NO: 2324057 - RNA, 18 nt, Yersinia pestis KIM
auaguguuguaagauuuc

SEQ ID NO: 2324058 - RNA, 22 nt, Yersinia pestis KIM
auagugauuuucaauccgggca

SEQ ID NO: 2324059 - RNA, 12 nt, Yersinia pestis KIM
auagugaguaug

SEQ ID NO: 2324060 - RNA, 15 nt, Yersinia pestis KIM
auagugaguauguau

SEQ ID NO: 2324061 - RNA, 17 nt, Yersinia pestis KIM
auaguaguguuugauag

SEQ ID NO: 2324062 - RNA, 13 nt, Yersinia pestis KIM
auaguugaucuac

SEQ ID NO: 2324063 - RNA, 22 nt, Yersinia pestis KIM
auaguugaucuaccugaaugcg

SEQ ID NO: 2324064 - RNA, 15 nt, Yersinia pestis KIM
auaguuguuagccac

SEQ ID NO: 2324065 - RNA, 14 nt, Yersinia pestis KIM
auaguuuuucuccu

SEQ ID NO: 2324066 - RNA, 20 nt, Yersinia pestis KIM
auaguuuuuuuuauggcugc

SEQ ID NO: 2324067 - RNA, 21 nt, Yersinia pestis KIM
auaguuuuuuuuauggcugcg

SEQ ID NO: 2324068 - RNA, 15 nt, Yersinia pestis KIM
auaggcagaggaagu

SEQ ID NO: 2324069 - RNA, 19 nt, Yersinia pestis KIM
auaggcagaaaagcaaagg

SEQ ID NO: 2324070 - RNA, 22 nt, Yersinia pestis KIM
auaggauaagggccauuuugcu

SEQ ID NO: 2324071 - RNA, 21 nt, Yersinia pestis KIM
auaggccuaaaccccacagcg

SEQ ID NO: 2324072 - RNA, 15 nt, Yersinia pestis KIM
auaggcgaaaggcgc

SEQ ID NO: 2324073 - RNA, 16 nt, Yersinia pestis KIM
auaggcgaaaggcgca

SEQ ID NO: 2324074 - RNA, 14 nt, Yersinia pestis KIM
auagggaaaaguua

SEQ ID NO: 2324075 - RNA, 17 nt, Yersinia pestis KIM
auagggagccaauagag

SEQ ID NO: 2324076 - RNA, 14 nt, Yersinia pestis KIM
auaggguaauacca

SEQ ID NO: 2324077 - RNA, 17 nt, Yersinia pestis KIM
auaggucagugguuuua

SEQ ID NO: 2324078 - RNA, 16 nt, Yersinia pestis KIM
auaggucagugguuuu

SEQ ID NO: 2324079 - RNA, 20 nt, Yersinia pestis KIM
auagguaucauuuuccugca

SEQ ID NO: 2324080 - RNA, 18 nt, Yersinia pestis KIM
auagguuggggaugccau

SEQ ID NO: 2324081 - RNA, 17 nt, Yersinia pestis KIM
auaguacguagcgauaa

SEQ ID NO: 2324082 - RNA, 13 nt, Yersinia pestis KIM
auaguacuuagca

SEQ ID NO: 2324083 - RNA, 15 nt, Yersinia pestis KIM
auaguaacaccagca

SEQ ID NO: 2324084 - RNA, 11 nt, Yersinia pestis KIM
auaguaacccu

SEQ ID NO: 2324085 - RNA, 20 nt, Yersinia pestis KIM
auaucaauaagugcaaacuu

SEQ ID NO: 2324086 - RNA, 23 nt, Yersinia pestis KIM
auaucaauaagugcaaacuuaaa

SEQ ID NO: 2324087 - RNA, 19 nt, Yersinia pestis KIM
auaucaagucuugaagagu

SEQ ID NO: 2324088 - RNA, 21 nt, Yersinia pestis KIM
auaucaaaauaaaaauucaca

SEQ ID NO: 2324089 - RNA, 13 nt, Yersinia pestis KIM
auaucaaaacuga

SEQ ID NO: 2324090 - RNA, 17 nt, Yersinia pestis KIM
auaucacuauaauuauu

SEQ ID NO: 2324091 - RNA, 21 nt, Yersinia pestis KIM
auaucagaaacaauaaauauc

SEQ ID NO: 2324092 - RNA, 17 nt, Yersinia pestis KIM
auaucagucgcuuuuua

SEQ ID NO: 2324093 - RNA, 20 nt, Yersinia pestis KIM
auaucagucgcuuuuuaaca

SEQ ID NO: 2324094 - RNA, 18 nt, Yersinia pestis KIM
auaucagcauuaauaccg

SEQ ID NO: 2324095 - RNA, 15 nt, Yersinia pestis KIM
auaucagcgccuucu

SEQ ID NO: 2324096 - RNA, 12 nt, Yersinia pestis KIM
auauauuuuucu

SEQ ID NO: 2324097 - RNA, 14 nt, Yersinia pestis KIM
auauauugcauuua

SEQ ID NO: 2324098 - RNA, 19 nt, Yersinia pestis KIM
auauauuaaaugagaauaa

SEQ ID NO: 2324099 - RNA, 17 nt, Yersinia pestis KIM
auaucuaacugauguau

SEQ ID NO: 2324100 - RNA, 18 nt, Yersinia pestis KIM
auaucuaaguccaagaca

SEQ ID NO: 2324101 - RNA, 21 nt, Yersinia pestis KIM
auaucuaaguccaagacagaa

SEQ ID NO: 2324102 - RNA, 21 nt, Yersinia pestis KIM
auaucuaauuuauaaccuuuu

SEQ ID NO: 2324103 - RNA, 19 nt, Yersinia pestis KIM
auaucgccacggauaaggu

SEQ ID NO: 2324104 - RNA, 16 nt, Yersinia pestis KIM
auaucgaugacagcau

SEQ ID NO: 2324105 - RNA, 13 nt, Yersinia pestis KIM
auauccaaaauaa

SEQ ID NO: 2324106 - RNA, 14 nt, Yersinia pestis KIM
auauccaaaauaau

SEQ ID NO: 2324107 - RNA, 14 nt, Yersinia pestis KIM
auauccaaccaacc

SEQ ID NO: 2324108 - RNA, 18 nt, Yersinia pestis KIM
auauccaaccaaccaugc

SEQ ID NO: 2324109 - RNA, 20 nt, Yersinia pestis KIM
auauccagcaacgaauaaaa

SEQ ID NO: 2324110 - RNA, 23 nt, Yersinia pestis KIM
auauccagcaacgaauaaaaaag

SEQ ID NO: 2324111 - RNA, 14 nt, Yersinia pestis KIM
auaucuucaaucag

SEQ ID NO: 2324112 - RNA, 17 nt, Yersinia pestis KIM
auaucugcucauuacca

SEQ ID NO: 2324113 - RNA, 13 nt, Yersinia pestis KIM
auaucuauauagg

SEQ ID NO: 2324114 - RNA, 21 nt, Yersinia pestis KIM
auaucuugaaccaauuuuucu

SEQ ID NO: 2324115 - RNA, 19 nt, Yersinia pestis KIM
auaucuugcugaaaacaau

SEQ ID NO: 2324116 - RNA, 17 nt, Yersinia pestis KIM
auaucuugaaccaauuu

SEQ ID NO: 2324117 - RNA, 19 nt, Yersinia pestis KIM
auaugaaaaaucugacucu

SEQ ID NO: 2324118 - RNA, 19 nt, Yersinia pestis KIM
auagcccucguuguuguau

SEQ ID NO: 2324119 - RNA, 23 nt, Yersinia pestis KIM
auagcccucguuguuguaugaca

SEQ ID NO: 2324120 - RNA, 23 nt, Yersinia pestis KIM
auagcccuucccccaaguaaaaa

SEQ ID NO: 2324121 - RNA, 16 nt, Yersinia pestis KIM
auagcgcugcaucagc

SEQ ID NO: 2324122 - RNA, 17 nt, Yersinia pestis KIM
auagcgcugcaucagca

SEQ ID NO: 2324123 - RNA, 15 nt, Yersinia pestis KIM
auagcgcuucaguga

SEQ ID NO: 2324124 - RNA, 21 nt, Yersinia pestis KIM
auagcggaauauuuaaccaga

SEQ ID NO: 2324125 - RNA, 22 nt, Yersinia pestis KIM
auagcgggccuuugcuuuucug

SEQ ID NO: 2324126 - RNA, 23 nt, Yersinia pestis KIM
auagcguuaucaauuaacuacac

SEQ ID NO: 2324127 - RNA, 14 nt, Yersinia pestis KIM
auagcccaaauaac

SEQ ID NO: 2324128 - RNA, 16 nt, Yersinia pestis KIM
auagccauauuuuaaa

SEQ ID NO: 2324129 - RNA, 23 nt, Yersinia pestis KIM
auagccaccgcucgucacacugg

SEQ ID NO: 2324130 - RNA, 14 nt, Yersinia pestis KIM
auagccaagccuug

SEQ ID NO: 2324131 - RNA, 14 nt, Yersinia pestis KIM
auagcuuucuccuu

SEQ ID NO: 2324132 - RNA, 20 nt, Yersinia pestis KIM
auagcuuucuccuuugauuu

SEQ ID NO: 2324133 - RNA, 11 nt, Yersinia pestis KIM
auagcuucccu

SEQ ID NO: 2324134 - RNA, 18 nt, Yersinia pestis KIM
auagcuuaaucaucauca

SEQ ID NO: 2324135 - RNA, 18 nt, Yersinia pestis KIM
auagcuucaggaacuugc

SEQ ID NO: 2324136 - RNA, 22 nt, Yersinia pestis KIM
auagcuggcggauaaaaaugca

SEQ ID NO: 2324137 - RNA, 14 nt, Yersinia pestis KIM
auagcugugugacc

SEQ ID NO: 2324138 - RNA, 15 nt, Yersinia pestis KIM
auagcuguaaaauac

SEQ ID NO: 2324139 - RNA, 16 nt, Yersinia pestis KIM
auagcuguaaaauacc

SEQ ID NO: 2324140 - RNA, 23 nt, Yersinia pestis KIM
auagcuacgggcaaacuccucca

SEQ ID NO: 2324141 - RNA, 15 nt, Yersinia pestis KIM
auagcuaucuugccu

SEQ ID NO: 2324142 - RNA, 21 nt, Yersinia pestis KIM
auagcucauuuuaaauaugau

SEQ ID NO: 2324143 - RNA, 22 nt, Yersinia pestis KIM
auagacuguuuuauuauauauu

SEQ ID NO: 2324144 - RNA, 20 nt, Yersinia pestis KIM
auagagacggaaagagccag

SEQ ID NO: 2324145 - RNA, 23 nt, Yersinia pestis KIM
auagagacggaaagagccagcac

SEQ ID NO: 2324146 - RNA, 20 nt, Yersinia pestis KIM
auagagcaguaaguuaaaaa

SEQ ID NO: 2324147 - RNA, 23 nt, Yersinia pestis KIM
auagagcaguaaguuaaaaagaa

SEQ ID NO: 2324148 - RNA, 21 nt, Yersinia pestis KIM
auacuuugcggcucaguuaac

SEQ ID NO: 2324149 - RNA, 19 nt, Yersinia pestis KIM
auagaucccauacccacua

SEQ ID NO: 2324150 - RNA, 16 nt, Yersinia pestis KIM
auagauggcuuuggug

SEQ ID NO: 2324151 - RNA, 11 nt, Yersinia pestis KIM
auagauuaaga

SEQ ID NO: 2324152 - RNA, 14 nt, Yersinia pestis KIM
auagauuaagaaaa

SEQ ID NO: 2324153 - RNA, 17 nt, Yersinia pestis KIM
auagauuaagaaaacau

SEQ ID NO: 2324154 - RNA, 14 nt, Yersinia pestis KIM
auagcaaucaauaa

SEQ ID NO: 2324155 - RNA, 21 nt, Yersinia pestis KIM
auagcaccgagcaugcuaacu

SEQ ID NO: 2324156 - RNA, 15 nt, Yersinia pestis KIM
auaauuaauuauuca

SEQ ID NO: 2324157 - RNA, 15 nt, Yersinia pestis KIM
auaauuacuuauaaa

SEQ ID NO: 2324158 - RNA, 20 nt, Yersinia pestis KIM
auaccgcugcuaccagcagu

SEQ ID NO: 2324159 - RNA, 18 nt, Yersinia pestis KIM
auaccuuaauuaacucuu

SEQ ID NO: 2324160 - RNA, 22 nt, Yersinia pestis KIM
auaccugaguagcauaaaaauc

SEQ ID NO: 2324161 - RNA, 23 nt, Yersinia pestis KIM
auaccugaguagcauaaaaauca

SEQ ID NO: 2324162 - RNA, 21 nt, Yersinia pestis KIM
auaccggguucaaggaaacca

SEQ ID NO: 2324163 - RNA, 15 nt, Yersinia pestis KIM
auaccggucauauuu

SEQ ID NO: 2324164 - RNA, 14 nt, Yersinia pestis KIM
auaccuuacugcau

SEQ ID NO: 2324165 - RNA, 13 nt, Yersinia pestis KIM
auacgaugucacc

SEQ ID NO: 2324166 - RNA, 17 nt, Yersinia pestis KIM
auacgccauccgcaccu

SEQ ID NO: 2324167 - RNA, 14 nt, Yersinia pestis KIM
auacggucaaaagc

SEQ ID NO: 2324168 - RNA, 15 nt, Yersinia pestis KIM
auacggucaaaagcu

SEQ ID NO: 2324169 - RNA, 14 nt, Yersinia pestis KIM
auacgguccagcau

SEQ ID NO: 2324170 - RNA, 15 nt, Yersinia pestis KIM
auacgguagcaauac

SEQ ID NO: 2324171 - RNA, 16 nt, Yersinia pestis KIM
auacggcgaaauauaa

SEQ ID NO: 2324172 - RNA, 22 nt, Yersinia pestis KIM
auacggcuucaccgcuuuucug

SEQ ID NO: 2324173 - RNA, 21 nt, Yersinia pestis KIM
auacugacggggaguuuuuau

SEQ ID NO: 2324174 - RNA, 17 nt, Yersinia pestis KIM
auacugccgaccauauc

SEQ ID NO: 2324175 - RNA, 12 nt, Yersinia pestis KIM
auacugcaaaug

SEQ ID NO: 2324176 - RNA, 22 nt, Yersinia pestis KIM
auacuucgaugauuauuuugug

SEQ ID NO: 2324177 - RNA, 23 nt, Yersinia pestis KIM
auacuguguuauuuuuguuuagu

SEQ ID NO: 2324178 - RNA, 17 nt, Yersinia pestis KIM
auacguucguagccacg

SEQ ID NO: 2324179 - RNA, 15 nt, Yersinia pestis KIM
auacguuggcggcuc

SEQ ID NO: 2324180 - RNA, 14 nt, Yersinia pestis KIM
auacucaaaaaugg

SEQ ID NO: 2324181 - RNA, 14 nt, Yersinia pestis KIM
auacucaccucccu

SEQ ID NO: 2324182 - RNA, 17 nt, Yersinia pestis KIM
auacucaugauggcacc

SEQ ID NO: 2324183 - RNA, 21 nt, Yersinia pestis KIM
auacuccgcugagcauauaca

SEQ ID NO: 2324184 - RNA, 21 nt, Yersinia pestis KIM
auauuugcugccugcaccagu

SEQ ID NO: 2324185 - RNA, 20 nt, Yersinia pestis KIM
auauuugggucgguaaccug

SEQ ID NO: 2324186 - RNA, 13 nt, Yersinia pestis KIM
auauuuuagcaau

SEQ ID NO: 2324187 - RNA, 19 nt, Yersinia pestis KIM
auauuuuacuuccugccaa

SEQ ID NO: 2324188 - RNA, 18 nt, Yersinia pestis KIM
auauuuuagcauuuucca

SEQ ID NO: 2324189 - RNA, 23 nt, Yersinia pestis KIM
auauugugcuaucccuccccacu

SEQ ID NO: 2324190 - RNA, 22 nt, Yersinia pestis KIM
auauuguguggcacgccaauca

SEQ ID NO: 2324191 - RNA, 18 nt, Yersinia pestis KIM
auauugucuuaugauaua

SEQ ID NO: 2324192 - RNA, 16 nt, Yersinia pestis KIM
auauugccaucgggca

SEQ ID NO: 2324193 - RNA, 18 nt, Yersinia pestis KIM
auauuuuuaaccucuugc

SEQ ID NO: 2324194 - RNA, 13 nt, Yersinia pestis KIM
auauuuuuaaucu

SEQ ID NO: 2324195 - RNA, 13 nt, Yersinia pestis KIM
aucaaaaaauaaa

SEQ ID NO: 2324196 - RNA, 14 nt, Yersinia pestis KIM
auauuuuuuauaua

SEQ ID NO: 2324197 - RNA, 19 nt, Yersinia pestis KIM
auauucaccaccauuaaca

SEQ ID NO: 2324198 - RNA, 13 nt, Yersinia pestis KIM
auauucaccagac

SEQ ID NO: 2324199 - RNA, 20 nt, Yersinia pestis KIM
auauucaccaucugccugca

SEQ ID NO: 2324200 - RNA, 22 nt, Yersinia pestis KIM
auauuauuuaucaaucagcuga

SEQ ID NO: 2324201 - RNA, 17 nt, Yersinia pestis KIM
auaugauaauaguucau

SEQ ID NO: 2324202 - RNA, 17 nt, Yersinia pestis KIM
auaugauaguguaaaaa

SEQ ID NO: 2324203 - RNA, 21 nt, Yersinia pestis KIM
auauuauucauauugaauuaa

SEQ ID NO: 2324204 - RNA, 15 nt, Yersinia pestis KIM
auauuauuagccaaa

SEQ ID NO: 2324205 - RNA, 21 nt, Yersinia pestis KIM
auauucgccagauugccaauc

SEQ ID NO: 2324206 - RNA, 20 nt, Yersinia pestis KIM
auauucgcagccaaaauaau

SEQ ID NO: 2324207 - RNA, 21 nt, Yersinia pestis KIM
auauucugcaugcuuuuuuau

SEQ ID NO: 2324208 - RNA, 22 nt, Yersinia pestis KIM
auauucugauggugucaacuca

SEQ ID NO: 2324209 - RNA, 23 nt, Yersinia pestis KIM
auauugauaaaaguaauuuauca

SEQ ID NO: 2324210 - RNA, 14 nt, Yersinia pestis KIM
auauugcauuuuac

SEQ ID NO: 2324211 - RNA, 20 nt, Yersinia pestis KIM
aucaaacucaccauuauguu

SEQ ID NO: 2324212 - RNA, 16 nt, Yersinia pestis KIM
aucaaacgugaaauug

SEQ ID NO: 2324213 - RNA, 18 nt, Yersinia pestis KIM
aucaaacggcuuuuuaaa

SEQ ID NO: 2324214 - RNA, 20 nt, Yersinia pestis KIM
aucaaacggcuuuuuaaacu

SEQ ID NO: 2324215 - RNA, 14 nt, Yersinia pestis KIM
aucaacauggaugu

SEQ ID NO: 2324216 - RNA, 22 nt, Yersinia pestis KIM
aucaaacaaaucuuaaauugaa

SEQ ID NO: 2324217 - RNA, 18 nt, Yersinia pestis KIM
aucaaacauaaccugcaa

SEQ ID NO: 2324218 - RNA, 18 nt, Yersinia pestis KIM
aucaacauuaucucgccu

SEQ ID NO: 2324219 - RNA, 18 nt, Yersinia pestis KIM
aucaacauuguccugcaa

SEQ ID NO: 2324220 - RNA, 18 nt, Yersinia pestis KIM
aucaaccaagacauaaug

SEQ ID NO: 2324221 - RNA, 22 nt, Yersinia pestis KIM
aucaacccccuguggaaacucu

SEQ ID NO: 2324222 - RNA, 15 nt, Yersinia pestis KIM
aucaaccucagccuc

SEQ ID NO: 2324223 - RNA, 20 nt, Yersinia pestis KIM
aucaaccgggauaucaaauu

SEQ ID NO: 2324224 - RNA, 16 nt, Yersinia pestis KIM
aucaaccugaucauca

SEQ ID NO: 2324225 - RNA, 16 nt, Yersinia pestis KIM
aucaacggcaccacag

SEQ ID NO: 2324226 - RNA, 17 nt, Yersinia pestis KIM
aucaacgcucaaucacg

SEQ ID NO: 2324227 - RNA, 12 nt, Yersinia pestis KIM
aucaagcccgca

SEQ ID NO: 2324228 - RNA, 17 nt, Yersinia pestis KIM
aucaaggcggcagagcc

SEQ ID NO: 2324229 - RNA, 19 nt, Yersinia pestis KIM
aucaaggcggcagagccaa

SEQ ID NO: 2324230 - RNA, 20 nt, Yersinia pestis KIM
aucaaguauguuuacuuuug

SEQ ID NO: 2324231 - RNA, 22 nt, Yersinia pestis KIM
aucaaggacgaaggguaaaaua

SEQ ID NO: 2324232 - RNA, 15 nt, Yersinia pestis KIM
aucaaggauaagaau

SEQ ID NO: 2324233 - RNA, 17 nt, Yersinia pestis KIM
aucacaaaaccuuuaau

SEQ ID NO: 2324234 - RNA, 16 nt, Yersinia pestis KIM
aucacaauacagcaaa

SEQ ID NO: 2324235 - RNA, 17 nt, Yersinia pestis KIM
aucacaauacagcaaau

SEQ ID NO: 2324236 - RNA, 18 nt, Yersinia pestis KIM
aucacacccuccugcaca

SEQ ID NO: 2324237 - RNA, 12 nt, Yersinia pestis KIM
aucacacuggcg

SEQ ID NO: 2324238 - RNA, 22 nt, Yersinia pestis KIM
aucaauuuauacccguuauauu

SEQ ID NO: 2324239 - RNA, 17 nt, Yersinia pestis KIM
aucaauuugaacaacau

SEQ ID NO: 2324240 - RNA, 21 nt, Yersinia pestis KIM
aucaauaucccgagaaacaaa

SEQ ID NO: 2324241 - RNA, 23 nt, Yersinia pestis KIM
aucaauaucccgagaaacaaaac

SEQ ID NO: 2324242 - RNA, 22 nt, Yersinia pestis KIM
aucaauaucgcuaaacuuauac

SEQ ID NO: 2324243 - RNA, 16 nt, Yersinia pestis KIM
aucaauauaagagaaa

SEQ ID NO: 2324244 - RNA, 17 nt, Yersinia pestis KIM
aucaauaggauuuucau

SEQ ID NO: 2324245 - RNA, 20 nt, Yersinia pestis KIM
aucaauaggauuuucaugau

SEQ ID NO: 2324246 - RNA, 13 nt, Yersinia pestis KIM
aucaauaggucag

SEQ ID NO: 2324247 - RNA, 14 nt, Yersinia pestis KIM
aucaauaggucagu

SEQ ID NO: 2324248 - RNA, 15 nt, Yersinia pestis KIM
aucaauggccagcgg

SEQ ID NO: 2324249 - RNA, 23 nt, Yersinia pestis KIM
aucaauguuaucgccaacacuau

SEQ ID NO: 2324250 - RNA, 20 nt, Yersinia pestis KIM
aucaauguuggcccaagaua

SEQ ID NO: 2324251 - RNA, 20 nt, Yersinia pestis KIM
aucaaugaccacuaaauuaa

SEQ ID NO: 2324252 - RNA, 15 nt, Yersinia pestis KIM
aucagacauuuuucu

SEQ ID NO: 2324253 - RNA, 17 nt, Yersinia pestis KIM
aucagacacguaaaaca

SEQ ID NO: 2324254 - RNA, 21 nt, Yersinia pestis KIM
aucagaccuuuacaggacuga

SEQ ID NO: 2324255 - RNA, 15 nt, Yersinia pestis KIM
aucagaccuuuagga

SEQ ID NO: 2324256 - RNA, 19 nt, Yersinia pestis KIM
aucagaccuuuaggaaagc

SEQ ID NO: 2324257 - RNA, 19 nt, Yersinia pestis KIM
aucagacggcagcaacgaa

SEQ ID NO: 2324258 - RNA, 20 nt, Yersinia pestis KIM
aucagacugcucuuucccuu

SEQ ID NO: 2324259 - RNA, 14 nt, Yersinia pestis KIM
aucagacugcucuu

SEQ ID NO: 2324260 - RNA, 23 nt, Yersinia pestis KIM
aucagauuguuuauaaauuaaaa

SEQ ID NO: 2324261 - RNA, 14 nt, Yersinia pestis KIM
aucagaugaugaug

SEQ ID NO: 2324262 - RNA, 17 nt, Yersinia pestis KIM
aucagaggugaaaaaau

SEQ ID NO: 2324263 - RNA, 13 nt, Yersinia pestis KIM
aucagagcucaau

SEQ ID NO: 2324264 - RNA, 19 nt, Yersinia pestis KIM
aucagauacggcuccagaa

SEQ ID NO: 2324265 - RNA, 22 nt, Yersinia pestis KIM
aucacuuauuccuuucguucac

SEQ ID NO: 2324266 - RNA, 20 nt, Yersinia pestis KIM
aucacuggcaauaauucaga

SEQ ID NO: 2324267 - RNA, 16 nt, Yersinia pestis KIM
aucacugucaaaaagc

SEQ ID NO: 2324268 - RNA, 15 nt, Yersinia pestis KIM
aucagcgauuuuaaa

SEQ ID NO: 2324269 - RNA, 14 nt, Yersinia pestis KIM
aucagcgcacugca

SEQ ID NO: 2324270 - RNA, 15 nt, Yersinia pestis KIM
aucagcgcacugcau

SEQ ID NO: 2324271 - RNA, 17 nt, Yersinia pestis KIM
aucagcgcacugcaugc

SEQ ID NO: 2324272 - RNA, 20 nt, Yersinia pestis KIM
aucagcgaccaaauggacga

SEQ ID NO: 2324273 - RNA, 13 nt, Yersinia pestis KIM
aucagcgaaaaau

SEQ ID NO: 2324274 - RNA, 18 nt, Yersinia pestis KIM
aucagccccuuugaacug

SEQ ID NO: 2324275 - RNA, 23 nt, Yersinia pestis KIM
aucagccauauguugccaccagc

SEQ ID NO: 2324276 - RNA, 18 nt, Yersinia pestis KIM
aucagccauauguugcca

SEQ ID NO: 2324277 - RNA, 17 nt, Yersinia pestis KIM
aucagcgccuuugcccc

SEQ ID NO: 2324278 - RNA, 15 nt, Yersinia pestis KIM
aucagcgccugcugu

SEQ ID NO: 2324279 - RNA, 16 nt, Yersinia pestis KIM
aucagcgcccuugcca

SEQ ID NO: 2324280 - RNA, 21 nt, Yersinia pestis KIM
aucagcguauagcgccgccag

SEQ ID NO: 2324281 - RNA, 18 nt, Yersinia pestis KIM
aucagcgguaucuagagc

SEQ ID NO: 2324282 - RNA, 17 nt, Yersinia pestis KIM
aucagcacauccaugcc

SEQ ID NO: 2324283 - RNA, 22 nt, Yersinia pestis KIM
aucagcagagagcgacucacga

SEQ ID NO: 2324284 - RNA, 16 nt, Yersinia pestis KIM
aucagcacuccccgcc

SEQ ID NO: 2324285 - RNA, 14 nt, Yersinia pestis KIM
aucagccagcuccu

SEQ ID NO: 2324286 - RNA, 16 nt, Yersinia pestis KIM
aucagcaucaauaaaa

SEQ ID NO: 2324287 - RNA, 16 nt, Yersinia pestis KIM
aucacgguacgcauga

SEQ ID NO: 2324288 - RNA, 22 nt, Yersinia pestis KIM
aucaccuuccaaacuuugugga

SEQ ID NO: 2324289 - RNA, 23 nt, Yersinia pestis KIM
aucaccuuccgucccaagaaaag

SEQ ID NO: 2324290 - RNA, 20 nt, Yersinia pestis KIM
aucaccuuggaaaacagcaa

SEQ ID NO: 2324291 - RNA, 18 nt, Yersinia pestis KIM
aucaccuuggaaaacagc

SEQ ID NO: 2324292 - RNA, 16 nt, Yersinia pestis KIM
aucaccuuauccaaua

SEQ ID NO: 2324293 - RNA, 13 nt, Yersinia pestis KIM
aucacgcagcaga

SEQ ID NO: 2324294 - RNA, 22 nt, Yersinia pestis KIM
aucacgcagcaggccauuuuca

SEQ ID NO: 2324295 - RNA, 14 nt, Yersinia pestis KIM
aucacuagcgggcc

SEQ ID NO: 2324296 - RNA, 13 nt, Yersinia pestis KIM
aucacuauaauua

SEQ ID NO: 2324297 - RNA, 18 nt, Yersinia pestis KIM
aucacuagcgggccucag

SEQ ID NO: 2324298 - RNA, 17 nt, Yersinia pestis KIM
aucacuagggggcaauu

SEQ ID NO: 2324299 - RNA, 16 nt, Yersinia pestis KIM
aucacucuguacguaa

SEQ ID NO: 2324300 - RNA, 14 nt, Yersinia pestis KIM
aucacucucaugaa

SEQ ID NO: 2324301 - RNA, 22 nt, Yersinia pestis KIM
aucacugauucagaaagguaug

SEQ ID NO: 2324302 - RNA, 19 nt, Yersinia pestis KIM
aucacugauucagaaaggu

SEQ ID NO: 2324303 - RNA, 15 nt, Yersinia pestis KIM
aucacugauucagaa

SEQ ID NO: 2324304 - RNA, 18 nt, Yersinia pestis KIM
aucacugaugagcuggca

SEQ ID NO: 2324305 - RNA, 14 nt, Yersinia pestis KIM
aucacuauuucaga

SEQ ID NO: 2324306 - RNA, 14 nt, Yersinia pestis KIM
aucacuauuucagg

SEQ ID NO: 2324307 - RNA, 23 nt, Yersinia pestis KIM
aucacuauuucguguauaucacu

SEQ ID NO: 2324308 - RNA, 15 nt, Yersinia pestis KIM
aucacccagcaaaau

SEQ ID NO: 2324309 - RNA, 18 nt, Yersinia pestis KIM
aucacccaucaauaauua

SEQ ID NO: 2324310 - RNA, 18 nt, Yersinia pestis KIM
aucaccccacuagaaaua

SEQ ID NO: 2324311 - RNA, 19 nt, Yersinia pestis KIM
aucaccccacuagaaauac

SEQ ID NO: 2324312 - RNA, 22 nt, Yersinia pestis KIM
aucaccccacuagaaauacugu

SEQ ID NO: 2324313 - RNA, 12 nt, Yersinia pestis KIM
aucaccccccug

SEQ ID NO: 2324314 - RNA, 17 nt, Yersinia pestis KIM
aucacccgccucuaaau

SEQ ID NO: 2324315 - RNA, 23 nt, Yersinia pestis KIM
aucacccggccaucuucagaaac

SEQ ID NO: 2324316 - RNA, 15 nt, Yersinia pestis KIM
aucaccgaaagaaga

SEQ ID NO: 2324317 - RNA, 16 nt, Yersinia pestis KIM
aucacccgccucuaaa

SEQ ID NO: 2324318 - RNA, 15 nt, Yersinia pestis KIM
aucacccgcagugcc

SEQ ID NO: 2324319 - RNA, 19 nt, Yersinia pestis KIM
aucacccgcagugccuuau

SEQ ID NO: 2324320 - RNA, 18 nt, Yersinia pestis KIM
aucaccauuaauaauaug

SEQ ID NO: 2324321 - RNA, 20 nt, Yersinia pestis KIM
aucaccauuaauaauaugca

SEQ ID NO: 2324322 - RNA, 14 nt, Yersinia pestis KIM
aucaccauugacca

SEQ ID NO: 2324323 - RNA, 18 nt, Yersinia pestis KIM
aucaccauaacugcugcu

SEQ ID NO: 2324324 - RNA, 21 nt, Yersinia pestis KIM
aucaccguucagaucacaacc

SEQ ID NO: 2324325 - RNA, 17 nt, Yersinia pestis KIM
aucacagcucucugagc

SEQ ID NO: 2324326 - RNA, 13 nt, Yersinia pestis KIM
aucacagcaaauu

SEQ ID NO: 2324327 - RNA, 16 nt, Yersinia pestis KIM
aucacauaauauuuac

SEQ ID NO: 2324328 - RNA, 22 nt, Yersinia pestis KIM
aucacaucucggcguaaacaau

SEQ ID NO: 2324329 - RNA, 18 nt, Yersinia pestis KIM
aucaccaccgcauuuuca

SEQ ID NO: 2324330 - RNA, 13 nt, Yersinia pestis KIM
aucacaugcucag

SEQ ID NO: 2324331 - RNA, 14 nt, Yersinia pestis KIM
aucacauuucaaau

SEQ ID NO: 2324332 - RNA, 14 nt, Yersinia pestis KIM
aucaccaaauccaa

SEQ ID NO: 2324333 - RNA, 18 nt, Yersinia pestis KIM
aguugcaguuggaucugc

SEQ ID NO: 2324334 - RNA, 19 nt, Yersinia pestis KIM
aguugcucacccauuuuau

SEQ ID NO: 2324335 - RNA, 16 nt, Yersinia pestis KIM
aguuggaaaugacaaa

SEQ ID NO: 2324336 - RNA, 16 nt, Yersinia pestis KIM
aguuggcaucagcucg

SEQ ID NO: 2324337 - RNA, 21 nt, Yersinia pestis KIM
aguuuaaugccguuuugcaga

SEQ ID NO: 2324338 - RNA, 21 nt, Yersinia pestis KIM
aguuuacgcacguugagugau

SEQ ID NO: 2324339 - RNA, 17 nt, Yersinia pestis KIM
aguuugaucgcuaaucg

SEQ ID NO: 2324340 - RNA, 15 nt, Yersinia pestis KIM
aguuugagaaacuga

SEQ ID NO: 2324341 - RNA, 18 nt, Yersinia pestis KIM
aguuuuagcccaaaauag

SEQ ID NO: 2324342 - RNA, 18 nt, Yersinia pestis KIM
aguuuucuggcaauuucu

SEQ ID NO: 2324343 - RNA, 21 nt, Yersinia pestis KIM
aguuuuaaacgucagauuagu

SEQ ID NO: 2324344 - RNA, 17 nt, Yersinia pestis KIM
aguuuugcuauuuacuc

SEQ ID NO: 2324345 - RNA, 16 nt, Yersinia pestis KIM
agugugcgcaucagcc

SEQ ID NO: 2324346 - RNA, 20 nt, Yersinia pestis KIM
agugugccuuggucucagaa

SEQ ID NO: 2324347 - RNA, 16 nt, Yersinia pestis KIM
aguguguguauuuaaa

SEQ ID NO: 2324348 - RNA, 20 nt, Yersinia pestis KIM
agugugugugcgcugaguga

SEQ ID NO: 2324349 - RNA, 19 nt, Yersinia pestis KIM
agugugggauucguuagua

SEQ ID NO: 2324350 - RNA, 22 nt, Yersinia pestis KIM
aguguucauaaauuaaaacuga

SEQ ID NO: 2324351 - RNA, 20 nt, Yersinia pestis KIM
aguguguuuucuuguauaua

SEQ ID NO: 2324352 - RNA, 13 nt, Yersinia pestis KIM
aguguugccaugg

SEQ ID NO: 2324353 - RNA, 17 nt, Yersinia pestis KIM
aguguugcgguuauuuu

SEQ ID NO: 2324354 - RNA, 15 nt, Yersinia pestis KIM
aguguuggccucaga

SEQ ID NO: 2324355 - RNA, 21 nt, Yersinia pestis KIM
aguuacuguaagauaauucga

SEQ ID NO: 2324356 - RNA, 19 nt, Yersinia pestis KIM
aguuagacccaauugcagg

SEQ ID NO: 2324357 - RNA, 21 nt, Yersinia pestis KIM
aguuacuuuuuuauuuuacuu

SEQ ID NO: 2324358 - RNA, 16 nt, Yersinia pestis KIM
aguuagcaggcagcac

SEQ ID NO: 2324359 - RNA, 22 nt, Yersinia pestis KIM
aguuagcuacgcugcugaauuc

SEQ ID NO: 2324360 - RNA, 13 nt, Yersinia pestis KIM
aguuagggcugga

SEQ ID NO: 2324361 - RNA, 18 nt, Yersinia pestis KIM
aguuacgucagaaauaaa

SEQ ID NO: 2324362 - RNA, 21 nt, Yersinia pestis KIM
aguuacgucaggaauaaagua

SEQ ID NO: 2324363 - RNA, 16 nt, Yersinia pestis KIM
aguuaccgugagcagc

SEQ ID NO: 2324364 - RNA, 17 nt, Yersinia pestis KIM
aguuaaaaccaguaacu

SEQ ID NO: 2324365 - RNA, 12 nt, Yersinia pestis KIM
aguuaaaaccag

SEQ ID NO: 2324366 - RNA, 14 nt, Yersinia pestis KIM
aguguuuucuccac

SEQ ID NO: 2324367 - RNA, 23 nt, Yersinia pestis KIM
aguuagugguguuauccacuugc

SEQ ID NO: 2324368 - RNA, 15 nt, Yersinia pestis KIM
aguucaagcagguuc

SEQ ID NO: 2324369 - RNA, 13 nt, Yersinia pestis KIM
aguuccagcccca

SEQ ID NO: 2324370 - RNA, 16 nt, Yersinia pestis KIM
aguucauuuugaccag

SEQ ID NO: 2324371 - RNA, 20 nt, Yersinia pestis KIM
aguucauuuugaccagcaua

SEQ ID NO: 2324372 - RNA, 14 nt, Yersinia pestis KIM
aguucugcgccccc

SEQ ID NO: 2324373 - RNA, 21 nt, Yersinia pestis KIM
aguucugcgccccccggauac

SEQ ID NO: 2324374 - RNA, 22 nt, Yersinia pestis KIM
aguucuggaucggcauacucca

SEQ ID NO: 2324375 - RNA, 18 nt, Yersinia pestis KIM
aguucuucacgaagaauu

SEQ ID NO: 2324376 - RNA, 14 nt, Yersinia pestis KIM
aguucguucccugu

SEQ ID NO: 2324377 - RNA, 17 nt, Yersinia pestis KIM
aguucguguugugccag

SEQ ID NO: 2324378 - RNA, 16 nt, Yersinia pestis KIM
aguucggucuauaaaa

SEQ ID NO: 2324379 - RNA, 19 nt, Yersinia pestis KIM
aguucggucuauaaaaccg

SEQ ID NO: 2324380 - RNA, 17 nt, Yersinia pestis KIM
agugcgacgauaaaggc

SEQ ID NO: 2324381 - RNA, 23 nt, Yersinia pestis KIM
agugcgauguuuuccaacuccau

SEQ ID NO: 2324382 - RNA, 15 nt, Yersinia pestis KIM
agugcuauccucuua

SEQ ID NO: 2324383 - RNA, 15 nt, Yersinia pestis KIM
agugcguacgccaac

SEQ ID NO: 2324384 - RNA, 20 nt, Yersinia pestis KIM
agugccgucaauuaucaaaa

SEQ ID NO: 2324385 - RNA, 22 nt, Yersinia pestis KIM
agugccgucaauuaucaaaaaa

SEQ ID NO: 2324386 - RNA, 18 nt, Yersinia pestis KIM
agugccuaucugaaugcu

SEQ ID NO: 2324387 - RNA, 21 nt, Yersinia pestis KIM
agugcgaagcgcacccaaaau

SEQ ID NO: 2324388 - RNA, 16 nt, Yersinia pestis KIM
agugcauccccacuga

SEQ ID NO: 2324389 - RNA, 17 nt, Yersinia pestis KIM
agugccaaaauaucuuc

SEQ ID NO: 2324390 - RNA, 17 nt, Yersinia pestis KIM
agugagcgcgggucaug

SEQ ID NO: 2324391 - RNA, 22 nt, Yersinia pestis KIM
agugagaaggguauugaagaua

SEQ ID NO: 2324392 - RNA, 22 nt, Yersinia pestis KIM
agugacuucgcugcuaaacagg

SEQ ID NO: 2324393 - RNA, 20 nt, Yersinia pestis KIM
agugacugaauggcuauuua

SEQ ID NO: 2324394 - RNA, 18 nt, Yersinia pestis KIM
agugacugguaugcggga

SEQ ID NO: 2324395 - RNA, 13 nt, Yersinia pestis KIM
agugacuccccug

SEQ ID NO: 2324396 - RNA, 15 nt, Yersinia pestis KIM
agugacguugauucu

SEQ ID NO: 2324397 - RNA, 16 nt, Yersinia pestis KIM
aguggcuuaauugaag

SEQ ID NO: 2324398 - RNA, 13 nt, Yersinia pestis KIM
aguggguaaaccu

SEQ ID NO: 2324399 - RNA, 18 nt, Yersinia pestis KIM
agugggggugauauaugc

SEQ ID NO: 2324400 - RNA, 15 nt, Yersinia pestis KIM
aguggucauuaauuu

SEQ ID NO: 2324401 - RNA, 16 nt, Yersinia pestis KIM
agugucaugcgcagaa

SEQ ID NO: 2324402 - RNA, 18 nt, Yersinia pestis KIM
agugucagggcaauaaca

SEQ ID NO: 2324403 - RNA, 20 nt, Yersinia pestis KIM
agugucagggcaauaacaaa

SEQ ID NO: 2324404 - RNA, 19 nt, Yersinia pestis KIM
agugucaguaugaaauuuu

SEQ ID NO: 2324405 - RNA, 22 nt, Yersinia pestis KIM
aguguccgcgccauaaaagaua

SEQ ID NO: 2324406 - RNA, 21 nt, Yersinia pestis KIM
aguguauucgcaucuuccaaa

SEQ ID NO: 2324407 - RNA, 13 nt, Yersinia pestis KIM
agugucagcaaac

SEQ ID NO: 2324408 - RNA, 20 nt, Yersinia pestis KIM
aguguaucaauaggauuuuc

SEQ ID NO: 2324409 - RNA, 18 nt, Yersinia pestis KIM
aguguaucaauaggauuu

SEQ ID NO: 2324410 - RNA, 20 nt, Yersinia pestis KIM
aguguaaaaccugacuguuu

SEQ ID NO: 2324411 - RNA, 18 nt, Yersinia pestis KIM
aguguaauuggucaccuu

SEQ ID NO: 2324412 - RNA, 17 nt, Yersinia pestis KIM
agucgacaguguaaaaa

SEQ ID NO: 2324413 - RNA, 20 nt, Yersinia pestis KIM
aguccuucggacgcuccuca

SEQ ID NO: 2324414 - RNA, 15 nt, Yersinia pestis KIM
aguccguuaaaaaau

SEQ ID NO: 2324415 - RNA, 19 nt, Yersinia pestis KIM
aguccgguuguggcugcca

SEQ ID NO: 2324416 - RNA, 19 nt, Yersinia pestis KIM
agucgcgaaauaagaauaa

SEQ ID NO: 2324417 - RNA, 13 nt, Yersinia pestis KIM
agucgcgaaauaa

SEQ ID NO: 2324418 - RNA, 12 nt, Yersinia pestis KIM
agucgccuuaaa

SEQ ID NO: 2324419 - RNA, 20 nt, Yersinia pestis KIM
agucgcgaugcgcugcucuu

SEQ ID NO: 2324420 - RNA, 23 nt, Yersinia pestis KIM
agucgcgauaaaauucagccacu

SEQ ID NO: 2324421 - RNA, 19 nt, Yersinia pestis KIM
agucucuguggauugccaa

SEQ ID NO: 2324422 - RNA, 20 nt, Yersinia pestis KIM
agucucuguggauugccaaa

SEQ ID NO: 2324423 - RNA, 22 nt, Yersinia pestis KIM
agucucuuuacggaauaaccua

SEQ ID NO: 2324424 - RNA, 21 nt, Yersinia pestis KIM
agucuugauauuuaagccaug

SEQ ID NO: 2324425 - RNA, 23 nt, Yersinia pestis KIM
agugacgaugagcuaccggcuga

SEQ ID NO: 2324426 - RNA, 19 nt, Yersinia pestis KIM
agugacccaagaugaccac

SEQ ID NO: 2324427 - RNA, 16 nt, Yersinia pestis KIM
agugaaugcugcgugu

SEQ ID NO: 2324428 - RNA, 15 nt, Yersinia pestis KIM
agugacaacaaaaaa

SEQ ID NO: 2324429 - RNA, 14 nt, Yersinia pestis KIM
agucuuagacguca

SEQ ID NO: 2324430 - RNA, 16 nt, Yersinia pestis KIM
agucuuaugaugcugg

SEQ ID NO: 2324431 - RNA, 21 nt, Yersinia pestis KIM
agucuucaucauccauaaaga

SEQ ID NO: 2324432 - RNA, 20 nt, Yersinia pestis KIM
agucuguuaugcccaacugc

SEQ ID NO: 2324433 - RNA, 20 nt, Yersinia pestis KIM
agucugucguacuuuccuuc

SEQ ID NO: 2324434 - RNA, 23 nt, Yersinia pestis KIM
agucugagccucaugaaugaggc

SEQ ID NO: 2324435 - RNA, 15 nt, Yersinia pestis KIM
agucugaggcccgcu

SEQ ID NO: 2324436 - RNA, 14 nt, Yersinia pestis KIM
agucugagggccac

SEQ ID NO: 2324437 - RNA, 23 nt, Yersinia pestis KIM
agucugacaccggggauccauag

SEQ ID NO: 2324438 - RNA, 14 nt, Yersinia pestis KIM
agucugaaaugauc

SEQ ID NO: 2324439 - RNA, 19 nt, Yersinia pestis KIM
agucugaaaugaucaccgc

SEQ ID NO: 2324440 - RNA, 20 nt, Yersinia pestis KIM
auaacacuuaauugguuuau

SEQ ID NO: 2324441 - RNA, 20 nt, Yersinia pestis KIM
auaacauuauugaacgcuug

SEQ ID NO: 2324442 - RNA, 14 nt, Yersinia pestis KIM
auaacagauauuac

SEQ ID NO: 2324443 - RNA, 20 nt, Yersinia pestis KIM
auaacagauauuacgcagcc

SEQ ID NO: 2324444 - RNA, 19 nt, Yersinia pestis KIM
auaacccgccuagcaucau

SEQ ID NO: 2324445 - RNA, 15 nt, Yersinia pestis KIM
auaaccauugguuac

SEQ ID NO: 2324446 - RNA, 22 nt, Yersinia pestis KIM
auaacccaaugccauagcugcu

SEQ ID NO: 2324447 - RNA, 14 nt, Yersinia pestis KIM
auaacccacagcaa

SEQ ID NO: 2324448 - RNA, 22 nt, Yersinia pestis KIM
auaaauuuuaaguuaauguuua

SEQ ID NO: 2324449 - RNA, 14 nt, Yersinia pestis KIM
auaaaugucacuug

SEQ ID NO: 2324450 - RNA, 19 nt, Yersinia pestis KIM
auaaauuaaaacugaaaag

SEQ ID NO: 2324451 - RNA, 16 nt, Yersinia pestis KIM
auaaccucaggggcca

SEQ ID NO: 2324452 - RNA, 17 nt, Yersinia pestis KIM
auaaccucagggcgucu

SEQ ID NO: 2324453 - RNA, 16 nt, Yersinia pestis KIM
auaaccucagccucau

SEQ ID NO: 2324454 - RNA, 14 nt, Yersinia pestis KIM
auaaccucagaggc

SEQ ID NO: 2324455 - RNA, 13 nt, Yersinia pestis KIM
auaaccucagccu

SEQ ID NO: 2324456 - RNA, 14 nt, Yersinia pestis KIM
auaaccguuuuuuc

SEQ ID NO: 2324457 - RNA, 16 nt, Yersinia pestis KIM
auaaccucaaaaggau

SEQ ID NO: 2324458 - RNA, 20 nt, Yersinia pestis KIM
auaaccuacaaaaauaguug

SEQ ID NO: 2324459 - RNA, 16 nt, Yersinia pestis KIM
auaacguuguuucuga

SEQ ID NO: 2324460 - RNA, 16 nt, Yersinia pestis KIM
auaacuaaaaaaguaa

SEQ ID NO: 2324461 - RNA, 20 nt, Yersinia pestis KIM
auaacuaagagucacagcau

SEQ ID NO: 2324462 - RNA, 14 nt, Yersinia pestis KIM
auaacucaucagua

SEQ ID NO: 2324463 - RNA, 12 nt, Yersinia pestis KIM
auaacucaucag

SEQ ID NO: 2324464 - RNA, 15 nt, Yersinia pestis KIM
auaacugguccaacu

SEQ ID NO: 2324465 - RNA, 18 nt, Yersinia pestis KIM
auaacuuauuacaccuua

SEQ ID NO: 2324466 - RNA, 17 nt, Yersinia pestis KIM
auaaaccgcuauaucau

SEQ ID NO: 2324467 - RNA, 22 nt, Yersinia pestis KIM
auaaacccgucgcucacuagca

SEQ ID NO: 2324468 - RNA, 18 nt, Yersinia pestis KIM
auaaacccacagacauuu

SEQ ID NO: 2324469 - RNA, 18 nt, Yersinia pestis KIM
auaaaccgugauugguuu

SEQ ID NO: 2324470 - RNA, 20 nt, Yersinia pestis KIM
auaaaccuacagccaucggu

SEQ ID NO: 2324471 - RNA, 12 nt, Yersinia pestis KIM
auaaaccugcaa

SEQ ID NO: 2324472 - RNA, 22 nt, Yersinia pestis KIM
auaaacgucuuaugccauaaca

SEQ ID NO: 2324473 - RNA, 14 nt, Yersinia pestis KIM
auaaagaugcaagc

SEQ ID NO: 2324474 - RNA, 16 nt, Yersinia pestis KIM
auaaagagugaaauau

SEQ ID NO: 2324475 - RNA, 21 nt, Yersinia pestis KIM
auaaagauggcauuaaaaauc

SEQ ID NO: 2324476 - RNA, 14 nt, Yersinia pestis KIM
auaaacuucacaau

SEQ ID NO: 2324477 - RNA, 19 nt, Yersinia pestis KIM
auaaacuucacaaugcaca

SEQ ID NO: 2324478 - RNA, 13 nt, Yersinia pestis KIM
auaaagagugaaa

SEQ ID NO: 2324479 - RNA, 20 nt, Yersinia pestis KIM
auaaacugaaguuaaaaagc

SEQ ID NO: 2324480 - RNA, 16 nt, Yersinia pestis KIM
auaaacaauaaacaga

SEQ ID NO: 2324481 - RNA, 17 nt, Yersinia pestis KIM
auaaacaaaauagggcg

SEQ ID NO: 2324482 - RNA, 11 nt, Yersinia pestis KIM
auaaaaaguca

SEQ ID NO: 2324483 - RNA, 14 nt, Yersinia pestis KIM
auaaaaauacauau

SEQ ID NO: 2324484 - RNA, 13 nt, Yersinia pestis KIM
auaaaaauacaua

SEQ ID NO: 2324485 - RNA, 17 nt, Yersinia pestis KIM
auaaaaauaaucaauga

SEQ ID NO: 2324486 - RNA, 15 nt, Yersinia pestis KIM
auaaaaauaaucaau

SEQ ID NO: 2324487 - RNA, 15 nt, Yersinia pestis KIM
auaaaaacuucagag

SEQ ID NO: 2324488 - RNA, 11 nt, Yersinia pestis KIM
auaaaaagcca

SEQ ID NO: 2324489 - RNA, 12 nt, Yersinia pestis KIM
auaaaaagccag

SEQ ID NO: 2324490 - RNA, 13 nt, Yersinia pestis KIM
auaaauaaaauaa

SEQ ID NO: 2324491 - RNA, 12 nt, Yersinia pestis KIM
auaaauaaaaua

SEQ ID NO: 2324492 - RNA, 21 nt, Yersinia pestis KIM
auaaaggcaaaagcaucacca

SEQ ID NO: 2324493 - RNA, 22 nt, Yersinia pestis KIM
auaaaggcaaaagcaucaccaa

SEQ ID NO: 2324494 - RNA, 15 nt, Yersinia pestis KIM
auaaagcaucagacu

SEQ ID NO: 2324495 - RNA, 16 nt, Yersinia pestis KIM
auaaagcauuuaucau

SEQ ID NO: 2324496 - RNA, 21 nt, Yersinia pestis KIM
auaaagcauuuaucauauuaa

SEQ ID NO: 2324497 - RNA, 23 nt, Yersinia pestis KIM
auaaagccauuggucaaucuaga

SEQ ID NO: 2324498 - RNA, 14 nt, Yersinia pestis KIM
auaaagcgguuggu

SEQ ID NO: 2324499 - RNA, 18 nt, Yersinia pestis KIM
auaaauauucauuaaaaa

SEQ ID NO: 2324500 - RNA, 20 nt, Yersinia pestis KIM
auaaauaucauuaacaaacu

SEQ ID NO: 2324501 - RNA, 20 nt, Yersinia pestis KIM
auaaauauccucggccagug

SEQ ID NO: 2324502 - RNA, 21 nt, Yersinia pestis KIM
auaaauaaccgagcgugaaga

SEQ ID NO: 2324503 - RNA, 14 nt, Yersinia pestis KIM
auaaauaaauuuaa

SEQ ID NO: 2324504 - RNA, 14 nt, Yersinia pestis KIM
auaaauaaguucag

SEQ ID NO: 2324505 - RNA, 17 nt, Yersinia pestis KIM
auaaauaauaucaauga

SEQ ID NO: 2324506 - RNA, 22 nt, Yersinia pestis KIM
auaaauaaucauuuguuuuuaa

SEQ ID NO: 2324507 - RNA, 19 nt, Yersinia pestis KIM
auaaauaauuuguaaauuu

SEQ ID NO: 2324508 - RNA, 15 nt, Yersinia pestis KIM
auaaauccugaacau

SEQ ID NO: 2324509 - RNA, 17 nt, Yersinia pestis KIM
auaaauauuuaauaugu

SEQ ID NO: 2324510 - RNA, 19 nt, Yersinia pestis KIM
auaaaucgcccaacccccc

SEQ ID NO: 2324511 - RNA, 21 nt, Yersinia pestis KIM
auaaucaccagacaaccaaua

SEQ ID NO: 2324512 - RNA, 19 nt, Yersinia pestis KIM
auaaucaccagacaaccaa

SEQ ID NO: 2324513 - RNA, 20 nt, Yersinia pestis KIM
auaaucacaggggcaauaau

SEQ ID NO: 2324514 - RNA, 22 nt, Yersinia pestis KIM
auaaucagaggugaaaaaauau

SEQ ID NO: 2324515 - RNA, 22 nt, Yersinia pestis KIM
auaaucaucaguuuauuguuau

SEQ ID NO: 2324516 - RNA, 18 nt, Yersinia pestis KIM
auaaucaguacaucaaua

SEQ ID NO: 2324517 - RNA, 21 nt, Yersinia pestis KIM
auaaucuugugaugaaauuaa

SEQ ID NO: 2324518 - RNA, 15 nt, Yersinia pestis KIM
auaaugcgauuaacc

SEQ ID NO: 2324519 - RNA, 23 nt, Yersinia pestis KIM
auaaugcggcucucuuucuccaa

SEQ ID NO: 2324520 - RNA, 21 nt, Yersinia pestis KIM
auaaugcugaugcaauaacuc

SEQ ID NO: 2324521 - RNA, 16 nt, Yersinia pestis KIM
auaauggcauuuuucg

SEQ ID NO: 2324522 - RNA, 15 nt, Yersinia pestis KIM
auaauggacgaacag

SEQ ID NO: 2324523 - RNA, 12 nt, Yersinia pestis KIM
auaauuaacuau

SEQ ID NO: 2324524 - RNA, 19 nt, Yersinia pestis KIM
auaauguuaauauuuuacu

SEQ ID NO: 2324525 - RNA, 20 nt, Yersinia pestis KIM
auaauaacgucgccaguugc

SEQ ID NO: 2324526 - RNA, 18 nt, Yersinia pestis KIM
auaauaaauuaucugaau

SEQ ID NO: 2324527 - RNA, 14 nt, Yersinia pestis KIM
auaauaacucuaug

SEQ ID NO: 2324528 - RNA, 14 nt, Yersinia pestis KIM
auaauaauauugau

SEQ ID NO: 2324529 - RNA, 16 nt, Yersinia pestis KIM
auaauaauccauaacu

SEQ ID NO: 2324530 - RNA, 10 nt, Yersinia pestis KIM
auaauaaugg

SEQ ID NO: 2324531 - RNA, 16 nt, Yersinia pestis KIM
auaauacgaucagcgu

SEQ ID NO: 2324532 - RNA, 14 nt, Yersinia pestis KIM
auaauaucaaugau

SEQ ID NO: 2324533 - RNA, 15 nt, Yersinia pestis KIM
auaauauagcugaau

SEQ ID NO: 2324534 - RNA, 14 nt, Yersinia pestis KIM
auaauauuauuauc

SEQ ID NO: 2324535 - RNA, 20 nt, Yersinia pestis KIM
auaaguucagguugaaauaa

SEQ ID NO: 2324536 - RNA, 22 nt, Yersinia pestis KIM
auaaguuacgucagaaauaaau

SEQ ID NO: 2324537 - RNA, 21 nt, Yersinia pestis KIM
auaaguuccggcagauaugau

SEQ ID NO: 2324538 - RNA, 23 nt, Yersinia pestis KIM
auaaguugauaacgccggauaaa

SEQ ID NO: 2324539 - RNA, 19 nt, Yersinia pestis KIM
auaagugaaacaaauacac

SEQ ID NO: 2324540 - RNA, 21 nt, Yersinia pestis KIM
auaagugcaaacuuaaaaauc

SEQ ID NO: 2324541 - RNA, 18 nt, Yersinia pestis KIM
auaaguguuucaaauaag

SEQ ID NO: 2324542 - RNA, 21 nt, Yersinia pestis KIM
auaaguguguguauuuaaaag

SEQ ID NO: 2324543 - RNA, 11 nt, Yersinia pestis KIM
auaauaaaaaa

SEQ ID NO: 2324544 - RNA, 15 nt, Yersinia pestis KIM
auaauaaaaaaaaau

SEQ ID NO: 2324545 - RNA, 22 nt, Yersinia pestis KIM
auaauaaaaucugcuucuccug

SEQ ID NO: 2324546 - RNA, 15 nt, Yersinia pestis KIM
auaaggcuaacaccu

SEQ ID NO: 2324547 - RNA, 18 nt, Yersinia pestis KIM
auaagggccauuuugcug

SEQ ID NO: 2324548 - RNA, 20 nt, Yersinia pestis KIM
auaaggcuagaucguuacau

SEQ ID NO: 2324549 - RNA, 17 nt, Yersinia pestis KIM
auaaggcuuuauauugc

SEQ ID NO: 2324550 - RNA, 19 nt, Yersinia pestis KIM
auaaggugccacacagaau

SEQ ID NO: 2324551 - RNA, 14 nt, Yersinia pestis KIM
auaaguaauaagua

SEQ ID NO: 2324552 - RNA, 19 nt, Yersinia pestis KIM
auaaguaggcaucugccac

SEQ ID NO: 2324553 - RNA, 14 nt, Yersinia pestis KIM
auaaggaauauacu

SEQ ID NO: 2324554 - RNA, 20 nt, Yersinia pestis KIM
auaagcgguuucauggcugg

SEQ ID NO: 2324555 - RNA, 17 nt, Yersinia pestis KIM
auaagcgguuuuaucaa

SEQ ID NO: 2324556 - RNA, 16 nt, Yersinia pestis KIM
auaagcguuauuuuug

SEQ ID NO: 2324557 - RNA, 22 nt, Yersinia pestis KIM
auaagccgcaggcaaacaaugu

SEQ ID NO: 2324558 - RNA, 19 nt, Yersinia pestis KIM
auaagccauuuuuuauaaa

SEQ ID NO: 2324559 - RNA, 19 nt, Yersinia pestis KIM
auaagccgcaggcaaacaa

SEQ ID NO: 2324560 - RNA, 23 nt, Yersinia pestis KIM
auaagcgcucaaauacgguagca

SEQ ID NO: 2324561 - RNA, 15 nt, Yersinia pestis KIM
auaagcgcucaaaua

SEQ ID NO: 2324562 - RNA, 16 nt, Yersinia pestis KIM
auaagcacuccacugg

SEQ ID NO: 2324563 - RNA, 16 nt, Yersinia pestis KIM
auaagcaggcaguaaa

SEQ ID NO: 2324564 - RNA, 15 nt, Yersinia pestis KIM
auaagauucagcugc

SEQ ID NO: 2324565 - RNA, 18 nt, Yersinia pestis KIM
auaagcacaacgcucuaa

SEQ ID NO: 2324566 - RNA, 22 nt, Yersinia pestis KIM
auaagaugaccaccaauuucau

SEQ ID NO: 2324567 - RNA, 17 nt, Yersinia pestis KIM
auaagauccagaacacc

SEQ ID NO: 2324568 - RNA, 17 nt, Yersinia pestis KIM
auaagacuaacagaaua

SEQ ID NO: 2324569 - RNA, 22 nt, Yersinia pestis KIM
aggcaucugccacacugaauuu

SEQ ID NO: 2324570 - RNA, 13 nt, Yersinia pestis KIM
aggcaucugccac

SEQ ID NO: 2324571 - RNA, 20 nt, Yersinia pestis KIM
aggccacccccauaaccauu

SEQ ID NO: 2324572 - RNA, 15 nt, Yersinia pestis KIM
aggccaauuuggcca

SEQ ID NO: 2324573 - RNA, 18 nt, Yersinia pestis KIM
aggccaauagcccaaaua

SEQ ID NO: 2324574 - RNA, 13 nt, Yersinia pestis KIM
aggccaacacuca

SEQ ID NO: 2324575 - RNA, 17 nt, Yersinia pestis KIM
aggcaucucugaagccu

SEQ ID NO: 2324576 - RNA, 17 nt, Yersinia pestis KIM
aggccgaguaacuccau

SEQ ID NO: 2324577 - RNA, 12 nt, Yersinia pestis KIM
aggcccuuucac

SEQ ID NO: 2324578 - RNA, 22 nt, Yersinia pestis KIM
aggcccgcuucccuacauaaaa

SEQ ID NO: 2324579 - RNA, 22 nt, Yersinia pestis KIM
aggcccgcuuuaaucagcccuu

SEQ ID NO: 2324580 - RNA, 15 nt, Yersinia pestis KIM
aggcccgcuaucacu

SEQ ID NO: 2324581 - RNA, 14 nt, Yersinia pestis KIM
aggccccucggggc

SEQ ID NO: 2324582 - RNA, 18 nt, Yersinia pestis KIM
aggcccauggacgggcca

SEQ ID NO: 2324583 - RNA, 14 nt, Yersinia pestis KIM
aggccauaaucugc

SEQ ID NO: 2324584 - RNA, 22 nt, Yersinia pestis KIM
aggccauagcaaccggauacaa

SEQ ID NO: 2324585 - RNA, 16 nt, Yersinia pestis KIM
aggccauccacgcagg

SEQ ID NO: 2324586 - RNA, 17 nt, Yersinia pestis KIM
aggccauucaaugucca

SEQ ID NO: 2324587 - RNA, 14 nt, Yersinia pestis KIM
aggcccacugcaac

SEQ ID NO: 2324588 - RNA, 17 nt, Yersinia pestis KIM
aggccagcgccccauca

SEQ ID NO: 2324589 - RNA, 23 nt, Yersinia pestis KIM
aggccagcacuaagugcuggccu

SEQ ID NO: 2324590 - RNA, 11 nt, Yersinia pestis KIM
aggcaccagcg

SEQ ID NO: 2324591 - RNA, 22 nt, Yersinia pestis KIM
aggcaccagagagguuucagua

SEQ ID NO: 2324592 - RNA, 23 nt, Yersinia pestis KIM
aggcacaucuccagaauauaaaa

SEQ ID NO: 2324593 - RNA, 18 nt, Yersinia pestis KIM
aggcaccguugaggugcc

SEQ ID NO: 2324594 - RNA, 20 nt, Yersinia pestis KIM
aggcaccucaacggugccuc

SEQ ID NO: 2324595 - RNA, 16 nt, Yersinia pestis KIM
aggcacgagcggugga

SEQ ID NO: 2324596 - RNA, 18 nt, Yersinia pestis KIM
aggcacuaacugcgccua

SEQ ID NO: 2324597 - RNA, 17 nt, Yersinia pestis KIM
aggcacgugccgcuggg

SEQ ID NO: 2324598 - RNA, 16 nt, Yersinia pestis KIM
aggcacugcagaaaau

SEQ ID NO: 2324599 - RNA, 12 nt, Yersinia pestis KIM
aggcagauaaau

SEQ ID NO: 2324600 - RNA, 20 nt, Yersinia pestis KIM
aggcaauacaccgccaguau

SEQ ID NO: 2324601 - RNA, 14 nt, Yersinia pestis KIM
aggcaauaagaaua

SEQ ID NO: 2324602 - RNA, 14 nt, Yersinia pestis KIM
aggcaaugagugca

SEQ ID NO: 2324603 - RNA, 14 nt, Yersinia pestis KIM
aggcaauuauccau

SEQ ID NO: 2324604 - RNA, 18 nt, Yersinia pestis KIM
aggcaaauucucaaugau

SEQ ID NO: 2324605 - RNA, 14 nt, Yersinia pestis KIM
aggcaacauuuguu

SEQ ID NO: 2324606 - RNA, 14 nt, Yersinia pestis KIM
aggcaacgaaggca

SEQ ID NO: 2324607 - RNA, 23 nt, Yersinia pestis KIM
aggcaaccuuggugaagaucaau

SEQ ID NO: 2324608 - RNA, 15 nt, Yersinia pestis KIM
aggcaacuaagcugc

SEQ ID NO: 2324609 - RNA, 16 nt, Yersinia pestis KIM
aggcaacuaagcugcc

SEQ ID NO: 2324610 - RNA, 15 nt, Yersinia pestis KIM
aggcaagcaaccgca

SEQ ID NO: 2324611 - RNA, 18 nt, Yersinia pestis KIM
aggauggcgcggcucgag

SEQ ID NO: 2324612 - RNA, 11 nt, Yersinia pestis KIM
aggcaaagaag

SEQ ID NO: 2324613 - RNA, 16 nt, Yersinia pestis KIM
aggauuucauaccgcu

SEQ ID NO: 2324614 - RNA, 22 nt, Yersinia pestis KIM
aggauuuauuucucugauaauc

SEQ ID NO: 2324615 - RNA, 21 nt, Yersinia pestis KIM
aggauuuuccgcagcucaccu

SEQ ID NO: 2324616 - RNA, 16 nt, Yersinia pestis KIM
aggauugaccaauaaa

SEQ ID NO: 2324617 - RNA, 19 nt, Yersinia pestis KIM
aggauuccguuuuacccuc

SEQ ID NO: 2324618 - RNA, 16 nt, Yersinia pestis KIM
aggaagcaaugaaaua

SEQ ID NO: 2324619 - RNA, 20 nt, Yersinia pestis KIM
aggaaguccaguaauaccuu

SEQ ID NO: 2324620 - RNA, 20 nt, Yersinia pestis KIM
aggaagggguucuuccaacg

SEQ ID NO: 2324621 - RNA, 23 nt, Yersinia pestis KIM
aggaauaaacagcaguucaucuu

SEQ ID NO: 2324622 - RNA, 17 nt, Yersinia pestis KIM
aggaaugcgcccuuuuc

SEQ ID NO: 2324623 - RNA, 16 nt, Yersinia pestis KIM
aggaauggcgugauau

SEQ ID NO: 2324624 - RNA, 17 nt, Yersinia pestis KIM
aggaauggcgugauauc

SEQ ID NO: 2324625 - RNA, 19 nt, Yersinia pestis KIM
aggaaugccgauaagcccu

SEQ ID NO: 2324626 - RNA, 15 nt, Yersinia pestis KIM
aggaaugcgcccuuu

SEQ ID NO: 2324627 - RNA, 20 nt, Yersinia pestis KIM
aggaacgaaguuagacccaa

SEQ ID NO: 2324628 - RNA, 14 nt, Yersinia pestis KIM
aggaaauuucaguu

SEQ ID NO: 2324629 - RNA, 21 nt, Yersinia pestis KIM
aggaaacucaugacaucccag

SEQ ID NO: 2324630 - RNA, 15 nt, Yersinia pestis KIM
aggaaacguauggcu

SEQ ID NO: 2324631 - RNA, 21 nt, Yersinia pestis KIM
aggaaauaaaugacuaucccu

SEQ ID NO: 2324632 - RNA, 22 nt, Yersinia pestis KIM
aggaaaggccggauguaaaaca

SEQ ID NO: 2324633 - RNA, 17 nt, Yersinia pestis KIM
aggaaaauggaauagug

SEQ ID NO: 2324634 - RNA, 20 nt, Yersinia pestis KIM
aggacucugcgcucauacuc

SEQ ID NO: 2324635 - RNA, 17 nt, Yersinia pestis KIM
aggacuuauggguuuuu

SEQ ID NO: 2324636 - RNA, 19 nt, Yersinia pestis KIM
aggagaaacauuaaaccca

SEQ ID NO: 2324637 - RNA, 14 nt, Yersinia pestis KIM
aggagaauuuaggc

SEQ ID NO: 2324638 - RNA, 19 nt, Yersinia pestis KIM
aggagauuucagacugcug

SEQ ID NO: 2324639 - RNA, 21 nt, Yersinia pestis KIM
aggagaucgauaaagccgagc

SEQ ID NO: 2324640 - RNA, 15 nt, Yersinia pestis KIM
aggacggaugguaaa

SEQ ID NO: 2324641 - RNA, 22 nt, Yersinia pestis KIM
aggacgaaggguaaaauaaaua

SEQ ID NO: 2324642 - RNA, 20 nt, Yersinia pestis KIM
aggacgacggguauauugcc

SEQ ID NO: 2324643 - RNA, 19 nt, Yersinia pestis KIM
aggagugaauuucuucccu

SEQ ID NO: 2324644 - RNA, 11 nt, Yersinia pestis KIM
aggauaaaaac

SEQ ID NO: 2324645 - RNA, 16 nt, Yersinia pestis KIM
aggaggcccaucuuuc

SEQ ID NO: 2324646 - RNA, 18 nt, Yersinia pestis KIM
aggauaggcagaggagua

SEQ ID NO: 2324647 - RNA, 18 nt, Yersinia pestis KIM
aggauaggcugaagagua

SEQ ID NO: 2324648 - RNA, 17 nt, Yersinia pestis KIM
aggauaaucaucaguuu

SEQ ID NO: 2324649 - RNA, 14 nt, Yersinia pestis KIM
agcguacacgcagu

SEQ ID NO: 2324650 - RNA, 16 nt, Yersinia pestis KIM
agcguagacaaugacu

SEQ ID NO: 2324651 - RNA, 16 nt, Yersinia pestis KIM
agcgggccagcaacca

SEQ ID NO: 2324652 - RNA, 13 nt, Yersinia pestis KIM
agcggggcaaaaa

SEQ ID NO: 2324653 - RNA, 18 nt, Yersinia pestis KIM
agcguauuaaaccagugc

SEQ ID NO: 2324654 - RNA, 19 nt, Yersinia pestis KIM
agcguaggcaacuaagcug

SEQ ID NO: 2324655 - RNA, 20 nt, Yersinia pestis KIM
agcguaggcaacuaagcugc

SEQ ID NO: 2324656 - RNA, 22 nt, Yersinia pestis KIM
agcguaggcaacuaagcugccu

SEQ ID NO: 2324657 - RNA, 19 nt, Yersinia pestis KIM
agcguagguaacuaagcug

SEQ ID NO: 2324658 - RNA, 20 nt, Yersinia pestis KIM
agcguagguaacuaagcugc

SEQ ID NO: 2324659 - RNA, 22 nt, Yersinia pestis KIM
agcgugcuacauagaaaauaau

SEQ ID NO: 2324660 - RNA, 21 nt, Yersinia pestis KIM
agcguggaauuaauaucccac

SEQ ID NO: 2324661 - RNA, 16 nt, Yersinia pestis KIM
agcgugcgcuccauuu

SEQ ID NO: 2324662 - RNA, 19 nt, Yersinia pestis KIM
agcguuaucaauuaacuac

SEQ ID NO: 2324663 - RNA, 15 nt, Yersinia pestis KIM
agcguucaucgcccu

SEQ ID NO: 2324664 - RNA, 16 nt, Yersinia pestis KIM
agcuaacaccgcugua

SEQ ID NO: 2324665 - RNA, 24 nt, Yersinia pestis KIM
agcuaacaccgcuguagcgucaag

SEQ ID NO: 2324666 - RNA, 14 nt, Yersinia pestis KIM
agcuaacagugacc

SEQ ID NO: 2324667 - RNA, 14 nt, Yersinia pestis KIM
agcuaaucauugca

SEQ ID NO: 2324668 - RNA, 17 nt, Yersinia pestis KIM
agcuauuggcugauuca

SEQ ID NO: 2324669 - RNA, 12 nt, Yersinia pestis KIM
agcuauuucuug

SEQ ID NO: 2324670 - RNA, 19 nt, Yersinia pestis KIM
agcuauuucuugcagugcu

SEQ ID NO: 2324671 - RNA, 20 nt, Yersinia pestis KIM
agcuauuucuugcagugcuu

SEQ ID NO: 2324672 - RNA, 13 nt, Yersinia pestis KIM
agcucaagaauuu

SEQ ID NO: 2324673 - RNA, 21 nt, Yersinia pestis KIM
agcucaauuugguauuggcua

SEQ ID NO: 2324674 - RNA, 19 nt, Yersinia pestis KIM
agcuaugcaguuaagguua

SEQ ID NO: 2324675 - RNA, 20 nt, Yersinia pestis KIM
agcuaaugcucgcucaucau

SEQ ID NO: 2324676 - RNA, 14 nt, Yersinia pestis KIM
agcuauccaccauc

SEQ ID NO: 2324677 - RNA, 19 nt, Yersinia pestis KIM
agcgcuggugcuggugaau

SEQ ID NO: 2324678 - RNA, 18 nt, Yersinia pestis KIM
agcgcggcuucagcaccu

SEQ ID NO: 2324679 - RNA, 20 nt, Yersinia pestis KIM
agcggcauccaguaagcugu

SEQ ID NO: 2324680 - RNA, 17 nt, Yersinia pestis KIM
agcggcguucagcaaua

SEQ ID NO: 2324681 - RNA, 18 nt, Yersinia pestis KIM
agcggcguuguucucugg

SEQ ID NO: 2324682 - RNA, 21 nt, Yersinia pestis KIM
agcggcuuaaugauggccgcu

SEQ ID NO: 2324683 - RNA, 16 nt, Yersinia pestis KIM
agcuuugggucaguua

SEQ ID NO: 2324684 - RNA, 18 nt, Yersinia pestis KIM
agcuuugccuaacggcau

SEQ ID NO: 2324685 - RNA, 22 nt, Yersinia pestis KIM
agcuuuagcauugcagauuucu

SEQ ID NO: 2324686 - RNA, 14 nt, Yersinia pestis KIM
agcuuuaagaucca

SEQ ID NO: 2324687 - RNA, 21 nt, Yersinia pestis KIM
agcuugcaacaaaauggccuu

SEQ ID NO: 2324688 - RNA, 20 nt, Yersinia pestis KIM
agcuugauagggcugaagac

SEQ ID NO: 2324689 - RNA, 19 nt, Yersinia pestis KIM
agcuucuucaaaagcaagu

SEQ ID NO: 2324690 - RNA, 20 nt, Yersinia pestis KIM
agcuuccagcaccccuucac

SEQ ID NO: 2324691 - RNA, 18 nt, Yersinia pestis KIM
agcuucagcucuucuaac

SEQ ID NO: 2324692 - RNA, 16 nt, Yersinia pestis KIM
agcuuauauuauucau

SEQ ID NO: 2324693 - RNA, 16 nt, Yersinia pestis KIM
agcuggcuucaaaauc

SEQ ID NO: 2324694 - RNA, 18 nt, Yersinia pestis KIM
agcuguaaauauaaaaua

SEQ ID NO: 2324695 - RNA, 19 nt, Yersinia pestis KIM
agcuguagaacuuguucau

SEQ ID NO: 2324696 - RNA, 13 nt, Yersinia pestis KIM
agcuguuguuguu

SEQ ID NO: 2324697 - RNA, 16 nt, Yersinia pestis KIM
agcuguuugcaccuuu

SEQ ID NO: 2324698 - RNA, 21 nt, Yersinia pestis KIM
agcuguuuccugagucuguuu

SEQ ID NO: 2324699 - RNA, 18 nt, Yersinia pestis KIM
agcuguuagccagauagg

SEQ ID NO: 2324700 - RNA, 16 nt, Yersinia pestis KIM
agcuguuacugcccug

SEQ ID NO: 2324701 - RNA, 15 nt, Yersinia pestis KIM
agcugcaauugccgc

SEQ ID NO: 2324702 - RNA, 24 nt, Yersinia pestis KIM
agcugaauugcuuauccagccgcu

SEQ ID NO: 2324703 - RNA, 12 nt, Yersinia pestis KIM
agcugaacugag

SEQ ID NO: 2324704 - RNA, 19 nt, Yersinia pestis KIM
agcucugacaaaaugccag

SEQ ID NO: 2324705 - RNA, 10 nt, Yersinia pestis KIM
agcucugagg

SEQ ID NO: 2324706 - RNA, 16 nt, Yersinia pestis KIM
agcucagcuggauaga

SEQ ID NO: 2324707 - RNA, 22 nt, Yersinia pestis KIM
agcucguugguggauaagcucu

SEQ ID NO: 2324708 - RNA, 21 nt, Yersinia pestis KIM
agcucucacugcuccagccaa

SEQ ID NO: 2324709 - RNA, 17 nt, Yersinia pestis KIM
agcucucugagccaucc

SEQ ID NO: 2324710 - RNA, 16 nt, Yersinia pestis KIM
agggagucagggagua

SEQ ID NO: 2324711 - RNA, 16 nt, Yersinia pestis KIM
agggaguuacucagca

SEQ ID NO: 2324712 - RNA, 13 nt, Yersinia pestis KIM
agggaguucauca

SEQ ID NO: 2324713 - RNA, 19 nt, Yersinia pestis KIM
agggauaugacagaaaaau

SEQ ID NO: 2324714 - RNA, 13 nt, Yersinia pestis KIM
agggauucuguca

SEQ ID NO: 2324715 - RNA, 19 nt, Yersinia pestis KIM
agggauucugucagagcua

SEQ ID NO: 2324716 - RNA, 15 nt, Yersinia pestis KIM
agggaugaaaagagc

SEQ ID NO: 2324717 - RNA, 22 nt, Yersinia pestis KIM
agggagccgcccugcauucugg

SEQ ID NO: 2324718 - RNA, 13 nt, Yersinia pestis KIM
agggagccgcccu

SEQ ID NO: 2324719 - RNA, 16 nt, Yersinia pestis KIM
agggagccaauagagg

SEQ ID NO: 2324720 - RNA, 23 nt, Yersinia pestis KIM
agggagagucuauuauauucaau

SEQ ID NO: 2324721 - RNA, 21 nt, Yersinia pestis KIM
agggaaguuucuuacuaaaau

SEQ ID NO: 2324722 - RNA, 23 nt, Yersinia pestis KIM
agggaaagguagaucggggacag

SEQ ID NO: 2324723 - RNA, 13 nt, Yersinia pestis KIM
aggcugucaggaa

SEQ ID NO: 2324724 - RNA, 15 nt, Yersinia pestis KIM
aggcuuugccugccc

SEQ ID NO: 2324725 - RNA, 14 nt, Yersinia pestis KIM
aggcuuugguuuug

SEQ ID NO: 2324726 - RNA, 15 nt, Yersinia pestis KIM
aggcuuucacggugc

SEQ ID NO: 2324727 - RNA, 21 nt, Yersinia pestis KIM
aggcuugaaguucucaucaaa

SEQ ID NO: 2324728 - RNA, 15 nt, Yersinia pestis KIM
aggcuuggcgggcug

SEQ ID NO: 2324729 - RNA, 23 nt, Yersinia pestis KIM
aggcuucuuaauucccagccacu

SEQ ID NO: 2324730 - RNA, 14 nt, Yersinia pestis KIM
aggggcuuguguuc

SEQ ID NO: 2324731 - RNA, 19 nt, Yersinia pestis KIM
aggggguuuuccccucaga

SEQ ID NO: 2324732 - RNA, 21 nt, Yersinia pestis KIM
agggggcuguuaagcauugag

SEQ ID NO: 2324733 - RNA, 18 nt, Yersinia pestis KIM
agggggcgauggugacau

SEQ ID NO: 2324734 - RNA, 18 nt, Yersinia pestis KIM
aggggccaacaggccccu

SEQ ID NO: 2324735 - RNA, 18 nt, Yersinia pestis KIM
aggggccaauaggccccu

SEQ ID NO: 2324736 - RNA, 18 nt, Yersinia pestis KIM
aggguaagccucaaggau

SEQ ID NO: 2324737 - RNA, 23 nt, Yersinia pestis KIM
aggggugcuguuccaaccaaccu

SEQ ID NO: 2324738 - RNA, 16 nt, Yersinia pestis KIM
agggguacagcaggga

SEQ ID NO: 2324739 - RNA, 20 nt, Yersinia pestis KIM
agggcucgguuucacccucu

SEQ ID NO: 2324740 - RNA, 19 nt, Yersinia pestis KIM
agggcugauccguuaucua

SEQ ID NO: 2324741 - RNA, 23 nt, Yersinia pestis KIM
aggggaauauaaugauauucaua

SEQ ID NO: 2324742 - RNA, 22 nt, Yersinia pestis KIM
aggggaaucuaccgcagaaccu

SEQ ID NO: 2324743 - RNA, 22 nt, Yersinia pestis KIM
agggcuguuauccggguggcuu

SEQ ID NO: 2324744 - RNA, 17 nt, Yersinia pestis KIM
aggggauaaaccaauca

SEQ ID NO: 2324745 - RNA, 14 nt, Yersinia pestis KIM
aggggauagggggc

SEQ ID NO: 2324746 - RNA, 19 nt, Yersinia pestis KIM
aggggcaauaauugcaccc

SEQ ID NO: 2324747 - RNA, 23 nt, Yersinia pestis KIM
agggccugcaaacggcucaucac

SEQ ID NO: 2324748 - RNA, 14 nt, Yersinia pestis KIM
agggcgauggcaac

SEQ ID NO: 2324749 - RNA, 16 nt, Yersinia pestis KIM
agggcgauaccucuac

SEQ ID NO: 2324750 - RNA, 16 nt, Yersinia pestis KIM
agggcgcauccccauc

SEQ ID NO: 2324751 - RNA, 13 nt, Yersinia pestis KIM
agggcgcagcccc

SEQ ID NO: 2324752 - RNA, 20 nt, Yersinia pestis KIM
agggcgcgcuucgagccccc

SEQ ID NO: 2324753 - RNA, 18 nt, Yersinia pestis KIM
agggccgcccagauaaag

SEQ ID NO: 2324754 - RNA, 22 nt, Yersinia pestis KIM
agggccacccugccaaaaaaua

SEQ ID NO: 2324755 - RNA, 17 nt, Yersinia pestis KIM
agggcagacggggagga

SEQ ID NO: 2324756 - RNA, 16 nt, Yersinia pestis KIM
agggcagcuaaccccu

SEQ ID NO: 2324757 - RNA, 21 nt, Yersinia pestis KIM
aggcggugagggagucaggga

SEQ ID NO: 2324758 - RNA, 22 nt, Yersinia pestis KIM
aggcggugagggagucagggag

SEQ ID NO: 2324759 - RNA, 21 nt, Yersinia pestis KIM
aggcguagguuucagccucug

SEQ ID NO: 2324760 - RNA, 15 nt, Yersinia pestis KIM
aggcgguuaucugga

SEQ ID NO: 2324761 - RNA, 22 nt, Yersinia pestis KIM
aggcggcaucacuaugggggau

SEQ ID NO: 2324762 - RNA, 15 nt, Yersinia pestis KIM
aggcgcuguugcaug

SEQ ID NO: 2324763 - RNA, 17 nt, Yersinia pestis KIM
aggcgcuagucucucuc

SEQ ID NO: 2324764 - RNA, 13 nt, Yersinia pestis KIM
aggcguuacccac

SEQ ID NO: 2324765 - RNA, 18 nt, Yersinia pestis KIM
aggcguuuccccuugcug

SEQ ID NO: 2324766 - RNA, 18 nt, Yersinia pestis KIM
aggcucagcacaaacaug

SEQ ID NO: 2324767 - RNA, 17 nt, Yersinia pestis KIM
aggcuauuuaagccagc

SEQ ID NO: 2324768 - RNA, 16 nt, Yersinia pestis KIM
aggcuaucgaucacuu

SEQ ID NO: 2324769 - RNA, 17 nt, Yersinia pestis KIM
aggcguuuuuuugccag

SEQ ID NO: 2324770 - RNA, 15 nt, Yersinia pestis KIM
aggcuaaaccggcac

SEQ ID NO: 2324771 - RNA, 23 nt, Yersinia pestis KIM
aggcuaaugugaugaaacuaaaa

SEQ ID NO: 2324772 - RNA, 12 nt, Yersinia pestis KIM
aggcuaccaagg

SEQ ID NO: 2324773 - RNA, 14 nt, Yersinia pestis KIM
aggcuaccaaggcu

SEQ ID NO: 2324774 - RNA, 22 nt, Yersinia pestis KIM
aggcucucauaucccccccaag

SEQ ID NO: 2324775 - RNA, 17 nt, Yersinia pestis KIM
aggcucuggucacuaaa

SEQ ID NO: 2324776 - RNA, 14 nt, Yersinia pestis KIM
aggcucuguuuuac

SEQ ID NO: 2324777 - RNA, 19 nt, Yersinia pestis KIM
aggcucuggcaauggcuag

SEQ ID NO: 2324778 - RNA, 19 nt, Yersinia pestis KIM
aggcugaaggcgcuccccu

SEQ ID NO: 2324779 - RNA, 16 nt, Yersinia pestis KIM
aggcugagguugauga

SEQ ID NO: 2324780 - RNA, 20 nt, Yersinia pestis KIM
aggcucgagccgcgccaucc

SEQ ID NO: 2324781 - RNA, 17 nt, Yersinia pestis KIM
aggcucauccugcgggc

SEQ ID NO: 2324782 - RNA, 17 nt, Yersinia pestis KIM
aggcucagcauggaaga

SEQ ID NO: 2324783 - RNA, 18 nt, Yersinia pestis KIM
aggcucaucaccuuccaa

SEQ ID NO: 2324784 - RNA, 21 nt, Yersinia pestis KIM
aggccgcgaauaacagacguu

SEQ ID NO: 2324785 - RNA, 21 nt, Yersinia pestis KIM
aggccgccaucaucaucaaua

SEQ ID NO: 2324786 - RNA, 21 nt, Yersinia pestis KIM
aggccgaucaacaggccaccu

SEQ ID NO: 2324787 - RNA, 14 nt, Yersinia pestis KIM
aggccguucacccu

SEQ ID NO: 2324788 - RNA, 14 nt, Yersinia pestis KIM
aggcgcagcagggc

SEQ ID NO: 2324789 - RNA, 17 nt, Yersinia pestis KIM
aggcgaugcaaggaagu

SEQ ID NO: 2324790 - RNA, 15 nt, Yersinia pestis KIM
aggcgaguuucccuu

SEQ ID NO: 2324791 - RNA, 22 nt, Yersinia pestis KIM
aggccugcaccgguguucacuc

SEQ ID NO: 2324792 - RNA, 14 nt, Yersinia pestis KIM
aguaacucaaguau

SEQ ID NO: 2324793 - RNA, 14 nt, Yersinia pestis KIM
aguaacguccaacu

SEQ ID NO: 2324794 - RNA, 11 nt, Yersinia pestis KIM
aguaaccgggc

SEQ ID NO: 2324795 - RNA, 23 nt, Yersinia pestis KIM
aguaacccagccccuaacagcag

SEQ ID NO: 2324796 - RNA, 19 nt, Yersinia pestis KIM
aguaacgccauaaucgcuu

SEQ ID NO: 2324797 - RNA, 20 nt, Yersinia pestis KIM
aguaacaccagcauccugca

SEQ ID NO: 2324798 - RNA, 19 nt, Yersinia pestis KIM
aguaacacguuuaacucau

SEQ ID NO: 2324799 - RNA, 23 nt, Yersinia pestis KIM
aguaaauucgggcuuuaauacaa

SEQ ID NO: 2324800 - RNA, 19 nt, Yersinia pestis KIM
aguaaauccugaugaccag

SEQ ID NO: 2324801 - RNA, 15 nt, Yersinia pestis KIM
aguaaaucaggccgg

SEQ ID NO: 2324802 - RNA, 13 nt, Yersinia pestis KIM
aguaagaugucau

SEQ ID NO: 2324803 - RNA, 14 nt, Yersinia pestis KIM
aguaagacaacuua

SEQ ID NO: 2324804 - RNA, 11 nt, Yersinia pestis KIM
aguaaggcagc

SEQ ID NO: 2324805 - RNA, 15 nt, Yersinia pestis KIM
aguaaggcagcaagu

SEQ ID NO: 2324806 - RNA, 16 nt, Yersinia pestis KIM
aguaagcguuuacucg

SEQ ID NO: 2324807 - RNA, 21 nt, Yersinia pestis KIM
aguaagccugaugccuugauc

SEQ ID NO: 2324808 - RNA, 18 nt, Yersinia pestis KIM
aguaagugauucggguga

SEQ ID NO: 2324809 - RNA, 23 nt, Yersinia pestis KIM
aguaagugauucgggugagugaa

SEQ ID NO: 2324810 - RNA, 17 nt, Yersinia pestis KIM
aguacaccgauaaaagu

SEQ ID NO: 2324811 - RNA, 13 nt, Yersinia pestis KIM
aguaccagcaaag

SEQ ID NO: 2324812 - RNA, 17 nt, Yersinia pestis KIM
aguaauauuauucaauu

SEQ ID NO: 2324813 - RNA, 15 nt, Yersinia pestis KIM
aguaauauuauucaa

SEQ ID NO: 2324814 - RNA, 23 nt, Yersinia pestis KIM
aguaaugaggcuaccugcaccaa

SEQ ID NO: 2324815 - RNA, 12 nt, Yersinia pestis KIM
aguaaugaaauc

SEQ ID NO: 2324816 - RNA, 22 nt, Yersinia pestis KIM
aguaauuucagauaaaaauaau

SEQ ID NO: 2324817 - RNA, 14 nt, Yersinia pestis KIM
aguaauuuccuugg

SEQ ID NO: 2324818 - RNA, 13 nt, Yersinia pestis KIM
aguaauucacccu

SEQ ID NO: 2324819 - RNA, 13 nt, Yersinia pestis KIM
aguaaugggauca

SEQ ID NO: 2324820 - RNA, 17 nt, Yersinia pestis KIM
agguguuucgugccgca

SEQ ID NO: 2324821 - RNA, 16 nt, Yersinia pestis KIM
agguuaacugcaguga

SEQ ID NO: 2324822 - RNA, 21 nt, Yersinia pestis KIM
agguuaacagccccgucucaa

SEQ ID NO: 2324823 - RNA, 23 nt, Yersinia pestis KIM
agguuauugacaaagagcccgca

SEQ ID NO: 2324824 - RNA, 13 nt, Yersinia pestis KIM
agguucaauuccc

SEQ ID NO: 2324825 - RNA, 14 nt, Yersinia pestis KIM
agguucaauucccg

SEQ ID NO: 2324826 - RNA, 18 nt, Yersinia pestis KIM
agguucauuacacagcau

SEQ ID NO: 2324827 - RNA, 13 nt, Yersinia pestis KIM
agguucuaaaccu

SEQ ID NO: 2324828 - RNA, 18 nt, Yersinia pestis KIM
agguucggcgcaaucaua

SEQ ID NO: 2324829 - RNA, 23 nt, Yersinia pestis KIM
agguugcauugccucccauugcu

SEQ ID NO: 2324830 - RNA, 15 nt, Yersinia pestis KIM
agguuucagccucug

SEQ ID NO: 2324831 - RNA, 15 nt, Yersinia pestis KIM
agguuugcuccaccg

SEQ ID NO: 2324832 - RNA, 17 nt, Yersinia pestis KIM
aguaaaagucagcaaau

SEQ ID NO: 2324833 - RNA, 16 nt, Yersinia pestis KIM
aguaaaaacucacugu

SEQ ID NO: 2324834 - RNA, 17 nt, Yersinia pestis KIM
aguaaaacugauauaaa

SEQ ID NO: 2324835 - RNA, 16 nt, Yersinia pestis KIM
aguaaaauauugauau

SEQ ID NO: 2324836 - RNA, 12 nt, Yersinia pestis KIM
aguaaacagcca

SEQ ID NO: 2324837 - RNA, 20 nt, Yersinia pestis KIM
aguaaagcaaauucccacca

SEQ ID NO: 2324838 - RNA, 14 nt, Yersinia pestis KIM
aguaaagcccagca

SEQ ID NO: 2324839 - RNA, 13 nt, Yersinia pestis KIM
aguaaauagcaaa

SEQ ID NO: 2324840 - RNA, 14 nt, Yersinia pestis KIM
aguaaauaccuuca

SEQ ID NO: 2324841 - RNA, 12 nt, Yersinia pestis KIM
aguaaagcuuuc

SEQ ID NO: 2324842 - RNA, 14 nt, Yersinia pestis KIM
agguaauaccaaug

SEQ ID NO: 2324843 - RNA, 20 nt, Yersinia pestis KIM
agguaacgggagauuaauac

SEQ ID NO: 2324844 - RNA, 15 nt, Yersinia pestis KIM
agguaagaaagagau

SEQ ID NO: 2324845 - RNA, 16 nt, Yersinia pestis KIM
agguaaauccuucugg

SEQ ID NO: 2324846 - RNA, 18 nt, Yersinia pestis KIM
agguaaaccgguuaaaac

SEQ ID NO: 2324847 - RNA, 19 nt, Yersinia pestis KIM
agguaaaccgguuaaaaca

SEQ ID NO: 2324848 - RNA, 20 nt, Yersinia pestis KIM
agguaaaccgguuaaaacag

SEQ ID NO: 2324849 - RNA, 20 nt, Yersinia pestis KIM
aggguugcgggccucuucuu

SEQ ID NO: 2324850 - RNA, 22 nt, Yersinia pestis KIM
aggguugagccaauuaagaaau

SEQ ID NO: 2324851 - RNA, 21 nt, Yersinia pestis KIM
aggguucgaaucccucccuca

SEQ ID NO: 2324852 - RNA, 17 nt, Yersinia pestis KIM
agggugaaagcccaacu

SEQ ID NO: 2324853 - RNA, 22 nt, Yersinia pestis KIM
agggucagaauacguagcccuu

SEQ ID NO: 2324854 - RNA, 16 nt, Yersinia pestis KIM
agggucauaguuuuua

SEQ ID NO: 2324855 - RNA, 12 nt, Yersinia pestis KIM
aggguauaugga

SEQ ID NO: 2324856 - RNA, 14 nt, Yersinia pestis KIM
aggguauugaagau

SEQ ID NO: 2324857 - RNA, 19 nt, Yersinia pestis KIM
aggguggucaacugugcca

SEQ ID NO: 2324858 - RNA, 17 nt, Yersinia pestis KIM
aggguuaaccagaagaa

SEQ ID NO: 2324859 - RNA, 14 nt, Yersinia pestis KIM
agggugaugacaau

SEQ ID NO: 2324860 - RNA, 20 nt, Yersinia pestis KIM
aggguggaaacagguagugg

SEQ ID NO: 2324861 - RNA, 16 nt, Yersinia pestis KIM
aggguggagagaaagg

SEQ ID NO: 2324862 - RNA, 16 nt, Yersinia pestis KIM
agguaccccauaaauc

SEQ ID NO: 2324863 - RNA, 18 nt, Yersinia pestis KIM
agguaccugaucagcauu

SEQ ID NO: 2324864 - RNA, 17 nt, Yersinia pestis KIM
agguaaugguaaaaaau

SEQ ID NO: 2324865 - RNA, 16 nt, Yersinia pestis KIM
agguaaugucacugcc

SEQ ID NO: 2324866 - RNA, 19 nt, Yersinia pestis KIM
agguaaugcauucugcugg

SEQ ID NO: 2324867 - RNA, 12 nt, Yersinia pestis KIM
agguaauuaaac

SEQ ID NO: 2324868 - RNA, 20 nt, Yersinia pestis KIM
agguaaucagacugcugaca

SEQ ID NO: 2324869 - RNA, 17 nt, Yersinia pestis KIM
agguaaucagacugcug

SEQ ID NO: 2324870 - RNA, 15 nt, Yersinia pestis KIM
agguacggccagcaa

SEQ ID NO: 2324871 - RNA, 17 nt, Yersinia pestis KIM
agguacggccagcaaug

SEQ ID NO: 2324872 - RNA, 19 nt, Yersinia pestis KIM
agguauacaccucaacgug

SEQ ID NO: 2324873 - RNA, 18 nt, Yersinia pestis KIM
agguaguuacagcaaaua

SEQ ID NO: 2324874 - RNA, 19 nt, Yersinia pestis KIM
agguaucauuuuccugcau

SEQ ID NO: 2324875 - RNA, 18 nt, Yersinia pestis KIM
agguaugugccaaaaaaa

SEQ ID NO: 2324876 - RNA, 23 nt, Yersinia pestis KIM
agguauuucuccauugcgguuca

SEQ ID NO: 2324877 - RNA, 19 nt, Yersinia pestis KIM
aggucaauaucgauuuuua

SEQ ID NO: 2324878 - RNA, 22 nt, Yersinia pestis KIM
aggucaaaugagucguaaaauu

SEQ ID NO: 2324879 - RNA, 19 nt, Yersinia pestis KIM
aggugacaggcaaagacua

SEQ ID NO: 2324880 - RNA, 22 nt, Yersinia pestis KIM
aggugacaggcaaagacuacac

SEQ ID NO: 2324881 - RNA, 23 nt, Yersinia pestis KIM
aggugccacacagaaucaccaac

SEQ ID NO: 2324882 - RNA, 14 nt, Yersinia pestis KIM
aggugcccgcuugu

SEQ ID NO: 2324883 - RNA, 13 nt, Yersinia pestis KIM
aggugcaguaacc

SEQ ID NO: 2324884 - RNA, 13 nt, Yersinia pestis KIM
aggugauuucaaa

SEQ ID NO: 2324885 - RNA, 18 nt, Yersinia pestis KIM
aggugguuuuggccggga

SEQ ID NO: 2324886 - RNA, 22 nt, Yersinia pestis KIM
aggugcgccaguggcaucaaua

SEQ ID NO: 2324887 - RNA, 23 nt, Yersinia pestis KIM
aggucucgcaaugaaaguggcca

SEQ ID NO: 2324888 - RNA, 14 nt, Yersinia pestis KIM
aggucgccucuggg

SEQ ID NO: 2324889 - RNA, 15 nt, Yersinia pestis KIM
aggucaggaagagaa

SEQ ID NO: 2324890 - RNA, 20 nt, Yersinia pestis KIM
aggucaggaagagaaaagca

SEQ ID NO: 2324891 - RNA, 14 nt, Yersinia pestis KIM
aggucaucccagca

SEQ ID NO: 2324892 - RNA, 22 nt, Yersinia pestis KIM
acggccagcaaccuggcggccc

SEQ ID NO: 2324893 - RNA, 22 nt, Yersinia pestis KIM
acggaugaaaagugauccacuu

SEQ ID NO: 2324894 - RNA, 21 nt, Yersinia pestis KIM
acggccggaacggucagggaa

SEQ ID NO: 2324895 - RNA, 19 nt, Yersinia pestis KIM
acggccuguaccaccacca

SEQ ID NO: 2324896 - RNA, 12 nt, Yersinia pestis KIM
acggccuucuuu

SEQ ID NO: 2324897 - RNA, 14 nt, Yersinia pestis KIM
acggcgaacuucgc

SEQ ID NO: 2324898 - RNA, 17 nt, Yersinia pestis KIM
acggacggaauccaaca

SEQ ID NO: 2324899 - RNA, 17 nt, Yersinia pestis KIM
acggacgguaaauuuac

SEQ ID NO: 2324900 - RNA, 14 nt, Yersinia pestis KIM
acggaucacgcugu

SEQ ID NO: 2324901 - RNA, 20 nt, Yersinia pestis KIM
acggacauuuagcacuguuc

SEQ ID NO: 2324902 - RNA, 18 nt, Yersinia pestis KIM
acggacauuuuacucccu

SEQ ID NO: 2324903 - RNA, 19 nt, Yersinia pestis KIM
acggacauuuuacucccug

SEQ ID NO: 2324904 - RNA, 17 nt, Yersinia pestis KIM
acggacaguugugucag

SEQ ID NO: 2324905 - RNA, 21 nt, Yersinia pestis KIM
acggacacauaaguguauucg

SEQ ID NO: 2324906 - RNA, 15 nt, Yersinia pestis KIM
acgcuuuugcugcaa

SEQ ID NO: 2324907 - RNA, 17 nt, Yersinia pestis KIM
acgcuuaaagcauaaca

SEQ ID NO: 2324908 - RNA, 15 nt, Yersinia pestis KIM
acgcuguuggguugu

SEQ ID NO: 2324909 - RNA, 22 nt, Yersinia pestis KIM
acggaaaugauaucugaaucag

SEQ ID NO: 2324910 - RNA, 11 nt, Yersinia pestis KIM
acgcaaguaaa

SEQ ID NO: 2324911 - RNA, 14 nt, Yersinia pestis KIM
acgcaaguaaaagu

SEQ ID NO: 2324912 - RNA, 20 nt, Yersinia pestis KIM
acgcugguuaucacagcaaa

SEQ ID NO: 2324913 - RNA, 13 nt, Yersinia pestis KIM
acgcugggcgaua

SEQ ID NO: 2324914 - RNA, 13 nt, Yersinia pestis KIM
acgcuggccagca

SEQ ID NO: 2324915 - RNA, 20 nt, Yersinia pestis KIM
acgcuggcacuggaugugug

SEQ ID NO: 2324916 - RNA, 16 nt, Yersinia pestis KIM
acggcggcgagcacug

SEQ ID NO: 2324917 - RNA, 19 nt, Yersinia pestis KIM
acggcggcgagcacugccc

SEQ ID NO: 2324918 - RNA, 15 nt, Yersinia pestis KIM
acggcgggcaacaga

SEQ ID NO: 2324919 - RNA, 22 nt, Yersinia pestis KIM
acggggaaacaguaaauuauuu

SEQ ID NO: 2324920 - RNA, 19 nt, Yersinia pestis KIM
acggguauauugcccggua

SEQ ID NO: 2324921 - RNA, 16 nt, Yersinia pestis KIM
acgguaaccauccaua

SEQ ID NO: 2324922 - RNA, 14 nt, Yersinia pestis KIM
acgggucagcugac

SEQ ID NO: 2324923 - RNA, 13 nt, Yersinia pestis KIM
acgggucagcuga

SEQ ID NO: 2324924 - RNA, 15 nt, Yersinia pestis KIM
acgguaaggccgcga

SEQ ID NO: 2324925 - RNA, 16 nt, Yersinia pestis KIM
acgguaccgcagguca

SEQ ID NO: 2324926 - RNA, 22 nt, Yersinia pestis KIM
acgguagugacucaucaaaaca

SEQ ID NO: 2324927 - RNA, 23 nt, Yersinia pestis KIM
acgguaggcagaaacggcuauuu

SEQ ID NO: 2324928 - RNA, 22 nt, Yersinia pestis KIM
acgguauuggagcugaaaauag

SEQ ID NO: 2324929 - RNA, 21 nt, Yersinia pestis KIM
acgguauugugcuccugauga

SEQ ID NO: 2324930 - RNA, 18 nt, Yersinia pestis KIM
acgguuuuaaucuccugg

SEQ ID NO: 2324931 - RNA, 17 nt, Yersinia pestis KIM
acgguucccaugacgau

SEQ ID NO: 2324932 - RNA, 21 nt, Yersinia pestis KIM
acgguguuuggugaagaaacc

SEQ ID NO: 2324933 - RNA, 16 nt, Yersinia pestis KIM
acgguguguugaaauu

SEQ ID NO: 2324934 - RNA, 16 nt, Yersinia pestis KIM
acguaaaaaccaaccg

SEQ ID NO: 2324935 - RNA, 13 nt, Yersinia pestis KIM
acggucucuuucg

SEQ ID NO: 2324936 - RNA, 16 nt, Yersinia pestis KIM
acggugccagcagcaa

SEQ ID NO: 2324937 - RNA, 13 nt, Yersinia pestis KIM
acggugaggauag

SEQ ID NO: 2324938 - RNA, 15 nt, Yersinia pestis KIM
acggugaggauaggc

SEQ ID NO: 2324939 - RNA, 13 nt, Yersinia pestis KIM
acggugaacagau

SEQ ID NO: 2324940 - RNA, 17 nt, Yersinia pestis KIM
acggugguaaucguccc

SEQ ID NO: 2324941 - RNA, 16 nt, Yersinia pestis KIM
acgguggcccucugcc

SEQ ID NO: 2324942 - RNA, 15 nt, Yersinia pestis KIM
acucaaaauacuuaa

SEQ ID NO: 2324943 - RNA, 16 nt, Yersinia pestis KIM
acucaaacugauaaag

SEQ ID NO: 2324944 - RNA, 14 nt, Yersinia pestis KIM
acucaaauuauuuu

SEQ ID NO: 2324945 - RNA, 19 nt, Yersinia pestis KIM
acucaaauagauagcaauc

SEQ ID NO: 2324946 - RNA, 14 nt, Yersinia pestis KIM
acuauuuuucucaa

SEQ ID NO: 2324947 - RNA, 22 nt, Yersinia pestis KIM
acucaaaaauggcaacaucagg

SEQ ID NO: 2324948 - RNA, 17 nt, Yersinia pestis KIM
acuauugcaucuuuaau

SEQ ID NO: 2324949 - RNA, 19 nt, Yersinia pestis KIM
acuauucaaugacuccuga

SEQ ID NO: 2324950 - RNA, 19 nt, Yersinia pestis KIM
acuauucugccuauccuca

SEQ ID NO: 2324951 - RNA, 12 nt, Yersinia pestis KIM
acuauucugcuu

SEQ ID NO: 2324952 - RNA, 18 nt, Yersinia pestis KIM
acuauuuucauuguucuu

SEQ ID NO: 2324953 - RNA, 21 nt, Yersinia pestis KIM
acuauuucguguauaucacua

SEQ ID NO: 2324954 - RNA, 13 nt, Yersinia pestis KIM
acuaucacuaucc

SEQ ID NO: 2324955 - RNA, 17 nt, Yersinia pestis KIM
acuaucacuauccuuug

SEQ ID NO: 2324956 - RNA, 18 nt, Yersinia pestis KIM
acuaucaaacucaccauu

SEQ ID NO: 2324957 - RNA, 18 nt, Yersinia pestis KIM
acuaucaucccaccgaaa

SEQ ID NO: 2324958 - RNA, 14 nt, Yersinia pestis KIM
acuaucgaaacacc

SEQ ID NO: 2324959 - RNA, 14 nt, Yersinia pestis KIM
acuaugggauaaac

SEQ ID NO: 2324960 - RNA, 17 nt, Yersinia pestis KIM
acuaugggggauuaucg

SEQ ID NO: 2324961 - RNA, 17 nt, Yersinia pestis KIM
acuauuaucuuuuaaaa

SEQ ID NO: 2324962 - RNA, 23 nt, Yersinia pestis KIM
acuauuaucuuuuaaaaaauuau

SEQ ID NO: 2324963 - RNA, 15 nt, Yersinia pestis KIM
acuaauuaauaacca

SEQ ID NO: 2324964 - RNA, 22 nt, Yersinia pestis KIM
acuaccaaauaaauauccuccg

SEQ ID NO: 2324965 - RNA, 19 nt, Yersinia pestis KIM
acuaauguuuguuucucug

SEQ ID NO: 2324966 - RNA, 19 nt, Yersinia pestis KIM
acuaauggccagacacuga

SEQ ID NO: 2324967 - RNA, 18 nt, Yersinia pestis KIM
acuaauggccagacacug

SEQ ID NO: 2324968 - RNA, 15 nt, Yersinia pestis KIM
acuaauggagagaug

SEQ ID NO: 2324969 - RNA, 20 nt, Yersinia pestis KIM
acuaaagccgauuuagacaa

SEQ ID NO: 2324970 - RNA, 20 nt, Yersinia pestis KIM
acuaaacgcccagcuaauug

SEQ ID NO: 2324971 - RNA, 15 nt, Yersinia pestis KIM
acuaaauagauaaaa

SEQ ID NO: 2324972 - RNA, 14 nt, Yersinia pestis KIM
acuacuuauuuccg

SEQ ID NO: 2324973 - RNA, 18 nt, Yersinia pestis KIM
acuaccuugcuccgcaau

SEQ ID NO: 2324974 - RNA, 22 nt, Yersinia pestis KIM
acuaccuuuugcauauuucucu

SEQ ID NO: 2324975 - RNA, 18 nt, Yersinia pestis KIM
acuaccccacauucagua

SEQ ID NO: 2324976 - RNA, 15 nt, Yersinia pestis KIM
acuaccgaucaucag

SEQ ID NO: 2324977 - RNA, 18 nt, Yersinia pestis KIM
acuaccgaucaucaggca

SEQ ID NO: 2324978 - RNA, 17 nt, Yersinia pestis KIM
acuaccgcucagauaaa

SEQ ID NO: 2324979 - RNA, 16 nt, Yersinia pestis KIM
acuaaacagaucaccc

SEQ ID NO: 2324980 - RNA, 17 nt, Yersinia pestis KIM
acuaaaauucaaacaaa

SEQ ID NO: 2324981 - RNA, 15 nt, Yersinia pestis KIM
acguuuuuuuaaauc

SEQ ID NO: 2324982 - RNA, 13 nt, Yersinia pestis KIM
acguuuuauucac

SEQ ID NO: 2324983 - RNA, 21 nt, Yersinia pestis KIM
acguuguuaucaucaccaccc

SEQ ID NO: 2324984 - RNA, 21 nt, Yersinia pestis KIM
acguuuauuuauaagaacaac

SEQ ID NO: 2324985 - RNA, 18 nt, Yersinia pestis KIM
acguuaucucaaccaguu

SEQ ID NO: 2324986 - RNA, 16 nt, Yersinia pestis KIM
acguuauuauugauua

SEQ ID NO: 2324987 - RNA, 16 nt, Yersinia pestis KIM
acguuaugugccauaa

SEQ ID NO: 2324988 - RNA, 19 nt, Yersinia pestis KIM
acguaauauguauuuagga

SEQ ID NO: 2324989 - RNA, 16 nt, Yersinia pestis KIM
acgucccuaaagccau

SEQ ID NO: 2324990 - RNA, 22 nt, Yersinia pestis KIM
acgugcguuuuugaaauaccac

SEQ ID NO: 2324991 - RNA, 22 nt, Yersinia pestis KIM
acgugcccaaaaacgcuggcca

SEQ ID NO: 2324992 - RNA, 16 nt, Yersinia pestis KIM
acgucucuuccagugg

SEQ ID NO: 2324993 - RNA, 12 nt, Yersinia pestis KIM
acuggcagauag

SEQ ID NO: 2324994 - RNA, 21 nt, Yersinia pestis KIM
acuggcaaaaaaacgccucca

SEQ ID NO: 2324995 - RNA, 17 nt, Yersinia pestis KIM
acuggaugagccgcagc

SEQ ID NO: 2324996 - RNA, 18 nt, Yersinia pestis KIM
acuggaugcgacgcagaa

SEQ ID NO: 2324997 - RNA, 13 nt, Yersinia pestis KIM
acuggccaugugu

SEQ ID NO: 2324998 - RNA, 13 nt, Yersinia pestis KIM
acuggccaacagg

SEQ ID NO: 2324999 - RNA, 16 nt, Yersinia pestis KIM
acuggcagggaaaggu

SEQ ID NO: 2325000 - RNA, 23 nt, Yersinia pestis KIM
acuggcuagauagccauaauaau

SEQ ID NO: 2325001 - RNA, 14 nt, Yersinia pestis KIM
acuggccgcaggcg

SEQ ID NO: 2325002 - RNA, 20 nt, Yersinia pestis KIM
acuggccuauuaagauaauu

SEQ ID NO: 2325003 - RNA, 22 nt, Yersinia pestis KIM
acugguccaacuaaacagggca

SEQ ID NO: 2325004 - RNA, 23 nt, Yersinia pestis KIM
acugguagcagccacaugguuuc

SEQ ID NO: 2325005 - RNA, 18 nt, Yersinia pestis KIM
acuggguuacauccugaa

SEQ ID NO: 2325006 - RNA, 15 nt, Yersinia pestis KIM
acuggcuuuauuaua

SEQ ID NO: 2325007 - RNA, 14 nt, Yersinia pestis KIM
acuggcugaaguua

SEQ ID NO: 2325008 - RNA, 16 nt, Yersinia pestis KIM
acuggcugaaguuaau

SEQ ID NO: 2325009 - RNA, 23 nt, Yersinia pestis KIM
acugggcgcaccggggugaucaa

SEQ ID NO: 2325010 - RNA, 21 nt, Yersinia pestis KIM
acugggucaucacccagcaaa

SEQ ID NO: 2325011 - RNA, 13 nt, Yersinia pestis KIM
acuggaagaaacc

SEQ ID NO: 2325012 - RNA, 15 nt, Yersinia pestis KIM
acuggauauuuuccc

SEQ ID NO: 2325013 - RNA, 12 nt, Yersinia pestis KIM
acugcuuuucua

SEQ ID NO: 2325014 - RNA, 22 nt, Yersinia pestis KIM
acugcuuuaggauuuauuucuc

SEQ ID NO: 2325015 - RNA, 16 nt, Yersinia pestis KIM
acugcugugccagagu

SEQ ID NO: 2325016 - RNA, 21 nt, Yersinia pestis KIM
acugcucaacugcucaacugc

SEQ ID NO: 2325017 - RNA, 20 nt, Yersinia pestis KIM
acugcucaacugcucaacug

SEQ ID NO: 2325018 - RNA, 12 nt, Yersinia pestis KIM
acugcucacugg

SEQ ID NO: 2325019 - RNA, 20 nt, Yersinia pestis KIM
acugcucacuuuuauccagc

SEQ ID NO: 2325020 - RNA, 18 nt, Yersinia pestis KIM
acugcuaauaccaccacc

SEQ ID NO: 2325021 - RNA, 16 nt, Yersinia pestis KIM
acugcgguccuacccu

SEQ ID NO: 2325022 - RNA, 21 nt, Yersinia pestis KIM
acugcugcaacucauuaacaa

SEQ ID NO: 2325023 - RNA, 13 nt, Yersinia pestis KIM
acugcugcacugg

SEQ ID NO: 2325024 - RNA, 12 nt, Yersinia pestis KIM
acugcugacaaa

SEQ ID NO: 2325025 - RNA, 12 nt, Yersinia pestis KIM
acugcugacaac

SEQ ID NO: 2325026 - RNA, 15 nt, Yersinia pestis KIM
acugcucauaaagca

SEQ ID NO: 2325027 - RNA, 20 nt, Yersinia pestis KIM
acuuccgccgccaacaguga

SEQ ID NO: 2325028 - RNA, 23 nt, Yersinia pestis KIM
acuuccgccgccaacagugaaua

SEQ ID NO: 2325029 - RNA, 14 nt, Yersinia pestis KIM
acuucaggccaaua

SEQ ID NO: 2325030 - RNA, 16 nt, Yersinia pestis KIM
acuucaguuacucacu

SEQ ID NO: 2325031 - RNA, 21 nt, Yersinia pestis KIM
acuuccaucugcuuuugaaac

SEQ ID NO: 2325032 - RNA, 16 nt, Yersinia pestis KIM
acuuaucuaaaaaacc

SEQ ID NO: 2325033 - RNA, 13 nt, Yersinia pestis KIM
acuuaucccaacu

SEQ ID NO: 2325034 - RNA, 17 nt, Yersinia pestis KIM
acuuauaucuccaccaa

SEQ ID NO: 2325035 - RNA, 24 nt, Yersinia pestis KIM
acuucaauuuggccauuaaccuaa

SEQ ID NO: 2325036 - RNA, 19 nt, Yersinia pestis KIM
acuucaauaccaaauuuac

SEQ ID NO: 2325037 - RNA, 13 nt, Yersinia pestis KIM
acuucaauaccaa

SEQ ID NO: 2325038 - RNA, 22 nt, Yersinia pestis KIM
acuuaauaaugaccacgcauca

SEQ ID NO: 2325039 - RNA, 17 nt, Yersinia pestis KIM
acuuaacuacugcaagc

SEQ ID NO: 2325040 - RNA, 17 nt, Yersinia pestis KIM
acuuaacugaaagccaa

SEQ ID NO: 2325041 - RNA, 22 nt, Yersinia pestis KIM
acuuaagcauuggcaaaucauc

SEQ ID NO: 2325042 - RNA, 21 nt, Yersinia pestis KIM
acuuaaucgccagugaguccu

SEQ ID NO: 2325043 - RNA, 16 nt, Yersinia pestis KIM
acuuagcucaaucggc

SEQ ID NO: 2325044 - RNA, 14 nt, Yersinia pestis KIM
acuuaaaaaucaaa

SEQ ID NO: 2325045 - RNA, 17 nt, Yersinia pestis KIM
acuguuuuauuauauau

SEQ ID NO: 2325046 - RNA, 20 nt, Yersinia pestis KIM
acuguuuuaugacugauacc

SEQ ID NO: 2325047 - RNA, 23 nt, Yersinia pestis KIM
acuguuuugguuuccgcugacau

SEQ ID NO: 2325048 - RNA, 13 nt, Yersinia pestis KIM
acuguaaaaucuu

SEQ ID NO: 2325049 - RNA, 21 nt, Yersinia pestis KIM
acuguaaacuuguuuauauua

SEQ ID NO: 2325050 - RNA, 15 nt, Yersinia pestis KIM
acugguugaaaccuc

SEQ ID NO: 2325051 - RNA, 17 nt, Yersinia pestis KIM
acugucgcauaagacaa

SEQ ID NO: 2325052 - RNA, 15 nt, Yersinia pestis KIM
acuguucaccgccuu

SEQ ID NO: 2325053 - RNA, 14 nt, Yersinia pestis KIM
acuguuaccgcgcu

SEQ ID NO: 2325054 - RNA, 20 nt, Yersinia pestis KIM
acugucuauuuuuauaauca

SEQ ID NO: 2325055 - RNA, 17 nt, Yersinia pestis KIM
acuguguuuauaccaaa

SEQ ID NO: 2325056 - RNA, 14 nt, Yersinia pestis KIM
acuguuaaaacagg

SEQ ID NO: 2325057 - RNA, 18 nt, Yersinia pestis KIM
acugcgcaaauccugaau

SEQ ID NO: 2325058 - RNA, 17 nt, Yersinia pestis KIM
acugcgcuagaccaguu

SEQ ID NO: 2325059 - RNA, 21 nt, Yersinia pestis KIM
acugcgcuagaccaguuaaua

SEQ ID NO: 2325060 - RNA, 13 nt, Yersinia pestis KIM
acugcauugcguu

SEQ ID NO: 2325061 - RNA, 21 nt, Yersinia pestis KIM
acugcagaaaaugcggcggcu

SEQ ID NO: 2325062 - RNA, 18 nt, Yersinia pestis KIM
acugccccuucaaagccg

SEQ ID NO: 2325063 - RNA, 19 nt, Yersinia pestis KIM
acugcccagguucaaaaua

SEQ ID NO: 2325064 - RNA, 13 nt, Yersinia pestis KIM
acugcccgccugc

SEQ ID NO: 2325065 - RNA, 13 nt, Yersinia pestis KIM
acugccauacauc

SEQ ID NO: 2325066 - RNA, 18 nt, Yersinia pestis KIM
acugccacugacugcuuu

SEQ ID NO: 2325067 - RNA, 14 nt, Yersinia pestis KIM
acugccauaaucca

SEQ ID NO: 2325068 - RNA, 21 nt, Yersinia pestis KIM
acugcaagccguaauucagau

SEQ ID NO: 2325069 - RNA, 19 nt, Yersinia pestis KIM
acugcaaauguucaacaag

SEQ ID NO: 2325070 - RNA, 17 nt, Yersinia pestis KIM
acugauuuaaccgaugc

SEQ ID NO: 2325071 - RNA, 17 nt, Yersinia pestis KIM
acugaucucaucaaaca

SEQ ID NO: 2325072 - RNA, 13 nt, Yersinia pestis KIM
acugauguuuuag

SEQ ID NO: 2325073 - RNA, 13 nt, Yersinia pestis KIM
acugauuaagaaa

SEQ ID NO: 2325074 - RNA, 16 nt, Yersinia pestis KIM
acugauauaaagcauu

SEQ ID NO: 2325075 - RNA, 16 nt, Yersinia pestis KIM
acugauagcaaacaaa

SEQ ID NO: 2325076 - RNA, 19 nt, Yersinia pestis KIM
acugaggcaacauuuguug

SEQ ID NO: 2325077 - RNA, 18 nt, Yersinia pestis KIM
acugaguugggccuugcu

SEQ ID NO: 2325078 - RNA, 13 nt, Yersinia pestis KIM
acugacugaaguu

SEQ ID NO: 2325079 - RNA, 19 nt, Yersinia pestis KIM
acugaaaguagaaauaaaa

SEQ ID NO: 2325080 - RNA, 16 nt, Yersinia pestis KIM
acugaaacguucuucc

SEQ ID NO: 2325081 - RNA, 21 nt, Yersinia pestis KIM
acugagcagguuaaacagcgc

SEQ ID NO: 2325082 - RNA, 20 nt, Yersinia pestis KIM
acugagaccuuccauaacuc

SEQ ID NO: 2325083 - RNA, 22 nt, Yersinia pestis KIM
acugagauuugccaaacgugaa

SEQ ID NO: 2325084 - RNA, 12 nt, Yersinia pestis KIM
acucuuuuuaau

SEQ ID NO: 2325085 - RNA, 12 nt, Yersinia pestis KIM
acucuuuguuac

SEQ ID NO: 2325086 - RNA, 12 nt, Yersinia pestis KIM
acucuguuuuaa

SEQ ID NO: 2325087 - RNA, 20 nt, Yersinia pestis KIM
acucuguagcacauuuaagc

SEQ ID NO: 2325088 - RNA, 21 nt, Yersinia pestis KIM
acucugucugcuguugccaca

SEQ ID NO: 2325089 - RNA, 16 nt, Yersinia pestis KIM
acucuggggcaaucaa

SEQ ID NO: 2325090 - RNA, 21 nt, Yersinia pestis KIM
acucuggcguugccgugcugu

SEQ ID NO: 2325091 - RNA, 21 nt, Yersinia pestis KIM
acucugaacccugcgauuuau

SEQ ID NO: 2325092 - RNA, 22 nt, Yersinia pestis KIM
acucugccagauagucaucuuu

SEQ ID NO: 2325093 - RNA, 19 nt, Yersinia pestis KIM
acucugcuaccaggaagcg

SEQ ID NO: 2325094 - RNA, 23 nt, Yersinia pestis KIM
acucugcgcucauacucagucau

SEQ ID NO: 2325095 - RNA, 15 nt, Yersinia pestis KIM
acucugcuaccagga

SEQ ID NO: 2325096 - RNA, 13 nt, Yersinia pestis KIM
acucggcccaucc

SEQ ID NO: 2325097 - RNA, 12 nt, Yersinia pestis KIM
acucgcuccgag

SEQ ID NO: 2325098 - RNA, 14 nt, Yersinia pestis KIM
acucgaucuugaac

SEQ ID NO: 2325099 - RNA, 12 nt, Yersinia pestis KIM
acucgauaguga

SEQ ID NO: 2325100 - RNA, 17 nt, Yersinia pestis KIM
acucuagcgccagcaau

SEQ ID NO: 2325101 - RNA, 18 nt, Yersinia pestis KIM
acucuagcuguguuuuau

SEQ ID NO: 2325102 - RNA, 23 nt, Yersinia pestis KIM
acucuaaggguaaaauccccauu

SEQ ID NO: 2325103 - RNA, 22 nt, Yersinia pestis KIM
acucuacauugacuaauuaaua

SEQ ID NO: 2325104 - RNA, 21 nt, Yersinia pestis KIM
acuccuuuaccuacaaccugg

SEQ ID NO: 2325105 - RNA, 21 nt, Yersinia pestis KIM
acuccuuuguuauuucuggga

SEQ ID NO: 2325106 - RNA, 14 nt, Yersinia pestis KIM
acuccuugaauauu

SEQ ID NO: 2325107 - RNA, 20 nt, Yersinia pestis KIM
acuccuuggaacuuacuccc

SEQ ID NO: 2325108 - RNA, 19 nt, Yersinia pestis KIM
acuccuugaaguguuuaau

SEQ ID NO: 2325109 - RNA, 22 nt, Yersinia pestis KIM
acuccuugaaguguuuaaucau

SEQ ID NO: 2325110 - RNA, 15 nt, Yersinia pestis KIM
acucgaacaaccggu

SEQ ID NO: 2325111 - RNA, 14 nt, Yersinia pestis KIM
acucgagcauuuga

SEQ ID NO: 2325112 - RNA, 18 nt, Yersinia pestis KIM
acuccucuuucuuaauaa

SEQ ID NO: 2325113 - RNA, 15 nt, Yersinia pestis KIM
acuccugaaauaaag

SEQ ID NO: 2325114 - RNA, 22 nt, Yersinia pestis KIM
acuccugcucaaacuugaucag

SEQ ID NO: 2325115 - RNA, 16 nt, Yersinia pestis KIM
acuccucuuucuuaau

SEQ ID NO: 2325116 - RNA, 15 nt, Yersinia pestis KIM
acuccucugccuauc

SEQ ID NO: 2325117 - RNA, 16 nt, Yersinia pestis KIM
acuccucugccuaucc

SEQ ID NO: 2325118 - RNA, 21 nt, Yersinia pestis KIM
acuccucuucuucgauuuuag

SEQ ID NO: 2325119 - RNA, 14 nt, Yersinia pestis KIM
acuccucugccuau

SEQ ID NO: 2325120 - RNA, 16 nt, Yersinia pestis KIM
acucaaugucaugcaa

SEQ ID NO: 2325121 - RNA, 23 nt, Yersinia pestis KIM
acucaaugucaugcaauuacugc

SEQ ID NO: 2325122 - RNA, 18 nt, Yersinia pestis KIM
acucaaccccagccggug

SEQ ID NO: 2325123 - RNA, 17 nt, Yersinia pestis KIM
acucaagcguacaucag

SEQ ID NO: 2325124 - RNA, 16 nt, Yersinia pestis KIM
agauggccccaauugu

SEQ ID NO: 2325125 - RNA, 21 nt, Yersinia pestis KIM
agauggcagugacauuaccug

SEQ ID NO: 2325126 - RNA, 21 nt, Yersinia pestis KIM
agauggcggucgcacugugag

SEQ ID NO: 2325127 - RNA, 18 nt, Yersinia pestis KIM
agauggcguuuuuaccug

SEQ ID NO: 2325128 - RNA, 20 nt, Yersinia pestis KIM
agaugggaagacagauccug

SEQ ID NO: 2325129 - RNA, 19 nt, Yersinia pestis KIM
agauuaauacaucaucaaa

SEQ ID NO: 2325130 - RNA, 19 nt, Yersinia pestis KIM
agauuacgcaucgucaguu

SEQ ID NO: 2325131 - RNA, 17 nt, Yersinia pestis KIM
agauuacggucaccaau

SEQ ID NO: 2325132 - RNA, 21 nt, Yersinia pestis KIM
agauuaacggcgugcgaacaa

SEQ ID NO: 2325133 - RNA, 13 nt, Yersinia pestis KIM
agaugucagauua

SEQ ID NO: 2325134 - RNA, 15 nt, Yersinia pestis KIM
agauguauccaaggc

SEQ ID NO: 2325135 - RNA, 15 nt, Yersinia pestis KIM
agauuauuauuacua

SEQ ID NO: 2325136 - RNA, 14 nt, Yersinia pestis KIM
agauuauuauuacu

SEQ ID NO: 2325137 - RNA, 22 nt, Yersinia pestis KIM
agauuagagguuauugacaaag

SEQ ID NO: 2325138 - RNA, 21 nt, Yersinia pestis KIM
agauuaguuuuagacgucaga

SEQ ID NO: 2325139 - RNA, 21 nt, Yersinia pestis KIM
agauuagucuuagacgucaga

SEQ ID NO: 2325140 - RNA, 16 nt, Yersinia pestis KIM
agauuauccagcccua

SEQ ID NO: 2325141 - RNA, 14 nt, Yersinia pestis KIM
agauuccuuaccug

SEQ ID NO: 2325142 - RNA, 16 nt, Yersinia pestis KIM
agauucauuagccagc

SEQ ID NO: 2325143 - RNA, 15 nt, Yersinia pestis KIM
agauucaauauuuau

SEQ ID NO: 2325144 - RNA, 18 nt, Yersinia pestis KIM
agauugccgcaaggccau

SEQ ID NO: 2325145 - RNA, 17 nt, Yersinia pestis KIM
agauugaaaaacaacgc

SEQ ID NO: 2325146 - RNA, 14 nt, Yersinia pestis KIM
agauugaacgcugg

SEQ ID NO: 2325147 - RNA, 17 nt, Yersinia pestis KIM
agauccaguucagucca

SEQ ID NO: 2325148 - RNA, 18 nt, Yersinia pestis KIM
agaucccaagcaggaaac

SEQ ID NO: 2325149 - RNA, 22 nt, Yersinia pestis KIM
agaucauguaguacuuaccuuc

SEQ ID NO: 2325150 - RNA, 17 nt, Yersinia pestis KIM
agaucaucgggcauuca

SEQ ID NO: 2325151 - RNA, 19 nt, Yersinia pestis KIM
agaucaucgggcauucacu

SEQ ID NO: 2325152 - RNA, 21 nt, Yersinia pestis KIM
agaucaucgggcauucacugc

SEQ ID NO: 2325153 - RNA, 16 nt, Yersinia pestis KIM
agauccaccacaucau

SEQ ID NO: 2325154 - RNA, 23 nt, Yersinia pestis KIM
agauccgugcgccugaacagccu

SEQ ID NO: 2325155 - RNA, 17 nt, Yersinia pestis KIM
agauccggugaagaauu

SEQ ID NO: 2325156 - RNA, 20 nt, Yersinia pestis KIM
agauccuccauauccucaag

SEQ ID NO: 2325157 - RNA, 15 nt, Yersinia pestis KIM
agauccuuaaagaaa

SEQ ID NO: 2325158 - RNA, 20 nt, Yersinia pestis KIM
agaucccgugugauuuccau

SEQ ID NO: 2325159 - RNA, 14 nt, Yersinia pestis KIM
agaucgcucucacc

SEQ ID NO: 2325160 - RNA, 15 nt, Yersinia pestis KIM
agaucgcucucaccc

SEQ ID NO: 2325161 - RNA, 22 nt, Yersinia pestis KIM
agaucggcauuauuaucuugau

SEQ ID NO: 2325162 - RNA, 12 nt, Yersinia pestis KIM
agaucguaaaga

SEQ ID NO: 2325163 - RNA, 16 nt, Yersinia pestis KIM
agaucucagaauuuuu

SEQ ID NO: 2325164 - RNA, 16 nt, Yersinia pestis KIM
agaucucuguuuucca

SEQ ID NO: 2325165 - RNA, 13 nt, Yersinia pestis KIM
agaugaaugaggg

SEQ ID NO: 2325166 - RNA, 15 nt, Yersinia pestis KIM
agaugaauacgcuuu

SEQ ID NO: 2325167 - RNA, 16 nt, Yersinia pestis KIM
agaugaaggucaccau

SEQ ID NO: 2325168 - RNA, 13 nt, Yersinia pestis KIM
agaugaucaaauu

SEQ ID NO: 2325169 - RNA, 23 nt, Yersinia pestis KIM
agaugccaaucaaaaaaccggcu

SEQ ID NO: 2325170 - RNA, 18 nt, Yersinia pestis KIM
agaugccaaucaaaaaac

SEQ ID NO: 2325171 - RNA, 17 nt, Yersinia pestis KIM
agaucagugccaguaau

SEQ ID NO: 2325172 - RNA, 16 nt, Yersinia pestis KIM
agaucagugccaguaa

SEQ ID NO: 2325173 - RNA, 14 nt, Yersinia pestis KIM
agaucagugccagu

SEQ ID NO: 2325174 - RNA, 15 nt, Yersinia pestis KIM
agaucaguucaguau

SEQ ID NO: 2325175 - RNA, 23 nt, Yersinia pestis KIM
agaucacagacguuuaaauaagc

SEQ ID NO: 2325176 - RNA, 20 nt, Yersinia pestis KIM
agaucaauguuaucgccaac

SEQ ID NO: 2325177 - RNA, 15 nt, Yersinia pestis KIM
agaucaaacauaacc

SEQ ID NO: 2325178 - RNA, 21 nt, Yersinia pestis KIM
agaucaagaaaacgcacgcgg

SEQ ID NO: 2325179 - RNA, 22 nt, Yersinia pestis KIM
agauaugccaggcaucaucugc

SEQ ID NO: 2325180 - RNA, 17 nt, Yersinia pestis KIM
agauaucagcgcaccca

SEQ ID NO: 2325181 - RNA, 15 nt, Yersinia pestis KIM
agauaucuaauuuau

SEQ ID NO: 2325182 - RNA, 15 nt, Yersinia pestis KIM
agauauuacuucuuu

SEQ ID NO: 2325183 - RNA, 21 nt, Yersinia pestis KIM
agauauuuuaccaaugcacgu

SEQ ID NO: 2325184 - RNA, 18 nt, Yersinia pestis KIM
agauaguuaucucccauu

SEQ ID NO: 2325185 - RNA, 21 nt, Yersinia pestis KIM
agauaggcacuaacugcgccu

SEQ ID NO: 2325186 - RNA, 23 nt, Yersinia pestis KIM
agauagcaaucaauaagcuacag

SEQ ID NO: 2325187 - RNA, 15 nt, Yersinia pestis KIM
agauagcaaucaaua

SEQ ID NO: 2325188 - RNA, 14 nt, Yersinia pestis KIM
agauagcaaaagaa

SEQ ID NO: 2325189 - RNA, 22 nt, Yersinia pestis KIM
agauagagcaguaaguuaaaaa

SEQ ID NO: 2325190 - RNA, 16 nt, Yersinia pestis KIM
agauacuggaagaaac

SEQ ID NO: 2325191 - RNA, 22 nt, Yersinia pestis KIM
agauacggcuccagaacaucuu

SEQ ID NO: 2325192 - RNA, 22 nt, Yersinia pestis KIM
agauagaaaucacugaugagcu

SEQ ID NO: 2325193 - RNA, 22 nt, Yersinia pestis KIM
agauagaccccuucuuccagca

SEQ ID NO: 2325194 - RNA, 19 nt, Yersinia pestis KIM
agauacccgccauaaauaa

SEQ ID NO: 2325195 - RNA, 19 nt, Yersinia pestis KIM
agauaccacaucaaaccgg

SEQ ID NO: 2325196 - RNA, 18 nt, Yersinia pestis KIM
agauacccuucucuuuau

SEQ ID NO: 2325197 - RNA, 19 nt, Yersinia pestis KIM
agauacagugcgcaaguau

SEQ ID NO: 2325198 - RNA, 21 nt, Yersinia pestis KIM
agauacaauagauaacugaaa

SEQ ID NO: 2325199 - RNA, 18 nt, Yersinia pestis KIM
agagugaccaaagcagua

SEQ ID NO: 2325200 - RNA, 17 nt, Yersinia pestis KIM
agaguugcucacccauu

SEQ ID NO: 2325201 - RNA, 19 nt, Yersinia pestis KIM
agagcgcaaaagaccaagu

SEQ ID NO: 2325202 - RNA, 14 nt, Yersinia pestis KIM
agagcgacucaaua

SEQ ID NO: 2325203 - RNA, 20 nt, Yersinia pestis KIM
agagcgcggcuucagcaccu

SEQ ID NO: 2325204 - RNA, 18 nt, Yersinia pestis KIM
agagccugaaucugaaug

SEQ ID NO: 2325205 - RNA, 23 nt, Yersinia pestis KIM
agagccucuauuaccucaauacg

SEQ ID NO: 2325206 - RNA, 15 nt, Yersinia pestis KIM
agagcacauuaacac

SEQ ID NO: 2325207 - RNA, 18 nt, Yersinia pestis KIM
agagcacaacggaaggcc

SEQ ID NO: 2325208 - RNA, 16 nt, Yersinia pestis KIM
agagggucacaagaau

SEQ ID NO: 2325209 - RNA, 19 nt, Yersinia pestis KIM
agagucgaugaaacacaac

SEQ ID NO: 2325210 - RNA, 17 nt, Yersinia pestis KIM
agagucgcaaaaaauau

SEQ ID NO: 2325211 - RNA, 18 nt, Yersinia pestis KIM
agagucuauuauauucaa

SEQ ID NO: 2325212 - RNA, 20 nt, Yersinia pestis KIM
agagucugucauggcacgcu

SEQ ID NO: 2325213 - RNA, 18 nt, Yersinia pestis KIM
agagguagacguaucaug

SEQ ID NO: 2325214 - RNA, 16 nt, Yersinia pestis KIM
agagucacagcauuca

SEQ ID NO: 2325215 - RNA, 18 nt, Yersinia pestis KIM
agagauguuauuugaaua

SEQ ID NO: 2325216 - RNA, 22 nt, Yersinia pestis KIM
agagauugccggauuccaccug

SEQ ID NO: 2325217 - RNA, 16 nt, Yersinia pestis KIM
agagcaaaacugggcu

SEQ ID NO: 2325218 - RNA, 20 nt, Yersinia pestis KIM
agagcaaaacugggcuugag

SEQ ID NO: 2325219 - RNA, 13 nt, Yersinia pestis KIM
agagauaauaggu

SEQ ID NO: 2325220 - RNA, 20 nt, Yersinia pestis KIM
agagaucguaggcuuuuuac

SEQ ID NO: 2325221 - RNA, 15 nt, Yersinia pestis KIM
agagaucguaggcuu

SEQ ID NO: 2325222 - RNA, 19 nt, Yersinia pestis KIM
agagaucccgugccagauc

SEQ ID NO: 2325223 - RNA, 17 nt, Yersinia pestis KIM
agagaugaaacccagaa

SEQ ID NO: 2325224 - RNA, 16 nt, Yersinia pestis KIM
agagaugcaaucuaac

SEQ ID NO: 2325225 - RNA, 19 nt, Yersinia pestis KIM
agacuaaacgcuaccauga

SEQ ID NO: 2325226 - RNA, 19 nt, Yersinia pestis KIM
agagacuuuguaccgguuc

SEQ ID NO: 2325227 - RNA, 16 nt, Yersinia pestis KIM
agagagcacauuaaca

SEQ ID NO: 2325228 - RNA, 23 nt, Yersinia pestis KIM
agagagccaaaauggcguuguag

SEQ ID NO: 2325229 - RNA, 17 nt, Yersinia pestis KIM
agagauaaaaaggggcu

SEQ ID NO: 2325230 - RNA, 16 nt, Yersinia pestis KIM
agaaagccggaaaaga

SEQ ID NO: 2325231 - RNA, 14 nt, Yersinia pestis KIM
agaaagccagguga

SEQ ID NO: 2325232 - RNA, 23 nt, Yersinia pestis KIM
agaaaggcggauaaucuaggccu

SEQ ID NO: 2325233 - RNA, 14 nt, Yersinia pestis KIM
agaaaggauuugaa

SEQ ID NO: 2325234 - RNA, 21 nt, Yersinia pestis KIM
agaaaccagcggcagcgccug

SEQ ID NO: 2325235 - RNA, 20 nt, Yersinia pestis KIM
agaaacgccccgauaaacca

SEQ ID NO: 2325236 - RNA, 16 nt, Yersinia pestis KIM
agaaacgauuacccac

SEQ ID NO: 2325237 - RNA, 18 nt, Yersinia pestis KIM
agaaacgauuacccacca

SEQ ID NO: 2325238 - RNA, 20 nt, Yersinia pestis KIM
agaaacggugaaaauaccca

SEQ ID NO: 2325239 - RNA, 20 nt, Yersinia pestis KIM
agaaacggcuauuuuuuuac

SEQ ID NO: 2325240 - RNA, 17 nt, Yersinia pestis KIM
agaaaaucaggauaucu

SEQ ID NO: 2325241 - RNA, 21 nt, Yersinia pestis KIM
acuucgaaagaaauaaaagaa

SEQ ID NO: 2325242 - RNA, 16 nt, Yersinia pestis KIM
acuucgaaagaaauaa

SEQ ID NO: 2325243 - RNA, 13 nt, Yersinia pestis KIM
acuuccuuugccc

SEQ ID NO: 2325244 - RNA, 21 nt, Yersinia pestis KIM
acuuccugccaacaacuuaau

SEQ ID NO: 2325245 - RNA, 23 nt, Yersinia pestis KIM
acuucgcacgcccaucaaggccu

SEQ ID NO: 2325246 - RNA, 21 nt, Yersinia pestis KIM
acuucgccaggucaggaagag

SEQ ID NO: 2325247 - RNA, 13 nt, Yersinia pestis KIM
acuucgcacgccc

SEQ ID NO: 2325248 - RNA, 16 nt, Yersinia pestis KIM
acuucgcugcuaaaca

SEQ ID NO: 2325249 - RNA, 11 nt, Yersinia pestis KIM
acuuuuuguga

SEQ ID NO: 2325250 - RNA, 20 nt, Yersinia pestis KIM
acuuuuuauuucuuuuaaau

SEQ ID NO: 2325251 - RNA, 21 nt, Yersinia pestis KIM
agaacaggcagcaaauaaagc

SEQ ID NO: 2325252 - RNA, 22 nt, Yersinia pestis KIM
agaacaggcagaucguaaagac

SEQ ID NO: 2325253 - RNA, 15 nt, Yersinia pestis KIM
agaacagcuuugcuu

SEQ ID NO: 2325254 - RNA, 21 nt, Yersinia pestis KIM
agaaccaguucugguagcugc

SEQ ID NO: 2325255 - RNA, 17 nt, Yersinia pestis KIM
agaaauuuaaaaacccu

SEQ ID NO: 2325256 - RNA, 15 nt, Yersinia pestis KIM
agaacgucagauaac

SEQ ID NO: 2325257 - RNA, 15 nt, Yersinia pestis KIM
agaacguuaauuuag

SEQ ID NO: 2325258 - RNA, 16 nt, Yersinia pestis KIM
agaacgggggauuaaa

SEQ ID NO: 2325259 - RNA, 15 nt, Yersinia pestis KIM
agaacuaauaucaac

SEQ ID NO: 2325260 - RNA, 20 nt, Yersinia pestis KIM
agaacuaauaucaacagaac

SEQ ID NO: 2325261 - RNA, 19 nt, Yersinia pestis KIM
agaacugauuucaggaaug

SEQ ID NO: 2325262 - RNA, 12 nt, Yersinia pestis KIM
agaacuggcugg

SEQ ID NO: 2325263 - RNA, 15 nt, Yersinia pestis KIM
agaacugauuucagg

SEQ ID NO: 2325264 - RNA, 15 nt, Yersinia pestis KIM
agaaccguaaucuug

SEQ ID NO: 2325265 - RNA, 20 nt, Yersinia pestis KIM
agaacccccgcgaacagcag

SEQ ID NO: 2325266 - RNA, 23 nt, Yersinia pestis KIM
agaacgaacgaagcgugaaagca

SEQ ID NO: 2325267 - RNA, 19 nt, Yersinia pestis KIM
agaacggccugccagaaca

SEQ ID NO: 2325268 - RNA, 21 nt, Yersinia pestis KIM
agacguuuaaauaagcuauca

SEQ ID NO: 2325269 - RNA, 16 nt, Yersinia pestis KIM
agacgucauaaaaagc

SEQ ID NO: 2325270 - RNA, 22 nt, Yersinia pestis KIM
agacgugcguuuuugaaauacc

SEQ ID NO: 2325271 - RNA, 23 nt, Yersinia pestis KIM
agacgagucuauugaaaaaauaa

SEQ ID NO: 2325272 - RNA, 19 nt, Yersinia pestis KIM
agaccugaggauaaaaacu

SEQ ID NO: 2325273 - RNA, 17 nt, Yersinia pestis KIM
agacgaguauuccccac

SEQ ID NO: 2325274 - RNA, 12 nt, Yersinia pestis KIM
agacauaaagcc

SEQ ID NO: 2325275 - RNA, 13 nt, Yersinia pestis KIM
agacauaaagaaa

SEQ ID NO: 2325276 - RNA, 12 nt, Yersinia pestis KIM
agacauaaugcc

SEQ ID NO: 2325277 - RNA, 12 nt, Yersinia pestis KIM
agaccagauaau

SEQ ID NO: 2325278 - RNA, 16 nt, Yersinia pestis KIM
agaccagauaaucgcc

SEQ ID NO: 2325279 - RNA, 20 nt, Yersinia pestis KIM
agacauauuguccaacaucu

SEQ ID NO: 2325280 - RNA, 13 nt, Yersinia pestis KIM
agaccaccaacuc

SEQ ID NO: 2325281 - RNA, 13 nt, Yersinia pestis KIM
agaauuucauugu

SEQ ID NO: 2325282 - RNA, 16 nt, Yersinia pestis KIM
agaauuuaccuccaua

SEQ ID NO: 2325283 - RNA, 22 nt, Yersinia pestis KIM
agaauugugccccaagaagaga

SEQ ID NO: 2325284 - RNA, 18 nt, Yersinia pestis KIM
agaauugcagaacagauu

SEQ ID NO: 2325285 - RNA, 21 nt, Yersinia pestis KIM
agaauugcagauaccacauca

SEQ ID NO: 2325286 - RNA, 20 nt, Yersinia pestis KIM
agacaacugacaacaucaaa

SEQ ID NO: 2325287 - RNA, 18 nt, Yersinia pestis KIM
agacaacucuucuaucuu

SEQ ID NO: 2325288 - RNA, 23 nt, Yersinia pestis KIM
agacacuaaccagacgcaaccaa

SEQ ID NO: 2325289 - RNA, 17 nt, Yersinia pestis KIM
agacacugacaucauca

SEQ ID NO: 2325290 - RNA, 23 nt, Yersinia pestis KIM
agaauucgcgucuuacugccuga

SEQ ID NO: 2325291 - RNA, 16 nt, Yersinia pestis KIM
agaauauuuacgguga

SEQ ID NO: 2325292 - RNA, 13 nt, Yersinia pestis KIM
agaauagcaaccu

SEQ ID NO: 2325293 - RNA, 21 nt, Yersinia pestis KIM
agaauacuguguggaucacau

SEQ ID NO: 2325294 - RNA, 17 nt, Yersinia pestis KIM
agaauacuucaggccaa

SEQ ID NO: 2325295 - RNA, 16 nt, Yersinia pestis KIM
agaaucaaugggauau

SEQ ID NO: 2325296 - RNA, 19 nt, Yersinia pestis KIM
agaaucaccaacaccacca

SEQ ID NO: 2325297 - RNA, 17 nt, Yersinia pestis KIM
agaaucaccgaaagaag

SEQ ID NO: 2325298 - RNA, 21 nt, Yersinia pestis KIM
agaaucccaucaaacgugaaa

SEQ ID NO: 2325299 - RNA, 15 nt, Yersinia pestis KIM
agaaucggccagugc

SEQ ID NO: 2325300 - RNA, 14 nt, Yersinia pestis KIM
agaagaauaucugc

SEQ ID NO: 2325301 - RNA, 20 nt, Yersinia pestis KIM
agaagaauugcagauaccac

SEQ ID NO: 2325302 - RNA, 20 nt, Yersinia pestis KIM
agaagacaauaaaucgccac

SEQ ID NO: 2325303 - RNA, 21 nt, Yersinia pestis KIM
agaagcguaaagcacccacac

SEQ ID NO: 2325304 - RNA, 15 nt, Yersinia pestis KIM
agaaguagaaugaga

SEQ ID NO: 2325305 - RNA, 22 nt, Yersinia pestis KIM
agaagcucauaugcagcaucca

SEQ ID NO: 2325306 - RNA, 15 nt, Yersinia pestis KIM
agaagcuaccagcac

SEQ ID NO: 2325307 - RNA, 14 nt, Yersinia pestis KIM
acaucugcuuuacu

SEQ ID NO: 2325308 - RNA, 21 nt, Yersinia pestis KIM
acaucugcuuuacugcuuuuc

SEQ ID NO: 2325309 - RNA, 19 nt, Yersinia pestis KIM
acaucuccugguucacucu

SEQ ID NO: 2325310 - RNA, 14 nt, Yersinia pestis KIM
acaucuuacugaua

SEQ ID NO: 2325311 - RNA, 15 nt, Yersinia pestis KIM
acaucguuguauguu

SEQ ID NO: 2325312 - RNA, 14 nt, Yersinia pestis KIM
acaugacugaacau

SEQ ID NO: 2325313 - RNA, 13 nt, Yersinia pestis KIM
acaugagauggca

SEQ ID NO: 2325314 - RNA, 16 nt, Yersinia pestis KIM
acaugaugaaugcgaa

SEQ ID NO: 2325315 - RNA, 11 nt, Yersinia pestis KIM
acaugcagcau

SEQ ID NO: 2325316 - RNA, 20 nt, Yersinia pestis KIM
acaugcaccguaacuucuuc

SEQ ID NO: 2325317 - RNA, 16 nt, Yersinia pestis KIM
acaugcugaagccagc

SEQ ID NO: 2325318 - RNA, 18 nt, Yersinia pestis KIM
acaugccacauagcguca

SEQ ID NO: 2325319 - RNA, 13 nt, Yersinia pestis KIM
acaugcuguucac

SEQ ID NO: 2325320 - RNA, 22 nt, Yersinia pestis KIM
acauauuggucauuuuucccuu

SEQ ID NO: 2325321 - RNA, 15 nt, Yersinia pestis KIM
acauauugguaauuu

SEQ ID NO: 2325322 - RNA, 14 nt, Yersinia pestis KIM
acaucaaaccggcu

SEQ ID NO: 2325323 - RNA, 14 nt, Yersinia pestis KIM
acauauucacuaua

SEQ ID NO: 2325324 - RNA, 14 nt, Yersinia pestis KIM
acauccaauucagu

SEQ ID NO: 2325325 - RNA, 13 nt, Yersinia pestis KIM
acaucgacaccaa

SEQ ID NO: 2325326 - RNA, 23 nt, Yersinia pestis KIM
acaucacgcagcgcuugcuggua

SEQ ID NO: 2325327 - RNA, 23 nt, Yersinia pestis KIM
acaggcucuaucucuucagggcg

SEQ ID NO: 2325328 - RNA, 20 nt, Yersinia pestis KIM
acaggcucagcacaaacaug

SEQ ID NO: 2325329 - RNA, 23 nt, Yersinia pestis KIM
acaggcggguucuucagccgcuc

SEQ ID NO: 2325330 - RNA, 13 nt, Yersinia pestis KIM
acagggcagaaaa

SEQ ID NO: 2325331 - RNA, 14 nt, Yersinia pestis KIM
acagggcagaaaau

SEQ ID NO: 2325332 - RNA, 16 nt, Yersinia pestis KIM
acaggcuuucaggacu

SEQ ID NO: 2325333 - RNA, 19 nt, Yersinia pestis KIM
acaggcuggauugauuuuu

SEQ ID NO: 2325334 - RNA, 18 nt, Yersinia pestis KIM
acagguauucuccaguug

SEQ ID NO: 2325335 - RNA, 16 nt, Yersinia pestis KIM
acaggugucaucaagg

SEQ ID NO: 2325336 - RNA, 15 nt, Yersinia pestis KIM
acaguaaauucuuua

SEQ ID NO: 2325337 - RNA, 16 nt, Yersinia pestis KIM
acagguucccaucccu

SEQ ID NO: 2325338 - RNA, 17 nt, Yersinia pestis KIM
acaguacaaaaaacaaa

SEQ ID NO: 2325339 - RNA, 15 nt, Yersinia pestis KIM
acaguaauuaaguug

SEQ ID NO: 2325340 - RNA, 19 nt, Yersinia pestis KIM
acaguaagguauugacaca

SEQ ID NO: 2325341 - RNA, 15 nt, Yersinia pestis KIM
acaguacugccaacc

SEQ ID NO: 2325342 - RNA, 17 nt, Yersinia pestis KIM
acaguacugccaaccac

SEQ ID NO: 2325343 - RNA, 18 nt, Yersinia pestis KIM
acaguaucaaccaccgcu

SEQ ID NO: 2325344 - RNA, 21 nt, Yersinia pestis KIM
acaguaggcugaaggccugcu

SEQ ID NO: 2325345 - RNA, 15 nt, Yersinia pestis KIM
acauaaauaaguuca

SEQ ID NO: 2325346 - RNA, 13 nt, Yersinia pestis KIM
acauaaacacgca

SEQ ID NO: 2325347 - RNA, 13 nt, Yersinia pestis KIM
acauaaucaaucc

SEQ ID NO: 2325348 - RNA, 18 nt, Yersinia pestis KIM
acaguugugucagaccaa

SEQ ID NO: 2325349 - RNA, 21 nt, Yersinia pestis KIM
acaguuauuuuaauugcugau

SEQ ID NO: 2325350 - RNA, 22 nt, Yersinia pestis KIM
acaguucauaucgauaccgaua

SEQ ID NO: 2325351 - RNA, 16 nt, Yersinia pestis KIM
acaguugauauuauua

SEQ ID NO: 2325352 - RNA, 17 nt, Yersinia pestis KIM
acaguugauauuauuau

SEQ ID NO: 2325353 - RNA, 14 nt, Yersinia pestis KIM
acaguuauuaggca

SEQ ID NO: 2325354 - RNA, 12 nt, Yersinia pestis KIM
acaguguugacc

SEQ ID NO: 2325355 - RNA, 20 nt, Yersinia pestis KIM
acagugcaacauuaaaaaua

SEQ ID NO: 2325356 - RNA, 16 nt, Yersinia pestis KIM
acagugccaacagcga

SEQ ID NO: 2325357 - RNA, 17 nt, Yersinia pestis KIM
acagugccaaaagaccg

SEQ ID NO: 2325358 - RNA, 22 nt, Yersinia pestis KIM
acaguguaaaaagcgaucgacc

SEQ ID NO: 2325359 - RNA, 18 nt, Yersinia pestis KIM
acagucggcauagcuaau

SEQ ID NO: 2325360 - RNA, 18 nt, Yersinia pestis KIM
acagucuuauuacucauu

SEQ ID NO: 2325361 - RNA, 18 nt, Yersinia pestis KIM
acagucugucguacuuuc

SEQ ID NO: 2325362 - RNA, 12 nt, Yersinia pestis KIM
acagucauuuac

SEQ ID NO: 2325363 - RNA, 15 nt, Yersinia pestis KIM
acagucaauugagaa

SEQ ID NO: 2325364 - RNA, 18 nt, Yersinia pestis KIM
acagucaauugagaauaa

SEQ ID NO: 2325365 - RNA, 14 nt, Yersinia pestis KIM
acaggaucugcucc

SEQ ID NO: 2325366 - RNA, 12 nt, Yersinia pestis KIM
acaggauuaaau

SEQ ID NO: 2325367 - RNA, 22 nt, Yersinia pestis KIM
acagcucagacuggccagaagg

SEQ ID NO: 2325368 - RNA, 12 nt, Yersinia pestis KIM
acagcucacucg

SEQ ID NO: 2325369 - RNA, 13 nt, Yersinia pestis KIM
acagcuuugcuuc

SEQ ID NO: 2325370 - RNA, 23 nt, Yersinia pestis KIM
acagcuuaaaaucuguaauuaau

SEQ ID NO: 2325371 - RNA, 15 nt, Yersinia pestis KIM
acagccguguagcau

SEQ ID NO: 2325372 - RNA, 20 nt, Yersinia pestis KIM
acagccgcugaauuaacaua

SEQ ID NO: 2325373 - RNA, 20 nt, Yersinia pestis KIM
acagcgagaaucuugauuug

SEQ ID NO: 2325374 - RNA, 23 nt, Yersinia pestis KIM
acagccguguagcauggcuuuau

SEQ ID NO: 2325375 - RNA, 21 nt, Yersinia pestis KIM
acagccguauaucuuaccuuc

SEQ ID NO: 2325376 - RNA, 20 nt, Yersinia pestis KIM
acagccuauggcgguuccaa

SEQ ID NO: 2325377 - RNA, 16 nt, Yersinia pestis KIM
acagcgcgcagccaac

SEQ ID NO: 2325378 - RNA, 21 nt, Yersinia pestis KIM
acagcgcuuuuuuaacgucca

SEQ ID NO: 2325379 - RNA, 15 nt, Yersinia pestis KIM
acagcgccucaguau

SEQ ID NO: 2325380 - RNA, 19 nt, Yersinia pestis KIM
acagcgcccgugguugaga

SEQ ID NO: 2325381 - RNA, 14 nt, Yersinia pestis KIM
acagcguauucacg

SEQ ID NO: 2325382 - RNA, 17 nt, Yersinia pestis KIM
acagcuaacacuggcuu

SEQ ID NO: 2325383 - RNA, 15 nt, Yersinia pestis KIM
acacugacaucauca

SEQ ID NO: 2325384 - RNA, 14 nt, Yersinia pestis KIM
acacugacauuuau

SEQ ID NO: 2325385 - RNA, 20 nt, Yersinia pestis KIM
acacugagcaccgcaggaac

SEQ ID NO: 2325386 - RNA, 15 nt, Yersinia pestis KIM
acacugcaucucugc

SEQ ID NO: 2325387 - RNA, 20 nt, Yersinia pestis KIM
acacuggaugcgacgcagaa

SEQ ID NO: 2325388 - RNA, 14 nt, Yersinia pestis KIM
aauuucagucaaua

SEQ ID NO: 2325389 - RNA, 11 nt, Yersinia pestis KIM
aauuucaguaa

SEQ ID NO: 2325390 - RNA, 22 nt, Yersinia pestis KIM
aauuucaggucgauuacauacu

SEQ ID NO: 2325391 - RNA, 13 nt, Yersinia pestis KIM
aauuucacuggca

SEQ ID NO: 2325392 - RNA, 16 nt, Yersinia pestis KIM
aauuucagauaaaaau

SEQ ID NO: 2325393 - RNA, 19 nt, Yersinia pestis KIM
aauuucagcagcacguuca

SEQ ID NO: 2325394 - RNA, 20 nt, Yersinia pestis KIM
acagacauuugcaacuuccu

SEQ ID NO: 2325395 - RNA, 22 nt, Yersinia pestis KIM
acacuucgccgggucaggaaga

SEQ ID NO: 2325396 - RNA, 21 nt, Yersinia pestis KIM
acacuuaauugguuuauaaca

SEQ ID NO: 2325397 - RNA, 15 nt, Yersinia pestis KIM
acacuugcucuacca

SEQ ID NO: 2325398 - RNA, 15 nt, Yersinia pestis KIM
acagagcagaaagca

SEQ ID NO: 2325399 - RNA, 21 nt, Yersinia pestis KIM
acagagcagaaagcagcagcu

SEQ ID NO: 2325400 - RNA, 18 nt, Yersinia pestis KIM
acagagcagaaagcagca

SEQ ID NO: 2325401 - RNA, 23 nt, Yersinia pestis KIM
acagcaaugcaccgacaaagaua

SEQ ID NO: 2325402 - RNA, 21 nt, Yersinia pestis KIM
acagcaaugcaccgacaaaga

SEQ ID NO: 2325403 - RNA, 19 nt, Yersinia pestis KIM
acagauuauuucagcuuca

SEQ ID NO: 2325404 - RNA, 16 nt, Yersinia pestis KIM
acagauucaauauuua

SEQ ID NO: 2325405 - RNA, 14 nt, Yersinia pestis KIM
acagauugcaggaa

SEQ ID NO: 2325406 - RNA, 12 nt, Yersinia pestis KIM
acagccagccuu

SEQ ID NO: 2325407 - RNA, 17 nt, Yersinia pestis KIM
acagccaucacccgaua

SEQ ID NO: 2325408 - RNA, 13 nt, Yersinia pestis KIM
acagccaccagcc

SEQ ID NO: 2325409 - RNA, 23 nt, Yersinia pestis KIM
acagccacgauuaucucuuacau

SEQ ID NO: 2325410 - RNA, 13 nt, Yersinia pestis KIM
acagcagaacaaa

SEQ ID NO: 2325411 - RNA, 18 nt, Yersinia pestis KIM
acagcagaacaaaacaag

SEQ ID NO: 2325412 - RNA, 19 nt, Yersinia pestis KIM
acagcagaacaaaacaagc

SEQ ID NO: 2325413 - RNA, 22 nt, Yersinia pestis KIM
acccaacaguaccuucuaucgu

SEQ ID NO: 2325414 - RNA, 15 nt, Yersinia pestis KIM
acccaaccccaucag

SEQ ID NO: 2325415 - RNA, 16 nt, Yersinia pestis KIM
acccaauggcaacaaa

SEQ ID NO: 2325416 - RNA, 18 nt, Yersinia pestis KIM
acccaauggcaacaaaau

SEQ ID NO: 2325417 - RNA, 19 nt, Yersinia pestis KIM
acccaagggcuauugcugu

SEQ ID NO: 2325418 - RNA, 15 nt, Yersinia pestis KIM
acccacuugcaacau

SEQ ID NO: 2325419 - RNA, 18 nt, Yersinia pestis KIM
acccaccagagaccacag

SEQ ID NO: 2325420 - RNA, 17 nt, Yersinia pestis KIM
acccacaccgcagcagu

SEQ ID NO: 2325421 - RNA, 20 nt, Yersinia pestis KIM
acccacaccgcagcagugcg

SEQ ID NO: 2325422 - RNA, 18 nt, Yersinia pestis KIM
accauuacuucuacucug

SEQ ID NO: 2325423 - RNA, 21 nt, Yersinia pestis KIM
accaucagacaggauaaucau

SEQ ID NO: 2325424 - RNA, 14 nt, Yersinia pestis KIM
accaucauugaguu

SEQ ID NO: 2325425 - RNA, 19 nt, Yersinia pestis KIM
accaucauugaguuuguca

SEQ ID NO: 2325426 - RNA, 12 nt, Yersinia pestis KIM
accauccagugc

SEQ ID NO: 2325427 - RNA, 15 nt, Yersinia pestis KIM
accauucucaaaaua

SEQ ID NO: 2325428 - RNA, 12 nt, Yersinia pestis KIM
accauugaccag

SEQ ID NO: 2325429 - RNA, 16 nt, Yersinia pestis KIM
accauugauaauaaua

SEQ ID NO: 2325430 - RNA, 15 nt, Yersinia pestis KIM
accauugguaauaau

SEQ ID NO: 2325431 - RNA, 21 nt, Yersinia pestis KIM
acccagccguggaucauggcu

SEQ ID NO: 2325432 - RNA, 19 nt, Yersinia pestis KIM
acccagcgaacguaaaaag

SEQ ID NO: 2325433 - RNA, 12 nt, Yersinia pestis KIM
acccagcaaaau

SEQ ID NO: 2325434 - RNA, 22 nt, Yersinia pestis KIM
acccagacaagaaugccugccg

SEQ ID NO: 2325435 - RNA, 23 nt, Yersinia pestis KIM
accccaauucuuaggucaucguc

SEQ ID NO: 2325436 - RNA, 19 nt, Yersinia pestis KIM
accccacaaccugcgccac

SEQ ID NO: 2325437 - RNA, 17 nt, Yersinia pestis KIM
accccacguaauuauug

SEQ ID NO: 2325438 - RNA, 12 nt, Yersinia pestis KIM
accccagaagau

SEQ ID NO: 2325439 - RNA, 13 nt, Yersinia pestis KIM
accccaccucuua

SEQ ID NO: 2325440 - RNA, 16 nt, Yersinia pestis KIM
acccagcgguugaggc

SEQ ID NO: 2325441 - RNA, 19 nt, Yersinia pestis KIM
acccccaacccaaggagau

SEQ ID NO: 2325442 - RNA, 14 nt, Yersinia pestis KIM
accccauugcacca

SEQ ID NO: 2325443 - RNA, 21 nt, Yersinia pestis KIM
accaggccacggccgccuuca

SEQ ID NO: 2325444 - RNA, 16 nt, Yersinia pestis KIM
accagcgcacugaaua

SEQ ID NO: 2325445 - RNA, 21 nt, Yersinia pestis KIM
accaggcgcuauuccgcgccu

SEQ ID NO: 2325446 - RNA, 19 nt, Yersinia pestis KIM
accaguaaacgccaaucac

SEQ ID NO: 2325447 - RNA, 15 nt, Yersinia pestis KIM
accaguaacugauca

SEQ ID NO: 2325448 - RNA, 15 nt, Yersinia pestis KIM
accaguaaacgccaa

SEQ ID NO: 2325449 - RNA, 17 nt, Yersinia pestis KIM
accagguauuucuccau

SEQ ID NO: 2325450 - RNA, 14 nt, Yersinia pestis KIM
accaguguugggcu

SEQ ID NO: 2325451 - RNA, 18 nt, Yersinia pestis KIM
accaguggugcucccgca

SEQ ID NO: 2325452 - RNA, 19 nt, Yersinia pestis KIM
accagugccaauccccacc

SEQ ID NO: 2325453 - RNA, 13 nt, Yersinia pestis KIM
accaguucuggua

SEQ ID NO: 2325454 - RNA, 21 nt, Yersinia pestis KIM
accaguucugguagcugcuca

SEQ ID NO: 2325455 - RNA, 22 nt, Yersinia pestis KIM
accaguucgcgugcgcccggua

SEQ ID NO: 2325456 - RNA, 19 nt, Yersinia pestis KIM
accagugaauaaguucugc

SEQ ID NO: 2325457 - RNA, 17 nt, Yersinia pestis KIM
accagugccgcccagcg

SEQ ID NO: 2325458 - RNA, 13 nt, Yersinia pestis KIM
accagucugcaua

SEQ ID NO: 2325459 - RNA, 14 nt, Yersinia pestis KIM
accaguaagugauu

SEQ ID NO: 2325460 - RNA, 15 nt, Yersinia pestis KIM
accagucagccuuaa

SEQ ID NO: 2325461 - RNA, 14 nt, Yersinia pestis KIM
accauaacgcugcu

SEQ ID NO: 2325462 - RNA, 17 nt, Yersinia pestis KIM
accauaaggccaggcaa

SEQ ID NO: 2325463 - RNA, 22 nt, Yersinia pestis KIM
accauaaaauaaauaauuugua

SEQ ID NO: 2325464 - RNA, 14 nt, Yersinia pestis KIM
accauaaaaggaug

SEQ ID NO: 2325465 - RNA, 22 nt, Yersinia pestis KIM
accauaucagaaccaagcaaua

SEQ ID NO: 2325466 - RNA, 13 nt, Yersinia pestis KIM
accauaucagcgc

SEQ ID NO: 2325467 - RNA, 14 nt, Yersinia pestis KIM
accauaucagaacc

SEQ ID NO: 2325468 - RNA, 13 nt, Yersinia pestis KIM
accauagagcaac

SEQ ID NO: 2325469 - RNA, 21 nt, Yersinia pestis KIM
accauagagcaaccguuacaa

SEQ ID NO: 2325470 - RNA, 11 nt, Yersinia pestis KIM
accaccaacuc

SEQ ID NO: 2325471 - RNA, 19 nt, Yersinia pestis KIM
accaccaacuccugccuac

SEQ ID NO: 2325472 - RNA, 13 nt, Yersinia pestis KIM
accaccacugcau

SEQ ID NO: 2325473 - RNA, 12 nt, Yersinia pestis KIM
accaccagaggu

SEQ ID NO: 2325474 - RNA, 17 nt, Yersinia pestis KIM
accacccguugcauuuu

SEQ ID NO: 2325475 - RNA, 19 nt, Yersinia pestis KIM
accaccgccgcaacaauaa

SEQ ID NO: 2325476 - RNA, 14 nt, Yersinia pestis KIM
accacgguaaugaa

SEQ ID NO: 2325477 - RNA, 16 nt, Yersinia pestis KIM
accacugauaggucau

SEQ ID NO: 2325478 - RNA, 16 nt, Yersinia pestis KIM
accaccuuuaccaugc

SEQ ID NO: 2325479 - RNA, 19 nt, Yersinia pestis KIM
accacgaaaaaauggcagc

SEQ ID NO: 2325480 - RNA, 21 nt, Yersinia pestis KIM
accacugccacacuuuugcug

SEQ ID NO: 2325481 - RNA, 12 nt, Yersinia pestis KIM
accagaauaauc

SEQ ID NO: 2325482 - RNA, 14 nt, Yersinia pestis KIM
accagaauaaucca

SEQ ID NO: 2325483 - RNA, 20 nt, Yersinia pestis KIM
accagaaauaacguaacgac

SEQ ID NO: 2325484 - RNA, 22 nt, Yersinia pestis KIM
accagacucugcuaccaggaag

SEQ ID NO: 2325485 - RNA, 15 nt, Yersinia pestis KIM
accagcaucaguagc

SEQ ID NO: 2325486 - RNA, 17 nt, Yersinia pestis KIM
accagcauccugcaaau

SEQ ID NO: 2325487 - RNA, 21 nt, Yersinia pestis KIM
accagauagcuguuagccaga

SEQ ID NO: 2325488 - RNA, 14 nt, Yersinia pestis KIM
accaacgaaaucac

SEQ ID NO: 2325489 - RNA, 22 nt, Yersinia pestis KIM
accaaccuugggggaccagcac

SEQ ID NO: 2325490 - RNA, 19 nt, Yersinia pestis KIM
accaaccguagucgcacca

SEQ ID NO: 2325491 - RNA, 16 nt, Yersinia pestis KIM
accaaggcucuggcaa

SEQ ID NO: 2325492 - RNA, 15 nt, Yersinia pestis KIM
accaaggaaaccacc

SEQ ID NO: 2325493 - RNA, 18 nt, Yersinia pestis KIM
accaaggaaaccaccuaa

SEQ ID NO: 2325494 - RNA, 13 nt, Yersinia pestis KIM
accaagaaaaccc

SEQ ID NO: 2325495 - RNA, 15 nt, Yersinia pestis KIM
accaccaacagcauu

SEQ ID NO: 2325496 - RNA, 23 nt, Yersinia pestis KIM
accaauuugccauaccaggccac

SEQ ID NO: 2325497 - RNA, 12 nt, Yersinia pestis KIM
accaauucaguu

SEQ ID NO: 2325498 - RNA, 14 nt, Yersinia pestis KIM
accaauucaucagc

SEQ ID NO: 2325499 - RNA, 15 nt, Yersinia pestis KIM
accaauucaucagcg

SEQ ID NO: 2325500 - RNA, 14 nt, Yersinia pestis KIM
accaauccaugcca

SEQ ID NO: 2325501 - RNA, 15 nt, Yersinia pestis KIM
accaaucaauacacu

SEQ ID NO: 2325502 - RNA, 23 nt, Yersinia pestis KIM
accaauauugcggauucacccau

SEQ ID NO: 2325503 - RNA, 15 nt, Yersinia pestis KIM
accaauaucauaaua

SEQ ID NO: 2325504 - RNA, 22 nt, Yersinia pestis KIM
accaaagcaacagccauauuuu

SEQ ID NO: 2325505 - RNA, 11 nt, Yersinia pestis KIM
accaaagcagu

SEQ ID NO: 2325506 - RNA, 21 nt, Yersinia pestis KIM
accaaagcguacucuucugua

SEQ ID NO: 2325507 - RNA, 17 nt, Yersinia pestis KIM
accaaaggcuauuuaag

SEQ ID NO: 2325508 - RNA, 17 nt, Yersinia pestis KIM
accaacaguuugguaau

SEQ ID NO: 2325509 - RNA, 20 nt, Yersinia pestis KIM
accaacaugagccacacauu

SEQ ID NO: 2325510 - RNA, 15 nt, Yersinia pestis KIM
accaacaguuauuuu

SEQ ID NO: 2325511 - RNA, 13 nt, Yersinia pestis KIM
accaacagacgcc

SEQ ID NO: 2325512 - RNA, 12 nt, Yersinia pestis KIM
accaaauauuac

SEQ ID NO: 2325513 - RNA, 20 nt, Yersinia pestis KIM
accaacacuccucuuucuua

SEQ ID NO: 2325514 - RNA, 23 nt, Yersinia pestis KIM
accaaauagcaagccaaaacagc

SEQ ID NO: 2325515 - RNA, 14 nt, Yersinia pestis KIM
accaaaaacuucau

SEQ ID NO: 2325516 - RNA, 15 nt, Yersinia pestis KIM
accaaaaaucuuguu

SEQ ID NO: 2325517 - RNA, 22 nt, Yersinia pestis KIM
accaaaaaucuuguuaauuuaa

SEQ ID NO: 2325518 - RNA, 18 nt, Yersinia pestis KIM
acaugggcaagcucuggg

SEQ ID NO: 2325519 - RNA, 18 nt, Yersinia pestis KIM
acauggcucucuuuuuuc

SEQ ID NO: 2325520 - RNA, 17 nt, Yersinia pestis KIM
acauggcaacgacuggg

SEQ ID NO: 2325521 - RNA, 13 nt, Yersinia pestis KIM
acaugggcagugc

SEQ ID NO: 2325522 - RNA, 22 nt, Yersinia pestis KIM
acaugguccacagucaguucau

SEQ ID NO: 2325523 - RNA, 22 nt, Yersinia pestis KIM
acaugugcguuggcuaugcgca

SEQ ID NO: 2325524 - RNA, 17 nt, Yersinia pestis KIM
acauuuaaacacucaau

SEQ ID NO: 2325525 - RNA, 22 nt, Yersinia pestis KIM
acauuuacuuauaaacacugau

SEQ ID NO: 2325526 - RNA, 18 nt, Yersinia pestis KIM
acauuuagcacuguucac

SEQ ID NO: 2325527 - RNA, 13 nt, Yersinia pestis KIM
acgaucgauagua

SEQ ID NO: 2325528 - RNA, 19 nt, Yersinia pestis KIM
acgaucagugaagagauaa

SEQ ID NO: 2325529 - RNA, 14 nt, Yersinia pestis KIM
acgaucacugcuuu

SEQ ID NO: 2325530 - RNA, 15 nt, Yersinia pestis KIM
acgaucaaccauggc

SEQ ID NO: 2325531 - RNA, 13 nt, Yersinia pestis KIM
acgauauuuuuau

SEQ ID NO: 2325532 - RNA, 18 nt, Yersinia pestis KIM
acgauauuuuuauuaaua

SEQ ID NO: 2325533 - RNA, 16 nt, Yersinia pestis KIM
acgauaauuugcagcc

SEQ ID NO: 2325534 - RNA, 18 nt, Yersinia pestis KIM
acgauacgacuucuuauu

SEQ ID NO: 2325535 - RNA, 16 nt, Yersinia pestis KIM
acgauaagaauauuua

SEQ ID NO: 2325536 - RNA, 16 nt, Yersinia pestis KIM
acgauaagaaugaaua

SEQ ID NO: 2325537 - RNA, 22 nt, Yersinia pestis KIM
acgauaacuuuuggcagcacca

SEQ ID NO: 2325538 - RNA, 13 nt, Yersinia pestis KIM
acgauaucaccag

SEQ ID NO: 2325539 - RNA, 16 nt, Yersinia pestis KIM
acgauagccagugaca

SEQ ID NO: 2325540 - RNA, 14 nt, Yersinia pestis KIM
acgauaaaggcggu

SEQ ID NO: 2325541 - RNA, 14 nt, Yersinia pestis KIM
acgaguaaugaaau

SEQ ID NO: 2325542 - RNA, 16 nt, Yersinia pestis KIM
acgaguaaauagcaaa

SEQ ID NO: 2325543 - RNA, 20 nt, Yersinia pestis KIM
acgaguaaaaagauggccuc

SEQ ID NO: 2325544 - RNA, 15 nt, Yersinia pestis KIM
acgauuaccugcaua

SEQ ID NO: 2325545 - RNA, 17 nt, Yersinia pestis KIM
acgauuaccugcauauc

SEQ ID NO: 2325546 - RNA, 17 nt, Yersinia pestis KIM
acgauuacccaccaccu

SEQ ID NO: 2325547 - RNA, 21 nt, Yersinia pestis KIM
acgcaaauaaagggccugcaa

SEQ ID NO: 2325548 - RNA, 17 nt, Yersinia pestis KIM
acgcaaagggcaacaau

SEQ ID NO: 2325549 - RNA, 20 nt, Yersinia pestis KIM
acgcaaagggcaacaauaua

SEQ ID NO: 2325550 - RNA, 22 nt, Yersinia pestis KIM
acgcaaaccccgaaccaaaaua

SEQ ID NO: 2325551 - RNA, 20 nt, Yersinia pestis KIM
acgauggaguggucaugcuc

SEQ ID NO: 2325552 - RNA, 16 nt, Yersinia pestis KIM
acgaugccgauaaaga

SEQ ID NO: 2325553 - RNA, 19 nt, Yersinia pestis KIM
acgaucugccuguucucuc

SEQ ID NO: 2325554 - RNA, 20 nt, Yersinia pestis KIM
acgaucugccuguucucucc

SEQ ID NO: 2325555 - RNA, 18 nt, Yersinia pestis KIM
acgaucuugcccaaugcc

SEQ ID NO: 2325556 - RNA, 18 nt, Yersinia pestis KIM
acgacccacucguucuca

SEQ ID NO: 2325557 - RNA, 22 nt, Yersinia pestis KIM
acgacccacucguucucaacca

SEQ ID NO: 2325558 - RNA, 17 nt, Yersinia pestis KIM
acgacgaaauagcgccu

SEQ ID NO: 2325559 - RNA, 17 nt, Yersinia pestis KIM
acgaccaguaagugauu

SEQ ID NO: 2325560 - RNA, 23 nt, Yersinia pestis KIM
acgagaucauuggcuaucacaca

SEQ ID NO: 2325561 - RNA, 14 nt, Yersinia pestis KIM
acgacgcccgcaga

SEQ ID NO: 2325562 - RNA, 19 nt, Yersinia pestis KIM
acgacguuaucaauacugc

SEQ ID NO: 2325563 - RNA, 21 nt, Yersinia pestis KIM
acgacgugcucgucuucgaca

SEQ ID NO: 2325564 - RNA, 20 nt, Yersinia pestis KIM
acgaagcgugaaagcauccc

SEQ ID NO: 2325565 - RNA, 21 nt, Yersinia pestis KIM
acgaacccgauaacccacagc

SEQ ID NO: 2325566 - RNA, 18 nt, Yersinia pestis KIM
acgaacagugccaacagc

SEQ ID NO: 2325567 - RNA, 16 nt, Yersinia pestis KIM
acgaacagccccaacc

SEQ ID NO: 2325568 - RNA, 18 nt, Yersinia pestis KIM
acgaauggcgacuaaugg

SEQ ID NO: 2325569 - RNA, 22 nt, Yersinia pestis KIM
acgaauggucugcaacucagug

SEQ ID NO: 2325570 - RNA, 21 nt, Yersinia pestis KIM
acgaaugagcaguaauagcaa

SEQ ID NO: 2325571 - RNA, 21 nt, Yersinia pestis KIM
acgaauaacucucaucuaucg

SEQ ID NO: 2325572 - RNA, 15 nt, Yersinia pestis KIM
acgaauauucaagag

SEQ ID NO: 2325573 - RNA, 14 nt, Yersinia pestis KIM
acgacagcagcagg

SEQ ID NO: 2325574 - RNA, 21 nt, Yersinia pestis KIM
acgacagauuauuguuaucca

SEQ ID NO: 2325575 - RNA, 21 nt, Yersinia pestis KIM
accuucagacugacgcagagc

SEQ ID NO: 2325576 - RNA, 16 nt, Yersinia pestis KIM
accuucacgcucuugc

SEQ ID NO: 2325577 - RNA, 20 nt, Yersinia pestis KIM
accuucacgcucuugcucuu

SEQ ID NO: 2325578 - RNA, 22 nt, Yersinia pestis KIM
accuucagacugacgcagagcu

SEQ ID NO: 2325579 - RNA, 19 nt, Yersinia pestis KIM
accuucaguuuauuuaagc

SEQ ID NO: 2325580 - RNA, 18 nt, Yersinia pestis KIM
accuucaguuuauuuaag

SEQ ID NO: 2325581 - RNA, 15 nt, Yersinia pestis KIM
accuucccauccuag

SEQ ID NO: 2325582 - RNA, 20 nt, Yersinia pestis KIM
accuuccgucccaagaaaag

SEQ ID NO: 2325583 - RNA, 16 nt, Yersinia pestis KIM
accuucugauuuuuug

SEQ ID NO: 2325584 - RNA, 16 nt, Yersinia pestis KIM
accuugugucaccaug

SEQ ID NO: 2325585 - RNA, 17 nt, Yersinia pestis KIM
accuugcgccaaguccu

SEQ ID NO: 2325586 - RNA, 21 nt, Yersinia pestis KIM
accuugcgcaauuuguuggca

SEQ ID NO: 2325587 - RNA, 15 nt, Yersinia pestis KIM
accuuggaaaacagc

SEQ ID NO: 2325588 - RNA, 14 nt, Yersinia pestis KIM
acgaaaaccuaaua

SEQ ID NO: 2325589 - RNA, 14 nt, Yersinia pestis KIM
acgaaaagcagcag

SEQ ID NO: 2325590 - RNA, 19 nt, Yersinia pestis KIM
acgaaagagaacacaaaag

SEQ ID NO: 2325591 - RNA, 16 nt, Yersinia pestis KIM
acgaaacgcauaagaa

SEQ ID NO: 2325592 - RNA, 22 nt, Yersinia pestis KIM
acgaaauacucgagcguauugc

SEQ ID NO: 2325593 - RNA, 18 nt, Yersinia pestis KIM
accuuucagacaagccag

SEQ ID NO: 2325594 - RNA, 22 nt, Yersinia pestis KIM
accuuucagguaagcagagaau

SEQ ID NO: 2325595 - RNA, 20 nt, Yersinia pestis KIM
accuuucuaauuauuaaaca

SEQ ID NO: 2325596 - RNA, 20 nt, Yersinia pestis KIM
accuuucgguugcaucagaa

SEQ ID NO: 2325597 - RNA, 19 nt, Yersinia pestis KIM
accuuuuuaggguuguugg

SEQ ID NO: 2325598 - RNA, 17 nt, Yersinia pestis KIM
accugcuggugccacug

SEQ ID NO: 2325599 - RNA, 15 nt, Yersinia pestis KIM
accugcucaacugcu

SEQ ID NO: 2325600 - RNA, 18 nt, Yersinia pestis KIM
accugcucaacugcucaa

SEQ ID NO: 2325601 - RNA, 13 nt, Yersinia pestis KIM
accugcuaaccga

SEQ ID NO: 2325602 - RNA, 22 nt, Yersinia pestis KIM
accuggaauggcgcaauagcau

SEQ ID NO: 2325603 - RNA, 15 nt, Yersinia pestis KIM
accugcaucaucaca

SEQ ID NO: 2325604 - RNA, 16 nt, Yersinia pestis KIM
accugcccgucacuca

SEQ ID NO: 2325605 - RNA, 17 nt, Yersinia pestis KIM
accugcaacguuaaaga

SEQ ID NO: 2325606 - RNA, 16 nt, Yersinia pestis KIM
accugcaaugccuaaa

SEQ ID NO: 2325607 - RNA, 19 nt, Yersinia pestis KIM
accugcacgcuuaaagcau

SEQ ID NO: 2325608 - RNA, 16 nt, Yersinia pestis KIM
accuguagcucauacu

SEQ ID NO: 2325609 - RNA, 23 nt, Yersinia pestis KIM
accuguagcuuuuuaaauaccag

SEQ ID NO: 2325610 - RNA, 17 nt, Yersinia pestis KIM
accugguuaucggccau

SEQ ID NO: 2325611 - RNA, 12 nt, Yersinia pestis KIM
accuguuaaaag

SEQ ID NO: 2325612 - RNA, 13 nt, Yersinia pestis KIM
accuguuugcaac

SEQ ID NO: 2325613 - RNA, 20 nt, Yersinia pestis KIM
accuuacagcagguggcuga

SEQ ID NO: 2325614 - RNA, 17 nt, Yersinia pestis KIM
accuuaaguaaguuuaa

SEQ ID NO: 2325615 - RNA, 23 nt, Yersinia pestis KIM
accuuaacuacaccgcuaaccuu

SEQ ID NO: 2325616 - RNA, 16 nt, Yersinia pestis KIM
accuuaaguaaguuua

SEQ ID NO: 2325617 - RNA, 22 nt, Yersinia pestis KIM
accuguuuuuguuguucuugau

SEQ ID NO: 2325618 - RNA, 13 nt, Yersinia pestis KIM
accuuagauaaau

SEQ ID NO: 2325619 - RNA, 22 nt, Yersinia pestis KIM
accuuagauaaauagacucauc

SEQ ID NO: 2325620 - RNA, 21 nt, Yersinia pestis KIM
accuuauauaacuagcaagga

SEQ ID NO: 2325621 - RNA, 13 nt, Yersinia pestis KIM
accuuaucaccaa

SEQ ID NO: 2325622 - RNA, 15 nt, Yersinia pestis KIM
accuucaaucauuga

SEQ ID NO: 2325623 - RNA, 17 nt, Yersinia pestis KIM
accuuaucuggccccug

SEQ ID NO: 2325624 - RNA, 20 nt, Yersinia pestis KIM
accucgggcgcuuaaauaaa

SEQ ID NO: 2325625 - RNA, 22 nt, Yersinia pestis KIM
accucggcgucagcaucaaacu

SEQ ID NO: 2325626 - RNA, 18 nt, Yersinia pestis KIM
accucuaaucuccucucc

SEQ ID NO: 2325627 - RNA, 14 nt, Yersinia pestis KIM
accucguuggcuac

SEQ ID NO: 2325628 - RNA, 19 nt, Yersinia pestis KIM
accucugcaaugcccagag

SEQ ID NO: 2325629 - RNA, 16 nt, Yersinia pestis KIM
accugaaccugacgca

SEQ ID NO: 2325630 - RNA, 14 nt, Yersinia pestis KIM
accugaaauacaaa

SEQ ID NO: 2325631 - RNA, 24 nt, Yersinia pestis KIM
accugaaucgauaaacccgugcuc

SEQ ID NO: 2325632 - RNA, 16 nt, Yersinia pestis KIM
accugacgaaaugccg

SEQ ID NO: 2325633 - RNA, 19 nt, Yersinia pestis KIM
accugauuccuaagcaaau

SEQ ID NO: 2325634 - RNA, 19 nt, Yersinia pestis KIM
accugcaacgccagugacu

SEQ ID NO: 2325635 - RNA, 17 nt, Yersinia pestis KIM
accugauccaguuucag

SEQ ID NO: 2325636 - RNA, 20 nt, Yersinia pestis KIM
accugacgaaaugccgccug

SEQ ID NO: 2325637 - RNA, 14 nt, Yersinia pestis KIM
accugacuguggcu

SEQ ID NO: 2325638 - RNA, 13 nt, Yersinia pestis KIM
accugagccaauc

SEQ ID NO: 2325639 - RNA, 22 nt, Yersinia pestis KIM
accugaguagcauaaaaaucaa

SEQ ID NO: 2325640 - RNA, 17 nt, Yersinia pestis KIM
accugaggauaaaaacu

SEQ ID NO: 2325641 - RNA, 16 nt, Yersinia pestis KIM
accuccaaaugucagg

SEQ ID NO: 2325642 - RNA, 15 nt, Yersinia pestis KIM
accuccguaggccaa

SEQ ID NO: 2325643 - RNA, 14 nt, Yersinia pestis KIM
accucaucacccgc

SEQ ID NO: 2325644 - RNA, 18 nt, Yersinia pestis KIM
accucauuauuaaacuga

SEQ ID NO: 2325645 - RNA, 19 nt, Yersinia pestis KIM
accucaaaaggauggccca

SEQ ID NO: 2325646 - RNA, 14 nt, Yersinia pestis KIM
accucaaaucgaua

SEQ ID NO: 2325647 - RNA, 22 nt, Yersinia pestis KIM
accuaucgguaucucccgcaaa

SEQ ID NO: 2325648 - RNA, 17 nt, Yersinia pestis KIM
accuauuaucccaguuu

SEQ ID NO: 2325649 - RNA, 18 nt, Yersinia pestis KIM
accuauugauaaaaccac

SEQ ID NO: 2325650 - RNA, 13 nt, Yersinia pestis KIM
accuauugauaaa

SEQ ID NO: 2325651 - RNA, 13 nt, Yersinia pestis KIM
accgugugauaaa

SEQ ID NO: 2325652 - RNA, 15 nt, Yersinia pestis KIM
accgugguuugcucu

SEQ ID NO: 2325653 - RNA, 16 nt, Yersinia pestis KIM
accguggauaaacaaa

SEQ ID NO: 2325654 - RNA, 14 nt, Yersinia pestis KIM
accguggauaaaca

SEQ ID NO: 2325655 - RNA, 21 nt, Yersinia pestis KIM
accgugcuggguaauucauua

SEQ ID NO: 2325656 - RNA, 18 nt, Yersinia pestis KIM
accgugacuaaaacaagc

SEQ ID NO: 2325657 - RNA, 16 nt, Yersinia pestis KIM
accgucuuugaccgaa

SEQ ID NO: 2325658 - RNA, 20 nt, Yersinia pestis KIM
accgucaagacaacaaacag

SEQ ID NO: 2325659 - RNA, 16 nt, Yersinia pestis KIM
accgucauccagcacu

SEQ ID NO: 2325660 - RNA, 13 nt, Yersinia pestis KIM
accgugugcuucc

SEQ ID NO: 2325661 - RNA, 15 nt, Yersinia pestis KIM
accuaaaaugacgau

SEQ ID NO: 2325662 - RNA, 14 nt, Yersinia pestis KIM
accuaaaaaaaaca

SEQ ID NO: 2325663 - RNA, 16 nt, Yersinia pestis KIM
accuaaccaaacauug

SEQ ID NO: 2325664 - RNA, 21 nt, Yersinia pestis KIM
accuaacacuuuaucgaccac

SEQ ID NO: 2325665 - RNA, 18 nt, Yersinia pestis KIM
accuaucgccgccgccag

SEQ ID NO: 2325666 - RNA, 21 nt, Yersinia pestis KIM
accuaucgccgccgccagccc

SEQ ID NO: 2325667 - RNA, 23 nt, Yersinia pestis KIM
accuauaaacuugauucaccaga

SEQ ID NO: 2325668 - RNA, 18 nt, Yersinia pestis KIM
accuauaauuaacagcau

SEQ ID NO: 2325669 - RNA, 19 nt, Yersinia pestis KIM
accuauaauuaacagcauc

SEQ ID NO: 2325670 - RNA, 16 nt, Yersinia pestis KIM
accuagguucuggacu

SEQ ID NO: 2325671 - RNA, 20 nt, Yersinia pestis KIM
accuacaggcuggauugauu

SEQ ID NO: 2325672 - RNA, 14 nt, Yersinia pestis KIM
accuacaaccuggu

SEQ ID NO: 2325673 - RNA, 14 nt, Yersinia pestis KIM
accuaauccaaggc

SEQ ID NO: 2325674 - RNA, 18 nt, Yersinia pestis KIM
accuaaugcaauggcucc

SEQ ID NO: 2325675 - RNA, 17 nt, Yersinia pestis KIM
accuaauacagcaccac

SEQ ID NO: 2325676 - RNA, 21 nt, Yersinia pestis KIM
accccuaauccagcagccucu

SEQ ID NO: 2325677 - RNA, 15 nt, Yersinia pestis KIM
accccuagccagcca

SEQ ID NO: 2325678 - RNA, 23 nt, Yersinia pestis KIM
accgaugauaagugaauaaauca

SEQ ID NO: 2325679 - RNA, 16 nt, Yersinia pestis KIM
accccugcgauaaucu

SEQ ID NO: 2325680 - RNA, 12 nt, Yersinia pestis KIM
accccugcugaa

SEQ ID NO: 2325681 - RNA, 18 nt, Yersinia pestis KIM
accccugucuuauuuuuu

SEQ ID NO: 2325682 - RNA, 19 nt, Yersinia pestis KIM
accccuucaagcacccauu

SEQ ID NO: 2325683 - RNA, 18 nt, Yersinia pestis KIM
accccuucgagcaccgcg

SEQ ID NO: 2325684 - RNA, 22 nt, Yersinia pestis KIM
accgccagugccgcggcggcca

SEQ ID NO: 2325685 - RNA, 16 nt, Yersinia pestis KIM
accgccacacaauaca

SEQ ID NO: 2325686 - RNA, 17 nt, Yersinia pestis KIM
accgccacagcaacagg

SEQ ID NO: 2325687 - RNA, 13 nt, Yersinia pestis KIM
accgccaaaucca

SEQ ID NO: 2325688 - RNA, 13 nt, Yersinia pestis KIM
accgcauuuucaa

SEQ ID NO: 2325689 - RNA, 14 nt, Yersinia pestis KIM
accgcauucccugc

SEQ ID NO: 2325690 - RNA, 14 nt, Yersinia pestis KIM
accgcaccacaaag

SEQ ID NO: 2325691 - RNA, 16 nt, Yersinia pestis KIM
accgcgcuuuugauuu

SEQ ID NO: 2325692 - RNA, 21 nt, Yersinia pestis KIM
accgcgcuuuugauuuucuua

SEQ ID NO: 2325693 - RNA, 19 nt, Yersinia pestis KIM
accgcugauaaccagcagc

SEQ ID NO: 2325694 - RNA, 15 nt, Yersinia pestis KIM
accgcugcccggcuc

SEQ ID NO: 2325695 - RNA, 23 nt, Yersinia pestis KIM
accgcugaaguggcugaauauca

SEQ ID NO: 2325696 - RNA, 16 nt, Yersinia pestis KIM
accgcugauaaccagc

SEQ ID NO: 2325697 - RNA, 12 nt, Yersinia pestis KIM
accgcugaagug

SEQ ID NO: 2325698 - RNA, 17 nt, Yersinia pestis KIM
accgcugaaguggccgu

SEQ ID NO: 2325699 - RNA, 23 nt, Yersinia pestis KIM
accgcuguaaaugcgugguaaac

SEQ ID NO: 2325700 - RNA, 15 nt, Yersinia pestis KIM
accgcuguagcguca

SEQ ID NO: 2325701 - RNA, 16 nt, Yersinia pestis KIM
accgccccccaucccc

SEQ ID NO: 2325702 - RNA, 15 nt, Yersinia pestis KIM
accggcguaaauaaa

SEQ ID NO: 2325703 - RNA, 21 nt, Yersinia pestis KIM
accggcugauguucugccaac

SEQ ID NO: 2325704 - RNA, 15 nt, Yersinia pestis KIM
accggcuaaccacag

SEQ ID NO: 2325705 - RNA, 17 nt, Yersinia pestis KIM
accggcauucuucgccg

SEQ ID NO: 2325706 - RNA, 13 nt, Yersinia pestis KIM
accggccaaaauc

SEQ ID NO: 2325707 - RNA, 14 nt, Yersinia pestis KIM
accgcuuaaggcau

SEQ ID NO: 2325708 - RNA, 23 nt, Yersinia pestis KIM
accgcuuaaggcaucaaccaguu

SEQ ID NO: 2325709 - RNA, 23 nt, Yersinia pestis KIM
accggauuacauaugauggcauc

SEQ ID NO: 2325710 - RNA, 14 nt, Yersinia pestis KIM
accggcaauaugaa

SEQ ID NO: 2325711 - RNA, 21 nt, Yersinia pestis KIM
accgguaacauauaaaccagc

SEQ ID NO: 2325712 - RNA, 20 nt, Yersinia pestis KIM
accggguucaaggaaaccaa

SEQ ID NO: 2325713 - RNA, 19 nt, Yersinia pestis KIM
accgggguucgcaaugaac

SEQ ID NO: 2325714 - RNA, 16 nt, Yersinia pestis KIM
accgggcuugauuaaa

SEQ ID NO: 2325715 - RNA, 18 nt, Yersinia pestis KIM
accgggauacgggaucga

SEQ ID NO: 2325716 - RNA, 13 nt, Yersinia pestis KIM
accgguguucacu

SEQ ID NO: 2325717 - RNA, 15 nt, Yersinia pestis KIM
accgguguucacucg

SEQ ID NO: 2325718 - RNA, 15 nt, Yersinia pestis KIM
accggucauauuuau

SEQ ID NO: 2325719 - RNA, 14 nt, Yersinia pestis KIM
accggucacaccag

SEQ ID NO: 2325720 - RNA, 15 nt, Yersinia pestis KIM
accguaaacauugac

SEQ ID NO: 2325721 - RNA, 14 nt, Yersinia pestis KIM
accguaacuucuuc

SEQ ID NO: 2325722 - RNA, 23 nt, Yersinia pestis KIM
aacccagccccuaacagcagugc

SEQ ID NO: 2325723 - RNA, 15 nt, Yersinia pestis KIM
aacccagaauggaau

SEQ ID NO: 2325724 - RNA, 21 nt, Yersinia pestis KIM
aacccaucaagcggcccauca

SEQ ID NO: 2325725 - RNA, 20 nt, Yersinia pestis KIM
aaccaugcugcccgcacacu

SEQ ID NO: 2325726 - RNA, 17 nt, Yersinia pestis KIM
aaccauggcacucucuu

SEQ ID NO: 2325727 - RNA, 20 nt, Yersinia pestis KIM
aaccauuaauugguuuuaau

SEQ ID NO: 2325728 - RNA, 11 nt, Yersinia pestis KIM
aaccauuuacc

SEQ ID NO: 2325729 - RNA, 12 nt, Yersinia pestis KIM
aaccauuuuuau

SEQ ID NO: 2325730 - RNA, 16 nt, Yersinia pestis KIM
aaccaguuagaaucca

SEQ ID NO: 2325731 - RNA, 20 nt, Yersinia pestis KIM
aaccaguucugguagcugcu

SEQ ID NO: 2325732 - RNA, 21 nt, Yersinia pestis KIM
aaccaggucaguuuuacccuu

SEQ ID NO: 2325733 - RNA, 15 nt, Yersinia pestis KIM
aaccaugaugacaau

SEQ ID NO: 2325734 - RNA, 15 nt, Yersinia pestis KIM
aaccaucugaugcag

SEQ ID NO: 2325735 - RNA, 13 nt, Yersinia pestis KIM
aaccauccauauu

SEQ ID NO: 2325736 - RNA, 15 nt, Yersinia pestis KIM
aaccaucaaauacac

SEQ ID NO: 2325737 - RNA, 14 nt, Yersinia pestis KIM
aaccaucaaauaca

SEQ ID NO: 2325738 - RNA, 14 nt, Yersinia pestis KIM
aaccaccaaaauag

SEQ ID NO: 2325739 - RNA, 16 nt, Yersinia pestis KIM
aaccaccgucaccaaa

SEQ ID NO: 2325740 - RNA, 18 nt, Yersinia pestis KIM
aaccaccuaauacagcac

SEQ ID NO: 2325741 - RNA, 21 nt, Yersinia pestis KIM
aaccaccgggugaguuaccua

SEQ ID NO: 2325742 - RNA, 19 nt, Yersinia pestis KIM
aaccaccgaaugguuuuuc

SEQ ID NO: 2325743 - RNA, 20 nt, Yersinia pestis KIM
aaccacccgacaucaagaaa

SEQ ID NO: 2325744 - RNA, 22 nt, Yersinia pestis KIM
aaccacugguuaaaucaccgac

SEQ ID NO: 2325745 - RNA, 20 nt, Yersinia pestis KIM
aaccacgcauuccaucagcc

SEQ ID NO: 2325746 - RNA, 21 nt, Yersinia pestis KIM
aaccacgucuacgcucuccuc

SEQ ID NO: 2325747 - RNA, 19 nt, Yersinia pestis KIM
aaccagauaacaacaaaga

SEQ ID NO: 2325748 - RNA, 20 nt, Yersinia pestis KIM
aaccagagcggagccucagu

SEQ ID NO: 2325749 - RNA, 13 nt, Yersinia pestis KIM
aaccagaauaauc

SEQ ID NO: 2325750 - RNA, 21 nt, Yersinia pestis KIM
aaccagauaacaacaaagaua

SEQ ID NO: 2325751 - RNA, 21 nt, Yersinia pestis KIM
aaccagcguucuaucaaugcc

SEQ ID NO: 2325752 - RNA, 14 nt, Yersinia pestis KIM
aaccagcguugaga

SEQ ID NO: 2325753 - RNA, 16 nt, Yersinia pestis KIM
aaccaggcgcuauucc

SEQ ID NO: 2325754 - RNA, 17 nt, Yersinia pestis KIM
aaccgccccccaucccc

SEQ ID NO: 2325755 - RNA, 17 nt, Yersinia pestis KIM
aaccgccauugcauauu

SEQ ID NO: 2325756 - RNA, 12 nt, Yersinia pestis KIM
aaccgccacagc

SEQ ID NO: 2325757 - RNA, 13 nt, Yersinia pestis KIM
aaccgccaaaaua

SEQ ID NO: 2325758 - RNA, 19 nt, Yersinia pestis KIM
aaccgauugcaugauacug

SEQ ID NO: 2325759 - RNA, 23 nt, Yersinia pestis KIM
aaccgcugaaguggcugaauauc

SEQ ID NO: 2325760 - RNA, 16 nt, Yersinia pestis KIM
aaccgcccucuugaac

SEQ ID NO: 2325761 - RNA, 22 nt, Yersinia pestis KIM
aaccgggggcguauuaucggau

SEQ ID NO: 2325762 - RNA, 19 nt, Yersinia pestis KIM
aaccggcguaaauaaaagc

SEQ ID NO: 2325763 - RNA, 13 nt, Yersinia pestis KIM
aaccggaauaaau

SEQ ID NO: 2325764 - RNA, 14 nt, Yersinia pestis KIM
aaccggauaaaaca

SEQ ID NO: 2325765 - RNA, 17 nt, Yersinia pestis KIM
aaccgcuuuuuacccag

SEQ ID NO: 2325766 - RNA, 16 nt, Yersinia pestis KIM
aacccccugcuaggca

SEQ ID NO: 2325767 - RNA, 12 nt, Yersinia pestis KIM
aaccccaccucu

SEQ ID NO: 2325768 - RNA, 23 nt, Yersinia pestis KIM
aacccauuuccccuuucuggugg

SEQ ID NO: 2325769 - RNA, 22 nt, Yersinia pestis KIM
aacccauuugcacagcauuuau

SEQ ID NO: 2325770 - RNA, 23 nt, Yersinia pestis KIM
aacccauuaaaaacaaaugauua

SEQ ID NO: 2325771 - RNA, 13 nt, Yersinia pestis KIM
aaccccuuuugau

SEQ ID NO: 2325772 - RNA, 22 nt, Yersinia pestis KIM
aaccccgugcgcucuaaacgaa

SEQ ID NO: 2325773 - RNA, 15 nt, Yersinia pestis KIM
aaccccgaugacuca

SEQ ID NO: 2325774 - RNA, 17 nt, Yersinia pestis KIM
aacccguuuagcucuca

SEQ ID NO: 2325775 - RNA, 14 nt, Yersinia pestis KIM
aacccggcuguuaa

SEQ ID NO: 2325776 - RNA, 16 nt, Yersinia pestis KIM
aacccggcuguuaaau

SEQ ID NO: 2325777 - RNA, 22 nt, Yersinia pestis KIM
aacccgcuggcgaccacuuccu

SEQ ID NO: 2325778 - RNA, 17 nt, Yersinia pestis KIM
aacccgcuaauauuuuc

SEQ ID NO: 2325779 - RNA, 17 nt, Yersinia pestis KIM
aaccgaggcgcugacau

SEQ ID NO: 2325780 - RNA, 15 nt, Yersinia pestis KIM
aaccgaugagugaaa

SEQ ID NO: 2325781 - RNA, 21 nt, Yersinia pestis KIM
aaccgaugaagaagcguucaa

SEQ ID NO: 2325782 - RNA, 16 nt, Yersinia pestis KIM
aaccgaagcugcggcu

SEQ ID NO: 2325783 - RNA, 14 nt, Yersinia pestis KIM
aaccgaaaugaucu

SEQ ID NO: 2325784 - RNA, 15 nt, Yersinia pestis KIM
aacccuaccuaggcc

SEQ ID NO: 2325785 - RNA, 13 nt, Yersinia pestis KIM
aacccucaguaaa

SEQ ID NO: 2325786 - RNA, 16 nt, Yersinia pestis KIM
aacccucaguaaaagc

SEQ ID NO: 2325787 - RNA, 19 nt, Yersinia pestis KIM
aacccuuucagcgcuuuuu

SEQ ID NO: 2325788 - RNA, 13 nt, Yersinia pestis KIM
aacaugcugaagc

SEQ ID NO: 2325789 - RNA, 17 nt, Yersinia pestis KIM
aacaugcugaagccagc

SEQ ID NO: 2325790 - RNA, 12 nt, Yersinia pestis KIM
aacaugcugaag

SEQ ID NO: 2325791 - RNA, 16 nt, Yersinia pestis KIM
aacaugccagccuguu

SEQ ID NO: 2325792 - RNA, 20 nt, Yersinia pestis KIM
aacauuauccguuugcaaca

SEQ ID NO: 2325793 - RNA, 23 nt, Yersinia pestis KIM
aacauuaccaccgucaagacaac

SEQ ID NO: 2325794 - RNA, 23 nt, Yersinia pestis KIM
aacauccugauuacguuccacug

SEQ ID NO: 2325795 - RNA, 17 nt, Yersinia pestis KIM
aacauccgaauuuuuac

SEQ ID NO: 2325796 - RNA, 14 nt, Yersinia pestis KIM
aacaucgcggaugc

SEQ ID NO: 2325797 - RNA, 14 nt, Yersinia pestis KIM
aacaucgcccuuuu

SEQ ID NO: 2325798 - RNA, 23 nt, Yersinia pestis KIM
aacauuuucaucugaccaaacau

SEQ ID NO: 2325799 - RNA, 12 nt, Yersinia pestis KIM
aacauuuucuaa

SEQ ID NO: 2325800 - RNA, 16 nt, Yersinia pestis KIM
aacauuuucuaagcug

SEQ ID NO: 2325801 - RNA, 21 nt, Yersinia pestis KIM
aacauuuucuaagcugccugu

SEQ ID NO: 2325802 - RNA, 21 nt, Yersinia pestis KIM
aacauuuacuuauaaacacug

SEQ ID NO: 2325803 - RNA, 23 nt, Yersinia pestis KIM
aacauugguuacccuaagaauug

SEQ ID NO: 2325804 - RNA, 13 nt, Yersinia pestis KIM
aacauucucuuuu

SEQ ID NO: 2325805 - RNA, 23 nt, Yersinia pestis KIM
aacauuguuaccuaaccaaacau

SEQ ID NO: 2325806 - RNA, 12 nt, Yersinia pestis KIM
aaccaaccaugc

SEQ ID NO: 2325807 - RNA, 23 nt, Yersinia pestis KIM
aaccaacaguuugguaauacuga

SEQ ID NO: 2325808 - RNA, 24 nt, Yersinia pestis KIM
aaccaaaauauucgcauugugcuu

SEQ ID NO: 2325809 - RNA, 23 nt, Yersinia pestis KIM
aaccaaagauaauacauaaaauc

SEQ ID NO: 2325810 - RNA, 19 nt, Yersinia pestis KIM
aaccaacgggcacaaucca

SEQ ID NO: 2325811 - RNA, 15 nt, Yersinia pestis KIM
aaccaacugaaacug

SEQ ID NO: 2325812 - RNA, 14 nt, Yersinia pestis KIM
aaccaagacauaau

SEQ ID NO: 2325813 - RNA, 16 nt, Yersinia pestis KIM
aaccaauacacagcac

SEQ ID NO: 2325814 - RNA, 12 nt, Yersinia pestis KIM
aacauaucguuu

SEQ ID NO: 2325815 - RNA, 15 nt, Yersinia pestis KIM
aacauauccugugcc

SEQ ID NO: 2325816 - RNA, 20 nt, Yersinia pestis KIM
aacauaucaauaagugcaaa

SEQ ID NO: 2325817 - RNA, 23 nt, Yersinia pestis KIM
aacauagcuauuggcugauucaa

SEQ ID NO: 2325818 - RNA, 13 nt, Yersinia pestis KIM
aacauaucaaaca

SEQ ID NO: 2325819 - RNA, 16 nt, Yersinia pestis KIM
aacauaucaaacagcu

SEQ ID NO: 2325820 - RNA, 17 nt, Yersinia pestis KIM
aacauaggggguaagua

SEQ ID NO: 2325821 - RNA, 23 nt, Yersinia pestis KIM
aacauaauccgcuccugauuuaa

SEQ ID NO: 2325822 - RNA, 14 nt, Yersinia pestis KIM
aacauaaucaaucc

SEQ ID NO: 2325823 - RNA, 14 nt, Yersinia pestis KIM
aacauaaucaagaa

SEQ ID NO: 2325824 - RNA, 18 nt, Yersinia pestis KIM
aacauacggacgcucuau

SEQ ID NO: 2325825 - RNA, 21 nt, Yersinia pestis KIM
aacauacuggcuaauauaucu

SEQ ID NO: 2325826 - RNA, 17 nt, Yersinia pestis KIM
aacauacuuuucauuuc

SEQ ID NO: 2325827 - RNA, 21 nt, Yersinia pestis KIM
aacaucaggccuucuuuucuc

SEQ ID NO: 2325828 - RNA, 14 nt, Yersinia pestis KIM
aacauccauguaag

SEQ ID NO: 2325829 - RNA, 18 nt, Yersinia pestis KIM
aacaucaugagauaaaua

SEQ ID NO: 2325830 - RNA, 21 nt, Yersinia pestis KIM
aacauauugcucugccgcagu

SEQ ID NO: 2325831 - RNA, 17 nt, Yersinia pestis KIM
aacauauugguaauuuc

SEQ ID NO: 2325832 - RNA, 15 nt, Yersinia pestis KIM
aacagggcagccaau

SEQ ID NO: 2325833 - RNA, 17 nt, Yersinia pestis KIM
aacagguagaucaaaca

SEQ ID NO: 2325834 - RNA, 16 nt, Yersinia pestis KIM
aacaguaaauuauuuu

SEQ ID NO: 2325835 - RNA, 22 nt, Yersinia pestis KIM
aacaguaacccagccccuaaca

SEQ ID NO: 2325836 - RNA, 21 nt, Yersinia pestis KIM
aacagugcaacauuaaaaaua

SEQ ID NO: 2325837 - RNA, 18 nt, Yersinia pestis KIM
aacagugcaacauuaaaa

SEQ ID NO: 2325838 - RNA, 15 nt, Yersinia pestis KIM
aacagugguuugcuc

SEQ ID NO: 2325839 - RNA, 17 nt, Yersinia pestis KIM
aacagucacaccaacac

SEQ ID NO: 2325840 - RNA, 22 nt, Yersinia pestis KIM
aacaguagcagggccgcccaga

SEQ ID NO: 2325841 - RNA, 15 nt, Yersinia pestis KIM
aacagugaugagaau

SEQ ID NO: 2325842 - RNA, 16 nt, Yersinia pestis KIM
aacagugaugagaauc

SEQ ID NO: 2325843 - RNA, 16 nt, Yersinia pestis KIM
aacagucauuaacaca

SEQ ID NO: 2325844 - RNA, 23 nt, Yersinia pestis KIM
aacaguuugcggucuggcaacug

SEQ ID NO: 2325845 - RNA, 17 nt, Yersinia pestis KIM
aacauaaguaauaagua

SEQ ID NO: 2325846 - RNA, 17 nt, Yersinia pestis KIM
aacagccccaaccaucu

SEQ ID NO: 2325847 - RNA, 15 nt, Yersinia pestis KIM
aacagcccccugccu

SEQ ID NO: 2325848 - RNA, 16 nt, Yersinia pestis KIM
aacagccggccauuca

SEQ ID NO: 2325849 - RNA, 17 nt, Yersinia pestis KIM
aacagccggccauucag

SEQ ID NO: 2325850 - RNA, 19 nt, Yersinia pestis KIM
aacagcaggccgcgaauau

SEQ ID NO: 2325851 - RNA, 15 nt, Yersinia pestis KIM
aacagcaucaucaaa

SEQ ID NO: 2325852 - RNA, 21 nt, Yersinia pestis KIM
aacagcauuaccaaggaaacc

SEQ ID NO: 2325853 - RNA, 20 nt, Yersinia pestis KIM
aacagcggcgauuaucggcu

SEQ ID NO: 2325854 - RNA, 18 nt, Yersinia pestis KIM
aacagcgcucauagcaaa

SEQ ID NO: 2325855 - RNA, 23 nt, Yersinia pestis KIM
aacagccuaaggccaucaauaaa

SEQ ID NO: 2325856 - RNA, 15 nt, Yersinia pestis KIM
aacagcuaaaaugau

SEQ ID NO: 2325857 - RNA, 13 nt, Yersinia pestis KIM
aacagcucacucg

SEQ ID NO: 2325858 - RNA, 15 nt, Yersinia pestis KIM
aacagcuucgccacc

SEQ ID NO: 2325859 - RNA, 22 nt, Yersinia pestis KIM
aacagcuucgccaccagauagu

SEQ ID NO: 2325860 - RNA, 17 nt, Yersinia pestis KIM
aacagaacuaaacgcca

SEQ ID NO: 2325861 - RNA, 15 nt, Yersinia pestis KIM
aacagacucacucuc

SEQ ID NO: 2325862 - RNA, 16 nt, Yersinia pestis KIM
aacagaccccagaaga

SEQ ID NO: 2325863 - RNA, 19 nt, Yersinia pestis KIM
aacacuuugcgcuuuuuaa

SEQ ID NO: 2325864 - RNA, 14 nt, Yersinia pestis KIM
aacacuugaccaac

SEQ ID NO: 2325865 - RNA, 19 nt, Yersinia pestis KIM
aacagagcagaaagcagca

SEQ ID NO: 2325866 - RNA, 20 nt, Yersinia pestis KIM
aacagagcagaaagcagcag

SEQ ID NO: 2325867 - RNA, 18 nt, Yersinia pestis KIM
aacagauaacucagggcg

SEQ ID NO: 2325868 - RNA, 15 nt, Yersinia pestis KIM
aacagauaaaaaaua

SEQ ID NO: 2325869 - RNA, 17 nt, Yersinia pestis KIM
aacagauaaaaaauaau

SEQ ID NO: 2325870 - RNA, 18 nt, Yersinia pestis KIM
aacagagcgcgagugaac

SEQ ID NO: 2325871 - RNA, 17 nt, Yersinia pestis KIM
aacagaggguggaaaca

SEQ ID NO: 2325872 - RNA, 19 nt, Yersinia pestis KIM
aacagaucacccgcaaaac

SEQ ID NO: 2325873 - RNA, 20 nt, Yersinia pestis KIM
aacagaucacccgcaaaacu

SEQ ID NO: 2325874 - RNA, 21 nt, Yersinia pestis KIM
aacagauguuauuugaauaaa

SEQ ID NO: 2325875 - RNA, 16 nt, Yersinia pestis KIM
aacagauucaauauuu

SEQ ID NO: 2325876 - RNA, 18 nt, Yersinia pestis KIM
aacagauauuacgcagcc

SEQ ID NO: 2325877 - RNA, 20 nt, Yersinia pestis KIM
aacagauaauuggcaauaau

SEQ ID NO: 2325878 - RNA, 19 nt, Yersinia pestis KIM
aacacucuuuuuaauuuau

SEQ ID NO: 2325879 - RNA, 15 nt, Yersinia pestis KIM
aacacuucagacuga

SEQ ID NO: 2325880 - RNA, 19 nt, Yersinia pestis KIM
aacacuuaugaucuugaau

SEQ ID NO: 2325881 - RNA, 22 nt, Yersinia pestis KIM
aacacuuaccuauaaacauuua

SEQ ID NO: 2325882 - RNA, 18 nt, Yersinia pestis KIM
aacacuggcuuagaucuu

SEQ ID NO: 2325883 - RNA, 22 nt, Yersinia pestis KIM
aacacguggguauccaguguca

SEQ ID NO: 2325884 - RNA, 20 nt, Yersinia pestis KIM
aacacguucggcgucgccac

SEQ ID NO: 2325885 - RNA, 20 nt, Yersinia pestis KIM
aacacguggguauccagugu

SEQ ID NO: 2325886 - RNA, 21 nt, Yersinia pestis KIM
aacacguucggcgucgccacc

SEQ ID NO: 2325887 - RNA, 23 nt, Yersinia pestis KIM
aacacuccucuuucuuaauaaua

SEQ ID NO: 2325888 - RNA, 19 nt, Yersinia pestis KIM
aacacgauccgcuuuuuag

SEQ ID NO: 2325889 - RNA, 15 nt, Yersinia pestis KIM
aacacgauauaccuc

SEQ ID NO: 2325890 - RNA, 19 nt, Yersinia pestis KIM
aacacgacuuuuggccccc

SEQ ID NO: 2325891 - RNA, 20 nt, Yersinia pestis KIM
aacacggugaauaaacccuu

SEQ ID NO: 2325892 - RNA, 18 nt, Yersinia pestis KIM
aacacgguugaaaaguuu

SEQ ID NO: 2325893 - RNA, 13 nt, Yersinia pestis KIM
aacacauaaaauc

SEQ ID NO: 2325894 - RNA, 15 nt, Yersinia pestis KIM
aacacauacaaauau

SEQ ID NO: 2325895 - RNA, 12 nt, Yersinia pestis KIM
aacacauccagg

SEQ ID NO: 2325896 - RNA, 18 nt, Yersinia pestis KIM
aacacaucuuccaguaca

SEQ ID NO: 2325897 - RNA, 14 nt, Yersinia pestis KIM
aacacaugcugcuu

SEQ ID NO: 2325898 - RNA, 21 nt, Yersinia pestis KIM
aacacagguucuccaggguuu

SEQ ID NO: 2325899 - RNA, 21 nt, Yersinia pestis KIM
aacacacuucgccgggucagg

SEQ ID NO: 2325900 - RNA, 21 nt, Yersinia pestis KIM
aacacacuucgccaggucagg

SEQ ID NO: 2325901 - RNA, 14 nt, Yersinia pestis KIM
aacaccauacuuuu

SEQ ID NO: 2325902 - RNA, 21 nt, Yersinia pestis KIM
aacacauuccaguaaaaaaau

SEQ ID NO: 2325903 - RNA, 17 nt, Yersinia pestis KIM
aacaccacaacauacaa

SEQ ID NO: 2325904 - RNA, 13 nt, Yersinia pestis KIM
aacacgaaaagca

SEQ ID NO: 2325905 - RNA, 15 nt, Yersinia pestis KIM
aacacgaccugugca

SEQ ID NO: 2325906 - RNA, 21 nt, Yersinia pestis KIM
aacacgaccugugcaccacac

SEQ ID NO: 2325907 - RNA, 19 nt, Yersinia pestis KIM
aacaccuaguuauucugua

SEQ ID NO: 2325908 - RNA, 21 nt, Yersinia pestis KIM
aacaccgugguuugcucuucc

SEQ ID NO: 2325909 - RNA, 16 nt, Yersinia pestis KIM
aacaccggcuucuccu

SEQ ID NO: 2325910 - RNA, 13 nt, Yersinia pestis KIM
aacaccgcuguag

SEQ ID NO: 2325911 - RNA, 11 nt, Yersinia pestis KIM
aacaccaucaa

SEQ ID NO: 2325912 - RNA, 14 nt, Yersinia pestis KIM
aacaccaucaacau

SEQ ID NO: 2325913 - RNA, 19 nt, Yersinia pestis KIM
aacacccuguguauuuaac

SEQ ID NO: 2325914 - RNA, 15 nt, Yersinia pestis KIM
aacacccuuccuuuu

SEQ ID NO: 2325915 - RNA, 23 nt, Yersinia pestis KIM
aacacacuuagcuaagcucuucc

SEQ ID NO: 2325916 - RNA, 12 nt, Yersinia pestis KIM
aacaauuucgaa

SEQ ID NO: 2325917 - RNA, 18 nt, Yersinia pestis KIM
aacaauuucgaaaacuca

SEQ ID NO: 2325918 - RNA, 19 nt, Yersinia pestis KIM
aacaauuuacgguccauaa

SEQ ID NO: 2325919 - RNA, 23 nt, Yersinia pestis KIM
aacaauugcuccaguugauacag

SEQ ID NO: 2325920 - RNA, 14 nt, Yersinia pestis KIM
aacaaucaccaccu

SEQ ID NO: 2325921 - RNA, 15 nt, Yersinia pestis KIM
aacaauaccgccaau

SEQ ID NO: 2325922 - RNA, 17 nt, Yersinia pestis KIM
aacaauccuauauacaa

SEQ ID NO: 2325923 - RNA, 14 nt, Yersinia pestis KIM
aacaauccgaacaa

SEQ ID NO: 2325924 - RNA, 19 nt, Yersinia pestis KIM
aacaaucagugcaauaaau

SEQ ID NO: 2325925 - RNA, 23 nt, Yersinia pestis KIM
aacaaaauagggcgccccgauaa

SEQ ID NO: 2325926 - RNA, 22 nt, Yersinia pestis KIM
aacaaaaucgcgaccagcagaa

SEQ ID NO: 2325927 - RNA, 20 nt, Yersinia pestis KIM
aacaaaaugcgguggcacug

SEQ ID NO: 2325928 - RNA, 18 nt, Yersinia pestis KIM
aacaacaaaggcgccaag

SEQ ID NO: 2325929 - RNA, 15 nt, Yersinia pestis KIM
aacaaaugaacccuu

SEQ ID NO: 2325930 - RNA, 17 nt, Yersinia pestis KIM
aacaacgacuccaucac

SEQ ID NO: 2325931 - RNA, 17 nt, Yersinia pestis KIM
aacaacccgaauuaaua

SEQ ID NO: 2325932 - RNA, 15 nt, Yersinia pestis KIM
aacaaccaagcuuug

SEQ ID NO: 2325933 - RNA, 15 nt, Yersinia pestis KIM
aacaacggugaacag

SEQ ID NO: 2325934 - RNA, 16 nt, Yersinia pestis KIM
aacaacgucauuugug

SEQ ID NO: 2325935 - RNA, 21 nt, Yersinia pestis KIM
aacaacggcuggccgagcaga

SEQ ID NO: 2325936 - RNA, 16 nt, Yersinia pestis KIM
aacaaguuucacuuuc

SEQ ID NO: 2325937 - RNA, 18 nt, Yersinia pestis KIM
aacaaguuacauuuuuaa

SEQ ID NO: 2325938 - RNA, 23 nt, Yersinia pestis KIM
aacaagacuuuccccagaugaau

SEQ ID NO: 2325939 - RNA, 23 nt, Yersinia pestis KIM
aacaagacugcuaauaccaccac

SEQ ID NO: 2325940 - RNA, 21 nt, Yersinia pestis KIM
aacaagaucccaagcaggaaa

SEQ ID NO: 2325941 - RNA, 21 nt, Yersinia pestis KIM
aacaagcgaccaucaugaaua

SEQ ID NO: 2325942 - RNA, 15 nt, Yersinia pestis KIM
aacaagcuuauauua

SEQ ID NO: 2325943 - RNA, 17 nt, Yersinia pestis KIM
aacaagccccacaguac

SEQ ID NO: 2325944 - RNA, 12 nt, Yersinia pestis KIM
aaauuucccccu

SEQ ID NO: 2325945 - RNA, 14 nt, Yersinia pestis KIM
aaauuuauuuagua

SEQ ID NO: 2325946 - RNA, 15 nt, Yersinia pestis KIM
aaauuuaucaguagc

SEQ ID NO: 2325947 - RNA, 13 nt, Yersinia pestis KIM
aaauuuaucuaau

SEQ ID NO: 2325948 - RNA, 21 nt, Yersinia pestis KIM
aaauuuaucuaauguauuuau

SEQ ID NO: 2325949 - RNA, 10 nt, Yersinia pestis KIM
aaauuucagu

SEQ ID NO: 2325950 - RNA, 22 nt, Yersinia pestis KIM
aaauuuuauucgcguuucauuu

SEQ ID NO: 2325951 - RNA, 10 nt, Yersinia pestis KIM
aaauuuuaaa

SEQ ID NO: 2325952 - RNA, 11 nt, Yersinia pestis KIM
aaauuuuaaac

SEQ ID NO: 2325953 - RNA, 17 nt, Yersinia pestis KIM
aaauuugacauuuccuu

SEQ ID NO: 2325954 - RNA, 14 nt, Yersinia pestis KIM
aaauuuaauaaguu

SEQ ID NO: 2325955 - RNA, 21 nt, Yersinia pestis KIM
aaauuguuccguuucucuuug

SEQ ID NO: 2325956 - RNA, 20 nt, Yersinia pestis KIM
aaauugugauucaacugccg

SEQ ID NO: 2325957 - RNA, 14 nt, Yersinia pestis KIM
aaauugucugggau

SEQ ID NO: 2325958 - RNA, 15 nt, Yersinia pestis KIM
aaauugccgcuuuag

SEQ ID NO: 2325959 - RNA, 19 nt, Yersinia pestis KIM
aaauugcgcccggcccacu

SEQ ID NO: 2325960 - RNA, 14 nt, Yersinia pestis KIM
aaauugcugaaaaa

SEQ ID NO: 2325961 - RNA, 23 nt, Yersinia pestis KIM
aaauugcacaugcagcauuucag

SEQ ID NO: 2325962 - RNA, 19 nt, Yersinia pestis KIM
aagaaaacccauaccacug

SEQ ID NO: 2325963 - RNA, 12 nt, Yersinia pestis KIM
aagaaaccagcg

SEQ ID NO: 2325964 - RNA, 16 nt, Yersinia pestis KIM
aagaaaaugauuuaau

SEQ ID NO: 2325965 - RNA, 18 nt, Yersinia pestis KIM
aacuuuuuucauccuaaa

SEQ ID NO: 2325966 - RNA, 15 nt, Yersinia pestis KIM
aagaaauaccugagu

SEQ ID NO: 2325967 - RNA, 13 nt, Yersinia pestis KIM
aagaaauaaaaga

SEQ ID NO: 2325968 - RNA, 17 nt, Yersinia pestis KIM
aagaaauaaaagaaaac

SEQ ID NO: 2325969 - RNA, 18 nt, Yersinia pestis KIM
aagaaauaaaagaaaacc

SEQ ID NO: 2325970 - RNA, 11 nt, Yersinia pestis KIM
aagaaauaaaa

SEQ ID NO: 2325971 - RNA, 23 nt, Yersinia pestis KIM
aagaaaucauuuaggcguuucuu

SEQ ID NO: 2325972 - RNA, 21 nt, Yersinia pestis KIM
aagaaacgccccgauaaacca

SEQ ID NO: 2325973 - RNA, 19 nt, Yersinia pestis KIM
aagaaacugccagcuaaaa

SEQ ID NO: 2325974 - RNA, 13 nt, Yersinia pestis KIM
aagaaagaaaaau
